United States Patent 6,551,795 (NUCLEIC ACID AND AMINO ACID SEQUENCES RELATING TO PSEUDOMONAS AERUGINOSA FOR DIAGNOSTICS AND THERAPEUTICS) - sequence listing, part 7

SEQ ID NO: 14983 - DNA, 978 bp, Pseudomonas aeruginosa
cagtccctgggcgtggaaggcgtcggcgatgcgctgttgctcgtcgagaccatctgcgctcaccggttgtacgtcgtagctgcgccgcgcattcgcctgctcgacggtagcggcatcgagattgccccacagcggccccagcaccttggccgcgtcggccgggtggctcttgagccagcgcccggtgcgctgcagttcggcgaagacctgctggagcacttcaggatgtttcctggcgtagtcgctggaggcgaggtagtagcgctggtagctggccaggccctggccgtcggccagtacccgcgcgcgttgctggcgctgggcgcttgccacgtaggggtcccaggtcacccaggcgtcgaccttgccgttctcgaaggcggcgcggccgtcggctggcgtcaggtaggctggctggatgtcggagaactcaagcccggcgctggccagcgcggcgatcagcaggtagtggctgccggcggccttggtcacggcgatgcgcttgcccttcagctcggccagggacttcagcggcgaatgttcgccgaccagtatcgcctgcgccgcgggcgaaggtgtttcgcgggcgaagtaggtcaggcgagcacccgccgcctgggcgaacaccggcacggtgtcggcgacgtcggcggagagatcgacgttgccgacattgagcgattcgagcaacggcaggccgctggggaactcatgccaggacacccggatgccctgcctggccaactcgcgctcgaaggtgccctggctgcggatcagggtcagcagagtcgaggatttctggaagccgatgcgcaggacctcctcggcctgtgcgccaccaatgcccgacaggacgacggaagcggcaaacacgatggccaagcgacgcaggaacggacgagacatgcgatgactcctaggataggtgcgagcgcccgcagggacgggagttccagctgccggcgacggaacggatag

SEQ ID NO: 14984 - DNA, 1371 bp, Pseudomonas aeruginosa
ataacttatagttatcaattaatgcccgggcagcgcctaccggatatccgcatccgacgcctgcctgaccgcaaagccgctggcgaaggtcggccgcacatcgaggcgctgcggaatcaatccatgggcctggtagaaatcggcggtctcctgctgctggccgagcgttcgctcatccagcgcctgccaacgcaagcgccggcgttcgaactgcaagcgcgcggcgtcctcggggaagccgatgatctgcgccaggcttcgcgaatactcgtccaggtgcaggtacgcccagcgctgggcgctggccaggcgttgcaggtagtcctgcagcacggcgcgtttcgccgggtcggccagtgcgctatcggtagcagcgaggaagctgttgccagcccacaggccgcgaccgtcgaccagtacccgagccttgtcggcggtctccgcgaacgcggtgtagggctcccaggtcgcccaggcatccacggaaccattggcgagggccattttcgcgtccaccgggccgaggaagcggaattcgacgtccttctcgcccagcccgaccgaggccaaggccttgagcgcgacgaagtggccgatggaaccgcgcccggtggcaatgcgctgacctttcaggtcgttggccgagcgcagcggcgaatcccctctcaccagcacggcggtaccgtagggatcggatttgtcgacggcgatggccttcagccgggcaccggcggccagggcgaagagcaatggcgcgtcgccgatgatgccggcatccaccgcaccggcattgagtgcttcggcgaggggggcggcggcggggaattcgaaccagcggatgtcgtaggtcaggtcgtccagcgcgccggcagcctccaactgggcgcgcatgttgcccttctggtcggccaggcgcagggtcacgcgctcgtcggcacaggcctggccgacgagcaggcagagaagcaggaacaggctcagggtctgacgcattccgtaactcctcaacgctggccgacgcggaggtcggcgggcaactggcgggccacttcggcggcaccggcggacaggctgaagtcgaacgccggggcgacctccagcgacttcggcagcacgccttcggcatggaagaaatcggcggcggtctgcagggtggcggcaacctccggaccgaagaccacaggactgatgcgcgcctcgccaacccagcgccgagtgacttcgcgcggcatgttcagatccttggccagggcctcggcgaacgcctccgggtgcctcagggcccaggcctgggcacgcgccaggcgggtcagcaggtcgctgatcgcggccttcttgcgggcgatcgcagcgtcgctggccagggcatag

SEQ ID NO: 14985 - DNA, 2487 bp, Pseudomonas aeruginosa
agcttgtgcccggacagctgccagccgtcgccgacacgccgcgccagcgtacccggcagaccgccgcgtgacggcgaacccagctcgggctccacgcgcaggctattgatcaacgccccctgctccagcacctcgcgcgccacgcgccgcttgagcgcgccgggccaatcggggttatcggccaggcgccgcaaatgcaggtactgcatgcacagcaccagggccgtggagggttcgccgcgagccaccgcgccgattacccggcgcagctcgccgaggctggcgccgggaccgccgagcgcaggcggcaaggccagggcgagcagcccgtggtgtcgcagcagggccaggttggcatggggaaaatctccgctgcggtcatgggcatcggcgctttccgccagttgccgggtcagttccggcagccattcgtcgaacgccgccgagggagtctgcaggacggccatgggatcaggccgtggcgcgccggcgctcgcgctcggcgactttggcgcgggtcagcgggatcagctcgcggccatattccacggcatcggcgaggggatcgaaaccgcgaatgaggatattgcgcacgcccaggtcgtagtaggcgagcagggcgtcggccacctgttccgcggtaccgaccagggcggtggagttgtgcccgccaccgaccagcctggcgattccggtccaaaggcgctcgtcgaggcgctcgccctgctccaccgccttgagcagacgctgggcgccgacgctctgcggcttgcccttggggaagccggcctcgcccaggcgcgcgccggcgcttgcgcgtatcgcctcggccttggcccaggcctcgtcctccgtgcgcccgaggatgggccggaacgacaggctgaactccacttcgcgaccattcgagcgcgcctgttcgcgcacagcggagatggtttcggcggcctgtgccaggggttcgccccagagcatgaacacatcggcctgcttgccggcgaccttcagcgcggcttccgaggagccgccgaaatacaccggaatgtgcggtttctgctgcggacggatggccgagaaggcgtgctccacgcggtagtacgcgccgtggaaatcgaagggttcggtgctggtccaggtgcgcttgagcagttcgatgaattcgtcgctgcgggcatagcgctggtcgtggtcgagataatcgccgtccttgcgctggtcggcgtcgctgccgccgctgacgatatgcaccgccaggcgcccgtcgaggaggtgttcgagggtcgccagcttgcgcgcggccagggtcggggcgacgaaaccggggcggtgcgccagcagcagaccgatccgggaagtggccaggccagcggcggcggccaccaggaatccatccggctggtccgaccagtagccgaccaggattcgatcgaagccggcctcttcgtgggcgcgtgcgaaagcggcgatgtaaggcttgtcgaggataggtccgaccggcgcgagggtctccgaggccaggcgatggccgatcatgccgagaaactggatgctcatggtccgtactcagtggaaggcttcgttgaaagacgtgtcgatccccgtggaagtgtcgaacggcttgggcaaggcaccggtctgcagcaggaaatccgcggtctcctggtagtcggtggcggcctgggcgtataccgggccgacgctcatgccggcctggccgatccaatggcgggagactgcccggtcgagattggccttctgcgcccagaggtcggcgtactgctccttgtgtgcctcgacccaggcccgtgccttgcgcaggcggccgaggaagtcggcgatctgcgcgcgcctgggctcgatggaagcagcgttggcggcgatgctggacagccccggcatcaggtcgcgggcggtgagaatcggccgtgcgccggaaaccacgatctgctgcgagatatacggctcccacaccggaaaggcatcgatgctgccgcgcggcaaggcggcggcggcgtcgatcggcatcagcttgacgaactccacgtagtccttcggcaggccggctttctccagcgcgcgcaaggtcagttgctggctccaggcaccgggccagtaggcgactttcctgcccttgagatcggcaatgctgcgcaccggagaatccttcggcaccagcagggctatggtatcggggttctgccgcgagacgccgaccagcttcaccggcgcacccttggcggcgaggaagatgaagcccgagtcgccgaggaaacccaggtccagcgctccggcctgcaacccttcggccaccggcgcggcggactggaaatgcttccattcgacctggtaaggcgcgccttcgagaactcccgaggcctccatggaagcccgcacgttgtagtagttctggtcgcccacacgcaacgtcggcagctctgcggcctgggccagggaggcaccgagcagaagcgtggcgaagctggttag

SEQ ID NO: 14986 - DNA, 444 bp, Pseudomonas aeruginosa
caggtattgcttgagtttcatcggagctcctcaaccggcgtgccgcaacagcggcaggcgggcgatatggtcatgtatggcgggaatcaggccctggccgtagcgcacggcgtcgccgagcggctcgaagcctcgaatcaggaaggtcgagacgcccagccggtagtactcgccaagcgcagcggcaacctgctcgggggtgcctaccagggcggtggagttccagcgcgccccggtcagccgggccacgccggtccacaaacggctgtcgagcacctcgccctgctcggcggcggccagcaggcgctgcgaaccgacgttctgcggctggtggtcgcgcagcggcagaccgaggcgcgcacggttctcgcggacctgttcgagcacctcggcggcacgcttccaggcggcctcctcggtatccgcgacgatcggccggaatga

SEQ ID NO: 14987 - DNA, 1659 bp, Pseudomonas aeruginosa
ggaaaaacccttcatttccggctattccaacagccgcttgcccaatatctgggacctgtcgaaagagaaccccgcatgagccagatcgccgtacgcaccttccacgatatccgcgccgctctcctcgcccgccgggagctggcgctgctcgacgtgcgcgaggaggacccgttcgcccaggcccatcccctgttcgccgccaacctgccgctgtccaggctggaactggagatccatgcccgggtgccgcgccgcgacacgccgattaccgtctacgacgacggcgaaggcctggcgccggtcgccgcgcaacgcctcctcgacctcggctacagcgacgtggccttgctcgatggcggcctgtccggttggcgcaacgccggcggcgagctgttcagcgatgtgaacgtgccgagcaaggccttcggcgaactggtggaggccgagcgccacacgccatcgctggccgcggaggaagtacaggctttgctcgacgccagggccgacgcggtgatcctggatgcccgtcgtttcgacgaataccagaccatgagtatccccggcggcatcagcgtgcccggcgccgaactggtgctgcgcgtcgccgaactggcgccggacccgcgcacccgggtgatagtcaactgtgccgggcgcactcgtagcatcatcggtacccagtcgctgctcaacgccggcatccccaacccggtggcggcattacgcaacggcaccatcggctggacgctggccggtcagcaactggaacacggccagacgcgacgcttcggtgcgatctcgcaggacacacgcaaggccgccgcccagcgcgcccgtgccgtcgccgaccgcgccggcgtcgaacgcctcgacctggccggtctggcccaatggcaggacgagcacgaccgcaccacctacctgctcgacgtacgcacgcccgaggaatacgaagccggtcacctgcctggctcccgctccacgcccggtggccagctggttcaggaaaccgaccatgtcgccagcgtgcgcggcgcgcgcctggtactggtggacgacgatggcgtacgcgccaacatgagcgcctcctggctggcccagatgggctggcaggtcgcggtactggacggactctccgacgccgacttcagcgagaggggcgcctggagcgcgccgctgccgaggcaaccccgggccgacaccatcgacccgaccaccctcgccgactggctgggcgaaccgggcacccgggtgctcgacttcaccgccagcgccaactatgcgaaacgccacatccccggcgccgcctgggtattgcgcagccagttgaagcaggcactggaacggctgggcacggccgagcgctacgtactcacctgcggcagcagcctgctggcacgcttcgccgtggcggaagtccaggcactcagcggcaagccggtgttccttctcgacggcggcaccagcgcctgggtcgccgcgggcctgccgacggaagacggcgaaagcctgttggcgtcgccgcgcattgaccgctaccgccgcccctacgaaggtaccgacaatccgcgcgaagcgatgcagggctacctggactgggagttcggcctggtggagcaactcggtcgcgacggaacccacggcttcttcgtgatctga

SEQ ID NO: 14988 - DNA, 648 bp, Pseudomonas aeruginosa
tcctctaccagaccagcgcgatcatccacggcggcgaacgcaactacatcatggccaccatcagcctgtacgtgtcgatctacaacctgttcatcagcctgttgcagatcttcggcatcgccggcggcgacgactgatagaaaacgcctccggaaaagcccgtccccgcgacgggctttttcatttgcggaccggcaaaacacaggcattggtttatcattcgaagaaatccttcgcgtatcgcagcatgaaattcgccatcgccctattcgaccctccccactcccccgccgcccgccgcgcgctgcgcttcagcgaagccgcgctggccggcgggcacgaaatcgtccgcctgttcttctaccaggacggcgtgcacagcgcctcggccaacgtcctggagcgggccagaacaatttcaacctggcccgcccgcctgggcgcgagtttgtcgagcgcaacggcctggacgccgtggtctgcatcgccgccgccctgcgccgcggcgtgctgaacgccgaggaagccgaacgctacggccgtcccggcgccaaccttggcgcaccatgggaactgtccggactcggccagttgcacgaggcggcgcaaagcgcggaccgcctggtctgcttcggaggcgaccgatga

SEQ ID NO: 14989 - DNA, 594 bp, Pseudomonas aeruginosa
cggccgcctgggcagttgcctgtacctgctcaaccccggcgacggcctgctgctctgcggcgacgccgtgcacgccctgctggccggcagccacgcctgccaggccctggaactgatgccggcggaaatcgaactgttcgccctgctggaagacctccaggcgcgcggtatcgaggacgtccccgctcgcctggtggcggtggactaccccggcttcgtcgaactcgccacccgcttcgacaaggtcaacagttggctatgacgctccttatgctggaaggccgggaaatccggctggacaaggacggctacctcgccgccctcgacgattggtcggagccggtggcggaagccctggccgcccgcgaggagctggccctgaccgccgagcactgggagattctccaactgctccgcgagttctatgcggagttccagctgtctccggccaaccgcccgctgatcaagtacgtcgcccagcgactgggtccggacaagggcaacagcctgcacctcaaccacctgttcaagggcgccccggccaagcttggcgcgaagctggccggcctgccgaaaccgagcaactgtctatga

SEQ ID NO: 14990 - DNA, 432 bp, Pseudomonas aeruginosa
tgcgcgagaacggctggaccttcgaccccgcccacggctccaccggcgatcgcctcgacggcctggcctttctgcaccagcgaaacacccgcgacgacccgcactacagcggccgggtcacggtgccgctgctgtgggacaagcaggcgcagaagatcgtcaacaacgaatcagccgatatcgtccgcatcttcaacagcgccttcgacgccatcggcgccaacgcgctggacttctacccggagccgctgcgcgaggagatcgaacgcctcaacggacgcatctatccggcggtcaacaacggcgtgtaccgtgctggcttcgccactcgccaggacgcctacgaggaggccttcgtccagttgttcgaggagctggactacctggaaggcttgctcggcgaacgccgctacctggccggcgaatacctga

SEQ ID NO: 14991 - DNA, 711 bp, Pseudomonas aeruginosa
taccgctgggcccgcgtctcgacctggcgcgcgcaccaggccgggaacgacttcccggcaagggcatctggggagaaggctgaaggctcaggcgtcctcgcgggcgccttcgaaccaggccagcttgtcgcgcagttgcacgacttcgccgacgatcaccagggtcggcgcatgcacttcgtgctcagccaccagttgcggcaggttttccagggttccggtgaatacccgctgctgggcggtggtcccctgctggatcagcgccgccggggtctgtgcggagcgaccgtgggcgaccagttgctcgcagatcaccggcaatcccaccaggcccatgtagaacaccagggtctggccaggcgctaccaggtcctgccacggcaggtcggtggtgccgtccttcagatgaccggtgacgaaacgaaccgattgcgcatggtcgcgatgagtcagcggaatcccggcgtaggccgcgcagccgctggccgcagtgattcccggcacgacctggaaaggtatgccgtgggcagccagttcgtcgatttcctcaccgccgcggccgaagatgaacgggtcgccgcccttcaggcgcagcacgcgcttgccctggctggccagctccaccagcaggcggttgatccgatcctgcggcaccgcatgttcggcgcggcgcttgccgacgtacaggcgttcggcatcgcggcggcataa

SEQ ID NO: 14992 - DNA, 543 bp, Pseudomonas aeruginosa
caattccttgacccggtggcggaagcggctggcgagtccggccagttgcccgtaggtcgagggaatccaggtttccagcttggcccggatcagccgcgccagcacgggcgcatcgccgccgctggagaccgccaccaccagcggcgaacggtcgacgatggccgggaagatcacgctgcacagggccggcgcgtccaccacgttgaccggtatcccgcgcgcattggccgctcgcgacacctcggcgttcagcggttcgtcgtcggtggcggcgatgatcagggcgcagccgggctggtcgccgtcctggtagtcgcgttcgagcagctcgccgccgccctgctccaccagatgccgcagttcgatgtggatctgcggcgcgaccacgcgcaggcgcgcgccggcgtcggccagcaggcgcgccttgcgcagggcgacttcgccgccaccgaccaccagcgcgaggcgcccttgcaaggagtggaacagcggcaggaaatccatgtcagccgatcacctcgatgccagccatgtagggcttga

SEQ ID NO: 14993 - DNA, 498 bp, Pseudomonas aeruginosa
gggtgtgcaccagctcgggcttgccggtttccggattgcggtagcgggcctgcatgcgccgggcctggaagtcgccgcagttggagcaggaggaaatctcgcggtacttgtcctggctgggaacccagacttccaggtcgtaggtcttggtcgaaccgaagcccatgtcgccggtgcacagcgccagcacccgatacggcaactcgagcagttgcaggacgcgctcggcgttggcggtcaggccttccagcgcctcgtaggaagtggccggatcgacgatctgcaccatctccaccttgtcgaactgatgctggcggatcatgccgcgggtatcgcgcccggaggcaccggcctcgctgcggaagcacggggtatgggcgacgaacttcagcggcaattgcttggcgtcgaggatctgcccggagacgatgttggtcagcgaaacctcggcggtcgggatcaggtagaggtcagcttcgccgtcgcggccgatcttga

SEQ ID NO: 14994 - DNA, 2502 bp, Pseudomonas aeruginosa
aacctgtcgggttcaatcacgaaccggcgccggcgcgatgacttcgcgggagccgttggtattcatcggggtgaccacgccggccatctccatcgcctcgatcatccgcgcggcgcggttgtagccgatcttcagcttgcgttgcacggcggagatcgatgcccggcgactctcggtgacgaaacgtaccgcctcgtcgtagagcgggtcgtcctcgctgccttcgccggagccgtcgccgccatcgaaggaaccgccaccgctgccgccttcgtcgacgccagcgaggatgtcctcgatgtagtcgggcgcgccgcgcagcttccaggcctcgaccacccggtgcacctcgtcgtcggaaacgaaggcgccgtgcacgcgaatcggcaggcctgtgcccggcggcaggtagagcatgtcgccgtggccgagaagttgttcggcgccaccctggtcgaggatggtgcgcgagtcgatcttgctggagacctggaaggcgatccgggtcgggatgttggccttgatcaggccggtgatcacgtccaccgacggccgctgggtcgccaggatcaggtggataccggccgcccgcgccttctgcgcgatacgggcgataagctcctcgaccttcttgccgacgatcatcatcatgtcggcgaattcgtcgaccaccaccacgatggtcggcagggtgctcagctgcggcggctcgtcgtccgggctttcgcgacggaacagcgggtcggtcagcggcgtgccagcctcctcggcgtccttcaccttgcggttgaagccagccaggttgcgcacacccatggccgccatcaggcggtagcgccgctccatctccgccacgctccagcgcagggcgttggcggcttccttcatgtcggtgaccaccgggcagagcaggtgcgggatcccttcgtagatcgacagttcgagcatcttcgggtcgatcatgatcagtcgcgcctcgctcggcgtggacttgaacaggatcgacaggagcatggcgttgacccccaccgacttaccggagccggtggtaccggccaccagcaggtgcggcatcttcgccaggtcggtgatgatcggccgaccgccgatgtcgtggcccagggccagcggcacggtggacttgtgctcgtcgtactccggcgacgacagcacttcggagaagcgcaccatctgccggtcttcgttgggaatctcgatgccgacagtggtcttgccgggaatcacttccaccacccgcacgctgatcaccgccagcgagcgcgccaggtccttggccaggttggaaatgcggctgaccttgacccccgccgcgggctggatctcgaaacgggtgatcacggggcccggatgcaccgaatccacgctgacctcgacgccgaactccttcagcttgatctccagcaggcgcgacatcgcctccagcgactcgggcgagtagctcttctgcttcacttccgccgggtcgagcagcgacagcggcggcagggtgccctccaccgccgtatcgacgaacagcggcgcctgcttctctttcagcacgcgcttgctcggctccggggccttcggcggcggtggcggatcgatcttcggcggcgggcgcttctcccgctcgctcatgtgcttggccagggcctcttcgcgttccagcaggcgctccttggccttggactgttcgcggcggtccggcacgctcggcgccaccacctcggcgacgcgctcgtcgacctcgcgcagttgcgcgaccagttgcttgcgctcggcgcgcgcgcccatccagcgattgaaggcgttctggatcagttcgaagaagtccagggtgatcttgccggtgacatccatcaccttgaaccaggagaggtcggcgaacaccgtcaggccgaagaggaacagggcgaagaacaccagcgtgctgccctgcacgttcagcgcatccaccgcgacgcggcccaggctctggccgatggcgccgccggccgaggcgctggccggcatgtggccgctggcgtggaaatggatgtaggccagtgccgagccggccaggatcaggaagatcagcccgaccaggcgccaggaaaacagccaggtgttccattcccacggcaggttgcggcggcggaatacctgccaggtcttgatgcccagcaacagcggaaagaggtaggcgaagtagccgagcgtcatgaacaggatatcggcggataccgcaccgagccgaccggcggcattctgcacctggtcaacctggctcgagtgactccagctcggatcggccgggtcataggtgagcagagccatccacaagtagaggcagagcgcgcccagcgcgatcaggaccccttccttcaggcgggaatgcagttgctgacgccatgcggcggcatggctcgcggtggtcgaatccttcaaatcgctatttttcctgcgcacggctggtgctttagaagctgtcttggtcaaaacgcgcctattgtacggctttag

SEQ ID NO: 14995 - DNA, 666 bp, Pseudomonas aeruginosa
tcattgccaccggtgcctccgcgcaatacctgggcatgtcgtcggaagaagccttcatgggcaagggcgtttccgcctgcgccacctgcgacggtttttctaccgcaaccaggtggtctgcgtggtcggcggcggcaataccgccgtcgaggaagcgctgtacctggccaacatcgccaaggaagtccacctgatccaccgtcgcgacaagctgcgctcggagaagatcctccaggacaagctgttcgacaaggccgagaacggcaacgtgcgcctgcactggaacaccaccctggacgaggtgctgggcgacgccagcggcgtcaccggcgtacgcctgaagagcaccatcgacggcagcaccagcgagctatcgctggccggcgtgttcatcgccatcggccacaagccgaacaccgacctgttccagggccaactggaaatgcgcgacggctacctgcggatccacggcggcagcgaaggcaatgccacccagaccagcatcgaaggcgtgttcgccgccggcgacgtggccgaccacgtctaccgccaggccatcacttccgccggcgccggctgcatggccgcgctggatgccgaaaaatacctcgacgaccattgatcggacccgggggaggcccgccctcccctaccccgccatgctga

SEQ ID NO: 14996 - DNA, 447 bp, Pseudomonas aeruginosa
tccaggcttgtgccgcgccgcgtgactacgccgacggcacctggatcaccacgccgatgcaactggcctaccaggagctgcacctgcgcggcatcgcccactccgtggaagtctggcaggagcgacaactggtcggcggcctctacggcctggccatgggcaggctgttcttcggcgaatcgatgttcagccgcgccgacaacgcttccaaggtcggcttcgtcacgctggtccgccatctgcgcgacgccggcttcgtcctcatcgactgccagatgccgacccgccacctgcacagcctgggcgcccgcgccatcagccggggggaattcgccgactacctgcaacgctatcgcgaccagcctcctaccggcgacctggatttttaggcgagtttccgtgcctggcataaacttgcttatgggtccctgctggagttcaccatga

SEQ ID NO: 14997 - DNA, 198 bp, Pseudomonas aeruginosa
acaggcgagcgcatcagcccggcgagagggtggtatactgcgcgccatgacttcgcagtcatcgaggtccgagcagtctgggaccagaccctctcccctcgcagcgtcgggttcgccaccatgaacccgccgtacaacgctctactggcgcccctatatcccgcggcatatctcgatttcgattcaacccgatgttga

SEQ ID NO: 14998 - DNA, 198 bp, Pseudomonas aeruginosa
tgcagcacgacgtggagaccggcgacatctggcgcgcctgccagaccaaggacgcaccgatccgcgactgggtcaagctggccgtcacccgcgcacgccagtccgataccccggcgatcttctggctggacccggagcgcgcccacgaccgcgaactgcgcaagaaggtcgagctgtacctcaaggaccacgacctga

SEQ ID NO: 14999 - DNA, 1140 bp, Pseudomonas aeruginosa
cgcctgatcgctatgtctgaatccgcccccaccccacgccgcgagcgcgtgatcgtcggcatgtccggcggcgtcgactcgtccgtctccgccctgctcctgttgcagcagggctatcaggtcgaaggcctgttcatgaagaactgggacgaggacgacggcaccgaatactgtaccgcccgcgaggacctggccgacgcccaggccgtctgcgaccggatcggcatcaagctgcacacggcgaacttcgccgcggaatactgggataacgtgttcgagcacttccttgccgagtacaaggccggccgtacgccgaacccggacatcctctgcaaccgcgaaatcaagttcaaggcgttcctcgactacgcgctgatgctcggcgcggacctgatcgccaccggccactatgtgcggcgccgcgaccgcgacgggcgcaccgagctgctcaagggcctggacccgaacaaggaccagagctacttcctgcacgcggtgggcggcgagcagatcgcccgcagcctgttccccgtcggcgaactggagaagccggaagtccgcgccatcgccgagaagcatggcctcgccacggcgaagaagaaggactccacgggcatctgcttcattggcgagcgacgcttcaccgatttcctcaagcagtacctgccggcccagccgggcgacatcgagaccatcgaaggcaaggtcatcggtcgccacagcggcctgatgtaccacaccatcggccagcgccagggcctcggcatcggcggtctcaaggaagccggcgacgatccctggtacgtgctcggcaaggacctgcaacgcaacgtgctgctggtcggccagggcaacgaccacccgctgctgttctcccgcgccctgctggcctcgcgaatctactgggtcaacccggtcgaactggagcggccgcgccgcctgcgggccaaggtgcgctaccgccagagcgaccaggactgcgtcctggagaaaaccgccgaaggctaccgcgcggtgttcgacgaaccgcagcgcgcggtgaccccggggcaatcggtggtgttctacgacggcgacgtctgcctcggcggcggcgtgatcgaaacggcggaagcctgggatttcggaggacgcccgtga

SEQ ID NO: 15000 - DNA, 1227 bp, Pseudomonas aeruginosa
tcggccagcgcctcgaccaggtcgaacagcaggtccagcacttcggcctggtccacgagaacgtcatcgcctcgttcgccagcatctaccaggacaccctcagcaccttccgccagcgcatccaggtacacggcgacatgcgccacctgcaggtcagcagcaacgccgcgcggatccgcgccctgctgctcgccggcatccgctcggcgcggctctggcggcaactgggcggcagccgctggcagatggtattcagccggcgccggctgctcaacgaactctatcccctgctgcgcggctagccatggccatggccgggagccagccgcaacggcgcaacagcccgacccagggcgccgccatgctggctctttcggcgctgttcttcgccctgatgggcggcctgatccgcgaggcctccagcaccgtcaacaacgaaaccgtggtgttcttccgcaacctcgtcggcgtgctgttcttcctgcccctggcgctgactcgcggcatcggcccgctgcgcacccgccgcccgctatcgcacctgctgcgcaccacctacggcctgggcggcatgtactgctacttctacgccctcgcccacctgccgctgaccgacgccatgctgttcagctatgccgcgccggtgttcacgccgctgatcgcacacctgtggatcaaggagccgctgacccgccgcatgatggtcgccaccctggtcggcttcctcggcgtgctgctggtggccaggcccagcggcgcggtagtggcgccgatcgccctggtcggcatcgcctccagcctgatggctgcctgcgccttcgtctcgatccgcgaaatgagcgacagcgagccagcctatcgcatcgtgttctacttcgccctgttcggcaccctgttctccgccgtgccgctggcctgggcctggcagccgctgaacggccaggaactgctcctgctgctcggcgccggactgttcgccagcctcggccaactgaccatgtcgcaggcctatgccctggcctccccgggagtgatcggaccgatcgcctacatggccatcgttttcgccggggtgatcgcctggctgcgctgggacgaactgcccagccacacgtcgctgctcggcgccgccctgattttcgccgccagcctgatccccctgctgggcaaccgccccgccgaaaggccccgctgaatgccccaccggggcgcacctttcatgtatga

SEQ ID NO: 15001 - DNA, 2622 bp, Pseudomonas aeruginosa
cttccagccacgagaacgtctcatgcagctttcctcgctcaccgcggtatcccccgtcgatggccgctatgccggcaaaaccagcagcctgcgtccgatcttcagcgaatacggcctgatccgtttccgcgtcatggtggaagtccgctggctgcagcgcctcgccgcccacgccgggattcccgaggtcgcgccgttctccgccgaagccaacgccctgctcgacagcctggccagcgacttccagctggaacacgccgaacgcatcaaggaaatcgagcgcaccaccaaccacgacgtgaaagccgtggagtacctgctcaaggaacaggccgccaagctcccggagctggccgcggtcagcgagttcatccacttcgcctgcacctccgaggacatcaacaacctgtcccacgccctgatgctccgcgagggtcgcgacagcgtgctgctgccgctgatgcgccagatcgccgaggccatccgcgaactggcggtgaaattcgccgacgtgccgatgctctcccgcacccacggccagcccgcctcgccgaccaccctgggcaaggaactggccaacgtcgtctaccgcctggagcggcagatcaagcaggtcgccggcatcgagttgctgggcaagatcaacggcgccgtgggcaactacaacgcccacctgtccgcctatcccgaagtcgactgggaagccaacgcccgccagttcatcgaaggcgacctcggcctgaccttcaacccctacaccacccagatcgagccgcacgactacatcgccgagctgttcgatgcgatcgcccgcttcaacaccatcctcatcgacttcgaccgcgacgtctggggctacatctccctcggctatttcaagcagaagaccgtggccggcgagatcggctcctcgaccatgccgcacaaggtcaacccgatcgacttcgagaactccgagggcaacctcggcatcgccaacgcgctgttccagcacctggccagcaagctgccgatctcgcgctggcagcgcgacctgaccgactccaccgtgctgcgcaacctcggcgtcggcatcgcccacagcgtcatcgcctacgaggccagcctgaagggcatcggcaagctggagctgaacgcccagcgcatcgccgaggacctggacgcctgctgggaagtccttgccgagccggtgcagaccgtgatgcgtcgctatggcgtggaaaacccctacgagaagctgaaggaactgacccgcggcaaaggcatcagcgccgaagccttgcagactttcatcgaagagctggcgattcccgccgaggccaaggtcgagctgaagaagctgaccccggccggctacgtcggcaatgccgccgcccaggccaagcgcatctgagcacgcaacccttttgcacgcccggctgcgccgggcgtttttgtttcaaggacttaaccatgaatgctgatactcccctgcaacttctgggcggactgaccgctgccgaattcctccgcgactactggcagcgcaaaccgctgctggtccgccaggcgatcccggacttcgaaagcccgctgtccgccgacgagctggccgggttgtcgctggaggagtcgatggaatcgcgcatcgtcctcgaacacgggaaaaccccgtgggaaatgcgccgtggcccgttccaggaggaggactaccagcacctgccggaacaggactggaccctgctggtgcaggcggtagaccagttcgtcccggaagtcgcccaactgctggagcaattccgcttcctgcccagctggcggatcgacgacgtgatgatcagctacgccgctcccggcggcggcgtcggtccgcacttcgacaactacgacgtattcctgcttcagggccacggacgccggcgctggaaagtcggacagatgtgcagcagcgacagcccgctgcgcgagcacgccgacctgcgcatcctcgccgacttcgaacagagcgacgagtgggtcctggagcccggcgacatgctctacctgcccccgcgcctcgcccactacggcattgccgaagacgagtgcatgacctactcgatcggcttccgcgcgcccagcgccgccgaagtgctgacccatttcaccgacttcctcggccagttcctctccgacgaggagcgctacaccgatgccggcctgcaaccggtaggcgacgatccgcaccagatccagcgcgacgctctggagcgcctgcagggcctgatccaggagcacatgagcgacgagcgcctgctgctgacttggttcggccagttcatgaccgaaccgcgctatcccgaactggttgccggcgaggagatccccgaagaggagctgttcggcgccctcgaggatggcgcgctgctggtgcgcaaccccagcgcccgcctggcctggagcgagatcgacatcggcctggtgctgttcgccagcggccagagcgtactcctgcccgggcagctcaaggaactgctgaagctggtctgctcggccgatgcgttgcatctggaaaacctcggccaatggctggccgatgacgatgcgcgtaagctgttggcggagttggtcaaacagggcagtttggagtttgcagatgaataa

SEQ ID NO: 15002 - DNA, 294 bp, Pseudomonas aeruginosa
gccgctggagcgcttcgagcatccgcaggaagcccgcgcccatgccctggccctcctgcagcaggcccgccgctcgctctgcctgcacagtcccgacctggaaagctggctctatcaccacagcagcatccaggaagcctgcacccgtttcctcctggccaatccacgcaatcgcctgcgtatcctcgttggcgacagcgcccaggccgtgcgcaacggccaccgcctgatcagcctttcgcgccgcctgtcgagcaactgcctgatccgccggctcaacccggactaccctaa

SEQ ID NO: 15003 - DNA, 999 bp, Pseudomonas aeruginosa
agaggacgacgccttcctcctggccgacgaccagggcctgctactgcgcccgaaaccggcgcaaccggcgggctacgcctgctaccgtgccgccgggcgggtgcgtcaactccaggcccgcttcgagcaggcctgggacaccagcctttccgacccggacctgcggagcttcctcctgtgaccctgttgcgcaccaccctgctctcctcgctgctggcgacggtcgttctcggcgcctcggccgccccgcgcaccgaagtgatcccgctcaactaccgcaccgccgacgacgtgatggcggtggcccagtcggtcatcggcatcgaaggcaaggtcaccgcctatggcaaccagttgatcgtcaatgccgagccggcgaagatccgcgagttgcaatcggtcctgcagcagatcgactcgcgcccgcatcgcctgctgatcaccgtggataccagcgagaacctgcaacaggacagccgcggctattcggtggatggttcggccagcgccggcaacatcgagatccagagcggccgcggcgaggtcaacggcaaggatcgcgtccgcatcatccgtcgctccaccgacagccgttccggcggcagccagcaggtccaggccaccgagggctacccggcgctgatccaggtcggccagagcgtccccatcaccagcaccgccaccggtccctacgggcagatctacagccagaccgaataccgcaacgtcaaccgcggcttctacgtcaccgcgacgctgaccggcaacctggtgcacgtcaccatcagctccagcaatgaccgcctcagccagagccatcccggcgtcatcgatacccagagcaccgacacccgggtcagcggcaagctcggcgagtggatcaccctgggcggcgtcagcgaacagaaccaggccgaccagcacggcttcgtgcgtcgctactcgacccagggacgcgacgacaccagcttgcgcctgaaagtcgaaaccctcgactga

SEQ ID NO: 15004 - DNA, 1890 bp, Pseudomonas aeruginosa
cgagattgcgactggaacgaagttgtcctgagggacggggaagcgtttacgtatcagccagatcgaaagactcgacagcgagtcgcccaccggcaaccacgagccgaacggcacttgatccagtcgagaagcacggtccgcgaactgttcgtctccaccccctcctcggcgtcattcttcgccacggtcattctctcgccatgcagcggtgagccacccgcaagacaaccttcaccagcaggttttgagtgggtcagtcggtgctcaaccaatacatttcttgaaggattgaccatgtccgcatatcagaacgagatcaaggcagttgccgcgctgaaagagaagaacggcagcagctggagcgcgatcaaccccgagtacgcagctcgcatgcgtatccagaaccgcttcaagaccggcctggatatcgccaagtacaccgcggccatcatgcgcaaggacatggccgaatacgatgcggactcctccgtctacacccagtcgctgggttgctggcacggcttcatcgggcagcagaagctgatctcgatcaagaagcacctgaagaccaccaacaagcgctacctctacctgtccggttggatggtcgccgcgctgcgctccgacttcggcccgctgccggaccagtccatgcacgagaaaaccgcggtttccggcctgatcgaagagctgtacaccttcctgcgccaggctgacgcccgcgagctggacctgctgttcaccggcctggacgctgcccgcgccgctggcgacaaggccaaggaagccgagctgctggcccagatcgacaacttcgaaacccacgtggtgccgatcatcgccgacatcgacgccggcttcggcaacgccgaggcgacctatctgctggccaagaagatgatcgaagccggcgcctgctgcatccagatcgagaaccaggtgtccgacgagaagcagtgcggccaccaggacggcaaggtcaccgttccgcacatcgacttcctcgccaagatcaatgccgtacgctacgccttcctcgagctgggcgtggacgatggcgtgatcgtcgcccgtaccgactccctgggcgccggcctgaccaagcagatcgccgtgaccaacgagccgggcgacctgggcgacctgtacaactccttcctggattgcgaagaaatctccgaggccgagctgggcaacggcgacgtcgtgatcaagcgcgaaggcaagctgctgcgtccgaagcgcctggcttccaacctgttccagttccgcaagggcaccggcgaagatcgctgcgtcctggactgcatcacctcgctgcagaacggcgccgacctgctctggatcgaaaccgagaagccgcacgtcggccagatcaaggcaatggtcgatcgcatccgcgaagtgattccgaacgccaagctggtctacaacaacagcccgtccttcaactggaccctgaacttccgccagcaggtgttcgatgcgttcgtcgccgaaggcaaggacgtttccgcctacgaccgcaacaagctgatgagcgtcgagtacgacgacaccgagctggccaaggtcgccgacgagaagatccgcaccttccagcgcgatggctcggcccacgccggcatcttccaccacctgatcaccctgccgacctaccacaccgccgcgctgtccaccgacaacctggccaagggctacttcgccgacgaaggcatgctggcctacgtgaagggcgtgcagcgccaggaactgcgccagggcatcgcctgcgtcaagcaccagaacatggcgggctccgacatcggcgacaaccataaagagtacttcgctggcgaagccgctctgaaggccagcggcaaagacaacaccatgaaccagttccactaa

SEQ ID NO: 15005 - DNA, 474 bp, Pseudomonas aeruginosa
tggcgacgagttgcccagcaaccattcgaacaacccgcacatgaacgacctgatcgccggcctcggccgccgccaggtcctggccggcggcgcggcgctcggcgccctcgccttcctcggcgtcgcgctccccgccagcgccgctcccgccgaagcgcaggcgcccgccgcggaaggcctgcgcggcttgcctttcaaacgccgcaaccgcttgcccttcgaagccatcgccagcggccgcgccgataccatccgggtgcccgccggctacaaggcgacgcccttcataccctggggcaccccgatcagcggcagttatccgggattcctcgacgacgccagcaacagcgcccaggaccaggccgaacagatcggcatgcaccacgacggcatgcacttcttcccgatcgacgcgcagttcggcttcggcggcggacacatcagcaaccatggcctgctggtgctcaaccatga

SEQ ID NO: 15006 - DNA, 1344 bp, Pseudomonas aeruginosa
agtgcgcaaggaaatcaacgcccatggcgtttccgtcgtggagatccgtcgcaacgtgcgtggcgagtggaatgtcgtaccgtcgcaacgcaatcggcggatcaccgccgccacgccgatgcgtatcgccggcccggcgcgcggccacgaactgctgcgcacccgccacagtccggacggcacccgcacccgcggcacccacaacaactgttccaacggtttcaccccctggggcacctacctcacctgcgaggagaactgggtcggctatttctccacccaggacagcgaactgccgcgcgaactgacccgctacggcattcgcaacaccagccgtttcggctgggagaccctggcgggcgacgagttcgagcgcttcgacgccacccgcaagggcaaacaggctcaggacgactaccgcaacgaaccgaacaacttcggctggatcgtcgagatcgacccgttcgacccgcaatcggtaccggtcaagcgcaccgctctcggccgcttcgcccacgaaggcctggtcttcgccccggtcaagccgggccgccaggtagtctgctactccggcgacgactcgcagaacgagtacatctacaagtacgtcagccgcgacaagttccgtccgggtcgcagcaacgctcgcctgctcgacgaaggtaccctctacgtcgcccgcttcaacgccgatggcagcggccagtggctgccgctggacatcgccgacggcaacttccgcgcggcctgtcgcaaggccggggtgagcttcgccgaccagggcgaagtgctgatcaacacccgcctggccgccgatgtcctcggcgcgaccaagatggatcgcccggagtggggcgcggtcaacccggacaacggcgacgtctacttcaccctcaccaacaacacgtcgcgcaccgtcgccgacgccgccaacccacgggtgaagaacgcctacggccatatcatccgctggcgcgaacgcagccgcgactatgccgggcaacgcttcacctgggacctgttcatgctcgccggtcccggcgaagacagccgcggcccggacggcaagccgctgaaccaggacaatatcctggccagccccgacggcctctggttcgacccggaaggccgcctgtggatccagaccgacatgagcggcagccagttgagcagcggcccgttcggcaacaaccagatgctggtggccgacccgcgcaccggcgaactgaagcgcttcctcaccggtccgctgggttgcgaggtgaccggcattgccgcgacgccggacttccgtacgctgttcatcaacatccagcacccgggggaaggctcgaccgccgataa

SEQ ID NO: 15007 - DNA, 708 bp, Pseudomonas aeruginosa
ggtcttgcaaagagccctcccccacgcttcgcggcaatacgaccaaaagccagccaggccgcgccatttctcgcagagacagcattcacgaggctttcggggattaaccaaagcgctggaaaaagcagagaagcgtctgtttgtgttagaaaaatttacttgtccggcgctttgggcataaaatcggaaagatacatacaacccttagctcactacgcagcgggttgcacaagaagtcgggcattgcgcccagaacccacgatcttatatatccggtacagaaggagtatcagcatgccaaacccagctgaacttgcagctcatcactggggattcgctgccttccttctaagggtcgttggccttctcgccttcatgctaggggtttcgtccctgcttggcagcaaggcatttggtcgcagcaagaacgaacccttcgaatccgggatcgtccccaccggaggcgcacgcctgcgtctctcggcaaaattctatctggtcgcgatgctcttcgtgatcttcgacgtcgaagccctcttcctcttcgcctggtcggtgtcggttcgcgaaagcggctgggccggcctgatcgaggcaaccattttcatagcaattctgttggcgggtcttgtctatctttggcggatcggtgcgctcgattgggctcccgaaagccgtcgcaagcggcaggcgaagctaaaacaatga

SEQ ID NO: 15008 - DNA, 618 bp, Pseudomonas aeruginosa
ccgaaagcgaccgagaccatgactgcagactccgctctgtacatcccgccttacaaggcagacgaccaggatatcgtcgtcgaactgaattcccgctttggcgccgagaccttcaccgtccagcccacccgtaccggcatgccggtgctctgggtcccgcgcgaaagactgatcgaagtcctgaccttcctccgtcaggtacccaagccctacgtgatgctctacgacctgcacggcgtcgacgagcggctgcgcacccatcgccgcggcctgccgagcgccgacttcagcgtgttctaccacctgatgtcgctggagcgtaatagtgacgtgatgatcaaggtcgccttgtccgagcgcgacctcaacctgcccaccgccacccgtatctggcccaacgccaactggtacgagcgcgaagtgtgggacatgtacggcatcaccttcaccggccacccgcacctgacccgcatgctgatgccgccgacctggcagggccatccgctgcgcaaggactacccggcgcgcgccaccgagttcgatccctactccctgtccgccgccaagcaggacctggaccgggggccctgcgcttcaagccggaagactggggcatga

SEQ ID NO: 15009 - DNA, 1182 bp, Pseudomonas aeruginosa
agcgccacgggcgagaacgaggactacatgttcctcaacctcggcccgaaccacccgtccgcccacggcgcgttccgcatcatcctgcagctggacggcgaggagatcatcgactgcgtcccggagatcggctaccaccaccgcggcgccgagaagatggccgagcgccagtcctggcacagtttcattccctacaccgaccgcatcgactacctcggcggggtgatgaacaacctgccctacgtactctcggtggagaagctcgccgggatcaaggtgccgcagcgggtcgacgtgatccggatcatgatggcggagttcttccgtatcctgaaccacctgctgtacctgggcacctatatccaggacgtcggcgccatgaccccggtgttcttcaccttcaccgaccgccagcgcgcctacaaggtggtcgaggccatcaccggcttccgcctgcacccggcctggtaccgcatcggcggcgtcgcccacgacctgccgcgcggctgggacaagctggtccgcgagttcctcgactggatgcccaagcgcctcgacgagtacgagaccgcggccctgaagaacagcatcctgcgcggccggaccatcggcgtcgcccagtacaacaccaaggaagccctcgagtggggcaccaccggcgccggcctgcgcgccaccggttgcgacttcgacctgcgcaaggcccgcccctactccggctacgagaacttcgagttcgaggtaccgctggcccacaacggcgacgcctacgaccgctgcatggtcaagatgggcgagatgcgccagagcctgcggatcatcgaacagtgcctgaagaacatgccggaaggcccttacaaggccgaccatccgctgaccacgccgccgccgaaagaacgcacgctgcaacacatcgaaaccctgatcacccacttcctgcaggtttcctggggcccggtcatgccggccaacgaagccttccagatgatcgaggcgaccaagggtatcaacagctactacctgaccagcgacggcagcaccatgagctaccgcacgcgtatccggacgcccagcttcgcgcacctgcaacagatcccctcggtgatcaacggcagcatgatcgcggacctgatcgcctacctgggtagcatcgatttcgttatggctgacgtggaccgctga

SEQ ID NO: 15010 - DNA, 1614 bp, Pseudomonas aeruginosa
tcagatattccgccagccggtgggccgccacatcatccgcgtctgcgacagcatggtctgctacatcggcggccacgagtcggtggtcggcgagatccagaagcaactcggcatcggtctcggccagactaccgccgacggacgcttcaccctgctcccggtctgctgcctgggcaactgcgacaaggccccggcgctgatgatcgacgacgacactcatggcgacgtgcgtcccgacggtgtcgccaaactgctggaggcctacgtatgacccttacctccattggtccggccaaccgcatggcgcgttcggcggaaacccatccgctgacctggcgcctgcgcgaagacgcccagcccgtctggctcgaggaataccagagcaaggacggctatgccgcggcgcgcaaggcgctgacccagatggcccaggacgacatcgtccagaccgtcaaggactccggcctcaagggccgcggcggcgcgggcttccccaccggcgtgaagtggggcctgatgccgaaggacgagtcgctgaacatccgctacctgctgtgcaacgcggacgagatggagccgaacacctggaaggaccgcatgctcatggagcagctgccgcacctgctggtggaaggcatgctgatttccgcgcgcgcgctgaaggcctaccgcggctacatcttcctgcgcggcgaatacgtcgacgcggcgcgcaacctcaaccgcgccatcgacgaagccaaggccgccggcctgctcggcaagaacatcctcggcagcggcttcgatttcgagctgttcgtccacaccggtgccggccgctacatctgcggcgaagagaccgcgctgatcaactcgctggaaggccgccgcgccaacccgcgttccaaaccgcccttccctgccgccgtcggcgtctggggcaagccgacctgcgtgaacaacgtggagacgctgtgcaacgtgccggccatcgtcggcaacggcgtggactggtacaagaccctggcccgccccggcagcgaagacatgggcaccaagctgatgggcttctccggcaaggtgaagaaccccggcctgtgggaactgccgttcggcgtcagcgcccgcgagctgttcgaggactacgccggcggcatgcgcgacggcttccagctcaaggcctggcagcccggcggcgccggtaccggcttcctgctcccggagcacctggatgcgcagatgttcgccggcggcatcgccaaggtcggcacccggatgggcaccggcctggccatggcggtggacgacagcatcaacatggtttccctgctgcgcaacatggaagagttcttcgcccgcgagtcctgcggctggtgcaccccctgccgcgatggcctgccgtggagcgtgaagctgctgcgtgccctggagcggggcgaaggccagcccggcgacctcgagaccctcgagcagctggtcaacttcctcggcccaggcaagaccttctgcgcccacgcgccgggagccgtcgagccgctgggcagcgccctcaagtatttccgtgccgaattcgaggcgggcatctcccgccagccttcggccgcgccgcgcccggcaacggtcggcgcctga

SEQ ID NO: 15011 - DNA, 414 bp, Pseudomonas aeruginosa
accgctgcatcgcctgctaccgctgcgtgcgctactacaaggactacgccggcggcaccgacctcggcgtctacggcgcccacgacaacgtctacttcggacgggtcgaggacggcgtgctggaaagcgagttctccggcaacctcaccgaggtctgccccaccggcgtgttcaccgacaagacccactccgagcgctacaaccgcaagtgggacatgcagttcgccccgagcatctgccacggctgctccagcggctgcaacatcagccccggcgagcgctacggcgagatccgccgcatcgagaaccgctacaacggctcggtcaaccactacttcctctgcgaccgcggtcgcttcggctacggctacgtcaaccgcgaagaccgtccgcgccagccgctgctggtgctga

SEQ ID NO: 15012 - DNA, 585 bp, Pseudomonas aeruginosa
tcgtcgccgatcaccagcagaccgccaccaccgccaaggcgcacctggtgctgccggcggccagcttcgccgaaggcgacggcaccctggtcagccaggaaggccgcgcccagcgcttcttccaggtgttcgacccgacctactacgacgccaggaacatggtccgcgagggctggcgctggctgcatgcgatccacagcaccctgcaaggcaagcgcgtcgactggacccagttggaccacgtcaccgaagccgtggccgaggcaaagccgatcctggccggcatccgcgacgccgcaccggccgcctcgttccgcatcaagggcctcaagctggcccgcgaaccgcaccggtacagcgggcgcaccgccatgcgcgccaatatcagcgtgcacgagccgcgcaccccgcaggacatcgactcggcgttcgccttctccatggaaggctactccggcagccaggaagaccgtcagcagatcccgttcgcctggtcgccgggctggaactcgccgcaggcctggaacaagttccaggacgaggtcggcggccacctgcgcgccggcgaccccggcgtgcgcctga

SEQ ID NO: 15013 - DNA, 654 bp, Pseudomonas aeruginosa
ccaggtgatggcgttcagctggaaggtgtgcctgccgctgaccctgatcaacctgctggtgaccggcgcgctcgtgctggccgcggcccagtaaggagaaccaccgtgatcaaagaaatcatcaacgtcgtgcatggcaccttcacccagcttcgcagcctggtgatgatcttcggccatgccttccgcaagcgcgacaccctgcaataccccgaagagccggtctacctgccgccgcgctatcgtggccggatcgtcctgacccgcgaccccgacggcgaggaacgctgcgtagcctgcaacctgtgcgccgtggcctgtccggttggctgcatctccctgcagaaggccgagaccgaggacggtcgctggtatccggagttcttccgcatcaacttctcgcgctgcatcttctgcggcctgtgcgaggaagcctgcccgaccaccgcgatccagctcaccccggacttcgagatgggcgagttcaagcgccaggacctggtctacgagaagcacgacctgctgatctccgggccgggcaagaacccggactacaactactaccgcgttgcggggatggcgatcgccggcaagccgaaaggcgccgcgcagaacgaagccgaaccgatcaacgtgaaaagcctgctgccataa

SEQ ID NO: 15014 - DNA, 1350 bp, Pseudomonas aeruginosa
cgcggcgctcaaggcattcatcgtcacccgcgtcggcgacgtgttcatggctttcggcctgttcatcctgttccagcagttcggcaccctgaacatccaggagctgctggtgctggcgccgcagaagttcccggaaggcaacctctggctgaccctggcgaccctggccctggctcggcggcgcggtcggcaagtccgcccagctgccgctgcagacctggatggccgacgccatggccggcccgaccccggttttccgcgctgatccacgccgccaccatggtgaccgccggcgtctacctgatcgcccgttgccacggcctgttcaccctggccccggacatcctcgaactggtcggcatcgtcggcgcggtgaccttggtcctggccggcttcgccgccctggtacagaccgatatcaagcgcatcctcgcctactcgaccatgagccagatcggctacatgttcctcgccctcggcgtcggcgcctgggacgcggcgatcttccacctgatgacccacgccttcttcaaggccctgctgttccttgcctcgggcgcggtgatcgtcgcctgccaccacgagcagaacatcttcaagatgggcggcttgtggaagaagctgccgctggcctacgccagcttcgtggtcggcggtgcggcgctggccgccctgcccttcctcaccgcgggcttctactccaaggacgagatcctctgggaggccttcgccagcggccatcgcgaactgctgatcgccggcctggtgggtgcgttcctgacctcgatctacaccttccgcctgatcttcgtcgccttccacggcgagccgaagaccgaagcccacgccggccacgggatttcccactggttgccgctcagcgtgctgatcgtcctgtcgaccttcgtcggcgccctgatcaccccgccgctggctggcgtcctgccggaaagcgtcggccacgcaggtggcgaagccaagcacagcctggaactggcctcgggtgccatcgccatcgccggtatcctgctggccgccctgctcttcctcggccagcgccgcttcgtcagcgccctggcgaagagcgccccgggtcgcttcttcggtacctggtggtaccacgcctggggcttcgactggctgtacgacaagctgttcgtgaaaccctacctgctgctctgccaattgctggggcgcgaccccatcgaccgtaccctgggcgtcgttccgttcagcgtgcgcggcggacacaacctcctcagcctcaccgagaacggccgcctgcgctggtacgccgcttccctggtgggtggagccgccatcctgctcggcgcgctgctgctggcctaa

SEQ ID NO: 15015 - DNA, 1557 bp, Pseudomonas aeruginosa
cgaattcacggagagactgagcctgtcatgattctgccctggctaatcctgatccccttcatcggcggtttcctctgctggatcgccgaacacagcagcaagaccctgccccgctggatcgcgctgctttcgatgaccctggtcctgatcctgagcctttggatctgggccaccggcgacttccagctggcgcccgcgcccggcggcgagccggaatggaccctgcaattcaaggtgctgtggatcgagcgtctcggcatcagcatccacctggcgatggatggcctgtcgctgctgatggtcgccctcaccggcctgctcggcgtgctctcggtcctctgctcctggaacgagatccagcgccgcatcggcttcttccatctgaacctgctgtggatcctgggcggtgtgatcggcgtgttcctcgccatcgacctgttcctgttcttcttcttctgggaaatgatgctggtgccgatgtacttcctcatcgcgctgtggggacacagttccgatgacggcaagaagacccgcatctacgccgccaccaagttcttcatcttcacccaggccagcggcctggtgatgctggtggcgatcctcggcctggtgttcgtcaacttcaatgccaccggcgtgatcaccttcgactacgccaccctgctgaagacccagctgagcccccacgtggaatggctgctgatgctcggcttcttcgtcgccttcgcggtgaagatgccggtggtgccggtgcattcctggctgccggacgcccacgcccaggcgcccaccgccggctccgtggacctcgccggcatcctcctgaagaccgccgcctacggcctgatccgcttcgccctgccgctgttccccaacgcctcggcggaattcgcgccgatcgccatgtggctcggcatcatcggcatcttctacggtgccctgctgtccttcgcgcagaccgacatcaagcgcctggtcgcctactccagcgtttcgcacatgggcttcgtgatgatcggcatctactccggcagccaggtcgcgctgcagggcgtggtggtgcagatgatcgcccacggcctctccgccgcggcgctgttcatcctctgcggccagctctacgagcgcctgcatacccgtgacatgcgcaagatgggcggcctgtggtcgcgcatgccctacctgccggcgatcagcctgttcttcgcctcggcgtcgctgggcctgcccggtaccggcaacttcgtcggggagttcctgatcctgatcggcgccttcaaggtggtcccggtgatcatcgtgatcgccaccttcggcctggtcttcgcctcggtctactcgctgatcatgatccaccgcgcctacttcggccccagccagtccgacgagccgatcctcggcctcgatgcccgcgaactgagcatggtgctcggcctggcggtcctgctggtcctgctcggggtctacccgcagccagtgctggacatctccgcggccagcatgcacggcgtgcagcaatggctgggcgcagccctttccacccttgcaggacggtag

SEQ ID NO: 15016 - DNA, 1260 bp, Pseudomonas aeruginosa
ccgcgaagagctgtacctgctcctgctgctggccaccgccggcggcctggtgctggtcagcgcgcagcacctggccagcctgttcatcggcctggagctgctctcggtcccggtctacgggatggtcgcctacgccttcttcaacaagcgctcgctggaagccggcatcaagtacaccgtgctctcggccgccgggtccgccttcctgctgttcggcatggccctgctctacgccgagtccggtaccctgggcttcgccggccttggcgccaaggttgccgagcacgtgctgagcggtccgctggtcagcgttggcgtaggcatgatgctggtcggcctgggcttcaagctgtcgctggtgcccttccacctgtggaccccggatgtctacgaaggcgccccggcgccggtctcggcgttcctcgccaccgccagcaaggtcgcggtgttcgccgtgctgctgcggctgttccagatcgccccggcggccctggacaaccaactgctgaacatctccctgagcgtcatcgcggtcgcctcgatcctcttcggcaacctgctggcactgacccagagcaacatcaagcgcctgctcggctactcgtccatcgcccacctgggctacctgctggtcgccctgatcgccagcaagggcatggccgtggaagcggtcggcgtctacctggccacctacgtactgacctccctcggcgcgttcggcgtgatcaccctgatgtccaccccgtacagcggccgcgacgccgatgcgctgttcgagtaccgcggcctgttctggcgccggccggtactgaccgcggtgatgaccgtgatgatgctgtcgctggcaggcatcccgctgaccgccggcttcatcggcaagttctacgtgatcgcggtcggcgtcgagtcgcacctgtggtggctgatcggcgccctggtgctgggcagcgccatcggcctgtactactacctgcgggtcatggtcaccctgttcctggtcgagcccggcatccgccagcacgacgcaccgttcaactggggccagcgcgccggcggcatcatgctggtggccatcgccctgctggcgttcttcctcggcgtctacccgcagccgctgctggaaatcctccagcattccggcctggccctcgccggctgagtcgcccgctccacgaaaaccccgcctcggcggggtttttctttggcccgccccacgcaccctgccccgctgccgtggcatgctccgcgctccatggatga

SEQ ID NO: 15017 - DNA, 1290 bp, Pseudomonas aeruginosa
agcggcactgtcatgtccaaacattcccggcttgaaaaagccttcctgcgcagcggcatcctcgtcgaccgccagcaggacatcgtcaccctcacccgtcgtcacgacggtacttcggcccagatcctgctgcccgccagcttcgcgctggaggaaaaggccgtgcgccagttgctcgacttcgcctcggtccaggcacccggcgacaccgggcacgtctgcaaggcctgcgccacgccggacttccatcccggcagcatcgccccggtcggctccatcgtcgccagtacggcggacttcgtcattcccgctgccatcggcaccgacatcaattgcggcatgcgcctgctgcgtaccggcctgaccctgtccagcgccgaggagcacaggcaagccctggtcgccggcctgacccacgtcctgctgcgtaacggtcgcgacgtaccattgcgggtccaggcgttcgaagcgctgttcgccgaaagccccgggcactgcctggagcgtctcagcgaagacggcctgtgggccgaggtcgaccaggcgcggctgttccgcgagttacagggctgcatcggcctggatgaattcggcgggcgtctcgagtatgcccccgaggccttgcgcgatcgccgccgcagcctgatccgcgatcccggcctgggtaccaccggttccggcaatcacttcgtcgagttgcaggtggtggaccgcctgctcgaccgccaccaggccttcgccctgggcctcagggccgacgaactggtggtgatgatccacagcggctcgcgcgatgtcggcttccacgtcggccagcgctggatggaccgtgcccgcaccgcctggccgcgcggccggcgccaccccgcgtccggcctctacgcgctgggcggcgagctggccggagaatacctccaggccatgggtggcccctgcgcgctatgcctggctgaaccgggtggtgctggcggagctggtgcgcaaggtcttgcgcgagaccttccagcgcgacgacagcgccctgctggtggacgtcccgcacaacgtggtgctccaggaacagggcctgaatctccaccgcaagggcgccacgccggcccgccagggcgatctgctgctgattcccggctcgatgggcgattactcgtacatcgccagcggcctgggacacccggactggctatggtcctgcagccatggggccggccgcagcatccgccggcaggcgctacgagcgctgaaaggcccgggcgacagcgcgctgccctggcactgcgtgaccctccgtga

SEQ ID NO: 15018 - DNA, 924 bp, Pseudomonas aeruginosa
ggagcgccgcatcgaagaggccccgggcgcctacaagccggtggggccggtgatcgatgcccaggagcgtgccgggctgatccggccgctggcacgcttgcgtccgtggctgaccttcaaggcctgaaacgaacaagccccgcattcgcggggcttgtctgccacgggcgcgactcaggcctgcggttcttcctcgcggccagtgaacaggtcccagctggccatgaacagcgcagcgatcagcgggccgatgacgaagccgttgagaccgaacagggccatgccgccgagggtggagatcagcaccacgtagtccggcatcttggtgtccttgccgaccaggatcgggcgcaggatgttgtccaccaggccgatcaccaccacgcagaacaggatcagcactacgccctgccagatcgccccggtgagcaggaaataggccgccaccggcgcccagatcagcgccgcgccgatggccggcagcagcgacaggaaggccatcagggtgccccagagcaaggcgccctcgatgcccagcagccagaagatcaggccgccgagagcgccctgggtggcagccacggcgatgttgcccttcaccgtggcgcggatcaccgtggtgaacttggcgaacaggtggtgcttgtgttcctggctcagcggcaccgcctgcttgatccgccggccgagcacgcgaccgtcgcggaggaggaagaacagcaggtagagcatgatgccgaagctgatgacgaagtcgagggtgttctggccgatgctgaacgccttggtcgccaccacctggctggcctgcatcgccaccgaggagagcttctcctgcaggctcgagagattggcccaggtcgaagcgctcccacccactggtgcaccgatggcggcaaggcagccaccgcctgctgcaggtag

SEQ ID NO: 15019 - DNA, 1170 bp, Pseudomonas aeruginosa
ccgaccagtcggcccaggccctggcccagttgcgccaggctgcgggcggtctgcgcgccctgctgggcctcgtcggcgacgctgtccaccgcgccggcgatctggtgcacgctgcggttgatctcctcggccaccgcggtctgttcctcggcggcgctggcgatctgcgcgttcatcgcgttgatggtggcgatcagctgggcgatggcatccagcgaatcgccggcctggttggcctggttgctggtgccctcgccggcctcgccggaacggcgcatggcgtcgaccgcggcgttggtgccctgctgcaggcgatcgatcatgccctggatttcctgggtactctgctgggtgcggctggccagcgcccgcacttcgtcggcgaccaccgcaaagccacgtccggcctcgccggcacgggccgcctcgatggccgcgttgagcgccagcaggttggtctgttcggcaatggagcggatcaccccgagcacactgacgatggattgcacgtcctgctgcaggctatccagagaagtcccgctgtcgcggatctcgtccaccagcgcgtggatgcgctcgatgctgccgtccaccacgcgcttggccgcctggccttcgtggtcggtctgctgcgcggcctcggcggcgcgctgggcgctctgcgccacttcatgggcggcggcggacatctcgttgatcgcggtggcgacctggtcggtctcgtggcgctggcgctccatggcctgctcggaacgctcggcctgggccgacatctgctccaccagttgcttgaggtcgccggtcatcccggcgatctgccgcaccagaccgtggatcttctcgacgaagcggttgaaggaaccggccagctcgcccagctcgtcgtggctggtcaccggtaggcgacgggtcaggtcgccttcgccggcggcgatgtcatcgaggttctggcggatctggtgcaacggccgcagcatcgcgttggccaccgccaggccgatcaccagcaggaccaccagaaggacgccggcgatccccacgatactggcgatcagggtgccgatacgctcgtcgatgtcctgcttgatttccaccaactgggcctcgacgccgtcgaggttgatcgccgagccgataaccatgtcccacttcggcaggtacagggtgtag

SEQ ID NO: 15020 - DNA, 621 bp, Pseudomonas aeruginosa
gccctggcggcgcggccgctcttctgcaacggcaactcgacgctcacccgcaggccgcccagcgggctgtcctcgagactcaggcggccaccgcaggcctcggcgatgtcgcgcgcgatgcccaggcccaggccatggccgctgacctgctcgtcgagccgggtaccccgctcgagcaccgcctggcgctggtcggggaggataccggggccgtcatcgtcgaccttcaggcggaccatgccctcgccctgcgcgacggtcaggcggacttcgctatcggcccacttgcaggcgttgtccagcagattgccgagcatctccagcaggtcctcgcggtcccatggcaggcgcagccccggtggcgcgctccagctcacctgcaggtgcgggccgtggatcaggcgcagggtgtcgcacagcgacggcaactcctcggcgcaatcgaaatgtgcgccaggcagcgcttcgccgaccaggcgggccttgcccaactcgcgaccgaggcgctgctggatctgttccagctgttcgcgcaggacctgttgcaactccggctggcgcgccatctcctcgcgctcggcgaggctgaccagcaccgccagcggcgtcttcagggcgtga

SEQ ID NO: 15021 - DNA, 1185 bp, Pseudomonas aeruginosa
ggtaacggaaagcctctgcgatggggctcgccggcgttcgaaagcgcttggtcctgcgacaactcgtcctataatcgccggtccgcaagggagaagaccagcatgccagccatccagatcaagtcccccgcactgaccctcaaggccggtcgccgcgccctcgcccgcatccgcgagcgcggcctgcagccggccgacgtcggcatcgtccccggtgccgccggcgggccaaaggcgctgggcatccagggactggacctggcgatcttcggcgagtggctgccgcgcgccccgcgtgaacgctcgctgatcggcgcctccatcggttcctggcgcttcgccagtgcctgcctgcccgacgccgtggccggcctcacccgcctcggcgagctgtacacccggcagcgttttcccaagggcgtgagcatcgccgaagtctcgcgcaagtgcgcggcgatgctcgacgacctgctcgccggccaggacgcgcggatcctcgacaacccgctgtaccgcctcaacgtggtggtggtgaagagccacgggcgcctcgcccacgaccacaaggccagcctcggcctggggctgtcctcggtgatccgcgacaacctgatcggccgccgccatctgcaccgccacttcgaacgggtgatcctgcatgacgcccgccaggcgccgccgctggccgcgctgaccgacttcccgtcgcgctacctgcacctggacggcggcaacctgcgccaggcgctgctcgcctccggctcgatcccgatggtcatggaaggcgtccgcgacctgcctggcgccggccccggcacctaccgcgacggcggcctgctcgactaccatctcgacctgccctacgaggaccgcggcgtggtgctctacccgcacttcaccgacaaggtgatccccggctggttcgacaagggcttgccctggcgccgtggcgacgccgggcgcctgcaggacgtgctgctgctggcgccgtcgcgcgagtacctggcgcgcctgccgcacgccaagctgccggaccgcaaggacttcacccgctacctcggcgacgacgacggccgcgagcgctactggcgccaggcgatggcggaaagccgcaggctcggcgacgaattcctcgaactggtcgacggcggccggctcggcgaacgcctgcaagcgctggactga

SEQ ID NO: 15022 - DNA, 402 bp, Pseudomonas aeruginosa
gccacatggagtactggaacgatgcgcgttttcacgattacctggcggactacctgcgccgcctgttggctgctggcctcgagcctgccggcgctggccgcgccctccccgcaggcgagccaggagatcggccgcttgctgagctttgttgaagacagcggctgcaccttcatccgcaacggcagcgaatacccggccgcggaagcccgcgcccacctgcagaagaagctcgactacctggagcgcaaggacctggtcgccagcagcgaggacttcatcgagcgcgccgcgacccagagcagcctcagcggcaagccctaccaggtgcgctgcgccacgcagacgcgcaactccgccgactggctgaaccaggagctgcggcgtctgcggcaagccccctga

SEQ ID NO: 15023 - DNA, 654 bp, Pseudomonas aeruginosa
tcaaccgggatggccgtcgacccgcggacgacacagcatcggcgcatagaaccaggcgaacagcaggaacgccaaagcccacagtccgcctgccaggggcagcgcccagttcgccggcaacaggctgggcaggaacacccgcgccgcgcagccgagattgagcagagcgaaagcccagggcatcgctgccggcggttgcagcgcgcgaccggtatggccgagagtgacccgtgccagcatcgccaggatcaacccgcccatgccgcccaccgccagcgcgtgcagcgcctggctcggcgccagcgccaggcccaggctccagagcgccatgccaagcggcgccacggcgatccagaaatatgccaggtgcagagaccagagcagcggcacctgccagatgccgcgatcgcgccaacgccacaggcgccacagttgcgcaccaccgagggcggcgaacagtcctgcaagccagggcgtcggctgcgtcgtgacgcccgcggcggtgagcagcgccaccagcacgcagcccagcaggatgccattgtccagccaggcgatcgccggcacctgctgctgacggccgagaccgcggtgggtgaagaacgggatcacccgcccgccgatcaggttcatcatcccggcgatcagccatag

SEQ ID NO: 15024 - DNA, 498 bp, Pseudomonas aeruginosa
ccagagcgcgatggcgaggaccgcgaacagcgcgccgccgaggaagaacgggcggaagcccaggcgccagatcggcggtatggccatcagcctggaacgatcaagcacttgcacagcagacctcccaaccgggtcgacgcatgcggaacagcgcgctcaggcgcatcacgtagccgatcttcaacagggtcgggccgaggatcaccagcgcatgggaaaacaccagcgccggcatgttcaggtagcggtcgaggaaataggcggcgatcacgccggcgacgagcagcgccaggccggccgccagcagcccgtgaccgatccgcagcacccgccgtggacaatcgaacagagcgttcatctcgatctcctttttccgaaaaagggccgacgcacctcgcgccggcccgtcgcttcaggcgtccagcgcggcggccggaccgaagaactcgtagtggcattgctgcgagggtacgccgaggtcggccaggtggcgcttga

SEQ ID NO: 15025 - DNA, 1572 bp, Pseudomonas aeruginosa
gactgcaaagaggtcgaaatgaccaccaaccccttgcttgccaccctgatcccgctggttgccgacctgtcccgcgacctgccggaagacgaacgctaccgccgcctgctccaggccctgcgcgacctgctgccctgcgacgccaccgcgctgctgcgcctggacggcgaatacctgatcccgctggcggtggacggcctcagcccggacaccctcggccggcgcttccgggtcggcgaacatccgcgcctcgaggccctcctggagcgccgcgggccgacccgcttccccgccgactgcggcctgcccgatccctacgacggtctggtggaaggcctccacggccacctggaaatccatgattgcctgggctgtccgctgtacctcgacgaccagccctggggcttgctgaccctggataccctcgatccgtcgcgcttcgccagcgccgacctggataccctggaggccttcgccagcctcgccgccgccacggtcaaggccagcgagcggatgcgcgacctgacccgccgcgccgaggacgagcaccagcgcgccgaggcctatctcgaagccgctggcgagcggccacgggaaatgatcggccagagcgccgcgcacaaggcgctgctggaagaaatccgcctggtcgccaacagcgacctgagcgtactgatcaccggcgagaccggggtcggcaaggaactggtggcgcaatccatccaccggcattccatgcgcagcggcaagccgatgatcagtctcaactgcgccgcgctgcccgagaccctggtggaaagcgaattgttcggccatgtgcgcggcgccttctccggcgcggtcaacgaacggcgcggcaagttcgaactggccgacggcggcagcctgttcctcgacgaggtcggcgagttgccgctggcggtgcaggccaagctgctccgcgtgctgcagagcgggcagttgcagcgggtcggctccgatcgcgagcaccgcgtcgacgtacgcctgatcgcagccaccaaccgcgacctggccgaggaagtgcgtgccgggcgcttccgcgccgatctctaccatcgcctcagcgtctatcccttgcgcgtgccgccgctgcgcgagcgcggccgcgatatcctcctgctggccggctacttcctcgaggaaaaccgaccgcgcctgggactgcgcagcctgcgcctggaccacgaggcccaggccgcgctcctcgactatcgctggccgggcaacgtgcgcgaactcgagcacctggtcggccgcgcctcgctcaaggccctcggccacaatccggagcggtcgcggatcgtcaccctgcatcggcaggatctcgacctgcccgcggaaacccccgcgccacctcgcagcgtggtcgagcccgcgcccgccgcgccaacgaccggtcactcgttgcgcgcggccaccgacgcctaccaacgccgcctgatccaggactgcctggcccgccaccagggaagctgggcctcggctgcacgcgagctgggcctggatcgcgccaacctggcgcgcctggcgcgccgcctgcaactcaggtaa

SEQ ID NO: 15026 - DNA, 1329 bp, Pseudomonas aeruginosa
agccctgttgtgcagctctgttcatacggtttccacttcacgtctcatccaaccagccgcggcatcgatacccggcattcaaagcaccatgtcgttggcgctggtaatcgccagtaccacgccggtaatgatcaggccgaacacagagccgatcagcaggatcgccaaaggctcgatcagtaccagggcctttttcattcgcgcctgcccggcctctccatagagcgtcgccaggctctgcagcatctccgcgagctgcccggaagcctctccaacccgcaccaggctcgaaccgatggacgtgaccgcctggcgctcctccaacgctgccgacaaggcgatgccggcccgcacatcctgggtgactcgctccagggtccggcgctgccgggcaatgcggacgccagcggcggaaagcagcagggcctccaccagcggcacacgatttcccagcagggttccaagcaccttcgaccattgcgctatttccgcctgcatcaaccattccccgactacgggcaggcgcaccaactggtcgagcgcatgggcgcggagcgccggattgcgcagcgccacggcgatgccgccagcaagcagcaggacggcgaacgccagcaagccggaactctcgttgctccataccccgatgctcagcactgcccaggcaagccacgggagctgggcagtctcgttcaggagattggcgaatttcggaacgacgaagacgaacagggtcgccacggcgagcaccccgctgagcaccagaatcgcagggtagatcagcgccccttgcaactcggcgcgggttcgccgttcgtattccatctgcgtggcacagtccctcaaggctcctgcgaggtttccggtcatctcgccggccgccaccagttgatatacatagcgcggcaagtcgaggccggcgctctccagcaccacgggaaaggattgcccctggcgcaggccattggccatcgcctgcagggcggtaatcaacttcgggtggcgcgcgcctcgctcctgagcctccaccgcgtcggccatgctcactcccgccgcgagcatggtggccagctcgtggatggccatgttcaattcctcggccttgagccgacgtcgcgagcccaggttgcggcgtttcacctccaggctgagcggggtgagcccctggcgctgcaactgccgcagcgcatcctggcgcgttgggaggcagagttcgccacgaacgcgcctgcccttgcgatcgacggcctggtagatgaaattcatgggcttagccgctggtcacgcgatgcacctcgtcaagactggtcatacccaaccaggccttga

SEQ ID NO: 15027 - DNA, 1251 bp, Pseudomonas aeruginosa
acagcttgcgtccgcgcggcctgctggtgtccttcggcgctacctccggcgtgccgccagccgtcgaagtcgccaccctcaacgccaagggttcgctattcctcacccgtccctcgctcgccgcccacaccgccaacccggaggaataccggctacgcgcgcaggctgtgctgcgcgcccatgcagacggtgtcattcagccccgggtctggcggcgctacccgctggccgaggcggccgtggcgcataccgatctgctggagggacgctcgcaaggcgcgctggtactcttgccctgacccacccgcaagaggcgcatgcatgcaaccgttcgacagccggcaggccgatgaagtcgccacgctcctggccctggccgagcacggttcgttcgccgccgccggccgcgccctgcaacgccatccctcggtgctctcgaagcggctcggcgcactggagcgtcgcctcggcatccgcctggtcgaacgcaccacccggcaactgcgcttcaccgatgaaggcgagcgcctggcgagccgcttccgccaggccgtcgacctgctcgacgaggccgagcacgaagccagcctgggcgccgcgcaactgcgcggacgcctgcgcatcgccctgccgtcggcgatgggccggctctggctcggtccgctgctggcggagttcgccctggcgcatccgcaggtggtgctggaaaccgactattcggagcgcttcgtcgacatcatcgcggaaggcttcgacctcgcgatccgggtcggcgaactggccgacagccgcctggtggccaggcggctgtgcgcccatcggcgcatcctcggcgccgctcccgactacctgaagcggcatggggtaccgcgtatcccggccgacctggcggcacataattgcctcggcttcagcggactgcactcgtacccggagtggaagctgacccgccaggacgaacagcagcccgtgcgggtacgcggctcgatggtcagcaacgacaacgaggccctgctctgcgccgcacgccagggcctgggtatcttcgccgccggcgagtggctgatgagccgcgacctcgaagccggcaggctggtacgggtgctgccggagtggcaactggacgccgacgccggcgtctacctggtgcgcccctcggcgcgatacgccacggcggcggccagcgcgttccgccaatgggtggaagcgcggttcgccgctggcccgccctggcagcgccagcgggcctga

SEQ ID NO: 15028 - DNA, 558 bp, Pseudomonas aeruginosa
tcggtcaggaaatcttcggcgtcaacgcgaacatgcgcgcggtggccgacctgtacgccgaagagggctacgtggccctggtccccgacctgttctggcggctgcagccgggcgtcgacctgggctacgacgaagcggccttcgccaaggccatcgagctgttccagcgcatcgatctggacgccgcggtggacgacatcgccgcctgtatcgagcacctgcgccaacgcgaggaggtggtccacgccgggatcggcttcgtcggcttctgcatgggcggcaagctggcctacctcgccgcgacgcgcaccgacgtctcctgctcggtgggctactacggcatgggcatcgaggcgctgctcgacgaggcgaaacagatcaagggccggctggtgctgcatttcgccgaacaggacgcctactgcccgcagcaggcccgcgacgcgatcctgccctgcctgcgcaacctgcccaagaccgagttgtacctctaccccggcgtcgatcacgccttcgcccgcgtcggcggcatgcacttcgacaaaccggcctacctga

SEQ ID NO: 15029 - DNA, 1854 bp, Pseudomonas aeruginosa
tggcgcgctgggcagccagcgaaggactcggcctctagcggccggctagccgccgagcaaggcgcagaaacgcgccaggtcgatgttaccgccgctgagcaggatcccgacccgcttgccgcgcaattcgtccttgcgctggcgggcggcggccaggccgaggcaaccggtgggctcgaccagcagcttcatccgcgcggcgaggaagcgcatgccatccaccagttcggcgtcgctggcggtgaggatgtcatcgacgttgcgctggatcagcgggaaggtgagattgcccaaatgctgggtctgggcgccatcggcgagggtctgcggcgtatcgatatgcacgatggcgccgctgcgcagcgaacgctggccatcgttgccggcctccggctccaccccgtagatccggcaggccggcgccagcgcgcggatcgccagggcgcagccggagagcaagccgccgccgccgaggggcgcgaagaaggcgtccagcggaccgacttcttcgaacagttccttggccgcggtgccctgcccggccagcacgtcggggtgatcgtagggcgggatcagggtcaggccatggcgctgcgccaggtcgcggccgatctgctcgcgatcttccgtatagcggtcatagagcactacctgcccgccgtagccacgggtcgcctcgatcttcaccgccggcgcgtcggccggcatcacgatggtcgccgggatccccagcaagcgcgccgagagggcgatggcctgggcgtggttgccggaggagaacgccaccaccccggcggcacgctgctcagcggaaaaccgcgacagcgcgttgaaggcgccgcggaacttgaacgctcccatgcgctgcaggttttcgcatttgaagaagacttccgcgccgagttcttcgtcgagggtacgcgaggacatcaccggcgtgcggttggcatgcccggcgatccgcgcggcggcggcgatcacatcgtcgtaggtaggcaggtcgtgcatggtcggctcctcggaccttggcaaagaagacaggcagttcgccaggttaccaggcgaacgccgccagcagcgcctgcgcgacagcatcggcggcggaagactggcggagccattgacgaagaggccctgcatgggtcgatgctccgcgatgccgggtcggcctcactcgtccaggtagccgtccctgatgcccttcgagcggcggtagaggtagagcccgaggcgcagcacgacgagcacgccgaagaacaccccgacggtcacccaggtgttgccgaagaaccattccaggcagacatagagcaacgccagcggtatgcagacgagggtcatcagcaggtaatgcttgatcattgcggcgggcactcctcttcttcgtccttcagcgggcatttgacgatctgcttgcccgtctgccaggcggcctgggtggccacggccttcttgatggtatcggcatgggcggccttgcgcgcggccagcttggccgcgcggttggcggtgttggccgcctgtccggaaagggtcctgatcgccttggcggactgcaccacggtcttgccggtgctgagcatgcccggcgccacggtgccgatggccgccgaggcgccgacgtgtttccagttgatgtcgatgcacttccacttgatatcggtgaggtcgcgatcgctgtcccagttgtccttcatctgccccagcacctgcttgccggtctgcatccccagctcgatgccggcgcccagcgccgctccgatcgcggcgcgggcggcgaaggcgccgatcaccaccagcgggatgatcaggccggtgggatcgtacgccatcgtgggcgcgttcagcgcatag

SEQ ID NO: 15030 - DNA, 2499 bp, Pseudomonas aeruginosa
ccacgggcgaaggtgaaggtgtccggcgccgccagggcgaaatcgacctcttccggcagcagcttgctgccgagcatcgggttgaccggcttgcccaccaacggcacgcaggcggacacccggtcggccaggccgaccgcgctgctgccgacgtgcacggtgggcgagccggtggagataacccctcccgagactttctcgccgacatgggaaaccggtaggccgctcatctatccatccttccttgggaaaagccgcgacaggacatccgcccgccgctcaacagttgatatcgacattgggcgagaggatctcgatctcccccggcgtcaggcggatcgtgctctggccgcagcgcaagaggatctcgcggtcggcggtcagctcgatgcgctggctgccgagggtgatgctctgaccgtccagggtgatcttagagccatcgtcgctgccgcccacgctcacttcgtagctatcgcccaccgacaaggtcttcttcttcatcacctgggtgctctggttcagcccgaccacggtgttcatcatcatgccgacgttcaggctgtagccgagcccgacgttttccatgcgccccatgccgacgttctgcaacgaggccatgaggatggtttccgtcttgttcatgccgatcctgaccgtctcgttgcggtcgaccgtcttgctgcggttggcatgcacggtgatggtctcgttgttgtccacggtctcggtgcgatcgtgcttcacatgcaccgtctcgtcgtggtcgatggtcttggtccggtcgtggccgacccagtgggtctcgtcgttctcgacctcgatgtcctggttcctctcggcatggatgaacaactgctcggcgcccttcttgtcctccatgcggatctcgttgaagttggccggcgtgccgcccttgctcgaacggctcttggtgccgctctgggtagcgttcgccggcagctcgtagggcaccgtctgctcggcgttgtagacccgcccggtgatgatcggccggtccgggtcgccttcgaggaagctgacgatcacttcctggccgatccgcgggatctggatcgagccccagttcttccccgcccaggcctgggagacgcgcatccagcaggagctgttctcgttggactggtcgtggcggtcccagtggaaatgcaccttcacccggccgtactggtcggtccagatctcctcgcccttgggcccgaccaccaccgcggtctgcgggccgcgcaccaccggcaccggggtcgacggcaaggggcggaaagcctggccggcgtcgatacagtccagctcgctctcgaactgcgcgccgcccccgccattaccggtctcgtagagttcctggactacccggtactcggcgccaaccaccaggtattcgcggttctggtccaggcgcgggtagttgctcaggtggaacagatggcccgccccgatacccctggcgcatccccgcaggcgaactcgctcgtactgggtctggatcgcctcgatgcgggtccgtgcatagtgttcgccgtcctgactctgcacatactcgccagggtagtcgtagagcgggtagtcggccgcggcatgggcgcgcccgacattggagcgcacttccaggcgggtgccgggacgctggaagtcgtagtcgttgaggctcagcgagccgggctggacctcgcgcgccatgtgccagtcgaagaagtggtcgcgctcgcggtggccgaggctcggcgggtaatagggcacgctggtgtagccggccgggctgtggtgcgcgccgtaggcatcggagagcaccaggatgtggcgcttcttttcgtggcggaaccagtagtagatgccttcctgctccatcagccggctgacgaaatcgaagctggtctcgcggtattgcacacagtattcccactcgcggtaggagcggctcagggcgtcctcgaagtcggagaagccgaggtcgcggaacacctgcttgatgatgtccgggaccttctggttctggaagatgcggcagtcggaggtgcgcgtcagcagccacagccagggccgcagggtgacctggtagctggcgaactggccggcgccggcgccctggctacagcgcgcgacgatgccgtggaaataccgccggctgccgccggggagttccagcgcgaggctcatcggcttgcccaacagggcatccagaggcaaggcgggattgctcgagaccagttcgagctcgtggctgaacagccggcccagctcttcgcgaccctccagccgttgcagttgcaggacctcgggtcccagcggggagtccacgtgtaccaggcgggtgtgttgggagaacagcatggggaatcttccttgatagtcacctgcggcgggcggcccgaacaacgcgccagcagcgcgccagatgatcgtacaacccagtgccgtcgcgaaaggctggccaatagccacgacactcctgcccgcctcctgcggacccgccgaccctaa

SEQ ID NO: 15031 - DNA, 2070 bp, Pseudomonas aeruginosa
gatattcacgaacgtgaatcattctcatatttcaatcccatctccccgcctgctgctggtcgaagacgacccgcgcctacgcgaggatctcgacgcgcatttccgccggcgcggcttccgcgtaaccgtctgcggcgatggctcgcacggactggaagccgccgggcgcgaagcgttcgacctggtgttgctggacatcatgctacccggcctcgacggcctggcgctgctggagtcgctgcgccgcgagcaggccacgccggtgatgctgatgtcggccctgggcgccgaacaggatcgcatcagcggcttcacccgcggcgccgacgactacctgccgaagccgttcagcctggccgagctggatgcccgcaccgacgccctgctgcgccgcgtacgactggaccgcctgccgtcggcgcagcggcgggatacccggctggtgttcgacgaccaggcccaggatgtgctccaccagggccttccggcggggctgacgccatccgagtaccgcctcctggcgacgctccgcgaacacgctggcgaggcgctgagcaagccgttcctctaccggagcgtgctgcaccgcagctacacgcgcctcgaccgcggtctcgacgtgcacgtctgcaacctgcggcgcaaactcgccgcggtcgccgtccgtcacctgcagatccaggcggtacgcggccagggctacctgctggtggagacggaacacccctgatgcgcaggcacccgctgttatggaaactggcgctgctgcaggtcggcttctgcctgctgctgacctggctgatctacacctggggcctgtcggtggagcgcagcacctacttcctcgccccggccgaccgcagctacctggcggactacgcgcggcaggcggaggatgcctggcgcagcgagggtgccgcgggcgccgaacgcttccgcaaggaactgtcggcgaaggaagatacctgggtggcgctggtcggaccgcacctggaaagcctcggcagcacgccgctaagcgccgaggagtcgagccacctgaccttcatgcgcaagctcgactggccgatgagccggcgcctgcaggacgaactgccgtacgtcagcatcgagttcccccgacatcccgagcagggccggctggtaatccagttaccggagcgcctgctgcccggcgggctgaccccctggacccacctggtcacccacggcatagtcccgaccctgctggccgccctgctcggcctgctgctctatcgccacctggtggtgccgctgaaccgcttgcgcgatcgcgccgacgccctgcgcgccgacgaactggaaagcactcccctcgccgcaccgctggcggcccgccgcgacgaactgggcgagctggcccaggccctggagcacatggccgagcgcctgcgcctgagtctcgcccagcagcgcctgctgctgcgcaccctgtcccacgaactgcgcacgccgctggcgcgcctgcgcatcgcccacgacagcgagctaccgccggaacagttgcgccagcgcctggatcgcgaaatcggcgacatgcaacgactgctggaagacaccctcgacctcgcctggatggacaccgagcgcccgcaactgcccaccgagccggtgctggcgctgtcggtgtgggaagcgctgcgcgatgacgcctgtttcgaaagcggctgggacccggcgcggctaccctgccgcttgggcgtcgactgtcgcgtcgaggtacacctggacagcctggcccaggccatggaaaacctcctgcgcaacgccatccgtcactcgcccgaggacggcacggtcagcctcgacggcgagcgcgagggcgacttctggcacctgcgcctgcaggaccagggccctggcgtggcggaagaccagttggaacgcatcttcctcccctaccagcgcctggacgatagcgccggcgaaggtttcggcctcggcctggcgatcgcccggcgcgccatcgagctacagggcggccggctctgggccagcaacggcaagcccggattgtgcctgcacctgtggctgccggcggccgcctga

SEQ ID NO: 15032 - DNA, 1437 bp, Pseudomonas aeruginosa
cgcccgagcagaccgtcgagttcgaggccggcttcagccgccagggcaacatttacaccggcgacacgcagaacaccaacagcaacaactgacgtgaagcagatgctcggccacgagaccaaccgcatgtaccgcgagacctactcggtcacccatcgcggcgaatgggacttcggcagctcgctggcctacctgcagtacgagaagacccgcaacagccggatcaacgaaggcctggccggcggcaccgaaggtatcttcgaccccaacaacgccggcttctacaccgccaccctgcgcgacctgaccgcccacggcgaggtcaacctgccgctgcacctgggctacgagcagaccctgaccctcggcagcgagtggaccgagcagaagctcgacgaccccagctccaacacccagaacaccgaggaaggcggctcgatccccggtctcgccggaaagaaccgcagcagcagttcctcagcgcggatcttctcgctgttcgccgaggacaacatcgagctgatgcccggcaccatgctcaccccaggcctgcgctgggaccaccacgacatcgtcggcgataactggagcccatcgctgaacctgtcccacgcgctcaccgagcgggtcaccctgaaggccggtatcgcccgcgcctacaaggcccccaacctgtaccagctgaaccccgaatacctgctgtacagccgtggccagggttgctacgggcaaagcaccagttgctacctgcgcggcaacgacggcctcaaggccgagaccagcgtgaacaaggaactgggcatcgagtacagccacgacggcctggtagcggggctgacctacttccgcaacgactacaagaacaagatcgaatccggcctgtcaccggtcgaccacgccagcggcggcaagggcgactacgccaacgcggcgatctaccagtgggagaacgtgcccaaggcggtggtcgagggcctcgaaggcaccctgaccctgcccctggccgacggcctgaagtggagcaacaacttcacctacatgctgcaatcgaagaacaaggaaaccggcgacgtgctctcggtgacgccgcgctacaccctcaactcgatgctcgactggcaggccaccgacgacctctcgctgcaagccacggtcacctggtacggcaagcagaagccgaagaaatacgactatcacggcgaccgtgtcaccggcagcgccaacgaccagctctcgccctacgccatcgccggccttggcggcacctatcggttgagcaagaacctgagcctcggcgccggcgtcgacaacctgttcgacaagcgcctgttccgcgccggcaatgcccagggcgtggtcggcatcgacggggccggcgcggcgacctacaacgagcccggacggaccttctataccagcctgaccgcgtcgttttga

SEQ ID NO: 15033 - DNA, 810 bp, Pseudomonas aeruginosa
gccataacgagaaagcctgatgagaacctccctgctcgtcgccgccctgggcctcgccctggcggcggccctgcccggcggcgcgccgctggcgcaaccggaccccgaggcgaccatggaccgcagcctgctgcaacgccaggacctgccctatcgcttcagcgccgtggacctggattccgtcgatggccagcggcattaccggctgtggctcggccgaccgctgcaggcaccgcccgccgccggctacccggtggtctggatgctcgacggcaacgccgccgtcggcgccctcgacgagtcaaccctgagacgcctggccgacggcgacgcaccgctgctggtcgccatcggctaccgcacgccgctgcgcatcgaccgcgccgggcgtaccttcgactacacccccgcgagtcccggccaggccgatcagcgcgacccgctcaacggcctgcccagcggtggcgccgacgccttcctcgacctgctgcgcgacggcatgcgcccggccgtggcggcgcaggcgcccctggacaccgcgcgacaaaccctctggggacactcctacggcggcttgctggtgctccacgcactgttcacccgtcccggcgagttcgcccgctacgccgcggccagcccgtcgctgtggtggcgcgacggggcgatcctcggcgaacgagcggggctcgaacagcgcctgcgcggaaagcgcgcggaactcctgctctggcgcggcagcgccgaaccggccagcccgcgcggctcgctgaaagccgagccgggccaggcgatggcgcggctggtagatga

SEQ ID NO: 15034 - DNA, 771 bp, Pseudomonas aeruginosa
gggaaaatcgccctacgctaccaccggaatcagcgggtcggccgctgccagcgccacggcgcggtccgccgccggcgggtagatccacacgccattgatctcggtcttgatcttcttgccctcctcgcgcacgaaccgtacctggcggtcccagccctcggtgaacaccgcgccccagccgccgagatcgagacaggtcacgtatttcacctggctgtagggaatcggctcgacgccgagcaggtcggcggccacgttattgccggccgagcgacccagggcgatggcgtgctggcaggtcatcagggcatggttgccgagctcgtcggtagccgcgcgggccacgtcgccggtggcgtagacatcgtcgagaccgagcaccttgaggttgcggtcgacatgcaggcgaccctgggcatcgcgctcgcccggaatctgcccggtcagggtgctggcccgcacgcccacggtccagaccacggtcttcgcctcgatccgctggccgtcgtcgagcgtcacgccctcggcatccaccgccgccaccgaacgccccaggcaccactccacgcccagttccgccgaggcctcggcgatcaagccgctcaggtccgcgcccatcgatgcgccgatggcggcgccgcgatcgaccacgatcactcgcagcgccgctttctcgccgaggatcgcccgcaggcgcgccggcatctcggtggcggtctcgatgccggtgaagccgccgccggcgaccaccacggtgttgcgtgccggtga

SEQ ID NO: 15035 - DNA, 504 bp, Pseudomonas aeruginosa
acgatggaacctggcagctaccaactgaccatgagcgtgctcatgacccccgacaaggcgaacttctccggcaacgtccacggcggcgcgctgctcaagctcctcgacgaagtggcctttgcctgcgccaagcgctacgccggacgctacgtggtgaccctgtcggtggatcaggtgatcttccgcgagccgatccatgtcggcgaactggtgaccttcctcgcctcggtgaactacaccgggcgcacttcgatggaggtcggggtgaaggtgatgaccgagaacatccacgagcgcaccgtgcgccataccaacagttgcttcttcaccatggtggcgatggacgaccagcgccggccggtggcggtgcgtccgctggagccggagaccgcgatcgagaaacgccgctacgcccaggccctggcccggcgcgagcagcgcaagctgatggaactgcgctaccaggagatccgcgaacaggtggatcacgcgatgccggcctga

SEQ ID NO: 15036 - DNA, 579 bp, Pseudomonas aeruginosa
agcttcatcttcgttctccttcgcggccgtgccgcccggcggaccggagcggcacggccggcattcacttggccggattcgggccgatgcgttcgccgtgggtcacccgctcgggcgccttgtgcaccatggtgtaggcgtagtccacgcccatgccgtaggccccggaatgctccttggcgatggccatcacggcgtcgtaggtatcccggcgggcccagtcgcgctgccactccagcaggacctgctgccaggtcaccggtaccacgccggcctggaccatgcggtccatggcgtacttgtgggcgtcgctggaggtgccgcccgaggcatcggccaccatgtagatctcgtagccgccctcgagcatggcgcagagggcgaaggtggtgttgcagacctcggtccacagcccggcgaccacgaccttcttgcggcccgcggcggccagcgagtcgcgcacgttctggtcgtcccaggagttcatcgaggtgcgttcgaggatcttctgctcggggaacaccgccagcagctccggataggtcgggccggagaagctgtcggtttccaccgtggtga

SEQ ID NO: 15037 - DNA, 969 bp, Pseudomonas aeruginosa
ttcgcgaactggccgaccagggccagctcaccgtacgcatcgcctacaacctgttcacccagaaaccgaaggaagaactcgccgacttcaagaactggaccggcagcgtcaagtacggccagggcagcgatttcttccgccacaacggcgccggcgagatgctggtgttctccgccgccgacttcgaggacttcctcgaaccgcgccctgacctgccgcagaccatggagcaggagctggagccagtggtccgccacctggtggagcagcgctggccgttccgcctgcacgccacctacgatgaatcgatctcgcggatgctcgacgtgttcgagaaggtcgaccgcgacattccgttcaacggcctgccctggttcttcgaccacgccgagaccatcaccccgtgcaacatcgagcgggtgcgggcactcggcggcggcatcgcgatccaggaccgcatggccttccagggcgagtacttcgtcgaccgctacggtgccaaggccgccgaggccacgccgccgatccagcgcatgctcgccgagggcgtgccggtgggtgccggcaccgacgccacccgggtctccagctacaacccctggacctcgctgtactggctggtcagcggtcgcaccgtcggcggcatggccctgtatccgcagggcctgccgcgggaaaccgcgttgcagctgttcacccacggcagcgcctggttctccagcgagcagggcaagaaaggacagatcaaggttggccagctcgccgacctggcggcgctgtcggcggacttcttcggcgtcgaggaagaggccatcaagtggatcgagtcggtgctcacggtggtcgacggcaaggtcgtctatgccgccgccgagttcgacaagctcggtccgccggcgccgccggtgctgccggactggtcgccggtggccaaggtacccggccactggcggcaaggcgcgccgctga

SEQ ID NO: 15038 - DNA, 2109 bp, Pseudomonas aeruginosa
ggtgggcgccggctggctgatgacctcgctctccgccagcccgctgaacgtggccctggtacaggtcgccggatcgctgccgatgttcttcctggccctgccggccggcgccctcgccgatatcgtcgacaagcgccgctacctgctcggcgtgcaattgtggatggccttggtggccaccctgctggccagcctcaccctgctccagttgaccagcgtctggctgctgctcggcctgaccctgtgcatgggcatcggcaccgcgctgatgatgccggcctggagcgccaccactccggaactggtgggcaaggacgaactgccggcggcggtggcgctgtccagtgtcggggtcaacctggcgcgggcggtcggaccggccatcgccggggtgctggtgagcctggtcggcccctggctgaccttcgccctcaacgccctctccttcttcgcggtgatcgccgtgctgctggcctggaaacgcgaggccgtgccctcggtgctgccggcggaacgcctgttcggcgccctgcgcgccggctggcgctacagccgcagctcgaggccactgcaatcggtgctggtgcgcgcggtggcgttcttcctcggcgccagcgccggcatgtcgctgctgcccctgatcgtgcgcggcgaactgcatggcaacgccatggacttcggcctgctgctgggcagcgtcggcgtcggcgcggtgctcggcgccgcgttcctgccgcgcctgcgcgaacgcctcggcagcgaccgcctgatgctgctctccagcgtgctctacgcactggtgctgctggccctggcgctgctgcgcaacctctatttgctggtgccggtgatgctgctcagcggcgcggcatggatcgccgtgctctccagcctgcaggtcgccgcgcagacctccgtgccggcctgggtccgcgcccgcgcgctggcggtctacatcctggtgttcttcggcagcatggccgccggcggcgccctgtggggtctggtcgccagccacctgtcgatcaccttcgccctgctctgcgccagcgccgcgctgctgctcggcctgttcgcgtcgctgcgctgccggctgccggtcaccgaggccgaggacctcgcgccgtcgctgcactggccggcaccactggtcgacgaagaggtggaccaggaacgcggcccggtgatggtcaccctcgagtacgacatcgacccgcaggacgccgcggcattccaggcggcgatggtcgaggtgcgcgccatgcgtcggcgcaacggcgcggtgtcctgggggctggtccaggacagcggcaaccgtcgcctgtggctggagtttttcatcgacgaatcctggctggaacacctgcgccaccaccagcgggtgacccgcggcgagttgcgggtcgaggccgccgcccggcgcttccagagcgccggcgtggaggtgcgcatccgccattacctgcacggcgcggccaggccttgagcctcccgggcgacggtcgtcgcctgcccctggcggatccgcccacggctgttatcctgctcgccgatggcgccacaaggacggtggccggtagcgatgccgcgcacccgcggcgccgcgaacgcaacccacagggaagtccacgcatgtcctacgactacgagaaaaccagcctcaccctctaccgggcggtattcaaggccaactacgacggcgacgtcggtcgctacctgcgtcccgacaaggaactcgccgaggctgcggaagtcgccccgctgctgcatccgaccttcgacagccccaacacccctggcgtccccgcccgcgcgccggacatcgtcgccggccgcgacggcctctacgccccggataccggcggcacctcggtgttcgaccgcgccggcgtgctgcgccgcgccgacggcgacttcgtgatacccgacggcaccgacatcccgccggaccttaaggtgaagcaggacagctacaacaagcgcctgcaagccacccactacaccatcatgccggccaagccgatgtaccgggaggtcctcatgggccaactggacaacttcgtgcgcaacgccatccgccgccaatgggaaaaagcccgcgggctctaa

SEQ ID NO: 15039 - DNA, 681 bp, Pseudomonas aeruginosa
cccagtaaccaccgacccgcggcgccgcagcgaaccggcgccgccttgcgccaggcgtatcgaatcatgctggaaacctcgctcttcgtagccaccctcgccaccctgggcatgctctcgcccggcccggacttcttcctgatcatccgcaacgcggcgcgctaccagcgctcggcggcgatgatgacctcgctgggggtgattctcggcgtggccacccacatggcctactgcgtcgccggcctggcggtgctgatcaccaccacgccgtggctgttcaacgcgctgaagtacaccggcgcggtctacctgatctggatcggcatccaggccctgcgctcgcgcggcggcggcacgctcgacctggcggtcggcggcgtgcagcgcgtcggccactggagcgcgttcctccagggctacctgtgcaacctgctcaaccccaaggccacgctgttcttcctcgccgtgttcacccaggtgctgagcctggactccagcttcgccgagaagctctggtacgccggcatcatcgtcggcctcgccgcactctggtggccgctgctggtggtgctgatccagagcgcggtggtgcgccgcggcctggccagggcccagggggtggtggacaagctgctcggcggcctgctgatcgccctcggggtcaaggtcgccctgagttga

SEQ ID NO: 15040 - DNA, 1290 bp, Pseudomonas aeruginosa
ggcaggcgggcggagcgacgccccgctgcggtgccggcgcctgtctgcgggcccgcaggtaaaagccgcccctttcctcgcttccggcaacgcgggataaaacccgggtgccggccagcgttgccggcgccccctgagcgccggcggcgaaccagtccgtcgccgacgctgtcgtcagccgacaggacacctacaacaatgaagacccgcatcgcttccctcaccctcctcgccctcgcttgcggcagcggcgcaaccctcgccgcggacaacctgaagatctacaactggtccgaatacatcgctcccgaaaccgtggcgaacttcgccaaggaaaccggcatccaggccacctacgacgtctacgacagcaacgagaccctcgacggcaagctgatgaccggccaatccggctacgacgtggtattcccgtcgaaccacttcatggccaagcagatccaggccggcgccctgaagaagctggacaagtcccagctgcccaactggaagaacctcaacccggtgctgctcaaggccctggaggtcaacgatccgggcaaccagtacggcttcccctacctctggggcaccaccggcatcggctacaacccggcgaagatcaaggcggtgctcggcgacgacgcgccgctggactcctgggatatattcttcaagcccgaatacatgcagaaactgagcaagtgcggggtggcggtgctggacaacggccccgagctgctgcccatcaccctcaactacctcggcctgccacaccacagccagaaggccgacgactacaagcaggcccaggcggcgctgctgaaggtgcgcccgtacatccgctacttccactcctcgaagtacgtcagcgacctggccaacggcgagatctgcatggtggtcggtttctccggcgacatcctgcaggccgcgacccgcgccaaggaggccaacaacggcgtggaagtgcgctactcgacgccgaaggaaggctcgccgctgtggttcgacatggtctcgatgccggtcgacgcgcccgacgagaaggccggctacgccttcatgaactacctgctgcgtcccgaggtgatggccgcgatcagcaaccatgtgcactacgccaacggcaacctggccgccgacccgctggtggacgccgagatcaaggccgacccggcgatctacccgccgcaggagaagatggccaagctgttcgccctcgagtccatgccgcagaagatcgaccgcgtgcgcacgcgcacctggaacacggtgaagaccggcaagtga

SEQ ID NO: 15041 - DNA, 432 bp, Pseudomonas aeruginosa
tgttcgtcttccgcaaggccggctgagcgaaccgagcgggtcgcggcccgcccttggcagagcgcgcgcggattcagttctgcgcgagcttgccagccatcgccgcgaaccccggccccggcaccgccgtcacatcgcgcgcccccaccggctcgccgcactccgggcagaccatggtcggccggaacttgtggccacaggccttgtgcacatactccaccggagccgccgcggccctcgtcgagccagcggtcgccccaattggccagggccagcagcaccggatgccaggtcctggcccatgtcggtgaggcggtattcgtagcgcggcggtcgcttctggtaaggcaccttccttcagcgcgcccgcctccaccagccggctcaggcggtcgaccagtacctggcggggtgaccccgaggctggcctga

SEQ ID NO: 15042 - DNA, 1119 bp, Pseudomonas aeruginosa
ccagcgcatgcgcgaagccatgcgcgccctggagttgtcggtggtgatcgacgtggccatgaccgagaccgcgcgccacgccgactacgtgctgccggcggcgagccagttcgaaaaggccgaggcgaccttcttcaacctggaattcccgcgcaacgccttccacctgcgcgcgccgctgttcccggcgcgccccggcaccctgccggaagcggagatccacgcccgcctgctggaagccatgggcgtgctcggcgagaaagactaccggccgttgcgcctggccctgaagctcgggcgcaaggcattctcggcggctttcctcgccgccgcggcgacccgccccaaggtcatgaaatacgcgccggtcctgctctaccgtaccctcggcccgaccctgcccgccggcatggaagcggccgcggcgatctggggcatctgccaactgcacgtgctgaacaaccgcaagaccgctgcccgcgccggcttcgacgggttgccgccgctggccgccgaccgcctgttccaggccatgctcgacaacccgtccggggtggtcttcgccgaaaccacctacgccgaaagctggcaggccgtcgcccgtcccgaacagcggatcaacctgcacatccccgaactgttgccggaactggccaagctcgcccacagcgcgccaccccacgatccggcctacccgttcatcctcgccgccggcgagcggcgcagcgacaccagcaataccgccgtgcgcgacaccggctggcaccgccgcgggcgctacggcaccctgcgcatcagcccgcaggacgccgaggcgctgggctgcgccgacggcgaggtgctgcgcgtggtgacccgccgcggcgaggtcgaggcggaagtggagatcagcgacatgatgcagccgggcaatatctccctgcccaacggccagggcctggactaccgcaacgccgagggcgaggtggtgcgccggggcgtggcgcccaacgaggtgaccgactgcacccagcgcgacttcctcgccggcacgccctggcacaagtacgtgccggcgcgcctggaacggctggcgacgcccgccgctacgaacgcctgagccagggaggacgatcatga

SEQ ID NO: 15043 - DNA, 537 bp, Pseudomonas aeruginosa
tcgccgccttcggcaccgggtcgtcgggatagcgggcgatgtagtggacgacctcgccgccgccggtggaatggccgacatggatcgccccgcgcaccccgaggcgctcaaccaccgccgccacgtcgtcggcgtagtggtccatgtcatggccgtcccagacctggctggagcgaccgtggccacggcgatcgtgggccactacgcgaaagccctcggcgaggaagaacagcatctgcgcatcccagtcgtcggaactcagtggccagccatgatggaagtagatcacctgggcgtcgcgcggcccccagtccttgtagaagagttcgacgccatccttcgttgtcacgtaacccatgtcgcttctcccgatcggtgtggatgcaggcaacggcgccaccctgcggccgccgtcccctgtgtaaagtagaaagccgcctgcgttgcgccgcctggacaaggaaaacgcgaccggcggtagcgcccatgcggcctggcgaacccgtcgatggaggcgagttcgtcgcccggccgtga

SEQ ID NO: 15044 - DNA, 789 bp, Pseudomonas aeruginosa
ccctgcgaatcctgccagtcgagagcggccaggttctgcatgccggcctcccacggctggttgtcgaacagcgcttccaccgtgcgctggttgccgaaggcacagaagaaatgccggaaccagtgcaggcgcgcgtccagcggctcggtgcggatcgcccgctcgatgctcgggaacagcccggccggcagcggcggcgccttgccttcggcgccgcgcaggccgaggttgccgatatgcacctcgaaacgccgctcgccgatctcccaggtctccaccatcacctggtcctcctcggcctggccccagagcgcggaaagcagcacgtggaaagagctggaggcgaagttacgcaacgcgtcctgcaagccgtcctcggcgctgccgatgccggcgaaggcttcctgcaactggtgctcgtcctccagcagcacgtcgacatccagccgtccggtcttctcccccgcataccaggtggcgcggatcgccggtagccgcccggctggcgccacccattcgccgtgcacgacgcagtcgatccggtgggattcgaacagagcagccagatgctgcgagacggagaccgcttccatgggttgtccttgcatggtcgagggcgcgccgccgaggcgctgcccggaaagcccggcgaggccgggcgaaacgcggcatagggtagcgcagatcggcactcgcggcgcgacctcccgttcggcgcctgcccaggtcgccgcacgccagccgactagactggcggggtcgaccccgcccgtggagacctcgccatga

SEQ ID NO: 15045 - DNA, 444 bp, Pseudomonas aeruginosa
agaaggcctgcaagggctgaacgccccaacgccttgcaaaggagtcacgaaatggatcgattcaccggcggctgcctctgcggcaaggtccgcctggtggcgagcggccgcccctaccgggtcgggctctgccactgcctcgactgccgcaagcaccacggcgcgctattccacgcttcggcgatctttcccgaggaggcggtgagcatagaaggcgagacccgcgactatgccgggcgtttcttctgtccgcagtgcggctcctcggtattctcacgcagcgccgacgagatcgaggtcagcctcggcgccctcgacgctcccgaccggttccagcccacctacgaactctggaccgtccgccgcgagggctggttgccggcgtttccgctggcacggcactatgaaagggatcgcgaaggcgacggacgcagcgaagagtga

SEQ ID NO: 15046 - DNA, 438 bp, Pseudomonas aeruginosa
tcgtgtgcacctcgaacctgggcatctaccgccagggggaaaacggcgaacgggtcgccaacgtgctccccggcgagcccttcgaggcggtgcagggcaaggtccacggcgagatcgagcgctacttcaagctggttctcaaccgcccggaaatcctcaaccggatcggcgagaacatcatcgtcttcgacttcatccgcgccgacgtcgccgagcagatcttcacccagatggtcgacggcaccttcgccgacctccgcgagcagcgcctcgtcatcgaactggccgaggcgccgcgccaggcgctgcacgacctctgcctgggcgacctgtccaacggcggccgcggcatccgcaaccagctcgaagcgcgcctgctcaacccgttgtcgcgggcactgttcgaccaggacgcgcagccgggcgagcgcttcctga

SEQ ID NO: 15047 - DNA, 657 bp, Pseudomonas aeruginosa
ccctggaacgccgctgagatggaactgagcctgtcgcgggtgcacttcccggtgaccaccctgggcccgggacggcgcctgggcatctggttccagggctgtagcatccgctgccccggctgcatctccgccgatacctgggggccgggacggcggcgcatcgccctggcacgcctgctcgccgacatccagccatggctggagcaggccgagggcatcaccgtctccggcggcgaacccttcgagcagttcgctgccctcctcgccctgctcggcgaactgcgccagcgcagccgcgccgacatcctggtctacagcggctacccgctggagcatctgcacgcgcaactggaacaggccgccgggctgatcgacgcgctgatcagcgacccctaccaacagcacgccgaacagagcctggccctgcgcggcagcgacaaccagcgcctgagcctgctcaccgaactcggccgcgcgcgcctcggcggctaccagcggccactgcgcgaagacgacaaggccctcgacctgatgttcgaccatgacggcagcgtgtggatggccggcatcccgcgccgcgacgacctgctgcggctacaggacctgctgcgcgaacagggccaccaacttagcgtcagcgcccatcggccgcgctga

SEQ ID NO: 15048 - DNA, 459 bp, Pseudomonas aeruginosa
atttgcgcgaggagcagcgccagcgcctggcccactggctgccgctgttccgcgacgccacgccagggcagccgagccgtggcgacggcctgctggcggaggccgagcagatcgaacggcaactgcgccagctcgacctcgaacggcatgcgccgctgctgtcgccggccctcgccatgctcgaagagaacaacctcgaacgcttccaggcccacgcccgccaggtgctcgaggcacgcacctggctggctcggctcaacccgctgcgcctgctgcggcgcggccgcctgcggcgcttcctgcgcgagcacggcgaggccgacgacgacagccgcctggccgccctcctcggcgcctgcgacctggagcgccagtggcggccgctgcgccggcaactggcggcgctgcaacagagcctggggctggcgacagtcgccaccgatgccggtccggaactga

SEQ ID NO: 15049 - DNA, 777 bp, Pseudomonas aeruginosa
tcacctcgatgccgatcggcgacatctccgacatgctcggcacccagcgctcgccgagcagcccgcgcgactacctgcaaggctacctggaatacgcccgcgcactgtccgccggcgagttcgccggtaccggccaactgctcgagcgcctgcacaccgaccgcagcgaccagcgccgccagcactaccagcgacacgacggcttcagcgagatcgtcggcgagtacatccgctcgctgggctggtccgccgcacccgccggcgaaggcgacgccttcggcctcgacttcgccatcgagaacccggccaccggcctctacgccatcggcatcgaatgcgacgccccctgccacccgctgctggaacgcgcccgcgcccgggaaatctggcgaccctcggtgctgcggcgggcgatcccgcacctccaccgggtttcctcccagggctggtaccacgacggcgacaacgaacgcgcacggctgcgcgccgccatcgagaaggccctggcgcccagcgcggaaacccatcccacggcagcagcggaggcctcccaatgagcggaccgaaagttgtaagaatcgtcacccgggaagaagccatcgccacctgcgagcgcgacctgcaacgcctggacaaggccctcgcgcgctgggaaaaccaggccagccggctcgcccagctcagcgacgccgagcgcgccgccgcccacgcccgccgcgccagcctgcacgccctggctcgaacaggaacgctggctggacgtgcaactacaggtga

SEQ ID NO: 15050 - DNA, 765 bp, Pseudomonas aeruginosa
agaccgacgaaacgcccatcaccctggaacagtggcgcgcccgccagcaacaggacgccccgcgcgaacagcgcctggcgcgcatcgaccggcacatcgccgaactgcaactgctgcaaggcgaggccagcgcccaagcgttcctcgagcgactggcacgcgccgaagccgaacagcgcccggagcgccgcaacctgctgctcgacagcctggtcctcgacctcgcccaggccgcccgcgaacaccagcagcaacgccagcgcctggaacacctgcaagacctcgccagcgaagtcgccgccctcggcgccgccgaacacgccgaactgctccagcgcgccgccgcctgccagcccgacagagatccgcagcaactcgccgaactcaccgagcgatgcaacgccatcctcaccgcccacctccagcaacaggccgccctcgcccgccgccaggccgtgctccagggcctcgccagcctcggctacgaagtccgcgaaggcatggccaccgcctgggcgcagaccggcagggtcgtcctgcgcaaacccgccacccccggctacggcctggaagtcggcggcaaggccgacaacggccgcctgcaactgcgcgccgtcgccctcaacgccaaccgcgacagccagcgcgaccgcgacatcgaaaccctctggtgcggcgagttccaacgcctccaggccctgctcgccgcccagggcggcgaactcagcgtggaacgcgcgctgggggtgggagaagtggcgttga

SEQ ID NO: 15051 - DNA, 276 bp, Pseudomonas aeruginosa
gcaagcaacgacgtacgttttccgccgagttcaaacgagaggccgcggccctggtgttggaccaaggctacagccatatcgacgcctgccgttcgcttgggggtggtggattcggccttgcgccggtggatgaaacagctccagcaggagcgcgatggcgtgaccccgaagagcaaggcgctcacccccgaacagcagaagatccaggagctggaggctcggatcaaccggctggagcggcagaaagcgatcctaaaaaggctaccgctctcttga

SEQ ID NO: 15052 - DNA, 423 bp, Pseudomonas aeruginosa
acaggccatgttgagcggccggatatcccgaatcggctgaaccgcgagttcgcgaccgagcatcccaatcaggtgtggtgtggcgacatcacctacgtctgggcgcaaggccgttggcactacctggccgcggtgctggatctgcatacccggcgggtgatcggctgggcgttctcggccaagccggatgccgaactggtgatcaaggccctggacatggcctacgaacagcgcggcaagccacagcaggtgctgttccattcagaccagggcagccagtacgccagccgcctgtttcggcaacggctctggcgctatcggatgcagcagagcatgagtcgccgagggaattgctgggataactcgccgatggagcgcctgttccgcagtctgaagtcggagtgggtcccgtcaacgggttga

SEQ ID NO: 15053 - DNA, 261 bp, Pseudomonas aeruginosa
gtacgggcataccattacctgcttgccacgaagatcgcgccccttggtaacgccgccaataacgaccgccacttcatcgaaagcggtgaccgcccaatgatcggggtagatctcttcgcactcagccatgccaacaagcttttggcgacgtatcagaccgcctgtaatgtactgagcccgcaatcgcgagcaatccgctttgattgcatcaaggtcaggtggggcctcagaggcctccgcaagcagaccgcggactgctag

SEQ ID NO: 15054 - DNA, 1068 bp, Pseudomonas aeruginosa
cgtggcattgaacctttcttccaacgacgtgacgatgttctgcgtcgtgctattgacttcatcgtcattaagagtgcgcgatggatgctgccaggtcaagccgacggcaaggctttttctatgcggatcaatgcctttaccgtgatacacatcaaacagcctgaggtccgtcagccattcgccggccgccgcacggatttgtgtcaggatgtcttgtgccggcacgtcctgatccaccagcagcgccaggtcgcggcgcacttcggggaagcgcgacagctcgcggaacttcggcaggtgaccgtcgaccacttcggccaacagcagctcgaagaggaacaccggctgctcgaggtcgagtttcttcgccagttccggatgcagcgcgcccaggtagccgaccagccgcccgtcccgctcgatgcgcgcggtctgccccgggtgcagcgccgggtgctcaccgggcacgaagctgaagtcgccgagggcgccggcactggccagcactgcctcgacatcggccttggcgtcgaagaagtccacgccgtcacggccgttggcccagccttccggcaggcgcttgccgcagatggcgccggcgagcatggcttcctgcttcaggccttccagttgaccgacgaagcgcaggccgctttcgaacaggcggacccgcgactgctggcggttgaggttgtgctgcagcgccttgaccaggcccggccagaggctggaacgcatcgccgccatgtcggcggagatcgggttggccagggtcagcggctgggtgcccggatcgaacagttcgaacagggccggatcgatgaagctgaaggtgatcgcttcctgatagccgcgggcgaccagcaggcgccgcagcagcggcagcgcggcgcgcgcttccggcttgttgttcggcgccaggcgcgcctgcgggtagcgcaccggcaggcggttgtagccgtagagacgggccagttcctcgatcaggtcgacttccagggaaatgtcgaagcgatggctcggtacgccgaccgaccactgcccttccccgtcggctaccaccgttag

SEQ ID NO: 15055 - DNA, 1512 bp, Pseudomonas aeruginosa
ttccagggcttgcagcaggcgcacgatctcggcggcgtccagcggcatgccgagcatctgggtcacgcgctcggcgcgcagggtgatcggcgcgaccttcggcaggtgcgcttcgctgacctgctcgacgatcggccccggttcaccgccgacgatgtcgaggatcaggcgcgtcgcgcgctccatggccttgcgcgccaactggctgtcgacgccgcgctcgaagcgatgcgaggagtcggtgtgcaggccataggagcgggccttgccggccagggcgatggtgtcgaagaacgcggcttcgaggaacaggtcgcgagtgctgtcgctgacgccgctgtgctcgccgcccatcaccccggcgatggccagggcgcgctggtggtcggcgatcaccagggtgtcggcgcgcagggtgatttcctggccgtcgagcaggaccagcttctcgccgtcctcggccatgcgcacgcgcacgccgccgttgatctcggcaaggtcgaaggcatgcatcggctggcccagttcgatcatcacgtagttggtgacgtcgaccaccggatcgatactgcgaatgtcggaacggcgcaggcgctcgaccatccacaacggggtcggccggctcaggtcgacgttgcggatcacccggccgaggtagcgcgggcaggcagccggcgcggcgagctcgaccggacgggtctcgtcgtgctgcgcggcgaccgcgtccaccgccaccggcgccagcggtacgtcgtagatggcgctgacttcgcgggccaggccggcgagcgacaggcagtcaccgcggttcggggtcaggccgacctcgatggtgtagtcgtccagctccaggtaggtgcggacgtcctggccgaccggcgcgtcggccggcagctcgagcagaccggcgttctcttcgctgatctgcaattccttggccgagcagagcatgccgaaggactcgacgccacgcagcttggctttcttgatcttgaagtcgcccggcagttcggcgccgatcatggcgaagggaatcttcaggcccgcgcgcacgttgggcgcgccgcagacgacctggaaggtctcgctgccgttgctgacctggcagacgcgcagcttgtcggcgtccggatgctgttcggtcgagagcacctcgccgaccaccacgccgctgaaggcgccggcgaccggcaggtcggcgtcgacctcgaggccgaccatggacaggcgagcgaccagctcgtcatgggaaacctgcggatttgcccagctccgcagccacttttcactgaatttcatcctgttctcctaaggaatccggttgcgttctggcctagcggaattgtccgaggaagcgcagatcgttatcgaagaacagacgcaggtcgttcaccccgtagcgcagcatggccaggcgctcggcgcccatgccgaaggcgaagccctggaatttctcgggatcgatgttggacatgcgcagcacgttcgggtgcaccatgccgcaacccatga

SEQ ID NO: 15056 - DNA, 339 bp, Pseudomonas aeruginosa
cgcagcatcccgactcctgtcagtcatttcatccctgatgctgacccgaacgaccttgcatcgttctgcgccagcctgccgaagcgccgaacgggcaggccagccctggccttcccttccgacacgagcgggggccggtcgatcctcgcccagccccctcgaagcttcactctagcactctcgcccgccctgccggaggtctccgccaggattccggacgaaccgttcagcccgccatgtagctcggcaggccgcgctcctgcagacgacgcagggtgccgaccacatccaccggcaggctccccgcctccagggccaggtcacggcgcacggcgttga

SEQ ID NO: 15057 - DNA, 1248 bp, Pseudomonas aeruginosa
gaccattcaaaatcaataacttacgaaaatactcagcgaagcggtccgtgcaaactgcaagatcgtgcgaaatgcatcatgcgatttgccagcaggctcagtcggaaaacagcggccggccccgcgcatcgaagccgcgcacccggtacagcgccgcttccgccagcgacagcgcggccgccggactctcgcacggcggctggcccggcagcaccagccattcggtgcgtccgtcgtcgatgctggttatctcgatctcggccagatagccgctgtcctcgcgcaaccaggtggcgcgcagttcgaactcgccaaaacgcctgccggacacccgccagcctcccttcggaaaagtcgtcgcagtgtaaccaggccgggcgtcgatcagccagccaggtcggccagcgcctcgcgctcctcgtcgcgcagggtcaggacccggcaaccccgctcggtgaccagcacggtgtgctcgtactgggccgacaggcggcggtcgcgggtggtcacggtccagccgtccttgtgcagcttcaccgcgtggccgccctggttgatcatcggttcgatggtgaaggtcatcccggccttcagccgcgcacccgcgccagcgcgaccgaagtgcaggacctgcggcgcctcgtgcatcttgcggccgatgccatgcccgcagtattcgcggaccaccgaataaccgttggcttcggcgtgactctggatggcatgcccgatatcgccgagggtggcgtccgggcgcaccacgcggatcgcccggtacaggcattcgcgggtgacgtcgagcagcttctgcgcctggcggtcgatggcgccgacccggtacatcttgctgctgtcgccgaaatagccgtccttgatcaccgtgacgtcgacgttgacgatatcgccgtcgcggaggatctgctgcgccgacggccagccatgacagaccacctcgttgaccgaggtgttcaccgtgaacggatagccgtactgccccttgctgccgggaatcgccgcgagggtgtcgacgatgtagcgctcgcagaagcggtcgatctctgccgtgctgatgcctggccgcaccacctcgtcgagggcttcgaggactttcgcggtgagcgcgccggccacgctcatgcgctggatttcctccgcgctcttgatcatcccgagatcctcgccgcgtcctgctcgcggcggtcgctttcgcgcgcttcgtccatcaattggcgtagcacctgcgcatag

SEQ ID NO: 15058 - DNA, 1494 bp, Pseudomonas aeruginosa
aggcgattacctggaggccagggatcgcagttctcgtcttttggggcatctgcgcgccatcgaaaaaaccctcaaaacgctcgccgcatcacgatgagcagaacgctgcgcagctggcagaacagctgcatcaccaaggcgctggaacacttcaccgtcacgccgcacttcttctgccaggctacccctggggctgggaagacgcgcatggccgcagaactggccagtcgactgcttgaggaaggcaggattgatctggtgctgtgcttcgccccgtcctgccaggtcgttgagggttttcgttcgacctttgcggaagtgctaggcaggcgacttgatggccagataggtgccgtgggcgcggcctatacctatcaggctatggaataccgtgatgagggattctggcagctgcttgatgattatcgggtgctcgtggttttcgacgagatccatcattgcgccggccacgatccgctgctcagcaatgcctggggacagcagatactgcatcggatacaggatcgggctgccttcacgttggccctgtctggcacgccctggcgttcggacgacaaggccatcgcattggctcgctactcttcgcccgaggggcatttgatctgtgattaccgttatggcttgaaagatgccattgccgacggcgtgtgccggtcccctcgaattgttctgctcgacaatcagaaggtgaaactcacggaagagcttggtgcggatagctccgtgaggctgtttcccagcatcgccaagctgctgggcgagtcacctgtgacttatgaggaactgctgcgccatgacgaggtgatcaatccaatccttgaccttggctgcagcaagctgagcgagctacgaaagatcaagcctgattctgccggtttggtggtggccaccgatattgaacacgctcagcaaattgcactcgctctggaagcaatgggtgaagagtaccgtatcgtgaccaacaaaaccccggatgcgcagcaggtgatcaatggattccggagcagcacctgccgctggattgtcgctgtcggaatgatcagtgaaggcaccgacatcccgcgcctgcaggtttgctgctacctcagccgtatccgcacggagctgcattaccggcaagtaatgggacgggtgctgcggcgcacaggtgaatcggatgatcaggcgtggctattcatgctagcggaaccgacgcttcagggctttgcggagcgaattgcggacgacctgccggatgatctagcggtattgagtgatgtgcttatgccaagtcttgctacaggctcaaggcctgagccgattggtgattttgaccatatcgaaggtattcatggtgctggcctaggagacgcggagtcggataatgggttgcaggctgcgaacgtcatttcgctgggtggttttggagctgaacctgcttatcaggtcagcttttcccagcattacaggcagcagttgttggcttgcttttga

SEQ ID NO: 15059 - DNA, 507 bp, Pseudomonas aeruginosa
cctctcatcgagtccgctcaagtcgatctggcgaagagctttgagcgccaggccaccctcctcgatgtcatcgccggcagagtcgaggaacctggcaccaagcgctcgcagcattccggtaccgccatcattggtcgcgctccccccaaaccccatgatgattcgttgcgcgccagaattcagggcttgctggaccagttgaccggttccgaaggtggacgcgcgcgtagcgtcgcgttccgcggccagaaccaagtgaatgccactggctgccgccatttcaatcacagcggtgcgagactcgttaagccagccccaagccgcttggacttccgccccaagtggtccttggacggtactgacccgccgctctccaccggtggcagccagaacggcgtcgacggtgccctcaccgccgtctgccatgggcatgcacacgatttcagcgtctggagccgaatcccgcactccttgagcaatggcttctgcaacgagctctgcaggtag

SEQ ID NO: 15060 - DNA, 240 bp, Pseudomonas aeruginosa
gctctcgaagctggcagccataaccgaggggcgcacgggtatatggcggcccagcactttcgacacgaaaaggaatgctcgcttgggattccggcgctctgcgaaaccgaacaggtcagctggagggagaacggtgtcttcgactttgacctcgaggagccctcgcttgagttgggcgcgtacggacgttggtactatgatattttccatgaatgcttccttgtttggcacgagggctga

SEQ ID NO: 15061 - DNA, 303 bp, Pseudomonas aeruginosa
tccccgaatgccgagggattgccgcactccagcgtccaggaacattgcgccgctcccaaagcggtgtttgcgccaggcgcgatcaccatcatccctgctttgctccttgagtcccgaaccttactaaatgcggcgaaatggtatcaaacttcaagtctgactacatatcaagttgccactggcaccgcaacggttatggctttcaccctgatgttcggtatccaatcactcaccggctcagccagaccaagccttctagtggcgaagatacctggcaggttcactcccgtatgtcgggtgtag

SEQ ID NO: 15062 - DNA, 1017 bp, Pseudomonas aeruginosa
ctatttaacgggcacatttcacatcgtcccggcctgggtgatcggtcaccagcggcgctgctggcagaacggcgggcggagcaactgcgcgaggcacgacagcacctaccagcgcgccgaagccgacctgcacaacctggtgccgagcatcggcgaggtcaacggcgaccgcagcaacttcggcttcggctggctgccgcagaaaccccagcaatatggcgcctgcccgatggtggtggacttcaaggcgcgcaaggcgatgccacgcccgcagatccgcgggatgatcgcccgcacctacttctacatgagcgaccgctacggcctgcgcctgtcgaagcaggatcgccagctctacaacgcctggcacaagcagtacccgccacagacctgggagcgccagcgcaaccacatggtcggctgcgtgatgggctggggcaatccctatgtcggcccggtggacctggcgacctgcagcaacctatcctcgcgtcgacgctgacctccgccggagtagcccatgatcttccgcaccctcgccctgttgccgctctgcgccgccctggcgttcgccgccgacgccggggagcgccgcttcgactgcacggtggtggcgatacacgacgacgccagcctgggctgccgcctgcccggcgcgaacaaggcgctgcgcatccagctcaatgccgtcgagctaccggccgccgagccctggcgtcggcgcgcccgggaagccctggaagacatgctgctcggcaaatcggcgaccatccgcgagcaaggccgcgacgcgcgcttccgcatcctcggcgcggcctgggtcaccccggccgactgccccacctgcggacataccctggatgccgggctggccctgctgaccattggcctggccagctggcgcgacgcgccggacagcggccagacggccgaggcgcgcggccagtaccggttcgccgaggaagaagcgcgggcgcgcaaggctggccagtggcgaccgcgcgacgccgctcctag

SEQ ID NO: 15063 - DNA, 1362 bp, Pseudomonas aeruginosa
gctgcggcgagggtatggtgcgagccacgtagcggccgtcggcggcctgcaactgcaacaacagcgcgccgtcgtggcggctcttgctggacaactggaactcgggaaaggcagcggcgattttcttcaggtcgacagacatggtgcgctccatttctgagaagttggacggaggcccgccgcgcggcgggcaggcgcagtctggctaacggatgcgaccgaatgatgacgccggcgacgaaccaattcgcccgccgtggcgtcccagaaaggacgcgacgaatttcacccaacggaaaatgcctggcggcaagcggccatcggtggtcgatcgtcatcggcacgcacacagcaaggagatggaatgttccgtacggcttatcgggaaataggcctgttcggcctggtcaagcgcacagtgaacgagttcctcgaggacgacatgccgacctacgcctcggccctcgcctatcagatgctgttctcgctatttccgttcctgctggtgctgatcaccctcgtaggctacctgcacctgccggagttcttcgcctggctgcgcgagcaggcggcgttgctgctgccgcccgaggcgatggatcaggtcaacccggtgatcgaccagttgcagcagcagaaaggcggcctgctgtcgatcggtatcgcggtggcgctgtggacctcctcggcgggcatccgctcgatgatgatcgcgctcaacgccgcctacgacgtgaaggagagccgcccggtatggaagcgcttctccctgtcgatcctctacaccctcggcatcgccctgttgttgctggtggcggccggcctgatggtcaccgggccgcaggtgatcgcctggatcgccggcctggtcggtctggaacagtacctggtgacgctctggacctggctgcgctggcctcttgcggtgttcctgctgatgctcgcggtggcgctgttctactatctggtgccggatgtcgagcagcgtttccgcttcatcactccaggctcggtgctctcggtgatcgcctggatcgccgcgtccctcgcctatggcttctacgtgaagaacttcgccaactacaacgccatgtacggcagcatcggggcgatcatcatcctcctgctgtacttctacctgtcggcggcagtggtgctgttcggcgccgagctgaacgcggtgatcgaacaccattcggaagacggcaaggaccctggcgagcgcgaacttccggacaacgacgaccccgaactcaaggcttgagcagggcgtcggcctcgctgacgctggccttgccggtggcgcgccggtacagacacagctcgcggccctggcggccctgcatgtgcggctgcggatag

SEQ ID NO: 15064 - DNA, 1161 bp, Pseudomonas aeruginosa
caaaaccacccgtcgttattgataatggctatgcctgtcagtgatcctatgcccctccggcacctcgccaggccccgccccgtctcgcacgcaaggcttgacggcgagcccccgcggttgcagcctctagcccctggaaacgaggaacgccatgaaccgaaacgacctgcgccgcgtcgatctgaacctgctgatcgtgttcgagactctgatgcacgaacgcagcgtgacccgcgccgcagagaaactgttcctcggccagccggccatcagcgccgcgctgtcgcgcctgcgcacgctgttcgacgacccgctgttcgtccgtaccggacgcagcatggagcccaccgcgcgagcccaggaaatcttcgcccacctgtcgccggcgctggactccatctccaccgccatgagccgcgccagcgagttcgatccggcgaccagcaccgcggtgttccgcatcggcctttccgacgacgtcgagttcggcctgttgccgcccctgctccgccgcctgcgcgcggaggcgccggggatcgtcctcgtcgtgcgccgcgccaactatctattgatgccgaacctgctggcctcgggggagatctcggtgggcgtcagctacaccgacgaactgccggccaacgccaagcgcaagaccgtgcgccgcagcaagccgaagatcctccgcgccgactccgcgcccggccaactgaccctcgacgactactgcgcgcgaccgcacgcgctggtgtccttcgccggcgacctcagcggcttcgtcgacgaggaactggagaaattcggccgcaagcgcaaggtggtcctggcggtgccgcagttcaacggcctcggcaccctcctggccggcaccgacatcatcgccaccgtgcccgactacgccgcccaggcgctgatcgccgccggcggcctacgcgccgaggacccaccgttcgagacccgggccttcgaactgtcgatggcttggcgcggcgcccaggacaacgatccggccgaacgctggctgcgctcgcggatcagcatgttcatcggcgatccggacagtctctgagccctccggcagctacccgcacgaggcgtcgcaacgggaaaatcgatcgcgcgccgcgggtgtgcggcttattccatcgaaagcactgtccataa

SEQ ID NO: 15065 - DNA, 1368 bp, Pseudomonas aeruginosa
ccatcgactgttacagaaaacgaaaaaccatgtatcactgttcgtgataatcaaaatctcgtcgttcgattagttccctgccggagcagcccgcagacttcgccaatcccgaaaaaccgactggcggagtcaagcatggaacagtcatcccacttctcctggcgctaccccctcgcactcgcggccgtactggtcctgagcgcctgcggcaaggccccggaaaccacccaaggcatggcggcgcccaaggtcagcgtcgccgaagtcatcgaacaaccgctgaacgagtgggacgaattcaccggccgcctggaggccccggagtcggtggagctgcgcccgcgggtgtcgggctacatcgaccgcgtggccttccatgaaggcgcactggtgaagaaaggcgacctgctgttccagatcgacccgcgcccgttcgaggccgaggtcaagcgcctcgaagcccaggtgcaacaggcccgcgcggcccaggcgcggagcgtcaacgaagcccagcgcggcgaacgcctgcgcgccagcaacgcgatctccgcggaattcgccgacgcccgcaccaccgccgcccaggaagccaaggcggcggtcgccgcgacccaggcgcaactggacgcggcgcgcctgaacctgagcttcacccggatcaccgcgccgatcgacggtcgcgtcagccgcgccgaggtcaccgccggcaacctggtcaactccggggaaaccctgctcaccaccctggtcagcaccgacaaggtctacgcctacttcgacgccgacgaacgcgtgttcctcaagtacgtcgagctggcccgccaggccggtcgcgacacgcgcagcgagagcccggtctacctcggcctgagcagcgaggacggcaacccgcacctgggccggctggacttcctcgacaaccaggtcaacccgcgtaccggcaccatccgcggccgcgccgtgttcgacaacgccaagggcgagttcaccccgggcctcaacgtgcgcctgaagttggtcggcagcaagacctacgccgccaccctgatcaaggacgaagcggtcggcaccgacctgggcaagaagttcgtgctggtcctggatggcgacaacaagaccgtctaccgcaccgtcgagatgggaccgaagctggagggcctgcgcatcgtccgcagcggcctgagcaagggcgaccggatcgtcgtgaatggcctgcagcgggtccgcccgggcatgcaggtggatccgcagaaggtcgagatggccagcgccgacaccctggccaccctcgcgcgcctgcggcagtcggtcggcgacagcgaaccaccgaaggtggcggcgtccaaggacaacgccactcgcaactag

SEQ ID NO: 15066 - DNA, 3198 bp, Pseudomonas aeruginosa
gaagaaccgatgaatttctcccaattcttcatccagcggccgatcttcgccgcggtgctgtcgctgctgatcctgattggcggcgccatctccctgttccagctacccatcagcgaatacccggaagtggtgccgccgaccgtcgtggtccgcgccaacttccccggcgccaacccgaaagtcatcggcgagaccgtcgcctctccccttgaacaggcgatcaccggggtggagaacatgctctacatgtcctcccagtcgacctccgacggcaagctgaccctgaccatcaccttcgccctcggcaccgacctggacaacgcccaggtgcaggtgcagaaccgcgtcacccggaccgagccgaagctcccggaagaagtgacccggctcggcatcaccgtcgacaaggcctcgcccgacctgaccatggtcgtgcacctgacctcgccggataaccgctacgacatgctctacctgtcgaactacgcggtgctcaacgtgaaggacgaactggcccgcctcgacggcgtcggcgacgtccagttgttcggcctcggcgactattcgctgcgcgtctggctggacccgaacaaggtcgcctcgcgcaacctcaccgccaccgacgtggtcaacgccatccgcgagcagaaccgccaggtcgccgccggcaccctgggcgcgccgccggcgccgagcgataccagcttccagttgtcgatcaacacccagggtcgcctggtcaccgaggaagagttcgagaacatcatcatccgcgccggcgccaacggcgagatcacccgtctgcgcgacatcgcccgggtcgagctgggctccaaccagtacgccctgcgctcgctgctgaacaacaagccggcggtggcgatcccgatcttccagcgtcccggctcgaacgccatcgagatctccaacctggtgcgggagaagatggccgagctgaagcacagcttcccgcaaggcatggactactccatcgtctacgacccgaccatcttcgtccgcggctccatcgaggcggtggtgcacaccctgttcgaagccctggtgctggtggtgctggtggtgatcctgttcctgcagacctggcgcgcctcgatcatcccgctggccgcggtgccggtgtcgctgatcggcaccttcgcggtgatgcacatgctcggcttctcgctcaacgcgctgtcgctgttcggcctggtgctggccatcggcatcgtggtggacgacgccatcgtggtggtggagaacgtcgagcgcaacatcggcctcggcctcaagccggtggaagccaccaagcgtgccatgcgcgaggtgaccgggccgatcatcgccacggcgctggtgctctgcgcggtgttcatcccgaccgcgttcatctccggcctcaccgggcagttctaccgccagttcgccctgaccatcgcgatctccacggtgatctcggcgttcaactcgctgaccctgtcgccagcgctggcggcggtcctgctcaagggccaccacgagccgaaggaccgcttctcggtgttcctcgacaagctcctcggcagttggctgttccgtccgttcaaccgtttcttcgaccgcgccagccatggctacgtcggcacggtgaaccgggtcctgcgcggcagctcgatcgccctgctggtctacggcggactgatggtgctgacctacttcggcttctccagcacgccgaccggtttcgtcccgcagcaggacaagcagtacctggtggccttcgcccagttgcccgacgcggccagcctggaccgtaccgaggcggtgatcaagcagatgtccgagatcgccctggcgcagcccggcgtggcggactcggtggccttccccggcctgtcgatcaacggcttcaccaacagcccgaacagcggcatcgtgttcaccccgctgaagccgttcgacgagcgcaaggacccgagccagtcggccggggccatcgccgccgcgctgaacgccaagtacgccgacatccaggacgcctacatcgcgatcttcccgccgccgccggtacaggggctggggaccatcggcggcttccgcctgcagatcgaggaccgtggcaaccagggctacgaggagctgttcaagcagacccagaacatcatcaccaaggcccgtgcgctgcctgagctggaacccagctcggtgttctccagctaccaggtcaacgtgccgcagatcgacgccgacatcgaccgcgagaaggccaagacccacggcgtggcgatcagcgacatcttcgacaccctgcaggtctacctcggctcgctgtacgcgaacgacttcaaccgcttcggccgtacctatcaggtcaacgtccaggccgagcagcagttccgcctcgaacccgagcagatcggccagctgaaggtgcgcaacaacctcggcgagatggtcccgctggcgtccttcatcaaggtcagcgacacctccggtccggaccgtgtgatgcactacaacggcttcatcaccgccgaactcaacggcgccccggccgcgggctacagctccggccaggcgcaggcggcgatcgagaagctgctgaaggaggaactgcccaacggcatgacctacgagtggaccgagctgacctaccagcagatcctcgccggcaataccgcgctgttcgtcttcccgctctgcgtgctgctggccttcctcgtgctggccgcccagtacgagagctggagcctgccgctggcggtgatcctgatcgtgccgatgaccctgctgtcggcgatcaccggggtgatcctggccggcagcgacaacaacatctttacccagatcggcctgatcgttctggtggggctggcgtgcaagaacgcgatcctgatcgtcgagttcgccaaggacaagcaggaggaaggcatggaccgcgtcgccgcggtgctggaagcctgccgcctgcgcctgcggccgatcctgatgacgtccatcgccttcatcatgggcgtggtgccgctggtgatctccaccggcgccggcgccgagatgcgccatgcgatgggcgtggcggtgttctccgggatgatcggggtgaccttcttcggcctgctgctgacgccggtgttctacgtcctcatccgccgcttcgtggagaaccgcgaagcgcgccgcgccgccaacgacaaaggcctgccagaggtgcatgcatga

SEQ ID NO: 15067 - DNA, 762 bp, Pseudomonas aeruginosa
cagtggacctttcgccgcgcgacctgccggcgatcaccaaggccctgccgatcggcgatcccggcgaactgctgcgccgccggccggacatccgcgccgccgaacggcgcctggccgccagcaccgccgacgtcggcgtggccaccgccgacctgttcccgcgggtcagcctcagcggcttcctcggcttcaccgccgggcggggctcgcagatcggctcaagcgccgcccgcgcctggagcgtcggcccgagcatcagttgggccgccttcgacctcggcagcgtgcgtgcccgcctgcgcggcgccaaggccgacgccgacgccgcgctggccagctacgaacagcaggtgctgctggccctggaagaatcggcgaatgccttcagcgactatggcaagcgccaggagcgcctggtctcgctggtccgccagtcggaagccagccgcgccgccgcgcaacaggcggcgatccgctaccgcgaaggcaccaccgatttcctggtgctgctggacgccgaacgcgagcaactctccgccgaagatgcccaggcccaggccgaggtcgagctgtaccgcggcatcgtggcgatctaccgctccctcggcggtggctggcaacccagcgcctgaaccggctatcccccggccgatggaaatcggccactccagccccgcgattgcagctcctggtcgcggggcttttttatgcgcagcgcgggggctcggtcgagccccacgtcgtttctcggcgatggcgtag

SEQ ID NO: 15068 - DNA, 1491 bp, Pseudomonas aeruginosa
aggctcggcgggcattgccgcgggctattcccgccgctccggctgcgcggagtggatatacagggtgtaggtatccgccggccggggcgcgcccgccaggtcgagggcatgaccgatggcgccgcgatggtaggtgccatggttgacgatatggaagaggatctcctggcgcgtcatgccgccgtcgcggccatcggcgaagcggaagcgcagccattcgccgcgacgctccagcggcagctcggcgacatagccggcgaaccaggcggccgaatcctccagccggcgacgcaggacgtcgtagccaggcaccacctcgctgttggtctgttggtggggcgccggctcgcccagcaggcgcgccctgaacagttcctcgacgatcgccatgtgattgagctgttgcaaggcgaaggccagcgaggccgggaacgcctcggcgtcgatccgggcgatggcatcgagggtgcggcggtcggaccaggccttgtaattgaaggactcgaccagcaggtcgacttgcagggtgggtcgggacatgtggcgggcttccgtgtccattcgctgagggagccggatcatagcccggagacagcgctcaacgctcgccctgcaacccttccaggcgcgcatcgcagaggtcgcgcaagcggtcgcggaggtgcgcccggcgctgtccagctcgggccgcgcgtagagcgccagctccaggccagcgatgggcgggaagccggcctgcgcgccaagcaggagatgctcgggcccgacgcagcccagcggcagcaggctgacccccagtccggcgccgaccgcggccaccaggctggccaggctggcgctggaatagccgatgcgccagcgacgcccgatgctctccagggcatggatcatctcctggcgatacagcgcgccgaccgggaacaccaccagcggcaccggctcctccggcgaaccctcgccgaacggccgcgcggcgctgccgaaccagcccagcggctcggcccagcgtgcatggcagtcgctgtcggccccccactgcttgaccagcagcaggtccagctcgccgctgcgatagaggcgcagcaggtgatggctgagaccgctctcgacctccaggcgcagtcgcggacgctcttcggtgaagcgcgtcagcaccggcatcagcacttcgccggcgaggtcttccggcacgccgaggcgcagcacgccgtcgccatgggccgggctgagggcctcgctggcctcgtccgagagccgcagcaggcgccgcgcgtatccaagcagacgctcgccttcctcggtcggcaaaacctgccgctggctgcggtcgagcaggcggcaaccgaggttctgttcgaggcggatgacctgctggctgacggtggactgggtcaggtgcaggtgttcgccggcgcgggtgaagttgccggtgtcgacaacgctgacgaaggtacggagcaggaccagatcgagcatgcacactcccactga

SEQ ID NO: 15069 - DNA, 630 bp, Pseudomonas aeruginosa
cggcggtccgcgccaccaggagatagtgcgcctgctgatcgacgccggcgccgacgtcaacctggccgatgccgacggcgtcagcccgatggcccacgcccgccagcgcggccagggcgggatcgagcggctgctgctggccgccggcgcccaatgaaagcgaaggagaaagacatgtccgatgaaatcttcatgcgcgaggccatcgccctcgcccgcgccaacgtcgaggccggcggccgcccgttcggcgccgtgctggtgcgcgacgggcgggtcctggcccgcggcgtcaaccagatccacgagacccacgatcccagtgcccacgccgaactgcaggcgatccgccaggccagtcaggcgctcggcagcccgcgtctggacggttgtgtgatctacgccagcggccatccctgcccgatgtgtctggccgccatgcatctctgcggcatccaggcggcctggttcgcctattccaacgaggacggcgaagcgttcggcctgtccactgccacgctctacgccgagatggcgcgcccgccacagcggcagagcctgccgctacgcgccctgcgtcctgccggcgaagagggtctgtaccggcaatggcggcaacgccaggcatga

SEQ ID NO: 15070 - DNA, 1089 bp, Pseudomonas aeruginosa
cctggaagtcgactacgacggccaccgccacccgttctctttcagcgaactgttctatccggacagcgacggctaccacgacctctggggctggatcgaacacgagcgcgagctggcggcggaagccgcggcagaagaaggccgcgactggaacggcaagctggcctacctgccgttcggtggcttcgagtacctggagcggctctacgtctgcgtcgaacccggccccgagcatggcgcggtaatcgcctggagccacggcctgccgccggcctgggccggacgcctgcaccaggattcggtgacgcgcctggccgacgacgtcggcgggctgttccgcctgctgtccttcgaacaggacccgttcgacgccgagaacgcctgcggcgtggccgacgagctactggaagcgctggacgccctggaggccgctggggagcccggcaaggcgctgaagggccgcctggaagtcctgctgcgccagcgcatcctcgactggcggccggccctcgccgacggcagcctggccgccgagccaaggctgcgtcaactggccctggccgaagctgcgcaagacggcgacatcgacctgctgcaacgcctgcgcgatgccggctgcgacttcgccgaaaccttgcgcggacgcggcggtgtgctggaggcctgcctcgcccgcgggcgcctggaggccgccagatggctgctcgaccagggcgtcgcggtgcaccaggacagcctgcagattggcgccgcgcacctcgatgcggtcctggccgaacgcctgttgcggctcggcgcgatctccgacccgaatacggtgctcctcgccctgcaatacggcgacgccgacgccgcgcggatcatggcgcgaccgctgctggaggagtcgccggcgagggccagcgccctgcgtctggccctcgccagccgcgccgagcgcgagcgcagcgacgccaggcgggtcaggtcgggaaagatgggcagcaaccgcagtcccgacgactacctggccctggccgagcgcctggagcgcttcctcgccgagctgccaggctgaggctcaaccctccggtccctgcacctcgatga

SEQ ID NO: 15071 - DNA, 1779 bp, Pseudomonas aeruginosa
cgctttccccggcggcgacccgatcgatggtctccgcgtccggtttgtagaaggtgtagggatggcggacagcgatcgcactggcgtccaccaaggtccacgaggccatgtcgactcccgcttggctggctacgcggcgcccgtagcctgggctgccacgggcacgccggtgcccgggcggcatgggtggaatggcgtggccgaggttcgggtcgcggcgcccaccggcaggtcgaagccatgcccggccaggaaccgcccttcggcccgcctacccagaggaaagtagcagcgccgccgcgcagccgccagcaacgggctgtcgcagagcgccgccccggacggggcggcggcgcgccttcagaggacttgcagcgggtattcgacgatcaggcggacttcgtcgaggtccgactcgaagctgtcggagcgcacggtggcctggcgcacgcggaacgccaggtccttggccgcgccaccctgcaccacgtacttgacctccacgtcgcgttcccagcggccctggttggtcagcgggttgccgttggcgtcggtgcgcatgtagacgctgttggcattcgaataatcggcgtcccagcccttgccatagcgggtcatgaagctcagccccggcacgccgaaggcggccatgtcgaggtcgtagcggagcatcagcgagcgttccttgggcgagttgaagtcgctgtactggatcgagttgtccaggtagatggagtcggtctggcgcaggtagtcgaagtcgtcgtcgccgttgttgcgctggtacgacagcagcacctggtgcggaccgtaggcgaagccgccgcgcacgctccagatgtcgttgtcgagttcgcccatcacctgcctgccctggtccttgaccttgtagtagttggcgccgccgagcagggacagcttgtcgtccagcggatagttgaagctggtgccggcgtagtactggtcccaggcgtccttctggcggctgccgtagaggctgacgctccagtgctcggtggcctggtagtcgccgccggcgtaggcgacccacggcgagtcgatgcgccggccggtgtagaagctgtagaagtcgtcgctgccgctggtgctgttcggctgggtcatcgagttcagcttgccggcctgcagggtcaggcccttcgccaggctgtcgttgaccagggtgaagccacggaagctggaggggaacagccggctgttgccgtactggattaccggggtttccgggaacacgtcgccgacccgcagcacggtgccataccagcgcagcttgaccgcgccgccggctcgcgaatagttgtcctgcggcctcccctggtcgtcatagggcagcaggtcgacgctaccgccggcgccggaacgcccgccgccgctgtccaggcgcacgccgagctgggcgaaggcgtcgatgccgacgcccagcgtgccctgggtgaagcccgaggaaaagttggccatgaagccctgcacccactcctcggtgtagccgccgcccgccgggctcgattggcccttgcggaagtcgcggttgaagtagaagttgcgcagcagcaggttgacctcgctgccctcgatgaaaccttccttgctccgctcggcgttctcctcggcgacggccgaggccatcagtccggcgcccagcagcagtggaagcgtccacagtcgtttctttccatccccttgcatggcgattgctccagatcggttcatgtctgtttttcttctgcggccatgccttgcggcgctggctgtgcgtga

SEQ ID NO: 15072 - DNA, 1140 bp, Pseudomonas aeruginosa
ggcgccagtcatggcgcctttttttatccgccgtcgcgcctggcggaagaaggcggcatggtcgccagcgaccagccgccctccccgtttcccgccttactcctgcaatgcccgcggccgctggctgcggcgctcggcggcgggcgccgggctggactggagctggaagtcgaaatccagttcggcgaagcgtccgccctccacgccgcggtcgcgggccgcggcggggtcgtcgttgaagcgcaggtcgccgatcagcccatcgcgggtggcataggcgaagtcgtcccacaggtagcggtcgcccgccaggttgatctgggtggtcaggtggcgatggccgggcgccgagacgaagaagtgaatgtgcgccggccgctggccgtggcggccgaggcggtcgagcagttcctgggtcgggccgtcgcttgggcaaccgtagccggacggcacgatgctgcgcgcacggtagcggccgtcggcgtcggtgcggatgcgccggcgcaggttgtattcggactggctgctgtcgaagtaggaataggtgccttgggtattggcgtgccagacatcgacgatggccccggccagcggctggccgtcgggaccgctgacgcggccctggaggaacatcacggtgccggcgtcgcggccgtcgtccatccgtgcctcgccatcgctcagcggcgcgccggcgacgtacagcggcccttcgatggtgcgcggcgtgccgccggtgaggccggcctcggcgtcctgggcgtcgagcagcaggtccaggtaatgctccaggcccagcccggcggccagcaggccggcctcctggcggctgcccaggcggttcaggtagtccaccgctttccagaattcgtcgggcgtgacctgcatctcttcgatcagcttcgccgtgtcgtcgaggacgcgccgcaccagggccttggtgcgcggatcgccgcgttcgttgagctggccgctggcctcttcgaagaagcgctggacgtcggcagtctgggaaatcttcacggtcatggcgtttgcctctgcttgttgttgtcgggcgtgggaagggaatctcagcggtcgtcggcatggatcgacgagggatgccggcaaagcccgtcgatctcgatgtccatgtag

SEQ ID NO: 15073 - DNA, 1557 bp, Pseudomonas aeruginosa
tgcccggcgatccgccagaggtgccgccagctgccctcgcgctggaggcgctgggccatttccttctcctcggccttgagccgctcggcctgttgcgggtccatgtcgacgggcaacttcacggtcatcttcacgtggaacagcatcggtcgtttctcctctgtctgcgggacggcttcagcgccggcggaagcgcgccaggcgctcctcgtcgagcgccaggccgagacccggcgcacgcggcacgtgcaagtggaaatcctggtagcgtggcgactcgaggaggatgtcctcggtcagcagcaacgggccgaacagttcgctgtgccaggccaggcggtcgagggtgacgaaggcgtgggcggcggccagggtgccgatgccgccctcgagcatggtcccgccgtacaggccgatcccggccgcctcggcgatcgccgcgctacgcagcaccgcgcgcggtccgccgttcttggcgatcttcagggcgaacaccggggcggcgccctcgcgagccagatggaaggcatcctcgacgctctcgatggcctcgtcggccatgatcggcgcgccgccgcggctgctcaggcgcgccaggccgacgcggttgtggcgggcaatgggctgttcgatcagggcgatgccgttgtcgccgagcgtcgcgcaggcacgctgggcaacgccttcgtcccaggcctggttgacgtccacccgcacgctggcgcgctcgccgagggcgcgcttgatggcgatcgcgtgggccacgtcggcatccacctcaccggcgccgatcttcagcttgaaatgccggtggcggcgcaggtcgagcatccgctcggcttcctcgatgtcgcggccggtgtcgccgctggccagggtccaggccacctccaggctgtcgtgcaggcggccgccgagcagttcgctgacggccaggccgaggcgcttgccatgggcgtcgagcaaggcggtctcgaccgccgagcgggcgaaggtgttgcccctgatgtgtcggtccaggcgctgcatcgcggcattcacgttgtccgccggctggcccagcagcaacggggcgaaatgcgcgtcgagattgctcttgatgctctccgggctctcgctgccgtaggccaggccaccgatggtggtggcttcgccgaggccctcgatgccgtcgctgcaacgcaggcggaggatcaccagggtctgccggttcatggtgtgcatggccagcttgtgcgggcggatggtcggcaggtcgacgatgatcgactcgaggctttggatcacggcttggctcattctcgggggtccaccagggttgcggtcgggttttcgacggttcgctgctcaaggctcgctcgataccgagcgggtttcgccgtcgtttcggccaagcatccatcgccttcttcactggggtccaatatcatcttcctctcgaaccataccctggaggtatcatggagcttcgtcacctgcgctacttccaggcgctggcccggaccctcaacttcacccgcgccgccgagcagttgcacatcgcccagccaccgctga

SEQ ID NO: 15074 - DNA, 1968 bp, Pseudomonas aeruginosa
ccgaagccgggcgcttcttccacgaacagagcgcgacgctcctggaccaactggaaagcatctgcgacagcacccggcggatcgggccagggccagcgccagtggttcggcatcggcttcgtgccctcggcgctgtatggcgtgctgccggagctgatccgccacctgctcggcgacccggagctggagctgggcctgctggagatgaccaccctgcaacaggtcgaggcgctgaagagcgggcgtatcgacatcggtttcggacgcatccggcatcgacgacccggcgatccgccagagcgtgctcagcgaagagccgctggtcgccgccctgcccgccgggcacccgttgctcggccagccgctgagcttggagcgcctgtcgcgcgagccgttcgtgctctaccccggccagccgcggccgagatacgccgaccacgtgctggcgctgttcgccacccacggcctgagcctgcgcgtgacgcaatgggccaacgagatgcagaccgccatcggcctggtcgccgccggactcggcgcgaccctggtgccggcctcggtgcagttgcagcaccgcgacgacgtcgcctaccaggccctggccgacgcctccctgacctcgccgatcatcgtcagccggcgccagggcgacggctccccgcacctgcggcgctgcctggcgctgatcggccgcgaggacgcctgaacgccctctcaggagcgccgcgcagcgcggcgctgggtcatgctcggggtttcctcgaagcgcttgcggtagtccacggagaagcgtccgaggtggctgaagccccagcccagggcgatcgtcgagatgctgcgggcgccgccgctggcgaggatttcctcgcgcaccgcggcgagccggtagtgcttcaggtagctcatcggcgacaccccgaagtagcgacggaagccctcgaacagcttgaaccgcgagaccccggcggcgcgttccacgtcctccaggctcagggtctcgcgggcgttggcctggagaaactcgcgggcgcgcagcaggtagtgcggcgggcgcccgccaaggccctgctgcagggcctcgctgtagttgttcggctgggccaggatcagtcccttgatcagcgcgcgttccaggtcgctgctgaaaaacgcctgggcgtagagttcgctgcgcgccatctcctcgctgatgtgccgcacggtgcgccaccaggacgcggaggcgccatccagggcatccatctccggatcgaagcgcaagggcgtatcgatcggccgctgcaacatctcctccaggaccttgcgcatcgccgtgcggccgatcaccacctgcagcttgcggcagtccccggcgatgctcagctcctggcgctcgttgggcgcgatgatcaccccgcggcggacgtcggagagcaggcgcagcccgccccggcacagctcctgctcgccgctgagcggcaggctcaggctgtaggcgttgaacgccgcggcatcctcgacggtgatggtgacgtcggtaccgtagccgatgtagccaagggtggtgcacatcgacttcagcacgttgccgtggtgctcgaactgcaccagtcccgggctcgccgcttcgagccggtgcggcccgcagaccttcgacatccaggaacgggcggcggccaggtccaggtggtcggcatggagatcgccacgatcggcgacgggatgggtcctcatcatggttcggcactcgacacggcaaggctgggggtgcgctctgctggcgctctgttttcagcaaaatgcaaggcatatgccggcgcaaggccggctccccgcatcctccactatccggatagcgttcgccgactttccggacaaagcgtccgccgcaagcgccgctcgaacctcggccgagccctccgcgagccccccggccgctcctcggcggctgcggattttcgggatgcgcatcgtcgactaagcggatag

SEQ ID NO: 15075 - DNA, 1908 bp, Pseudomonas aeruginosa
cgacaacgcacaagggtgagaacgcatgaacgctacccgcagaagcctcgaacagtggcgcgactatgtcggcggctgcctcgacttccgtcccgaggaaggcatcttccgcatcgcccgggacatgttcaccgaaccggagctgttcgacctggagatggagctgatcttcgaaaagaactggatctacgcctgccacgaaagcgaactggccaggccccacgacttcgtcaccctgcgcgccggacgccagccgctgatcgtcacccgcgacggcaacggccagttgcacgcgctggtcgacgcctgccagcatcgcggcgcgaccctggtgcgggtcggcaagggcaaccagtcgaccttcacctgtccgttccatgcctggtgctacaagaacgacggccggctggtgaaggtcaaggcgccgggcgaatacccggaaggcttcgacaaggccacccgtggcctgaagaaagcgcgcatccagagctacaggggcttcgtcttcgtcagcctggacgtcgccggcgaggacgacctggtggacttcctcggcgacgcccgggtgttcctcgacatgctggtggcgcagtctcccagcggcgagctggaagtgttgcccggcacctccacctacacctacgaaggcaactggaagctgcagaacgagaatggcctggacggctatcacgtcagcacagtgcactacaactacgtagccaccgtgcagcaccgccagcaggtcgaggccgagcgcggcggcgtggccgccaccctcgactacagcaagctcggcgccggcgacgcggccaccgacgacggctggttctccttcgccaacggccacagcgtgctcttcagcgagatgcccaaccccgccgtacgccccggctacgccagcgtgatgccgcggctggtggcggaatacggccaggcccgcgccgagtggatgatgcatcgcctgcgcaacctcaatctctaccccagcctgttcgtcatcgaccagatcagctcgcagctgcgcatcgtccgcccgctggcctggaaccgtaccgagatcgtcagccagtgcatcggcgtaaagggcgagtcggacgccgaccgggagaaccggatccgccagttcgaggacttcttcaacgtctccgggatgggcacgcccgacgacctggtggagttccgcgaagcccagcgtggcttccaagcccgcctggagcgctggagcgacatctcccgcggccacggcaagtggctcgaaggcgcgacgccgaacagccaggcgctgggtatcgcgccgctgctgaccggcaccgagatcacccacgaaggcctctacgtcaaccagcacgcgcattggcggcgcttcctcctcgacggcctggagcgcctggccctgcgcgcgaaggaggtgaccccatgaacgccggactgcagtaccgcgtcgaacagttcctctaccgccacgccgaactctgcgatgcccaggactgggacggctacctcgcgcagttcgacgaacagtgcgagttccacctgccgcagtgggagtccgagcagcgctacacccgcgatccgaagcgcgagatgtcgctgatctactaccccagccgtgccggcctggaagaccgggtgttccgtatccgcaccggcaaggccgcgtccaccgtgccgatgccgcgcaccctgcaccagatcggcaacgtgcgcatcgccgaggaaggcgaaggcctgctgcgagtgcgggtcaactggcagaccctgttccagcgcctggaccagaccggcagcttcttcggccatgccacctaccgcctgaaaccccatggcgaggcctggctgatcgcgcgcaagcacatcgtcctgctcaacgaccggatcgactcggtcctcgacttctaccacctctga

SEQ ID NO: 15076 - DNA, 1044 bp, Pseudomonas aeruginosa
acggcgggccccgtcacgatgaatcacaaagtcgccctcagcttcgccgacggcaagaccctgttcctgcccgtcggccacgacgacctgctcctcgacgccgccctgcgccacggcatcaacctgccgctggactgccgcgaaggggtctgcggcacctgcatgggccgctgcgaggcgggcagctacagcctggactacgccgacgaggacaccctctccgccgccgacctggagcagcgcaaggtgctcgcctgccagacccgggtgcgctccgacgcggccttctacttcgacttcgcctcgaccctctgccacgccgccgcggcccaggcgcacagcggcgtggtgcgcgaactgcgcctgctctccgaggacaccgcgctgctccgcctcgacgccggcgccgcgggccgccagttggacttcctgcccggccagtacgcgcgcctgcaagtacccggcagcgactgccggcgcgcctactccttcgccaaccggccgaatccgcagaaccacctgcagttcctcatccgcctgctcccgggcggcgccatgagcgactacctgcgccaaggttgccgggtcggcgacgagatccgcttcgaggcgccgctgggcaccttctacctgcgtcaggtggagcgcccgttgctgctggtggccggcggcaccggcctgtctgcgttcctcggcatgctcgacgaactggccgagcgcggctgcgatcgggcggtgcatctctactacggggtacgccgcgccgccgatctctgcgaattgcagcggatcgccggctacgccgagcggcttcccggcttccgcttcgtcccggtgctcagccgaggcggacgccgactgggacggccggcgcggctacctgcactagcatttcgacgccgcccgcctgcgcgacgaagctttcgacctctacctgtgcgggccgccgccgatggtcgaggcggtccgccagtggcttgcgcgagcgctcccttggagcatctacggctgtacctggagaagttcaccgaaagcggcgactga

SEQ ID NO: 15077 - DNA, 1815 bp, Pseudomonas aeruginosa
cgctccaggtcggcggtcaggcacaggcaggcgtcaccggccagttcgtggaccagctcggagcggtccaccgccaccacccgcgcgccttcctccagcaggcgccggaccacgcccaggccgataccctgggcggcgccgctgaccagggcgaccttgtcgcggaatctgtcgttcatgggaatctccttggctcgctcgggttcaggccgcgctggcggcgaacttttcgtagtagaaattcgccgggcgcacgccctgctcgcgcaggtagcgctcgaccgcctcgaccatcggcggcggcccgcacaggtagatgtcgacgtcgccctcgtgcaggtgctgcgcggcgatgtgctcggtcacgtagcccttgcgcggatagtcgctgtcggcgctggccacgcacgcgctccaggtgaagccgggaatccgttcggcgaacgcctccaggcgctcgagaccgaccaggtcgacgtcgtgggtcaccccgtagaccaggtgcagcgggtgcgcgctgccctgttcggcgatccgttcgagcatcgcggtgaacggcgccaggccggtgccgccggccagcatcagcagtggccggtgaatctcgcgcaggtagaaactgcccagcgggccgtccatcgccaggctgtcgccggccctggccgtgccactgaggaagccgctcatcagcccgccggggacgttgcggatcaggaagctgacctcgccgtccttcgccagcgagctgaaggagtaggcgcggcgctgctcgctgccgggtacctggaggttgacgtactgcccgggcaggaacgccaggctggccagcgcctcgccgcgcagcgacaggccgatggtgctcggcgagagttgccggacttcgctgatgcgcgcctcgtagcgcgcctggccggtcctgcacagggtcgaggacgccggcacgcgcagcacgcagtcgctttcggcgcgcatctggcaggtcagcacgtagccgcgggcggcttcctcggcgctgagggcatcgtcgatgtagtcctggcccagcgcatagcgcccggcctcggccaggcacttgcaggtgccgcaggcgccgtcgcggcagtccagggggatgttgatgccctggcggtaggccgcgtcggccacggtctcgccgggcgcggcatggatgaagcgggtcaccccgtcttcgaagttgagtgcgatccgatggttcatggcatgtccctcgacagcccgccggcgcgggcgtcagacgtggtagacgtcgatcagctggcgaacgtagtcgttcttcaggatcactttcttggccttgatcagcggactctcgccgcgtacgtcgaggtcgtagaaggtggtgccgaagtagctgtccacggtcttgtagcgatagctcagggtgtgccagttgcagcgcgcgcggcagatgccgtcgtcctcgccgagcagttcgatgttgctcaggttgtgcgaggtgcgggtgtccggcagggtcgcgctggagcgctcggtgcggatgcggaatacccggtcctccaggccgccgcggttgccgtaccagatcagcgagatttcccgctgcgggtcctcggtgagctggtcgcggtcgtcccaggacggcatccagaaactggcgtccgcggcgtacaacgccagccaggcgtcccaatccttgtcgtcgagatagcgcgcctcgcggtagaggaaatcgcgcagggcgtcgtagcccaggctcatgacgccacctcccgcagcgccacgcgctgcgtccgttcgcgctccagggcggcgagcagcgcctcctgccagtag

SEQ ID NO: 15078 - DNA, 3444 bp, Pseudomonas aeruginosa
gcaaggaggcattcatgggcaggacactcaggctgctatcgttgttgttatcgccgcgcggcgccaagcgccgggcgcggaacgtccacccacactacgcaagccctccgccggcgacaatccgggccggcaatcgcgtgcggtaatcgaacggaatccgtccaacggccaacgaaaaagggccgccagggtttcccctgccggcccgcttgcgcgcccgcttcagccggccgccggcgtctcctcgcgcggtccggcgtcgcgcccgtgggtccagcgatagagcaccggcagcaccagcagggtcagcatggtcgaggacaggatgccgccgatcaccaccgtcgccagcggccgctgcacctcggcgccggtgccggtggccagggccatcggcacgaaaccgagggacgccaccagggcggtcatcagcaccggacgcaggcgggtgatggcgccctcccacaccgcctggtcgaggctgcgtccttcctgcaacaggttgcggatgaaggagatcatcaccaggccgttgagcaccgccaccccggacagggcgatgaaacccaccgccgccgagatcgacagcggtatcccgcgcagccacagggccagcaccccgccggtgagggcgaaggggatgccggtgaacaccagcaggccgtccttgacgttgttgaacatggcgaagagcaaggtgaacaccagcagcagcgccaccggcaccactacctgcaagcgcttggcggcggactgcaactgttcgaactggccgccccaggtggtccagtagccggccgggatcttcaccccgtcctgcagcttctgttgcgcttccagcacgaacgagccgatgtcgcggccgcgcacgttggcgctgaccacgatgcgccgcttgccgttctcccggctgatctggttcggtcccggcgagaggtcgaggcgcgccacgtccgacagcgggatgaagtcgatccgcgccaggttgttcggcggcagcgggatcagcaggttggacagtgccggcaggtcggcgcgcagggtttccggcaggcggatgacgatgtcgaagcggcggtcgccctcgaacagggtaccggcgttgcgtccgccgagggcggtggccacggtgtcctggatgtcgccgacattgaggccgaagcgtgccgccttgtcgcggtcgatgtccaccgtcagcaccggcaggccggtggtctgctcgaccttcacctcggaggcgccgtcgatgccttgcagcaccttggagatcttctccgcggtgtcgttgagcacctgcatgtcgtcgccgaagaccttcaccgcgacgtcgctgcgcaccccggagatcagttcgttgaagcgcaactggatcggctgggagaactcgtagacgctgcccggcacctcaagggccgcggcctgcaattcttccagcagcgcctcccgcgacttcttcgggtccggccactggctctgcggcttgagcatcacgtagctgtcggaggcgttcggcggcatcaggtcggaggcgatctcggcggtcccggtgcgggcgaagacccgctcgatctccgggaacttgcccatcagcttcctctccagggtctgctgcatctcgaccgactgggtcaggctggtgcccggcacccgcaggccctgcatggcgaagtcgccctcgctgaggctgggaatgaactcgctgcccatccgcgaggccaccagcccggtgagcaggatcgcgccgagggcgccgccgaccaccagcgcgcggtgcccgagcacccagcgcagcgccggttcgtaggccagacgcgcgcggcgcatgacgaagttctcctcctccttgaccttgccggtgatgaacagcgcgatcgccgccgggacgaaggtcaccgagaggatcatcgcgccgagcagcgcggtgaccacggtgaacgccatcgggtggaacatcttcccctcgaccccggtgagggcgaagatcggcaggtacaccaccatgatgatgatctggccgaagaccagcgcccggcgcgcctccctggacgcggcgaagacctcgtggaaacgttccgcgcgggtcagctggcggccgtggtgggcctgggcgtgggccaggcggcggatggcgttctcgacgatcaccacggcgccgtcgacgatgatgccgaagtccagcgcgccgaggctcatcaggttggcgctgaccctgttgccgaccatcccggtgaaggtgaacagcatcgacagcgggatgatggtggcggtgatcaacgccgcgcggatgttgccgaggaacaggaagagcaccgcgatcaccagcgccgcgccttccaccaggttcttcttcaccgtggccacggccttgtccaccagggtggtgcggtcgtagacggtgatcgccttgacccccttgggcagggtccggttgatctcctccaggcgctggccgaccgcctgggccacttcccggctgttctcgccgatcagcatgaacaccgtgccgagcaccacttcgcggccgttctcggtggccgcgccggtgcgcagctccttgcccaggccgacctcggcgacgtcgcggatacggatcggcacgccgtcgacgttggaaacgatgatcccgcggatatcgtccatgtccttgacctggcccggcgcgcggatcagcaactgctcgccgcgccgctcgatgtagccggcgccgacgttctcgttgttgcgcagcacagcgttctgcaggtcgccgagggtcagcttgtaggccgcgagcttcttcggatccggggcgatgaggaattgcttggcgtagccgccgatggtgttgatctcggccacgcccttcacgttgcgcaactgcggacggatgatccagtcctggatggtgcgcaggtcggtgggcgtgtaggcgctgccgtcctccttggtcgcgccctcctcggcctccaccgtccacaggtagatctcgccgagaccggtggagatcggcccgagggtcggcgagatgtcttccggcagttgctcgcgcgccgtgctcaggcgttcgttgacctgctggcgggcgaagtaaatatcggtgccctcctcgaagatcaccgtcacctgggaaatccccggccgcgacagcgaacgggtttcctgcaaacccggcaggccggccatgacggtctccaccgggtaggtgatccgctgctccacttccagcggcgagtagccgggggcggcggtattgatctgcacctggacgttggtgatgtccgggaccgcgtcgatggacagcttctggtagctgccgatgccgaccccggccatccccagcaccgccagcaggaccagccagcgttgctcgatggcgaattggatgatgcgttcgaacatgcgaagactcctggagcgggactcagtgaccgtgttccgccgagcccttgcccagttcggatttga

SEQ ID NO: 15079 - DNA, 2064 bp, Pseudomonas aeruginosa
agtcaagactgccgactacctgcaccagggcctgaccgaaagcggctacatcgtcgaccgcgccaacgatggcatcgacggcctgcacatggccttgcaacacccttacgaactggtgatcctcgacgtcaacctgcccggcatcgacggctgggacctgctccgccgcctgcgcgaacgcagcagcgcgcgggtgatgatgctcaccgggcatggcaggctgaccgacaaggtgcgcggcctcgatctcggcgccgacgacttcatggtcaagccgttccagttccccgaactgctggcgcgggtccgctcgctgctgcgccgccacgaccaggcaccgatgcaggacgtcctgcgggtcgccgacctggagctggacgccagccgccaccgggccttccgcggccgggtgcggatcaacctgacgaccaaggagttcgccctgctgcacctgctgatgcggcgcaacggcgacgtcatcacccggacgcagatcatctcgctgatctgggacatgaacttcgacaacgactccaacgtggtggaagtcgccatctgccgcctgcgggcgaagatcgacgacggcttcgacctcaagctgatccataccattcgcggcgtcggctacgtcctggaagcgcgccgatgacgccaccaggccgactgtcgctgcgcctggccctgctggtcggcgccctcggcgcgctgctggccctggcgctcggcgcaatggcgcactggaacctcggccgcgagctggaagcccgcgagcgggaaaacctgcaattgaagctggagcagatccgccacagcctggaagacgatctcgacctgcgcagcgacccggccgtacaggcgcatgccctgcaggaccaactggtggctcacagcggcctgcacctgagcattctcgacagccgcagcggccagccgctgatgagcttcggcgaccaggccgcggccagcgtcgcggccaaccgcgcgcttctcgcccgcttgcaggcggatgcccgccagccggtgttccagagctggagcaccggcaacgaccagcgcctgctgagcatcggcgcttccatgcgcatgaagaacggcaccccggtacaggtgttgctgagcagcgagcgcaacgccgacgagcgcctgctcgacggtttcctccgcgccaccctgctggccctgcccttcctcctgccattgatcgccctgaccgcctggtgggtggtgcgtgccggcctcgaaccgttgaaccgcttccgccgggtggccgcccaggtcagcccgcaggatctctcctaccgcatccccgagcagaacctgccgcgcgagctggacagcctggcccgcagcttcaaccacatgctcggccgcctcgaggatggcgtacgccagctctcgcagttctccgacgacctggcccacgaactgcgcgcgccgatctgcaacctgctggtgcgcaaccaggtgctgctcagccagcatcgcgacggcgcggcataccgcgaagccctggagtccaatgccgaggaactggagcggctgtcgcggatcgtcaccgacatgctgttcctggtgcaggtggacaacccggcgatccaggcccagttcggctgcgtcgccctgcacgagcaggcggccaaggtcatcgacctgtacgagatggtcgccgaggacaagggcgtcgaactgcgcctgtccggcaacggcttcgcccacggcgacaacctgatgatccagcgcgccatttccaacctggtgtccaacgccgtgcgccacaccccgcaaggcgggcgcatcgacgtgcggatcggggaacgcgcggggcacaccgaggtgagggtcagcaacgacggtccgggcatcccgccggagtacctgccgcacctgttcgagcgcttctaccgccgcgccggacgccagactggagcccaggccggcaccggcctgggactggccatcgtgcaatcgatcatggcctaccacggcggccgcgccgaagcggaaagcgtaccgcagcagaagacccacctgcgcctgctgttcccttcgacgggcgctgcctga

SEQ ID NO: 15080 - DNA, 1725 bp, Pseudomonas aeruginosa
cctcggcgcgagggcatttccggaaacttccccgacacgtattcacctccacatccgccaccgcactctagccgagacgcggacggcggtgtgtcatgcaagcgcaatagcggggaaaggcattcgtcaggaacaggcagcgagaagaactcagggcgaaggcggcaggccctcctcgacccggccgagccgctcgtcggtccgctcgatatcggcgctgtcccagccgccgcccattgccgcgatcaactggacgctggcggtcaggcggctgccgagcagggtcagcacggtgcgttcgttgctcagcgcggtggcctggttggtgaccacgtcggtgtagtcgacggtgccggccttgtactggttctcggccaggcgcagtgcctcgcgggccgactccagggcttcgcgctgcaccccgctctcctcgtcgaggacgctcaattgcaccaggtagtcctccacctcgcggaaaccgtcgagcacggtctgccggtaggtcgccacggtctggtcgtaggtcgcctcggcctggtccacctgggagccgatcaggccgccgtcgaacagggtcatggcgaactgcgggccgatcgaccagaagcggttcggcgtgctgatccagttgctcaggctgccgctgcggtagccgccggcggcgctcagggtgaggtcggggaaataggcggccttggccacgccgatctgggcgttggcggaaatcaccttgcgttccgccgaggcgatgtccggccgccgctcgagcaattgcgacggcaccactgccggcaggtccggcagcttcggcacgctcgccaccggcggcaggttgaattgcgccggcggcaggccgaccagcacggcgatggcgtgctccagctgggcacgctggtacttcaggtcgatggcctgggcctgggtgcttttcaactgggtgcgggcctgggccacgtcggccctggtgacgatgccggcgcggtatttgttctcggccaccttcagcgaacgctcgtaggccgtcaccgtgtcgttgagcaggcggatctgttcgtccatcacccgcagttgcaggtagttctgcgccagttgcgactgctggctgaggcgcaccgcggcgaggtcggcggcgctggcatgcaggctcgcctggttggcctccagttgccggcgcagcttgccccagaggtcgacctcccagctgacaccgaggctggtcgagtaactgttgctgatcgcaccggaaccaccgccgctgctcacagtggagccgtcgggcaggcgcacggtgctgtcgccgccgccctggccgctgcgggtcttgcccacgttgccggtgatcgacgggaagaacgccgcccgcgcgccgcgcaccagcgcctcggcctggcggaactgcgccaccgactgggccagggtctggttggaacgttccaggtgcatctgcaggtcgttcagggtctggtcgccgtacagctcccaccaggcgccgcgctggaacacgtcgcgcggctcggcgcggcgccagccttcggcttccttgaattcggcgggcaccgccaggtccggtcgctggtagtcggggccgatggcgcagccgccgagggcggcgaccagggccagggcgagcaacgagggggtgtgtttcataggggtgtctccagcgcaccgtccgtgcgtacgccgcgtttctggttgacccagtggcgcaggcggtcgagatag

SEQ ID NO: 15081 - DNA, 423 bp, Pseudomonas aeruginosa
tggctgaacgcggacagcggcacgcgctggccgtcgttgccgatcacctggacctggcggaggatctccgggctctgctggtactgctggtcgacctccatcaccacccgatactggttcagcgggttgaagatggtcgacacctggcgctggccgaaggagtcgttgagcaccgcgtcgaccattcccacgttgatccccagggtcgccgcgcggtcgcggtcgatcaccaggcgggtctgcacgcccttgtcctgggagtcgctgttgacgtccaccagctgcggcagcttgcgcatcgccgcctcgaccttcggcgcccattcgcggagcagggtcaggtcgtcgctgcgcagggtgaattcgtactgcgcgttgctgtcgcggccgcccaggcgcacgtcctggccggcgttgagatag

SEQ ID NO: 15082 - DNA, 810 bp, Pseudomonas aeruginosa
cgcagcatgaaggcggcgaagaagcgatcgctgcgccgcgcctgggaagcgccttcgggccgtttcagcggacgcagtatacgcgcgcagagcatcggcgtgagggtcaaggataccaccagggacaccaggatcgccgccgagagagtcaccgcgaactcgcggaacaaccgcccggtgaggccgcccatgagcagcagcgggatgaacaccgcgaccagcgagagcgtcatcgacagcacggtgaaaccgacctggcgggcaccggtgatcgccgcctggatcggcggatcgccctcctcgatgcgtcgggcgatgttctccaccaccacgatggcgtcgtccaccacgaagccggtggcgatgatcagcgccatcagcgacaggttgttcaggctgaagtcgcacaggtacatgaccgcgaaggtgccgatcagcgagaccggcaccgccaggctggggatcagcgtggcgcggccgttgcgcaggaacaggaagaccaccaggatcaccagcgccaccgagatcagcagggtcagctcggcctcttccagcgacgcacggatcgacgggctgcgatcgtccatcacgttcagcttgacctgcggcccgagcagttcctgcaacaccggcagttgcgcgtggatggcgtcggtggcctcgatgatgttggcgccgggctggcgggtgacgatcagcagcaccgccggcagatcgtcggaaaagccggcgttgcgcacgtcctccaccgagtcgctgaccttggccacgtcgccgaggcgcaccgcggcgccgttgtcggcgttgtag

SEQ ID NO: 15083 - DNA, 1347 bp, Pseudomonas aeruginosa
acgggcgggacgggttcattcagcgctcccgctacccaccgagtcgccctggaggccgctggggcggccagtctgcggtttctgcggctcgccctcgaggacctgcggggaggcctcggcgacacgcacttccataccgtcgcgcaggcggtcggtgccttccaccaccacctgctcgccggccttcaggccgctttccaccaccacccgctcgttctcgctggtgccgatggcgacgctgcgctggctgaccttgttgtcggcgccgaccacgtacacatagataccgttggtgccgcgctgcacggcgttggctggaatggtcagcacgcccttgagggtatgcgccagcaggcgcacgttgacgaactggttggggaacagcttgccgtcggcgttctcgaagcgcgccttgagcttgaccgtgccggtggtggtgtcgatctggttgtccagggtggtcagggtgccttcggcgagaaccttgtcctggttgcggtccagcgcggtgaccgccagcttgccggggccgttcatctgctcgacgacggtgccgatctgctgctgcggcaggctgaacaccaccgagatcggcttgacctgggtgatcaccaccagcggcgtggtatcgccgctggtgaccaggttgccgatgtccacctggcgcaggccgaggcgcccggaaatcggtgcgcggacctcggtgaaggtcagattgaggcgggcgtcgtcgacctggccctggttggtacggatggtgccctgcaactggcggacctgggcttcctgggtatccagggtctgcttggcgatcgagtcctcggcgtacagccccttgtagcgctgcaggtcgatctcggcgttcttcagttgcgcctggttctgcatcagcgtgccctcggcctgggccagcgccgccttgtaggtgcgcgggtcgaccaccgccagcaggtcgccggccttgacctcctgcccctcctggaacagcaccttgaccagctcgccgttgacccgcggcttgacgttcaccgtgttgaaggcggtgacggtgccaagcgcgttgaaatgcagcgccaggtcgccctgctccaccctggccacgccgacggtgagcgcgttggccttgggcagcgcggcgcccggcttgccgccgcgaccgggtcgcccgtcggaggacggtgccgaggcgggcgccgccagccacatcaccaggccgatcacggcggcgaaggccagggcggtgatcagccacgggcgcagggtacggaacttggatttaccggtcgttggagtcatggttcttcttcaggcttagaacggaggcgctttttccaggctgcacgataa

SEQ ID NO: 15084 - DNA, 546 bp, Pseudomonas aeruginosa
cagccagacccgcagtttcggcggccaccatgccggccagcagggcggcgccgaagtgatcgagcgcctcggcctggtcggcgccgcgccgcgcatcgccgaccaggccctgcaactgctggcggcgccgaacaccccgagcggccgctgcgacctgctgctgatgccggaccagatgatcctgcagatccacgagtcgatcggccacccgctggagctggatcgcatcctcggcgacgagcgcaactacgccgggaccagcttcatcaagaccgaggacttcggtcgctaccagtacggctccagcctgctcaacgtcagcttcgacccggaaatccccgaggagctggccagctaccgccaggacgacgacggcagccccgcgcgcaaggaatacctgatccgcgaaggccgcctgctgcgcccgctcggcggcgccctgtcgcaacaccgcagcggcctggagggcgtcgccaacagccgcgccagcagttggaaccgcgcgcccatcgaccgcatggccaatctcaacctggagcccggtga

SEQ ID NO: 15085 - DNA, 1668 bp, Pseudomonas aeruginosa
caagagcttcgcgcagctggtggccggtatcgagcgcggggtgctgatgtcctacaaccgctcctggtcgatcgacgacgcacgcaacaagttccagttcggctgcgaatggggccagttgatcgaggacggcgaactcaagggcgtggtgaaaaaccccaactaccggggcatctccgcgcagttctggcgcaacctcagcgcggtgggcgacgccggcaccttcgaggtgctcggcaccccctactgcggcaagggcgagccgaaccaggtgatccgtgtcggccacgcctcgccggcctgcgtattcagcgatgtggacgtattcgggggagacgcctgatgcaccagagacagcatttcgaagccctcgccgaggacctgcgccgacacctggccgagggcgaggacttcaccctctggtacagcgccgaggactccgagttcatccgcttcaaccgggcgcgggtgcgccaggccggtcgggtgcgccaggccagcgcgctgctccggctgatccgcgacgaacgccaggcgagcctcgacctgacgctctccggcgcgccggaagaagaccgccagcgtctggccgaaggccttcggcaactgcgccagagcctggcctggattcccgccgatccctatctgctgctcgacaccacggcctggcagcgagagaaccaggacctcggcgcagcgcccgacagcggggcgctgctggccagcctcgaacgccaggcgcgcgacctcgacctggtcggcatctatgccgccggaccgctgttccgtggcttcgccaactcctggggcgccttcggctggcatgccggcagcagcttcaacttcgactggagcctgttccacggcaacggccaggcggtgaaggccgactacgccggccagcgctgggacgacgaagccttcgcccggcgcttcgaacaggcccgggagcagctcggccacctgggcaagccgctgcgccagttgcgccccggcgactaccgcgcctacctggcgccggcggcgctcgaagaagtcatgcagatgctctgctggggcggtttctccgcgcgcgccctggctaccggcgaaagccccctgcaacgcctgcagaacggcgacgccctgctcagcccgctgctgaacctcgccgagcgccctgccacctcgccctccccggcattcagcgcggaaggctcgccgcgcgccgaggtcgaactggtcggcaacggccgcctgagcggacgcctggtgagttcgcgcagcgcccgcgaatatggcctggtagccaatggcgccggcgccaacgaggcgcccacggcgctggacatggccggcggcagcctggagcaggcgcgcatcctcgaggccctggataccggcctgtacatcggcaacctgtggtacctgaactactcggacatgcccgccgcacgcctgaccggaatgacccgcttcgccaccttctgggtggagaacggccagatccgggcgccggtcagcaccatgcgcttcgacgacagcctgtacagcttcctcggcgcccacctggaagacctcagccacgagcgcgaactgcgcctgtccagcaatacctacggcgaacgccagaccgactcgatgcacctgccgggcgcgttgaccgggcgcttcaccctcacgctctga

SEQ ID NO: 15086 - DNA, 828 bp, Pseudomonas aeruginosa
agctatgcccgctttgagtcgtcgttcgttcgtgaccctgaccgccctggcctccagcagcatcctgctgagcccgcgagccttcgccgggagcggcgcgacaagcgccgccgggaagccgcaagagaccttcctggatttcaacgaaagcccctacggcccctccgccaaggccagggccgccatgcagcgggcggccgcgctctgcggccgctacgactacgacgcgcaggacgccctggtcggcctgttcgccaagcagaacggcatccccgccgaatgcgtgcatgcctactgcggctcgcgccagccgctgcaatacgccgtcgcggcgttcaccggcaaggagcgcagactggtcatggccgatccctcctacgactccgtggtcggcgccgcccaggtccagggggcgaaggtcgctgccgtgccgctggacgccgaggcggcccacgacatcgagcgcatgctcgccgccgcgcaacgcgacgccgggctgatctatatctgcaacccgaacaacccgaccggcaccctcaccccgcacgagcggatcgtcagggcgatcgaacgcaagcccgagcgcagcgtggtgctggtcgacgaggcgtatatccatttttccgacgcacccagcgtcgttggcctggccatccagcgccaggatgtgctggtcctgcgtaccttctcgaaactctacgggatggccggcgcccggctcggcctggccatcgggcatccgcagctgctggcgcggctggagcgcttcggcggccacaacgtggtgccctcgccgaccgcccacgccgggctggaaagcctgcgtga

SEQ ID NO: 15087 - DNA, 555 bp, Pseudomonas aeruginosa
cagtcatgggacgaagcgggttggccgtggggctcagagagccgccagggccgccgcgtagttcggctcgtcggcgatttcgccgaccagttcgctgtgcagcaccttgttctgctcgtcgagcaccaccacggcgcgcgcggccaggccggccagcgggccgctggcgatggccacgccatagttctcgaggaactcgcgaccgcgcagggtcgacaggttgactacgttctccaggccttcggcgccgcagaagcgcttctgcgcgaacggcaggtcggcggagatgcacagcaccacggtgttggccagcttgccggcctcgacgttgaacttgcgcaccgaggtggcgcaggtcggggtgtcgacgctggggaagatgttcagcaccttgcgcttgccggcgaagttttccagggtcacgtcagcgaggtcgccgccgaccaggctgaaggccggagcctgggcgcctttctgcgggagctggccatcgacgttgaccgggttgcccttgagagtcacttgagccattgcgttgatccttctagtcagtga

SEQ ID NO: 15088 - DNA, 462 bp, Pseudomonas aeruginosa
cctgcggcaggtcggccaggtgccggccgaccaggctggaatcgtgcagttcgccgacccgcagcacgcagtccgcgccctcgcgcagcaggtcgaccaggcgatcgttgctgctcaactgcagctccagttccgggtagcgctcgcagaactccggcaggaacggaatcacccgcatccgccccagtgcgcccggcaggtcgacccgcaagcgcccgcgcgggttgttcaggacgcgtggaaagcagctttccgcctcctccaggtccgccagcaggcgcacgcaacgctcgtagtaggcctgcccgtcgagggtcaggcttacctggcgggtggtgcgctgcagcaactgcacgccaaggtgcgcctccagttgctggatcgcctgggtcacgctggcgcgcggcagctccaggctgtccgcggccttgccgaaggcgcccagctcgacgatgcgggtga

SEQ ID NO: 15089 - DNA, 489 bp, Pseudomonas aeruginosa
ccccatccgaccacaggctgcccaggcgcaggccggcacgggtggcgcgccagtagagatcgcgcggcgagttcttcggcaacggcgcggccagcgcctcggcctcggcgcaggtatggcccaggcggtcggcatcgagcaggctcggtcgttcgggggccgtggcgaatgcctcgaggaggaagcgccgggcacggccgacggccaggtgacgatcgcgctcgccaagggtgtcgtggaagaagccgggcaggatgtgcttttccttgcgcaggctgccgagacgctcgaagaagcgctcctgcggcgcacgatggacgacgaagtcggccccggaaatcagcagttgggtgggaatctggatcgcctgtgcgtccgctaccacccgctcggcagcttcgtagaggccgagcaggacgttcaccgagatcgccttggcgatcagcgggtcgctgtcgtaggaggcgatccgctgcgggtcgtgactga

SEQ ID NO: 15090 - DNA, 1722 bp, Pseudomonas aeruginosa
cacacttttatgcgttacgcatggtccgtatcagcgcatccgtcagaaatcgcgcttgaagaacaggtccagcgaactggccaggccgctcgccgcttcgagatagaggcgtttggtcaactggtagcgcaaggcgatggtatttgccggttcgaacactccaacaccatagcgcaggctgagcttgtcggtgatattcccgctggcgaccacgctggtgctgttgccggtgccctcggtgtccagctggaagtcctggatgccgagctgcttggcgatttccccggtgagcggcgcgctaccggccaggcccagggccagggccgcctcgccgagcatgttgctgtcttcgccggtgctcatcggccgccccagcaccaggtaggacagcgcctgctcctggctcatcgccggttcggagaataccgcgctggtcggctgctcggcgctgccggtcaggcgcaggccggcgaccacgtcgtcgacccggcggatcgcctcgatatccaggtacggctggtcgatcggtccggcgaaaaacagccgcgccctacggatcgtcaggcgctggccgtatgcacgatagcggcccttgttcaggttcagctcgccgcgggtatccaggttgtctccgatgtgcaggtggccggccagttcggcgctgaggccgaagccggagaacgccagcttgtcctggccgacctcgacatcgatgtccatcttcatcttcagcggctgctgctcgggctgctcggagccgacgatcaccgcgtcgtcggagaccttgaccgtggatggcggcaactggcggatggtgatgtcgccacgcggcaccaggaccttgccggagatcgccagctcctgcccggccatgccgatcttcaggtccggttccacctccagttgcgcatagggatcgaccaccaccggcaggcggttgccacggatgttcagggcgacgttcagcgcgtcgccccagctcaggttgccggacaggctgccctggccgtacctgccgctgcgccagccgccgccgagttccaggctttcgccagcgatgcgagcgtcgagggaaaggttctcgaagctggtcggcagctcgccgccgccaatgttgccgtcgctcagcgtcacccgtccgtcgacccgcggcgccagcaggccgccggacagccggccgctgccgttcagcctgccttgcagtttctccaccatcggcacgaacgggcgcgccaccgacaggtcgaggccggccaggctgaactcgccgctcagcggcttgctcgccgggcgcgggtcgatctgcgcctgcacccgcaactcgccgagcttcggtccgcggaagtcgagggaggtatcgacgcggttgggcgccaaccggctctccaggcgcaggctgtcgtagccgacgtcgacccactggccctggtcgcgcaggcgcagcgtaccgctgccggcgtccaggctgaccacgccgctcgggccgcgggccggaacgtccagttgcaggtcgccgttcagcttgccctgccaggcgaagtcctcggggaaccattgcttcaggctgtccagcgggaagtcgcgcaaggtgtagcgcagccgcggctcgggcagcaggcgctgctcgccgccgcagaggctggcgccgccggatacccagcaatgtgcgccgaaattgaccttgccgtcggccaaccgctccaggcgcgccggctgctgtag

SEQ ID NO: 15091 - DNA, 1446 bp, Pseudomonas aeruginosa
caaagacctctggagccgtaccctgagcctggttttcctcggattcctctgttacgccttcccctggtcggtattcgccgcccccttgccgatccccacggacgacacgccggcgctgcgcatccagggttccaacaccatcggcgcgaagctcctgccggccctggtcgagggcctgatggaagaggaaggcctggaggatatccgccgtacccccggagaacgggaaaacgaactccatctgctcggcaagagccgcgacggccgcctggtgagggtggagctatccgcccacggttcgagcaccggcttcgccgccctcctcgaacgccacgccgaactcgccgcggcctcgcgtcccgtcaaggacagcgaagttcgtgccctggccggcttcggcgacctgcgcagcccatatgccgagcaggtgatcgccatcgacggactggcgatcatcctgcatccggacaacccgctggcctcgctgcacaccgcgcaactggcggcggtgttcgccggcgaggtgcgtacctgggaagaactgggcggcaagggcggcgccatccgcctgtacgctcgcgacgagcagtccggcacctacgacaccttcaaggaactggtgctggccagtcacggcaaaagcctggccagcgacgcccgccgcttcgaatccaacgatcggctggcggccgcggtgagcgccgatccgcacgccatcggcttcgtcggcatcgcgtcggtgggccgggcccgcgccttggccatcgccgacggcgaatcgctgccgatggcgccccaggaaagcctgatcgccaccgaggactatccgctgtcgcgccgcctgttcctctacctgaagcccggcgagaagaacccctgggcccaggccctggtacgtttcgcccagggcccgcgcggccaggcgatcgtcacccgcagcggcttcgtcgcgcagaagatccaggcggtgcagatcgcaccgcgcccgcagatgcccgccgaataccgcaagctcgcggaacaggcgcggcgcctgacggtgaacttccgcttccaggaaggcagcgcgctgctcgacaacaaggcactgctcgacgtacagcgtttgctggactacctgcggcaaaatcggaagttgcaggagcgcaccgtgctggtgggcttcggcgatcccaagtccgacgccgagcgctcggtcctgctttcgcgcctgcgcgccatggccgtgcgccgcgaactggcccgcggcggcgtgagtttccgcgagatccccggcttcggcgacgagttgccggtcgcccagcaacgaccaggaactgggccgacagaagaaccggcgggtggaagtctgggtctactgaacgctgtagccactttgtaacctcgccgttttgccggcgcccggagcctggtttattttttccgagtgactgcgggcccctctga

SEQ ID NO: 15092 - DNA, 237 bp, Pseudomonas aeruginosa
agacccgcacgccgaaagccaccgtcgaggacaaggccgaaccgaatgccgaacacgctctggatcgaacgtctggacacccacgctgaacctttctggcgggtccgcctcggcacgcgtgggatctgcttccgcaacgagcgggcggcccgcgagttcgccgccctgctgcacagccgtcgcgcgtggcagctggaacgcaacgccgaggaaaaaggggcggagtccccggaatga

SEQ ID NO: 15093 - DNA, 1389 bp, Pseudomonas aeruginosa
aaaaggcccgcacccgcgggcctttcccctataccacagccgtcagcggctgctgcgcagcatctccctgggcacgtacttgcccagctcgaacttgccgatcgccgcgcggtgcacctcgtccgggccgtcggccaggcgcagggtgcgctgcatggcgtaccagtaagccagcgggaagtcgttggaaaccccggcgccaccgtgcatctggatcgcccggtcgatcaccttcaacgccacgttgggcgccaccaccttgatctgggcgatttcgctctgggcgatcttgttgcccacggtatccatcatgtaggcggcctgcagggtcagcaggcgcgccatgttgatctccatccgcgagtcggcgatgtggtcgatgttgccgcccaggcgcgccagcggcttgccgaacgcggtacggctgaccgcgcgcttgcacatcagttcgagggcgcgctcggccatgccgatggagcgcatgcagtggtggatgcggcccgggccgaggcgcccctgggcgatctcgaaaccgcggccctcgccgaggatgacgttctcgtagggcacccgcacgttctcgaacagcacttcggcatggccatgcggcgcgtcgtcgtagccgaacaccggcagcggacggaggatcttcaccccgggggtgtcgaccggtaccaggatcatcgagtgctgctggtggcgcggcgcgtccgggttggtcaggcccatgaagatcaggatcttgcagcgcggatcacaggcgccggaagtccaccacttgcgcccgttgatcacccagtcgtcgccctggcgctcggcgcgcgcctccatattggtggcgtcggacgaggccacgcccggttcggtcatggcgaaggccgagcggatctcgccgctcagcagcggttccagccaagtgcgcttctgctcctcgctgccgtagcgcaccagcacctccatgttgccggtatccggcgcggcgcagttgaagggttccggcccgatcagcgaacggcccatgatttccgccagcggcgcgtattcgtggttggccagcccggcaccgtactcggactcgggcaggaacaggttccacagcccttcggccttggccttggccttcagctcttccatgatcgccgtcggctgccagcggtcgccctcggcgacctggcgctcgaacacggcttcggcgggatagacatgcgcttccatgaacgcgctgacgcgttcacgcagctcctggaccttgggggaataggcgaaatccatgggggataccttctgacgggttggcaggcgaggcatcggacaaaggcgctggtaacgatgccggaacagggcttaagatttgcccagtctattttttccgtccatgaacattcatga

SEQ ID NO: 15094 - DNA, 957 bp, Pseudomonas aeruginosa
tggtcgagcaggcgccgtcgccagcggcgatctcctcgagggccatggcgtaggccaggtgcccggtctgcgcgccgccccattcctcgggcaccagcatgccgaggaagccgaggtcggccatctcgcggattgcctcggccgggaaacggtgctcgcggtcccagtcggcggcgaacggtttcagccgttcctgggcgaactgccgcgccatgtcacggatctggatctcttcttcgcagggaatcatcgcgggttcctcttcttcactgcctgcatcagcgcaagcgctcgacggcgatcgcggtcgcctcgccgccgccgatgcagaccgccgccacgccgcgttccaggtcgtactgctgcagggcgttgagcagggtcacgacgatccgcgcgccggacgcgccgatcggatggcccagcgcacaggcgccgccgtggacgttgaggcgctcgtgggacaggtcgaggtcgcgcattgccgccatgccgaccacggcgaaggcttcgttgacctcgaacaggtcgacctcgcccagcgaccagccggtacgctgcatcaggcgcttcaccgcaccgaccggcgcggtggggaacaggttcggcgcgtcggcgaacgaagcatgcccacgaatcgccgccaacggcgcgagcccgcgtcgctcggcctcggaaaggcgcatcaggaccagcgcggcggcgccgtcggaaatcgaactggagttggccgcggtcaccgtgccgccttcgcggaacgccggcttcagggtcgggatcttgtccagccgggccttcggcggctgctcgtcgctatccaccaggcgctcggtcttgccgacggtgaccgtcagcggcacgatctcggcctggaagcgcccgtcgcgcatggcttgctgcgcgcgggtcagcgaggccacggcgaactcgtcctgtgcttcgcgggtgaagccgtag

SEQ ID NO: 15095 - DNA, 444 bp, Pseudomonas aeruginosa
ggcgcgttggacatgctttccatgcccccggccagcgcgaccccggcgctgccggcgagcaacgtgtcatgggcgagcatcagcgccttcatgcccgagccgcacatcttgttcagcgtcgagcacggcgtgccgcgcgccagtccggcgccaagcaccgcctggcgcgccggcgcctggccctggccggcggcgagcacgcagccgagcacggcctcgtccacttcgtcggcttgcaggcgcgcccgctccaccgcggcgcgcaccgccgcggcaccgagggtagcggcgttgacgtccttgaagtcgccgaggaagccgcccatcggggtgcggacggcgctgacgatgacgatcggatcttcgcgggtcatgggatcttcctcctgtattagcgggcggccatgcggatggcgccgtcgaggcgaatcacttcgccgttga

SEQ ID NO: 15096 - DNA, 1965 bp, Pseudomonas aeruginosa
cccgcgcgtagggtttgccgagcagctgcggatcgataccggcggcctggaggacctccccctgctcgccgccctgccggcgccactccaccagcgcttcgccgaccaggcgcaccgagatggtgcccttggtactcgcctgagtctcgccgtcgttcttcacccgcccctctcgcctcgctgcgcgccgcccgccaccttagcgcaggagcggggcgcggctccatcctctcaatcgcgcccctggcgcagcgcgagcaggcgaatctcttcgatgctgatctcgcgcatgcggaacttctggatcttgccggtaacggtcatcgggaactcgtcgacgaacttgaagtggcgcgggatcttgaagtgagcgatacgcgccttgcagaacgcccgcaactgttcgtcatcggcgtggtggcccggatgcagcttgatccaggcgacgatttcctcgccatagcgctcgtcggggatgccgatcacctgcacgtcggccaccgccgggtgagtgaagaagaactcctccagttcgcgcggatagatgttctcgccgccgcggatgatcatgtccttgctgcgcccgacgatccgcacgtagccgtcgtcgtccatcaccgccaggtcgccggtgtgcatccagcgcgccgggtcgatggcctcggcggtggcctgggggtcgttccagtagccgagcatcacgctgtagccgcgggtgcacagctcgccgatctcgccgcgcggcaccaccctgcccgtctggtcgacgatcttgctctccagcctcggctgggtgcgtccgacagtggtcacgcgcagctccaggccatcgtccggaccggtctgcagcgacaccggactggtctcggtcatgccgtaggcgatctgcacctcggccatgtgcatgtcgccaatgacccgccgcatcacctcgatcgggcaggtggcgccggccatgattccggtgcgcaggctggaaaggtcgaattcgcggcggcgcggatgatccagctcggcgatgaacatggtcggtaccccgtacagcgcggtggcgcgctcctcggccacggccagcagggtcgcctcggcgtcgaagctgggcgccgggtagatcatggtcgagccgtgggtgacgcagccgaggttgcccatcaccatgccgaagcagtgatacagcggcaccgggatcaccaggcggtcttccgcgccgagtccgaggctttcgccgaccatgtagccgttgttgaggatgttgtagtggctgagggtggcgcccttggggaagccggtggtaccggaggtgtactggatgttgatcggctcgtcgaactgcagcgaggcctggcgctggcgcagttcctcggcgcctaccgcggcggccagccccggcaggccctgccagtgcaggaagcccgccggcgcccgctcggccaggctgatcacgccgcgcagttccggcaggcgctcgctggccagttcgcccggacgcgcccgcgccagctccggcagcaggtcgccgagcatcgcgtggtagtcgctggtcttgaaggcgtcggcgcagatcagccaactgcaaccggactgcttgagagcgtattccagctcgctgctgcggtatgccgggttgatgttcaccaggaccgcaccgaccttggcgctggcgaactgggtaatgcaccattcggcgcagttcggcgcccaaatccccaggcgttcgccggggcgcaggcccagggcgatgaaggcgcgggcgtaggcatcgacccgctccgccagttgccgccagctgtagcgcaggcgttgatgccgcaccaccagcgcctcgcgctcggcatgacgcgcgacggtggcatcgaaggcgtcgccgacggtggtcgccagcaaggcgacatcctggcgacccgaggtatagctcggctgattcatggctttcccttgttgtggttgttctgggaatgtcgctga

SEQ ID NO: 15097 - DNA, 735 bp, Pseudomonas aeruginosa
aatgggcggtttttcacaggagcacagcatgaccccggaaatcgccatcggcctggtgacggccctcggcctcggtgcgctggtcggtctcgagcgacaatggcgacagcgctcttccggcatggccacccacgcgatggtcgcactcggtgcggccagcttctcgatcctgccgctgttgctcgacaacgaagtcagcgtgacccgcatggcggcccaggtagtcagcggcatcggttttctcggcgccggcgtgatcatgcgcgacgggctcagcgtacgcggcctgagcactgcggcgagcatctggagcaccggcgcgatcggcgtactggccggcagcggtttcatcctggcggcctgcatgacgaccgcgctgatcgtcatcgccaacctgttcctgcccgctctcggccgggtggtggaccgccacacctcgggcgaggccgagcaggagcgcttctaccagatcagcgtgtcctgcgaggcgcgcaacgaagcgctggtgcgcatgcagttgctgcaacgcatgggcgacaaccgcctgaacctgcagagcctggaaagccacgcgctgaaaggcagcggcaacgtggaagtgaacgccgtggtgttcaccctgcacaaggaggattcgctggtggaacagatggtcggcgagctgtgcctggcaccgcaggtcaccgccgccagttgggtgatgaatcccgccgcggaatgaaccggcgaatttag

SEQ ID NO: 15098 - DNA, 549 bp, Pseudomonas aeruginosa
ccgacttggcgaggaacgcacaaatttcatcggctggcgtacaggtatgggacatcggtaccaatagcgaagtcgcgcaatccgtcagttttttttgaatttttgccattggaaaaagtctgttcagcgcagcgtttttccaagtcccatccggcccgcaaggagaacccatggctgaaccccaggacaagtacacccggcgcacaggcaggacctgggcggacgaccaggcgacctacaaccgtctgcgcgaagaagccgacgccgctcgccagaagctgcgcgaaagcggctacagcggcgccgagtacgaccagttgcgtcaagccgccttcgatctcaaccgcaaggccaaccagtactgggagcagatgctcagcgacctgcgccaggaagactgatcagcgccacgccgggagactgccgctctcggcccgcacaccccctccactctttgcgtgctcctggcgtcggctcattcgggcgcatccgggtattgcacctcgtccagcaggcgaaaccccacgttgtcggcgtccagcgcgctga

SEQ ID NO: 15099 - DNA, 768 bp, Pseudomonas aeruginosa
gtcagatccttcgactggcacaatgtgacattcgtcacagagattaaccgaagccccgcagaacatccatgccagctatttcccttcgtcggctctggcccggcccctgcgtcgtcctcaagttgtcagatccgctgtcgatactctgcgtgccggaacacgcgccatgcccgcctcgccgggccacagggacgtcctcggctgcctcgtcgcagcctgcgtgccggtccaacctggcaatccatcgaggcgttccatgctgcaacaatccctacgtgcgcaaatccttgtcctgctcggcggcagcctggcggcgctgctactcatagccctggcctgcttcggctcgctgaccggcgacgtacgcgcctaccgcgagctgctcggcggccccgtgcgggcggcgcaactgatcgacgaggccaacctgcaattccgcggccaggtccaggaatggaagaacgtcctgctgcgcggacgccaggcagaggcccagacgaaatactggagccagttcgaagcccaggagcgagcggtgcaggacatcctcgggcgcctgggcagcgtggccgaaggcgagttgaaggatcgtgtcgagcgcctgcgcgaagagcaccggcgactcggtacggcttaccgacaaggcaggcaacggttcctcgaggcgggcgccgaccccatcgccggcgaccaggcggtgaccggcatcgaccgtgccaccaccgcgcagatgcaggccctgcgcgacgaactgcaccaggccagtga

SEQ ID NO: 15100 - DNA, 582 bp, Pseudomonas aeruginosa
tctccattcctcctccatcagcgcggaggcccggcgcaccatgctgctcggcagcctggtgctgatcggcgccagcctggccgtcgccctgctcagcctgtggctggtcaaccgcaacctggtccgtccggtgcaacgcctgatcgagcacatcgcccagctcagccatggcgacttcggcgagcgcatcgagatccggcgcaaggacgaactcggcaagctggccctggccgccaacaccctgcgcgacttcctggtggacatcttcgaccggctgcggcgcagtacccgcgacctggacagcgccagcggctcgctgaacgcgatcgccagcctgatggcggccggtacccgcgagcagttcagccgcaccgaccaggtcgccacggcgatgcaggaaatgtccgccaccgcccaggaagtggcgcgctacgccggcgacgcggccagggccgccgacgaggcggacgattccgcccagcgcggcgaagacgtgatggaagaaacgattcgcagcatcggcgagatgcgcaaggagatcgaccatacggtggaggtcatccgccaattggaaagcgatag

SEQ ID NO: 15101 - DNA, 555 bp, Pseudomonas aeruginosa
cggcaggatcggcaaggtcctcgacgtgatccgtggcatcgccgagcagaccaacctgctcgctctcaacgcggccatcgaagccgcccgcgccggcgatgccggccgtggcttcgcggtggtcgccgacgaggtccgcaccctggcgcagcgcaccgccgagtccatcgccgagatccaccagatcatcgataccgtgcagaacggcgcggtgaatgccgcgcgcgccatcgaaagcgggcagtcgcgcagcgaggccggtgccgagcaggttgccaacgccggcgccatgctgcgccagatcaccgcctcggtcgaatcgatccgcgacatgaaccgccagatcgctaccgccgccgaggaacagaccgccgtggccgaggacatttcccgcaacctcacggaaatcgcctcgatcgcctccagcaaccaggaacaggtggagcagaccgaagccgccagccgcgatctccacggcctctccgcgcaactgggcgatgccctgcaacgcctgcgggcctgacctggggtaagaaaacgacttccatgaggtaa

SEQ ID NO: 15102 - DNA, 1641 bp, Pseudomonas aeruginosa
ccatgcctgccccttccggccacggtccgaacgaccgtggccagcgttcgttcgcctgaacgcctgtcgtcatcccttgttttttccaatgccatcccgcggcccgcgctgtcgaccgactgcacgggccgtgcctcgcccctgggtatcccgatgctacagacgctgaaacagaactggttctccaacctccgcggcgacctgctcgccggcctggtcgtcgccctggcgctgatccccgaggccatcgccttctccatcatcgccggggtcgacccgaagatcggcctgtacgcctccttcagcatggcggtggtgatcgccttcgccggcggccgtccgggaatgatctccgccgcgactggcgccatggcgctgctgatggtcaacctggtgaaggaccacggcctgcaatacctgctggcggcgaccctgctctgcggcgtgctgcagatactcgccggctacctgcgcctgggttcgctgatgcgcttcgtctcgcgctcggtggtgaccggtttcgtcaatgccctggcgatcctcatcttcatggcccagctacccgaactcaccgatgtcggctggccggtctacgcgatgaccgccgcgggcctggcgatcgtctacggcttcccgcacctgccccggatcggccggctgctgccctctccgctggtatgcatcctggtcctcaccggcatatccatctacctgggcctggacatccgcaccgtcggcgacatgggtcagttgcccgacagcctgccgctgttcctctggccggacgtgccgctgaacctcgacaccctgctgatcgtcctgccctactccgccgccctggcggtggtcggccttctggagtcgctgatgaccgccaccatcgtcgacgagatgaccgacaccggcagcgacaagaaccgcgaatgcaagggccagggcctggcgaacatcgccaccggcctgctcggcggcatggctggctgcgcgatgatcggccagtcggtgatcaatgttaaatccggcgggcgcagccggctctcgaccctgatggccggcgtcgcgctgctgctgatggtggtgttcctcagcgactgggtcgggcggattcccatggcggccctggtggcggtgatgatcatggtatccatcggcaccttccgctgggagtcgatccgcaacctgaagcgctacccgctatcgaccaacctggtcatgctggtgacggtcggcgtggtcctcgccacccacaacctggccttcggcgtggtcgccggcgttctcctggcctcgctgttcttcgccaacaagatcgggcactacctcgatatcgacagcgaacgctccgccgacggcacccgccgccactaccaggtgaggggacaggtgttcttcgcgtcgtccggcaggttcgtcgctgccttcgacctgaaagagacactggagcatgtgctcatcgacctgcgccacgcccacctgtgggacgtcaccgccgtcgcggcactggacaaggtggtcctgggctttcgccagcgcggcgtgcaggtcgacgtgctgggcctgaacgccgccagcgcgaccctggtcgatcgcttcggcgcctacgacaagccgggcgccgtggacattctccccggccattga

SEQ ID NO: 15103 - DNA, 396 bp, Pseudomonas aeruginosa
ataccatcatccgtacgctgggctatcccttttccaacgacctcatgctcgaggcgcgcgaccgcatccgcgcggaactgccggatttcactctctacaagatcagcccgacgcgcttcggactgctcctgccacggcagcaacaggaagaaaccgagtcggtctgcctccgcctgctgcgggccttcgaaagccccgtcgtatgtcgcgggatcccgatcaaggccaacgtgggcctcggcgtactaccgcttgccgacgatcccctcgacggcgatcaggactggctgcgcctggtggtcagcgcggccgacgacgcccgcgaccgcggtgtcggctgggcccgctacaacccgccgctggaccaggcccagcagcgtgccttcacattgctga

SEQ ID NO: 15104 - DNA, 408 bp, Pseudomonas aeruginosa
tgcgccccctcagcgactgggtgctgcgccatgccatggcccagctggcgcaatggaacgcacggaacatcccgctcaggctggcgatcaacgtatcggcatcggacatggaagacagcagcttcctggaagaggccgtcagactcgccaaaacctacaacatcgacctttccgccctcgagctggaattcaccgaaagcgtactcatccgcgacgcctcggcggtcggctcggtgctgctgcgtgcccgggagcttggcatgggcatcgcggtggacgacttcggcaccggctacagcaactggacctacctgcgcgatctgccaatcaccgccatcaagctcgaccaatcgttcacccgcgacctcgccggctcgccgaaggcgcagagcgtcacccaggcggtga

SEQ ID NO: 15105 - DNA, 399 bp, Pseudomonas aeruginosa
gattgccggccatctggcggacctcctgtccctgcaaaggcaggccgaggagcagcaggcgctcttccgcagcccacggcgccaatagcggaaaatcggcgggaggcgcatgcaccacgacctgcaagcgggagtcgagacgccagaaccgctcgagaacgggaatatccgcgcctaccgacggcatcccgaggaagaccacggcatacggcgcatcggcctggagggccgagcgtatccgccccaatgcctcctcggcgcttcccgccgtatccacctggtagccccgctcaggcgccacgggaggcgattcggcccctagggttccctgcaacaacccgcatacacggtctcgatccgcctgccgctcatcgatcaccagcaagcgccggttcctga

SEQ ID NO: 15106 - DNA, 1455 bp, Pseudomonas aeruginosa
tccgcacctccgctcgcccagccgccgcgtgcatgcgccctcgtccaggccagactcggactatgcttgcctgaagtattcaggcaaaactcacccggtggacagacactcatgaacgatagcgcacctccttccaacgagacggagatccgcttcagcgtgctgctggtcgacgacgagccgctgatcctcagcagcctgcgccggctgctacgcaaccagccctacgacctgttgctggcggagagcggcgaacaggccctgcaactgctggaaagccggcccgtggacctggtggtgtccgacgcccgcatgccgaacatggacggcgctgccctgctcgcggaaatccatcgccgctccccggaaaccattcgcatcctgctcaccggccatgccgacctgccaaccatcgccaaggccatcaatgaagggcgcatccaccattacctgagcaagccgtggaacgacgacgagttgctgctgaccctgcgccagtcgctcgaatacctgcattccgagcgcgagcggcggcgcctggagcgacttacccaggagcagaacgaccgcctccagcaactcaacgccacgctggaaaagcgcgttcaggcgcgcaccgccgaactgcagcagaccgccgacatgctcgacctcgcctatgaggagctaaagcgcagctacgtggtcggcaccgaagtcttctcgctgctggtcaaccagcgcctgcccaaggacaagcagaccaaccagcaaatcatcgaactggtccgcgcctgctgtgccagcggcctcgtcgacgaatcggatggtcgcgacctggcgatggccgcggcgctctacaacatcggcaagctaagctggaacgacaccctgctcagctcgccctcggacctgctctatcaccacgaccgcgatcgtttccgcggctacccggaactcagcgagtcgctgctgatgtcgctggaaccgatgcaggacgccgcccgcctgattcgccatcaccaggagcactgggacggcagcggctatccggaccacctcaagggcgaggccattcccctgggctcgcgcctcttgaagctggcggtggatttcgtcgagctgcagcgcggactgatcctcgaacggcgcatgaatcgcgacgaagcactgatgtacatccgcaaatacgccggccggctgtacgaccccgagctgatcgaaccgttcatccaggtctgcgcgacgacccttgccgatgtcaccctggccgatccgcaagtccgtgcccatggcacccgcgacctggttccgggcatggtgctggcgcgcaacctcaccgccaacaacggcatgctgctgctcaacgcgggcaaggtcctgaacctggcgctgatcgagaagctgatcgccttcgaagcgatcgaaggcgcacgctacacgctgttcgtgcgcctcccggagtcgacgacctag

SEQ ID NO: 15107 - DNA, 441 bp, Pseudomonas aeruginosa
atcaaaggccaagtcctcgcggttttatgcccatcgactttctcgatattccattttcatccgtactggccgtctctcgctgccggccgcgctggaccgtggatacccggctttcctggggaagccgggtatccatcgcatcagccgataggaatcaccggttatttcccattgatctcatcgaggccgtcgctaatatcgaatccaatttccaaacaaggagcctcacgatgtctgacgcattcctctcctccatcaagaaccgccgcaccatctacgccctggacaagcaactgcccgtctcccaggagaaaatcgtcgaactggtcaaggaggccgtctcgcacagcccttccgcgttcaactcgcagagctcgcgggtggtcgtcctgttcggcgccgagcacgagcagttctggaacatcgccaaggacgagttga

SEQ ID NO: 15108 - DNA, 600 bp, Pseudomonas aeruginosa
acgccggctccccccgatgacctgagcgaggcactccgcatgcccacacccggcacgggttccgtcccggaattgcaactcgtcccgttccagctggaacacttcccaatcctgcaacgctggttcgccacggaaaaggagctggtgcaatgggccggccccgccctgcggcatccgctgagcctcgagcagatgcatgaagacctcgcggaaagccgccggcgaccgccgctgcgcctgctctggagcgcttgccgggatgaccaggtcatcggccattgccagttgctgttcgaccgccgcaacggcgtcgtccgcctggctcgcatagtcctggcgccaagcgcgcgcggccagggcctggggctaccgatgctggaggcgctgctcgccgaggccttcgccgacgccgacatcgagcgcgttgaattgaacgtgtacgactggaacgctgccgcccgtcatctctatcgacgcgcggggttccgcgaagaaggcttgcgccgctccgccacccgggtcggccgggaacgctggaatgtcgttctcatggggcttttgcggcaagagtgggcggcgggaggcgccggcaacgactga

SEQ ID NO: 15109 - DNA, 486 bp, Pseudomonas aeruginosa
ccatccatccgcggcatcatgccgtcggtaatcacgacgtcgaagtcttcgccctgccaacgttcgaatgcttcctcgccatcttccgtggaggtcacccggtgcccaaggctttccaattgcatggtcagggtcagccgattgaacggatggtcttccgcaagcaatatcgagagcgcccttgcctctttccgctcctcgacctcggcaactccggaacgcgcttcgctggactcgctgggcggaggctcggtcagcggaagatcgaactcgaccgagaagcaggagccgttgcccagttcgctgcgcaggctgatctggccgcccatcaggtgcaccaggcgtcggctgatgtacaaccccaggccgctgccggacgcctggccaagcgcaggcgagccgacctgcgagaatggccggaacagcctggcctggtcctcctccgaaataccgaggccggtgtcgcttacctcgagcagcaaatga

SEQ ID NO: 15110 - DNA, 690 bp, Pseudomonas aeruginosa
atctatatttggagcgggaaacgagactcgaactcgcgaccccgaccttggcaaggtcgtgctctaccaactgagctattcccgcatcgtcttggtgacgggcgccattctatagcatcgcggcgccgtgtcaactccttgattcaaaaaagtttatttctctttcggggtggtcgacagatgcggccacgcggccagcaggtagtgcaccatggaccacagggtcagcgccgcggagatgatcagcagcacgtagccgagaatcacccagaaggtcatcagcggcggattcgccaggagaatgaccagcgccagcatctgcgccgcggtcttccacttgcccaggttggacaccgcgacctgcgccctcgcccccagttcggccatccactcacgcaaggcggaaaccacgatctcgcggccgatgatgatcaccgccggcagggtcagccacaggttggcgtgctcttccaccagcaagaccagcgcaaccgccaccatcagcttgtccgcgaccgggtcgaggaaggcgccgaacggcgtgctctggccgaggcgccgggcgaggtagccgtccagccagtcggtggcggcggccagggcgaacacggcactggcggtcaggtagctccaggacgtcggcagatagaacagcagaatgaagatcggaatgagcaggacgcgcagtaa

SEQ ID NO: 15111 - DNA, 2769 bp, Pseudomonas aeruginosa
gccggcattctactcgctgtgcaggacggcataaatctgctcggcaagctttttactgataccgggggctttggccagttcatcgatactcgcccgcgacaattcctgcaacccgccgaaatgcttgagcaggtcgcgccgacgtttcgggccgacgccagggacgtcctccagcgtcgacgtccgccgtgccttgccgcgccgcgcacggtggccggtgatggcgaaacggtgcgcttcgtcacgtatctgctggatcaggtgcagcgccggcgaatcggccggcagggtgaactcgtgggaggcatcgttcaggtagagggtttccagccccggcttgcgggtcacgcccttggccacgccgagcaggatcagaccggcgaccgccagttcctggagcacatcctgggccatggccaattgccccttgccgccatccaccaggagaatgtcgggcatcttcccctcgccgtccttcaggcgactgaagcggcgggtcagcgcctggtgcatcgctgcgtagtcgtcgccggccgtgacgccttcgatgttgtagcggcgatagtccgacttcagcggcccttccgggccgaacaccacgcaggaagccacggtggcctcgccgctggagtgactgatatcgaagcactccaggcgttgcggcggctccgccaggtcgagcgcctcggcaagggcttcgaagcgtgccgccacatgctggcggttggccaggcgtgcgcccagggcctgttcggcgttggtcaccgccagttgctgccagcgggcgcgggtaccacgcacccggtagctgatctccagttcgcggcctcgcgcttcggcgatcgccgaaaccagcaccgggaaatcctcgtgcgtcacgttgacgatcaactccgccggcaggtcgcgctcctggtggctgagatagtactggccaaggaacgccagcagcacttcgcccacctcctcctcgatcgcgacctgcgggaagaagttcttgctgcccagcacccgcccgccgcgtacgctgatcaggtgtacgcaagcgccgccaggggtgacgatggcggcgacgatgtcgacgtcgccgttgccaccttccatgctctgctggtcctggacccgccgcaggatcgccacctggtcgcgcaactccgccgccttctcgaagtccaggcgcatcgccgcctgctccatgccgacgttcagctcgtcggccagcgcgttgctccttccttcgaggaacatcaccgagtggcgcacgtcctcggcgtactcctcaggactgaccagccccacgcagggccccttgcagcgcttgatctggtattgcaggcagggccgcgtacggttgcggaaatagctgtcctcgcactggcggacgagaaacgccttctgcagcaggttgaggctctcgcggatcgctcccgcgctcggatagggaccgaagtaacgccccttgcgcttcttcgcgccacggtgcagggacagccgcggatactcgtcctcgctggagaggaacacgaagggataggacttgtcgtcccgcagcaggatgttgtagggcggccgccactccttgatcagcgtctgctccagcagcaacgcctcggtttcattggcggtgatggtggtttccacctgggcgatccgcgccaccagcgcagcggtcttcggcgccaggccggacttgcggaaatagctggccaggcgcttcttcaggctcttcgccttgcccacgtagagaagcttggcgtccgcatcgaacatgcggtagacgcccggacgattgctgcaggtagcgaggaaagcgcttgcgtcgaaaacggcgctcatctagctggcggcatcgaccatgccgtggcggacggcgagcagcgccagctccacgtcgctggtgatcgagagcttctcgaagatgcggtagcgataggtattcacggtcttcggcgacaggcacagcttgtcggagatgctctgcaccttgtggcagttggcgatcatcagggcgatctggatctcgcgctcggacagcgaatcgaagggggaatcgtgctgctgcggctggaaggacttcagcgccagttgctgggcgatctgcgggctgatatagcgctggccggcgaagacctggcgaatcgcctggaccatttcctccagccccgcgcccttggtcatgtagccggcggcgccggcctgcatgaggcgggtggggaacggatcctcttcgcagacggtgactaccacgaccttgatgtcgggctggctgcgcagcagcttgcgggttgcctccaggccgccgataccgggcatcttcacgtccatcaggacgacatccggcttcagttcgcgggccagtttcagacagtcttcaccgcagtcggcctggccgaccacttgcaagccttcgatgtcggccagcatgcgggtaataccggtgcgtaccagatcgtggtcgtcgaccaccagcaccttaatcacgctgcacctcgtcgcgcattagcagacaaccgcccacacgggcccccaggagatttcggcaaccttaacagaaagccatcccatgacctagcttggcgcaaaggcgtcataaatcaagcgtcatggaaacatcattcgacggcatcgaacgggcgctgcgaagtataccgccagcccccggcgagcggcagaccggatcgcagcaaaaaccggcgaatctgtggagagcccagcgacgccgggcctggtaaagcgcaagcgccctggttgcccgggactcctccatag

SEQ ID NO: 15112 - DNA, 1209 bp, Pseudomonas aeruginosa
catcgcgtgcaagaggtaaccgatgagcccgtccgaaaacatccagtacgatttcgagtggcgaccactcaacaactacctcgccgtgcaacgcatcacgcctccggacatgcgtcagggttcggctgccgagccgcgcctgcccagcgaagcgctctacgagtggatcgtgctgaacggacgctcccccctggaaggcctgagcctgggggagcactaccgcctttccgactacggcgtcgccgggctggcattgcagagtgccggcaccgtgggcgaagccttgcaactgatcaagaccaacatgctgctgttccgcaaggatatccgcgggatcgcggtgcgacgttccagttgcgacaccgtggatgtggatatcgacctgcaggacaagccggactggccgcagtcggcccggctgtatcacgccaacgtcctggcgtcggccgcctacgcggtgttccgcgacctgctgctgggcgagctggaactggtccgcctgcgcctcccggaaaggaacggcgacgtgcgggcatacgaggagtatttccgggtgccggtgtatttcgccggcgcaggcatcaccttcaccctccccgaggaattgctcgaggccgagatcgccactgccaactccgccgtgttccaggcctcgctggcgctcggcagcaaggccttcaacacccgcgtcacccgcgagatgggcggctaccgccaacgcatcgtggcactgctggaggtgctacaggaccgctacccgagcatcgcctgggtcgcccggcagttgaaggtcaccgaacggacgctgcgccgacggctcgccgacgagggcaccaactaccgggaagtgctcgacctggtccgccacgacagggcgcgccaactgctgcgggacgagcgactgcgcatcgaggaagtcgccgagaggctgggctacatggatacctccagttttcgccacgccttccgtcgctggacgggacagtgcgccaacgactatcgccaggcccgcctcgccggcaagaccgcgcggcgccagggcgaacgctagccggcatgattcccttcagggcaatttctgcggataggggcgaaaggcgaacaggctgcacgcagccagggaaaaagccgcgagcagcacccattcggccgtcccgtagccttcggcgcggtcgtacagccagcccagcaggtaagcgccgagactga

SEQ ID NO: 15113 - DNA, 1248 bp, Pseudomonas aeruginosa
gtagtagaaggcgccgttgaagccgatctgcgaggcataggtgtcgtagcgcagcacgtcgccataggtggtgttctgcgcgggcagcttgtccggacggacgtcgaacaggttgtcggcgccggcggtcagcgtcaggtcggcgctgagccggtagcgcgcggcgatgtcggtgatgtacttcgggtcgttgacgaaatggttgaatttctccgtcgaccaggcgtccggccctaccgtgtagtcgagttccgagctggtccggccgtagcgcgtcaggcgcaggctgacctcccagtcctggcggctccaggtgccgccgagggaaacctggctgcgcggggtggagctggtgatccaggcgacctgctgggcattgagcagcggctcgccgttggcgcctcgatggttcttgcgcaaggtggtgcggttgaagttggccgacagttcccagtcgacctgcccgtactcgccaagcgcgacgaggtagtgaccggtgatgtcgacaccgcgggtgcgggtgtcggcaccgttggccaggtaatgggtactgaccgtactggcactggccggcaacgagatccccgccgcggccagggcatcgatggcttcctggccggaataggtggcgctgtcgacgatgcggtcgcggatgctgatctggtaggcgtcgatgttcagcccgacgttttcccacgggctgagtaccaggccaaggttgaagctggtcgacttctccggttgcagttcgtcggcgccgagcatcttcgccgccggcgagttggccgccagcaggccaagggcgatggtcgggccgacgctgaggccggtgtagtgctcctggaccagggacggcgcgcggaacccgctgcttacgctggcgcgcagcgccacccgcggatcgaactggtaacgggtggcgaacttgccgttggtggtgctgccgaagtcgctgaatttctcgtggcgcaccgccacgtcgacctcccaggctggggtcagggaggtacccaggtccaggtaggacgcccaggcgtgccgcgaccattgcccctcgctgagcggcgagaggccagccagggattccgccccgccgctgtagtaggacgccggttcgcgggcgtcgatgcggtagctttcccgccggtattccgcaccccagcgacaacgcccggcggagcagcgaggaaatccagttcgaattctcgccccaggtccaggttgctggtccattggctgttgcggtag

SEQ ID NO: 15114 - DNA, 1173 bp, Pseudomonas aeruginosa
ccacaggtcagaactaccagttctggtaggtgcaaaatccaacttgtttcgtttcggaaaggaaatccaatgaaaaaagtttgtgcactggcgttatcgatcctgacgacgatcggtgcgacagcggcggacagtgcatgggctgcgcaaaccagcgtccatctttacaactggtatgacttcatcgccccggaaacgcccaaggctttccagaaggaaaccggcacccgtgtcgtcctcgacaccttcgacagcgccgagaccgcgcagggcaaactgatggtcggccgctccggctacgacgtggtggtgatcacctccaacatcctgcccgggctgatcaaggcgggcgtcctccaggaactcgaccgcgaccggctcccccactggaagaacctcgacgcggacatcctcgggaagcttcaggccaacgatcccggcaatcgctatgccgtaccttatctctggggaaccaccgggatcgcctacgacgtggacaaggtccgcaagctgctcggccccgacgcgccggtcgactcctgggacctggtcttcaaggaggagaacatctcccgcctcagccagtgcggcgtggccacgctggactcctccaccgagctggtgtccatcgccctcaactacctgggcctgccgcacaacagccagaatcccgaggactaccagaaagcccaggaactgttgctgaaggttcgcccctacattcgctatttcgactcctccagagtcgacaccgatctctccaacggcaacgtctgcgtggtggtcggctggcagggtacggcctacatggcccaggtcaacaacgaacaggccgggaacggtcgccatatcgcctacagcattccccgggaaggctcgctggtctgggccgagaacatggtgctgctcaaggatgcaccgcatccgcagcagggttatgcgctgatcgactacctgctgcgtccggaggtcatcgccaggacctccaactacgtgggctatccgaatggcaaccaggcggcgctgccgctggtagagcggaagctgcgggaaaacccggcggtttacctgagcaaggaaaccatggcgaccctcttcccgctggaaaccctgccactgaaggtcgagagaatccgtacccgggtctggagccgggtcaagaccgggagctga

SEQ ID NO: 15115 - DNA, 486 bp, Pseudomonas aeruginosa
gcgagcagggcgtcggccacctgttccgcggtaccgaccagggcggtggagttgtgcccgccaccgaccagcctggcgattccggtccaaaggcgctcgtcgaggcgctcgccctgctccaccgccttgagcagacgctgggcgccgacgctctgcggcttgcccttggggaagccggcctcgcccaggcgcgcgccggcgcttgcgcgtatcgcctcggccttggcccaggcctcgtcctccgtgcgcccgaggatgggccggaacgacaggctgaactccacttcgcgaccattcgagcgcgcctgttcgcgcacagcggagatggtttcggcggcctgtgccaggggttcgccccagagcatgaacacatcggcctgcttgccggcgaccttcagcgcggcttccgaggagccgccgaaatacaccggaatgtgcggtttctgctgcggacggatggccgagaaggcgtgctccacgcggtag

SEQ ID NO: 15116 - DNA, 234 bp, Pseudomonas aeruginosa
gcgactttcctgcccttgagatcggcaatgctgcgcaccggagaatccttcggcaccagcagggctatggtatcggggttctgccgcgagacgccgaccagcttcaccggcgcacccttggcggcgaggaagatgaagcccgagtcgccgaggaaacccaggtccagcgctccggcctgcaacccttcggccaccggcgcggcggactggaaatgcttccattcgacctggtaa

SEQ ID NO: 15117 - DNA, 378 bp, Pseudomonas aeruginosa
tactcgccaagcgcagcggcaacctgctcgggggtgcctaccagggcggtggagttccagcgcgccccggtcagccgggccacgccggtccacaaacggctgtcgagcacctcgccctgctcggcggcggccagcaggcgctgcgaaccgacgttctgcggctggtggtcgcgcagcggcagaccgaggcgcgcacggttctcgcggacctgttcgagcacctcggcggcacgcttccaggcggcctcctcggtatccgcgacgatcggccggaatgacaccgagaagcgcggatcgcgtccctgggccttggcggcggcgcgcactcggcggatatgcccgtcgaccgcggccagcggctcgccccagagcatgtag

SEQ ID NO: 15118 - DNA, 684 bp, Pseudomonas aeruginosa
cttagattcaaaatgcatttcaggaataaaaaagcgtttgctaccgtaccgccagaacttcccggagtgaatccccgcatgtcatccatcctgcgcctcgaccgcctgcgccagttcatcggcgagctggcgacactgctcgacagccgtcccgacgaatccaccctgctcgcccaagcccaccccctgctggccgagctggtgcgccaggacgactggctgccggaagactgcgcccgccccgatccacagcgctaccaacagtacctgctgcatgtcgactcacggcagcgcttctcggtggtcagcttcgtctgggggccgggccagatcacaccggtacacgatcatcgggtctggggcctgatcggcatgctccgcggggccgaatactcgcagccgtacgccttcgatgcgggggggcgtccgcatcccagcggagcccgtcgacgcctggagcccggcgaggtcgaagcgctgtcgccacgcattggcgacgtgcaccaggtgagcaacgccttcagcgaccgcacatccatcagtatccacgtctacggcgccaatatcggtgcggtacggcgtgccgtgttcagcgccgaaggtgaggaaaaacccttcatttccggctattccaacagccgcttgcccaatatctgggacctgtcgaaagagaaccccgcatga

SEQ ID NO: 15119 - DNA, 249 bp, Pseudomonas aeruginosa
gcgcctcctggctggcccagatgggctggcaggtcgcggtactggacggactctccgacgccgacttcagcgagaggggcgcctggagcgcgccgctgccgaggcaaccccgggccgacaccatcgacccgaccaccctcgccgactggctgggcgaaccgggcacccgggtgctcgacttcaccgccagcgccaactatgcgaaacgccacatccccggcgccgcctgggtattgcgcagccagttga

SEQ ID NO: 15120 - DNA, 996 bp, Pseudomonas aeruginosa
agtcagcggcgttctgcgcaatacctacggcctgctggcactcaccctggccttcagcggcctggtggcctacgtttcgcagcagatgcgcctgccctatccgaacgtgttcgtggtgctgatcggcttctacggcctgttcttcctcaccgtgaagctgcgcaacagcgcctggggtctggtcagcactttcgccctgaccggcttcatgggctacacgctcggcccgatcctcaacatgtacctcggcctgcccaacggcggcagcgtcatcacttcggcgttcgccatgaccgccctggtgttcttcggcctgtccgcctatgtgctgaccacccgcaaggacatgagcttcctgtccggcttcatcaccgccggcttcttcgtcctgctgggcgccgtgctggtatcgctgttcttccagatcagtggcctgcaactggcgatcagcgccggcttcgtcctgttctcctcggcgatgatcctctaccagaccagcgcgatcatccacggcggcgaacgcaactacatcatggccaccatcagcctgtacgtgtcgatctacaacctgttcatcagcctgttgcagatcttcggcatcgccggcggcgacgactgatagaaaacgcctccggaaaagcccgtccccgcgacgggctttttcatttgcggaccggcaaaacacaggcattggtttatcattcgaagaaatccttcgcgtatcgcagcatgaaattcgccatcgccctattcgaccctccccactcccccgccgcccgccgcgcgctgcgcttcagcgaagccgcgctggccggcgggcacgaaatcgtccgcctgttcttctaccaggacggcgtgcacagcgcctcggccaacgtcctggagcgggccagaacaatttcaacctggcccgcccgcctgggcgcgagtttgtcgagcgcaacggcctggacgccgtggtctgcatcgccgccgccctgcgccgcggcgtgctga

SEQ ID NO: 15121 - DNA, 393 bp, Pseudomonas aeruginosa
agagcgcctggccctcgcggtcgaggtgctcgacgaccaggccctgcgcgacctgctgcaacgctacgaccaggtgattaccctctgatggccacgaccctccacgtactgtcccgctcgccgttcaatgacggccgcctgggcagttgcctgtacctgctcaaccccggcgacggcctgctgctctgcggcgacgccgtgcacgccctgctggccggcagccacgcctgccaggccctggaactgatgccggcggaaatcgaactgttcgccctgctggaagacctccaggcgcgcggtatcgaggacgtccccgctcgcctggtggcggtggactaccccggcttcgtcgaactcgccacccgcttcgacaaggtcaacagttggctatga

SEQ ID NO: 15122 - DNA, 1140 bp, Pseudomonas aeruginosa
tcaagtacgtcgcccagcgactgggtccggacaagggcaacagcctgcacctcaaccacctgttcaagggcgccccggccaagcttggcgcgaagctggccggcctgccgaaaccgagcaactgtctatgactctctcgactcccgccgaacatccgttcgcccagttcgtccgcatcctcggcaaaggcaagcgcggagcgcgcagcctgacccgggaggaagcccgcgaggccctcggcatgatcctcgacggcagggtcgaggacacccagctgggcgccttcctcatgctcctgcggcacaaggaggaaagcagcgaggaactggccggtttcaccgaggcggtgcgcgagcgcctgcaagtcccgtccttgcgcgtcgacctcgactggcccagttacgccggcaagaagcgccacctgccctggtacctgctggccgccaagtgcctggccggccatggcgtgcgcatcctcatgcacggcggcggcgcgcataccgccggacgcctgtacagcgaacagttgctggcggcgctggagatcccgctctgccacgactggctgcaggtagaacaggccctggagcgcggccacctggcgttcattccgctcggtgcctggatgccggtgctgcaacgcatgatcgatctgcgcaataccctcggcctgcgctcgccgatccattcgctggttcgcctgctcaaccccctgaatgcggattgcatcctgcagagcatcttccaccccggttaccaggaaacccaccgcgaggccagccgcctgctcggcgaccgggccatcgtcatcaagggcgaaggcggcgagatcgaagtcaacccggacgtcgtcgcccacctgtatggttgcgaccagggcgaagcctgggacgaggaatggccggcattgtcgacgcaccggcacatgaagccggaacagctcgacccgggtttccttcgggccgtctgggacggccgcgaaggcgacgcctatggccacctggcggtgctctccagcatggccctggcgctacgggcccttggcaagaatcgcgaagaagccttcaaggaagccgcacactactgggcgacccgaaacgaatcgatctgatcgatacgaatagccctttatttatataa

SEQ ID NO: 15123 - DNA, 1188 bp, Pseudomonas aeruginosa
cacacagaaagacggccgcttccagcgcgaaaacgcccagcgccgccattggctgggcgagccggcgttccccgccgagggcgggcgctaccatctctatgtctcgctggcctgcccctgggcccatcggaccctgatcgtgcgcaagctgaaggggctggagtcgctggtcgatgtttcggtggtcagttggctgatgcgcgagaacggctggaccttcgaccccgcccacggctccaccggcgatcgcctcgacggcctggcctttctgcaccagcgaaacacccgcgacgacccgcactacagcggccgggtcacggtgccgctgctgtgggacaagcaggcgcagaagatcgtcaacaacgaatcagccgatatcgtccgcatcttcaacagcgccttcgacgccatcggcgccaacgcgctggacttctacccggagccgctgcgcgaggagatcgaacgcctcaacggacgcatctatccggcggtcaacaacggcgtgtaccgtgctggcttcgccactcgccaggacgcctacgaggaggccttcgtccagttgttcgaggagctggactacctggaaggcttgctcggcgaacgccgctacctggccggcgaatacctgaccgaggccgatatccgcctgttcaccaccctggtgcgcttcgatgcggtgtaccacggacacttcaagtgcaacctgcggcgcatcgaagactacccgaatctctccggctggttgcgcgagctgtaccaacgcccgggcatcggcgagacagtggacttcgaacatatcaaggggcactagtacgccagccaccgcaccatcaacccgaccgggatagtaccgctgggcccgcgtctcgacctggcgcgcgcaccaggccgggaacgacttcccggcaagggcatctggggagaaggctgaaggctcaggcgtcctcgcgggcgccttcgaaccaggccagcttgtcgcgcagttgcacgacttcgccgacgatcaccagggtcggcgcatgcacttcgtgctcagccaccagttgcggcaggttttccagggttccggtgaatacccgctgctgggcggtggtcccctgctggatcagcgccgccggggtctgtgcggagcgaccgtgggcgaccagttgctcgcagatcaccggcaatcccaccaggcccatgtag

SEQ ID NO: 15124 - DNA, 258 bp, Pseudomonas aeruginosa
gtcgagggaatccaggtttccagcttggcccggatcagccgcgccagcacgggcgcatcgccgccgctggagaccgccaccaccagcggcgaacggtcgacgatggccgggaagatcacgctgcacagggccggcgcgtccaccacgttgaccggtatcccgcgcgcattggccgctcgcgacacctcggcgttcagcggttcgtcgtcggtggcggcgatgatcagggcgcagccgggctggtcgccgtcctggtag

SEQ ID NO: 15125 - DNA, 1884 bp, Pseudomonas aeruginosa
tcgcgttcgagcagctcgccgccgccctgctccaccagatgccgcagttcgatgtggatctgcggcgcgaccacgcgcaggcgcgcgccggcgtcggccagcaggcgcgccttgcgcagggcgacttcgccgccaccgaccaccagcgcgaggcgcccttgcaaggagtggaacagcggcaggaaatccatgtcagccgatcacctcgatgccagccatgtagggcttgaggacttccggcacacggatcgagccgtccgcctgctggtagttctccagtaccgccaccaaggtgcggccgacggccaggccggagccgttgagggtgtgcaccagctcgggcttgccggtttccggattgcggtagcgggcctgcatgcgccgggcctggaagtcgccgcagttggagcaggaggaaatctcgcggtacttgtcctggctgggaacccagacttccaggtcgtaggtcttggtcgaaccgaagcccatgtcgccggtgcacagcgccagcacccgatacggcaactcgagcagttgcaggacgcgctcggcgttggcggtcaggccttccagcgcctcgtaggaagtggccggatcgacgatctgcaccatctccaccttgtcgaactgatgctggcggatcatgccgcgggtatcgcgcccggaggcaccggcctcgctgcggaagcacggggtatgggcgacgaacttcagcggcaattgcttggcgtcgaggatctgcccggagacgatgttggtcagcgaaacctcggcggtcgggatcaggtagaggtcagcttcgccgtcgcggccgatcttgaacaggtcctcctcgaacttcggcaactggccggtgccttgcagcgccggagcctggacgagataaggggtgtaggcctcctcgtagccatgctcggcggtatgcaggttgatcatgaactgcgccagggcgcgatgcaggcgggcgatcgggccgcgcatgagggcgaagcgcgcgccggaaagcttggcagcggtctcgaaatccagccagccgtgccgttcaccgagggcgacatggtccttgacctcgaaatcgaaggtcttcggcgtgccccagcgacgcacttcgacgttggcgtcctcgtcggcaccgaccggcaccgactcgtgcggcaggttgggaatgcccagcagcatggcatccagttcgccctggatggcgtccagctggcgcttgccttcctccagctcggagcccatgcgatcgacatcggccagcagcggcgcgatgtcctcgccacgctgcttggcctggccgatcgccttggaacgcgcgttgcgctcggcttgcagctgctcggtacgggtctgtaccgacttgcgctgctcttccagcgcttcgatgcgtgcgacatccagttggaagccacgggtggccaggcgggcagccacttcttgcggctgggtgcgtaccagtttgggatcgagcatgctcttttctcgtctcgtgtcggttatcggcggttcgtggcccggttggcgcttcgccggccccggcgacgtcatcgacgccgtcgcggaagcctggctagctccgccgagcccataccgctcaggattttctgcgttggcggggactggtgcgatccagctcggccaggtgttccagcttgtcgcggatcttcagttccaggcccctcggcaccggttgatagtaacgccgcggctccagatcctcggggaaataatcctctccggcggcataggcatccggctcgtcgtgggcgtagcggtattcctcgccatagccgaggctcttcatcaatttggtcggcgcgttgcgcaagtgcaatggcacttcccgcgagccgctttcggcgacgtcgcgcatcgccgcgttga

SEQ ID NO: 15126 - DNA, 384 bp, Pseudomonas aeruginosa
gcaattgctcgttcggcgcatcggtatgccagcggaacagtcccggccgcttcaggctcagttggccggcggtttcctgcaggcgcgtgccgctaccgtccagggtcagttgggaaaaacgcgcggtcagggtctgggccttgttcagcaggccggtcaggcgctggacagcggcgctgtcgtcggcatgggccagcgaagcgcccatggccagggcggcaacgaacaacgtgcggatcagtcgcatcggaatcctctaaaacctgtcgggttcaatcacgaaccggcgccggcgcgatgacttcgcgggagccgttggtattcatcggggtgaccacgccggccatctccatcgcctcgatcatccgcgcggcgcggttgtag

SEQ ID NO: 15127 - DNA, 528 bp, Pseudomonas aeruginosa
atcgacagttcgagcatcttcgggtcgatcatgatcagtcgcgcctcgctcggcgtggacttgaacaggatcgacaggagcatggcgttgacccccaccgacttaccggagccggtggtaccggccaccagcaggtgcggcatcttcgccaggtcggtgatgatcggccgaccgccgatgtcgtggcccagggccagcggcacggtggacttgtgctcgtcgtactccggcgacgacagcacttcggagaagcgcaccatctgccggtcttcgttgggaatctcgatgccgacagtggtcttgccgggaatcacttccaccacccgcacgctgatcaccgccagcgagcgcgccaggtccttggccaggttggaaatgcggctgaccttgacccccgccgcgggctggatctcgaaacgggtgatcacggggcccggatgcaccgaatccacgctgacctcgacgccgaactccttcagcttgatctccagcaggcgcgacatcgcctccagcgactcgggcgagtag

SEQ ID NO: 15128 - DNA, 582 bp, Pseudomonas aeruginosa
ctcttctgcttcacttccgccgggtcgagcagcgacagcggcggcagggtgccctccaccgccgtatcgacgaacagcggcgcctgcttctctttcagcacgcgcttgctcggctccggggccttcggcggcggtggcggatcgatcttcggcggcgggcgcttctcccgctcgctcatgtgcttggccagggcctcttcgcgttccagcaggcgctccttggccttggactgttcgcggcggtccggcacgctcggcgccaccacctcggcgacgcgctcgtcgacctcgcgcagttgcgcgaccagttgcttgcgctcggcgcgcgcgcccatccagcgattgaaggcgttctggatcagttcgaagaagtccagggtgatcttgccggtgacatccatcaccttgaaccaggagaggtcggcgaacaccgtcaggccgaagaggaacagggcgaagaacaccagcgtgctgccctgcacgttcagcgcatccaccgcgacgcggcccaggctctggccgatggcgccgccggccgaggcgctggccggcatgtggccgctggcgtggaaatggatgtag

SEQ ID NO: 15129 - DNA, 648 bp, Pseudomonas aeruginosa
tggcacttatacctgcgatgcattgatcattgccaccggtgcctccgcgcaatacctgggcatgtcgtcggaagaagccttcatgggcaagggcgtttccgcctgcgccacctgcgacggtttttctaccgcaaccaggtggtctgcgtggtcggcggcggcaataccgccgtcgaggaagcgctgtacctggccaacatcgccaaggaagtccacctgatccaccgtcgcgacaagctgcgctcggagaagatcctccaggacaagctgttcgacaaggccgagaacggcaacgtgcgcctgcactggaacaccaccctggacgaggtgctgggcgacgccagcggcgtcaccggcgtacgcctgaagagcaccatcgacggcagcaccagcgagctatcgctggccggcgtgttcatcgccatcggccacaagccgaacaccgacctgttccagggccaactggaaatgcgcgacggctacctgcggatccacggcggcagcgaaggcaatgccacccagaccagcatcgaaggcgtgttcgccgccggcgacgtggccgaccacgtctaccgccaggccatcacttccgccggcgccggctgcatggccgcgctggatgccgaaaaatacctcgacgaccattga

SEQ ID NO: 15130 - DNA, 963 bp, Pseudomonas aeruginosa
gcaggcaaccaccctgttcctcgatcccagccagcccatggacacgcagctgtacgcctcgctgtcggaggtcggcttccgccgcagcggcgaccatctctatcgtccgcactgccagcattgcaccgcctgcatcgccgcgcgcataccggtcgccggcttcagcccgaaccgccagcagcggcgcatcctcaagcgcaatgcggaactgcaggtgatccgcaagcgaccgagcttcaacgaggagtactacgacctctatcggcgctacatcgagcaacgccacgccgacggcgacatgtatccgcccagccgcgaccagttcgccaccttcctggtccgcgacctgcccttctgctgcttcttcgagttccgcctgcatggccgcctgctggccatagccgtgacggacgtgctgccgaacggactctcggccgtctataccttctacgatcccgacgaagagcagcgcagcctgggacgctacgcgatcctctggcagatcgccgagaccgaacgcctgggcctgcaggccgtctacctgggctactggatcaagaattgccgcaagatgaactacaagacccagtaccggcccatcgaactgttcgtcaaccagcgctgggtcgccctcacctgatagccgtgtggcgctattgtcgattttctggcacaatgcacgccgcttttcacggcccacctctcattgaaagggccacccatagataccgagggctctactgcatgtcgaaagaagacagcttcgaaatggaaggtactgtcgtcgacaccctgcccaacaccatgttccgtgtggagttggaaaatgggcacgtcgtcaccgcgcacatctccggcaaaatgcgcaagaactacatccgcatcctcaccggcgacaaggtccgcgtggaactgacgccctacgacctgagcaagggccgcatcacctaccgcgcccgctga

SEQ ID NO: 15131 - DNA, 2646 bp, Pseudomonas aeruginosa
gtcgacacgagccgctgcggctcgccgattgcaaaagaaaacgcccggcatctgccgggcgttttcgttgccgcgctcggatcaggcgggctccgccgccgtgatctcgaactcgaaggccagctcgtcgcccttcaggtcgacatgcaccaggccgccatgctcggccagctcgccgaacaggatctcctcggccaacggccgcttgatcttgtcctggataagccgcgccatcggtcgcgcacccatctgcacgtcgtagcccttctccgccagccagccgcgcgccgcatcgctgacctcgagctggacgcgcttgtcctccagctgcgcctgcagctcggtgaggaacttgtcgaccacgctcttgatcgtctcggtgctcaggcggccgaactggatgatggtatccaggcggttgcggaactccggggtgaagctcttcttgatcacttccatcgcatcggtggtgtgatcctgctggttgaagccgatcgacgcgcgcgccgccacttccgcgccggcgttggtggtcatgatcaggatgatgttgcggaagtccgccttgcgcccgttgttgtcggtcagggtgccgtggtccatcacctgcagcagcaggttgaagacctccgggtgagccttctcgatctcgtcgagcagcaacacgcagtgcggggtcttggtgatcgcctcggtgagcaggccgccctggtcgaagccgacgtagcccggaggcgcaccgatcagccgcgacacggtatgccgctccatgtactcggacatgtcgaagcgcaccagctccacgcccaaggccttcgccaactgccgcgccacctcggtcttgcccacgccggtgggaccggcgaagaggaacgagccgaccggcttgtccggcgccttgagcccggcccgggacagcttgatcgccgtggacagcgactcgatggcgtcgtcctggccgaacacggtcagcttgaggtcgcgctcgaggttgcgcagcaactccttgtcggaggtggtgacgtgtttcggcgggatccgcgcgatcttcgccacgatatcctcgacctgcgccacctcgatgcgcttcacgcgcttctcttccggctgcaggcgctggtaggcgcccgcctcgtcgatgacgtcgatggccttgtccggcatgtgccggtcgttgatgtagcgcgccgccagctcggccgcggcgcgcagcgcctcgtcgctgtactcgatgtggtgatgctgctcgaagcgccccttgaggcccttgaggatgccataggtgtcttccaccgacggctcggtcacgtcgaccttctggaagcgccgcgccaaggcccggtccttctcgaagatgccgcggaactcctggaaggtggtcgagccgatgcagcggatctcgcccgaggacagaaccggcttgagcaggttggaggcgtccattaccccgccggatgccgcaccggcgccgatgatggtatggatctcgtcgatgaacagcaccgcgtgcgggcgcttgcgcaactcgttgagcaaggccttgaagcgcttctcgaagtcgccgcggtacttggtacccgcgagcaaggcacccaggtcgagggagtagaccacgctgtcggccagcaggtccggcacctggccatcgacgatgcgtttggccaggccctcggcgatggccgtcttgccgacccccgcctcgcctaccagcagcgggttgttcttgcgccggcgggcaaggatctgcgccacccgctcgacttcatgctcacgccccaccagcgggtcgatccgcccctggcgagccagttcgttgaggttgctggcataggcgtccagcggatggttggacgtggccgactcgccaccttcctcatcctgcatatcctgctccccatcctgcggatgttcggcatgcccgggcaccttggagataccatgggcgatgtagttcaccacatcgatacgcgcgatgctctgctgcttgagcaggaacaccgcctggctttcctgttcgctgaagatcgccaccaggacattggccccggtcacttcgcgcttgccggaactctgcacgtggaacaccgcacgctgcaggacgcgctggaagcccagcgtcggctgggtttcgcgctcgtcgtcgtgctgcgggatcagcggcgtggtggaatcgatgaattcctgcaggtcgcgccgcagcttgtccaggttggcaccgcacgcacgcaataccgttgccgccgcctcattgtccagcaaggccagcagcaggtgctcaaccgtcatgaattcatggcgtttggccctcgcctccttgaaggcgagattgagggtgacttcgagctctcgattcaacatggcttcacctcgctcccaaacatccgatcaactgtctttctctatctcgcagagcaatggatgctggctctcccgtgcatactgattgacctgcatcgccttggtttcggccacgtcccgggtaaacaagccgcagaccgccttaccctgagtatgtaccgtcaacatgatcttggtggctttttcccggtccatgttgaagaacacttccagcacttcaacaacaaagtccatcggcgtgtaatcgtcgttgaacagtaccaccttatacaacggtggcggctgtaa

SEQ ID NO: 15132 - DNA, 318 bp, Pseudomonas aeruginosa
tggatgatactccagcgttggagtcctttgcagagggatatgagcatgctcagcggtaaggtcaagtggttcaacaacgccaagggctacgggttcatcctggccgagggccgagatgaggacctgttcgcccattactcggccattcagatggacggttacaagacactcaaggcgggccagccggtcaatttcgagatcatccagggaccgaagggactgcatgccatcaacatcagccccgccaccgcgacaaccgccgcaccctccgcccccgccccgcaggaagagccgcaggcgacgcccatcgaagcctga

SEQ ID NO: 15133 - DNA, 1347 bp, Pseudomonas aeruginosa
cccttcctacatcttggcaatcatcgcgtcgccgaactccgagcaggacagcagggtcgcgccgtccatcaggcgttcgaagtcataggtcacggtcttggcggcgatcgccccgttggtgcccttgatgatcaggtcggccgcctcggtccaacccatgtggcgcagcatcatctccgcggagaggatcagcgaacccgggttgaccttgtcctggccggcgtacttcggcgcggtgccgtgggtcgcctcgaacatggccaccgaatcggacaggttggcgccgggcgcgatgccgatgccaccgacctcggccgccagggcgtcggagagatagtcgccgttcaggttcagggtggcgatcacgtcgtactcggcggggcgcagcaggatctgctgcaacatggcgtcggcgatcacgtccttgaccacgacgttcttgccggtcttcggattcttgaactgcatccacggaccgccgtccagcagctcggcgccgaattcatcgcgcgcgacttcgtagccccaatccttgaaggcaccctcggtgaacttcatgatgttgcccttgtgcaccagggtcaccgaactgcggtcgttgtcgacggcgtattgcagggccttgcgcaccaggcgcttggtgccttcctgggaaaccggcttgatgccgatgccgcagttctcggtgaagcggatcttcttgacgcccatttcctcggtgaggaacttgatgaccttctccgcttccggcgaaccggccttccactcgacgccggcatagatgtcctcggagttctcgcggaagatcaccatgtccacgtcgccgggcttcttcaccgggctgggcacgccttcgaaccagcgtaccgggcgctggcagacgtagagatcgagttgctggcgcagggccacgttcagggagcggatgccgccaccgaccggggtggtcagcgggcccttgatggaaaccacgtagtcgcgtacggcgtccagggtttcctggggcagccaggtgtcctggtcatacacctgggtggccttctcgccggcgtagacttccatccaggcgatcttgcgctcgcccttgtatgctttttccactgcagcgtcgacaaccttgatcatgaccgggctgatatcgacgccgatgccatcaccctcgatgaacgggatgatcgggttcttcggtacgctcaaggacatgtcggcattcacagtgattttgtcaccggtcgccggcacctggatcttttggtatcccatgctgaactccgtgttgtggttaaaaccctgttgcagccttctagggtagcccagttgtccgcccggaaaccacatcttccttag

SEQ ID NO: 15134 - DNA, 1449 bp, Pseudomonas aeruginosa
cgtgcgcatcgaattcgtcggcaaggacggcaaggtcgaggtcaagaagcaactgagcctgcaggaaggcgaagtgctcgacagcatgttcatgagctgcggcaagctgcgcgacttcttcgagaagaccctgcaggactgcaaggaaaccggcgtcatgtggtccctgcacgtcaaggcgaccatgatgaagatttcccacccgatcgtcttcggacatgcggtgagcgtctactacaaggacgtcttcgacaagtggggccaactcttcgaagagctcggcgtgaacccgaacaacggtatctccagcgtctacgacaagatcaagtcgctgcccgcctcccagcaggaagagatcctccacgacatccacgaggtgtacagccaccgcccggaaatggcgatggtcgactccgtgaaaggcatcaccaacctgcacattccgagcgacgtcatcgtcgacgcctcgatgccggcgatgatccgcaactccggccagatgtggggcaaggacggcaagcagaaagacaccaaggcggtaatgccggaaagcacctacgcccgcatctaccaggagatgatcaacttctgcaagaccaacggcgccttcgacccgaccaccatgggcagcgtgccgaacgtcggcctgatggcgcagaaggccgaggaatacggctcccacgacaagaccttcgaaatgaccgccgacggcaccatgcgcgtggtcctggccgacggcagcgtgctgatgcagcacgacgtggagaccggcgacatctggcgcgcctgccagaccaaggacgcaccgatccgcgactgggtcaagctggccgtcacccgcgcacgccagtccgataccccggcgatcttctggctggacccggagcgcgcccacgaccgcgaactgcgcaagaaggtcgagctgtacctcaaggaccacgacctgaccggtctcgacatcagcatcatgggctacaacgaggccattcgcgtcagcatggaacgcctgatccgcggcaaggacaccatctcggtgaccggcaacgtcctgcgcgactacctgaccgacctgttcccgatcatggaactgggcacctcggccaagatgctctccatcgttccgctgatggcgggcggcggcatgtacgaaaccggcgccggcggctcggcacccaagcacgtccagcaactggtggaagagaactacctgcgctgggactccctgggcgagttcctggccctggccgtgtccctggaggaaaccgggatcaagaccggcaacgccaaggccaagctgctcggcaaggcgctggacgaagccaccggcaagctgctggacaacaacaagtcgccgtcgcgcaaggtcggcgacatcgacaaccgcggcagccacttctacctggcgatgtactgggcccaggccctggccgcccaggacgaagacgctga

SEQ ID NO: 15135 - DNA, 582 bp, Pseudomonas aeruginosa
  unsure (123),(127),(131),(134),(188),(215): Identity of nucleotide at the above locations are unknown.
cgaagcagaaaccctgggcctacgctcggggtttctttttatcgaggccttttccgtaccgaggagacatccatgagctggcatccccatgtgccccgtagcgaccatcgtcgaggaccaggnccgnttcntgntggtcgaggaacaggccgacggccgcgaggtgctgaaccagcccgccgggcacntggagcccgccgaaagcctgttggagnccgccctgcgcgaaaccttcgaggaaaccggctgggaggtcgagctgagcgccgtcaccggcatctacctgtacaccgcgccgtccaacggtgtcacctatcagcgcgtatgcttcgccgcccgccccgtgcgccaccaccccgagcgcgccctcgacgacggcatcatcggcccgcgctggctgagccgcgacgaactggccgcccagccgcagcgctggcgcagccacctggtgctgcgctgcatcgacgactacctggccggcggccgctatcccctggcgctgatccgcgacacccacgtgtcgccctccctaccccaggcctgatagaattcgcgttttacgaattcgcccgtgacgcctga

SEQ ID NO: 15136 - DNA, 1551 bp, Pseudomonas aeruginosa
tcgaaacggcggaagcctgggatttcggaggacgcccgtgagcgatccgcgacagcaactgattgccctcggcgccgtcttcgaatccgcagccctggtcgacaagctggcacgcaccgggcagatcagcgaagccccgctgggctgcatgctcggcagcctgctggcgcgcaacccggccagcaccctggacgtctacggtggcgacagcctcaacctgcgcgacggcttcaaggccctggccagcgccctggagcgcaagcccggcagcctgcagcgcgaaccgctgcgctacgccctggcgatgctgaccctggaacggcaactggacaagcgcggcgacatgctcgacctgatcggccagcgcctcgaccaggtcgaacagcaggtccagcacttcggcctggtccacgagaacgtcatcgcctcgttcgccagcatctaccaggacaccctcagcaccttccgccagcgcatccaggtacacggcgacatgcgccacctgcaggtcagcagcaacgccgcgcggatccgcgccctgctgctcgccggcatccgctcggcgcggctctggcggcaactgggcggcagccgctggcagatggtattcagccggcgccggctgctcaacgaactctatcccctgctgcgcggctagccatggccatggccgggagccagccgcaacggcgcaacagcccgacccagggcgccgccatgctggctctttcggcgctgttcttcgccctgatgggcggcctgatccgcgaggcctccagcaccgtcaacaacgaaaccgtggtgttcttccgcaacctcgtcggcgtgctgttcttcctgcccctggcgctgactcgcggcatcggcccgctgcgcacccgccgcccgctatcgcacctgctgcgcaccacctacggcctgggcggcatgtactgctacttctacgccctcgcccacctgccgctgaccgacgccatgctgttcagctatgccgcgccggtgttcacgccgctgatcgcacacctgtggatcaaggagccgctgacccgccgcatgatggtcgccaccctggtcggcttcctcggcgtgctgctggtggccaggcccagcggcgcggtagtggcgccgatcgccctggtcggcatcgcctccagcctgatggctgcctgcgccttcgtctcgatccgcgaaatgagcgacagcgagccagcctatcgcatcgtgttctacttcgccctgttcggcaccctgttctccgccgtgccgctggcctgggcctggcagccgctgaacggccaggaactgctcctgctgctcggcgccggactgttcgccagcctcggccaactgaccatgtcgcaggcctatgccctggcctccccgggagtgatcggaccgatcgcctacatggccatcgttttcgccggggtgatcgcctggctgcgctgggacgaactgcccagccacacgtcgctgctcggcgccgccctgattttcgccgccagcctgatccccctgctgggcaaccgccccgccgaaaggccccgctga

SEQ ID NO: 15137 - DNA, 1446 bp, Pseudomonas aeruginosa
atgccccaccggggcgcacctttcatgtatgatatgcgcccctttttcgttgacttccagccacgagaacgtctcatgcagctttcctcgctcaccgcggtatcccccgtcgatggccgctatgccggcaaaaccagcagcctgcgtccgatcttcagcgaatacggcctgatccgtttccgcgtcatggtggaagtccgctggctgcagcgcctcgccgcccacgccgggattcccgaggtcgcgccgttctccgccgaagccaacgccctgctcgacagcctggccagcgacttccagctggaacacgccgaacgcatcaaggaaatcgagcgcaccaccaaccacgacgtgaaagccgtggagtacctgctcaaggaacaggccgccaagctcccggagctggccgcggtcagcgagttcatccacttcgcctgcacctccgaggacatcaacaacctgtcccacgccctgatgctccgcgagggtcgcgacagcgtgctgctgccgctgatgcgccagatcgccgaggccatccgcgaactggcggtgaaattcgccgacgtgccgatgctctcccgcacccacggccagcccgcctcgccgaccaccctgggcaaggaactggccaacgtcgtctaccgcctggagcggcagatcaagcaggtcgccggcatcgagttgctgggcaagatcaacggcgccgtgggcaactacaacgcccacctgtccgcctatcccgaagtcgactgggaagccaacgcccgccagttcatcgaaggcgacctcggcctgaccttcaacccctacaccacccagatcgagccgcacgactacatcgccgagctgttcgatgcgatcgcccgcttcaacaccatcctcatcgacttcgaccgcgacgtctggggctacatctccctcggctatttcaagcagaagaccgtggccggcgagatcggctcctcgaccatgccgcacaaggtcaacccgatcgacttcgagaactccgagggcaacctcggcatcgccaacgcgctgttccagcacctggccagcaagctgccgatctcgcgctggcagcgcgacctgaccgactccaccgtgctgcgcaacctcggcgtcggcatcgcccacagcgtcatcgcctacgaggccagcctgaagggcatcggcaagctggagctgaacgcccagcgcatcgccgaggacctggacgcctgctgggaagtccttgccgagccggtgcagaccgtgatgcgtcgctatggcgtggaaaacccctacgagaagctgaaggaactgacccgcggcaaaggcatcagcgccgaagccttgcagactttcatcgaagagctggcgattcccgccgaggccaaggtcgagctgaagaagctgaccccggccggctacgtcggcaatgccgccgcccaggccaagcgcatctga

SEQ ID NO: 15138 - DNA, 543 bp, Pseudomonas aeruginosa
agctggtctgctcggccgatgcgttgcatctggaaaacctcggccaatggctggccgatgacgatgcgcgtaagctgttggcggagttggtcaaacagggcagtttggagtttgcagatgaataagatccgcgtacgcgtagccgactggcagaaggacaatgccgagctgcgccgcatccgcgaagcggtcttcattgccgaacagtcggttccgccggaactggagtgggacgccgaagacgacgaagccgtgcattttctcgcctatgaaggcgaatacgcgatcggcaccgcgcgcctgctgggcgacgggcacatcggcagggtctcggtactcaaggactggcgcggcctgaaggtcggcgacgcgctgatgcgcgcggccatcgaggaagccgagcgacgcggcctgaagcgccaactgctgaccgcgcaggtctatgccatacccttctacgagcgactgggcttcaaggtcgacagcggcgagttcctcgacgccggcctgccccatgtcgacatggttcgcgacagcgactga

SEQ ID NO: 15139 - DNA, 627 bp, Pseudomonas aeruginosa
ggcccgatgagcgacgccccggagacctcgccggccgacctgccggccatcgaattcagctctccggggtgctttgcggtacgcaacccggccagcgccgcgctgcctgcggaacgctgggaaccagcgccattccgcctcggcgaacatgagccgctggagcgcttcgagcatccgcaggaagcccgcgcccatgccctggccctcctgcagcaggcccgccgctcgctctgcctgcacagtcccgacctggaaagctggctctatcaccacagcagcatccaggaagcctgcacccgtttcctcctggccaatccacgcaatcgcctgcgtatcctcgttggcgacagcgcccaggccgtgcgcaacggccaccgcctgatcagcctttcgcgccgcctgtcgagcaactgcctgatccgccggctcaacccggactaccctaaagaggacgacgccttcctcctggccgacgaccagggcctgctactgcgcccgaaaccggcgcaaccggcgggctacgcctgctaccgtgccgccgggcgggtgcgtcaactccaggcccgcttcgagcaggcctgggacaccagcctttccgacccggacctgcggagcttcctcctgtga

SEQ ID NO: 15140 - DNA, 2058 bp, Pseudomonas aeruginosa
cgtcaatgctccgtcgatcagcccacaaggagcacgtccgtgagcctggagaaaaaagatgccatcctgttcggtgatggcgacgagttgcccagcaaccattcgaacaacccgcacatgaacgacctgatcgccggcctcggccgccgccaggtcctggccggcggcgcggcgctcggcgccctcgccttcctcggcgtcgcgctccccgccagcgccgctcccgccgaagcgcaggcgcccgccgcggaaggcctgcgcggcttgcctttcaaacgccgcaaccgcttgcccttcgaagccatcgccagcggccgcgccgataccatccgggtgcccgccggctacaaggcgacgcccttcataccctggggcaccccgatcagcggcagttatccgggattcctcgacgacgccagcaacagcgcccaggaccaggccgaacagatcggcatgcaccacgacggcatgcacttcttcccgatcgacgcgcagttcggcttcggcggcggacacatcagcaaccatggcctgctggtgctcaaccatgaatacatcgacgcgccgctgctgcacaccaatggcccgaccgtggtcgatggcaagcgcaccgtcgccgatgaagtgcgcaaggaaatcaacgcccatggcgtttccgtcgtggagatccgtcgcaacgtgcgtggcgagtggaatgtcgtaccgtcgcaacgcaatcggcggatcaccgccgccacgccgatgcgtatcgccggcccggcgcgcggccacgaactgctgcgcacccgccacagtccggacggcacccgcacccgcggcacccacaacaactgttccaacggtttcaccccctggggcacctacctcacctgcgaggagaactgggtcggctatttctccacccaggacagcgaactgccgcgcgaactgacccgctacggcattcgcaacaccagccgtttcggctgggagaccctggcgggcgacgagttcgagcgcttcgacgccacccgcaagggcaaacaggctcaggacgactaccgcaacgaaccgaacaacttcggctggatcgtcgagatcgacccgttcgacccgcaatcggtaccggtcaagcgcaccgctctcggccgcttcgcccacgaaggcctggtcttcgccccggtcaagccgggccgccaggtagtctgctactccggcgacgactcgcagaacgagtacatctacaagtacgtcagccgcgacaagttccgtccgggtcgcagcaacgctcgcctgctcgacgaaggtaccctctacgtcgcccgcttcaacgccgatggcagcggccagtggctgccgctggacatcgccgacggcaacttccgcgcggcctgtcgcaaggccggggtgagcttcgccgaccagggcgaagtgctgatcaacacccgcctggccgccgatgtcctcggcgcgaccaagatggatcgcccggagtggggcgcggtcaacccggacaacggcgacgtctacttcaccctcaccaacaacacgtcgcgcaccgtcgccgacgccgccaacccacgggtgaagaacgcctacggccatatcatccgctggcgcgaacgcagccgcgactatgccgggcaacgcttcacctgggacctgttcatgctcgccggtcccggcgaagacagccgcggcccggacggcaagccgctgaaccaggacaatatcctggccagccccgacggcctctggttcgacccggaaggccgcctgtggatccagaccgacatgagcggcagccagttgagcagcggcccgttcggcaacaaccagatgctggtggccgacccgcgcaccggcgaactgaagcgcttcctcaccggtccgctgggttgcgaggtgaccggcattgccgcgacgccggacttccgtacgctgttcatcaacatccagcacccgggggaaggctcgaccgccgataacctcctcagcacctggccggacgggccgggccgccggccacgctcggccaccgtggtgatcacccgcgaagacggccgacgcctgctctga

SEQ ID NO: 15141 - DNA, 633 bp, Pseudomonas aeruginosa
cgcgccacgacgacctgcgttggccggaatgccggcgcaggtcgccgctacagccgtgggcaagcccgggcaaagcgggtggaatgcaggctcccctctctatggaaggacgccagcatgcccaagcgcaatcgtctcagccgcgccgtcggcgccatcaacctcctcccccgccgcctgcgcagccgcagcctgacgctgctgctgggctcccaggtgcgcttcgccggcacggcgagggtgcgcatccatgaactggggcaggagcgcgccatcctcagcctgaagaaccgtcgaccggtgcagaaccacataaaaggtatccatgccgcagcgatggccttgctcgccgagtcggccagcggcttcctggtcggaatgaacgtaccggacgacaagctgccgctgatcaagaccatgaagatcgactatctcaagcgcgcccagggcgacctgaccgccatcgcgacgctggaggccggacagatcgagcagatccggcaacaggacaagggcgaggtccgcgtggcggtgctggtcagcgacgagaacggcaaccagccgatcgcctgcgagatggtctgggcctgggtcggcaagaaaccccgggacgctaccgcagcccctaggtag

SEQ ID NO: 15142 - DNA, 696 bp, Pseudomonas aeruginosa
aacaatgaggctttggcgatgcaatacaaacttacccggatcgatcccgatgcggccaacgaccaatacccgataggcgaacgggaaaccgtagccgacccgctggtcgagggccaggttcacaagaacatcttcatgggcaagctcgaggatgtgctgaactccaccgtcaactggggtcgcaagaactcgctctggccctataacttcgggctgtcgtgctgctacgtggagatgaccaccgccttcaccgcgccgcacgatatcgcccgcttcggcgccgaagtgatccgggcgtcgccgcgccaggccgacttcatggtcatcgccggcacctgcttcatcaagatggccccggtcatccagcgcctctacgagcagatgctcgaacccaagtgggtcatctccatgggctcgtgcgccaattccggcggcatgtacgacatctattcggtggtccagggggtcgacaagttcctccccgtggacgtctacatccccggctgcccgccccgtccggaggcgttcctgcaaggcttgatgctgttgcaggaatccatcggccaggagcgccgcccgctgtcctgggtcgttggcgaccagggggtctaccgcgccgaaatgccggcccagaaagacctgaaacgcgagcagcgcatccaggtgaccaacctgcgcagccccgacgaagtgtga

SEQ ID NO: 15143 - DNA, 552 bp, Pseudomonas aeruginosa
tcgcctacctgggtagcatcgatttcgttatggctgacgtggaccgctgacatgagccagagcaacctgattcagaccgaccgtttcgtcctcagcgaaaccgagcgctcgtccatcgagcatgaaatgcatcactacgaggacccgcgcgcggcgtccatcgaagccctgaagatcgtccagaaacagcgcggctgggtgccggacggcgccatcccggcgatcggcgaggtgctggggatcccggccagcgacgtcgaaggcgtcgccaccttctatagtcagatattccgccagccggtgggccgccacatcatccgcgtctgcgacagcatggtctgctacatcggcggccacgagtcggtggtcggcgagatccagaagcaactcggcatcggtctcggccagactaccgccgacggacgcttcaccctgctcccggtctgctgcctgggcaactgcgacaaggccccggcgctgatgatcgacgacgacactcatggcgacgtgcgtcccgacggtgtcgccaaactgctggaggcctacgtatga

SEQ ID NO: 15144 - DNA, 2175 bp, Pseudomonas aeruginosa
gatgaaccgctgcatcgcctgctaccgctgcgtgcgctactacaaggactacgccggcggcaccgacctcggcgtctacggcgcccacgacaacgtctacttcggacgggtcgaggacggcgtgctggaaagcgagttctccggcaacctcaccgaggtctgccccaccggcgtgttcaccgacaagacccactccgagcgctacaaccgcaagtgggacatgcagttcgccccgagcatctgccacggctgctccagcggctgcaacatcagccccggcgagcgctacggcgagatccgccgcatcgagaaccgctacaacggctcggtcaaccactacttcctctgcgaccgcggtcgcttcggctacggctacgtcaaccgcgaagaccgtccgcgccagccgctgctggtgctgagcaagcagaagctgagcctggacggcgccctcgaccaggccgccgccctgctgaaggagcgcaaggtggtcggcatcggttcgccgcgcgccagcctggaaagcaacttcgccctgcgcgagctggttggcgaaggcaacttctacagcggcatcaacgaaggcgagctcgaccgcctgcgcctgatcctgcaggtcatgcaggaaggcccgctgccggtgccgagcatccgcgacatcgaggaccacgacgcggtcttcgtcctcggcgaggacctgacccagaccgccgcccgcatcgccctggccctgcgccagtcggtgaagggcaaggccgtcgagatggctgccgacatgaaggtccagccgtggctcgacgccgcggtgaagaacatcgcccagcatgcgcagaacccgctgttcatcgccagcgtcagcgcgacccgcctcgacgacgtggccgaggaaaccgttcacgccgcgccggacgatctcgctcgcctcggcttcgccgtggcccacgcgatcgacccaagcgccccgtccgtggccgacctcgacccgcaggcccaggccttcgcccagcgcatcgccgatgccctgctggcggccaagcgtccgctggtagtgtccggcaactcgctgggcaacaaggcattgatcgaagccgcggcgaacatcgccaaggccctcaagcagcgcgagaagaacggttccatcagcctggtggtcggcgaagccaacagcctcggcctggcgctcttcggcggcgactccgtggaagccgcgctcgagcgactgacctccggacaggccgacgccgtggtggtgctggagaacgatctctatcgccgcaccgacaccgcccgtgtcgacgcggccctggcggcggccaaggtggtgatcgtcgccgatcaccagcagaccgccaccaccgccaaggcgcacctggtgctgccggcggccagcttcgccgaaggcgacggcaccctggtcagccaggaaggccgcgcccagcgcttcttccaggtgttcgacccgacctactacgacgccaggaacatggtccgcgagggctggcgctggctgcatgcgatccacagcaccctgcaaggcaagcgcgtcgactggacccagttggaccacgtcaccgaagccgtggccgaggcaaagccgatcctggccggcatccgcgacgccgcaccggccgcctcgttccgcatcaagggcctcaagctggcccgcgaaccgcaccggtacagcgggcgcaccgccatgcgcgccaatatcagcgtgcacgagccgcgcaccccgcaggacatcgactcggcgttcgccttctccatggaaggctactccggcagccaggaagaccgtcagcagatcccgttcgcctggtcgccgggctggaactcgccgcaggcctggaacaagttccaggacgaggtcggcggccacctgcgcgccggcgaccccggcgtgcgcctgatcgaaccgaagggcgaaggcctcgactggttccaggccgtgccggtgccgttcagcgccaaggccgacagctggaaggtagtgccgctgtaccacctgttcggcagcgaggaaaacagctcgcgggccgcgccgatccagcagcgcatcccggagacctacgtcgccctgtccaaggaagacgcggaccgcctcggcgtcaacgacggcgcgaccctcggcttccagctcaagggccaggccctgcgcctgccgctgcgtatcgatga

SEQ ID NO: 15145 - DNA, 1095 bp, Pseudomonas aeruginosa
acaactcggcgccggcctgatcggcctgccggtcggcttcgccggcatcccggcggcgatcgccggctgctccgtggaaggtctgcaggaggctgcacaatgagttggctgactcccgctctggtcaccatcatcctcaccgtggtcaaggccatcgtggtgctgctcgccgtggtcatctgcggcgccctgctaagctgggtcgagcgccgcctgctcggcctctggcaggaccgctacggccccaaccgggtcggtccgttcggtgcgttccagctcggcgcggacatggtcaagatgttcttcaaggaggactggaccccgccgttcgccgacaagatgatcttcaccctggccccggtgatcgcgatgggcgccctgctcgtcgccttcgccatcgtgccgatcacccccacctggggcgtggcggacctgaacatcggcatcctgttcttcttcgccatggccggcctgacggtgtacgccgtgctgttcgccggctggtcgagcaacaacaagttcgccctgctcggcagcctgcgcgcctcggcccagaccatctcctacgaggtgttcctggccctgtcgctgatgggcatcgtcgcccaggtcggctcgttcaacatgcgcgacatcgtccagtaccagatcgacaacgtctggttcatcattccgcagttcttcggcttctgcaccttcatcatcgccggcgtcgccgtgacccaccgtcacccgttcgaccagccggaagcggagcacgaactggcggacggctaccacatcgagtacgccgggatgaaatggggcatgttcttcgtcggcgaatacatcggcatcgtactggtctcggggctgctggcgaccctgttcttcggcggctggcacggtccgttcctggacaccctgcgctggctgtcgttcttctacttcgccgccaagaccggcttcttcatcatgctcttcatcctgatccgcgcctcgctgccgcgtccgcgctatgaccaggtgatggcgttcagctggaaggtgtgcctgccgctgaccctgatcaacctgctggtgaccggcgcgctcgtgctggccgcggcccagtaa

SEQ ID NO: 15146 - DNA, 570 bp, Pseudomonas aeruginosa
aaagcctgctgccataaggagacgtcgcgtggaattcgctttctatttcgctgccggcgtcgccgtactggccacgctgcgggtcatcaccaacagcaacccggtgcatgccctgctctacctgatcatttccctgctggccatctcgatgaccttcttcagcctcggcgcacccttcgccggtgccctggagatcatcgtctacgctggcgccatcatggttctgttcgtcttcgtggtgatgatgctcaacctcggcccggccgtggtcgagcaggagcgcaagtggctcacgcccggcatctgggtcgggccttcggccctggccctggtcctgctggtggaactgctggtggtcctcgcccgcaccccgagcggtgccggcatcggccataccacggtagacgccaaggcggtcggcatcagcctctacggcccgtacctgctggtggtcgaactggcctccatgctgttgctcgcggccctggtcgctgcctatcacctgggtcgtcaagacgccaaacaataaaggttcggcgggcgccctgcgcccgccccaagggaacgtaa

SEQ ID NO: 15147 - DNA, 1074 bp, Pseudomonas aeruginosa
cgctatgaacgcaataccactggaacacggcctggccctcgccagcgtcctgttcgccctcggactggtcggcttgatggtgcgacgcaacatcctgttcgtactgatgagcctggaagtgatgatgaacgccgccgccctcgccttcgtggtcgccggcagccgctggggccaacccgacggccaggtgatgttcatcctggtgctgagcctcgcggccgccgaagcgagcatcggcctggcgatcctgctgcaactgtatcgccgcttccacaccctcgatatcgacgctgccagcgagatgcgcggatgaaccttctacctcttaccttcctgttccccctggtcggcttcctgctgctgtcgttctcccgcggcaggtggtcggaaaacctttcggcgctggtcggcgtcggctcggtcggcctctccgccctgagcgcggcctgggccatcttcagcttccacagcagtccgccggaaggcggtgcctacagcctggtgctgtggcagtggatggcggccggcgacttcagcaccaacttcaccctgtacctggacggcctctcggtaaccatgctcggcgtggttaccggcgtcggcttcctgatccacctgttcgcctcctggtacatgcgtggcgaaaccggctattcgcgcttcttcgcctacaccaacctgttcatcgccagcatgctgttcctggtgctgggcgacaacctgctgttcctctacttcggctgggaaggcgtgggcctgtgcagctacctgctgatcggcttctactacagcaatcgcaacaacggtaacgcggcgctcaaggcattcatcgtcacccgcgtcggcgacgtgttcatggctttcggcctgttcatcctgttccagcagttcggcaccctgaacatccaggagctgctggtgctggcgccgcagaagttcccggaaggcaacctctggctgaccctggcgaccctggccctggctcggcggcgcggtcggcaagtccgcccagctgccgctgcagacctggatggccgacgccatggccggcccgaccccggttttccgcgctga

SEQ ID NO: 15148 - DNA, 1605 bp, Pseudomonas aeruginosa
gcatggtgctcggcctggcggtcctgctggtcctgctcggggtctacccgcagccagtgctggacatctccgcggccagcatgcacggcgtgcagcaatggctgggcgcagccctttccacccttgcaggacggtagtcgcgaaatgacctttacgattcaacacttcatcgcgctcctgccactgctgatcaccagcgccaccctggtggtggtgatgctggcggtagcctggaaacgcaatcactcgttcaccgccaccctctcggtgatcggcctcaacctggccctgctgtcgctgctgccggtcctcggcgtcaccccgatcgaggtgacaccgctggtgctggtggacaactacgcctgcttctacatggccctggtgctggtctccgccctggcctgcgtgaccctcgcccacgcctacatggaaagctatccgggtaaccgcgaagagctgtacctgctcctgctgctggccaccgccggcggcctggtgctggtcagcgcgcagcacctggccagcctgttcatcggcctggagctgctctcggtcccggtctacgggatggtcgcctacgccttcttcaacaagcgctcgctggaagccggcatcaagtacaccgtgctctcggccgccgggtccgccttcctgctgttcggcatggccctgctctacgccgagtccggtaccctgggcttcgccggccttggcgccaaggttgccgagcacgtgctgagcggtccgctggtcagcgttggcgtaggcatgatgctggtcggcctgggcttcaagctgtcgctggtgcccttccacctgtggaccccggatgtctacgaaggcgccccggcgccggtctcggcgttcctcgccaccgccagcaaggtcgcggtgttcgccgtgctgctgcggctgttccagatcgccccggcggccctggacaaccaactgctgaacatctccctgagcgtcatcgcggtcgcctcgatcctcttcggcaacctgctggcactgacccagagcaacatcaagcgcctgctcggctactcgtccatcgcccacctgggctacctgctggtcgccctgatcgccagcaagggcatggccgtggaagcggtcggcgtctacctggccacctacgtactgacctccctcggcgcgttcggcgtgatcaccctgatgtccaccccgtacagcggccgcgacgccgatgcgctgttcgagtaccgcggcctgttctggcgccggccggtactgaccgcggtgatgaccgtgatgatgctgtcgctggcaggcatcccgctgaccgccggcttcatcggcaagttctacgtgatcgcggtcggcgtcgagtcgcacctgtggtggctgatcggcgccctggtgctgggcagcgccatcggcctgtactactacctgcgggtcatggtcaccctgttcctggtcgagcccggcatccgccagcacgacgcaccgttcaactggggccagcgcgccggcggcatcatgctggtggccatcgccctgctggcgttcttcctcggcgtctacccgcagccgctgctggaaatcctccagcattccggcctggccctcgccggctga

SEQ ID NO: 15149 - DNA, 924 bp, Pseudomonas aeruginosa
gtcgcccgctccacgaaaaccccgcctcggcggggtttttctttggcccgccccacgcaccctgccccgctgccgtggcatgctccgcgctccatggatgaacccggaggcctcatgcccaccttccacgaaatcgacgtcctgcgacacaacagcgccagttgggacgcccaggccgcccgtgactgcgaatggtcgcgaccggtcagcgccgaagaggtcgccgccgcacgccgcggcgactgggcggtgaagctgaccccgggcgcgttacccgctcactggctgggcgacgtacgcggccgcgagatcctctgcctggcctcggccggcggccagcaggcgccgatccttgccgccgccggcgcacgggtcacgctgttcgacgcctcggggggacagctggacaaggaccgccaggtcgccgcccgcgaccgcctcgaactggcctgcgtgcagggcgacatgcgcgacctctcgaccttcgccgatgcctccttcgacctggtcttcaatcccatctccaatctctacgtcgacgatgtcctgccggtctggcgcgaatgcgcgcgggtgctgcggccgggcggcaagctgctggcgagcttctacaacccggcgctgttcatcaaggaccgctcgccggaactggcagagcagggcctgatccggccgcgacatcgcctgccctactccgacctggaaagcctctccgccgaagccctcgcggcaaagcgcgagaaaggcgaagccctggtgttcggccatagcctgacccagcagatcgccggccagctcgccgccggcctgctgctgcaggatttctacgaagactggcaaccgcacccgcgcttcgtcatcgaccgcttcatgccgaccttcctcgccacctgcgcgctcaagccgaggtccgccgccggttga

SEQ ID NO: 15150 - DNA, 417 bp, Pseudomonas aeruginosa
gcggaaagacgccagcctccgttttccaccggacggcttcgcattgtctgtagagcggcactgtcatgtccaaacattcccggcttgaaaaagccttcctgcgcagcggcatcctcgtcgaccgccagcaggacatcgtcaccctcacccgtcgtcacgacggtacttcggcccagatcctgctgcccgccagcttcgcgctggaggaaaaggccgtgcgccagttgctcgacttcgcctcggtccaggcacccggcgacaccgggcacgtctgcaaggcctgcgccacgccggacttccatcccggcagcatcgccccggtcggctccatcgtcgccagtacggcggacttcgtcattcccgctgccatcggcaccgacatcaattgcggcatgcgcctgctgcgtaccggcctga

SEQ ID NO: 15151 - DNA, 642 bp, Pseudomonas aeruginosa
tccacagcggctcgcgcgatgtcggcttccacgtcggccagcgctggatggaccgtgcccgcaccgcctggccgcgcggccggcgccaccccgcgtccggcctctacgcgctgggcggcgagctggccggagaatacctccaggccatgggtggcccctgcgcgctatgcctggctgaaccgggtggtgctggcggagctggtgcgcaaggtcttgcgcgagaccttccagcgcgacgacagcgccctgctggtggacgtcccgcacaacgtggtgctccaggaacagggcctgaatctccaccgcaagggcgccacgccggcccgccagggcgatctgctgctgattcccggctcgatgggcgattactcgtacatcgccagcggcctgggacacccggactggctatggtcctgcagccatggggccggccgcagcatccgccggcaggcgctacgagcgctgaaaggcccgggcgacagcgcgctgccctggcactgcgtgaccctccgtgaggagcgccgcatcgaagaggccccgggcgcctacaagccggtggggccggtgatcgatgcccaggagcgtgccgggctgatccggccgctggcacgcttgcgtccgtggctgaccttcaaggcctga

SEQ ID NO: 15152 - DNA, 1401 bp, Pseudomonas aeruginosa
gcaccagggcgaagagcagcaccggcaccatggccagcaggaggactttggatttcagggtcagacgcatcatcaactcctagcatgacgcccaataaaaaacgggattcccgtttcatcggcaatcccgtcggaagcttaagcggccggcccgacattccgtcaggcgaccgcccgagatggaactcagagcaacatcgcggcggcccagccgaacaccagcaacggcaggttgtagtgcaggaaggtcggcaccacggtgtcccagatgtgattgtgctggccgtcgacgttgagcccggaggtcggcccaagggtcgagtccgacgccggagaacctgcatcccccagcgcgccggcggtgccgacgatgctgacgatggccagcgggctgaagcccagttgcaccgccagcgggacgaagatcgcggcgatgatcggcacggtggagaacgacgagccgatgcccatggtgaccagcaggccgaccagcagcatcagcatggcgccgaccgccttgctgttgccgatccaggccaccgaggcgtcgaccaggctctgcacctcgccggtggccttcatcacctcggcgaaaccggccgcggcgatcatgatgaaaccgatggtggccatcatcttcatgccttcggtgaacaggtcgtcggtctccttccagcgcaccacgccggacagcgagaagaccacgaaaccgaccagcgcgccgatgatcatcgagtccagccacagctgtgcgacgaacgcggcgacgatggataccccggccaccgccaggctcttcgggttgtagctgacatcgacgcgttcggcctgctcgatccgctgcaagtcgtagacgcgcttgcggcggtagctgaacagcaccgcgatgagcaacccggcgagcatgcccagggctgggatgaacatggcgtgggtgacgttgatcccgctgacgtcgacgccgttgcgcgccacgttggccagcaggatttcattgaggaagatgttgccgaagcccaccggcaggaacatgtacggggtgatcaggccgaaggtgatgacgcaggcgatcaatcgccggtcgatctgcagcttgctcagcacatagagcagcggcggcaccagcagcgggatgaaggcgatatggatcggcaggatattctgcgaggataccgccacgcagagcagcaggccgaccaggatccacttgaacgcaccggcgcccttgccctgctcgtcgtgccggccgagcagcgccaggaccttgtcggccagcgcatgggccacgccggagcgggcgatggccacggcgaaggcgccgagcatggcgtacgacagggccaccgtggcacccccgccgaggccgccgttgaaggccttgagagtcccctcaaggcctag

SEQ ID NO: 15153 - DNA, 2283 bp, Pseudomonas aeruginosa
accgttgtgcacggttcttgcgtgcgattcgccgaacgacggcaatccggcgccagcgaccggaccgtcgtcaagaatgggcgagccctgccgataagccttgggcccccgcagtttcttcgtacaaggacccctcccatgttccttcgccgcctgtccatccaatggaagatcaccctgctggcagggctctgcctgctcggcgtggtcgccttgctggtcggcctttcggtctaccgcatgcagcacagcagcgtgctggtgaaaagcgccagtacacagatgctcgacgaatcggcgcgcctgcgcctggaagcccgcggggaattgcaggcgttacgcatccagcgctatttcatggatgccttccagtacggcaagggcttctcccggcagatcctgttcctccgcgaccaggcgcagaagcgcttcctcgatgcctacgacctgcgcgaagacctgacccgccaggtgcgcaccgcgctcgccgccaatcccgaagtgctcggccagtacgtggtcttcgaacccaatgcgctggacggcaaggacgaactgttgttggaccagccggccctgggcagcaacgacaagggacgcttctccctgtactgggcgcaggccacgccgggacagctggaatccgagtcgatgatcgagtccgaactcgccgacaccagcagcgggcccagcggcgcggcctacaacgcctggtacacctgcccgaaggaaagcgggcaaccctgcgtgctcgatccttacttcgacaaggtcggcgaacgccaactgctgatgaccagcatcgcctttcccctcgaactggatggcaaggtgatcggcgtgatgggcctggacatcaacctgagcaacctgcaggcgctcagcgaacagggcaaccgcgaactctatgacggcgtcggccaggtcggcatcctcagcccggccgggctgttcgccggcaacagccgcgacgccggcctgctcggcaagaacctggccaaggcggatccgcagcacgccggcgaactcctgcaactgctggccgccggcaagagccggttgttcaacgagaacgacgacctcaaggtgctgcaaccgttgcagccgattcccggcgccaagccctggggcgtgctcctcgaagtgccgaagagcgccctgctcggcccggccctggcgctggagcggcaactggacgacatgcgtcgcgaaggcacctgggtcgaactgggcctcggcctcggcgccgcggtgctcggcctgctggtgctgtggctgagcgcccgcggcgtgacccggccgatcctcggcgtcgcccacatgctgcgcgacatcgccagcggcgaaggcgacctgacccagcgtctgccgcacaccgggcgcgacgagctgggcgaactggccggttggttcaaccgttttctcgacaagctgcagccgatcatccgcgacgtgaaggtctcggtgcgcgatgcgcgcagtaccgccgaccagtcggcggcgatttccagccagaccagcgccggcatgcagcagcagttccgcgagatcgaccaggtcgccaccgcatcccacgagatgaccgccactgcccaggacgtcgcccgtagcgccgcccaggccgccgacgccgcgcgcggtgccgaccaggcgacccgcgacggcctggcgctgatcgaccgcaccacacagagcatcgacagcctggccgccaacctgaccagcgccatgggccaggtcgagcaactggccagcagcagcgaggaaatcggttcggtgctggaagtgatccgcgccatcgccgagcagaccaacctgctggcgctcaacgcggccatcgaggcggcccgcgccggcgacgccggccgcggcttcgcggtggtcgccgacgaagtgcgcaacctcgcccggcgcacccaggactcggtggaacagatccgcggggtgatcgaaggcctgcaacagggcacccgcgacgtggtcgacgccatgcatggcagccatcgccaggcccagggcagcgtcgagcaggtggatgaagcggtggccgcgctgcaacggatcggcgaggcggtgacggtgatcaacgacatgaacctgcagattgccagcgccgccgaggaacagagctcggtagccgaggagatcaaccgcaatgtcgcggcgatccgtgacgtcaccgagtcgctgtcgagccaggccgaggagtcggcccaggtcagtcagtcgctgaaccgcctggccaaccaccagcagggcctgatggaacagttcaaggcctga

SEQ ID NO: 15154 - DNA, 444 bp, Pseudomonas aeruginosa
cctgctcgtcgagccgggtaccccgctcgagcaccgcctggcgctggtcggggaggataccggggccgtcatcgtcgaccttcaggcggaccatgccctcgccctgcgcgacggtcaggcggacttcgctatcggcccacttgcaggcgttgtccagcagattgccgagcatctccagcaggtcctcgcggtcccatggcaggcgcagccccggtggcgcgctccagctcacctgcaggtgcgggccgtggatcaggcgcagggtgtcgcacagcgacggcaactcctcggcgcaatcgaaatgtgcgccaggcagcgcttcgccgaccaggcgggccttgcccaactcgcgaccgaggcgctgctggatctgttccagctgttcgcgcaggacctgttgcaactccggctggcgcgccatctcctcgcgctcggcgaggctga

SEQ ID NO: 15155 - DNA, 402 bp, Pseudomonas aeruginosa
tctgctccaccagcggctccagttcctcgggagcctggttgtccagttggctacgctggccctgctgcagctgggcgatctgcaggcgcacctcctccagcggacgcagcgaacgacgcacggtcaggcgctgcaacagcaataccaggagcagcgccagggcgccggcgcccagacccatccactgcacacgggcgaagctttccaggatcggcgtatagtcctgcgccaccacgatccgcagcttctggcccatgcgcttgtagtggccgcggaacaccagcagtcgctgctcctcgggcccatcgaccaggccctgcaccagccctttcttgtgcggcacttccagctcgctgtcccacagggagcgtgagcgccaggtgtccttttccagctcgatga

SEQ ID NO: 15156 - DNA, 687 bp, Pseudomonas aeruginosa
gtggttgacgtggacctcgatgacgtgggaatcgcgttcggtctcgccgtcgtacagatgctcggccaggtgccccttggacaggacctggccggggtgcagcatgaaatagcgcagcaggcggaattcggcggcggtcaggtcgacgtcggcgccgttcaggcacacgcactggcgctgctcgtccaggcgcagcccggcggcctccagctggctctggttggccagcccatgggcgcggcgcaacagggcctggatgcgcaaggccagctcttccggatggaacggcttggtcaggtagtcgtcggcaccggccttgagcccatcgatgcgttcggcccaggaaccgcgcgcggtgaggatcagcaccggagtcgcgagtcccagcccacgccactcctggagtatctccaggccgggacgcccgggcaagccgaggtcgaggatgatcagatcgtagggctcgctggcgccctgcaccgccgcgtcgcggccgtcggccagccagtccaccgcgtagccctggcgggtcaggctggccatcagttcgtcggccaggggaacgtgatcctcaaccagcagcaaccgcatcagtcgtcttcctcgtccttcaggatgcggccgttgcgggcatccagttccagttcacgcacgacgccgtcgcgggtgagcagctccacctcgtag

SEQ ID NO: 15157 - DNA, 453 bp, Pseudomonas aeruginosa
tcgcagccaccaaccgcgacctggccgaggaagtgcgtgccgggcgcttccgcgccgatctctaccatcgcctcagcgtctatcccttgcgcgtgccgccgctgcgcgagcgcggccgcgatatcctcctgctggccggctacttcctcgaggaaaaccgaccgcgcctgggactgcgcagcctgcgcctggaccacgaggcccaggccgcgctcctcgactatcgctggccgggcaacgtgcgcgaactcgagcacctggtcggccgcgcctcgctcaaggccctcggccacaatccggagcggtcgcggatcgtcaccctgcatcggcaggatctcgacctgcccgcggaaacccccgcgccacctcgcagcgtggtcgagcccgcgcccgccgcgccaacgaccggtcactcgttgcgcgcggccaccgacgcctaccaacgccgcctga

SEQ ID NO: 15158 - DNA, 567 bp, Pseudomonas aeruginosa
tccaggactgcctggcccgccaccagggaagctgggcctcggctgcacgcgagctgggcctggatcgcgccaacctggcgcgcctggcgcgccgcctgcaactcaggtaaacgaccgcccggtcggagcagaccgggtccggcgcgcaaacctgctaccatggcgcccccattccggttgtccgataaccccgatccagagcgcactacagtggaactcttcaaagaattcaccttcgaatccgcccatcgcctgccccacgtccccgaaggccacaaatgcgggcgcctgcacggccactcgttccgtgtcgccatccacatcgaaggtgaggtcgatccgcataccggctggatccgcgacttcgcggaaatcaaggcgatcttcaagccgatctacgagcaactcgaccacaattatctgaacgatattccaggcctggaaaaccccaccagcgaaaacctctgccgctggatctggcaacaactcaagccgctgttgccggaactctccaaggtccgcgtccacgaaacttgcaccagcggttgcgaatatcggggcgattga

SEQ ID NO: 15159 - DNA, 1374 bp, Pseudomonas aeruginosa
atgaaattcatgggcttagccgctggtcacgcgatgcacctcgtcaagactggtcatacccaaccaggccttgatcaagccatcttcacgcagattgcgctgtccctggctggcggcaagccgatgcatctgttcgagggaagctctctgcacgatcaggtcgcgcatctcggaagacagatcgacgagttcgtagatgcccacacggccgctgtagccggtaccttcgcagcggccgcagcctcgcgccacgcgccattgcgctgcctgccccgggaacagccgcgcggtggccgcctgggtcgctgccagatcggccgcagcaagggttggctcgcaaggttccgcgcagtgggcgcacaacctgcgcaccagtcgctgggcctggacaccgcgcaccggcgaagccaccaggaagggttccacgcccatgtcgatcaaacgcgtgaaggcgctcaccgcatcgttggtatgcagggtcgaaagcaccaggtgaccggtgagcgaggactgtacggcgatctccgccgtctccaggtcgcgtatctccccgatcatgatcacatcgggatcctgccgcaggatcgagcgcaaggcggcagcgaaggtcaggccgatgtcggcatggacctggacctgggtgatattgggcacctggtattccacgggatcttccacgctgatgagcttgcgcacgccatcattgatttcctccagcgcgccatagagcgtggtggacttgcccgatccggtggggccggtcaccaggatgatgccgtggggttccgctacccatgcacgcatcctccgcaagtggtccgggagcatcccgagccggtccaggcgcaacccctcgcgctccttcggcaacaggcgcatgaccaccgattcgccatgcacccctggcaaggtggagacccgcacgtcgagctccgtaccgctgacccggatgctcatgcgtccatcctgcggcaaccgtcgctccgcgatgtcgatggcggagatcagcttgatccgcgagacgaccgccgcgaatcgctcgcggggaaggctcagttggtcgtgcaggacgccgtcgacgcggaagcggatacggaagtcgaactcccggggttcgatgtgaatatccgaagaacgcttttccatggcctggctcatcacgttgttgacgagttcgactaccggcgcctcctccgccagctcccgcaggtagcggatgtcttcgctgccgtaggcgtgccgatccgcaccttgccgggccaggtccagggagtgctccaaccagccgtccagatcctgggagcggcacagcactgcttgaatcgagcgctccggatagaaatagcccagggtttcgcgtatcgaaggagataa

SEQ ID NO: 15160 - DNA, 1686 bp, Pseudomonas aeruginosa
gcgaatcctgtcgatacggaaacacgactttcggtcaccttggagcaccgtctcactactgcatgcggtgcagcaatcaactgcaaagaacctacctggtcatccccggatgcttcattagactgccggaacgacgaacgcagccaaggagaccgccatgcccagtcgcatcaccctcaacgcaaacggaggccccgaggtcctgcgcctggagcaagtccaggcgcagcaaccgggccccggcgaggtctggctggagcaggccgccatcggcgtcaatccgctggacctcggccagcgctcgggagcggtaccgattccgctgccgtccggcctcggcctggaaggcgccggagtggtcgccgcgctgggtccgggagtctccggactggcgccgggcgaccgcgtcgcctatgccaccggcccgctgggcgcctatgccagcgcccggctctaccccgccgagcgcttgctgaagctgcccgacacactcgctttcgaggacgcggcggcgctgctgttcaagggcatcaccgcgcactacctgctgtacgccacctaccccgtcgggcccggcacacgcatcctgctgtacggcgcggcgggcgccgtcggccagttgatggcggcctgggcccggcacctgggcgcctgggtgatcggcgtggtgtcgaaggcggaaagcgtcgagcgggccagggctgccggctgcgacgaggtgctggtgttcgacgcggccagtctcgccgcccaggtcgccgagctgaccgccgggcgcaaggtcgatgtggtctacgaccccatcggtcgcgctaccttcgaggcatccctgaacagcttgcgtccgcgcggcctgctggtgtccttcggcgctacctccggcgtgccgccagccgtcgaagtcgccaccctcaacgccaagggttcgctattcctcacccgtccctcgctcgccgcccacaccgccaacccggaggaataccggctacgcgcgcaggctgtgctgcgcgcccatgcagacggtgtcattcagccccgggtctggcggcgctacccgctggccgaggcggccgtggcgcataccgatctgctggagggacgctcgcaaggcgcgctggtactcttgccctgacccacccgcaagaggcgcatgcatgcaaccgttcgacagccggcaggccgatgaagtcgccacgctcctggccctggccgagcacggttcgttcgccgccgccggccgcgccctgcaacgccatccctcggtgctctcgaagcggctcggcgcactggagcgtcgcctcggcatccgcctggtcgaacgcaccacccggcaactgcgcttcaccgatgaaggcgagcgcctggcgagccgcttccgccaggccgtcgacctgctcgacgaggccgagcacgaagccagcctgggcgccgcgcaactgcgcggacgcctgcgcatcgccctgccgtcggcgatgggccggctctggctcggtccgctgctggcggagttcgccctggcgcatccgcaggtggtgctggaaaccgactattcggagcgcttcgtcgacatcatcgcggaaggcttcgacctcgcgatccgggtcggcgaactggccgacagccgcctggtggccaggcggctgtgcgcccatcggcgcatcctcggcgccgctcccgactacctga

SEQ ID NO: 15161 - DNA, 1314 bp, Pseudomonas aeruginosa
gctggttcgcttcgctttcccgttttcccactccaacaacaacccgatgaggaatccaggcatgggacagtacgtcagcatcgccgcgtccgacggcagcggccggttcgacgcgtatctcgcgctccccgccagcggcaaggggccgggcgtggtgatcggtcaggaaatcttcggcgtcaacgcgaacatgcgcgcggtggccgacctgtacgccgaagagggctacgtggccctggtccccgacctgttctggcggctgcagccgggcgtcgacctgggctacgacgaagcggccttcgccaaggccatcgagctgttccagcgcatcgatctggacgccgcggtggacgacatcgccgcctgtatcgagcacctgcgccaacgcgaggaggtggtccacgccgggatcggcttcgtcggcttctgcatgggcggcaagctggcctacctcgccgcgacgcgcaccgacgtctcctgctcggtgggctactacggcatgggcatcgaggcgctgctcgacgaggcgaaacagatcaagggccggctggtgctgcatttcgccgaacaggacgcctactgcccgcagcaggcccgcgacgcgatcctgccctgcctgcgcaacctgcccaagaccgagttgtacctctaccccggcgtcgatcacgccttcgcccgcgtcggcggcatgcacttcgacaaaccggcctacctgatggctcacgaacgcagcatcgccgccctgaagcgggagatcgggccgaacttcgacctctccgcgctgtgggacgagcatgtgcgccacgagttcgatacccgcgacgtcgccgcgaccatggcgaccatggtcgccgagccctacgtcaaccatgtcccgaccctcaccggcggcgtcggccagcgcgaactgagccgcttctaccgccatcacttcatccacggcaacccgccggacatgaccctcacgccgatttcgcggacggtgggggcgctgcaggtggtcgacgagttcgtcatgcgcttcacccacagctgcgagatcgactggctgctgcccggcgtcccacccaccgggcgcttcgtggaaatccccatgctcggcgtggtgcgctttcgcggcgaccgcctttaccacgagcacatctattgggaccaggccggcgtgctggtgcagatcggcctgctcgacccgcagggcctgccggtcgcgggggtggaaagcgcgcgcaagctgctcgacgaaagcctgccgtcgaaccgcctgatggcgcgctgggcagccagcgaaggactcggcctctagcggccggctag

SEQ ID NO: 15162 - DNA, 822 bp, Pseudomonas aeruginosa
tcaggccggtgggatcgtacgccatcgtgggcgcgttcagcgcataggcatagaggttggggccaccgcccaggccgagcgggtcctggctggcatagcacccggcttccggcaggtattaacggtagcggttgtagtaaaggccgctttcttcatcgtggtactgcccctggaagcggatcggctgcgcacccggctgtcgttccggcgctaccgcccgccagtcgtccggaacgccctgccaacgcagttggccacgttcgtcgctcagctgcaggggggtaccgaggtgatcggtgtggaaaaaagcgatccgcgcctcgcccagcgccggcacgcattgcgccggcagcggctggccttcggcggcgaacgcctggcgcagttgcagcagctccgggggatcgggctcgcaggcctgctccaggcgcagcaacgggacgaaaccgcccggttcgtgaacggtggtgcgcagttcccgcgcaaaggcttcggcgcattggcgatcgccgtcccagccgaagcgcacctgctgctcgacaccgtcgcgcagcaccaccttggcgatccgtcgcgacagcgcgtcgtagcggtagcgcgcctccagccgcgtgccgtcggcgtaatcgcgcgtcagatggaccaggcgctgcgcgccgtcgtaggccaggcgcaggcgctcgccgtcggcgccgatacgctcgaccaggttgcccagcgcatcgaagcgatagcggttgccggcgatcctctccacgcggttgccggcccagcgcgccgggccttcgccggcctggttcgcgcgcacctcggagcgactga

SEQ ID NO: 15163 - DNA, 1260 bp, Pseudomonas aeruginosa
acaacgcgtcatcctgcccgtcgcggcgggcgtcgcgacgcacctcacggtgcagggcatcgcgctcgaaggccagctcgaccgcaccgaccagcgcgccgtgcagatgacccgggccataggtcagccaggcgaccggcggcgcgtcgccgtagcggctggtctggcgcacgcctagcgcgtcgtggctgtgctcgacgctgtagacccaaccgtcggcatgtacctggctttccaggcgcaggttaccgacctcgtcgtacgtgtagcgcacctcgcaatccgccccgccggcgctggccaggcggccgtcggccaaccagcggtaacgctcgaccagggccggtgcgtgctcggtggcgggaacccggatgctcgccaggcggccatcgcggtcgtaggcataggtggtctcgcgaccgtcggcatcctcgcgggcgatcagttcgtcagcggcgttgtagcgatagcgttggcgacgaccgtcgaagccggtctcttccaccagacggtccagcaggtcgtagcggaactgcgcctggacgccgttctcgttggtcagggcgaccagcctgccggcttcgtcgtgcaggtaggacaattcgccgccgccggcgtcggaaacccgcgccagcagatcgccgtgcccccaggaaaacagcgtggcgtgcccctcggcatcggcgatacgggtctgccgcccaagggcgtcgtattcatagctcagggcgctgccgtcggccaattccaggccgatcagttgccccagcgggtcgtagcggcgccgggtcagttgtcccagcgggtcgctgctggcgaccaaacgtccttcgttgtcgtagtcgtaacgccagacctggccggaacaatcggtcaacgcggccaacaggccgaagcggttccactccaggcgccgctcgccgccgcgcgggtcgacgattcgcgtcggccggtcgggcaggcgcgggtcttcgtaggcgtagcgggtgctgccggccgggccgcgcaccgtcgtcgcattgccccgttcgtcgcgctcgaaggtccagcggcgctgcatcgcgtcctccagctcgaccagcagcccggtctcttcgtcgacgcgcttgcgatagcgcgccttgcccggcgactcctcctcgagcatccgcccctggccatcgcgccggcgccgcgtctcccgtcccagcggatcgcgcatggcgaccaggcggccgaacaggtcgtagtcgaactcgctacggctgccgtcggccctga

SEQ ID NO: 15164 - DNA, 417 bp, Pseudomonas aeruginosa
gcaggccacgtccgctccagcggaactcggtgcggtagccggcgcggccgaagctggcctgcaggcgccagataccgtcggggcaacgctggaaatgcaggtagctgtggccggacagcaccagcacggagccctcctgcgtctgcagttcggccggcaccgccgcccagcgcccgcgccaggcctgcgcttcgccgccgctcgaaccgccgcggcgcagccacagctcctcgctgccggaataatgctgggcaccgggagccagcgcaggaaagccgatccggcggccctgggcgtcgaccagcacgcaggcgtcttcgctcagttccaggtgcatgctctcgcccggcagccaccagccccggccgagccggccgatacgggggttgctcgacaggtagccacgggcgaaggtga

SEQ ID NO: 15165 - DNA, 963 bp, Pseudomonas aeruginosa
tcacctgcggcgggcggcccgaacaacgcgccagcagcgcgccagatgatcgtacaacccagtgccgtcgcgaaaggctggccaatagccacgacactcctgcccgcctcctgcggacccgccgaccctaagccagaaccaaagccgaagcaacgacggctttgtcgaaaagtatttccgctccgagcacgctgcggcgcattggcccattgcccgatacccggcaaaaatgagatattcacgaacgtgaatcattctcatatttcaatcccatctccccgcctgctgctggtcgaagacgacccgcgcctacgcgaggatctcgacgcgcatttccgccggcgcggcttccgcgtaaccgtctgcggcgatggctcgcacggactggaagccgccgggcgcgaagcgttcgacctggtgttgctggacatcatgctacccggcctcgacggcctggcgctgctggagtcgctgcgccgcgagcaggccacgccggtgatgctgatgtcggccctgggcgccgaacaggatcgcatcagcggcttcacccgcggcgccgacgactacctgccgaagccgttcagcctggccgagctggatgcccgcaccgacgccctgctgcgccgcgtacgactggaccgcctgccgtcggcgcagcggcgggatacccggctggtgttcgacgaccaggcccaggatgtgctccaccagggccttccggcggggctgacgccatccgagtaccgcctcctggcgacgctccgcgaacacgctggcgaggcgctgagcaagccgttcctctaccggagcgtgctgcaccgcagctacacgcgcctcgaccgcggtctcgacgtgcacgtctgcaacctgcggcgcaaactcgccgcggtcgccgtccgtcacctgcagatccaggcggtacgcggccagggctacctgctggtggagacggaacacccctga

SEQ ID NO: 15166 - DNA, 693 bp, Pseudomonas aeruginosa
gtctcgcccagcagcgcctgctgctgcgcaccctgtcccacgaactgcgcacgccgctggcgcgcctgcgcatcgcccacgacagcgagctaccgccggaacagttgcgccagcgcctggatcgcgaaatcggcgacatgcaacgactgctggaagacaccctcgacctcgcctggatggacaccgagcgcccgcaactgcccaccgagccggtgctggcgctgtcggtgtgggaagcgctgcgcgatgacgcctgtttcgaaagcggctgggacccggcgcggctaccctgccgcttgggcgtcgactgtcgcgtcgaggtacacctggacagcctggcccaggccatggaaaacctcctgcgcaacgccatccgtcactcgcccgaggacggcacggtcagcctcgacggcgagcgcgagggcgacttctggcacctgcgcctgcaggaccagggccctggcgtggcggaagaccagttggaacgcatcttcctcccctaccagcgcctggacgatagcgccggcgaaggtttcggcctcggcctggcgatcgcccggcgcgccatcgagctacagggcggccggctctgggccagcaacggcaagcccggattgtgcctgcacctgtggctgccggcggccgcctgagggcgaagtgtttagaaagttaatgcgctttactctcaaataa

SEQ ID NO: 15167 - DNA, 603 bp, Pseudomonas aeruginosa
caatcaatatcatttgtgatctcttgcatttcgctgcattgcccggagatccccgatgtcctcacgcgcccttcccgccgttcccttcctgctgctgtccagttgcctgctcgccaacgccgtacacgccgccggccagggcgacggctccgtcatcgagctgggcgagcagaccgtggtcgccaccgcccaggaggaaaccaagcaggcgccgggggtttccatcatcaccgccgaggacatcgccaagcgaccgccgagcaacgacctgtcgcagatcatccggaccatgccgggggtcaacctgaccggcaacagctccagcggccagcgtggcaacaaccggcagatcgacatccgcggcatgggcccggagaacaccctgatcctggtcgacggcaagccggtcagctcgcgcaactcggtgcgctacggctggcgcggcgagcgcgacagccgcggcgacaccaactgggtgccggccgaccaggtcgagcgcatcgaagtgatccgcggcccggcggcggcgcgctacggcaacggcgcggcgggcggcgtggtgaacatcatcaccaagcaggccggcgcggaaacccacggtaa

SEQ ID NO: 15168 - DNA, 927 bp, Pseudomonas aeruginosa
cgagaaagcctgatgagaacctccctgctcgtcgccgccctgggcctcgccctggcggcggccctgcccggcggcgcgccgctggcgcaaccggaccccgaggcgaccatggaccgcagcctgctgcaacgccaggacctgccctatcgcttcagcgccgtggacctggattccgtcgatggccagcggcattaccggctgtggctcggccgaccgctgcaggcaccgcccgccgccggctacccggtggtctggatgctcgacggcaacgccgccgtcggcgccctcgacgagtcaaccctgagacgcctggccgacggcgacgcaccgctgctggtcgccatcggctaccgcacgccgctgcgcatcgaccgcgccgggcgtaccttcgactacacccccgcgagtcccggccaggccgatcagcgcgacccgctcaacggcctgcccagcggtggcgccgacgccttcctcgacctgctgcgcgacggcatgcgcccggccgtggcggcgcaggcgcccctggacaccgcgcgacaaaccctctggggacactcctacggcggcttgctggtgctccacgcactgttcacccgtcccggcgagttcgcccgctacgccgcggccagcccgtcgctgtggtggcgcgacggggcgatcctcggcgaacgagcggggctcgaacagcgcctgcgcggaaagcgcgcggaactcctgctctggcgcggcagcgccgaaccggccagcccgcgcggctcgctgaaagccgagccgggccaggcgatggcgcggctggtagatgacctgcgccgggttgccgggctcacgctggacttccagccgctcgacggcctgggtcatggcgaaacgctgggggcctcgttgcgccttctgctcgcccgtccggcggtggaacgccagcgctga

SEQ ID NO: 15169 - DNA, 555 bp, Pseudomonas aeruginosa
acatcgtcgagaccgagcaccttgaggttgcggtcgacatgcaggcgaccctgggcatcgcgctcgcccggaatctgcccggtcagggtgctggcccgcacgcccacggtccagaccacggtcttcgcctcgatccgctggccgtcgtcgagcgtcacgccctcggcatccaccgccgccaccgaacgccccaggcaccactccacgcccagttccgccgaggcctcggcgatcaagccgctcaggtccgcgcccatcgatgcgccgatggcggcgccgcgatcgaccacgatcactcgcagcgccgctttctcgccgaggatcgcccgcaggcgcgccggcatctcggtggcggtctcgatgccggtgaagccgccgccggcgaccaccacggtgttgcgtgccggtgaatccggcaagtcgcgcagggcatgcaggtgtgcctctaggcgcagggcgtcttccaactggtcgacatcgaaggcagcgtcgatgccgacgacactcgccggacgccacacgccgctgccggccgccagcaccaggcggtcgtag

SEQ ID NO: 15170 - DNA, 567 bp, Pseudomonas aeruginosa
aaaccgcgcagaatattgcgaatatttctatcggagttagtgatggctctctatagcgccggcgtcgaatacggcatccactgcctgttgttcctcgccgacgagaaaggcgacagccgcgagtccagcgtacgcaccctcgccgagttgcagggcgtgccgccggaactgctggccaaggtcttcacccgcctggccaaggccggcctggtggctgccaccgaaggcgtgcgcggtggcttccgcctggcacggccggccaacgaaatcagcgtgctcgacgtggtccgcgccatcgacggcgacaaatcgatcttcgaatgccgcgaggtccgcgagcgctgcgcgatcttcgaaggcaacccgccttcctgggcgacccgcaacacctgctcgatccacgcggtgatgctcaccgcgcagaagcgcatggaagaagcgctggcccagcagaccatcctcgacctggtacgccgggtggggcgtatcgcgccaccggagttcggcgaagaagtgctgcgctggatggatgccagccgggaaggacgcggcggctcccgcgactag

SEQ ID NO: 15171 - DNA, 849 bp, Pseudomonas aeruginosa
cctgctcgccgagcaggatgccgagcaaccccaccagcgccaccagcggcggagccggcgaacgcacctgcagcaggctgtagacgatccccaccaacagtccggcgcccagcgacaatacgtagagcttcatcttcgttctccttcgcggccgtgccgcccggcggaccggagcggcacggccggcattcacttggccggattcgggccgatgcgttcgccgtgggtcacccgctcgggcgccttgtgcaccatggtgtaggcgtagtccacgcccatgccgtaggccccggaatgctccttggcgatggccatcacggcgtcgtaggtatcccggcgggcccagtcgcgctgccactccagcaggacctgctgccaggtcaccggtaccacgccggcctggaccatgcggtccatggcgtacttgtgggcgtcgctggaggtgccgcccgaggcatcggccaccatgtagatctcgtagccgccctcgagcatggcgcagagggcgaaggtggtgttgcagacctcggtccacagcccggcgaccacgaccttcttgcggcccgcggcggccagcgagtcgcgcacgttctggtcgtcccaggagttcatcgaggtgcgttcgaggatcttctgctcggggaacaccgccagcagctccggataggtcgggccggagaagctgtcggtttccaccgtggtgatggtgaccgggatgtcgaataccttcgccgccttggccaggcccactacgttgttcttcagcgtctggcgatcgatggactgtacgccgaatgccatctgtggctgctggtcgatgaagatgatctggctgttctgcggagttag

SEQ ID NO: 15172 - DNA, 1329 bp, Pseudomonas aeruginosa
aagaaggattaccagctagcagaatcgacagtccgccctataagaaaaagcccccatgaagttcaggacatgtctcgcgccttacttgctatcgaacaccagcaagttgcgcttgcaggaggatgcgtcattcgggaaaaccgctctttcgtcccgtacgtttcccgccgcacctatcctgtccggtggcctctctcgccgccgccctcgctgaccgattccgccccgctgccaggagcacgccatgagccacgatccgccgagcaaggaccgccgccatttcctcactaccagttcggtgctgggcgccgccggagtcctgtggtccgccctgcccttcgccaacgccgccagcctttctcccgcaagcaacccaggaggttccatgaccgccgacctgatcctgcacaacggccgtttccacaccgtggaccgcgacaaccccaccgccaccgccgtggcgatcaaggacggcaagttccttgccgtcggcaacgacgccgatgcgatgctccatcgcggcagcgccacccaggtgatcgacctgcagaagcgcaccgtgatccccggtctcaacgactcgcacctgcacctgatccgcggtggcctcaactacaacctggagctgcgctgggaaggcgtgccctccctggccgacgccttgcgcatgctcaagaaccaggccgaacgcacgcccagcccccagtgggtgcgggtggtcggcggctggaacgagttccagttcgccgagaagcgcatgccgaccctggaggaattgaacaaggccgcgccggacaccccggtgttcgtcctccacctgtacgatcgcgccctgctcaaccgcgccgccctgcgcgtggtcggctacaccaaggacacgcccaacccgcccggcggcgagatcgtccgcgacagcagcggcgaacccaccggcatgctgatcgcccggcccaacgcgatgattctctacgccaccctggccaagggaccgaagctgccgctggaataccaggtcaactccacccgccagttcatgcgcgaactcaaccgcctcggcctgaccagcgcgatcgacgccggcggcggcttccagaactacccggacgactaccaggtgattcgcgaactggccgaccagggccagctcaccgtacgcatcgcctacaacctgttcacccagaaaccgaaggaagaactcgccgacttcaagaactggaccggcagcgtcaagtacggccagggcagcgatttcttccgccacaacggcgccggcgagatgctggtgttctccgccgccgacttcgaggacttcctcgaaccgcgccctga

SEQ ID NO: 15173 - DNA, 1191 bp, Pseudomonas aeruginosa
atcgatctcgcggatgctcgacgtgttcgagaaggtcgaccgcgacattccgttcaacggcctgccctggttcttcgaccacgccgagaccatcaccccgtgcaacatcgagcgggtgcgggcactcggcggcggcatcgcgatccaggaccgcatggccttccagggcgagtacttcgtcgaccgctacggtgccaaggccgccgaggccacgccgccgatccagcgcatgctcgccgagggcgtgccggtgggtgccggcaccgacgccacccgggtctccagctacaacccctggacctcgctgtactggctggtcagcggtcgcaccgtcggcggcatggccctgtatccgcagggcctgccgcgggaaaccgcgttgcagctgttcacccacggcagcgcctggttctccagcgagcagggcaagaaaggacagatcaaggttggccagctcgccgacctggcggcgctgtcggcggacttcttcggcgtcgaggaagaggccatcaagtggatcgagtcggtgctcacggtggtcgacggcaaggtcgtctatgccgccgccgagttcgacaagctcggtccgccggcgccgccggtgctgccggactggtcgccggtggccaaggtacccggccactggcggcaaggcgcgccgctgaccgcccaggtccaccagtgcgtcggtgcctgcgcggtacacgcccacgagcacaaccgcgcgcgccactccaacgtaccggtgagcgacttccagggtttctggggcgcattcggctgttcctgcttcgctttctgacgtacccgggcgggcccttcgcggcccgcctcgcccggagttttcccgatgatccgcgttcgaccggtcggccgcctggcccttttcctggcgctgggcggcacctcgccgtgccacgccgcgacacaggaagccaaggcgcccgactacctggagtggcgcctgctcaaccgcaactacttcctctacaacgactatcgccgcgcggacgccgggcgcggctaccgcaaggaatgggcacacggcctgatcgccgacctggagtcggcctatactcccggccgcgtcggtttcggcctcgatctccacggcttcgccggcttcaagctcgacggcggacgtggccatgccggcaccggcctgttgccgctggactcatccggcgataa

SEQ ID NO: 15174 - DNA, 1995 bp, Pseudomonas aeruginosa
ctccatctacctcgccaactcgatcaagtacgccgatttcaacggtccgggcgaacgctcctggcaggcccgctacgatctcgacctggccccgttcggcctgccggggctgagcttcatggcgcgttacgtcagcggccgcgccatcgacggcagccatgcgccggccggcggcgcctacaacccgctgggcgccgatggccgctaccggcccttgcagggcagcggcggcaagcactgggagcgcgacctcgacctgcgctacctgttcgcctcgggcccgttcaaggacctctcgctgaacgtctcgcacctcagccaccgggccaacgcggcccaggccggcgacgacatcgaccgcctctacctgatcgtcgaatacccactcaaaggctcgctctgaccatgaccgcacccgccgcctcaccctggagtcccctgcgccaagccaccttccgctggctatggctggccagcatcacctcgaacatcggcacctggatgcatgaggtgggcgccggctggctgatgacctcgctctccgccagcccgctgaacgtggccctggtacaggtcgccggatcgctgccgatgttcttcctggccctgccggccggcgccctcgccgatatcgtcgacaagcgccgctacctgctcggcgtgcaattgtggatggccttggtggccaccctgctggccagcctcaccctgctccagttgaccagcgtctggctgctgctcggcctgaccctgtgcatgggcatcggcaccgcgctgatgatgccggcctggagcgccaccactccggaactggtgggcaaggacgaactgccggcggcggtggcgctgtccagtgtcggggtcaacctggcgcgggcggtcggaccggccatcgccggggtgctggtgagcctggtcggcccctggctgaccttcgccctcaacgccctctccttcttcgcggtgatcgccgtgctgctggcctggaaacgcgaggccgtgccctcggtgctgccggcggaacgcctgttcggcgccctgcgcgccggctggcgctacagccgcagctcgaggccactgcaatcggtgctggtgcgcgcggtggcgttcttcctcggcgccagcgccggcatgtcgctgctgcccctgatcgtgcgcggcgaactgcatggcaacgccatggacttcggcctgctgctgggcagcgtcggcgtcggcgcggtgctcggcgccgcgttcctgccgcgcctgcgcgaacgcctcggcagcgaccgcctgatgctgctctccagcgtgctctacgcactggtgctgctggccctggcgctgctgcgcaacctctatttgctggtgccggtgatgctgctcagcggcgcggcatggatcgccgtgctctccagcctgcaggtcgccgcgcagacctccgtgccggcctgggtccgcgcccgcgcgctggcggtctacatcctggtgttcttcggcagcatggccgccggcggcgccctgtggggtctggtcgccagccacctgtcgatcaccttcgccctgctctgcgccagcgccgcgctgctgctcggcctgttcgcgtcgctgcgctgccggctgccggtcaccgaggccgaggacctcgcgccgtcgctgcactggccggcaccactggtcgacgaagaggtggaccaggaacgcggcccggtgatggtcaccctcgagtacgacatcgacccgcaggacgccgcggcattccaggcggcgatggtcgaggtgcgcgccatgcgtcggcgcaacggcgcggtgtcctgggggctggtccaggacagcggcaaccgtcgcctgtggctggagtttttcatcgacgaatcctggctggaacacctgcgccaccaccagcgggtgacccgcggcgagttgcgggtcgaggccgccgcccggcgcttccagagcgccggcgtggaggtgcgcatccgccattacctgcacggcgcggccaggccttga

SEQ ID NO: 15175 - DNA, 435 bp, Pseudomonas aeruginosa
gcctcccgggcgacggtcgtcgcctgcccctggcggatccgcccacggctgttatcctgctcgccgatggcgccacaaggacggtggccggtagcgatgccgcgcacccgcggcgccgcgaacgcaacccacagggaagtccacgcatgtcctacgactacgagaaaaccagcctcaccctctaccgggcggtattcaaggccaactacgacggcgacgtcggtcgctacctgcgtcccgacaaggaactcgccgaggctgcggaagtcgccccgctgctgcatccgaccttcgacagccccaacacccctggcgtccccgcccgcgcgccggacatcgtcgccggccgcgacggcctctacgccccggataccggcggcacctcggtgttcgaccgcgccggcgtgctgcgccgcgccgacggcgacttcgtga

SEQ ID NO: 15176 - DNA, 237 bp, Pseudomonas aeruginosa
accatgaacctgaaaccccagaccctgatggtggcgatccagtgcgtcgccgcgcgcacccgcgaactcgacgcgcagttgcagaacgacgacccgcagaacgccgctgaactcgaacagttgctggtcggctacgacctcgccgccgacgacctgaagaacgcctacgagcaagccctgggccaatacagcggcctgccgccctatgaccggctgatcgaagagccggcatcctga

SEQ ID NO: 15177 - DNA, 480 bp, Pseudomonas aeruginosa
agccgagttcctcggcgatccggtagatcggcatgtcgccgctctgcaacaactccttggcgcgggcgaagcgcaactcgtcgagcaattgctggtagctggtgcgctgctgctgaaggtgccggcgcaggctgcgcgacgaacagttcaggcgcctggccagttcctccaggccgggcgggtcctgcaagcgctcggcgaggatcgcccggaccttgtccagccaggcacgacgcgcggccaggtcgatgttctgccgccggcactgttccagcatctcccggtgggtcaccgggtcggccagcggcaacgggcgctccagccattcggcggcgaagccgatggcgctgcgctcgcgttcgaagtgcaactcgcaggcgaaaccctcggcgtaggcccgcgccatcgcctcgtcgccggcatagtcgaaggccgcttccagcaagggcagcggctggccgagcaggtcggcgggggtga

SEQ ID NO: 15178 - DNA, 1764 bp, Pseudomonas aeruginosa
gcaagttgcgtgccgccgcgcctgtcgccggtcccgcaggcagttggctcaaccgcgcgagaggaagcgcatgccctcctccaggccgctcagggtcaacggatacatctgttccttgaccagttcgcggaccaggccggtggacgccgtgtagttccaggtgtccttcggataggggttgatccagatgagcttcttgtacttctccatgaagcgctgcatccagacgtaaccggcttcctcgttccagtgctcgacgctgccgccggcctgggtgatttcgtagggcgccatcgccgcgtcgccgacgaacaccaccttgtagtccggaccgtacttgtgcagcaggtcgaaggtggcggtgcgttcgctgctgcggcgcaggttgttcttccacaccgactcgtagatgaagttgtggaagtagaaatactccaggtgcttgaactcggtcttgcaggccgagaacagctcctcgcagaccttgacgtgggcgtccatcgagccgccgatgtccagcagcagcaacagcttcaccgtgttgcgccgctccgggcgcatctggatgttgagcagcccggcgtccttcgcggtgtggtcgatggtgccgtcgatgtccagctcctccgccgcgccctcgcgggcgaacttgcgcaggcgccgcagggcgatcttgatgttgcgcgtacccagttcgacctggtcgtcgaggttcttgtattcgcgctggtcccagaccttggccgccttgccctggcgcttgccggcgtcgccgacgcggatgccctccgggttgaaaccgccggagccgaacggactggtaccgccggtaccgatccacttgttaccgccggcatggcgctccttctgttcctcgaggcgtttcttgaactcctcgatcagcttgtccaggccgccgagggactggatctgcgccttttcctcgtcggtcagcaggcgctcgaactccttgcgcagccattcctcggggatcagcgacttgaggtggtcgtcgagcttctccaggcccttgaagtaggcgccgaaggcccggtcgaacttgtcgaagtggcgctcgtccttgaccatgatggtgcgcgccaggtagtagaactcgtccatgtcggcgaacaccacgcggtgcttcagggcatcgatcaggtcgagcagctcgcgcaccgacaccggcaccttggctgcgcgcatttcgttgaacaggttgagcagcatggctgcgacctcgtctgttgtccgttgatcccggcgcgcgagcgccggtcagtattggtgttcctgcggcaggtcgtcggcgatgacgtaccagtcggctttcgaacccacgtagatgtgccgctgcgctaccgatggcagcggcgagtcgagggtgccgagggcaatagaggtgtacgtcgggtcctcgttgccgccaagccactgcaggttcgatccgcagtggcggcagaaggtacgggtgacgcctggcgacgagtggtattcggccaccgcgtccgctccggcgacatagcggaacgcctcgcggcgcaccttgccgtaggtggcgaacgccgcgccgtgggccttgcggcactggctgcaatgacaatgactggccgactcgatgggcgcgtcgatttcatagcctaccgcgccgcacaggcaacttccgctgagcatgggatgttcctccgctgtctggcgtgccgccccgcagccctttcctcggaaagggccgacgcactcagcggctggcgcggcggctcatga

SEQ ID NO: 15179 - DNA, 495 bp, Pseudomonas aeruginosa
tctttctccatgcgacaaggacaccatcatgagccgcatcttcgcagacaacgcgcagtccatcggcaacacgccgctggtccagatcaaccgcatcgccccgcgcggcgtcaccatcctggccaagatcgaagggcgcaaccccggctattcggtgaagtgccggatcggcgcgaacatgatctgggatgccgaagccagcggcagactgaagtccggcatgaccctggtcgagccgacctccggcaacaccggcatcggcctcgccttcgtcgccgccgcacgcggctacaaactgatcctgaccatgccggcgtcgatgagcctggagcgacgcaaggtgctcaaggcgctgggcgcggagctggtcctgaccgaaccggcgaagggcatgaagggtgcgatccagaaggccgaggaactggtcgcgggggatcccgggaagtacttcatgccgcagcagttcgacaacccggccaacccggcgatccatga

SEQ ID NO: 15180 - DNA, 954 bp, Pseudomonas aeruginosa
gcgcggcaaggccctgctcaccggcctggtgatgctggggatctatccgatcttctatatcttctcgctgaagctgcaggtcactcccggcatgatggcgaccatcctcggcgtgcaaccgatcctcaccgccgtcatcctcgaacgccggcagtcgccggcgcgcctgttcggcctgctgctgggcctggccggcctggtgctggtggtctaccagggcatcggcctggccgggatgtccacggccggcatcctctgcgcactgctggcgctggccggcgtcaccggcggctcgatcatgcagaagggcatccgcgagaacccgctgggcaccctgcccctgcagtacctcgccggcctcggcctgtgcctggcgttcgtgcccttccagccgttcgagttcgaatggaacgccggcttcctggtccccgcgctatggatgggcgtcgtggtctcggtgggcgcgaccctgctgctctaccggctgatcgcccagggcaacctggtcaacgtcaccagcctgttctacctggtgccggcggtgaccgcgatcatggacttcatggtcttcggcaaccgcctcggctggctcagcctgctgggcatggggctgatcgtggtggggctgatgttcgtcttccgcaaggccggctgagcgaaccgagcgggtcgcggcccgcccttggcagagcgcgcgcggattcagttctgcgcgagcttgccagccatcgccgcgaaccccggccccggcaccgccgtcacatcgcgcgcccccaccggctcgccgcactccgggcagaccatggtcggccggaacttgtggccacaggccttgtgcacatactccaccggagccgccgcggccctcgtcgagccagcggtcgccccaattggccagggccagcagcaccggatgccaggtcctggcccatgtcggtgaggcggtattcgtag

SEQ ID NO: 15181 - DNA, 2457 bp, Pseudomonas aeruginosa
gagggaaaggccgatacgacggggttccgtgtgccgcccgcgcgtcgtccttgcagcacagcgtcaggcagtcccgaaagaacgaagcccgcacggctggggtgcgccccaggttgcgccggcaacgacaacaacgaggaacacaccgtgactacgccgtccccgcaatggaagaagaccgcctgtatcctctgcagcctcaactgcgggctggaagtgcagaccgagaatggccgcatcagcaagatccgcggcgatgacgaccaccccgcctcgcagggctacgtctgcgagaaatcgcagcgcatggactactaccagaacggcgccgaccgcctggacacgccgatgcgtcggcgccccgatggcagctacgaagccatcgactgggacacggcgatccgcgaggtggcggagaaattcctcgccatcaagcgcaggcatggcggcgaaagcatcctctactacggcggcggcgcgcagggcaaccacctcggcggcgcctacggcgacagcacgctgaaggccctcggggtgaagtaccgctccaacgccctggcccaggaaaagaccggcgagttctgggtccagggcaagatgttcggtaccggcgtgcacggcgacttcgagcattgcgaggtggccatcctgatcggcaagaatccctggcaatcccatggtttcgcccgcgcccgcgtgctgctcaacgccatggccaaggaccccgcacgctcgatcatcgtgatcgatccgcgcctgagcgaaaccgccgccctggccgacttccacctgcagatccgtccgggcaccgacgcctggtgcctggcggcgctggtcgggatcatcgtccaggacgggctgctggcgcgcgactggctggccgaacacaccagcggctacgagcacatcgtcgacgaactgaacgccatcccggtggcctactgcgccgagacctgcggggtggcggaagacaagctgcgcgccgccgcccggcggatcgccagcgccagcagcgtatcggcgctggaagacctgggcatgcagatgaacctgcactcgaccctcggcagctacctgcaacgcctggtctggttactcaccggccattacgggcgccccggcaccagcaacgccttcgtgcccttcctctcgctgtccaaggcgagcaagggcgatacctcgatgggcaagaggggcgcgccacgcgtcgagaagcgcagcccggtggccaatgccaagatcatcatcggcctgattccctgcaacgtgattccagaggaaatcctcaccgaccatcccaagcgctatcgcgccatgctggtggagaccggcaacccgctgcattcgctggccgatagccagcgcatgcgcgaagccatgcgcgccctggagttgtcggtggtgatcgacgtggccatgaccgagaccgcgcgccacgccgactacgtgctgccggcggcgagccagttcgaaaaggccgaggcgaccttcttcaacctggaattcccgcgcaacgccttccacctgcgcgcgccgctgttcccggcgcgccccggcaccctgccggaagcggagatccacgcccgcctgctggaagccatgggcgtgctcggcgagaaagactaccggccgttgcgcctggccctgaagctcgggcgcaaggcattctcggcggctttcctcgccgccgcggcgacccgccccaaggtcatgaaatacgcgccggtcctgctctaccgtaccctcggcccgaccctgcccgccggcatggaagcggccgcggcgatctggggcatctgccaactgcacgtgctgaacaaccgcaagaccgctgcccgcgccggcttcgacgggttgccgccgctggccgccgaccgcctgttccaggccatgctcgacaacccgtccggggtggtcttcgccgaaaccacctacgccgaaagctggcaggccgtcgcccgtcccgaacagcggatcaacctgcacatccccgaactgttgccggaactggccaagctcgcccacagcgcgccaccccacgatccggcctacccgttcatcctcgccgccggcgagcggcgcagcgacaccagcaataccgccgtgcgcgacaccggctggcaccgccgcgggcgctacggcaccctgcgcatcagcccgcaggacgccgaggcgctgggctgcgccgacggcgaggtgctgcgcgtggtgacccgccgcggcgaggtcgaggcggaagtggagatcagcgacatgatgcagccgggcaatatctccctgcccaacggccagggcctggactaccgcaacgccgagggcgaggtggtgcgccggggcgtggcgcccaacgaggtgaccgactgcacccagcgcgacttcctcgccggcacgccctggcacaagtacgtgccggcgcgcctggaacggctggcgacgcccgccgctacgaacgcctga

SEQ ID NO: 15182 - DNA, 1257 bp, Pseudomonas aeruginosa
cggtgctcaggcttcggcgcgcgaacgcatgagccgccggtaacggcgggtctgcaggagcgcgccggcctgctgcgcgagcaacgcgcacagcggcgacacccgtgggttggtcgccctgccccggctcagcttgcgcagctggaacttcaccgcggccatgttcgccagcgatgccaggggtttgttcttccaggttatcggccgcaactgcggcgccgagtccttgccggcgcgccagtcgcgcggcaggttcggctcgatcgccagcgccgtgccgatgccaaccatgtccaccccgctggccagcacctgctcggccaccggccgccggcggatgccgcccgtgaccattaccggcatccgcgccgccgcgcggatgtcgcgggcgaactcgacgaagtaggcctcgcgggccagggtccgcccgtcgcgcgcttcgccctgcatggccggcgcctcgtagctgccgcccgacagctcgaccaggtcgacgcccaggccatcgagcatccgtaccacctcgcgggcatcgtcggcgctgaagccgccgcgctggaaatcggcggaattcagcttcaccgccaccgcgaagccaggggcaacctcggcgcgcaccgcccggacgatctccagcagcaggcgcgcgcgattctccagggagccgccccaggcgtcgctgcggcggttgctcagcggcgagaggaactggctgagcaggtaaccgtgggcggcatggatctccaccccgctgaagccggcccgctcggccaggccggcgctgcgggcgaaccgctggatcacctcggcgatcatcgcctcgtccatcgccttcggcgtagcgaagtgcctggacatcccgcccagttccagcggcaccgccgagggtgcccaggcctgctggccgagattggcctgcatctgccgaccgggatggttgatctgcaaccagaactgcgcgccggcggaacgcccgatgcgcgcccagcggcggaatttctccagttgcgcgtcgttttccaggaccaccccgccggggccggtcatggcacggctgtcgaccatcacgttaccgctgatcagcagcccggcgccgccgtcggcccaggcctggtagaggcgcatcaggcgttcggagggggcctgcgcggcatcggccatgttctcctccatggcggccttggcgaggcgattgggaatggtcgagccgttgggaagcgtcagcgtgtcgaacaggttcatgggcctacctcatga

SEQ ID NO: 15183 - DNA, 1014 bp, Pseudomonas aeruginosa
ggacagtggcccgacgataagattgaagtcgacttcaaggtcaacgctttttttgccgcgccgcccgggccccgaccgggtgccgggagcgcgccccggcacccggcgcgctcagccgcggatgaaggccagcaggtcggcgttgatcacctcggcctgggtggtcggcatgccgtgcgggaaccccggatagatcttcagcgtgccgttgcgcagcagcttcgccgagagtacgccggaattctcgtagggcacgatctggtcgtcgtcgccatgcatcaccagcaccgggatgtcgatgcgcttcaggtcatcgctgaagtcggtctgggaaaaggccacgatcccatcgtagtgggccttggcgccgcccatcatgccctgccgccaccagttgcggacgatcccttccgagggctgcgccccgggacggttgtagccatagaacgggccggcgggaatgtcctggtagaactgcgcgcgattggccgcgagctgcgcctggagatcgtcgaagacgctcttcggcaggccgcccggattgccctcggtcttcaccatcagcggcggtaccgcgctgatgatcgccgccttcggcaccgggtcgtcgggatagcgggcgatgtagtggacgacctcgccgccgccggtggaatggccgacatggatcgccccgcgcaccccgaggcgctcaaccaccgccgccacgtcgtcggcgtagtggtccatgtcatggccgtcccagacctggctggagcgaccgtggccacggcgatcgtgggccactacgcgaaagccctcggcgaggaagaacagcatctgcgcatcccagtcgtcggaactcagtggccagccatgatggaagtagatcacctgggcgtcgcgcggcccccagtccttgtagaagagttcgacgccatccttcgttgtcacgtaacccatgtcgcttctcccgatcggtgtggatgcaggcaacggcgccaccctgcggccgccgtcccctgtgtaaagtag

SEQ ID NO: 15184 - DNA, 702 bp, Pseudomonas aeruginosa
ggaagttgcgcacgctgtagtaaccctgcgaatcctgccagtcgagagcggccaggttctgcatgccggcctcccacggctggttgtcgaacagcgcttccaccgtgcgctggttgccgaaggcacagaagaaatgccggaaccagtgcaggcgcgcgtccagcggctcggtgcggatcgcccgctcgatgctcgggaacagcccggccggcagcggcggcgccttgccttcggcgccgcgcaggccgaggttgccgatatgcacctcgaaacgccgctcgccgatctcccaggtctccaccatcacctggtcctcctcggcctggccccagagcgcggaaagcagcacgtggaaagagctggaggcgaagttacgcaacgcgtcctgcaagccgtcctcggcgctgccgatgccggcgaaggcttcctgcaactggtgctcgtcctccagcagcacgtcgacatccagccgtccggtcttctcccccgcataccaggtggcgcggatcgccggtagccgcccggctggcgccacccattcgccgtgcacgacgcagtcgatccggtgggattcgaacagagcagccagatgctgcgagacggagaccgcttccatgggttgtccttgcatggtcgagggcgcgccgccgaggcgctgcccggaaagcccggcgaggccgggcgaaacgcggcatagggtag

SEQ ID NO: 15185 - DNA, 1155 bp, Pseudomonas aeruginosa
aaggcgagacccgcgactatgccgggcgtttcttctgtccgcagtgcggctcctcggtattctcacgcagcgccgacgagatcgaggtcagcctcggcgccctcgacgctcccgaccggttccagcccacctacgaactctggaccgtccgccgcgagggctggttgccggcgtttccgctggcacggcactatgaaagggatcgcgaaggcgacggacgcagcgaagagtgacgttgttccagcaggagaagggaggcagcatggacgaactgttcgaagagcacctggagatcgccaaggcgctcttcgcgcagcgcttgccgtactggtgcgatgtctttctgcgcccggccgaccaggctttcaacgcctacctgaatgcccgcggccaggcctccacctacctggtgctcgaaggcttcgatccggtctatattcctcgcggctgcgacctcgacgccgtgcgcgcgaccgccagggccagggctcgattgagggaagcggggctgggcgaagacgcgctgcccgtactgctctgagcgcaggccgccagtatctcggaagcgtctgctggcaatttctcccaccgcactgtccgccaacggaaggctacatgacccgcccctacctgctccgtctcgccgccggcctggcgctgctcctgccggccgcctgcacgtcccctgccccgccagcaccgaacctgaccgcactgttcgccgacgccctgcactgccgcggcgacttccccgacggccgcgaccgcgcaaccgccgagcgcctgcgcgccgagggcgtcgaagtgctggatcgcgcgcccggcgagaccctcgacctgctctaccgcttcgccaccccgctgcgcatcgacggcagcctggtgaacgcggtgcgggtacgcggcgacagcagcgtgctggtgatggcctacgccgagggcgacctcgaagacttcgcccggcgccagggcgcgacgccgcacccggcggaacgcgccgcgctggatggtttcggcgagctggaggtgctctacagccgtccgttgccgccgcgtcccgatctcgacgaaagcccgccgcgcctggtgatcggccgcgggatcgaggcggcggcgcaggcgttccgctggggctgccggagctacgacggttga

SEQ ID NO: 15186 - DNA, 375 bp, Pseudomonas aeruginosa
gcgactaccgatgccagggactgcactgttcgaaaagccacgctggttgcgcgacctcctgcgcttcctgcccctcaagagtcaattcgtcctctccgggaacatccgcgacctgcaagcctgcgaagtggtgccgggtacggtcaccgcgcagagcttcaaccagaccctctgcgacgccctgctggacgccggctacgcccaggtgctggcctgggatccgctggccgggttccgcgtgctcggccggccgggcagcgaggcgggggccactccgcaggtgcttctcgacctcggcctgaccccggtggacggcgccgcgccggccggcatcgacctactcggcgcgaccctgcaacgcctggtcaaccgtag

SEQ ID NO: 15187 - DNA, 1476 bp, Pseudomonas aeruginosa
cggcgagccgatcgccctgatcgtcgacttcgcctcgcgcctggcggtgcgcaacgacgccctgagcgccgccgagcaccagttgttcacccaggccctggtgctctcccaccaggcccgcagccgtcccgccggggaacagcgcaaaccgttcttcaacagcgtgctgtgggtggtggaaaaggaaggcgacctgcccgactggctgctggtggacaacccgcgcctgcgccatatcccggtgtcgaagcccgaccagccggcgcgccgggccctggccccggcgctgctccgcgggctcggcggcgcgggcgtcgccgaggaggccctgcaacaggccgccgcaaccttcgtcgagaacaccgaaggcctgctgctcctcgatctcaacgccatcgtccagttggcgcgcgtggaaggcctggccatggaacgcatcgccgacgccgtgcgccgctacaaggtcggcgtcaccgaagacccctggctgaagatcgaccgccagcgcatccgccaggccgacgagatcgtccgccgccgggtcaagggccagcagcacgcggtgacccacatgctggacatcgtcaagcgcgcgatgaccggggtcggcgccagccgcaagggcaaccgcccgcgcggcgtggccttcctcgccgggcccaccggggtcggcaagaccgagctggcgaagaccgtcaccagcctgctgttcggcgacgagagcgcctacatccgcttcgacatgtccgagttcagcgccgagcatgccgaccagcgcctgatcggcgcgccgcccggctacgtcggctacgacgtcggcggcgaactgaccaacgcgatccgcgaaaaacccttcagcgtggtgctcttcgacgagatcgagaaagcccacccccggatcctcgacaagttcctgcagatcctcgacgacggcgtgctcacctccgggcgcggcgatcgcgtgtacttctccgaggcgctgatcgtgtgcacctcgaacctgggcatctaccgccagggggaaaacggcgaacgggtcgccaacgtgctccccggcgagcccttcgaggcggtgcagggcaaggtccacggcgagatcgagcgctacttcaagctggttctcaaccgcccggaaatcctcaaccggatcggcgagaacatcatcgtcttcgacttcatccgcgccgacgtcgccgagcagatcttcacccagatggtcgacggcaccttcgccgacctccgcgagcagcgcctcgtcatcgaactggccgaggcgccgcgccaggcgctgcacgacctctgcctgggcgacctgtccaacggcggccgcggcatccgcaaccagctcgaagcgcgcctgctcaacccgttgtcgcgggcactgttcgaccaggacgcgcagccgggcgagcgcttcctgatcagcgccctggacgccgacggcctgaccctggaacgccgctgagatggaactga

SEQ ID NO: 15188 - DNA, 2430 bp, Pseudomonas aeruginosa
tgttcgaccatgacggcagcgtgtggatggccggcatcccgcgccgcgacgacctgctgcggctacaggacctgctgcgcgaacagggccaccaacttagcgtcagcgcccatcggccgcgctgaatggatcgataccgatgatacgtttctgccccaactgccagagcgaacgctcgctttcggaaatcttctgcgaaggctcgatccagggccagccctgcggctgggacctttccgccgaagccatccatcccgccggctggcgaccacagccggtgctgacccaggaagccatcgcgccgcccgccagcgagccgccagcggcgtccgccccgctctgcgccaacggccacccgctgcaacccggcgacctgatgtgcctggagtgcggcgccgcgccggccgaaggcccgctgccgatgcaggccgaggccacgccgcagcccgccgtcacggaaaccctgatcgacggctggcgtctgctgcggcagatcgccagcagcgacggcgtgcgcgagcgctacctggccgaacacgcggaaggcgcccgccaggcggtgctcaccctgtatcgcccgggcgccgagccggacccggcgatctacgacgtgatccgccgcctgccgcgcgaacacgtaccggaaatcctcgccaccggccgctgggacgagcgcgcctacgaagtggtcgaggagctcaccggcggcagcctcgccgacctcggcaccgtgctggaggaccgcgaggcggtgcgccacgtggtccgcgagctgggccacgccctgcacgtgttcaacgaagccggcctgcgccaccgcgacctgcgcccggccagcctgctggtgcgcagccacgagccactggacctggtgatcagcggcttcggctcggcgcgcctgtcggagttcgacctggatatcgtctcgccgctggagaccagccgctacatggcccccgaggcgatcgccggcggcgtggcggcggcttccgactggtggagcctgggcatgatcctgctggagcagttgacccgcggctcctgcttcgaaggagtcaacgccaacgccttcctgatccacgtgctggccaacggcgtggcgctgcccgacgacctcgacccgcagttgcacctgctgctgcgcggcctgcttgcacgcgaccgccaccagcgctggcagtggccgcaggtacaggcctggctgaacggcgaggcggtggacgcgccggcctcggcggacagcgaaaaggacgacgccgaaggcgccagcatcgccctcggcgcacggcgcttccgcaagccgacggtcttcgccctggccgcggcccaggccgagcactgggcggaggccctcgaccacctgctgcgcggggcgatcgtcacctgggccgagcacatcggcctgtcgcccaggctgctcgccggcctgcgccaggtggcccagcacgaggggctggaggacgacttccggctgatgctggcgctcaagctgctgaacccggaaatcccgctgatccagcgcggcgagatcgtcacccccggctggctgctggagcatccgctggagggctaccggctgatcagcggctcggtgcccgacctgctcgaacagttgcacaccgaaagctggctgtcgcggctcaagacccgcgccgagaacgtccgccagcgcgccctgcaccagcacatcgaactcgccgaagaacagttgcgcatctacctgctgtcgacctcgcgggcgcgcctcgccgcgcagtggcaggagcgccagcgcctcctgccggacaccgagcaccccggcctgctggccctggccgagcgccgggtgatcgccgaggaagacctgatcgtcctgctcagcgccaacatcggccagttccgtgccgccgaggcgatcgtcgaggaagccgccggcctggcccgcgacgccgatgtgcacctgttcgacgcggagaccgcgcgcggcctgttgcagcactcgcggcaggagctgtaccgccgcgtcgacgaacgcatcagcggcttcgcccgcagcggcgtgcccagggtcgacgaatgggccgagcagttccgcctggagcggcgcatgccgttggcgagggtcctggtgctgctggcgatcccgccggaacagtggctggaaccgcagaagcagcagtacgtgtcgcagatcctcgatttcttcgagaagaaagtggtcgccgcggtgatgcgcgggccgctggtgcgcatgagcatcggcaagagcaccccacgcatcgacctcaacgaactgcacagcgcgcgacgccccgccgccgccctgctcgaccatctgctgcaacgcaacgcccgcgcggtgagcctcgacccggacagcttcctcgccaacccgcaactggaagtgcggctcaacgcgctgtcccggcaaagctcgctgtacaagcgtga

SEQ ID NO: 15189 - DNA, 5121 bp, Pseudomonas aeruginosa
ggtgctggaaggattgccaccgagttccaccgaggtcacgccctaccaggaccaactggcctgcgccgcggtgctgttccacgtcaccttcatgggccaggcgatcggcgaggacctgcgccagctgaagagcctgccgccctccggcaccggactggagaccgcgctgcgcctgcgcgagaacggcgagccggaagcccgcgagagcccgccggagttgcagcgctacttcaccgtggccagcgacccgtcccaggaggccgccgtgctgcaggcccggcagagcccggggctgctggtggagggcccgcccggcaccggcaagagccagaccatcgtcaacatggtcgccgacgccatcggccgccagcgcagcctgctgatcgtctgccagaagcacgccgccctggaagtggtgcacaagcgcctggtggccgagggcctgggccagcgcatcgtcatgctcaacgacgtcaaccgcgaccgcgaaccggtgatccgcaacatccgcgagcagctcgaagcgctgttcgccgaagccggcggcgcccagggctgggagcgccagcgcgagcgcctggcggcgcgtatcgaggcgctggaaggcgaactggaccgctaccaccagagcctgcaccgcgtggacgaggccaccgggctgagctaccggcgcctgctcggcgaactgatcgagctggagaaaggctcgccgccgctggacttcccggccctgcgccagcgcctggcggcgctggacatcggcagcctggcgcgcctggaggaaaactgcgcgccgctggtccgcctctggctaccggcccgctacgaaggcagcccgctggcgcaactgcgcgccttcgccaccgaccaggccaccctgcacgccttcgccgacagcctgcgcgccttcggcgaagcggagaacgcccggcagaaagccctcgacgaacacccggcgagcttcgaggtcgacgacccgacgccctaccgcgcctggctggcaagccaggtcggtaccctgctgaatttgcgcgaggagcagcgccagcgcctggcccactggctgccgctgttccgcgacgccacgccagggcagccgagccgtggcgacggcctgctggcggaggccgagcagatcgaacggcaactgcgccagctcgacctcgaacggcatgcgccgctgctgtcgccggccctcgccatgctcgaagagaacaacctcgaacgcttccaggcccacgcccgccaggtgctcgaggcacgcacctggctggctcggctcaacccgctgcgcctgctgcggcgcggccgcctgcggcgcttcctgcgcgagcacggcgaggccgacgacgacagccgcctggccgccctcctcggcgcctgcgacctggagcgccagtggcggccgctgcgccggcaactggcggcgctgcaacagagcctggggctggcgacagtcgccaccgatgccggtccggaactgaccggcctggccggccacgccagccagcagctgcgcgagatccaggtcctggctcgtggcctggcccaagcgccgcgcgccgagcagctcgacgcggtgatcctcaccggcgagaaacagcgcttcgaagcgctgctcggcgacctcgacgccgcgctgatccgccaggccgcacgccagctcagcctggacaaactgaaggtgctcgccgactggctcggcgacgaactgctggaacagctgcaccgcgccatcgccggcaaccagagcaacctgccggccctcggccgcctgcgcgaggcgctaccgcaactagtcgcctaccagcgcttccgtggccgcgccggccagctcgaagccaccgacctggaattcctggccctgctgcgccagcgccaggaacgactcgacgcgattcccgccgaagaactcgaagccacggtgcgccgcatgctcaaccgcgaagcgcggctgggctggaagcagcgcctggaacaagacaatccggaactgctgttcagccaggacgaagccagggccagggtcgccagcctcgccgaagccgatgtgcagatgcgcgcgctgaaccgcgaactgctcggcaagggcatcggcgccgcgcgcctgggcagccgcaagcaatgggaagacgtcacccgcctgaccggcaagcgctcgcggcgcctgcgcgagttcatcgagctgggcgccgaactcggcctgatgagcctgcgcccggtctggctgatgaaccccgacctggccagccgcgtgctgccgctcaaggccgggctgttcgacatggtgatctacgacgaagcctcgcagatgccggtggagttcgccctgccgaccctctatcgcgggcgggtcacggtggtcagcggcgacgagaagcagatgccgccgaccgcgttcttctccagccgcgtggaaagcgacgaggccgaactgttcgacggcgaagcgcccgacgaggacgccgacgaggagcagcgcgaagcctacgaggacacctggaaccgccgcgagatcaaggactgcccggacctcctgcaactggcgcgcaacgccctgcccagcaccaccctgcagatccactaccgctcggcctaccgcgagctgatcggcttctccaacgcctcgttctacggcaaccgcctgagcgtgccggtacgccatccgcaggccaacatcctgcgcatcaagccgctggaactgatccaggtgaacggcctgtaccagaaccagagcaacgagcgcgaggccgagcgagtcgtcgactacctcgccgaactctggcgccaaccctacgcggcgcggccgtcggtgggcgtggtcaccttcaaccgcaagcaggccgacctcatcgaggagcgcctggaactgcgcgccgagcaggacgagacgttccgcgccgcctacagcgaggagcgcgagcgcagcgaagacggcgaggacatgggcgtgttcgtgaagaacgtggagaacgtgcagggcgacgtgatcgtcttctcctccaccttcggccgcaacggccagggcagcttccggcgcaacttcggcgtgctcgggcagaccggcggcgagcgccgcctcaacgtggcggtgacccgcgcgcggcgcaaggtggtgatgatcacctcgatgccgatcggcgacatctccgacatgctcggcacccagcgctcgccgagcagcccgcgcgactacctgcaaggctacctggaatacgcccgcgcactgtccgccggcgagttcgccggtaccggccaactgctcgagcgcctgcacaccgaccgcagcgaccagcgccgccagcactaccagcgacacgacggcttcagcgagatcgtcggcgagtacatccgctcgctgggctggtccgccgcacccgccggcgaaggcgacgccttcggcctcgacttcgccatcgagaacccggccaccggcctctacgccatcggcatcgaatgcgacgccccctgccacccgctgctggaacgcgcccgcgcccgggaaatctggcgaccctcggtgctgcggcgggcgatcccgcacctccaccgggtttcctcccagggctggtaccacgacggcgacaacgaacgcgcacggctgcgcgccgccatcgagaaggccctggcgcccagcgcggaaacccatcccacggcagcagcggaggcctcccaatgagcggaccgaaagttgtaagaatcgtcacccgggaagaagccatcgccacctgcgagcgcgacctgcaacgcctggacaaggccctcgcgcgctgggaaaaccaggccagccggctcgcccagctcagcgacgccgagcgcgccgccgcccacgcccgccgcgccagcctgcacgccctggctcgaacaggaacgctggctggacgtgcaactacaggtgaagatcgaaagcgaattcctcaagcgcgacctcgccgaacgcgaagagcgcgccatccgccaggccgcggaatcacgccagcaacaccgccgcctccaggaaaacgccagcgccctgctccaggccctcgacgccaagcccgatgccgccagcgcggcagtccggcaaaccctgcaagcgctggccgacggcgccctccgcgacgacgcggaagccctgctcgcccaaggttttgccgccctcgccagcgcccccgccgaggaacgcctcagcgaagcccagcacgaactcgcccagcgcctgaagaccgacgaaacgcccatcaccctggaacagtggcgcgcccgccagcaacaggacgccccgcgcgaacagcgcctggcgcgcatcgaccggcacatcgccgaactgcaactgctgcaaggcgaggccagcgcccaagcgttcctcgagcgactggcacgcgccgaagccgaacagcgcccggagcgccgcaacctgctgctcgacagcctggtcctcgacctcgcccaggccgcccgcgaacaccagcagcaacgccagcgcctggaacacctgcaagacctcgccagcgaagtcgccgccctcggcgccgccgaacacgccgaactgctccagcgcgccgccgcctgccagcccgacagagatccgcagcaactcgccgaactcaccgagcgatgcaacgccatcctcaccgcccacctccagcaacaggccgccctcgcccgccgccaggccgtgctccagggcctcgccagcctcggctacgaagtccgcgaaggcatggccaccgcctgggcgcagaccggcagggtcgtcctgcgcaaacccgccacccccggctacggcctggaagtcggcggcaaggccgacaacggccgcctgcaactgcgcgccgtcgccctcaacgccaaccgcgacagccagcgcgaccgcgacatcgaaaccctctggtgcggcgagttccaacgcctccaggccctgctcgccgcccagggcggcgaactcagcgtggaacgcgcgctgggggtgggagaagtggcgttgaaggagattggcgaggaagagcagcaggagatgggggtggtgcggcagagggggttgtgaaggggccggctggcgcctcggcgaggcattcgatccgggcagtccatcgcttgacccctggatgccccctcgctaccctgccggccaggtgctga

SEQ ID NO: 15190 - DNA, 378 bp, Pseudomonas aeruginosa
aaaggctaccgctctcttgatgtcggacgaactcgatcgtacgcgctgatagaccagttgagtgagcaggagtcggtagaagtggtctgttcagctttcgatgtggcacggtcttgctaccgcgtccaccgtcttcgacgtcgtcgggtcgatgcgcgccgcgttgcgctacgcagccaggtcaaccagttgttcaaccagcgtcggggctcggccggcagctgcagcatcctgggcatgctgcgcgaagagggcgtgaccatcggccgtttccgagtgcgtcggttgatgcgtgagctgggcctagtcagcaagcaaccgggctcgcacgcctatagacaggccatgttgagcggccggatatcccgaatcggctga

SEQ ID NO: 15191 - DNA, 195 bp, Pseudomonas aeruginosa
agtcggagtgggtcccgtcaacgggttgacctgccccccgatttcagtaccatgtcaaacttagtagagtccgttttccgagcaggagacggcagtgaaaaagcgttttaccgaagagcagattctcgacttcctcaagcaggcggaggccggtgtgccggtgaaggaactgtgtcgccgacacggcttcagtga

SEQ ID NO: 15192 - DNA, 963 bp, Pseudomonas aeruginosa
actggaaaacagccgattgaagaagttgctcgccgaggcccacctcgacatcgagtcgctgaaagtggtcgcccggggaaaagggtaagcccgacagcacggcgggaggcggtgcaggagatgcaggcgcgaaccggcatctccgagcgtcgtgcctgtcagttgatcgggctgtcccgctcggtgttgcgctaccagccgcgagccagtgtgcaaaacaccgagctgcaagcccaactggtggaactggcccaagagcgccggcgctttggctatcgccgcctgcacttcctgctgcggcgtgctggcgtgcaggtcaaccacaagcggatctatcgcctgtaccgcgctgccggcttgatggtgaaacggcggcgccgccgccatggcgtcgcggtggagcgcgaacgtctgagtttgccgagcgcaccaaaccaggtctggtcgatggacttcgtcttcgatgcactgagcaccgggcggcggatcaaatgcctgacggtggtcgatgacttcaccaaggagtcggtcggcatcctggtggagcacggtatcagcggctttcgtgtcacacgggcgctggacgagatggcgcggtttcgcggctacccgaaagcgatccgcaccgaccaggggcccgagttcaccggcaaggcactcgatcaatgggcctatcagcgcgacatcaagctgaagctgattcagcctggtaagcccacgcagaatgccttcatcgagtcgttcaacggtaagttccgggacgaatgcctcaatgagcactggttctgttcgctggccgaagcgagaatccgcatcgaggcctggcggcgggattacaacgaacaccgaccgcacagcgcgattggcaatctcaccccggcagaatttgctgcaagttggcgaactcgccagcagcagctgaagcaggaaaaattaatatcaaccccagggcctactaactag

SEQ ID NO: 15193 - DNA, 2574 bp, Pseudomonas aeruginosa
gcagcggtactaaaactgggggcaggtcaacttggctcgttccagccatatctcaaaccttttcgcgattggcgtgacaacggtattggggcaatgcgtacggcattggatgccagtaagaaaatcgtggcgctcacagccgatgtcagctccttctatcacgagctgagcccagccttcatgctcgaccccgccttcatatcaggtgtgctagggctggagctgaccgaagagcaaagcaagctcaatttcctcttcatccatgctctacgggcatgggctgcggggacgccattgaagaaggggctaccagtggggctacctgcctcggctgtagtggccaatgtggcattgatcgagcttgatcgtgtcatcgaacagcaagtggccccgatttactacgggcgctacgtcgatgacattctgttggtcatggaaaacggcgctaactttcgctcctcggtcgagctatgggaatggctatttgctcgtgcggaaggaaagctgggctgggtagagcagcaaaaccatcagcagattcgctttcagcccgcatacctaaaacacggcgatagcgaaagtcagatccacttcgccaacagcaaaaataaggttttcctcctcgccgatgcccctggccagacgctggtcgatgctatcgcacaccagattcatcagcgcgctagtgaatggcgagccatgccgcggttgccgcgatccgcaaaccatgtagggacggatttgcttgctgcaactcaaagcgatggtgaagccgccgacaatctgcgcaaagcagatgcgctaaccatgcggcgcgcagggtttgccatcaagctgcgcgactttgaagcctatgaacgggacctgcaaccagaggcttggagtgagcatcgccgggccttcttccaagcctatatccaacatgtcctggtgctaccgcagttttttgatctagccgtataccttcctcgcgtgattcgcctggcgactgcctgcgaagacttcgctgatttgcgaaaaaccatcaacgccctggaaaagctttgcaggcaagtaaacgattactgtacgaccactatcaaggcgagtccgcctggtaatgccatcccccacagcgaggtaattaccagttggcaaaatcaattgttcgccagcattcgcgagagcatcaccgcggcttttccaccccaactatccaaggcaggcaagcaagcctgggatgagcacatggctgactgcctcccaatgacagatgttgatactgctctgtcttggccgctttcagctaaaggctttcaaaaagagcaggggcgcttgttctcgttcgatctagcgcacttgccgttccgtttcatcggccttcctaaggagatggttgcccagcgaggtattccagccaaaaagagtgttgtcacttgcgctgatgcaactgctctgctgccgagcaatgtgattgaaggaaatcaggtgcttgccaagtggatcaatctaaagggattaccctacgggctcctttttgccacacgaccttttaacctccctgagctgtttgtcctgaacaaagatgcgtacgctacatctggacgaacctctatgcgggcagtagtgcttgctgtgcgaggtttcgaactcggtgaaaaagcgccgagtttcgacaatcacggtgtacttcaaattccggacggagcctcaccgcgcaggtacgggattgcggtctccagttggaagacacgcatcgagagttggactgctgctgttacgcgccggccagatcctgatgccgaccgctatgcccgcctttgccggctactggatgtcgcaatttcccagccacagcagagccgatacttcgtcctgccagaacttgcactgcctgcccactggtttatccgaattgcgcgcaagctccaaggccgagggatctcactgattaccggtattgaatacctgcatgctggtaaagcgagggtacgcaaccaagtgtgggctgccctgccacatgatggtttgggttttccttcgctgatgatctatcgtcaggacaagcagcgccctgccttacatgaagagcaagagcttcaacgcctcgcagggttggagctcaagccagacagaccgtggaaaacgcctccaatcattcagcacggagatctgcgcttcgccctgctgatttgtagtgaactgaccaatatcagctaccgcgccgccttacggggcgcggtagatgtccttttcgtgccggaatggaaccaggacaccgaaacctttaactccctggtcgagtcggcagcgctagacattcacgcctacatcatccaatgcaatgatcggcaatatggtgacagccgcatccgagcccccttcaaagacagctggaaacgcgatgttctgcgagtcaaaggcggcattaccgattattgcgtaattggcgaaatcgatgtgcaggccttgcgacagttccagagcagctaccgctcacccagtaccctctttaaaccagtgcctgatggttttgaaattaactttgaccgcaaagtattacccattggtggagctgagccatcaaatacgtag

SEQ ID NO: 15194 - DNA, 288 bp, Pseudomonas aeruginosa
ggtccacatggccaaagggatagaggccctgtcagcctcgtactgcgcatctttgctgaagcccccggtactgacatagaggcctcgatcatccttatgtcggccacccagaaagctgcgaatctcctggctacccatctgccctttgcggtgtttaacctctacgacaatacgtggatgctcgaaaccgaagccgtcaggcgaggcaacgatgtccttgcctcgatcagagccaggtggcgagacttgggtcttgtagcccatagcacgaagaattcctgctactag

SEQ ID NO: 15195 - DNA, 1089 bp, Pseudomonas aeruginosa
ctccagcaccttggcgtcttcgatgtcctgcacgccgtgatcggcaaatttatccagcagggcttcgagcacggcgcgggcctgctcgccgtacttgccgaacacatcacgcctcttgacgttgttggcgcgctcgcggcgggtgagcggcttctggtcgaaagccacgtgggcgaccagatcgaatacatccagctcgctaccgttggtcacggtttgctgcaggatttcgagtggaacgccgtgatcggccagttctttaagcacagcttgcttgcgctcagcactgttccagcggcgcaggaaatcggtgagcgtgccgaactcagcctgcagtgctttcctgatatcgtccttgagcagaacgcggtaatcctcggtgatgagtttgccgtcggcgtcgaggtattgcgaacgctctaccgcgacacgcacgctcacatcgtcgatcacatacttaacgcgaccttcgccgctcgttccaccggtattgccactagggaagacttcagcgccgccagtggcatcggggacatagggtggcagctcctgctcgcctattgccagtgcctcgatggtttctggcggcactaccggctcttcaggtttgggctcgtagatcatcacgggctcgccgtcgaaatcagggtcagcaaacaaacgcgtggcgcccttgaaatccatgatggtgaagtagagcttctggtagtcctcgcgcaggcgggtgccgcgaccgatgatctgcttgaactcggtcatcgagttgatgttctggtccagcacgatgagcttgcaggttttggcatccactccggtggtgagcagcttggaggtggtggcgatgaccgggtaaagctcgtcgttgtcgatgaagtaggaaagctgagccttgccttcgttgtcgtcaccagtgatgcgcatcacgtaacgacggttgctagcagcagcgggtatgagcttgaccagctcttgccgcatccgctcggcgtgatcctgatcgtcgcaaaacacgatggttttagccattgggtcagtagctttgaggtattcccacactttgctggccacgagcctagtgcgcttttctag

SEQ ID NO: 15196 - DNA, 801 bp, Pseudomonas aeruginosa
caccagattgcggtcgaaatccttggtgttgtattggcgctgttccaccgtttggccgagcttgtcgaccttgcccttctcgggggtgtagcccacggcgtcggcatcggtagcaatgcggatgaccttataaggcgcgaggaaaccatcctcgatgccctgcttgagcgaatacgtataaacagggtcaccaaagtaggtgatgttgctgacttccttcgtttccttgggtgtggcggtcagacccaggtgggtagcactgctgaagtagtcgagcacgtcccgccaggcagagtcatcagcagcacttccgcgatggcattcatcgatgaccaccagatcgaagaaatcggccgggaactgacgatagatctgtttccactcctcacgcccagttacagcctgatagagcgccagatagatttcgtagttcttcttgacctcgcgattagtgaccttgtgcatcacctcaccaaaaggggcgaaatcctgctgcatagtctggtcgacaaggatgttgcggtcggccaaaaacagaatgcgcttcttggccttagccttccacagccgccaaatgatctggaatgccgtgtaggttttgccggtgccggtggccatgaccaacaacacccgctgctggcctttggcgatggcctcgatggaacggttgatggcgacgcgctggtaatagcgcggctccttgccgcttccgtcggagtaaaaaggctgctcgacgagtttgaccacagtgtctgtgacgagccccttccattgctggtaaagcggccacagatcgtctag

SEQ ID NO: 15197 - DNA, 498 bp, Pseudomonas aeruginosa
agtagcgcttgccgggaatcggtggcagctcgtcgttatgacttggttccagcatatgcctcaaccctggccttcagtttctgccctggacgaaaggtgacaacgcggcgggccgtgatcgggatttcttcgccggtcttcgggttgcgtccggggcgctggcgcttgtcgcgcaggtcgaagttgccgaaaccggacagcttgacctgctcgttgtgctccagcgcctggcggatctcttcgaagaacagctccaccaactccttggcttcccgtttgttcaggcccagctcttcgtacagacgttccgcaatttcagctttcgtcagagcccccatacgctatttccttaacgtggcattgaacctttcttccaacgacgtgacgatgttctgcgtcgtgctattgacttcatcgtcattaagagtgcgcgatggatgctgccaggtcaagccgacggcaaggctttttctatgcggatcaatgcctttaccgtga

SEQ ID NO: 15198 - DNA, 456 bp, Pseudomonas aeruginosa
gtgcggacgtcctggccgaccggcgcgtcggccggcagctcgagcagaccggcgttctcttcgctgatctgcaattccttggccgagcagagcatgccgaaggactcgacgccacgcagcttggctttcttgatcttgaagtcgcccggcagttcggcgccgatcatggcgaagggaatcttcaggcccgcgcgcacgttgggcgcgccgcagacgacctggaaggtctcgctgccgttgctgacctggcagacgcgcagcttgtcggcgtccggatgctgttcggtcgagagcacctcgccgaccaccacgccgctgaaggcgccggcgaccggcaggtcggcgtcgacctcgaggccgaccatggacaggcgagcgaccagctcgtcatgggaaacctgcggatttgcccagctccgcagccacttttcactgaatttcatcctgttctcctaa

SEQ ID NO: 15199 - DNA, 528 bp, Pseudomonas aeruginosa
ggaatccggttgcgttctggcctagcggaattgtccgaggaagcgcagatcgttatcgaagaacagacgcaggtcgttcaccccgtagcgcagcatggccaggcgctcggcgcccatgccgaaggcgaagccctggaatttctcgggatcgatgttggacatgcgcagcacgttcgggtgcaccatgccgcaacccatgacttccagccagccggtctgcttgcacacgcggcagccgttgccgctgcagatcacgcactggatgtccacttcggccgagggctcggtgaaggggaagaaggacggacggaagcgcacttcgagctgcttctcgaagaaggcgcggaggaattcctcgatggtgcccttgaggtcggcgaagctgacgccctcgtccaccagcagaccttccacctggtggaacatcggcgagtgggtcaggtcggagtcgcagcggtagacgcgccccgggcagacaatgcggatcggcggctgctgggactccatggtccgcacctgcaccggtga

SEQ ID NO: 15200 - DNA, 534 bp, Pseudomonas aeruginosa
ggtgtgggtacgcagcagcatgttcgcattgaaatagaaagtgtcgtgcatggcacgcgccgggtggtggcccggaatgttgagcgcttcgaagttgtggtagtcgtcttcgacttccgggccttcggcgacttcatagccgatgcggctgaagcactgctcgatgcgctccagcgtgcgggtgaccggatgcaggccgccgctcagctggccacgaccgggcagggtgacatcgatgcgctccgcggccagccgggcggccagcgcggccccttccagctcggtcttacgcgcgttcagcgcatcctggaccttttccttggccacgttgatcagcgcgccaaccttcggccgctcttcggccggcaggtcgcccagggtcttcatcacctgggtcagttcgcctttcttgccgaggtagtgaacccggatctgctccagggcattgacgtcttcggtgtgtcgcacagcctccaatgcttgagagaccagcgcatccaggttttccatgtatggactccagatacaaaatag

SEQ ID NO: 15201 - DNA, 2145 bp, Pseudomonas aeruginosa
ttactccgagtcttggcgaccacgccgggaaaccgcctgtgccaacagctcagcgaactgggtgacgggcatggagcccaggtcttccccttcgcgcgtacgcaccgcgacggccttcgattcaacttcccgatctccaataaccaagagatagggaaccttgagcaaagtatgctcgcggattttaaagccgatcttctcgtttctcaagtcggacttggcacggaatccgctttccccgaggatccgcaccacctcggcggcgaaatcggcctgcttgtcggtgatattcatcaccactgcctgggtcggcgccagccaggccgggaaggctccggcgtagtgctcgatgagcatgccgatgaagcgctcgaaggacccgaggatcgcacggtgcagcatcaccgggcgcttgcggttgttgtcctcggcgatgtagctggcgtccaggcgctccggcaggttcgggtcgtactgcagggtgccgcactgccagttacgaccgaggcagtccttcagggtgaactcgatcttcggcccgtagaacgcgccctcgcccggctggtattcccaggccaggccggattcgttcagcgcatcggccagcgcgccttcggcgcgatcccacagctcgtcggaaccgacgcgcttggccggacgggtcgacagcttcatggcgatgtcggtgaaaccgaagtcgcggtagacctgcaaggtcagcttgatgaaatcggccgcttccttcttcacctgctcttcggtgcagaagatatgcgcgtcgtcctgggtaaagccgcgtacgcgcatgatcccgtgcagcgcgccggaaggctcgttgcggtggcaggcgccgaactcggcgaggcgcagcggcaggtcgcggtaggacttcaggccctggttgaagatctgcacgtggcacgggcagttcatcggcttgaccgcgtagtcgcggctttccgaggaggtggtgaacatgttctcggcgtagttcgaccagtggcccgaacgctcccagaggatgcggtcgaccacctgcggggtacgcacttcgacatagccatggtcgcgctggaccttgcgcatgtactgctcgagcacctggtagacgctccagccattcgggtgccagaacaccatgcccggcgcttcttcctgcaggtggaacaggtcgagctgcttgccgatgcggcgatggtcgcgcttctcggcctcttcgatgcgctggatgtaggccgccagttgcttcttgtcggcccaggcggtgccgtagatgcgttgcaactgctcgttcttcgagtcgccgcgccagtaggcgccggaaatcttggtcagttggaacgccttgaggaagcgggtgttcggcacgtgcgggccgcggcacatgtccacgtactcctcatggaagtacaggcccatggccttctcgtccggcatgtcgtcgatcaggcgcagcttgtagtcttcgccacgggacttgaacagctcgatgacctcggcgcgcggggtcatcttcttgatcacgtcgtagtccttgtcgatcagctcgcgcatgcgctgctggatcgccgccatgtcctcgggggtgaaggggcgctcgaagaagatgtcgtagtagaagccttcctcgatcaccgggccgatgaccatcttcgcggtcggatagagctgctggaccgcatggccgaccaggtgggcgcaggagtggcggatgatctccagtccttcctcgtccttgggcgtgatgatctgcagggtcgcgtcgcgatcgatggtgtcgcaggcgtcgaccaggcggccgtcgaccttgccggcgagggtcgccttggccaggcccgcgccgatggattgggccacctcggccacggagaccgggtgatcgaaggaacgttgactgccgtcgggaagagtaatgatgggcatggcgcctcctctcctagtggtgacccctaccaaaggccacgtgggttgggatgtgccagtaagcgtcgcccgccgggccggcctgcctcacagtggcaggcgccttgcggcacccctgcgccgaagcgcgcggacggagatcactgggaatggatactgacgaaaaacgccggagctgatccggcgcgaagcgcccatggtaaagcatccgcggcgagctga

SEQ ID NO: 15202 - DNA, 357 bp, Pseudomonas aeruginosa
gctggaagttcccctgcggaggtgacgccgatgaatacgccgatcttctacgagctattccgcaaccacccgctgcatgccccgtccgcccggaccctggcgagcatgctggccctcggcctggcactggccggggtatgggccctgctgctgggctggggcatcggcctgggcatcgacaacttcgccatgtacttcggctggaccgccctgctcatgaccatcctcctggtcgcgctgttcctcggcgccacgctgttgcgcatggaggccatctggctggctttcctgctcgccctgcccctgctgaccagcctgaccggctgcctggccctggtcggtgccggccccgaatga

SEQ ID NO: 15203 - DNA, 675 bp, Pseudomonas aeruginosa
cttacgaaaatactcagcgaagcggtccgtgcaaactgcaagatcgtgcgaaatgcatcatgcgatttgccagcaggctcagtcggaaaacagcggccggccccgcgcatcgaagccgcgcacccggtacagcgccgcttccgccagcgacagcgcggccgccggactctcgcacggcggctggcccggcagcaccagccattcggtgcgtccgtcgtcgatgctggttatctcgatctcggccagatagccgctgtcctcgcgcaaccaggtggcgcgcagttcgaactcgccaaaacgcctgccggacacccgccagcctcccttcggaaaagtcgtcgcagtgtaaccaggccgggcgtcgatcagccagccaggtcggccagcgcctcgcgctcctcgtcgcgcagggtcaggacccggcaaccccgctcggtgaccagcacggtgtgctcgtactgggccgacaggcggcggtcgcgggtggtcacggtccagccgtccttgtgcagcttcaccgcgtggccgccctggttgatcatcggttcgatggtgaaggtcatcccggccttcagccgcgcacccgcgccagcgcgaccgaagtgcaggacctgcggcgcctcgtgcatcttgcggccgatgccatgcccgcagtattcgcggaccaccgaataa

SEQ ID NO: 15204 - DNA, 690 bp, Pseudomonas aeruginosa
ccgtctcaattcaacttgaggcggcactatcgtgcgtttgcggacgcacagaccacggattataatccgcattttcgcgttaactcttctggtgcctcaatgaaatcggcctcgtttatctgcgacaggcgtctgtatgagctgcttcaggagtcagggcgtacaacctttacaacccgtgaactgcgcgatgcctatgccgctcgcctgaaaggcacacattttcgtatcgccgatgtacgccgttatgtatacgagcagatccgtcgattagtgcgtgcgggctgggttgtgccggacgaagagcgtcgtgttcgaggacaggtctaccacctgcagccgattccggcgcatctgcaactggagctgatcgacaacggctttgaggacagcctgatggctgctggagtacccgaaccagagacggcagcacgcgatgtagaagctttgccgcttaagtcgtcagccaatacagatttgcagttggaggcactccacaaagaaatccgtttggactttctcacttcaatgggcgaggcggagcgattcaagctgctgctagacgagatgccgcatttgcgggacaaggttgaaggcgattacctggaggccagggatcgcagttctcgtcttttggggcatctgcgcgccatcgaaaaaaccctcaaaacgctcgccgcatcacgatga

SEQ ID NO: 15205 - DNA, 1254 bp, Pseudomonas aeruginosa
ccaaggcgtggcttccgatccagttttggaggtaacgccactggggctgatgcgaatttcgtcgccatcgatctcgatcatccccaagacgtaggtgtaaaccaggctactgaaaaatcctcctttgaattcgaaggcacactctacgacctcgtccccgtactccatccgcattttcggcttgagggaggcaaccgacactgctccgttgtcgacggcggaatagacgctgcagaccagcgcgactttaccgcccataagatgagagatggctgcattgatctcgacggtttcgatccctggggcagaggtgctcgcgcttaccacatcgccggtatggaatacgaaggggtcagcctcgaaggaaccgcgcttgtcaggcgcctgaatgatggacatccgaccgtctgggcgaaggataccgattcgcaggtcaaggtcgtcgttgtctcgaccgtctccgttgtccacccacctggcgctgaccttgatgaccttcggcgcggccgcgcctttctccagagagaccttgtgcgtgttcccgggtttgtccaaggtgatcaccgtcttggtgatgctgaccggtttcgcagggggcgcggctgggatcggggcagttgccggctcatcgtcgacctcgactccatacatgccacagagcccgaccaggcccgaggcgaaaccctgccagacagagcgcgccttcgcttgaccgtttcggacgtagagctcgagtacgatgatgcccgtctcccgctcaaatgccccaggcgcaagatccagcacctggtcgccggcaagaacacgtgcgctgaggtttggtactcctgcgaaacctcctccggtgccatcttgggtcaaggtgatggcgatcttcgagatagaggctggcaggcgactcagatcaaagctgatgctgtgactgatcgagccggcctggatgatgggaggcgagaatgcggccgcgccggacgcatgctccggcgcattgaagaagaccatcccactgtcatcgaccacttttccggagtcagtgatgaggaaggccgtcaggttcacgtcgaggtttgcgccggcagaatgcgttaccagcacctgacctttcgactggttgatggtggtgttctcgccgggcttgagggattgattcaattctggtcgcctattccttggtttatgtgcaggcaaagtaagcctggattgcatgaagcgaggtcacacactcgtccattcagggccgaatctccaaagtaa

SEQ ID NO: 15206 - DNA, 204 bp, Pseudomonas aeruginosa
cggcgaggacgaggttgcactcgaagctggcgcaaccttttgagggggttggtactgcgggatctgggctggtacctgctggtgctctccagcacgttgagtttcgagcgcttgggcggcctgaccacgctgctggagttcgatgattgccaactggcgctgattctcgatctgcgcctgtcgagctgcttcttcagtccctag

SEQ ID NO: 15207 - DNA, 306 bp, Pseudomonas aeruginosa
tgtcaaccgaactcactatccccgcaaccacctaagcagctgcacattggctacttccgagggagtgatactgcactgaccgcatacgtggttgctttgcacaacaccaccctcggccctcattacctcctggcggctggaggatatcctcaggaaccccctactctagcaaccttccacagttgcactaaatccgatgccctatgccggagaagagttgcggcgtcggagcacgctgattcgagcgtcatgggcccagaggtgatggagaaggctgcaacgattccaatgtcgcgcagcagctga

SEQ ID NO: 15208 - DNA, 216 bp, Pseudomonas aeruginosa
atgccactggctgccgccatttcaatcacagcggtgcgagactcgttaagccagccccaagccgcttggacttccgccccaagtggtccttggacggtactgacccgccgctctccaccggtggcagccagaacggcgtcgacggtgccctcaccgccgtctgccatgggcatgcacacgatttcagcgtctggagccgaatcccgcactccttga

SEQ ID NO: 15209 - DNA, 708 bp, Pseudomonas aeruginosa
aggaacgcaccaggcgtctgcggcctggtgccgaatccattcggccgccaggtcaaggtcttctggggttgccatctcgagaaggactgccgtgcggcgaaggtcaggtctcagccccaatcgttgggcctcaacgatggcccgttgagcagattggccagacaggaggatggctgtcagaacgtcttcgatccgcttctggagccaaatccggtgctgctgatcatttcgttgggcgaccagcatctcagcggtcattcgaaccatctcagcgaacgtgcgtacctcatcaggcgcaccagatacgccaataacgccgatcacctggccatccaggcaaagcgggaagttcaccccttcttgcacgcccctgagagcgccagcggctgcgttgtcgatctcaacagccctgctgttggtgaggaccagctgggccccttcgtggcgggtatagaggcgctcagcctcgcccgtcccaatgatcaagccctggctatccatcacgttcacgtttcgcggaaggatggccatcgctcggtcgacgatttcctgagcgagggagtggtcaagatcgaacatgtcggcggccttcattttgtttcaggccagtgtaccgaggtcggtgcttgccaccagcctttcgaacagctcatggaggaattcccgagctggatcaaggaagcttcggcgaaggggatcatcggctag

SEQ ID NO: 15210 - DNA, 471 bp, Pseudomonas aeruginosa
tgtgattccttgattcagtttattagatggagatcagttgacggtcagaccgtaaccgttggccagggccttcaggccaccagcgtagccttgaccaacagcgcggaacttccattcgctgttgtggcggtacaactcggcgaagatcatcgcggtttcagtcgaggcgtcttcggccagatcgtaacgaacaatctcggagccgttggtctcgttaacgatacggatgaaggagttgccgacctgaccgaagttctggcgacgattttcagcgtcatggatcgtcacggtgaaggcgatcttgtcgacgtcgaccggcacgcggctcagatcgaccttgatagcctcgtcgtcaccgtcgccggcgccatcacggttgtcgccggtatgctcaacggaaccgtccggactcttgagttggttgtagaagatgaagtctgcatcgccgcggactttaccggaggcgtttag

SEQ ID NO: 15211 - DNA, 969 bp, Pseudomonas aeruginosa
acttggcgacctcagtcgtcagagtctcgcgagctttcgtcgcgttggttttcagccattcgagcatgtgttcctctcagtgagcggggcccttcggccccgccggatcagtgtttacttggagcccgccgtccagcgcatcccccagccgtaggctttgtccatatcttggtgcccacggtggaagtcgactctgcgggagaccttaacggccccgtttacgttttcaagcaaggcgatggcgcacatcccatagcgtccaccttcttcgttcaggcgaacttcgatttctggctggcccgggatgaagatcgtcacgacgccgtcggtagctttccagttcggagcaccttcgtagatgaacgcgaagaccaggatgcgtttgatctcgctccactgccggccgttgatgtgcatccactcgccgccagcaacagaaccagttcggtcgtcgcccatcaactgaatgtagggctcatcgttcagatcaccgaaggcctcccccagggcctgaacaactcccttgtagccatcttgcagttcgaagagacacccaacgtcgaggtcgacggacttgctcttgccaaagatgccgccgagtacaccgccacttccaccttggttccagttcaagttcaccttgatctcaccaaaccctgcagcaggcttgtccaggctgatgctcgagcgagacttgtcgagcgttaccttgctgaggctgatggtcggcttcggcggggctggaggtacttgaggcggcgcagcgggagtcggtgccggcgcggaaggaggtgcagcgatttcgacgccgaagtgctttgccagcggtcccaagcctcccgcgaagccctgggcgacacaacgaaacttccacgctccctgccgaaggtagaactcaccgaggatgagggcggtttcattcatcccgtgtgttgggatctgagcttcgatccctccagtgagcgctag

SEQ ID NO: 15212 - DNA, 279 bp, Pseudomonas aeruginosa
tatatcgggagaagcgacatatcctccagttacatccacatgagccaaaaatacagaatggactgcgacccttactgtttcaacatcatatggaaccctctctatccaaccttggcgccttgcatagttatagaaagagcaaacaactcgcagtctaagatttatggtgttttcgctaagcccgcaactacgcatcgaccagtcacggtatgcagccagtgggctcgagcccagctcaaaaaaaccaacatctctccagtctcgattggcagcatttag

SEQ ID NO: 15213 - DNA, 546 bp, Pseudomonas aeruginosa
gtcacggtagacaccccagactcctacgacaaggaaatgtgtaactatttaacgggcacatttcacatcgtcccggcctgggtgatcggtcaccagcggcgctgctggcagaacggcgggcggagcaactgcgcgaggcacgacagcacctaccagcgcgccgaagccgacctgcacaacctggtgccgagcatcggcgaggtcaacggcgaccgcagcaacttcggcttcggctggctgccgcagaaaccccagcaatatggcgcctgcccgatggtggtggacttcaaggcgcgcaaggcgatgccacgcccgcagatccgcgggatgatcgcccgcacctacttctacatgagcgaccgctacggcctgcgcctgtcgaagcaggatcgccagctctacaacgcctggcacaagcagtacccgccacagacctgggagcgccagcgcaaccacatggtcggctgcgtgatgggctggggcaatccctatgtcggcccggtggacctggcgacctgcagcaacctatcctcgcgtcgacgctga

SEQ ID NO: 15214 - DNA, 522 bp, Pseudomonas aeruginosa
cccatgatcttccgcaccctcgccctgttgccgctctgcgccgccctggcgttcgccgccgacgccggggagcgccgcttcgactgcacggtggtggcgatacacgacgacgccagcctgggctgccgcctgcccggcgcgaacaaggcgctgcgcatccagctcaatgccgtcgagctaccggccgccgagccctggcgtcggcgcgcccgggaagccctggaagacatgctgctcggcaaatcggcgaccatccgcgagcaaggccgcgacgcgcgcttccgcatcctcggcgcggcctgggtcaccccggccgactgccccacctgcggacataccctggatgccgggctggccctgctgaccattggcctggccagctggcgcgacgcgccggacagcggccagacggccgaggcgcgcggccagtaccggttcgccgaggaagaagcgcgggcgcgcaaggctggccagtggcgaccgcgcgacgccgctcctagagatggatctccgcgaacttga

SEQ ID NO: 15215 - DNA, 1035 bp, Pseudomonas aeruginosa
cgccggcgacgaaccaattcgcccgccgtggcgtcccagaaaggacgcgacgaatttcacccaacggaaaatgcctggcggcaagcggccatcggtggtcgatcgtcatcggcacgcacacagcaaggagatggaatgttccgtacggcttatcgggaaataggcctgttcggcctggtcaagcgcacagtgaacgagttcctcgaggacgacatgccgacctacgcctcggccctcgcctatcagatgctgttctcgctatttccgttcctgctggtgctgatcaccctcgtaggctacctgcacctgccggagttcttcgcctggctgcgcgagcaggcggcgttgctgctgccgcccgaggcgatggatcaggtcaacccggtgatcgaccagttgcagcagcagaaaggcggcctgctgtcgatcggtatcgcggtggcgctgtggacctcctcggcgggcatccgctcgatgatgatcgcgctcaacgccgcctacgacgtgaaggagagccgcccggtatggaagcgcttctccctgtcgatcctctacaccctcggcatcgccctgttgttgctggtggcggccggcctgatggtcaccgggccgcaggtgatcgcctggatcgccggcctggtcggtctggaacagtacctggtgacgctctggacctggctgcgctggcctcttgcggtgttcctgctgatgctcgcggtggcgctgttctactatctggtgccggatgtcgagcagcgtttccgcttcatcactccaggctcggtgctctcggtgatcgcctggatcgccgcgtccctcgcctatggcttctacgtgaagaacttcgccaactacaacgccatgtacggcagcatcggggcgatcatcatcctcctgctgtacttctacctgtcggcggcagtggtgctgttcggcgccgagctgaacgcggtgatcgaacaccattcggaagacggcaaggaccctggcgagcgcgaacttccggacaacgacgaccccgaactcaaggcttga

SEQ ID NO: 15216 - DNA, 1155 bp, Pseudomonas aeruginosa
gtaagtactcgacgacagctaccgggcagccatggccacctacctgctcggcgaccagccgccgccggccaaggtggtccaggcgctgcccgaggcgcagctgaacgacagcggcaagcgcggtcgccagcagtacctcaacgtctgcgccggctgccacggcggcgaaggcgagggcaagccgcatatcgcggtggcgatgaacggcaactacgacagcatcggcccggccgcgccgctgctgctggtgctgacccgcctgctgcaaggcctggcctggggcggcgaggccgggccggcgaccacctacatcctcgaggcggcaccgccgcacaagcgcggcacctacgcctgctggcaggtcgtagcgcaaggcatcgcggcggtcgccgccgggctgatgggctacctgctcaccctctggctcgacgagcgccaactgcaggaatggggctggcggattcccttcgcggccggcctgctggtcctgccgatcggcctgtacatccgcctcaacctggccgagacctttgccggacgcggccgccaggccagcacccggaacctgctcggcgaattgttcggcaatcatccgccagccctgctgctcggtctgctgatcctctccggaagcaccatcacccactacttcctcaactacatgaccaccttcgcccttaccgagctacacctgccggcgggcatcgtgatgctctcgacgctggtcgccggcgccgcactggcgctctcggcgttgctcggcggcgtgctctgcgaccgctacgggcgccgcgccgtgctgatcctgccgcgcctggcgctgctcgcggtgctgttctcggcactgcatgcaatgacccgtcaccccgagccggcagtcttcctcgacgtcctcgccctgctctcggccctgcatggcatgagcggcgcggggctgatcgtgctgctggtacaaagcttcacccgggcgctgcgctccatcggtttttccctggtctatgcgaccggtgtcaccgcgtactgcggctccgcccacatcgtggtgacctggatgatccgtgtcaccggcattcccctgtccccgctgggctacctgctgctgggcaacctggttctgccttgagtggggccccgggttggccccccaataactag

SEQ ID NO: 15217 - DNA, 1119 bp, Pseudomonas aeruginosa
gtactcgacgacagctaccgggcagccatggccacctacctgctcggcgaccagccgccgccggccaaggtggtccaggcgctgcccgaggcgcagctgaacgacagcggcaagcgcggtcgccagcagtacctcaacgtctgcgccggctgccacggcggcgaaggcgagggcaagccgcatatcgcggtggcgatgaacggcaactacgacagcatcggcccggccgcgccgctgctgctggtgctgacccgcctgctgcaaggcctggcctggggcggcgaggccgggccggcgaccacctacatcctcgaggcggcaccgccgcacaagcgcggcacctacgcctgctggcaggtcgtagcgcaaggcatcgcggcggtcgccgccgggctgatgggctacctgctcaccctctggctcgacgagcgccaactgcaggaatggggctggcggattcccttcgcggccggcctgctggtcctgccgatcggcctgtacatccgcctcaacctggccgagacctttgccggacgcggccgccaggccagcacccggaacctgctcggcgaattgttcggcaatcatccgccagccctgctgctcggtctgctgatcctctccggaagcaccatcacccactacttcctcaactacatgaccaccttcgcccttaccgagctacacctgccggcgggcatcgtgatgctctcgacgctggtcgccggcgccgcactggcgctctcggcgttgctcggcggcgtgctctgcgaccgctacgggcgccgcgccgtgctgatcctgccgcgcctggcgctgctcgcggtgctgttctcggcactgcatgcaatgacccgtcaccccgagccggcagtcttcctcgacgtcctcgccctgctctcggccctgcatggcatgagcggcgcggggctgatcgtgctgctggtacaaagcttcacccgggcgctgcgctccatcggtttttccctggtctatgcgaccggtgtcaccgcgtactgcggctccgcccacatcgtggtgacctggatgatccgtgtcaccggcattcccctgtccccgctgggctacctgctgctgggcaacctggttctgccttga

SEQ ID NO: 15218 - DNA, 687 bp, Pseudomonas aeruginosa
ctcggtaagggcgaaggtggtcatgtagttgaggaagtagtgggtgatggtgcttccggagaggatcagcagaccgagcagcagggctggcggatgattgccgaacaattcgccgagcaggttccgggtgctggcctggcggccgcgtccggcaaaggtctcggccaggttgaggcggatgtacaggccgatcggcaggaccagcaggccggccgcgaagggaatccgccagccccattcctgcagttggcgctcgtcgagccagagggtgagcaggtagcccatcagcccggcggcgaccgccgcgatgccttgcgctacgacctgccagcaggcgtaggtgccgcgcttgtgcggcggtgccgcctcgaggatgtaggtggtcgccggcccggcctcgccgccccaggccaggccttgcagcaggcgggtcagcaccagcagcagcggcgcggccgggccgatgctgtcgtagttgccgttcatcgccaccgcgatatgcggcttgccctcgccttcgccgccgtggcagccggcgcagacgttgaggtactgctggcgaccgcgcttgccgctgtcgttcagctgcgcctcgggcagcgcctggaccaccttggccggcggcggctggtcgccgagcaggtaggtggccatggctgcccggtagctgtcgtcgagtacttactc

SEQ ID NO: 15219 - DNA, 2070 bp, Pseudomonas aeruginosa
cgccgcccacccgcgctaccgctatttcgccgagaccggcgaggagcgctacgcgtcgttcctcggcgcgccgatcatccaccatcggcgggtgatgggggtgctggtggtgcagcagaaggagcgccgccagttcgacgaaggcgaggaggccttcctcgtcaccatgagcgctcagctcgccggggtcatcgcgcatgccgaggcgaccggttcgatccgcggcctgggcaagctcggcaagggcatccaggaagccaagttcgtcggcgtgcccggcgcccccggggtcagggtgggcaaggcggtggtggtgttgccgccggccgacctggaagtggtgccggacaagcaggtcgacgacatcgacgccgagatcgccctgttcaagcaggccctggagggcgttcgcgccgacatgcgcgcgctgtcgagcaagctcgccagccagttgcgcaaggaagaacgcgcgctgttcgacgtctacctgatgatgctcgacgatgcctccatcggcaacgaggtcaagcgcatcatccgtaccggccagtgggcccagggcgccctgcgccaggtggtgatggagcacgtgcagcgcttcgagctgatggacgacgcctatctccgcgagcgcgcctccgacgtcaaggacatcggtcgccgcctgctcgcctacctgcaggaagaacgcaagcagaacctgacctacccggagcagaccatcatcgtcagcgaggagctgtcgccggcgatgctcggcgaggtgccggaagggcgcctggtcggcctggtctcggtgctcggctcgggcaactcgcacgtggcgatcctcgcccgtgccatgggcatccccacggtgatgggggcggtcgacctgccgtactccaaggtcgacggcatcgacctgatcgtcgatggctaccacggcgaggtctacaccaacccctccgccgagctggtgcgccagtacagcgacgtggtcgccgaggagcgcgagctgagcaagggcctggcggccctgcgcgagctgccctgcgagaccctcgacggccaccgcatgccgctttgggtcaacaccggcctgctcgccgatgtcgcccgcgcccaggagcgtggcgccgagggcgtgggcctgtaccgcaccgaagtgccgttcatgatcaacgaccgcttccccagcgagaaggaacagctggcgatctaccgcgagcagctcagtgccttccacccgctgccggtgaccatgcgcaccctggatatcggcggcgacaaggcgctgtcctacttcccgatcaaggaagacaacccgttcctcggctggcgcggcatccgcgtcaccctcgaccacccggagatcttcctggtccagacccgcgccatgctcaaggccagcgaaggactggacaacctgcgtatcctgctgccgatgatctccggcacccacgagctggaagaggccctgcacctgatccaccgcgcctggggcgaggtgcgcgacgagggcgtggacatcgccatgccgcccatcggcatgatggtcgagattcccgccgccgtgtaccagacccgcgagctggcccgccaggtcgacttcctttcggtcggttcgaacgacctgacccagtacctgctggcggtcgaccgcaacaatccgcgggtcgccgacctctacgactacctgcatccggccgtgctgcatgcgttgaagaaggtggtcgacgatgcccacctggaaggcaagccggtgagcatctgcggcgagatggccggcgatcccgcggctgccgtgctgctgatggcgatgggcttcgacagcctgtcgatgaacgccaccaacctgcccaaggtgaagtggctgctgcgccagatcaccctggacaaggcccgggacctgctcggccagttgctcaccttcgacaacccgcaggtcatccacagctcgctgcacctggcgttgcgcaacctcggcctgggtcgcgtgatcaacccggcggctaccgtccagccctgatttcccgcgcgccggacgcttcgtcgtgcggcgcttacgctttccccgcaagcgtatag

SEQ ID NO: 15220 - DNA, 999 bp, Pseudomonas aeruginosa
aattcgtcacggttggcggcgaccagcagcggcagggcgtgccccggttgccaggcgaagacgatcaggcacatgcgcgatccttgggatgggctggccgtcaggctaaaggcatccgccatcgccgttcaagcacgacgcctgccgcacggcgcgcaattccgttaccatgccggctttccaacgggggcgtgcatggagtttctcctctatatcgtgctgggcgcctgtgccggcgtgctggccggactgttcggcgtcggcggcggcctgatcatcgtcccggcgctggtcttcagcttcaccgcgcacggtttcggcggcgacgtcctgacccagatggcggtcggcacctccctggcgaccatcgtcttcacttcgatcaattccattctcgaacaccatcggcgcggcgcggtgcgctggccggtgttcgcctggatgaccctcggcatcctcatcggcagtgccctcggcgcgctgaccgcggcgcagatcaaggggccgctgttgcagaagataatcggggtgttcgccatcctggtcgctttgcagatggttctcgacctcaagcccaagggtagccgcgaggtgcccggcaagggcggcctgaccctggccggcgcggtgatcggctgggcctcggcgatcttcggcatcggcggcggttcgctgaccgtgcctttcctcagttggcgcagcgtgccgatgcagcaggcggtggcgacttcctcggcctgcggccttcctatcgccatttccggcgctctgtcgttcatcgcggtcggctggcacaacccgcagttgccggagtggagcctgggctacgtctatctgccggcgttggtcggcatcgccgccaccagtatgctgttcgcccgcttcggcgcgcgcctggcgcatcgtttgtcgccgcgcgtactcaagcgactgttcgccctgctgctgttcagcgtgggcataagtttcctgacccccgatctcgcttttctgtcgtag

SEQ ID NO: 15221 - DNA, 810 bp, Pseudomonas aeruginosa
gagttatcgatgctgacgtatccccagatcgatccggttgcgctggccatcggcccgctgaagatccactggtacgggctgatgtacctgatcgggatcggcggcgcctggctgctggcgtcgcgccggatgaagcgcttcgacccgacctggaccaaggagcgcctttccgacctggtcttctgggtcgcctgcggcgtgatcctcggtggccgcctgggctacgtgctgttctacaacctggacgagtacatcgccaacccgacgctgatcttcgaggtctggaaaggcggcatgtccttccatggcggcctgctcggcgtgatgctggcggtctggtggttcggcaagcgccatggcaagagcttcttccagctgatggacttcatcgccccgctggtgcccatcggcctgggcgccgggcgcatcggcaacttcatcaactcggaactgtggggcaaggtcagcgatgtgccctgggccatggtcttccccaacggcggcccgctgccgcggcatccctcgcagctgtaccagttcgccctggaaggcgtggcgctgttcgtcatcctctggctgttcacccgcaagccacggccgaccgcctcggtctccggcctgttcgtgctgtgctacgggatcttccgcttcgttgtcgaattcgtccgcgtgccggatgcccagctcggctacctcgcctggggttggctgaccatgggccaggtgctctgcgtaccgatggtgctggccggcattgccctgatggtctgggcctaccgccgcgacgcggcgcagccgaaggcggcctga

SEQ ID NO: 15222 - DNA, 1134 bp, Pseudomonas aeruginosa
  unsure (175): Identity of nucleotide at the above locations are unknown.
acagatcgtcgccccagcggccgtcgagcagcggcaggtcggcggcgcgggcgtcgtccctggcgaaggcgtagagccgcagcaacgcttccacgcaggcctgctcgcgcttgcgcacctgctggtgcaggtcgcgggtggcttcctgcacggcgctttcgccgccgggcaccangcgccggcaggcggcgaggtcgaccagcaattcggcgatcagccgttgcccggcgcgcaggcgcgcggcggcctgggtctcatggtcggcgatcagccggtcgagttgcggccgggcgcgctccatcagcagcgccaggctctcgtataggcgccgttcgccgtccagcggcggcgccacgctgtcgaaacgcaccaaggcgtgcaggcccatgcgagcgagggcggcgcgccactcctcctcgcgatgctgcgggctggcgacgaagttcagcaccggcagcagcggccggccgcagccggcgagcaccgccagttcgtcgcgatacttggccagcaccggttcgcgggcgtcgatcacgtagagcccggcgtcggaggcgagcaactggccgaccacattggcttcctgttcgaaacgcccgcgcgattcgttgctgtccagcaaccgcgccatgcgttccgggccatcgagacgctcgccggggcgctccagggcgtccaggtagtcgagcagggcgatggcgtcttccaggccgggcgtgtcgtagagttccagcagcgcttcgccgtccaccgacagcctggcgccctcgacgtggcgggtggtgctggggcgatgggagacttcgccgaatccgaggtcgcgggtcagggtgcgcagcagcgaggtcttgccggtattggtgtggccgaccacggccaggatcagcggctcagtcatggccggtctccagccaggccagcggcgaggtctcgccgtgcggcagttgcaggcgttccagggcggcgtgccagtcacccaagcggtcgctgtcgagcgcttcgccgggcggagcctggagcagccagatgcgggtgctggcggcgcagcgggcgagttcgccgagcagtgccagggtgccgcggtccggcgagcgacgcgggtcgcaggcgatggccaggcgcgccggcgggtag

SEQ ID NO: 15223 - DNA, 2010 bp, Pseudomonas aeruginosa
gccgcccacccgcgctaccgctatttcgccgagaccggcgaggagcgctacgcgtcgttcctcggcgcgccgatcatccaccatcggcgggtgatgggggtgctggtggtgcagcagaaggagcgccgccagttcgacgaaggcgaggaggccttcctcgtcaccatgagcgctcagctcgccggggtcatcgcgcatgccgaggcgaccggttcgatccgcggcctgggcaagctcggcaagggcatccaggaagccaagttcgtcggcgtgcccggcgcccccggggtcagggtgggcaaggcggtggtggtgttgccgccggccgacctggaagtggtgccggacaagcaggtcgacgacatcgacgccgagatcgccctgttcaagcaggccctggagggcgttcgcgccgacatgcgcgcgctgtcgagcaagctcgccagccagttgcgcaaggaagaacgcgcgctgttcgacgtctacctgatgatgctcgacgatgcctccatcggcaacgaggtcaagcgcatcatccgtaccggccagtgggcccagggcgccctgcgccaggtggtgatggagcacgtgcagcgcttcgagctgatggacgacgcctatctccgcgagcgcgcctccgacgtcaaggacatcggtcgccgcctgctcgcctacctgcaggaagaacgcaagcagaacctgacctacccggagcagaccatcatcgtcagcgaggagctgtcgccggcgatgctcggcgaggtgccggaagggcgcctggtcggcctggtctcggtgctcggctcgggcaactcgcacgtggcgatcctcgcccgtgccatgggcatccccacggtgatgggggcggtcgacctgccgtactccaaggtcgacggcatcgacctgatcgtcgatggctaccacggcgaggtctacaccaacccctccgccgagctggtgcgccagtacagcgacgtggtcgccgaggagcgcgagctgagcaagggcctggcggccctgcgcgagctgccctgcgagaccctcgacggccaccgcatgccgctttgggtcaacaccggcctgctcgccgatgtcgcccgcgcccaggagcgtggcgccgagggcgtgggcctgtaccgcaccgaagtgccgttcatgatcaacgaccgcttccccagcgagaaggaacagctggcgatctaccgcgagcagctcagtgccttccacccgctgccggtgaccatgcgcaccctggatatcggcggcgacaaggcgctgtcctacttcccgatcaaggaagacaacccgttcctcggctggcgcggcatccgcgtcaccctcgaccacccggagatcttcctggtccagacccgcgccatgctcaaggccagcgaaggactggacaacctgcgtatcctgctgccgatgatctccggcacccacgagctggaagaggccctgcacctgatccaccgcgcctggggcgaggtgcgcgacgagggcgtggacatcgccatgccgcccatcggcatgatggtcgagattcccgccgccgtgtaccagacccgcgagctggcccgccaggtcgacttcctttcggtcggttcgaacgacctgacccagtacctgctggcggtcgaccgcaacaatccgcgggtcgccgacctctacgactacctgcatccggccgtgctgcatgcgttgaagaaggtggtcgacgatgcccacctggaaggcaagccggtgagcatctgcggcgagatggccggcgatcccgcggctgccgtgctgctgatggcgatgggcttcgacagcctgtcgatgaacgccaccaacctgcccaaggtgaagtggctgctgcgccagatcaccctggacaaggcccgggacctgctcggccagttgctcaccttcgacaacccgcaggtcatccacagctcgctgcacctggcgttgcgcaacctcggcctgggtcgcgtgatcaacccggcggctaccgtccagccctga

SEQ ID NO: 15224 - DNA, 870 bp, Pseudomonas aeruginosa
acttggccatccttctgtcatccctcggtgggagccgccacgtcggcgccgcaccgatatcgatccgagcctccgatgaaacagtacctcgacctgatgcgccacgtgcgcgagcacggcaccttcaagagcgaccgcaccggcaccggcacctatagcgtgttcggccaccagatgcgcttcgacctggccgcgggcttccccctggtgaccaccaagaagtgccacctcaagtcgatcgtccacgagctgctgtggttcctcaagggctccaccaatatcgcctacctcaaggagcacggcgtctcgatctgggacgaatgggccgacgagaacggcgacctcggcccggtgtatggctaccagtggcgctcctggccggcgccggacggccgccacatcgaccagatcgccaacctgatggcgatgctgaagaagaatccggactcgcgccggctgatcgtctccgcctggaacccggcgctgatcgacgagatggccctgccgccctgccacgcgctgttccagttctacgtcgccgacggcaagctcagctgccagctctaccaacgttcggcggacatcttcctcggcgtacccttcaatatcgccagctatgccctgctgaccctgatggtggcgcaggtcgccggcctgcagccgggcgagttcatctggaccggcggcgattgccacctgtacgccaaccacctggagcaggccgacctgcagctgacccgcgagccgctgccgttgccgagcatgaagctgaatcccgaggtgaaggatctgttcgactttcgcttcgaggacttcgagctggtcggctacgaggcccatccgcacatcaaggcaccggtcgcggtctga

SEQ ID NO: 15225 - DNA, 1185 bp, Pseudomonas aeruginosa
tcaacccggcggctaccgtccagccctgatttcccgcgcgccggacgcttcgtcgtgcggcgcttacgctttccccgcaagcgtatagactgcctgccattcggtagaggccactggccagtcgaacgtgcgagggattgccgcaaaatggacgaacgggcgtcgaagccgccaggtcttcttccgctgtcacgcgaagaccttgagaaaaccctgcgatatgccctggagatcgtcagcgacgggatctgggactggaacatcgcgaccaaccaggtcagccgcagcgccggctggtacctgatgctcggctatccgccgcatagcctgccggagagcgtggagacctggaagaacatcatccatcccgaggactatccgcgggtgatggccagcttccaggcctacctcgacggcgaaagcccggaatactgcgaggaataccgctgccgcacctacagcggggattacctgtggatcagcgatcgcgggcgtttcgtcgagttcgacgagcgcggcgagccgcggcggatgatcggtgcgcaccacgagatccatcagcgcaagctggtcgagctggagttgcagcagcgcaacgaggaactgttcgactggaacctgcgtctcgaggacctggtggccgagcgcaccgaggcgctgcaccgggtcaaccaggcgctggcctcgaagatggccgaggcccagcgcctgagcgaaatcgatccgctcaccgagctgtacaaccgacgcaagttcgagcagtgcctgcaccatgaatggatgcgccggcagcgccatggacgcgccacggcactggtgatgatcgatgtcgatcacttcaagcggatcaacgacctgttcggccactccaccggtgatcgcgtgctggtcgccttcggccgcctggttgccagcgagctgcgcgaggtcgacgtgctggcgcgctggggtggcgaggagttcatcctgctgctcccggaaaccggcctggaggccgcggcggccttggccgaacgcctgcgccagcgggttcgctcgcagtccttcgagatgggcgagcggttgaccgccagctttggcgtcggcgtgctgaatgatggcgagaccctcgacctgctgctgtgccgcgtggacgacgccctctatcgggccaagcagcgtcgcgattgcgtggcctgttgctga

SEQ ID NO: 15226 - DNA, 1269 bp, Pseudomonas aeruginosa
aggtcagcctggcggcagcaccaggctgacctcgccgagccgggcgccggacggcccgaagctgcgctcgatcatctcccgcgtgccgtcggcgtgtacccgtacgacgctgctggcgcgagtgccgtagctcgggctggcgatgaacacgctggagagcaggcgttccgtggccagacccacgccggtatccggcaactggccgtcggcggccggcgctgcgtcggccagcagctccagcagggcctgcggatgcggctcggcaagccgctcggcgagggcggcgcgagccttgagcagcttcggccagggcgtatcgagggccgcgttggacagcccgtagatccccgccggcagcaggcgcggtggccctacgcgggggttgtagtgccagagctgatggcgatcgccaatgagcaggttgaagccggaatagtccgcggcgcgcccggcgacctgcgccaggtagtcggccgggttgccgccgccgcgcaggaagtccgccaccagttcgccacgggagcgcttgccgagagcctgcgacggatcgcggacgttggtcagggcggcgaaacggccggccgggccgagccccagccaggtgccgccggcctccaggtcgcgtccggcgaataccccctcggcgtcctcccaggccgccagcggcaggctcgggcgggcatagaattcgtcacggttggcggcgaccagcagcggcagggcgtgccccggttgccaggcgaagacgatcaggcacatgcgcgatccttgggatgggctggccgtcaggctaaaggcatccgccatcgccgttcaagcacgacgcctgccgcacggcgcgcaattccgttaccatgccggctttccaacgggggcgtgcatggagtttctcctctatatcgtgctgggcgcctgtgccggcgtgctggccggactgttcggcgtcggcggcggcctgatcatcgtcccggcgctggtcttcagcttcaccgcgcacggtttcggcggcgacgtcctgacccagatggcggtcggcacctccctggcgaccatcgtcttcacttcgatcaattccattctcgaacaccatcggcgcggcgcggtgcgctggccggtgttcgcctggatgaccctcggcatcctcatcggcagtgccctcggcgcgctgaccgcggcgcagatcaaggggccgctgttgcagaagataatcggggtgttcgccatcctggtcgctttgcagatggttctcgacctcaagcccaagggtag

SEQ ID NO: 15227 - DNA, 1434 bp, Pseudomonas aeruginosa
ccgcgaggtgcccggcaagggcggcctgaccctggccggcgcggtgatcggctgggcctcggcgatcttcggcatcggcggcggttcgctgaccgtgcctttcctcagttggcgcagcgtgccgatgcagcaggcggtggcgacttcctcggcctgcggccttcctatcgccatttccggcgctctgtcgttcatcgcggtcggctggcacaacccgcagttgccggagtggagcctgggctacgtctatctgccggcgttggtcggcatcgccgccaccagtatgctgttcgcccgcttcggcgcgcgcctggcgcatcgtttgtcgccgcgcgtactcaagcgactgttcgccctgctgctgttcagcgtgggcataagtttcctgacccccgatctcgcttttctgtcgtaggagttatcgatgctgacgtatccccagatcgatccggttgcgctggccatcggcccgctgaagatccactggtacgggctgatgtacctgatcgggatcggcggcgcctggctgctggcgtcgcgccggatgaagcgcttcgacccgacctggaccaaggagcgcctttccgacctggtcttctgggtcgcctgcggcgtgatcctcggtggccgcctgggctacgtgctgttctacaacctggacgagtacatcgccaacccgacgctgatcttcgaggtctggaaaggcggcatgtccttccatggcggcctgctcggcgtgatgctggcggtctggtggttcggcaagcgccatggcaagagcttcttccagctgatggacttcatcgccccgctggtgcccatcggcctgggcgccgggcgcatcggcaacttcatcaactcggaactgtggggcaaggtcagcgatgtgccctgggccatggtcttccccaacggcggcccgctgccgcggcatccctcgcagctgtaccagttcgccctggaaggcgtggcgctgttcgtcatcctctggctgttcacccgcaagccacggccgaccgcctcggtctccggcctgttcgtgctgtgctacgggatcttccgcttcgttgtcgaattcgtccgcgtgccggatgcccagctcggctacctcgcctggggttggctgaccatgggccaggtgctctgcgtaccgatggtgctggccggcattgccctgatggtctgggcctaccgccgcgacgcggcgcagccgaaggcggcctgagccgcttttcgtgcccggggcggataacgtcgcaggcgtcatccgctccgggcagccggctttccgctccagggcgtgcatggcttgcgccggtcgcgccgaactggcgatgcaggctccgtcgccgtagacttggccatccttctgtcatccctcggtgggagccgccacgtcggcgccgcaccgatatcgatccgagcctccgatga

SEQ ID NO: 15228 - DNA, 465 bp, Pseudomonas aeruginosa
  unsure (101): Identity of nucleotide at the above locations are unknown.
agccgcagcaacgcttccacgcaggcctgctcgcgcttgcgcacctgctggtgcaggtcgcgggtggcttcctgcacggcgctttcgccgccgggcaccangcgccggcaggcggcgaggtcgaccagcaattcggcgatcagccgttgcccggcgcgcaggcgcgcggcggcctgggtctcatggtcggcgatcagccggtcgagttgcggccgggcgcgctccatcagcagcgccaggctctcgtataggcgccgttcgccgtccagcggcggcgccacgctgtcgaaacgcaccaaggcgtgcaggcccatgcgagcgagggcggcgcgccactcctcctcgcgatgctgcgggctggcgacgaagttcagcaccggcagcagcggccggccgcagccggcgagcaccgccagttcgtcgcgatacttggccagcaccggttcgcgggcgtcgatcacgtag

SEQ ID NO: 15229 - DNA, 756 bp, Pseudomonas aeruginosa
  unsure (18),(34),(36),(487): Identity of nucleotide at the above locations are unknown.
ctttttctctttactttngggcgcgactatcccnangcctgcgggccagccccgctacggtttcgtctgggaaaccaccattctcggcagcgataccttcatcgcccttacccaggcgctcggcgccctgccggcgttgcttggcttcccgttgccggacgccgagctgatccgcgccagcggcgacgccgccctggccagcgaagccgcacggcacgcctgggccggctggctggtaggcgtactgctggtctatggggtcctgccgcgcgcgctgctcggtctgctctgcctgtggcgctggaaacgcggcctggcccacctcgacctggacctcgacgacccaggctacagcctgctgcgcgaacgcttgatgccggccagcgaacgcctcggcgtcagcgacgcggcaccggactggctgccggagccgcagggcggccagtccggccaggaagccgccggagcggtgctggtggcggtgganctggacgatcgccggccctggccgccgaagctcgccgaaagcgtcgccgacgccgggatcctcgacaacggccagcagcgccgtcgcctgctcgaacaactgacccgctacccgccggcgcgcctggccatcgcctgcgacccgcgtcgctcgccggaccgcggcaccctggcactgctcggcgaactcgcccgctgcgccgccagcacccgcatctggctgctccaggctccgcccggcgaagcgctcgacagcgaccgcttgggtga

SEQ ID NO: 15230 - DNA, 423 bp, Pseudomonas aeruginosa
  unsure (39): Identity of nucleotide at the above locations are unknown.
tcgccgaattgctggtcgacctcgccgcctgccggcgcntggtgcccggcggcgaaagcgccgtgcaggaagccacccgcgacctgcaccagcaggtgcgcaagcgcgagcaggcctgcgtggaagcgttgctgcggctctacgccttcgccagggacgacgcccgcgccgccgacctgccgctgctcgacggccgctggggcgacgatctgttcaatccggagaccctgcgccaactcggtatccgcctcggcggcggggttgcggccggtgccgcggccggcgccggcatcgacctgctggtgggcggcgtcacccttggcgccgccgccgccctcggtgccctcgccggcggcgcctggcagaccgtcggccactacggctcgcgcctgctcggcaagctcaagggcgcccgcgagctga

SEQ ID NO: 15231 - DNA, 915 bp, Pseudomonas aeruginosa
acggcaggcgggtgggcggcagcgaccgccaggaacagatcgacgcgctggccgaattgctggagagcgggcgcggggaatgacagactgggcgacgatcgcccaagaggtaggcccatgcccttcgtttcctacgcgcagaacctggaagacgtccgactctggcgggccctgaaactcttccccagggggttctacatcgacgtcggcgccaaccacccgcggatcgactcggtcaccctggcgttctacgagcgcggctggcgcggcatcaacatcgaaccgctgccccacctgcaccgcgagctggagcgggaacggccggaagacctcaacctgaacctcgccattggcgagcgcgaaggccgcgccacgctctacgagatggccgcctcgggtctctccaccctggaccccgagctagcccgccagcgccaggccgagggatgcacgaccaccccgcgcgaagtgaaggtcagcaccctggacgcgatctgcgcggcccatgtcgaagggccgatccacttcctcaagatcgacgtcgaagggctggaaggcgcggtgctccgcggcctcgacctgaaccgctggcgcccgtggctgatcctcgcggaaactccattcgaccacgaccccgagtggaaagcgccgctgctcgccgcgggctaccgtttcgtccacttcgacggcctcaacggctattacctggcggaggaacaggcacgcctggaaggcgccttcgcgctaccgccgaacctgctggacgacttccagctctgccatggccatgccatgagccatccggtcgctccgctggagcaggccctggaacaggcgctgcaacgcgcagaagatgcggagcgggctttgcgggactggcgcgcgcttccctggtaccgtcgcctgttcggttga

SEQ ID NO: 15232 - DNA, 954 bp, Pseudomonas aeruginosa
cagaaggatggccaagtctacggcgacggagcctgcatcgccagttcggcgcgaccggcgcaagccatgcacgccctggagcggaaagccggctgcccggagcggatgacgcctgcgacgttatccgccccgggcacgaaaagcggctcaggccgccttcggctgcgccgcgtcgcggcggtaggcccagaccatcagggcaatgccggccagcaccatcggtacgcagagcacctggcccatggtcagccaaccccaggcgaggtagccgagctgggcatccggcacgcggacgaattcgacaacgaagcggaagatcccgtagcacagcacgaacaggccggagaccgaggcggtcggccgtggcttgcgggtgaacagccagaggatgacgaacagcgccacgccttccagggcgaactggtacagctgcgagggatgccgcggcagcgggccgccgttggggaagaccatggcccagggcacatcgctgaccttgccccacagttccgagttgatgaagttgccgatgcgcccggcgcccaggccgatgggcaccagcggggcgatgaagtccatcagctggaagaagctcttgccatggcgcttgccgaaccaccagaccgccagcatcacgccgagcaggccgccatggaaggacatgccgcctttccagacctcgaagatcagcgtcgggttggcgatgtactcgtccaggttgtagaacagcacgtagcccaggcggccaccgaggatcacgccgcaggcgacccagaagaccaggtcggaaaggcgctccttggtccaggtcgggtcgaagcgcttcatccggcgcgacgccagcagccaggcgccgccgatcccgatcaggtacatcagcccgtaccagtggatcttcagcgggccgatggccagcgcaaccggatcgatctggggatacgtcagcatcgataa

SEQ ID NO: 15233 - DNA, 897 bp, Pseudomonas aeruginosa
ctcctacgacagaaaagcgagatcgggggtcaggaaacttatgcccacgctgaacagcagcagggcgaacagtcgcttgagtacgcgcggcgacaaacgatgcgccaggcgcgcgccgaagcgggcgaacagcatactggtggcggcgatgccgaccaacgccggcagatagacgtagcccaggctccactccggcaactgcgggttgtgccagccgaccgcgatgaacgacagagcgccggaaatggcgataggaaggccgcaggccgaggaagtcgccaccgcctgctgcatcggcacgctgcgccaactgaggaaaggcacggtcagcgaaccgccgccgatgccgaagatcgccgaggcccagccgatcaccgcgccggccagggtcaggccgcccttgccgggcacctcgcggctacccttgggcttgaggtcgagaaccatctgcaaagcgaccaggatggcgaacaccccgattatcttctgcaacagcggccccttgatctgcgccgcggtcagcgcgccgagggcactgccgatgaggatgccgagggtcatccaggcgaacaccggccagcgcaccgcgccgcgccgatggtgttcgagaatggaattgatcgaagtgaagacgatggtcgccagggaggtgccgaccgccatctgggtcaggacgtcgccgccgaaaccgtgcgcggtgaagctgaagaccagcgccgggacgatgatcaggccgccgccgacgccgaacagtccggccagcacgccggcacaggcgcccagcacgatatagaggagaaactccatgcacgcccccgttggaaagccggcatggtaacggaattgcgcgccgtgcggcaggcgtcgtgcttgaacggcgatggcggatgcctttag

SEQ ID NO: 15234 - DNA, 915 bp, Pseudomonas aeruginosa
cgaattctatgcccgcccgagcctgccgctggcggcctgggaggacgccgagggggtattcgccggacgcgacctggaggccggcggcacctggctggggctcggcccggccggccgtttcgccgccctgaccaacgtccgcgatccgtcgcaggctctcggcaagcgctcccgtggcgaactggtggcggacttcctgcgcggcggcggcaacccggccgactacctggcgcaggtcgccgggcgcgccgcggactattccggcttcaacctgctcattggcgatcgccatcagctctggcactacaacccccgcgtagggccaccgcgcctgctgccggcggggatctacgggctgtccaacgcggccctcgatacgccctggccgaagctgctcaaggctcgcgccgccctcgccgagcggcttgccgagccgcatccgcaggccctgctggagctgctggccgacgcagcgccggccgccgacggccagttgccggataccggcgtgggtctggccacggaacgcctgctctccagcgtgttcatcgccagcccgagctacggcactcgcgccagcagcgtcgtacgggtacacgccgacggcacgcgggagatgatcgagcgcagcttcgggccgtccggcgcccggctcggcgaggtcagcctggtgctgccgccaggctgaccttcagcaacaggccacgcaatcgcgacgctgcttggcccgatagagggcgtcgtccacgcggcacagcagcaggtcgagggtctcgccatcattcagcacgccgacgccaaagctggcggtcaaccgctcgcccatctcgaaggactgcgagcgaacccgctggcgcaggcgttcggccaaggccgccgcggcctccaggccggtttccgggagcagcaggatga

SEQ ID NO: 15235 - DNA, 819 bp, Pseudomonas aeruginosa
  unsure (15),(17),(468): Identity of nucleotide at the above locations are unknown.
ggcgcgactatcccnangcctgcgggccagccccgctacggtttcgtctgggaaaccaccattctcggcagcgataccttcatcgcccttacccaggcgctcggcgccctgccggcgttgcttggcttcccgttgccggacgccgagctgatccgcgccagcggcgacgccgccctggccagcgaagccgcacggcacgcctgggccggctggctggtaggcgtactgctggtctatggggtcctgccgcgcgcgctgctcggtctgctctgcctgtggcgctggaaacgcggcctggcccacctcgacctggacctcgacgacccaggctacagcctgctgcgcgaacgcttgatgccggccagcgaacgcctcggcgtcagcgacgcggcaccggactggctgccggagccgcagggcggccagtccggccaggaagccgccggagcggtgctggtggcggtgganctggacgatcgccggccctggccgccgaagctcgccgaaagcgtcgccgacgccgggatcctcgacaacggccagcagcgccgtcgcctgctcgaacaactgacccgctacccgccggcgcgcctggccatcgcctgcgacccgcgtcgctcgccggaccgcggcaccctggcactgctcggcgaactcgcccgctgcgccgccagcacccgcatctggctgctccaggctccgcccggcgaagcgctcgacagcgaccgcttgggtgactggcacgccgccctggaacgcctgcaactgccgcacggcgagacctcgccgctggcctggctggagaccggccatgactga

SEQ ID NO: 15236 - DNA, 636 bp, Pseudomonas aeruginosa
gccgctgatcctggccgtggtcggccacaccaataccggcaagacctcgctgctgcgcaccctgacccgcgacctcggattcggcgaagtctcccatcgccccagcaccacccgccacgtcgagggcgccaggctgtcggtggacggcgaagcgctgctggaactctacgacacgcccggcctggaagacgccatcgccctgctcgactacctggacgccctggagcgccccggcgagcgtctcgatggcccggaacgcatggcgcggttgctggacagcaacgaatcgcgcgggcgtttcgaacaggaagccaatgtggtcggccagttgctcgcctccgacgccgggctctacgtgatcgacgcccgcgaaccggtgctggccaagtatcgcgacgaactggcggtgctcgccggctgcggccggccgctgctgccggtgctgaacttcgtcgccagcccgcagcatcgcgaggaggagtggcgcgccgccctcgctcgcatgggcctgcacgccttggtgcgtttcgacagcgtggcgccgccgctggacggcgaacggcgcctatacgagagcctggcgctgctgatggagcgcgcccggccgcaactcgaccggctgatcgccgaccatga

SEQ ID NO: 15237 - DNA, 828 bp, Pseudomonas aeruginosa
  unsure (80): Identity of nucleotide at the above locations are unknown.
gacccaggccgccgcgcgcctgcgcgccgggcaacggctgatcgccgaattgctggtcgacctcgccgcctgccggcgcntggtgcccggcggcgaaagcgccgtgcaggaagccacccgcgacctgcaccagcaggtgcgcaagcgcgagcaggcctgcgtggaagcgttgctgcggctctacgccttcgccagggacgacgcccgcgccgccgacctgccgctgctcgacggccgctggggcgacgatctgttcaatccggagaccctgcgccaactcggtatccgcctcggcggcggggttgcggccggtgccgcggccggcgccggcatcgacctgctggtgggcggcgtcacccttggcgccgccgccgccctcggtgccctcgccggcggcgcctggcagaccgtcggccactacggctcgcgcctgctcggcaagctcaagggcgcccgcgagctgaccgtcaacgacgccgtgctgcgcttgctcgcgctgcgccaacggcagctcctggcagccctgcaaacgcgcggccacgcggcggtcgaggcgatccgcctggaaaccccggaggacaagcagtggcgcgaaggcaagctgccggaagcgctgcgcaaggcgcgcgcgcatccggagtggtcgtcgctgaacggcaggcgggtgggcggcagcgaccgccaggaacagatcgacgcgctggccgaattgctggagagcgggcgcggggaatgacagactgggcgacgatcgcccaagaggtaggcccatgcccttcgtttcctacgcgcagaacctggaagacgtccgactctggcgggccctga

SEQ ID NO: 15238 - DNA, 615 bp, Pseudomonas aeruginosa
cccaggctccactccggcaactgcgggttgtgccagccgaccgcgatgaacgacagagcgccggaaatggcgataggaaggccgcaggccgaggaagtcgccaccgcctgctgcatcggcacgctgcgccaactgaggaaaggcacggtcagcgaaccgccgccgatgccgaagatcgccgaggcccagccgatcaccgcgccggccagggtcaggccgcccttgccgggcacctcgcggctacccttgggcttgaggtcgagaaccatctgcaaagcgaccaggatggcgaacaccccgattatcttctgcaacagcggccccttgatctgcgccgcggtcagcgcgccgagggcactgccgatgaggatgccgagggtcatccaggcgaacaccggccagcgcaccgcgccgcgccgatggtgttcgagaatggaattgatcgaagtgaagacgatggtcgccagggaggtgccgaccgccatctgggtcaggacgtcgccgccgaaaccgtgcgcggtgaagctgaagaccagcgccgggacgatgatcaggccgccgccgacgccgaacagtccggccagcacgccggcacaggcgcccagcacgatatag

SEQ ID NO: 15239 - DNA, 810 bp, Pseudomonas aeruginosa
acggcgatggcggatgcctttagcctgacggccagcccatcccaaggatcgcgcatgtgcctgatcgtcttcgcctggcaaccggggcacgccctgccgctgctggtcgccgccaaccgtgacgaattctatgcccgcccgagcctgccgctggcggcctgggaggacgccgagggggtattcgccggacgcgacctggaggccggcggcacctggctggggctcggcccggccggccgtttcgccgccctgaccaacgtccgcgatccgtcgcaggctctcggcaagcgctcccgtggcgaactggtggcggacttcctgcgcggcggcggcaacccggccgactacctggcgcaggtcgccgggcgcgccgcggactattccggcttcaacctgctcattggcgatcgccatcagctctggcactacaacccccgcgtagggccaccgcgcctgctgccggcggggatctacgggctgtccaacgcggccctcgatacgccctggccgaagctgctcaaggctcgcgccgccctcgccgagcggcttgccgagccgcatccgcaggccctgctggagctgctggccgacgcagcgccggccgccgacggccagttgccggataccggcgtgggtctggccacggaacgcctgctctccagcgtgttcatcgccagcccgagctacggcactcgcgccagcagcgtcgtacgggtacacgccgacggcacgcgggagatgatcgagcgcagcttcgggccgtccggcgcccggctcggcgaggtcagcctggtgctgccgccaggctga

SEQ ID NO: 15240 - DNA, 999 bp, Pseudomonas aeruginosa
ccttcagcaacaggccacgcaatcgcgacgctgcttggcccgatagagggcgtcgtccacgcggcacagcagcaggtcgagggtctcgccatcattcagcacgccgacgccaaagctggcggtcaaccgctcgcccatctcgaaggactgcgagcgaacccgctggcgcaggcgttcggccaaggccgccgcggcctccaggccggtttccgggagcagcaggatgaactcctcgccaccccagcgcgccagcacgtcgacctcgcgcagctcgctggcaaccaggcggccgaaggcgaccagcacgcgatcaccggtggagtggccgaacaggtcgttgatccgcttgaagtgatcgacatcgatcatcaccagtgccgtggcgcgtccatggcgctgccggcgcatccattcatggtgcaggcactgctcgaacttgcgtcggttgtacagctcggtgagcggatcgatttcgctcaggcgctgggcctcggccatcttcgaggccagcgcctggttgacccggtgcagcgcctcggtgcgctcggccaccaggtcctcgagacgcaggttccagtcgaacagttcctcgttgcgctgctgcaactccagctcgaccagcttgcgctgatggatctcgtggtgcgcaccgatcatccgccgcggctcgccgcgctcgtcgaactcgacgaaacgcccgcgatcgctgatccacaggtaatccccgctgtaggtgcggcagcggtattcctcgcagtattccgggctttcgccgtcgaggtaggcctggaagctggccatcacccgcggatagtcctcgggatggatgatgttcttccaggtctccacgctctccggcaggctatgcggcggatagccgagcatcaggtaccagccggcgctgcggctgacctggttggtcgcgatgttccagtcccagatcccgtcgctgacgatctccagggcatatcgcagggttttctcaaggtcttcgcgtga

SEQ ID NO: 15241 - DNA, 486 bp, Pseudomonas aeruginosa
tctggcgcagcagccacttcaccttgggcaggttggtggcgttcatcgacaggctgtcgaagcccatcgccatcagcagcacggcagccgcgggatcgccggccatctcgccgcagatgctcaccggcttgccttccaggtgggcatcgtcgaccaccttcttcaacgcatgcagcacggccggatgcaggtagtcgtagaggtcggcgacccgcggattgttgcggtcgaccgccagcaggtactgggtcaggtcgttcgaaccgaccgaaaggaagtcgacctggcgggccagctcgcgggtctggtacacggcggcgggaatctcgaccatcatgccgatgggcggcatggcgatgtccacgccctcgtcgcgcacctcgccccaggcgcggtggatcaggtgcagggcctcttccagctcgtgggtgccggagatcatcggcagcaggatacgcaggttgtccagtccttcgctggccttga

SEQ ID NO: 15242 - DNA, 1620 bp, Pseudomonas aeruginosa
  unsure (964): Identity of nucleotide at the above locations are unknown.
cccgctacccgccggcgcgcctggccatcgcctgcgacccgcgtcgctcgccggaccgcggcaccctggcactgctcggcgaactcgcccgctgcgccgccagcacccgcatctggctgctccaggctccgcccggcgaagcgctcgacagcgaccgcttgggtgactggcacgccgccctggaacgcctgcaactgccgcacggcgagacctcgccgctggcctggctggagaccggccatgactgagccgctgatcctggccgtggtcggccacaccaataccggcaagacctcgctgctgcgcaccctgacccgcgacctcggattcggcgaagtctcccatcgccccagcaccacccgccacgtcgagggcgccaggctgtcggtggacggcgaagcgctgctggaactctacgacacgcccggcctggaagacgccatcgccctgctcgactacctggacgccctggagcgccccggcgagcgtctcgatggcccggaacgcatggcgcggttgctggacagcaacgaatcgcgcgggcgtttcgaacaggaagccaatgtggtcggccagttgctcgcctccgacgccgggctctacgtgatcgacgcccgcgaaccggtgctggccaagtatcgcgacgaactggcggtgctcgccggctgcggccggccgctgctgccggtgctgaacttcgtcgccagcccgcagcatcgcgaggaggagtggcgcgccgccctcgctcgcatgggcctgcacgccttggtgcgtttcgacagcgtggcgccgccgctggacggcgaacggcgcctatacgagagcctggcgctgctgatggagcgcgcccggccgcaactcgaccggctgatcgccgaccatgagacccaggccgccgcgcgcctgcgcgccgggcaacggctgatcgccgaattgctggtcgacctcgccgcctgccggcgcntggtgcccggcggcgaaagcgccgtgcaggaagccacccgcgacctgcaccagcaggtgcgcaagcgcgagcaggcctgcgtggaagcgttgctgcggctctacgccttcgccagggacgacgcccgcgccgccgacctgccgctgctcgacggccgctggggcgacgatctgttcaatccggagaccctgcgccaactcggtatccgcctcggcggcggggttgcggccggtgccgcggccggcgccggcatcgacctgctggtgggcggcgtcacccttggcgccgccgccgccctcggtgccctcgccggcggcgcctggcagaccgtcggccactacggctcgcgcctgctcggcaagctcaagggcgcccgcgagctgaccgtcaacgacgccgtgctgcgcttgctcgcgctgcgccaacggcagctcctggcagccctgcaaacgcgcggccacgcggcggtcgaggcgatccgcctggaaaccccggaggacaagcagtggcgcgaaggcaagctgccggaagcgctgcgcaaggcgcgcgcgcatccggagtggtcgtcgctgaacggcaggcgggtgggcggcagcgaccgccaggaacagatcgacgcgctggccgaattgctggagagcgggcgcggggaatga

SEQ ID NO: 15243 - DNA, 2058 bp, Pseudomonas aeruginosa
gcccatgcccttcgtttcctacgcgcagaacctggaagacgtccgactctggcgggccctgaaactcttccccagggggttctacatcgacgtcggcgccaaccacccgcggatcgactcggtcaccctggcgttctacgagcgcggctggcgcggcatcaacatcgaaccgctgccccacctgcaccgcgagctggagcgggaacggccggaagacctcaacctgaacctcgccattggcgagcgcgaaggccgcgccacgctctacgagatggccgcctcgggtctctccaccctggaccccgagctagcccgccagcgccaggccgagggatgcacgaccaccccgcgcgaagtgaaggtcagcaccctggacgcgatctgcgcggcccatgtcgaagggccgatccacttcctcaagatcgacgtcgaagggctggaaggcgcggtgctccgcggcctcgacctgaaccgctggcgcccgtggctgatcctcgcggaaactccattcgaccacgaccccgagtggaaagcgccgctgctcgccgcgggctaccgtttcgtccacttcgacggcctcaacggctattacctggcggaggaacaggcacgcctggaaggcgccttcgcgctaccgccgaacctgctggacgacttccagctctgccatggccatgccatgagccatccggtcgctccgctggagcaggccctggaacaggcgctgcaacgcgcagaagatgcggagcgggctttgcgggactggcgcgcgcttccctggtaccgtcgcctgttcggttgagcggagccgacggctccgccgaagggtcagaccgcgaccggtgccttgatgtgcggatgggcctcgtagccgaccagctcgaagtcctcgaagcgaaagtcgaacagatccttcacctcgggattcagcttcatgctcggcaacggcagcggctcgcgggtcagctgcaggtcggcctgctccaggtggttggcgtacaggtggcaatcgccgccggtccagatgaactcgcccggctgcaggccggcgacctgcgccaccatcagggtcagcagggcatagctggcgatattgaagggtacgccgaggaagatgtccgccgaacgttggtagagctggcagctgagcttgccgtcggcgacgtagaactggaacagcgcgtggcagggcggcagggccatctcgtcgatcagcgccgggttccaggcggagacgatcagccggcgcgagtccggattcttcttcagcatcgccatcaggttggcgatctggtcgatgtggcggccgtccggcgccggccaggagcgccactggtagccatacaccgggccgaggtcgccgttctcgtcggcccattcgtcccagatcgagacgccgtgctccttgaggtaggcgatattggtggagcccttgaggaaccacagcagctcgtggacgatcgacttgaggtggcacttcttggtggtcaccagggggaagcccgcggccaggtcgaagcgcatctggtggccgaacacgctataggtgccggtgccggtgcggtcgctcttgaaggtgccgtgctcgcgcacgtggcgcatcaggtcgaggtactgtttcatcggaggctcggatcgatatcggtgcggcgccgacgtggcggctcccaccgagggatgacagaaggatggccaagtctacggcgacggagcctgcatcgccagttcggcgcgaccggcgcaagccatgcacgccctggagcggaaagccggctgcccggagcggatgacgcctgcgacgttatccgccccgggcacgaaaagcggctcaggccgccttcggctgcgccgcgtcgcggcggtaggcccagaccatcagggcaatgccggccagcaccatcggtacgcagagcacctggcccatggtcagccaaccccaggcgaggtagccgagctgggcatccggcacgcggacgaattcgacaacgaagcggaagatcccgtagcacagcacgaacaggccggagaccgaggcggtcggccgtggcttgcgggtga

SEQ ID NO: 15244 - DNA, 435 bp, Pseudomonas aeruginosa
agtccatcagctggaagaagctcttgccatggcgcttgccgaaccaccagaccgccagcatcacgccgagcaggccgccatggaaggacatgccgcctttccagacctcgaagatcagcgtcgggttggcgatgtactcgtccaggttgtagaacagcacgtagcccaggcggccaccgaggatcacgccgcaggcgacccagaagaccaggtcggaaaggcgctccttggtccaggtcgggtcgaagcgcttcatccggcgcgacgccagcagccaggcgccgccgatcccgatcaggtacatcagcccgtaccagtggatcttcagcgggccgatggccagcgcaaccggatcgatctggggatacgtcagcatcgataactcctacgacagaaaagcgagatcgggggtcaggaaacttatgcccacgctga

SEQ ID NO: 15245 - DNA, 2292 bp, Pseudomonas aeruginosa
ccgagcatcaggtaccagccggcgctgcggctgacctggttggtcgcgatgttccagtcccagatcccgtcgctgacgatctccagggcatatcgcagggttttctcaaggtcttcgcgtgacagcggaagaagacctggcggcttcgacgcccgttcgtccattttgcggcaatccctcgcacgttcgactggccagtggcctctaccgaatggcaggcagtctatacgcttgcggggaaagcgtaagcgccgcacgacgaagcgtccggcgcgcgggaaatcagggctggacggtagccgccgggttgatcacgcgacccaggccgaggttgcgcaacgccaggtgcagcgagctgtggatgacctgcgggttgtcgaaggtgagcaactggccgagcaggtcccgggccttgtccagggtgatctggcgcagcagccacttcaccttgggcaggttggtggcgttcatcgacaggctgtcgaagcccatcgccatcagcagcacggcagccgcgggatcgccggccatctcgccgcagatgctcaccggcttgccttccaggtgggcatcgtcgaccaccttcttcaacgcatgcagcacggccggatgcaggtagtcgtagaggtcggcgacccgcggattgttgcggtcgaccgccagcaggtactgggtcaggtcgttcgaaccgaccgaaaggaagtcgacctggcgggccagctcgcgggtctggtacacggcggcgggaatctcgaccatcatgccgatgggcggcatggcgatgtccacgccctcgtcgcgcacctcgccccaggcgcggtggatcaggtgcagggcctcttccagctcgtgggtgccggagatcatcggcagcaggatacgcaggttgtccagtccttcgctggccttgagcatggcgcgggtctggaccaggaagatctccgggtggtcgagggtgacgcggatgccgcgccagccgaggaacgggttgtcttccttgatcgggaagtaggacagcgccttgtcgccgccgatatccagggtgcgcatggtcaccggcagcgggtggaaggcactgagctgctcgcggtagatcgccagctgttccttctcgctggggaagcggtcgttgatcatgaacggcacttcggtgcggtacaggcccacgccctcggcgccacgctcctgggcgcgggcgacatcggcgagcaggccggtgttgacccaaagcggcatgcggtggccgtcgagggtctcgcagggcagctcgcgcagggccgccaggcccttgctcagctcgcgctcctcggcgaccacgtcgctgtactggcgcaccagctcggcggaggggttggtgtagacctcgccgtggtagccatcgacgatcaggtcgatgccgtcgaccttggagtacggcaggtcgaccgcccccatcaccgtggggatgcccatggcacgggcgaggatcgccacgtgcgagttgcccgagccgagcaccgagaccaggccgaccaggcgcccttccggcacctcgccgagcatcgccggcgacagctcctcgctgacgatgatggtctgctccgggtaggtcaggttctgcttgcgttcttcctgcaggtaggcgagcaggcggcgaccgatgtccttgacgtcggaggcgcgctcgcggagataggcgtcgtccatcagctcgaagcgctgcacgtgctccatcaccacctggcgcagggcgccctgggcccactggccggtacggatgatgcgcttgacctcgttgccgatggaggcatcgtcgagcatcatcaggtagacgtcgaacagcgcgcgttcttccttgcgcaactggctggcgagcttgctcgacagcgcgcgcatgtcggcgcgaacgccctccagggcctgcttgaacagggcgatctcggcgtcgatgtcgtcgacctgcttgtccggcaccacttccaggtcggccggcggcaacaccaccaccgccttgcccaccctgaccccgggggcgccgggcacgccgacgaacttggcttcctggatgcccttgccgagcttgcccaggccgcggatcgaaccggtcgcctcggcatgcgcgatgaccccggcgagctgagcgctcatggtgacgaggaaggcctcctcgccttcgtcgaactggcggcgctccttctgctgcaccaccagcacccccatcacccgccgatggtggatgatcggcgcgccgaggaacgacgcgtagcgctcctcgccggtctcggcgaaatagcggtagcgcgggtgggcggc

SEQ ID NO: 15246 - DNA, 1389 bp, Pseudomonas aeruginosa
ggtaggcgagcaacggcggaaagccgagtatttcaccgaagccccgcgcggtgctgcgtgcctcgtccgggtcgaagtagtggcgtggtgcggcgccggcgatcgggcgcgccgggtaccaggcacgtaccagcaggcgccgcggctgcccggccggggcgccgagcaggccgggccggctggggtcgtccagttcgaaatcgcgcacgccgaccgcataggggccgctcggcgccggtagcggcgcgaccgggaacaggtacagcgcggcgattgccagcagcaccagcaggccgtacagcgaaccggtccggaacggcaggccgcgcacgggcttccggcgcagacaggcgccgagcagcagggagaaaccggcgaaggcgccgacgccggcttgccagcggtcgtcccatacagcgtacaggccggcgccgagcgccagcgtcgaggcgagcgccagcaggccacggcggccgggcagggcgggtatccaccaggcgagcagggccgccagcagggtcgcgaccagcagcaggtcgacagcggtcatggtgcttcgctcctcgtttccacggggcgcgtcggttggctcggccagaacgccgccagcgccagcagcagaccgaccagcgcgtagggggcgcggctgtcaaattggtggagcagcgtgccgagcagcggcccgctgatcaggccgaagccatgtacggccaccagggtgccggcggcggcaccctgttcctcggcgcgcacggcattggcgttgagcaccgagactgccgggaatacccaacccatgcccgccgcggcgacgaagaaggccagccagagcagcggcggcgagtcggcgaagcacacggcggcgaagccgatggcggcgaccagcccgccgacccggatcagtcgcggcggtggccagtccaggcggcgcaccaggagctgggccaggatcagcgcgacgcccactgcggtcagggcgatgccggccacccgcgcggcgtcggcggaatccaggcgcagccggtcgagggcgaagaagcccacggtgatctgcgccacggtgacgctgaacatcgccacgaagcccaccgccagcggccgccgcaggcggcggtcgccgatcgccagggcggcgccgcggttcggctggcgacgctcctcgcgcggcagccagcgccagagcgccagcagggcgaccaggggcagcgcgccggtgaccagcaacggcaggaccagcccgtgagtcgccagcagtccggccagccccggcccgatcaccatgcctatcgcgctggccgcgccgagtccggccagcgccgcggcgcgtcgttgcgcctcgacgtgatcggccaccagtgccgccgtgcaggccggcaccgcggcgtataa

SEQ ID NO: 15247 - DNA, 987 bp, Pseudomonas aeruginosa
accgccggcgaggccgcgcaggagaacaataccggcgaaggcgagcagggtcggcaacgtccagtgcagggcgagcacgatgaacaggcagagcgaggcttaggagagggcgaagccggccagcccgccgagcagtatccgccgtcgcccatgccggtcgctggcgatgccccagggccgcgccgcgagcatccaggcgatgccgccgacggtcaccgcggcgccggcctgccagggcgccaggccgagcttgcgggcgagcgggccgaccagggcgacgaaggacatcaccgcgagggtgcagacgaaggtctccaacatcagcggacgcaggtccagggtgttggcggagggcggcggggtggtcatctcaggggttccttcgggttcgcggcaggcgcagccagacccagccgaccagcaccagcggagtgcccagggcgagccaggagagcaggtcgtagaggccgtcgccgagcagcgccgagagcagcccgaagaggccgagcagggccagtagcaggggccagcggaagatcatccagagaccgcgcctcatgccttgccctccgtcgccaggctgccgtccggcagttccgccaggcgcttctccaatggcgtcttgcgtcggccgagccagaggtagagaccgctggcgaggatgacgatgctgacgaggtcgagcagcgcccagacgatcttcagcggcatgccgccgtagtcgccgaagtgcagcggctgcgacagcaggagcgtcttcacgtacagcggcatctcgcgcatgtcggtgagttcgccgctctgcgcgtcgatcagtgccggcttcagcaggcgctcggtgagcggcgtgttgccgcgcatgaacaccgcatagtgatgctggctgctgaactgggtgccggggaagccgacgaagctgacctccatgtccggcgccgcccggcgtgccgtggccagggccgcgtcgagcgagccgaggcgctgtag

SEQ ID NO: 15248 - DNA, 834 bp, Pseudomonas aeruginosa
cgggcgagttcggcgagcacctcggccagcggcatccggtcggccatcagcatgccgcgggtccaggcgtccggcaggccgtcgaagaccagccggcgcgcttcgccgtcggcgcccaggcgcaccgactcgccgctttccagccagcgcccgcgtccgtggagcgggctcagttcgacccgtccggcgagtaccgcgacccgggtcgcggccatctcctggcgtacgttgaagcgggcggcaccggcatgcagccgcgcttcggcggtggcgacgcggaacggacgcgggtcggcgcggctatcgacgaagatctcgccgcgcagcaggcgtaccagccgctggctggcgtcgaaggccaggtccacggcgctgtcggtgttcagggtcagcaggctgccgtcgggcagggtcaggcggcgctgttcgccgacgccggtgcgctggtcggccagccagtcgcgcaacggttcggcctgccaggtggcgagccccagcgaggcgccgccgaggaccagggcgaggtgcttgatcgcgcgccgccggtccagcccgtgctcgcggccgagggtcggcagggccagcgccggcggcagtcggccgaggcattgcagcaggcgctcggcgcgctcccaggcatgggcgtgctgcgggctgcgctgccgccactgggcgcaggcctggcgcgtgtcgtcggtgcagccgctgtcctgcaggcgcaccagccactcggcggcctcgtcgaggatcggcgagggaatccggccttcgcccgcggcgttcattccatcagctccaggcactggcggaaggcctgctgcatgtagcgcttga

SEQ ID NO: 15249 - DNA, 1500 bp, Pseudomonas aeruginosa
cgcccccgcggagcggcctcaggtgttattgcagcccttggcgatggagtcctcgttggaggtgtacggccgcgagggttccaggttccactcgggcttgttgcgggcgacgttgaagtggcagaccagttgtcggcgcatgctgccgatattgctgtcgcggttgtccgggttgtccttccattcgctgtccaggtagtggtcgaccaccagctcgttgaagaaattgttggtctggttgtcctggatcttgcgcccgcaatcggtcggtaccacttccagggtcatgatcttcttcctgaagcccggatcgtcgcgctccacccaggtggcgctttccacatagcgctcgcaggcattcttctcgctggtcgggtagatcgcctgcttacgcccgtcgtaggcgaactgcgcgtcctgctggcgggtctgcggcagtcgcatgttgatgatcgggaggaatgcctggaccgactgataccactggatctggttgagccgagcgccctccaggccggcgtcctcggtgtagaacgcggcgaggatcgacggcgacttcggcgggttttcctcccacttggccaggcgcagttcgttctgggtggtgaaggattcgtcggcgatctgcgccatcgcccggatgctctggtagaaggccgggccggcggcggtattgcgctcgtcgcggacgtcgaaggagcactgccgcgaatggtcgccgcggttctgccggtagttcgccgcccactgctcggcggtgctgacgttgatgtcctggcaggacttctcgacgctgttcggcgtgcgccgcgaatcggtgcaaccctgctgggcgcggtcgtcggtggcggcgtcgatggggaaggaacagagcaccgcatagtcctggtggtccttcggattaccgaagatggtgtcgaagatgaagccactcttcaggccataggcgagcttgcggtacttggcgtccttgcgcaggtaggaggcggagacgccgccgcttttctggctcttcggactgatgctgtagaacatgtagtcggtcgaaggccaggtggcgcggaacagtacgccggaacagaggaatgccggcttcgacggtccgccgcaatcctggcgggtgtcgttgtacaactggttgagccgggcgaccacgtcgttgccccggtcggcctgggccgcgggtgtcagcgccaggccggcggcggcgagaaggtagagaaaggtggatctgcttccgttcatgggatggactccacgcaggttcgaaggagcgggccgggggcggcccggttggtcccgatggggacgagcgcgacgggcggatcgcgggggatgaagcgcttgcgacggcatggccgtcggcgttgggacgtcagcgggacgtggtggcgccagtctgcaaccgggcgctgccgggaatgccgggcgaccccggcgggcgctgggcggcgggggcctgccgagcgcgtgggggaagtcgctcgagggaggcggtga

SEQ ID NO: 15250 - DNA, 1272 bp, Pseudomonas aeruginosa
tccggcagccgctcgcccagggctatcagcaggcagttccggtcggaaggaatgccgatgctgagcgcttcgccttccgcgagcggatggcgaaggaccatcgggctgcggctccgcctgctcgcgacggcggttgcgcagcgcgtcggccaactccgcgggcagccctggcaggcctggctgccaggccgccagggtgtcgggaacgatgaggtagaggctgctccgcacgtccttgccgaggcgttgcagcagcgccggcaggcccagtccctgcatgctcaaccgggcgctttcgtatatccgggccagggcgttgcggcgctcgtattcgtctttctgtcccgcatcgacgatggcccgggtcacggcggcgaaagggacgccgtagtgggtgagaatcaacggaaagcccagggcctcggccgtctcgcgcagggcatcgaggtcgctcggggcttccatgttctcgccgatcatcatgcctgccaggccggcctcggccagttttcggacgtaacgccgttgccgctcggcgtcgctcggtatgcccagcccggtggtcatcagcaggtcaccctcgccgagccattcggtggggtcgtcgagttcgcagacatgcgcccagcgaaccgggcggtcgaggccgccggctccgctcagcaggcgcgaacggagttcggggagggcgatcaggtggcggatgctctgcggcatgtccaggaaactccaggcatgggccttcagtgtaatcgccccgggcgcaggcagcgcgccctgtcaccaactggcgggcagcatccccagtgccgaggcgatcgcgtagaccccgctggaggcgaacaccaggacgatcagcccctgtatcagcggatgggcataccagccgcagctgaatgccggcagttggtcgccgtggcgccgcgccgcgttgagcaggaggatggggatgatgcccatcagtacgccgccgaaggtaccggcgaagtacagcgcgttcacgaagccgccgagccccgcataggccagcaggaacggcgggaccgagaccgcggcgagcaccgccaggcgtttgcgcccgtgggtttcgctgcccacgcggaagtggtcgaagatattggtgaacaggcacccgccgagtccccagtacgaggtcagcatcgccaaccaggcgaaagtgttcgccacgtagtaggcccatcggccgaaggagcgtccccagctcaaggtcgccacctcgctgatgtcgtccggggcgaccaggggcgatga

SEQ ID NO: 15251 - DNA, 4260 bp, Pseudomonas aeruginosa
ggcacggatccgcggcctcgagctgggcggcggcgtggacctgccggcggacctgcgctgggaactcaactacacctacctcgacgcgcgcaaccgcaccgccggccagcgcctcggcgatcgctcccggcacctcgccaacagccaattgcgctggagccccaatgcccgcttcagcgcccagttgcgcaccgaatacgtcggcagccaggtggcctacagcagcaacgtcggctacgccttgccggcctacagcctgtggcacctggagctgagccagaaactcagcgagaacctgacgctgcgcggcggcatcgagaaccttggcgaccagcgcctggccgacgacgacacgcacttcacctatgccgaacctgggcggaccttccatctcggcctggtggcgagcttctgatgcgccgttcgctactcttctgcggcgcgctgctggccagtctctgtgcctgggcggagccggcccaggtgcgtctgctcagcagcgatttcgtcctcccgggcaagcaccagcgcctagccggttgggcgcgcgaggccggtgtcgagttgcgcggcctgcgcctcggcatcggcgaggcgccgcccggcgagtggctggacggcggcaacctgctgatcctcgacacgccgcggccgaccgatcgcgcccaggtcgaggaggcgctgggcgagcgcttgcaaggcgggacgcaaccctggatccgcgtcggcggcggtcctccgggcttcggcaacctgccggcggcgctgggcgggcgcctggtcggctactacgcgaacggcggcgaagccaacctgcgccggctgttcgaggcggtccaacgctggcatgccggcctgcccgtcgacgcgttgccggcgccgcagcccctggcgcaggccggcttctatcatcccgacgcaccggcgccgttcgccggcctcgccgactacctggcctggggcgcctcgcgctgggccagcgatgccccgcgcatcgccttcctgatcccgcgcggcgccatcgccgacgcccagaccggcgccatcgacgaactgttgcggcgtagcgagcggcacggccaggcgccgctggcggtgtggttcgacgacagcgatccggaggcgttgaggaagtccttcgctggcgccgatgtccaggcgctggtcaacctgcagcacctgcagaacggcccggcgcgccgtgccgagttcctcgcgctggacgtgccggtattgcagaccctcggctaccgcgacggcaacgaggccgactggctggccgccgccagcggggtggcgccgcgtaccgtggcggccttcctcggcatgccggaaacctggggaatgagcgatccgctggtcatcagcgccctggagaacggcgagccgaagctgatggccgggcaggccgaggccctgctggacaagctcgaccggctgctgcgcctgcgtcgcctgccggtggcggacaagcacctggcgctgatgttctggaaccacccggagggcgagaagaacgtcgccgcctcgcatctcaatgtaccggccagcctggcccgtctcggcgaagcgctgcgggcggccggctaccgggttgcgacgagcgacgaaagcgcgctgatcgataccgcccagcgcctgctcggcggctactaccggccgcagaccctggacgcgctgtatcgcgacggcctcgccgcgagcctgccgctggacgcctacctgcactggctcgaggcgctgccggcggacctgcgcgaggagatgcgcgcgcgctggggcgacccgcgtcgacattgggccttgcgcgatatcgacggccagcgacgcttcgtgttcccggcggcgcgcctgggtaatctgctgctgttgccgcagccgccgcgtgccggccgtccgggcgaggcctaccacgacagcgcggtgccgccggaccatctctacctggcggtctaccagttcgtccgcgagggtttcggcgccgacgcgctgatccatttcggcacccatggcacccaggaatggctacccggcaaggaccgcgggctggcggtgggcgactacccgctgcggacgctcggcgacctgccggtgttctacccgtacatccaggacaacgttggcgaggcgatccaggcgcgccggcgcgggcgcgcggtcaccgtcagccaccagacgccgtcgttcgccccggccgggctgtacgacgaactgcgcgacctgcaccagctgatccacgaataccagcaactggacgagggcgcggtgcgcgaacgcagcgccgagcagatccgcgcggcggtgcgggcggcgcacatgaacgacgacctgggctggagcgaggcagcgatgcgcgaggatttcccggcgttcctcggcgtgctccacgaccacctgcaccgactggccggctcggcgatgccgctggggctgcacaccttcggtgtcgccgcctcgccggagctgcgcctgggcaccgtcatgcagcagctcggcgagccctactaccgcgcgctcggtctcgaccccgacgaactgttcgccgccgatttcagggcgctgcgggaaggtcgtgcctaccgcacgctgcaacgctacctgcgcgacggtggcgagatcgccaaggtggccgatccgcgcctgcgcgagcagttgctgcgcgcccgcgaactggaccgccagctcgccgacaccggcgaactggaggcgctgctcgccggcctcgccgggcgcttcgtcgcgcccgggccgggcggcgatccgatccgcaatccgcaggtacccagcgggcgcaacctgttcgccttcgaggccgacaaggtaccgacccgcgccgcctacgaagccggcgccgaggccttcggccaactgctggaaagctaccgcgccgagcaccagggcagggcgccggaaaagctcgccttcagcctctggtcgtcggaaaccatgcgccacctgggcatcgtcgaaagccaggcgctgcacgccctcggcctgcgcccgcgctgggacgccggtggccgcctgctggcgctggacatcgtgccggcggcggaactggggcgtccacgggtggacgtggtgctacaggtgaccagtgtctaccgcgaccagttcgacggcttcatgcgcctgctcgccgaggccatcgagcgcctcgccgcgctggacgagccgggcaacccgctggcgcgcaacagccaggcgctggagcggcgcctgcgcgaacgcggcgtcgaagcgccactggcgcagcgcctgtcgcgcctgcggctgttcggcaatgcgccgggcgactacggcaccggggtaacgcaactgaccctcgattccacccgctgggacgacgactcggcgctcgccgagcagttcctcgggcgcttgcagtacgcctacggcagtcgcgactggggcgtgaagctggatggcggcaacctgttcgccgaacagttgaagggtgtacaggcggcgatcctctcgcgctcctcgacgctcaacggcgtgctctccaccgaccacccgttcgagtacctcggcggcctgtcgctggcggtacgccacctcgacggcgccagcccggcgctgtacatcgccgacctgcgccagcgccagccgcgcaccacggccgccgcgcagttcctcgccagcgagctgcgcgggcgctacctcagcccgcagtggatcgccgcgatgcagcgcgagggctacgccggcagcctggaaatgctcgacctggccaacaacctgtggggctggcaggcggcggatcgcaccatggtccgcgccgaccagtggcaggcgttgcacgacaccttcgtcatggaccgccgcgagctgggtctcgccgagtggttcgaaacgcacaatccgaccgcccaggcgcagatcatcgcgcgcatggccgaggccatccgcaagggctactgggacgccagcgagcagacccgccgcgaactggccgagcgctggcggcaactggcggccgccggcgccggcgaggtcggcgcggcgaccacccgtgaattcatcgaacggatggccggcggtttcggcgaggccgcggcgcaggcagagggcgcggccgcgtccggtgccggcgaaacggtcagcggccgcgtcctcgaagaagtcgcgccgccgccgtccggcgagccgcagccgtggctccggctggccgccgccgtgctgctcgcgctgttcgccgccggcgccgtccggcaatccgtagtcaatcgtcgtccgatggaaaatcgctcatga

SEQ ID NO: 15252 - DNA, 2784 bp, Pseudomonas aeruginosa
tcctggccctggtcgccgccagcatcaccttcttcatccttaccgtgcgtcgccgctggctgctccaggaactgcgcgccgtcgaacgcgcgcgggaggccggctgatgcgcttcctcgaacacgacgaggcggacgacccgatcctctcgatggtcaacctgatcgacctgttcctggtggtgatcggcatcctcctgatcgtcatcgtgcagaacccgctcaacccgttcagccaggacaaggtggtggtggtcgagaatcccggcgaggcggacatgcgcatgctggtcaaggacggcaaggagctgaagcgctaccaggccagcggcgagatcggcgaagggcagggcagccgcgccggggtgacctaccgcttggccgacggacggatgatctacgtgccggagagcggcggggaggccggcaagtagcgacgcgtacggcggagagctgggacttttgcccggagttcccggataatggccggtttccgtttctcttggtgctcgccgtggaagtaaaggtcaattttctcgataaccttcgactggaagccaggttcgatgatttcacggtgatcgccgaccagccgatccgctacaagggcgacggctccgcgccggggccgttcgactacttcctggcgtcgtcggcgctgtgtgccgcctacttcgtcaagctgtactgccagacgcgcaacatccccaccgacaacatacgcctgtcgcagaacaacatcgtcgacccggagaaccgctaccggcagatcttcaagatccaggtggaactgccggccgacatctcggagaaggaccgccagggcatcctccgctccatcgaccgctgcacggtgaagaaggtggtgcagaccgggcccgagttcgtcatcgaggaggtcgacaacctcgatgccgacgcccaggcgctgctgatgcccggcaccgatgccgccggctgcacgcgcatcccgggcaaggacctgccgctggagcagaccatcgccaacctgtcggccatcctcgccggcctcggcatgaagatcgagatcgcctcctggcgcaacatcgtgcccaacgtctggtcgctgcacatccgcgatgcgcagtcgccgatgtgcttcaccaacggcaagggcgcgagcaaggaaagcgcgctggcctcggcgctgggcgaattcatcgagcggctgaactgcaacttcttctacaacgaccagtactggggagaagagatcgccaatgcggcgttcgtccattacccggacgaacgctggttcaagcccggccgcgacgatgcgctgccgctgggactgctcgacggccattgcctggcgatctacgaccccgacggcgagctgcgcggctcgcacctgtacgacaccaactcgggcaacgtgcagcgcggtatctgcgccttgcccttcgtgcgccagtccgacggccaggtggtgtatttcccctccaacctgatcgagaacctctacctcagcaacggcatgagcgccggcaataccctggccgaggcgcaggtgcagtgcctgtcggagatcttcgagcgtgcggtcaagcggcaaatcctcgaaggcgagctggcgctgccggacgtgccgccggaggtgctggccaagtacccgggcatcctcgccgggatccgcggcctggaagagcagggcttcccggtactggtcaaggacgcctcgctgggcggcgaattcccggtgatgtgcgtgaccctgatgaatccgcgcaccggcggcgtgttcgcttccttcggcgctcacccgagcttcgaggtggccctggagcgcagcctgaccgaactgctccaggggcgcagcttcgaaggcctgaacgacctgccccagccgaccttcgaaagccatgcgctgaccgagccgaacaacttcgtcgagcatttcatcgattccagcggcgtggtgtcctggcgcttcttcagcgccaaggccgatttcccgttcgtcgagtgggacttcacccggcagggcgaggctgccaacgccgaggaagccgcgaccctgttcggcatcctcgaagccatgggcaagcaggtctacatggcggtgtacgagaacctcggcgctacggcctgccggatcctggtgccgggctactcggaaatctatccggtggaagacctgatctgggacaacaccaacaaggccctggcgttccgcgaggacatcctcaacctgcaccgcctcgacgacgccgcgctcggggcgttgctggagcgcctggaagactgcgaggtggacgactacaccgacatcaccacgctgatcggcgtcgagttcgacgacaacacggtctggggccaactgaccatcctcgagctgaaagtgctcatcggcctcgccctgaagcgcttcgaagacgccaaggaaggcgtggaggcgttcctccagtacaacgacaacagcgtcgagcgcggcctgttctaccaggcgctgaacgtggtgctggaggtcgtcctcgacgacgagctggagatcgccgactacgaggccaatttccgccgcatgttcggcgacgcgcggatggatgccgcgctgggctcggtggacggcagcgtgcgcttcttcggcctgacgccgaccagcatgaagctggaagggctcgaccggcacctgcggctgatcgacagctacaagaagctgcacgcggcgcgagccaggatgcagcccttggtcgacggcgaggccggcgctgccgcggctggcggtctcaagcctcggcgcatggcgatccgcaagcgcaagtga

SEQ ID NO: 15253 - DNA, 2385 bp, Pseudomonas aeruginosa
tttcatcacgaagaaattgagtttgtctcatggcatgagtctcccgagaatccctccatcgacctttcgactggaggaacacccatggccctggcccacactctcggcttcccacgcatcggacgcgatcgcgaactgaaaaaagcccaggaagcgttctggaagggcgagctggacgaggccggcctgcgggccgtcggtcggcagctgcgcgctgcccactggcaggtacagaaggatgccggcatccagttgctgccggtcggcgatttcgcctggtatgaccaggtgctgacccattcgctgaccttcggcgtgatccccgagcgcttccgggcgcacggcgaggccgggccgaccctgcataccctgttcggcatggcccgtggcgtcagcgacgacagttgttgcggcggtgcccatgcccaggaaatgaccaagtggttcgacaccaactatcactacctggtccccgagttcagcgccgatcagcagttccagctgagctgggaacaactgttcgaggaggtcgacgaggccagggccctcggccaccaggtgaagccggtgctgatcggtccgctgacctacctgtggctgggcaagggcaagggcgccgagttcgacaggctcgacctgctggaccgcctgctgccgctctacggccagatcttgcgccgcctcgccggccagggcgtggagtgggtgcagatcgacgagccgatcctggtcctcgacctgccgcaggcatggaagaacgccttcgagcgcgcctacaacctgctacagagcgaaccgctgaagaagctggtcgccacctacttcggcggcctggaagacaacctgggcctggccgccaacctcccggtggacggcctgcacatcgacctggtgcgagcgccggaacagtatccgagcatcctcgaccgcctgccggcctacaaggtcgtctcgctgggcctggtcaacggacgcaacgtctggcgctgcgacctggagaaagccctggaagtggtacgccatgcccgggagcgcctgggcgagcggctgtgggtcgcgccgtcctgctcgctgctgcacagcccggtggacctggagcgcgaagacgggctggacgccgagctgaagagctggctggccttcgccgtgcagaagtgccgcgaagtcgcggtgctggcccgtgccgccactgagccggaggccgccgaggtgcttgccgccctggaagagagccgtgcggtccaggccagccgcgcttcttcgccgcgaatccacaagccggccgtgcaggcgcgcctggccgcgatcaaggccagcgacgcccagcgccgctcgccgttcgccgaacgcatcgccaggcagcgcgccggactcgacctgccggcgttcccgaccaccaccatcggctccttcccgcagacctcgtcgatccgcctggcccgccagtcgttcaagcagggcaagctgagcgaggccgagtacatcgaggcgatgcacagcgagatccgccatgcggtgcagatccaggagcaactggggctggacgtgctggtgcacggcgaggccgagcgcaacgacatggtcgagtacttcgccgagcaactggacggctacgtcttcacccgcttcggctgggtgcagagctacggctcgcgctgcgtgaagccggcggtgatctatggcgacctgagccgtccgcgggccatgaccgtggagtggatcaggtacgcccagagccttaccgacaaggtgatgaagggcatgctgaccggcccggtgaccatgctgatgtggtccttcccgcgcgaggacgtgtctcgcgaggtgcaggcgcgccagttggccctggcgatccgcgacgaagtggtcgacctggaggccgccggcatcaggatcgtgcagatcgacgaggcggctttccgcgaaggcctgccgctgcgccgcaacgcctggccgcactatctggagtgggccaccgaggccttccgcctgtgcgcctccggagtccgcgacgaaacccagatccatacgcacatgtgctacagcgagttcaacgatgtgatcgagtccatcgccgccatggacgccgacgtgatcaccatcgagacttcgcgttcggacatggagctgctggaggccttcgagcagttcgactacccgaacgagatcggtccgggcgtctacgacatccattcgccgcgcgtgccgagccgggaagagatcgtcgcgctgctgcgcaaggcggcccggcggatacccgccgagcggctctgggtcaacccggactgcggcctgaagacccgcgcctggccggaaaccgaggcagcgctggtgaacatggtcgccgccgcccgcgaactgcgtggcgacctcgcccgcggttga

SEQ ID NO: 15254 - DNA, 1275 bp, Pseudomonas aeruginosa
agacctggcgtggcgactcgatgccatcgggcagaacgtcgccaccatccgtttcactcccgatggccagatactgtccgccaacccgctgttcctcgcggtggtcggctactcggcggacgagctggtcggcaagcaccatcggatcttctgcgacgaggacttccaggcctccgccgcctacgtgcgcttctggaaggaactggccagcggcacgccccagcgcggcgtgttcaagcgcctgcggcgcgatggtacgccggtctggctggaggccacctatttcccggtgaagaatgccgaaggggcggtcgtcgaggtgctgaagatcgccgccgacgtgacccgcaaccattccgaactgctcctgctcaacgcgatcaacgacgccatacgccagtccatggcggtcatcgagttcaccccggacggcgagatactcgatgccaacgaaaacttcctgcgtctcttcggctacagcctcaagtcgctcaagggccagcaccaccgcatgctctgcttcgacgagttctatcgggagaacccggatttctgggctcggctgcggcacggcgaattctcacgcgggcatttcgagcgccgcagcgccgccggcgagcgggtacatatcgaagccacctacaacccggtcaaggacagttcggggcggataatcaaggtcatcaagttcgccatcgacgttaccgagcaggtcaatcgcaacgaggaagtacggcgcgccgccgagctgtcgttctccaccgcggaagagaccgcgcagatttccacccgcggcatcgactccctcgaccagtccgtcgccctgtcggccaagaccctgtcgatggtcaacaccgccgtcggcctgatttcccagctcacccaccagaccaaggacatcgagaacatcgtcaccaccatccagagcgtcgccgaacagaccaacctgctggccctcaacgccgccatcgaggcggctcgcgccggcgacatggggcgcggcttcgcggtggtcgccgacgaggtgcggcaactggcggcgcgcaccagcggcgccacggtggagatcaagaacgtggtcaccgagaacgtcaagctgacccagcagatcaaccacaacatgcagaccatcgagtccagcgcccaggagaacaacaaccagatcaccaccgtggccggcatcatgcaggagatcagcaagggcgccgagcacgtggcgcgggtggtgtcgagcctgttcaagtgacctcggcgcagggctccggcggccgatag

SEQ ID NO: 15255 - DNA, 2301 bp, Pseudomonas aeruginosa
cgccaggccgctggcccacaacgccttcaagatcggattggcgcgcaacgccatcgttcgcgcactggaagaagcccactcgggagggatcggccaatgagcagcctgccacacagcaccgggcaagccctggatcgcgtcgacgggccagccaaggtcaccggccaggctcgctacgccgccgaatatcctgccgccgacctgctccacggcagcgtggtcagcagcgacgtcgcccgcggccgggtgcgcggcatcgactgtgcggcggccctggcggtacccggggtggtcgcggtactgcatcacctgaaccggccgccgatggcgggcgacgacgagccctacaaggacgccgatgccgccgaaggcgaacccttccgcccgctgttcgacgaccgcgtcctgtacagcggccagccccttgccctggtcctggcacggagcctggaactggcccgctacgcgggctcgctgctgcgcatcgacatcgagcccgagccgcaccagaccgacctgctggccgccctcgaccaggcccatgaggctcccgccgaactgcccgccgagcgcggcgatttctacaccgcctaccgcgccgcgccgattcgggtcgaggccagctacagcacgccgatcgagcaccacaatcccatggaaccgcacgcgtccacggtcatcgtccagcccgacggcagcctgctggtgcacgacaagacccaggggacgcagaacagccaggcctacctgcaaaaggtcttcggcctgcccgccgacaaggtaagggtctgtgccgcctacgtcggcggcgccttcggctccggcctgcgtccgcaataccagttggccctggcggtgatggcggcgctgcaactgcggcggtcggtgcgcgtagtgctgacccgccagcagatgttcaccttcggctaccggccgcgcaccctgcagcgccttcaactgggcgccgatgccgaggggcgcctccttgcgctgggccaccaggcgacagcgcagacctcgcgcttcgaagacttcaccgagcacgtggtggagtggagcggcatgctctatcgctgcgagaacctttccctggcctaccgtctggtgccgctggacgtctataccccgctggacatgcgcgcccccggcgcggcgctggggctgatcgggctggaatgcgcgatggacgaactggcggtgcggctcggcatggaccccatcgcgctgcgccggttcaacttcgccgagcgcaacggcaacgaggacaagccgtactccagcaaggcgctgctggcctgctacgaggagggcgcccggcgcttcggttggcaggcccgcgacccacggccacggagcatgagcgaagggcgccagttgctcggctggggcatggccggcggcgtctgggaggccatgcagagcaaggccagcgcgagggcgcggctggaggcggacggcctgctgcgggtggccagcgcgaccacggatatcggcaccggcacctacacggtgatgacccagatcgccgccgacgccgctggcatggcgccggaagaggtgcgcttccagcttggcgacagtgcgttgcccaaggctccattgcagggcggctcgttcaccgtctcgtcggtcggttccgccgtccgcctggcctgcctgcgcctgcgccaggccctggtcgcccatgccagggcccgccatccggagctggccggcaccgccgaagaacgcttccgcatatgccgtggccatctggaagcgggcgatacgcgatacgccctggccgacctgctgcaagggctgccggaagacgcgttgcaggtggaggtggaagctgaaccctcggcgcggcgcaaaggctacgccaccgcgacccattcggcggtattcgtcgaggtgcggatcgacgaagccctcggtaccctgcgtgtgagccgggtggtcagcgcggtcgcggcggggcgggtgatcaacccgaagaccgctcgcagccagatactcggcggggtggtctggggcctgggcatggccttgcaggaggaaacccaggtcgaccatgcgctgggccgctgcatgaaccacaacctcgccgagtaccacatcccggttaacgccgatattggcgatatcgaggtgatcttcgttgacgaacccgacgatatcgttaacgaactgggctccaagggcgtcggcgaaataggcatcgtcggcgtcgccgccgcagtggcgaatgccgtgtaccacgccaccggccgccgcctgcgcgacttcccgctgaccgtcgacaagttgctcggctga

SEQ ID NO: 15256 - DNA, 546 bp, Pseudomonas aeruginosa
cgagcggttttcgcctggaagcacggttgcgggaaaagttccgctggaaaccctccgacttgcagaacacgaggcaccccgcattccttggcactgcgcttgatcgcggcgaaaagacccacggaaaatcaccgggtcgttcagtctttgccaaaggaaatcagtatgaagaacgcaatggccctgaccctggccggcctgctggccgctccttccctcggcttcgccgccgcgccggacgcagtgatggtcttcgcccgccagggcgacaagggcagcgtatccgtcggcgacaagcacttccgcacccaggccttcaaggtccgcctggtgaatgcggcgaagagcgagatcagcctgaagaacagctgcctggtggcgcagtccgccgccggccagtccttcaggctggataccgtggacgaggaactcaccgccgagaccctcaagccgggggccaccgtcgaaggcgaggcgatcttcgcctccgaggacgacgcggtgtacggcgcatcgctggtcaggctgagcgaccggtgcaagtag

SEQ ID NO: 15257 - DNA, 1305 bp, Pseudomonas aeruginosa
cagtccaaattggcgaaatcaataccaagggagacgccatacacagctaccttccaccttcccaacccctcacccattcctccccaacctatacccactgaccgcctcgtaaaccgccttccgcaaccggttgatcccgccgatcggccgatgctccggcagtgcgtgccaggggttgaacgagaggttgtcacagaacaggttctgttcccggctatcaaaatcctgagctggcacaatgatgtcggctatggtagcgaagggcgcgtccgactccttccattcgacgctggtgtcttcgatgggcatgtacttgcccgggtcctggcgctgcacttggaaggcgtagcaggcgggggcgcggtcgatggagagttgctggtacagggcggcgcggaggaagttgggcaggtcctggttctgcttcggcagctcgtaggccgggcacttctccggggcggggacgacgcggaacttgatgttgtgttcgcccagcttgtacggcgagatgccgttgtagccggcgtgcagcgggctgtccggggcgggggcgagggtgcgcagggcgatcagcaggtggcgcagttcccagctggcggggttccagttggggaagaaggccagggctttcttgccgtcggcctgggcggcgaagttctgccggtattcggcgatgtcgcggatgaagaacaccggctggttgaacatgacgaagtcctgctcgccgtcatggccgcggccgggcaggagtttttcgccgggcacgtcgagcagcttgatggccatgccgcgcgcgtcgttcttgctgtcgaactgcgggtaggcgttgccgttggagaagcgcacccaggcgttccagcttttgcccgcttcggcgaacacgccgcgacgcagggtcgggtcgaggtcggcgcgtaccttgaattcggccttcacgcagccgtgggccttggcgtgggcatcgcgcaggacgcgggtgttgtcgcggtgctgttcgaccacgcggatggcgtcctggatgatcgcctgggtgatgcgggcttcgtccggggcgatctgctcttccgcggacaccgggccggagaatttccaggcgtagtagaggctgccgatggcccagccgccgaggccgacggccagcagcaggaggagcaggcggccgagccatttgccgaggaacagccaggcgtgggtgaggagtgcgcgcatggagtgggtgtccttggtggtgtgcgttggctgtgggcttttattcttcttgggcggggagtgcgccacgattgcttctccccgtcctctggctag

SEQ ID NO: 15258 - DNA, 1461 bp, Pseudomonas aeruginosa
tgtaggccaggcccttggccgaggacagttgcgagaggtcgagttgctgcggatcggcgccgatcagctggacgttcatccgcgccagttcgtcgacgctccagccgagcttgcgcaggtcgtagcggtggtcggcgatgttgtcggcggtggtcgggtcggtgccgatcacctcggtcggcaccatgtgcatgcgccactcgggattgcgtccgggggcggcgtattccgccggttgcaccttgggcgcatggcagaaggcgcagttggcttcgaatagggcgcggccctgggaggcgcgttgcaggtcgatgcggccgaagaggtcttccggccaggtcggtggtttcagttgttgcaggtttcttccagggcgtgcaggtcgtgcaggcgtacgctggaggcgtagcgctgctcgccctgcagcggctggccgtgctcgtcgaagatctgcaggcgcgcgccgacgccgagggcctcgccgatattgcgcgccatcggctgcatggccgagccgttccattgcacccagtcgaatttccagatgtcccagacctgcggatagctcaccggggcgttggcgacgcggtagttgcccgggtcgatggcatcgccgaagacgctgttggcgatgcgcccgaaggcgtcggtgcggccggggccttcctcggtggggtagaggtggcggcgggtgtcgttccaggcggtgcgcaggagggtgtcgagtacggccttgaagtcggcgcgcagttgcgacttgtcctgttcgtagcgttcgccgaggactttcctggcgaagcggttgaacttgaacgggttgtagtaggtggcggccatgctcgcgccgagcgcctggccgaaggcgccgccgcgcagggtcggcacggtggcggcgatggagtgcatggcggcgccgccgtcgatgcgcagcgacttgccctggtagcgcagttcgccggtgtggcaggcggcgcaggtgatgtccaggtagcgggtgccggtcttctcgtcgcggtgctggctgaagcccaccggcaggttgccggggttgaggtcgctggccttctgctgcggatcgacgaggaagccgaagcgggcgaggtattcgggggcggcgaagggttcttcggagaagggcagttcgagggcggtgaaccagtcgtagtgcaggcccttcaccagggtgccctggggcgtgtagtagaagcgctggcgggcctcgtcctgccattgcggcaggtagcgtacctcgctcggcgcctggtagtgggggaggttgggattggcgaggtagtagaccaccaccccgacgaccgccagcacgatcacgccgacaaccagcagagcctttttcacggtgcgcatcaggaacgtccttgtaggccttttttgggcaccgttatgccaaggcgttggcatattggcaagctgctatcagcttttttgacaaggttttcttga

SEQ ID NO: 15259 - DNA, 2916 bp, Pseudomonas aeruginosa
gtgagaacatctccccgccgcagggcggggcgatgcggatcattccgggttgaacaggatcaccgccgcgcgcagcttgctgcggccgaagcggctcatcttgtcgaactcggcgtggcttaccgggatgtgttggcaatccagcggctggcggtgctggctgtggtcgacgtcgggatcgtggaggtagacgaagtcctcgtcgtagtgggtgaccagcacccagtgcggggccttggagcgggtcaggcggtagctgctgatcagcaccagcggctggccgcccctggccagctggcgtgggatgtcgagcctggccgagcgtttctgctcgacgcccgaggcgtccagttcctcgcagaagtcctcgtggaccaggcgcatcaccgccttcttgtcttcgttgcgtacgccgtcgaggaacagcgggccgccggcggacagtaccagcttgacccggaagccgcgccgccaggcggccagcgccaggccctgggggctacagccgccgtgcccggcggtcatgtagatggtggtcgcctcgcgccacaggcgcagttcctcgcggcgggtcaactggcgctccggttgcagcgcgcccatggccatcagcaggcaggccgggccgcaggtgaaatcggtggtctgccggtagaagggcacgtggcggcgctgttcgtggccggggttgcggatgcgtttctcgaagcgcagcgcttcgctgtggtcctcgtagtagtcgcgcacggtggcgaagggacggtagccgttgcgctcgtagagggcgatggcgccacggttgtccgggcgcacttccaggcgcatgtaggcgcggtcgttgtcccgcgcggcctgctcggcggcttccagcagcttctggccgaggccgatgccgcgggcgcgcgggtcgatggcgatggagtagaggcgggccagcgaggtgccttcgtggaacagcaccagggcgtagccgagcacgccgccgtcgccctcggctaccgtcaggctggcgtgggcgcgggtgagcatccactggaagttgcggcgggacaggcgatcgtagtcgaagcagcggttttccagctcgaccagggcggacaggtcgtccacaccggccgggcggagggtcaggttcatagcggtctccacggccgcgggcgggaacttccgcgcgggcgtgctgtaatgggtgctgtacgcttcggtttgctggcaggcgccatagagcggtttcgcaagggattcccgccgagtattggccgggatgcgtgcgccggcaagccggttccgaatgcgccgtggtttcgctgtcaccccgggaggtgtcgtgagcaagctgttcatcatcgtggaacgcaaggaagactggacgtcctattaccccagcgaggatgtggtcaccgcccaggaatacctggaactgcccatcgacgacgacactggcaagcgggtccaggtgatcaacctgtgccggcactacaagtacctgcgccatggctactactgctcgctgctcgccgaggcgcgcgggcacaaggtgatcccctcggtgcggaccatcagcgagctggccaggaagtcgctgtacagcctggtcctggaagatctggatcgcaccctggacaaggccctggccgcgcacccctacggcagcaccgatggtttcaccctgaccctgtatttcggccgtaccgatatcgagccgctgcaggacctggcgcgacaactgttcgaggcgtttccctgcccgttgctgctggtggagttcaagcgcaaccgcacctggcacatcgagggcatcaagcccggcgccatccacaagctgcgcgaggaccaggaagacctcttcgccaacgccctggacagcttcagccggcagatctggcgcaagccgcgttcgcgcaagccgttccgctacgatctggcgatcctccacgaccccggcgaggcgttcccgccttccgacgccaaggcgctgaaaaacttcgtgcgggtcggccgcagcctcggcatcgacgtcgacctgatcgagcgcaaggactattcgcggatcgccgagtacgacgcgctgttcatccgcgagaccaccaatgtcgccgaccacacctaccgtttcgccaagaaggccgagagcgaagggttggtggtgatggacgacccggtgtcgatcctgcgctgcaccaacaaggtgtacctggccgacctgctgcgcagccacaagctgggcatgccggccacggagattctctacaaggagaacccgcaggaactggagaaggtcggcgagcgcctgggcttcccgctggtgctgaagattcccgacggcagcttctcgcgcggggtgatcaaggtggaggaccaggagcagttgctggcagccagcgccgagcttttcgagcgctcggtgctgatccttgcccaggagttcttctataccgagtacgactggcgtatcggcgtgctcaaccgcaagccgatcttcgcctgccagtacttcatgtccaagggccactggcagatctacgaccacagcccggacgccgaggaggtcagcggcgatttccgcaccatgcccgtgcacgaggcgccgcgcaaggtggtggagctggcggtgaagaccgccaacctgatcggcgacggcctttacggggtggacctgaagcaggccggcgacaaggtggtggtgatcgaggtgaacgacaacccgaacatcgactgcggggtggaggatgtctacctcggcgacgacctttacaagctggtcctggaggagttcgtccggcgcctggaagtcaagcgtcgcggctacgactgataagacgatttcggcattggcgatataaacaaagattcactttcgcgcgtcaaaaaattgctagattttcctttcagagcgccaacatgccgtttttatga

SEQ ID NO: 15260 - DNA, 429 bp, Pseudomonas aeruginosa
ccggccggtcgaggtggacgtgcgggtgctggcggcgacccatgtcgacctggaggcggcgatcgatgccgggacgttccgcgaggacctctactaccggctcaacgtcctgcaggtcggcaccgcgccgttgcgcgaacggagcgaggacctgccgctgctggcccagcatttctcccggctctacagcctggagaccggccgccgcccgcgccgcttcagcgaggacgcgctggcggcgatggcgatgcacgcctggccgggcaatgtccgcgaactggccaaccgggtacgtcgcgggttggtcctggcagagggaaagcagatcgaggcccaggacctcggcctggaatgcgcgcgcggcgacggcccgccgttgtccagcctggaggtctacaagctctgcgccgagcgccaggcgatgtgtga

SEQ ID NO: 15261 - DNA, 1122 bp, Pseudomonas aeruginosa
cgaactagaatccaaccgatcccgaccggttcgcgacagttactcgtggcgattgacagaatctgtcagatcgacgcatattcacctaacgcaaacgtttgcgtctggataatctcctggaaaagcctcaatacaacgataagaaaagctggaggatacaccatgaagcgggtcgcttcccggcgcctgttggctgccgttgtgctgactgcctgttcctcgttcctgcccctgtccgccgtccacgcggaaactcccgagaagcccaggatcgcgctggtgatgaagtcgctggcgaacgagttcttcctgaccatggaggacggcgccaaggcctaccagaaggagcatgccgaccggttcgaactggtttccaacggcatcaaggacgagaccgatacctccagccagatccgcatcgtcgagcagatgatcgtttccggggtcgacgcactggtgatcgcgccggccgattccaaggcgctggtgccggtggtgaagaaagcgctggacgccggcatcgtggtggtcaacatcgacaaccgcttcgacccgcaggtgctgcaggcgaagaagatcggcgtgcccttcgtcgggcccgacaaccgcaagggtgcgcggctggtcggcgagtacctggcgaagcgactgaaggccggcgacgaggtcggcatcatcgaaggggtctccacgaccaccaatgcccagcagcgcaccgccggcttcagggatgcgatggacgcggcggggatgaagatcgtctccttgcagtcgggcaactgggaaatcgagaagggcaacgcggtggcttcggcgatgctcaacgagcatccggacctcaaggcgctgctcgccggcaacgacagcatggccctcggcgcggtatcggcggtgcgcgcggcgggccgcgccgggcaggtgaaggtggtcggctacgacaatatccaggcgatcaagccgatgctcaaggatggccgggtgctggccactgccgaccagttcgccgcgaagcaggcggtgttcggtatccagaccgcgctcaagctgctcgccgggcaaaccccggaacatgagaaggacggcgtggtcgagacgcctgtcgagttggtgactgcgccctga

SEQ ID NO: 15262 - DNA, 1554 bp, Pseudomonas aeruginosa
gccgtccgatggagccttcccatgtctagcgacgcattgccgctgctgagcatccgcggggtcggcaagacctacgcgcagccggtgctggcggagatcgacctgcaactgttcggcggcgaggtgctggccctgaccggcgagaacggtgccggcaagagcaccttgtcgaagatcgtcggcggcctggaacgtcccggcgccggcagcctggagctcctcggccggccttacgcccccgctagccgccgcgaggccgaggcgctgggcgtgcgcatggtgatgcaggaactgaacctgctgccgaccctgtcggtggcggagaacctgttcctccacgacctgccccggcgcgccggctggatcgaccgtcggcgcctgcgcgcggcggcccgcgaggcgatggcccaggtcggcctggaggcgatcgatcccgacacgctggtcggcgacctcggcatcggccaccagcagatggtcgagatcgcccgcaacctgatcggcgactgccgcttgctgatcctcgacgaacccacggcgatgcttaccgcgcgcgaggtggacatgctcttcgagcaggtcgagcggctgcgcgaacgcggcgtggcgatcgtctacatctcccatcgcctggaagagctggcgcggatttcgcagcgcatcgcggtgttgcgcgatggccgcctggtctgcgtcgagccgatcgagcgctacgacgccgaccaactggtgaccctgatggtcggccgcgaactgggcgagcgcttcgacctgggcccacggcagaccggtgcgccgctgctgcgggtggagcggctgagccggcgcggcaaggtgcatgaggtgtcgttcgaggtgcgcgcgggggagatcttcggcatttccggactgatcggctccgggcgcaccgaattgttgcgcctgatctacggcgccgaccgcgccgacggtgggcaggtcctgctcggcgatccgccgcagcgcctgagcctgcgttcgccggccgactcggtgcgccagggggtggcgctgatcaccgaggaccgcaagggcgagggcctgctgctggaccagtcgatcagcgccaacctggccctgggcaacctgccggcgctggcgcgccacggggtgatcgaccggcgccgcgaggaagccctggcgcggcgccaggtggaggcgctgcgggtgcgctgcgcggacaccgcgcaggcggtgggcgaactgtccggcggcaaccagcagaaggtggtgatcggccgctggctggagcgcgactgccaggtgctgctgttcgacgagccgacccgtggcatcgacgtcggcgccaagttcgacatctatgccttgctcgccgaactgacccgccggggcaaggcgctggtggtggtgtccagcgacctgcgcgagctgatgctgatctgcgatcgcatcggcgtgctctcggcgggacgtatggtggacaccttcgagcgcgacgcctggacccaggacgcgctgctggcggcggccttcgccggttacaagaaacgcgacgcgctgctggcgacgtcgtga

SEQ ID NO: 15263 - DNA, 1278 bp, Pseudomonas aeruginosa
ccaccgtgggccagtcgatccgcctgctcggcgagatcgccgcgcaactgctgctgcaacgcatcgccgagcgcgaggagccgatgcagcggcgggtggtggcgccggcgctggtcctgcgcgaatccaccgcgccgccgctggtgcgggtctgaaccgggcgccgggggcgccctcgctagagagaggctggaacaaggacgcaacgatgcaagcgaaagtactggtggtgggcagcctgaacatggacctggtggtgcgcgcgccgcgcctgccacggggcggcgagaccctcgccgggcagtccttcaccaccattcccggcggcaagggcgccaaccaggcggtcgccgcggcgcgtctcggcgctggggtggcgatgatcggctgccttggcgacgatgcctacggcgaccagctgtaccgcgcgctgcaggccgagggcatcgactgccagggcgtcgagcgggtggccggggagtccagcggggtggcgctgatcgtggtcgacgacagcagccagaacgccatcgtcatcgtcgccggcggcaacggccacctgtcgccggccgtgctggcgcgccacgaacacttgctggagcaggcgcaggtggtggtctgccagctggaaagcccgctggagacggttggccatgtgctgcgccgggcccatgcgctgggcaagacggtgatcctcaacccggcgccggccacccgcgacgtgccggcggactggctgccactggtggactacctggtccccaacgagaccgaaagcgaactgctctgccgcctgccggtggactccctggagagcgccgggcgtgccgccgagcgcctgcgcgaaatgggcgccggcagggtgatcgtcaccctcggcgcccagggcgccctgctggtgggcgaggggcgggtcgagcatttcccggtggcgcgggtcaaggcgctggataccacggcggccggcgacaccttcgtcggtggcttcgccgcggcccttgcgcgcggcctcgacgaggcggcggcgatccgtttcggccaggccgccgcggcgatctcggtgacccgcctcggcgcgcagacctcgatcccctcgcgcgaggaagtcgagcgggcgctcgctggcgaggcttgagagggacggtgccgttgctaccggcggataacgcctgcggcgttatccgccctgcgcagctaggcgaggatcgctcccaggctcacgcatcccttcgaggggtaaggcatgcccaggctcgaacggtggcccctcagaagtag

SEQ ID NO: 15264 - DNA, 822 bp, Pseudomonas aeruginosa
tcgactggagcaccgccggcgaggtgtgaggcccgggaacaggcaagaggcgcggcgcgagccgcgccttttttcgtctggccgccgcgggtggctagaatgcagcgcgaaacgggtagcgagcgagtggatgtggatatggaaaagccgggcatgatcagccgctggtatgacgacaagggcttcggcttcatcctgccgaagaccggcggggaagaagtcttcctgcatatctccgcgttccgcggcgaccgccgtccccgccagggcgaccaggtgtggtttctcgccagccaggacgcccagggccgcctgcgcgccgagagggcgcggctggacgcgctgaccatcgatccgccaactgtccgccgtggcgcccaggcgccggtgacgcgggcccaggcgcggccggcgccgactccgccgagcgcgttgcagcgcccgttggcgaagctgctggtcctgctgatcctctgcgtgctgccggccgctggcgcctggcggatgtacctggacggacaggccctctggccgctgctggcctatccgctggccagcctgctcgcattcgccctctactggcgggacaagcgcagcgccgcacgcggcgactggcgtaccccggaggtccgcctgcacctgttcgagctgctcggcggctggcctggcgcgctggtcgcgcagcaggtattccgccacaagacccgcaagctctcgttccaactggtgttctggggcatcgtcctgctgcaccagctgttctggctcgacagcctgctcggcgggcgcctgtccgccgcgctgttgcagcggatcggctga

SEQ ID NO: 15265 - DNA, 303 bp, Pseudomonas aeruginosa
attggccggacaattacaagcacaaggaaccggcctgtgagcgcgtgttactgccgcaactgcggcgcccgagcgacccgtctcgtcgagaacggcatctgcgaagcctgcaagcggcgctcggacatcaatccgaagaacgtcctgatcgctgccgccctgatcgtctacatcggggtgaacgtggctgcctacatcaaggaccacccgccccgcgagctgaccgccgaacagcgcgagaagatcgccgagggccagcgcctggcgacccgcgcggcgatgatggccggctacgtcgactga

SEQ ID NO: 15266 - DNA, 438 bp, Pseudomonas aeruginosa
aaatcatcctgctcgatagtgcttattcgttcggctgaacgcgggaagaagcgctgccggcggcgccagccgggccgtggggtggacgacgcgattggcgccgcccgccggcatgtcccgcgctcggccgggagaacaagcggcaggccgctggggcctgctcaggcggcgacttgcgcaggcttgcccagcaggcggtcgaccaggctgcaggcggcgagagtggcgaccgaggggatcaaccaggccaggccctgttcggccaacggcaggtgcagcagccattgcgggaagtcctggcccaggcccgccgccttcagggcatcgagcacgccgaacgccagggaaaccagcatcaccggggcgaggatgcgcgtcgccgaatgccagaggccgatgcagaagctcagcgccaccagcacgatgcacggcggatag

SEQ ID NO: 15267 - DNA, 405 bp, Pseudomonas aeruginosa
cagaccgccgccagcaggccgccggcatacctgccgatcggatggctgagggcgtcgaccgaaccgccgaccttggccagggcgatcacggtgatcaccggcagccccaccgcggtgatcaggaagcccagcgccgccagccacacatgggggccggactgcaagccgacgatgggcgggaagatgatgttgccggccccgacgaacagggcaaaggtcataaaaccaagcgccaggatgtcccggcctttcaaagcgttcatgctggagaggtaccgcgctgctcgaggaaattcacagaagggtttcccggggggtaggggaaacggcactcatctggatgggacgagcaggggaggcggccgccgtccttgtgggaaccgggccgtaagcttggcatgctaa

SEQ ID NO: 15268 - DNA, 1716 bp, Pseudomonas aeruginosa
  unsure (877),(891): Identity of nucleotide at the above locations are unknown.
agatccgtgcccatgtcgaaagcccgcgccgtccgtcccgaactgctgaccctgctggtcagcctcgccttcctgctgttctacaacctgccgctgtggcaacgcctgctggcgatcaccccggcgggctggcagggcctcggcatgatgctggcagtcggcctgatgatcgccgcgatcttcaacctggcgctgaccctgctggcgttccgctggctgctcaagccggcgctgaccctgctgatcctggcggccgccggtaccacctacttcatgacccagtacggcgtgctgatggacgtcggcatgctgcgcaacgtcatgcagaccaacccggccgaggtcgccgacctgctttcgccgaagctcgccgtctacctggcgttgcttggcgcgctgccggtctggctgctgtggcgcacgccggtgcgctaccggccgtggccacgcgagctgctgagcaagctgctggtggcgctcgcctgcctggccctgcttgccggggtggcgctggccaattaccaggggctgtcctcgctgttccgcaacaacaaggaactgcgcctgcaggtcaccccgagcaacctggtcggcgccgccatcggctacgccaagggccaggcccaggccgccagccagccgctgcggccgatcgccgtcgatgcccggcgcgccgccctgtggcagggccatgcgcgcaagtcgctgaccgtgctggtggtgggcgagagcgcgcgggcacagaacttcggcctcaacggctacgctcgcgagaccaacccgcggctgaaggccgaagaaggcctgatcaacttctccaacgtgcactcctgcggtaccgagaccgcggtgtcggtgccctgcatgttctccaacntgggccgcgcggantacagcgacgctcgcgcgcgcacccaggaaggccttctcgatgtgttgcagcgcgcaggcctgcgggtcctgtggcgggacaaccagtccggctgcaagggcacctgcgaccgcgtcgccttccaggacctgagcgagagcaaggatccggccctgtgcgccggcggcgagtgccatgacgagatcctcctgcgcgacttgcaggccttcatcgacgggctgcaacaggacaccgtgctggtcctgcaccagatgggcagccacggcccggcctacttcaagcgctatcccagggagtacgagaagttcaccccggtctgcgccagcaacgacttcagcgcctgctcgcgggacagcatcatcaacggctacgacaacaccctgctgtacaccgaccacgtgctggccagcctgatcgacctgctgcgcaagaacgaagagcgcatcgataccggcatgctctacctctccgaccatggcgagtcgctcggcgagtacaacctctacctgcatggcacgccttacctgctggcgccggaccagcagaagcacgtcggcatgctggcctggttctcgcccggctaccagagcgccttcggcctcgacagtggctgcctgcgccagcgcagcaacgaggagctgtcccaggacaacctgttccactcgatgctcggcctgctggaagtgcgcaccggcgcctacgatcccggcctcgacctgttcgccccgtgccgtgcgccggaggtcctgcaggcgctcaaggccgacggcggacgggcgctgtactccgaggaagcgtctggccaggagccgccggcttcctga

SEQ ID NO: 15269 - DNA, 1590 bp, Pseudomonas aeruginosa
gcggcgacgacctgctcgcggcccaggcccggttgctggaggcgcgcggcggctggtgggtgctttccagtcggcgctgaagcgagccacgcggtaactcgacgacagccttgccggcgtcactgcggcgttaggtcgaaagccgcgctgcttcggtggcgctcccgccgcgaccaaggttgcgctaccgccggaggagcgctgcccgcgccttgcgcagcggcacccacgcccaccatgaagaagcgtcgaagcaggcccaaggaagcgtatggcagggctttcccggtttcgataatcggctccgccacgaccggcccggtcgtttcacctcgcggagtgcgccatgaacaagaacaacaccgccgttcgccgaatcctgccgctgaccctggcctcgctgggtgccctgggcggcctgcaaccggccgccgccgatatcctgctgtacgacaaggacgagaccacattttccaccgacggctacttcaacgccttctacgtcaacagcgacgtcgaccgccagggcgagacctacgatcgccgccagtcgcgggtgaagatgggattcctgccgaactacatcggcttcaacttcggcaggaaggtcgacgagctgagcctcggtggtcgcgcttccttctgggtgaccatcaacgacagcgagaccgacggcaccgataccgccatcgacgtccgtcagttctacggcacggtcgccggcgactggggcgaggtgctgatcggcaaggacttcggcctgttctcgcgctcgaacatcttcctcgacgaactgctggccggtttcggcaaccccagcgacaccctcggcctggtggacggcaagggcgtctccttcggcaacatcggcaccggctatccgtatccgttccccacctcgcagatcacctaccgcaacaacaacctgctgcccggcctgcgcatcgccgtgggcatcctcgacccgatcgactccaaccagatcgacaaagatgccagcgacggcctcgacgacaaggcctaccaggacaacccgcgctacgagagcgaggtcagctaccagttcgacctggccggggcgcaggtctacagctggatcaacggcggttaccagacttcgaagaacaccagcgacagcgtcgacagcgtgacttccaagggggtcggctatggcttgcaggtgaagatgggcggcttctccgtgaccggttcggggttcaccgccaagggcatcaatcccttcttcaccaacaacgccggcgaagccgcgctgcgcgaggtggacagccgcggcgcattgctgcagggctcgtattcatggggcaagaaccgcctggcgctgtcctacggcaagaccgtcgacgacggcaacggcctgggttccgcggccgactacgagagtcgcggcatcgcctatttccgcacgatcaacgacaacctcaagctggtcgccgagctgaaccgctaccggatcgacgggcgcgacggtgccgcgctcgacgaggacaccgacaccgtggcgctcggcgccgtactgaactggtgataccgaaactttcgaaggaccccgccgcgacccaagtaggatag

SEQ ID NO: 15270 - DNA, 537 bp, Pseudomonas aeruginosa
ccgccagcgaagggctacgcctggacttcgtggcctgcggggcgctggtccgcagcgaccagcaactgctcgcgcgaatcctccgcaacctgctttccaacgccatccgctataccccgcgagggcgcgtgctgctgggttgccgccggcatcggcagcgcctgtcgatcgaggtctgggacaccggggtgggcatcgccgccgacaagctcggcgagattttccaggaattcaagcgcggcgagtcacagcgttgtcaccaagaccgcgggctcggcctgggattggcgatcgtcgacaagatcgcccgcatgctcggccaccgggtccgggtcggctcgctgccgggcaagggctcatgcttcgccatcgaggtaccgctggcccgccatgccccgcgcagtcgcgccgagccgctggccagcgcggacgacctgcgcgagcgcctgcgtggttcgcgggtgtgggtgctggacaacgatgcggcgatctgcgcaggcatgcgcacgttgctcgaagcctggggctgccgggtag

SEQ ID NO: 15271 - DNA, 621 bp, Pseudomonas aeruginosa
agaccgcgctctgccacttgctggagcgcgaagcctcggtctgattcaggcgtcttcgcgcgccgcgcggcccaggcgcggggcgaggatcagggcgatcccgccgagcaccgccagggtcgccggcggcaatcgcggggcgagcggctcgccgagcagcagggcgccgcagagggcggcgagcaccggcacgctgagctgcaccgaggcgccctggatcgccgtcagccccggcagtgcgctgtaccagacggcgtagccgaggccggaggcgagggcgccggaaagcagggcataggccagcccggcgccgtccagccgcaactgcccgtggaatgccaggagcagcagggcggcgaaggcaagggcacgcaggaagttgcccgcgctgaccgccagcggatcgccgccgccgcggccgagcagggtatagaggccccaggcgaggccggacaggagcatcagcagggcaccgcccagcggcggcgcgctggctccggggagcaacaggaacagcaggccgcccagggccagcaggaaaccgagcagcgcctgtccgcccagccgttcgccgcgcagcaggccggccagcagcagggtgacctgtaccgcgccgaatag

SEQ ID NO: 15272 - DNA, 483 bp, Pseudomonas aeruginosa
cgatatcggccagtacctgacgggcatccgcacccaactgttgttgctgcgctgcacggcaggcgacgggcagccggcgctggcacgcctggagcgctactgccaggggctggacgacagcttccgcgcgctgctgcgcggtctaccgccgccggccctgcaacgccagtcgctggacgaggcgctgcgcgcctgcgtggcggactggcaggaaggccagggcatcgcctgcgagctgcgcctgggcggtccgctgccgcccctggatgcggcggccgggacccatctctaccgcctgttgcaggaggcgctgaacaacgtcgcccggcatgccggcgccagccgcgtgcggatccgcctgcaatgccgtggcggctttctctacctgagcgtacgcgacgacggtcgcggctgcgcggcggacccggcacccggcttcggcctggactcgatgcgccagcgcgcgcgctgcctgggcgctga

SEQ ID NO: 15273 - DNA, 1278 bp, Pseudomonas aeruginosa
cgaactggccctggtgcgccaggcgctggatgccggtgcccgcggctacgtgaccaagcgagcggcgccgacggtgctgctggaggcgatacggcgagtgctcgccggccagctctatctggagcagcccctggccacgcgcctggcctgccagtcgtgggaagagcagggcggggcagcgttgcgcgggctgacccgtcgcgagttcgagatcttccgcctgctcgcgcgtggcctggccctgcgcgaggtggccgagcacctgggggtaagcgccaagaccgtgtccaaccatgtcagcctgctcaagcagaagttgcaggtgagtacccaggcggaactggtgcaccgggccatcgacagcggcgtgctgcggctgggcctgccgctgccgctcgccgaggaggctcgcggcagcctcggctaggggggccgtcgctgctgtccggcgcttcactgccagcccgcggggcaatccttgcaaccctgcatgttgctgccctggaagttgccgaagcgcaccttgctgccgcgcaggtcggcatcttccaggttggcctcggccagcttgacttcctgcaggttggcgtcgcgcaggtcggcgcccttgagatcggcgcgggacagccaggtcatctccaggtcggcggcgcgcagcgtggcctggtgcaggcggccgccgctgagacgggcgaactccaggtaggcggcggtgaggtcggcgccttgccactgggcgccctgggcgaacaggccccaggcctggatcgccaccgccctggcgccggagaggtcggccccgcgcaggttggcttgctgcaggctggcacgggtgaggtcggcaccacgcaggttggctttttccaggttggccaggtcgagcctggcgtgacgcaggtcggcgccggagagatcggcgccggccaggtcgatgcggccgaggtcgaggttgcgcaggtcggcgccgcgcaggtcggccttggcgcagcgcgcgccgggctccaggcggcagccggcgatgacgcggacgtcgtcgatgtcgtcggcggcctgggccaggccggcgccgagcagggcggcgcagaggaggaaggtcttcatcgggatactccgcaggcggggaaagccgcgcctcgcagggcgcggcgcggggatcagcggctggcggtgcggttgtcccagctgggcagcttgaatacccagaaggaaccgccctgggccaccggccgggtcaggtcggccatgtcgccgccccacagcggcacggcgccgccgtag

SEQ ID NO: 15274 - DNA, 897 bp, Pseudomonas aeruginosa
ccccccaggcagtggacaccaagggactcgagccgctgggcaaggaatggcgcgacaccaacccctaccgcaagccctacgccaagcacgacctcgccgtcgagatcggcgcctccgcctacaaccagaactgcgcgcgctgccacggcctggaagccaagtccggcggcatcgccccggacctgcgcctgctggagaccggcgccgagggcgacgaatggttcaaggagcgggtcatcaacggcgcggtgcgcgatggcgcggtgtacatgccgaagatggccgacttcatcagccaggaaggcctctgggcgatccgcagctatctggaaagcgtgcacgtcgacgagtgacgcgcccgacccttcgccgccgaccgcggcgcccttgcacgagtccgccgcgccacggcggaacgaccacacaggagagcttcgccatgatttacgcagcgcccggaacccccggtgccgtcgttaccttcaagcctcgctacggcaactacatcggcggcgagttcgtgcctccggtcaagggccagtacttcaccaacacctcgccggtgaacggccagccgatcgccgagttcccccgttccaccgccgaggacatcgacaaggccctcgacgccgcccacgccgccgccgacgcctggggccgtacctcggtgcaggagcgttcgaacatcctgctgaagatcgccgaccgcatcgagcagaacctggaactgctcgccgtcaccgagacctgggacaacggcaaggccgtgcgcgagaccctcaacgccgacatccccctggccgccgaccacttccgctacttcgccggctgcatccgcgcccaggaaggctccgccgccgagatcaacgacagcaccgtggcctaccacatccatga

SEQ ID NO: 15275 - DNA, 1248 bp, Pseudomonas aeruginosa
gccgctgggcgtggtcgggcagatcatcccgtggaacttcccgctgctgatggccgcctggaagctggccccggcgctggccgccggcaactgcgtggtgctcaagccggccgagcagaccccgctgggcatctgcgtgctgctggaactcatcggcgacctgctgccgccgggcgtgctcaacgtcgtccagggcttcggcagggaggccggcgaggccctggccaccagcaagcgcatcgccaagatcgccttcaccggttccaccccggtcggctcgcacatcctcaagtgcgcggcggagaacatcattccctccaccgtcgagctgggcggcaagagcccgaacatctatttcgaagacatcatgcaggccgagccggcgttcatcgagaaggccgccgagggcctggtgctggccttcttcaaccagggcgaggtgtgcacctgcccgtcccgcgcgctggtccaggagtcgatctacccggcattcatggaagaggtgctgaaaaaggtcagggcgatcaagcgcggcgacccgctggacaccgagaccatggtcggcgcccaggcttcccagcagcagtacgagaagatcctctcctacctcgacatcgcccagcaggaaggcgccgagctgctcgccggcggcagcgtcgagaagctcgaaggcaacctggccagcggctactacatccagccgaccctgctcaaggggcacaacggcatgcgcgtgttccaggaggaaatcttcggcccggtggtcggagtcaccaccttcaaggacgaagccgaggccctggccatcgccaacgacaccgagtacggcctcggcgccggcctctggacccgcgacatcaaccgcgcctaccgcatgggccgcgggatcaaggccggtcgcgtgtggaccaactgctaccacctgtacccggcccacgccgcgttcggcggctacaagaagtccggcgtcggtcgcgagacgcacaagatgatgctcgaccactaccagcagaccaagaacctgctggtgagctacgacatcaacccgctgggcttcttctagtaggaccccggaccggccgcgaccgctctttcccggagcggtcgcgccggctcgtgaaacacgccgccgaggctgacggcggcgccccttccacctcctcgccaggccgattgcagagcggctggcatagctattgcctgcgttcaccacgtacagcacaccaccgggaaaaccggggtcgataa

SEQ ID NO: 15276 - DNA, 1461 bp, Pseudomonas aeruginosa
ggtgaaaaacccatgtccctcgaacaaaccggccatgcgcccgcaacttccggggtcgacttcgaaagcgtcgacgccgactacttccaacaccgtcaactgaagaaaggcgccgccggctgggtcctgctggtcgggctcggcgtcgcctacgtgatctccggcgactacgccggctggaacttcggcctggcccagggcggctggggcgggatgttcctcgccaccctgctgatggccaccatgtacctgtgcatgtgcttctcgctcgccgagctgtcttcgatgatccctaccgccggcggcggaaacggcttcgcccgcagcgccttcgggccctggggcggcttcctcaccggcaccgcgatcctcatcgaatacgccatcgccccggcggccatcgcctgcttcatcggcgcctactgcgagtcgctgttcggcgtcggcggctggctgatctacctggtgttctacatcgtattcatcggcatccacatcctcggcgccggcgaggcgctgaagctgatgttcgtcatcaccgcggtggcggccatcgccctcggcgtgttcattgtcgcgatggttccgcacttcgactcggccaacctgttcaacatcccgcagaccgcggcgaccggcgccagcagcttcctgccgttcggctatgtcggggtctgggcggcgatcccctacgcgatctggttcttcctcgccgtcgaaggcgtgccgctggccgccgaggaaaccaagaaccccaagcgcgacctgccgcgcggactgatcggcgccatgttggtgcttctcgccttcgccgcactgattctggtcgtcggtcccggggccgccggagccaaggagctgatgggctcgggcaatcccctggtggaagcgctggagtcggcctacaagggttcgacctggatgagccagttcgtcaacctggtcggcctggccgggctgatcgccagcttcttctcgatcatctatgcctactcgcggcagatcttcgccctctcccgcgccggctacctgccgcgcagcctctcgctgaccaaccgcaagaaggcgccggtactggccctggtggtgccgggggtgatcggcttcggcttgtcgctgaccggccagggcgacctgctgatcctggtcgcggtgttcggcgcgaccatctcctacgtgctgatgatggccgcgcacatcaccctgcgcatccgccgcccggacatgcagcgcccctaccgcacccctggcggcatcctcacctccggcgtatccctggcgctggcctgcgtcgcggtggtcgccggcttcctggtcgacccgcgggtcgtggtcggcgcggtggcgatctacgctgtactgatcggctacttcgccctgtacagtcggcatcacctggtgtccggcaccccggaagaagagttcgccgcgatccaggcggcggaacaggacctgcgctga

SEQ ID NO: 15277 - DNA, 1329 bp, Pseudomonas aeruginosa
cgtcggcggcgaaacctaccgcttcgacagcctcaaggacgtgatggccaaggccagccccgcgcgctccggcgatttcctcgccggcgtcgcggcgagcaacgacggcgagcgggtcgccgcgcagatggccctggccgacatcccgctcaaacacttcctcgacgaggcgctgattccctacgaggacgacgaggtcacccgcctgatcatcgacacccaccagcgcgacgccttcgccccggtgtcccatctcaccgtcggcggcttccgcgactggctgctcggcgacgccgccgacgaggccagcctgcgcgccctggctccgggcctgacgccggaaatggcagcggcggtatcgaagatcatgcgtgtccaggacctggtcctggtggcgcagaagatccgcgtggtcacccgcttccgcaacaccctcggccttcgcggccggctctccacccgcctgcaaccaaaccacccgaccgacgacccggccggaatcgccgcgagcatcctcgacggcctgctgttcggcaatggcgacgcgatgctcgggatcaatcctgccaccgacagcatggcctcgatctgcgccctgctggagatgctcgacgcgatcatccagcgctacgagattcctacccaggcctgcgtgctgacccacgtcaccagctccatcgaggcgatcaaccgcggcgtgccgctggacctggtgttccagtcgatcgccggcaccgaggcggccaatgccagcttcggcatcagcctgaagatcctccaggaaggctacgaggccgggctcagccagaagcgcggcaccctaggcaacaacctgatgtacttcgagaccggccagggcagcgcgctctcggccaacgcccaccacggcgtcgaccagcagacctgcgagacccgcgcctatgcggtggctcgtcacttcaagccgttcctggtgaacaccgtggtcggcttcatcggtcccgagtacctgtacaacggcaagcagatcatccgcgccggcctggaagaccacttctgcggcaagctgctcggcgtgccgatgggttgcgacatctgctacaccaaccatgccgaggccgaccaggacgacatggacatgctcctgaccctgctgggcgtcgccgggatcaacttcatcatgggcattcccggctccgacgacgtgatgctcaactaccagaccacctccttccacgacgccctctatgcgcgccagacgctgggcctgaagccggcgccggaattcgaggactggttgcagcggatgggaatcttcacccaggccgacgggcgcatccgcttcggtga

SEQ ID NO: 15278 - DNA, 471 bp, Pseudomonas aeruginosa
cccccgcgcggatcgccctgggccgcaccggcaccagcctgccgacccgcccgcaactggacttccagtacgcccacgcccaggcgcgcgacgccgtgcacctgcccttcgaccatgcggccatcagcgacggcctgcgccagcgcggccgcgacagcctgctgctgcacagcgccgccgccgaccgccacgtctacctgcaacgcccggacctcggccggcgcctcgacgaggcctcggtgcaacgcctgcgcgaacacgccgccggctacgacgggcagatcgacctggccatcgtggtcgccgacggcctctccgcgctggccgtgcagcgtcacaccctgcccttcctcgaacgcctggaggaacaggcgctggccgaaggctggtcgctgtcgccggtggtcctggtggaacagggacgggtggcggtggccgacgagatcggtgaattgctgcgggcgaagatga

SEQ ID NO: 15279 - DNA, 948 bp, Pseudomonas aeruginosa
gctgaagacaaaggcacggcacctcccaaccgatcgctcagagcagaggcatccatgggttcgcgcacctggcactggcccggcgtcctgctcggcctgctcctcgccacggccggcgcgcaggccgacaccctgcgcgtggcgaccctcgactgggcgccctacgtcggccccgacctgccgggcaagggcctcgccagccgcatcctcgacgaagccctggccctcgacgggcaccgcgccgaactggtgttcctgccctggcaacgtgccctgaaggaagccgccgaggggcgcttcgacgctctcatgccggcctacctgtcgcccgagcggcgcgaactgttccacgccaccatccccctgctcgactcgcaactgggcttcttccgccagcgcgagcgcctgctgccggtcaatcccgcgcatctggaaagcctgcgtccgtaccgcatcggcgtggtccgcggctacgtcaaccgggaggatttcgacgccgaccgcagcctgaccaaggacgcggtgaccaacgactggcagaacctcgagaagctcctgcgcgggcgtatcgacctggccgtggtcgatcgctacaccggctaccacctgctggcgcgcaacgtgccggcgctgaaggatcgcctggtgttcatcgaaccgccgctggaggtcaagccgctctatgtactggtgccgaaaagacacgcccgcggcgccgcccttgccgccagcctcgaccgcaacctgcgcctgatgcgtcgcagcggccggctggaacaactgatcgccgaagcacacctcgaacgcagcgggcagacccgcacgctggccgtcgatccgttaaccggccaggccgaccagcagcgcagccccggccaggagcaggaccagggccagcacgccccgttgcaaccggcgtggcgcgaagacccgctggggatgcgctag

SEQ ID NO: 15280 - DNA, 1014 bp, Pseudomonas aeruginosa
gttgctccaggaggaccagcgcgcattgcggttccagcggcaggtgcgctggcgcccaatccagcaggctgcgcatcggccagcgcggcggagcgaacaactggaaggcatgacgacgcaaccggggcgacgacaatactcgcggcaggctctccgcacggcagcgccgcaatgcccattcgcgctgccagaacgcttcgtcggcatcgaccgccgcgagcagcagcaacgcctcgcgtccttgctcgtcgcaggcgcggaatagccgcccgggcgggccgaacgcgcaagctgcctgcaaggtccagccatccacgcagtcgccggggcacgccgcgcccagcgctggccagccggtatgccgtggcgccgccggggcgcgctcgagcgcccccggcaagaccagcgccaccgcccccggcgcatgcagcaacggctgcagcacgccctccaggcgccccgtggccagccccgcacaacgctctccgagggcgcgcaggtcggccacttcgagcagcggctggggcgccagcaacaagggctcgccggccacctgggtcaggttgtgctggaccagcgccagctccgcgctgctacccagcggctggccgctccctcccaggcgctgcaggctgccctggcgataacgcagcaggccgacggcgccgcactggagaaagtgcacgcctccggcatggaccagcagcaaccccaccgccagctcgagcacgcccggctcgccttcgcggcgccggcgatagagctgcatgttcagcgaagccaggacctgccgcgccgcctgcgcttccggccaaccctcgggggtacaggcgtagtcggcgaacagggcgtcgagatggccttcgatggcctgcaccacgttggcgcaaccgcgtccccagagcagcgccaggagaaacgccggagcccgtccggggcgaggcgcgagccattcggcgcgaacccgcgcggcctgccccgggaggtcgcgcccggcgcccagggcgagactga

SEQ ID NO: 15281 - DNA, 1110 bp, Pseudomonas aeruginosa
aggaatacaccgacctgccggccctgctgctggaacagatcaagcacttcttcgagaactacaaggatctcgagaaaggcaagtgggtcaaggtcgaaggctggggcaacgccgacgccgcccgcgccgagatcaccaaggccgtggccgcgttccagaagtaagcgcgcctcgccgaaaagaagccccgcagccgcggggctttttcattctccctcgccgaccgccaaggtcggtctcgccaccccgctccgctcagtcgaccgtcgccacgctctccaaccgatatccgtagccgtagatggtcagcaactgccaaccgcgctcggcggtcaggccaagcttgttgcgcaggcgatagatgtgggtatccagcggccgcgaggacaacacttcctcgtggggccagaagcgctcgtagagatattcccgcgacaacggccgtcccaggttggcgaacaggcagcgggccaggcggtattcgcgttcggtcaggctgatcggcgcgccggcccgggtcacggtcagctcggcatcgtcgaagctgaggtcgttgaaagtctgcacctcatgctgcgcgggacgcgttcccccgtggcgacgcagcacggcggctacccgcgccttcagttcgttgggtcggaacggcttgctgacatagtcgtcggcgccgctgttcaacgcctgcacgatgtcctgttcggcgtcacggctggtcagcatgatcgccggcggcggcgcatccagatgctcgcggctccagcgcagcaattgcaggccgctgaggtccggcaactgccagtcgaggatcagcaggtcgaaggtttcccgcttgagctgcttgagcaggtcctcgccacgggcgaaacggtgcaccgtccaggcctgttcgccctgcgcgggtatctgctgcaaggtctgctcgacccggtccagttcggccgactcgtcgtccagtatcgcgacacgcataaaagctggtcctgttcaatcgggctaacgcccctttttcgctccaggaacggcgaattacgtacaaatctgaagaattgtgacgaatctctctggtcgcgaccagcccttgatagcctgattccaaatagccattaa

SEQ ID NO: 15282 - DNA, 939 bp, Pseudomonas aeruginosa
gccaaggagcaaatggattgctccgacacagggatgtgtaaacccgctccggcgggccgtggaacgagaccactcgaaccacagtcaggggtcggtaacggacgatcgccccaggcaaccaagccaatccccccagggctggcttcgacacacggatgtgtcatctccccttccttgttcgaatcatcccctcccgctatccggacgcctcgatccgcgtcccatcctggatctgaaaaggacctcatcatgaagcaatacggagcagagttcttcggcaccttctggctggtattgggcggctgcggcagcgcagtactcgctgccggcgtaccggaactgggaatcggctacctcggcgtggccctggcgttcggcctcagcgtgctgaccatggcctatgccatcggcccgatctccggcgcccacctgaaccccgcggtatcggtaggcctgtgggtcggcgggcgcttcccggccagccaactgctgccctatgtcgtcgcccaggtcctcggtggcctcgccgccggcggcgtgctgtacctgatcgccagcggcaaggccggcttcgacctggccgccggcttcgcctccaacggctacggcgaacactcgccgggcggctactcgttgcaagccgcgctggtcagcgaagtggtacttaccggcatgttcctgctgatcatcctcggcgccacctccaagcgcgcgccgcagggcttcgcgccgatcgccatcggcctgaccctgaccctgatccacctgatcagcatcccggtcaccaacacctcggtgaacccggcgcgcagcaccgcggtcgccctgtacgtcggcgactgggcggtttcccagctgtggctgttctgggtcgcgccgattctcggtgcggtactcggcgccctggcctatcgcctgatcggcgacaagaacgactga

SEQ ID NO: 15283 - DNA, 1044 bp, Pseudomonas aeruginosa
ccggaccgccagcgatacctgacccgccgcccagtgaagcctatgacagccctcgcccttacttcccgatccctctttccggcttgcgccgccctggcgctgggcggactgttgacgctgctcgccggctccgtcgcggccgcgccggccaagacgaaacggccgccgttcatcgagcagggcgaaacgtgcctgccccagccgctccccgccagcgtgctctacctcgccggcgacgcctggaagctcgacgccaagggcaaccagacgcccctggaagaaggcatggacatcgacgaactggaaggcgtcaagacctctccgaccgccttcgtcagcctgctgctcggcgacggcagccgcatcgtcctgccctccagttcggaagtcaccctgcacctcgacgaggacaccggcattccgcagatcgccctgcgcgcggggcaggtcgagtcctatgtcctgaagagaaagagcgatcacgaccgcttccaggtgctgaccccggtcggcgtactgggcgtgcgcggtacccacttccgcgcccgcaccgaagacggccaggcgctgaccgaagtgctcgacgggcgcgtcgcggtgaaccgcgagctgaccagcgacgacctgccgctcaacggcaggcgcccggcccgcaaggcggcgcaggccgagccggacgaggacgtgctggtcgacgcccgccgcggcctgaaggtcaagccgcagggcaagctgacgccggtggacctgctacccgccccgcaattgcgcggccagggcggcgagcacggcgagtcgccggtttggaagctctatcttgccccgctgcacggcgccaagcgctaccgtgcccaggtagccagcgatccggacttcctgcgcatccagcaggagcgtttctcgagcaccccggaagtcagtttcagcggactcaaggcggccttctaccacgtccgtctctcggccttcgacaacgacggactggagggcgagaccagcgtatacgacattctctactacccgcgaggcggcagtgcccgatag

SEQ ID NO: 15284 - DNA, 2319 bp, Pseudomonas aeruginosa
ggcaccggggcctcgccgatgaaggcgctcgaccgccaggacgagcccagccaggcgcagcggctgttccgcggcctggtgcgcgaatggctgctggtcagcctgctgctccttccgctcaccgccctgctttcgctgagcagcggcctgccgctgaacaacctgctctacgaccgcctgcgcaacctcgccccgctggccgtcgatccgcgcatcctcgtcgtcgccatcgacgaccgtagcctggaaagcctcggtcgctggccctggccgcgcagcgtccacgccgagctgctggatcgcctggccgccgccggcgcacgcagcgtactgctcgacgtgatcttcagcgaaccctcctccaatccggacagcgaccgccagttggcaagatcgctgtgccgggccggcaacgtcctcctgccactgctgcgcgaaagcgtgccgcgctacggcgaaccgccacgggagataccgccgaccgcgccgctggccggctgcgccgccggcatcgggcatatcaacgtcgaagcggacagcgacggcacggtgcgcagcgtctacctgcgcgaaggaccgctcggccagccgcgcccgctgctcgcctggcaagcattcgccgatgccggcgccatgcccatgcccggcctcgacgacatgcgcaacctgcccggctggcagcgtgaccacgccatccgcattcccttcatcggtgccgacgcgggcttccccagcgtgccctacgtcagcgtgttgcgcggcgaggtgccagacagcctgctgcgcgaccgcctggtcctggtcggcgccaccgcgccgggcctcggcgaccgctatgtcaccccgctgtcggccagcctcggcaccacgccgggggtggagatccaggccaacattctcaacggcctgttgcagcagcgcaccgccgtcgacctgcaaccctggctcgccgccctgctctccgccgccagcgtagcgctgctgctcggcctgatgctgttccgctcgcgccacgccttgctcctcaccctggcctgcgcggccctggccctgggtctttcctgggcgctgctgctcaacggctggtggtggtcgccgctggccagcctggtcggcctgctgctggcctacctgatctggagctggcgccggctgaacgcggtgctcgcctacttcggctgggaactggcgcgcctcgaccgcgagcccaaggtgctgcccgagcgggccagccccccgcgcgccggcaacgatccattgcagaaccgcatcgccgccctggagcaggcggtcagccgcacccgcgacagccggcggttcatggccgacggcctggaatgcctgccggtggcgaccctgatctgcgacccgcaggggcagatcctgctggccaaccgcaaggcacgcgacctgttcggcggcgagctgcgcggcgccgaactgcgccagcgcctggccgaactcggccatccgagcctcgccggtggcgcccgcccaacgctggaaaccctggaagccatcgagttccgcgaccaccgggaacgcgacctgcgcctcgacctggcgcgcctgctgccggtcgaaagcgaaaccgccatcggctggctggtgagcctgatcgacctgagcgccgaacgcgatgccgagcgccagcgcgccaccctcctgcgcttcctctcccatgacctgcgcgcgccgcactcggcgatcctcgccctgctcgacgtccgccccgccgaggacgaagccggccagcaggtctaccgacagatagagcagcaggtccgtcgcgccctgggcctgaccgacgccttcgtgcaactggccaaggccgaatccgacgcctaccgcttcgaagcgtgcatgttcaccatgttggcgatggacgccgccgaccagctctggcccctcgcgcaacagaaagacatcgacctgcggcgcgactgggacgacgagcaggaaccgatggtctgggccgaccccggcctgctcacgcgcgcgctgttcaacctgctggagaatgcggtcaagtacagcccggcggggaccgtcgtcagcctgagcatccgcctcgaaggcgactggctgagctgccggatcgtcgaccagggcaaaggtatcgcggccgccgaactaccgcgcctgttcagccagtaccagcgcttcgcttccgccgagggcagcgccggcctgggcctggggctggccatggtcaagacggtgatcgaccggcacggcggcaggatcggttgccagagccaggttggccagggcaccactttcgagattcgccttccgctgctgaaaggcgaggaataa

SEQ ID NO: 15285 - DNA, 1416 bp, Pseudomonas aeruginosa
cctgcccgccctgcgcaactacgcccgccgcgtcgaggaagtgctggacctctatgcacggcggagccatggcaatgtccgattgttcgtgatcgatcccctgccattctccgacgacgaggaccgtgccgcgcgcttcggcctgcaggcgccgcccatcggcccgaatggcgaagccatctactttggcctggcggccaccaacccgaccgacggcctccaggtgatcccgttcttctcgccggaagaagagccgcttctggaatacgatctcagccgcctggtccaggcactcgcacagcgggaacgcacggtagtcggcctgatgagctcgctgccgatgaccgggcaggcgcccaccgacgggcagccgggcagcaggccctgggcgatgatggacaagctctaccaacagttcgacatccgcaccctggggctcgcttcgacggaaatccccgccgaagtctcggtgttgatgctggtgcaccccaggcaattgtccgaacagacccaatacgccatcgaccagttcgtcctgcgcggcggcaagctgctggccttcgtcgaccctctgagtctcgccgatgcagacggcgggaaaagctccgacctggccccgttgctgcgctcctggggcgtccagttgcggccggataccctgctggcggatgcctcgttcgccatgatcaagccaaacgccgaacgtcgcccggagcgcaatccgacctggctacacctccccggcgacacgttcccccacgacaacgtgctgaccaccggcctggaaagcctcaacctcgccagcgtcggcctgctcgaacctctcggcggagcctcgacgcgcttcattccgttgctgcacagctcggcgcacagcatgccgctgtcgctggaacgcttccgccaatcctcgacggagcagctcaacgccaccctggtcccgaccggggaacgctacgtgctggccgccaaggtcgaggggccggcgacgagtgccttccctgcggaccgcgggaagcaaggcgaaggcctgagcgacagcgcgaacatccatgtgctgttggtcgccgatacggacctgctgagcaatccgctctggctccaggaacagcccggccacaacgagccgcaggtatgggcggacaacgacctgttcgtcggcaatgccctcgactacctctccggttcggacgcgctgatcgacctacgctcgcgaggccatacgaagcgcccgttcacccgcgtggaagcgctccgccgcgaggccgggctgcgcgcccaggaacagctcaacgcgctgcagcaaagcctcaacgacaccgacaggaacctgcgcaccttgcagcaatcgatggacgccggcgaccaggaggtgactccggaaatggaagcgacgctgcgccgcttcatcgatga

SEQ ID NO: 15286 - DNA, 294 bp, Pseudomonas aeruginosa; identical to SEQ ID NO: 9314

SEQ ID NO: 15287 - DNA, 666 bp, Pseudomonas aeruginosa
ataatgctttttgaagagctgtctaatatgtcaccaagagacctcattttaagaacgcgggagtctcttcgagatacatatgaaagcctttttggaaatactcaatttgatgaattcatcctcgcggtcagggacgacataaaaaaaggtaagatcaccgagactgtgcttaataacaaatggctagagcacatagctgtagatcaaatatccccaagctaccctttcctttacgcctgtgttctgaatgagttggcgcagcaggctcttgacgctggaaaccacaatcagagctggcctttaatcgcccatgccagcgcgagtgcagaaggagcagccacccatacgttctataacactgtgattaacactacagaagctttaaatcataacagagcaatggcaggtgccaatgctcgaaatgaaaagttccaaatggtgaaagactacgctttaacactcatgacagagaagcgccccaaacacggctggaacgacttcatgcacgcagcggaatcgattaaaagtgaactagtaaattttattatcttggagaaagtcagcctaagccaagatcttattgtaaaaacccttcagagatggttaaagaaagatgagcactttcggagcgccgtcactgaaataatccccacgttcaagctgtag

SEQ ID NO: 15288 - DNA, 852 bp, Pseudomonas aeruginosa
cggagactcttcccatgcatggaatcgtcacgctatgatgtgtttacgaccacggcatttacgacccatttctataaaaaatcctgcctttggcatctaaaatctgcggccccccctttaatccaatccagcccatcaaccaccaataaaggaataattgtggaaaccctcgtcaagactgcactcgctgcaacaatttttcttgcaacacatgcctacgcaaatggtcatccagagttcgatcaatacaaaacgtccgacgtaatcctctgcgaaagcaccggacgggtgatgtatgggttcccgcttactctttgcttagaagaaagtcgccctggaaaacacgtagtgcgttaccagaatcgtgagactggtgaaatcactatgaaagaagaggaaacatttgaatacatacgctgctctaaagcgcaggacaaatgtaccgaccgagatggcaattacaggggaaagttttccgctccaagagacacatactacgcaatctttaaagatttctatgtgtacccagggaatgatggtaaagactatgcctataagaccggaacagggcctctatttggcggtgcggcggctgcaagcgtagcagcacagcctgcggcacgtttgactgcaacaccgacagcaacgggcacatacgacgtatggtgcgacccacaaggcgactcatgtgaaataactatcgatggaggtgacgacatggtcagccgcgaacggcttcccgtatatgtcccaatggcctcagacaccaataactgcacattagagttctgctacaactcaagccaggatgtgataggcctaaatcccgactaccacctttggaaaaaataa

SEQ ID NO: 15289 - DNA, 1014 bp, Pseudomonas aeruginosa
gcgcttagcacgggtgtccttcctacccgcttcggctctatccgcccatcagtgcgccctgtcctgccctttcagcgtcctcgcacccagcgagccacctgtgcttgtcttttcttgttaccattcggccttggaaaactcaggccggagactggatggatggctgctagcgagaaaacgataatcattgagagaattttcgagacgctatatgacgagaccactaaggagttttcccgcaccctggtgacatctgaggacgtccaagaagcaaaacgctactgcgcagagcatcatggaaccaagatgaagctagacggtaatccttacaacttcatgaaagatatcgtaagaggaaaaagcgcatctagaatttggccgcaacggttgaaagatcttgggattggaggtgtccaaaggacaggagatggtgccatttttgaattcgttcatggcatagagggagctctcgacagccttgacgaagattttcgcccttctgagtcgacccccaactttcctgtgcaaagccttagcctaccgctagcatctaaggcattagggcgtacggatgagtcatggcttcttcaggtagcagtaaacctgcgagtaatagaaagccacttcgccaactctaagcacagccaaattgaagcgttagagcttacacatcttcagatggacataaaactaagaaaagtccagattgatgcactgtttcgcgcactacataccacacccgatggcggcccttcagatgctttaatcaccgtggaggccaaacagggaaatcaacgaattctgaccgagcaaattggccgccaagtcatagcagctttcgagtctactgaaaccgaacttgtaattccagtagctattgcggctgtaaaaaacaaaggtatttacgttgttgaattcaccgcagtgcatagacaagaactagataaatttagcgccccgcaattccaccgagacgctatgtttatacttcaaccaaaagtcaaaggtatctaa

SEQ ID NO: 15290 - DNA, 606 bp, Pseudomonas aeruginosa
ggggcgcggctgtcaaattggtggagcagcgtgccgagcagcggcccgctgatcaggccgaagccatgtacggccaccagggtgccggcggcggcaccctgttcctcggcgcgcacggcattggcgttgagcaccgagactgccgggaatacccaacccatgcccgccgcggcgacgaagaaggccagccagagcagcggcggcgagtcggcgaagcacacggcggcgaagccgatggcggcgaccagcccgccgacccggatcagtcgcggcggtggccagtccaggcggcgcaccaggagctgggccaggatcagcgcgacgcccactgcggtcagggcgatgccggccacccgcgcggcgtcggcggaatccaggcgcagccggtcgagggcgaagaagcccacggtgatctgcgccacggtgacgctgaacatcgccacgaagcccaccgccagcggccgccgcaggcggcggtcgccgatcgccagggcggcgccgcggttcggctggcgacgctcctcgcgcggcagccagcgccagagcgccagcagggcgaccaggggcagcgcgccggtgaccagcaacggcaggaccagcccgtga

SEQ ID NO: 15291 - DNA, 2016 bp, Pseudomonas aeruginosa
tgctcgatctcctcgtggaagatcagcggcaacccggtgaggcaaagcatcagcaggaagatcgtggagatcaggctggtccatttgtgcaccaggtaccaggtgcgcagggttttcgcggtcattggctggtcatcggcggtttctggttatggtggggcggactcagaagtccgccgtgagggaaagggaaagggtgcgcggcgagctgatcgacaggtagccgttggctgcggtccagtagtccttgcccagtgcgttctccaggttggcgcgcgccaccagcggcttgccggcgacctggaaggcgtaggcggcgccgaggtcgacgcggttccagtgcggcacggcgagggcgttggcgctgtccacataggccgagccggtgtagatccagcggctgtcgagggtcagtccgtcgacgaacggggtgtcccagctgacccccaggttggcctggcggcgggccacgccgggcgcgtccttgccttcgctggcagggtcgccggtcttgttctgctcgggcttgatgtaggtggcgccggccatcacccgcacgccgtccagcggttcgccatagaggctcagctccacgccgcggttgcgttgctcgccgtcggcgcggaagacgttgctggcgtcggtataggcgttcggtttcctgatctcgaacagcgccagggtggtggtgaagccgcccaggtcgtacttggcgccgatctcgtactgctcggccttgtatggcgccagcacctggccggcgttggccgcggtcatcggcgccgcctcgccctggctgaggccctggatgtagttggcgtacagcgacaggtcctgcagcggcttgaccagcacgctggccatcggcgtccacacgtgccgcttgtcgtggctggtgcgcgcgccgctggtctggtcgtagttgcgcgactcgatctgctggcggcgcacgcccagggtgacctgcacgcgatcatcgaggaacgacagcctgtcggccagcgccacgccgccgaggtcggtttcattggtcttcggaatgctcccgtcgaggctggagaagtccggcagcggcgtatgcggcgaggtctggtagaggttgcccggctgcatcccggtgaaggcatagaccatgcccagccgttcgtgcaggcggttggcgctgagcgtccagtcgtggcggagcgggccggtgtcgaagttgccgcgcaggccgacctcggcggaataggtgcggcggtcgccgcgctggcgtgccaggctgttgacgatatcgccctggttgccgacgaggatgctgttggcggcgatggtttcgtagttgctctggcggccgccgatgctggcgaacgccgtcaggttgtcggcgaggtcgtactcgccgcggttgaccatggagtaatcctcctggtccaggtaggaatcgcgcaggccgaagcgtgtcttcgagtccggggcatgggggatgtgggtggttcccgggccggtcagcagcgggcgcaccacgccttccaggctttccttctggtacagcaggtcgctggacaggcgcaggcgctcgccacggaagtccaggcccagggagagcatgggaaactcgcggctctgatggtcgacggcggtatcgccgttgcggtagacgccgttgaagcgcacgccgaaggcgttgttctcgccgaagcgccggccgatgtcgaggtgagtgccgagctggctgcgctgggtccaatcgacgctgacgcgggtcagcggctggtcgtcggcgcgcttgggcaccaggttgatggtgccgccgacgctgccgccgggggaaatcccgccgagcagggcgtttggtcccttgagcacttccacgcgctcggcgaattcgatcggtacccgccagaacggcagcaggccatagagaccgttgaaggcgacgtcggcgttctgcacgctgaagccgcgaatcgtgtagctgtccaccaggtcgccgcgcccgccgaccacccgcaccgacggatcgttggcctgtag

SEQ ID NO: 15292 - DNA, 792 bp, Pseudomonas aeruginosa
caggtcggcgacgctgcgcgcctgctgctgctcgatggtcctggcggtgtagctggtgatgctgaatggcgcgtccatcacgtcggcgttgcccagcatgcccaggcgcgcgccacgggctacctggccgccggcgtactcggcgggcagggtctcggcaccggcggcctgggcggtgatcagcgaggattgcagttccagcgcgccatcggtggttgccggcaccagggtgtagctgccgtcgctgcgctgctgcaactccaggccgctgcccagcagcaggcggtgcagcgcctcgaccggcgcgtagcggccgcgcagggcggcgctgcggcgaccctcggtgagcgccgggtcgaacgccagggacaccccgttgtcgctggcgaaggccgacagggtgcgaccgagcgggccgggggcgatgtcatagctgcgcgccgagctggcggcgggcgcctcggcggcaagcagggcgggggccgctccggcgagggcgagggtcatggcggcggcgtggatggccagggacagcgaacgggggcgaagcgtgcgtacgggcatgtacagggttcctcgtggtctctgcggaccttgggtcggggcggattcctctacttgccagccgagaaggaaaaaggtctcaggtcgaggcggttatttttctgcggagcacggtatgtcgatggcaacgcctgttccggcgcaacggcggacggcctgccggggtggacgcgagggggcggttgccacggggatggcggccgcgccgtcacgccggcaccaggctga

SEQ ID NO: 15293 - DNA, 516 bp, Pseudomonas aeruginosa
cgacacaacggtcgccgggaatggctgtgggccagggccagacgcgcttcgcgcaaggcctcggcgcaacgttcggcacgacggagcggggcgctcacgcccagcgagctgtccagggcttcctgcagtgtcgaggcgaggccggcctggtgcagcaaaatgatttcctggccctgcgcgcgaaccagcaggcgtgagtcgtggccccggaaaagaccgatagggtcggtcgcgagcccctcggaacttgccacggaaacgactgcatcgtcgagatcgagcccgggcagcagttcctccagccgctcctcggcttggttccccggtatagccgtccgtgcagcaggtcgtggagcaattccgaacccaggcgcaggtggcgttcgctttcgacgcgcagccgttcgatctctatgccgagcactgccgtcaggtggtgcaggagactgtagtccggcagccgctcgcccagggctatcagcaggcagttccggtcggaaggaatgccgatgctga

SEQ ID NO: 15294 - DNA, 2157 bp, Pseudomonas aeruginosa
cccatcacgcgggtccagacttcgcagcgctggcgctggccttcgggcaactggttggggttcatcggtggtactccttgctggtggatgaaaggaacgacaggcgactcaaccgccgcagccgccgcaacagctcttgggcgtggagcgttgcagcagctcctcgtcgcacttcgggcagaactcgtgctcgccggccaggtagccgtgccgcgggcagatcgagaaggtgggggtgacggtcaggtacggcaggcggaagcgaccgagggcggtgcgcaccagggtcttgcaggcttcggcggaggaaatccgctcggccatgtagagatgcagcacggtgccgccggtgtacttgcattgcagggcgtcctgcagctccagcgcctcgaacgggtcgtcggtgaagcccaccggcagttgcgaggagttggtgtagtagggtgcctccggcgtgccggcctggaggatgcgcggatagcgcttgcggtcctcgcgggcgaagcgataggtggtgccctcggcgggcgtggcttccaggttgtagaggtgcccgctgtcctcctggaaacccaccagccgcgcgcgcacgtgatcgagcagggccagggccatctcgcgcccggcttcgctgtgcagtccctcgcggtcgtcgctgaagttgcgcaccatctcgtgcaggccgttcacgccgatggtggagaaatggttgcgcagggtacccaggtagcgtcgggtgtagggatagaggccggcatccatgtgctgctggatcaccttgcgcttcagctccaggctggcgaaggcgagttcgagcaggtggtcgagctggcggtagaggccggcggcgtcgccacggtggcgatagcccaggcgcgcgcagttgatcgtcaccacgcccagcgagccggtctgctccgccgagccgaacaggccgttgccacgcttgagcagttcgcgcacgtccagttgcaggcggcagcacatcgagcgcacctggttgggctgcatgtccgagttgaggaagttctggaagtagggcaggccgtagcgcgcggtcatctcgaacaggcgcgtggcgttgtcgctgtcccaggggaagtcgtgggtgatgttgtaggtcgggatcgggaaggtgaacacccggccatgggcgtcgccggcctgcatcacctcgatgtaggcgcggttgatcaggtccatctcggcctgcagctcgccgtaggcgaagggcatctcctcgccgccgatgcgcggcacctggtcgcgcaggtcgtccgggcagacccagtcgaaggtcaggttggtgaagggcgtctgggtgccccagcgcgacggcacgttgaggttgtagatgaactcctggagggcctggcgcacgctggcgtagtcgaggcggtccttgcgcacgtagggcgccaggtaggtatcgaaggagctgaaggcctgggccccggcccattcgttctgcagggtgccgaggaagttgaccatctgccccagggcgctgcccaggtgcttcggcggaccggcctcgacccgccccggcacgccgttcaggccttcgttcagcaaggtgcgcagcgaccagccggcgcaatagccggcgagcatgtcgaggtcgtggatatgcaggtcggcgtcgcggtgggcggcggcgatgtcggcatcgtagacctcatccagccagtagttcgcggtgaccttgccggatacgttgaggatcagcccgccgagggaatagccctggttggcgttggcgcgcacccgccaatcctcgcgggaaaggtattcgttcatcgacgcggcgacgtccaccagggtcttgcgctcgcggcgcagccggccgtggcgttcgcggtagaccacgtaggcgcgcgccgtggggtagtggccggcctccatcagcacccgttcgaccaggtcctggacccgttcgatatccaggcaggcgcgttccggcaggcgttccaccacgcgttcggcgagcgcctgcgcctgctgcgggtcgaactcgccggtggcttggccggcggcggcgatggcgcgttcgatcttgccgggatcgaaagggacttcacgtccgttgcgcttgagcagggtggccggccaggtagccttccggggctgggtcatttcaacttctccacaacatga

SEQ ID NO: 15295 - DNA, 1437 bp, Pseudomonas aeruginosa
  unsure (1253): Identity of nucleotide at the above locations are unknown.
cttataaatactcataattcatacctgccgaccatgaccccccattcctccccgcaccgtcttcctccgctgcggctggcccgcgccgtgccgttcctctacctgcttccctgcctggcgctggccgcgccggtcgacctggagccgaccgtggtcagcgccaccactaccgagcgcaagctgcgcgacgccccggccagcgtttcgctgatcgccgccgaggacctgcggcggcgcccggtgcgcgacctgcaggaagccctgcgcggttcggaaagcctgcagttcaacggcgtcggcatgtcccggcggggcatcagcgttcgcggcatgtccagcgagcacaccctggtgctggtggacggccagcggatctccacctcgtccggggccatcgcccattccgacttcgacctcggctgggggccggtggagagcatcgagcgcatcgaggtggtacgcgggccgatgtcctcgctctacggttcggaagccctcggcggggtggtgaacgtgatcacccggcgcgccaccgatacctggatgggcagcggtctgctcgatggcggcgtgcgcgaggacggcctcggtgggcagagccaccagctcggcgcctatctcgccgggccgctggtgcccggcaagctgggcctcgccctgaacggcgagagccgccgccagcaggaaaccccggacgccgatgagcgccgactctccgagctggaaggcggcaacgccgacagcggtgggctgaacctcagctggaccccggacgacgcccagcgcatcgacctcggccaccagcgcgggcgcgaacgacgctggcgcaacagcgagaccggagggccgcgctcgcgctactacgagtcgcgcgacgtgatcgaacgcgagcgctggtcgctcgcccacaatggccagtgggactggggtagcagccagctgcgcacctaccgcaaccgcctggagcggcacaacacgcgttccgacggacaaccgccgagcaacccgcagcggcttaccgacagcgtggtcgacggccacctcagcgtgccggccttcgagcgacatctcttcaccctcggcggcgaatggcgcaaggaagaactggaggatcgctcggtgaataccgccggcgacgccagcgcgcgacacaaggcgctgttcctgcaggacgagatcgccttcggcccggactggtcgctgaccctcggcagccgcttcgacaagcacgaggcgttcggctgggaaagcantccgcgcctgtacctgctgcaccacctttccgatgcgctgaccctgcgcgccggcgtctgccgcggctacaatgcgccgagcctgaagcagctatctccggagtatgcagcggtcggtggcggcgggcgcttcaccatctacggcaatcccgacctgagaccggagaccaatacgtcctactaa

SEQ ID NO: 15296 - DNA, 558 bp, Pseudomonas aeruginosa
  unsure (18): Identity of nucleotide at the above locations are unknown.
ctgggcgccgactaccanagccaatgctggtcgcttaaaggcacagtgttctacaacgatgtccgcgacctgatccagaccgtctgcgtagcgcgctgcggggtgcgcggcggcgagatacgcaactacgagaacgtcgatagggcacggatccgcggcctcgagctgggcggcggcgtggacctgccggcggacctgcgctgggaactcaactacacctacctcgacgcgcgcaaccgcaccgccggccagcgcctcggcgatcgctcccggcacctcgccaacagccaattgcgctggagccccaatgcccgcttcagcgcccagttgcgcaccgaatacgtcggcagccaggtggcctacagcagcaacgtcggctacgccttgccggcctacagcctgtggcacctggagctgagccagaaactcagcgagaacctgacgctgcgcggcggcatcgagaaccttggcgaccagcgcctggccgacgacgacacgcacttcacctatgccgaacctgggcggaccttccatctcggcctggtggcgagcttctga

SEQ ID NO: 15297 - DNA, 774 bp, Pseudomonas aeruginosa
acgacgacctgggctggagcgaggcagcgatgcgcgaggatttcccggcgttcctcggcgtgctccacgaccacctgcaccgactggccggctcggcgatgccgctggggctgcacaccttcggtgtcgccgcctcgccggagctgcgcctgggcaccgtcatgcagcagctcggcgagccctactaccgcgcgctcggtctcgaccccgacgaactgttcgccgccgatttcagggcgctgcgggaaggtcgtgcctaccgcacgctgcaacgctacctgcgcgacggtggcgagatcgccaaggtggccgatccgcgcctgcgcgagcagttgctgcgcgcccgcgaactggaccgccagctcgccgacaccggcgaactggaggcgctgctcgccggcctcgccgggcgcttcgtcgcgcccgggccgggcggcgatccgatccgcaatccgcaggtacccagcgggcgcaacctgttcgccttcgaggccgacaaggtaccgacccgcgccgcctacgaagccggcgccgaggccttcggccaactgctggaaagctaccgcgccgagcaccagggcagggcgccggaaaagctcgccttcagcctctggtcgtcggaaaccatgcgccacctgggcatcgtcgaaagccaggcgctgcacgccctcggcctgcgcccgcgctgggacgccggtggccgcctgctggcgctggacatcgtgccggcggcggaactggggcgtccacgggtggacgtggtgctacaggtga

SEQ ID NO: 15298 - DNA, 774 bp, Pseudomonas aeruginosa
agggtgtacaggcggcgatcctctcgcgctcctcgacgctcaacggcgtgctctccaccgaccacccgttcgagtacctcggcggcctgtcgctggcggtacgccacctcgacggcgccagcccggcgctgtacatcgccgacctgcgccagcgccagccgcgcaccacggccgccgcgcagttcctcgccagcgagctgcgcgggcgctacctcagcccgcagtggatcgccgcgatgcagcgcgagggctacgccggcagcctggaaatgctcgacctggccaacaacctgtggggctggcaggcggcggatcgcaccatggtccgcgccgaccagtggcaggcgttgcacgacaccttcgtcatggaccgccgcgagctgggtctcgccgagtggttcgaaacgcacaatccgaccgcccaggcgcagatcatcgcgcgcatggccgaggccatccgcaagggctactgggacgccagcgagcagacccgccgcgaactggccgagcgctggcggcaactggcggccgccggcgccggcgaggtcggcgcggcgaccacccgtgaattcatcgaacggatggccggcggtttcggcgaggccgcggcgcaggcagagggcgcggccgcgtccggtgccggcgaaacggtcagcggccgcgtcctcgaagaagtcgcgccgccgccgtccggcgagccgcagccgtggctccggctggccgccgccgtgctgctcgcgctgttcgccgccggcgccgtccggcaatccgtag

SEQ ID NO: 15299 - DNA, 831 bp, Pseudomonas aeruginosa
tcaatcgtcgtccgatggaaaatcgctcatgaatggtctggaaaccagcctctacgaactcacccgcctgttcctgctgccggtgctgctgttgatcctcgccgcgctggcctacgccttcgtcgccctcggcggcttcgccatggaagcctggcagcgccgtcgcgggcgctaccgctcgcgcctggcggcctggcaggcgctgcatggcggcaacagcgacgacctcgaactgtggatcatgcagcgcctggaatggctgcggatcacctcgcgcagcgcgccgatgctcggcctggtggcgaccatgatccccatgggaccggcactgctggcgctgacccgcaacgacgcccaggggatcggcgagaacctggtggtggcgttttccgcggtgatcctggccctggtcgccgccagcatcaccttcttcatccttaccgtgcgtcgccgctggctgctccaggaactgcgcgccgtcgaacgcgcgcgggaggccggctgatgcgcttcctcgaacacgacgaggcggacgacccgatcctctcgatggtcaacctgatcgacctgttcctggtggtgatcggcatcctcctgatcgtcatcgtgcagaacccgctcaacccgttcagccaggacaaggtggtggtggtcgagaatcccggcgaggcggacatgcgcatgctggtcaaggacggcaaggagctgaagcgctaccaggccagcggcgagatcggcgaagggcagggcagccgcgccggggtgacctaccgcttggccgacggacggatgatctacgtgccggagagcggcggggaggccggcaagtag

SEQ ID NO: 15300 - DNA, 216 bp, Pseudomonas aeruginosa
cctacctgtggctgggcaagggcaagggcgccgagttcgacaggctcgacctgctggaccgcctgctgccgctctacggccagatcttgcgccgcctcgccggccagggcgtggagtgggtgcagatcgacgagccgatcctggtcctcgacctgccgcaggcatggaagaacgccttcgagcgcgcctacaacctgctacagagcgaaccgctga

SEQ ID NO: 15301 - DNA, 648 bp, Pseudomonas aeruginosa
cagggtgcgggcgcgggcgttgtccacggaaaaataccccgggtcgcgcagcggctcccatggcgccaggtgctcgcggttggcgttctcgtagcggctggtccggacgaaatcgtcgggttgcagcgcgcgcaggaggaagtccgcgtcgcgatgcagtatcggcacctgccgccggttgcccggcaagaccctcgggtagccgggcgggaagggcgccagggcagatttgaagtcattcatagaacttgcccgccagcatcagctgcgccgcgcgccgccaggcattctccggcctggaatagcccggcaggccgtcgtgggagtcctcgccccaggtcgcggcggcatcgaggaagccaccgatgctgccgttctcccaacccagcgggctggggccgaacggtttcggcgggttggcggcggcgaggcggcggtcttcctcccagtccgccgccagcgcggcgaggaagtgcaggaaacccgcttcgtcctcgacctgttcggccagcgcgtagagatcgattgccatgtgcttcctcctggaagtgggtttcgggatacgacggcgcgaggtcggagcgcggtcagtccgggcgcagcgatcatagcgcggaccggcgctggcatggctcgcagcctggctga

SEQ ID NO: 15302 - DNA, 1359 bp, Pseudomonas aeruginosa
gacggctatctccggttctccactccctcgcgatggacaggcgccatcaaggagtcgtgcgcgatgctcttcggcagaaaaagcagggcggtggaaagcgccgccaaggatgaagacctggcgtggcgactcgatgccatcgggcagaacgtcgccaccatccgtttcactcccgatggccagatactgtccgccaacccgctgttcctcgcggtggtcggctactcggcggacgagctggtcggcaagcaccatcggatcttctgcgacgaggacttccaggcctccgccgcctacgtgcgcttctggaaggaactggccagcggcacgccccagcgcggcgtgttcaagcgcctgcggcgcgatggtacgccggtctggctggaggccacctatttcccggtgaagaatgccgaaggggcggtcgtcgaggtgctgaagatcgccgccgacgtgacccgcaaccattccgaactgctcctgctcaacgcgatcaacgacgccatacgccagtccatggcggtcatcgagttcaccccggacggcgagatactcgatgccaacgaaaacttcctgcgtctcttcggctacagcctcaagtcgctcaagggccagcaccaccgcatgctctgcttcgacgagttctatcgggagaacccggatttctgggctcggctgcggcacggcgaattctcacgcgggcatttcgagcgccgcagcgccgccggcgagcgggtacatatcgaagccacctacaacccggtcaaggacagttcggggcggataatcaaggtcatcaagttcgccatcgacgttaccgagcaggtcaatcgcaacgaggaagtacggcgcgccgccgagctgtcgttctccaccgcggaagagaccgcgcagatttccacccgcggcatcgactccctcgaccagtccgtcgccctgtcggccaagaccctgtcgatggtcaacaccgccgtcggcctgatttcccagctcacccaccagaccaaggacatcgagaacatcgtcaccaccatccagagcgtcgccgaacagaccaacctgctggccctcaacgccgccatcgaggcggctcgcgccggcgacatggggcgcggcttcgcggtggtcgccgacgaggtgcggcaactggcggcgcgcaccagcggcgccacggtggagatcaagaacgtggtcaccgagaacgtcaagctgacccagcagatcaaccacaacatgcagaccatcgagtccagcgcccaggagaacaacaaccagatcaccaccgtggccggcatcatgcaggagatcagcaagggcgccgagcacgtggcgcgggtggtgtcgagcctgttcaagtga

SEQ ID NO: 15303 - DNA, 1194 bp, Pseudomonas aeruginosa
tgccttccagtgcggctactgcacgcccggacagatctgttcggcccttggcctggcgagcgaggggcgggcgcgctcgcgggcggagatccgcgagggcatgagcggcaacctgtgccgctgcggcgcctacggcaatatcctcgacgctgtggaagacgccttgccgctgctcgatcgcgacggacagggagggcagcgcgcatgacgcccttcgcctatgccaagccggccgacatcgagcaggcgctgggcctcgccggcccggagtcgcgctacatcgccggtggcactaacctgctcgacctgatgaaggaaaacgttgccaggccccggcgactcatcgacatcaccggcctcccgctgcgcgacatccgccggacgcccaccggcggcctgctggtcggagccctggtcagcaacgccgaactggcctggaatcccgccgtggaggcggactatcccttgctagcccaggcgatcctcgccggcgcctcgccgcagttgcgcaacatggccagcacaggcggcaacctgttgcagcgtacccgctgccagtatttctacgacaccggcacgccatgcaacaagcgcgagccgggcagcggatgccccgcgcgcagcgggctgaaccgcaaccatgcgatcctcggcgccagcgaacactgcgtggcggtacatccatccgacctgtgcgtggcactggcggcgctggaggctcaggtactggtgcgcggccgcgctggcgagcggcgggtcgctttcgccgacttccatcgcctgccggcagacacgcccgagcgcgacaactgcctggccgtcgacgaactggtcaccgccatcgagctgccagcaccgcgcttcgcccggcattgccactacctgaaggtgcgcgaccgggcctcctacgccttcgccctggtctcggtggcggcggccctggaaccggacggcgagcgcattggcgaactgcgcctggcgctcggcggcgtggcccacaagccatggcgcgtcgcagagctggaggaacgtttcaggggccacccggcgaaccgggacagctatgtccgcttcgccgaagcgctgctgcgtgacgccaggccgctggcccacaacgccttcaagatcggattggcgcgcaacgccatcgttcgcgcactggaagaagcccactcgggagggatcggccaatga

SEQ ID NO: 15304 - DNA, 471 bp, Pseudomonas aeruginosa
accggccgccgatggcgggcgacgacgagccctacaaggacgccgatgccgccgaaggcgaacccttccgcccgctgttcgacgaccgcgtcctgtacagcggccagccccttgccctggtcctggcacggagcctggaactggcccgctacgcgggctcgctgctgcgcatcgacatcgagcccgagccgcaccagaccgacctgctggccgccctcgaccaggcccatgaggctcccgccgaactgcccgccgagcgcggcgatttctacaccgcctaccgcgccgcgccgattcgggtcgaggccagctacagcacgccgatcgagcaccacaatcccatggaaccgcacgcgtccacggtcatcgtccagcccgacggcagcctgctggtgcacgacaagacccaggggacgcagaacagccaggcctacctgcaaaaggtcttcggcctgcccgccgacaaggtaa

SEQ ID NO: 15305 - DNA, 453 bp, Pseudomonas aeruginosa
  unsure (12),(96): Identity of nucleotide at the above locations are unknown.
acatcgctccangctgcgcccgagcgaagcgctcgacccacaaggcacgcccggccctctctcctgcgtgggggaaagggttggggtgagggccancaacacaatacccgccaacacctgattccaaaaaacgaatccgcaccactcaagctgcagctattgcggttagcagtggggggaggttgtggttctgcaggtggcaataggtgtgccgttcaggtatggggaaaggctatggcttatggaaggaaaggctgtatacggccagaagctgtcactcaccaaaggatacttctgtcactaactatcgggggcctgcactcaggagcacgctggcgaaccgtcacaccagatacgcccaactatgacatccttaaggatgtgttggacgatgatgtggatgtggccgtgtcctaccgtatgcaagtcggccacggcttaaggtgtgactga

SEQ ID NO: 15306 - DNA, 1284 bp, Pseudomonas aeruginosa
ccctttctcgacgctagagaaacgccagatcaggctttgcccagcagggcatcggtactcgttctttgctgcgtcatagatgaaatcacctttgccgaagcggcccgccgctgtcgcgcccgaggtcagcgttttgggcacgaaaacagtgattccagcctcatgacaggcgaggatttcttcgcctttgaaataccctctgtctgcgaccgccgagagttcctcgacacccatggcctctcgcgcctgcttggccatggcgctcagctggtctcgatcgactccgtcgttcgtgacctcgtgcgtcacgatcaggtggtgcttcgcatcgaccgctgcctgcacgttgtagccgaccattccggtgccacgcgttttcatcgaacgagcatcgggatcggtcagggagatctgtttatccggtatttcgttgagctgaacctcgatctccttgagctcctgcagcttcgctttcaaggtcgcgatcttgtcgtggaggcgttcggctttgacctgcgccacggcaggttcctgacgatcagcggtatccagtgcgctcaggtagcgattgatgctggactcgatctcctccattcgccgttgaagcttggcgctggtgaaattgcggtcgcggttgttgaccgccttgaacttgctgccgtcgatggccaccagcgcttcagagaacaggccaagctgctggcacagcaccacgaactgccgacagacaccgcggattgccttgccgttatctttgcggaagttagcgatggtcttgaagtccggcatcaaacgtccggtcagccacatcaactcaacgttgcgctgagcctcacgttcgagacggcggctggactggatgcgattgagatagccgtagatgtagatcttcaggaggtcggcaggatggtaagcgggacgacctgtttcagccgggacgacgccgtcgaaacccagctggccaaggtcgagttcatcgacgaaaacatcgaccacccgcaccgggttggtgtccgccacgtagtcatccaggctctcgggaagcagcgagctttggcctcgatgctctccctggataaaacgcttcatagacgtccccccgctgatttgaatcgatcaaatcacagcaaggtcgatgccaacgtttttacacagtctgggccgttttctgacagtccaaattggcgaaatcaataccaagggagacgccatacacagctaccttccaccttcccaacccctcacccattcctccccaacctatacccactgaccgcctcgtaa

SEQ ID NO: 15307 - DNA, 1590 bp, Pseudomonas aeruginosa
agcggtttcgcaagggattcccgccgagtattggccgggatgcgtgcgccggcaagccggttccgaatgcgccgtggtttcgctgtcaccccgggaggtgtcgtgagcaagctgttcatcatcgtggaacgcaaggaagactggacgtcctattaccccagcgaggatgtggtcaccgcccaggaatacctggaactgcccatcgacgacgacactggcaagcgggtccaggtgatcaacctgtgccggcactacaagtacctgcgccatggctactactgctcgctgctcgccgaggcgcgcgggcacaaggtgatcccctcggtgcggaccatcagcgagctggccaggaagtcgctgtacagcctggtcctggaagatctggatcgcaccctggacaaggccctggccgcgcacccctacggcagcaccgatggtttcaccctgaccctgtatttcggccgtaccgatatcgagccgctgcaggacctggcgcgacaactgttcgaggcgtttccctgcccgttgctgctggtggagttcaagcgcaaccgcacctggcacatcgagggcatcaagcccggcgccatccacaagctgcgcgaggaccaggaagacctcttcgccaacgccctggacagcttcagccggcagatctggcgcaagccgcgttcgcgcaagccgttccgctacgatctggcgatcctccacgaccccggcgaggcgttcccgccttccgacgccaaggcgctgaaaaacttcgtgcgggtcggccgcagcctcggcatcgacgtcgacctgatcgagcgcaaggactattcgcggatcgccgagtacgacgcgctgttcatccgcgagaccaccaatgtcgccgaccacacctaccgtttcgccaagaaggccgagagcgaagggttggtggtgatggacgacccggtgtcgatcctgcgctgcaccaacaaggtgtacctggccgacctgctgcgcagccacaagctgggcatgccggccacggagattctctacaaggagaacccgcaggaactggagaaggtcggcgagcgcctgggcttcccgctggtgctgaagattcccgacggcagcttctcgcgcggggtgatcaaggtggaggaccaggagcagttgctggcagccagcgccgagcttttcgagcgctcggtgctgatccttgcccaggagttcttctataccgagtacgactggcgtatcggcgtgctcaaccgcaagccgatcttcgcctgccagtacttcatgtccaagggccactggcagatctacgaccacagcccggacgccgaggaggtcagcggcgatttccgcaccatgcccgtgcacgaggcgccgcgcaaggtggtggagctggcggtgaagaccgccaacctgatcggcgacggcctttacggggtggacctgaagcaggccggcgacaaggtggtggtgatcgaggtgaacgacaacccgaacatcgactgcggggtggaggatgtctacctcggcgacgacctttacaagctggtcctggaggagttcgtccggcgcctggaagtcaagcgtcgcggctacgactga

SEQ ID NO: 15308 - DNA, 1461 bp, Pseudomonas aeruginosa
gacgatttcggcattggcgatataaacaaagattcactttcgcgcgtcaaaaaattgctagattttcctttcagagcgccaacatgccgtttttatgacggttcaaagaattggcgccgcaaaggagcacacatgttagatgcatcgaacctccgccgtctgctggtggtggacccgtgcgacgattgccggcgcctgttgccgggccttcgcgaggcgggttgggcagtggacagctgcgcgctggaaacggcgcgcgaacgcgcttgcgacgtcggcctgctgcgcctgcggccgttccacctggagcggccggaaacggtgaaggacctgatcagccgcagcggcaccgagtggatcgccgtgctcagcccggacaccttgccgctgaatggtgtcggcgatttcgtctgcgaatggttcttcgacttccataccttgccgttcgacatggcgcgggtgcaggtgaccctcggccgcgcctttggcatggcccgcctgcgcgggcgcggcacggtgcccggcgatgccgagggcgagcacgaactgctcggcgagagcctggccgtacgcgacctgcgccggctgctggcgaagctggcgccgaccgactcgccggtactgatccgtggcgagagcggcaccggcaaggaactggtcgcgcgtaccctgcaccggcagtcgcggcgcgcggacaagccgttcgtcgcgatcaactgcggggcgattcccgagcacctgatccagtccgagctgttcggccacgagaagggcgccttcaccggcgcgcaccagcgcaaggtcgggcggatcgaggcggccgacggcggcaccctgttcctcgacgagatcggcgacctgccgctggagttgcaggccaacctgttgcgctttctccaggaacagcagatcgagcgggtcggcggtagccggccggtcgaggtggacgtgcgggtgctggcggcgacccatgtcgacctggaggcggcgatcgatgccgggacgttccgcgaggacctctactaccggctcaacgtcctgcaggtcggcaccgcgccgttgcgcgaacggagcgaggacctgccgctgctggcccagcatttctcccggctctacagcctggagaccggccgccgcccgcgccgcttcagcgaggacgcgctggcggcgatggcgatgcacgcctggccgggcaatgtccgcgaactggccaaccgggtacgtcgcgggttggtcctggcagagggaaagcagatcgaggcccaggacctcggcctggaatgcgcgcgcggcgacggcccgccgttgtccagcctggaggtctacaagctctgcgccgagcgccaggcgatgtgtgatgcgctggcccgttacggcgacaacctcagcgtggccgcgcggatgctcggggtgtcgcggccgaccttctaccgcctgttgcacaagcaccggttgcgctga

SEQ ID NO: 15309 - DNA, 831 bp, Pseudomonas aeruginosa
tctgcgatcgcatcggcgtgctctcggcgggacgtatggtggacaccttcgagcgcgacgcctggacccaggacgcgctgctggcggcggccttcgccggttacaagaaacgcgacgcgctgctggcgacgtcgtgaacacgcaacgcaaggaaccagaaatgagcgacccgacgtcttccgctaccgccgccgcagcgccaaccctgcgacgcggcaactatttcggcctgggcacctacctcggcctggccggcgcgctgctggcgatgatcgcgctgttctcggcgctgagcagccacttcctcagctatggcaccttcctcgccatcgccaaccagatccccgacctggtggtgctggcggtgggcatgaccttcatcctgatcgtcggcggcatcgatctctcggtaggttcggtgctggccctggcggcctcggcggtaagcctggcgacgctcggctggggctggggcgtgctgccggcggcgatgctcgggatggcctgcgcgaccctggccggctgcgtcaccggttcgatcacggtggcctggcggattccctcgttcatcgtgtccctcggggtgctggagatggcccgtgggctggcctaccagatgaccgactcgcgcacggcctatatcggcgacgcctatgcctggctgtccaatccgctggcgttcggcatctcgccggccttcgtgatcgccctgctggtgatgttcgccgcccaggcggtgctcacccgcacggtgtttggccgctacctgatcggcatcggcaccaacgaagaagcggtgcgattggccggtgtgaacccgaaaccctataa

SEQ ID NO: 15310 - DNA, 813 bp, Pseudomonas aeruginosa
gattgcagtattcgccctgatggggctgctcgccgggttggccgcgctgttccagatctcgcgtctggaagcggccgaccccaacgccggggtcggcctggaactccaggtcatcgccgcggtggtgatcggcggcaccagcctgatgggcgggcgaggttcggtggtcagcaccttcttcggcgtgctgatcatttccgtattggcggcggggctggcgcagatcggtgcgtcggagccgaccaaacgaatcattaccggggcggtgatcgtggtagcggtggtgctggatacctaccgcagccatcgcgcccgcagacagggctgaacgatggcgacaatgaaggacgtggcggcgatggcgggggtttccttcaccaccgtatcgcatgtggtgaacaggacgcggccggtcagcgacgcggtgcgcaagaaggtcgaggacgccatcgcgcagctgcactacgtgcccagcgcggtggcgcgctcgctgaaggtgcgcaccacctcgatcatcggcctgctggtgccgaacagcaccaacccgtatttcgccgagctgtcgcggggcatcgaggattgctgcgagcgcaacggctactgcgtgatcctctgcaactccgacgacaacccgcagaagcaggccaactacctgcgcgtgctccaggagaaacgcatcgacggcctggtcctggcgtccgccggcggcgacggcgcgctggccaaggggctggcgaacatgcgcacgccgaccgtgatcgtcgaccgcgaggtggaaggcgtggaagccgaccgggtgcagatcgaccatga

SEQ ID NO: 15311 - DNA, 1512 bp, Pseudomonas aeruginosa
gatgggcgcctacctggcgacccgccacctgctcgagctgggccatcgcgacatcgcctgcatcggcgggccgctgtcgaccaaggtttcgacgctgcgggtcgagggctaccggcgggcgatggccaaggccggcctggaggtgcgcccgcagtggctgctggaaagcgagttcagcagccccggcggctaccacgcggcgctcggcctgctgggcggcgagggcgagcgaccgacggcgatcgtcgccggcaacgacatgatcggcatcggcgtgctgcgcgccgcggccgagctgaatatcagggtgccgcacgaactgtcggtgatcggcttcgacgatatcgagctgagccgcttcgtgtttcccgccttgaccaccgtgggccagtcgatccgcctgctcggcgagatcgccgcgcaactgctgctgcaacgcatcgccgagcgcgaggagccgatgcagcggcgggtggtggcgccggcgctggtcctgcgcgaatccaccgcgccgccgctggtgcgggtctgaaccgggcgccgggggcgccctcgctagagagaggctggaacaaggacgcaacgatgcaagcgaaagtactggtggtgggcagcctgaacatggacctggtggtgcgcgcgccgcgcctgccacggggcggcgagaccctcgccgggcagtccttcaccaccattcccggcggcaagggcgccaaccaggcggtcgccgcggcgcgtctcggcgctggggtggcgatgatcggctgccttggcgacgatgcctacggcgaccagctgtaccgcgcgctgcaggccgagggcatcgactgccagggcgtcgagcgggtggccggggagtccagcggggtggcgctgatcgtggtcgacgacagcagccagaacgccatcgtcatcgtcgccggcggcaacggccacctgtcgccggccgtgctggcgcgccacgaacacttgctggagcaggcgcaggtggtggtctgccagctggaaagcccgctggagacggttggccatgtgctgcgccgggcccatgcgctgggcaagacggtgatcctcaacccggcgccggccacccgcgacgtgccggcggactggctgccactggtggactacctggtccccaacgagaccgaaagcgaactgctctgccgcctgccggtggactccctggagagcgccgggcgtgccgccgagcgcctgcgcgaaatgggcgccggcagggtgatcgtcaccctcggcgcccagggcgccctgctggtgggcgaggggcgggtcgagcatttcccggtggcgcgggtcaaggcgctggataccacggcggccggcgacaccttcgtcggtggcttcgccgcggcccttgcgcgcggcctcgacgaggcggcggcgatccgtttcggccaggccgccgcggcgatctcggtgacccgcctcggcgcgcagacctcgatcccctcgcgcgaggaagtcgagcgggcgctcgctggcgaggcttga

SEQ ID NO: 15312 - DNA, 432 bp, Pseudomonas aeruginosa
cagggccggcccgtcagccgtcccggagcagtccttgcactgcggcgaaagcctggcgccggcgctcggcccagtcgccggcgatggcgcggtagggctgccgatggcgctccagccaggcatggcattcgcgatggaatgcctggcgctgcgccagttccggctggcagcgctggccgtcggcgctccaggccacgccttccggcgagagcagcaggtgcaggtcgtagcgccgccgcagcagggcgggttcgagccagtccgggcaggcgccgaagagaatccggctccagaggatgttgctcagcaggtgggtatcgaggatcagcagcgccggccgttccgcgcgagcggcgtcctcccaggccagttgcccgcgggcgatggcggggatgtcggcgtagcaggtgtcgcggcgctgttcgtcgatga

SEQ ID NO: 15313 - DNA, 1371 bp, Pseudomonas aeruginosa
tcctctgcgtgctgccggccgctggcgcctggcggatgtacctggacggacaggccctctggccgctgctggcctatccgctggccagcctgctcgcattcgccctctactggcgggacaagcgcagcgccgcacgcggcgactggcgtaccccggaggtccgcctgcacctgttcgagctgctcggcggctggcctggcgcgctggtcgcgcagcaggtattccgccacaagacccgcaagctctcgttccaactggtgttctggggcatcgtcctgctgcaccagctgttctggctcgacagcctgctcggcgggcgcctgtccgccgcgctgttgcagcggatcggctgaacggcgcggctcactcgcgggcgcggcggtaggccgggccggtctcgcccgaggggcgttgcagggcttccacgagaaagtcgatcaaagcacggatcgccggaatctggctgctgcgcggcaggtaggcggcctgcatggtgcttttcggcaaggtccactgcggcaggatgcgcaccaggctgccatcggccagttccctgtcgcagtagccttcgggcagcaaggtgacgccgaggccggccacggcggctttcttgcgcaggacgaagtcgtcgacgcccaggcgcggttcgcgttccaactggtagcggctgccatccggcccgatcagggtcgcgtggaccttgcggtcgttatgaatagcgccgaggaagggcaggtcttcgaggtcttccggatgttccaggcgacgcccggcgatcagcgacggggcggcgaggatctgcgtggtcgccggagccaggcgccggcagaccagcgcagggtcctcgtcgccgagttcgcgcacgcgcagtgccacgtccaccccctcgttgagcaggtcgacccggcggttggtcaggaggatttccagctggacctgcgggtgtcgttcgagaaaccgcggcaacaggtcggccaggttgctcgaagccatggccaccggtgcggaaaggcgcagccggccacgcggctcgacgctcagctcggcgatcacctgttcggccatctccgcttccagcagcaggttgcggcagtgctgcaggtagcgttcgccgacctccgtgagcgccagcttgcgtgtcgtgcggtgcagcaggcgcacctgaaggcgctcctccagctcggcgatgcgccgcgacaggcgcgacttgggaatccccgtctcgcgtccggccgcggcgaagccgccgcattccaccaccttggcgaagtagtagaggtcgttgaggtcgtggggcatgcaggcgctccgctggggggaaaaacagattgtcctatgtgtgggacgaatagtcatgtttctaccgactaa

SEQ ID NO: 15314 - DNA, 1506 bp, Pseudomonas aeruginosa
ggaaacgaattcgcggtcgtggctgacgaagatcagcgtgcccggatagttgtccagcgccaggttcagcgcctcgatggactccatgtccaggtggttggtcggctcgtccatcaccagcacgttggggcgcttgaggatcagccggccgaacagcatgcggccctgctcgccgccggagatcactttcaccgacttcttgatctcgtcgttggagaacagcatgcggccgagggtgccgcgcaccagttgttcgccgccctgggtccactgggccatccagtcgaacaggctcatgtcgtcggcgaagtcgtcggcatggtcctgggcgaaatagccgacgtcggcgctgtcggtccatttcacctcgccgccgtccaccggcaggtcgccgaccaggcagcgcaacagggtggtcttgccgatgccgttggggccgatgatggcgacgcgctcgccggcctcgacctgcaggctcaggcccttgaacagcggcttgccgtcatagcccttgctgatgttttccacggtcaccgcctggcggtgcagcttcttgtattgctcgaagcggatgaacgggctgacccggctggacggcttgacctcttccaactggatcttgtcgatctgccgggcgcggctggtggcctgcttggccttggaggcgttggccgagaagcggctgacgaaggattgcagctcggcgatctgcgccttcttcttggcgttgtccgacagcaggcgctcgcgggcctgttcggcggcggtcatgtactcgtcgtagttgcccgggaacaggcgcagctcgccgtagtccaggtcggccatgtgggtgcagacgctgttcaggaagtggcgatcgtgggaaatgatgatcatggtgctgttgcgcgcggtgagcacgccttccagccagcggatggtgttgatgtccaggtggttggtcggttcgtcgagcagcagcacgtccgggtccgagaacagcgcctgggccagcagtacgcgcagcttccagccgggagcgacggcgctcatcgggccgaagtgctgctccagcgggatgcccaggccgagcagcagctcgccggcgcgggactcggcggtgtagccgtcgaactcggcgaactggacttccagctcggccaccgccatgccatctgcctcgctcatttccggcagggagtagatgcggtcgcgttcggccttcaccgcccagagttcctcgtggcccatgatcaccgtatcgatgacgctgaagtcctcgtaggcgaactggtcctggcgcagcttgcccaggcgcacgttgggttccagcatgacctggccggcgctcggctccaggtcgttgccgaggatcttcatgaaggtcgacttgccgcaaccgttggcgccgatcaggccgtagcggttgccgttgccgaacttgacggaaacgttctcgaacagcggcttggcgccgaactgcatggtgatattcgcggtggagatcaacttctttacctatag

SEQ ID NO: 15315 - DNA, 372 bp, Pseudomonas aeruginosa
agtcccgtcttccgctcatccgcaaaggactccccgatgaagcccgctgttctccccgcgttgttggttctgtcgctgctgggcggttgcggggattcatcgtcggacggaaaggccgcttccgggccgctggcgttgcactgcggagacttcggcaaactcgaggtgatcgacggtttcgccagtctaaagctgcccgacggcagcagcgtccagtcgctgggcggcgatgtccgcagcctcgccgatggccaggcgctgagcgcgatttcctatagcgacggttcggtcctgtaccgccaggcgggcgacacgcccggctatctgtacacgccggccaaaggccagcggcaggcctgcgagacgcgctga

SEQ ID NO: 15316 - DNA, 459 bp, Pseudomonas aeruginosa
tctgagccacgcaggcgcaggccggctgtcgcatcgctcgtcgagccgctagaatcccgctccccattccccgcaaggcccgccagcatgccgcatctcgtcatcgaagccactgccaacctccgcctcgaaacgtcccccggcgaactgctggagcaggccaatgccgcgctgttcgcttccgggcaattcggcgaggcggacatcaagtcgcgcttcgtcaccctggaggcctaccggcagggaaccgcggcggccgagcgcgcctacctgcatgcctgcctgtcgatcctcgacgggcgcgacgcggcgacccgccaggcactgggcgagtcgctctgcgaggtgctcgccggagcggtggcgggcggcggcgaggagggcgtgcaggtcagcgtcgaagtgcgcgagatggagcgcgccagctacgccaagcgcgtcgtcgcccggcagcgctga

SEQ ID NO: 15317 - DNA, 270 bp, Pseudomonas aeruginosa
aatgtccgacttgtgcagcaggttgcgaagagagccatgaccgacactcccgacgatcgaaccggagatgcctccggtctgtcgaagcgccaggcattccatcggcagcaccggcaacgggcggaggaagaggcgcggcgcctgctcgacgcccgcgccgaacagggcggccgctggctggactgggtcgcgggccagctctacctcctgcgtccgccggaatacgcggccatggtgcgtcgcgaactgcagcgcctgagcggcgactga

SEQ ID NO: 15318 - DNA, 429 bp, Pseudomonas aeruginosa
tgcttattcgttcggctgaacgcgggaagaagcgctgccggcggcgccagccgggccgtggggtggacgacgcgattggcgccgcccgccggcatgtcccgcgctcggccgggagaacaagcggcaggccgctggggcctgctcaggcggcgacttgcgcaggcttgcccagcaggcggtcgaccaggctgcaggcggcgagagtggcgaccgaggggatcaaccaggccaggccctgttcggccaacggcaggtgcagcagccattgcgggaagtcctggcccaggcccgccgccttcagggcatcgagcacgccgaacgccagggaaaccagcatcaccggggcgaggatgcgcgtcgccgaatgccagaggccgatgcagaagctcagcgccaccagcacgatgcacggcggatagatcgcggtga

SEQ ID NO: 15319 - DNA, 456 bp, Pseudomonas aeruginosa
tcgacctgctgcgcaagaacgaagagcgcatcgataccggcatgctctacctctccgaccatggcgagtcgctcggcgagtacaacctctacctgcatggcacgccttacctgctggcgccggaccagcagaagcacgtcggcatgctggcctggttctcgcccggctaccagagcgccttcggcctcgacagtggctgcctgcgccagcgcagcaacgaggagctgtcccaggacaacctgttccactcgatgctcggcctgctggaagtgcgcaccggcgcctacgatcccggcctcgacctgttcgccccgtgccgtgcgccggaggtcctgcaggcgctcaaggccgacggcggacgggcgctgtactccgaggaagcgtctggccaggagccgccggcttcctgatacgacccggcgaaaggactatttccttcgcctcgcggaagggtaa

SEQ ID NO: 15320 - DNA, 2187 bp, Pseudomonas aeruginosa
ggttcagcctcggaacccgcgaggacgcccatggatcgccacgcccaacaccaccccaggagccgcgcctgcgtgctgcccaacggcctgcgcctgcacctggcgcatgatccggcggcatcgcgcgccgctgcctggctgcgggtggcggcgggcagccacgacgagccgagcgcgcatcccggcctggcccacttcctcgagcacctgtcgtttctcggcggcgcggcgtttcccggcgacgagcgcctgatgccgtggttgcaggtgcgcggcggccaggtcaacgccagcacccggggcaggaccaccgactatttcttcgaggtgacggcggagcacattggcgccggtctggcacggctgatcgacatgctcgcccgccccttgctggacatcgatgcgcaacggcgcgagcgcgaagtactcgaggccgaatacctggcgcgctcggccgacgagcagaccctgatcgacgcggcgctggccctcggcttgcccgccggacacccccctgcggcgtttcgctgccgggcgccgcgacagcctggccctggagaacgatgcgttccagcgggccctgcgcgaattccatgccgcccactatcacgccggcaattgccagctatggctgcaagggccgcaggcactggacgagctggagaggctggcgcagcgtgcctgcgccgacctgccggggcgcgcgccaggcgcgaatccgccgccgccgccgttgctgcccttcgccggcgaagcgctggcgctgcgcctgccgggaccgccgcggctggtgctgggctttgccctcgacgctttgcgggaggccgacgaacagaccctgcaggcgttcgccgaattgctcggcgatcgctcgccgggcgggttgctggcggcactcggcgaacagggcctgggcgaatcggcggcgctgcgggtggttcaccgggatgcgcggcaggcgctcctggcgttgaccttcgaactgttcgacggcagcgcggcggcggcgctggaggcggcctttttcgactggctgggcgacctgcgcgacgatgccgccagcctgctggcggcgcgccggccgttgctggcggagcccactgcaccgctggagcgactacgccagcgcgttcttggcctgccagcggagattcgcccggcctgcctggacgcgctgcgcgccgaccgttgcctgcggctgcacctggacagcgaactcgacggtgccgaagcgcgctggtcggcgggcttccgcctgagtgtggcgccggttgccgcagcgccgccgctggccgcgcagcggcatgcctggcgcttcgaactgccgttgccgcccagtgccgccgccgagggcgcgctgttcctgcgctggcgctttcccggtgtgcccgcacggtcacgctttctggcgctgcgccaggcgttgcgtccgctgtgcggccaggcacgcctggggggtgtggagatgggcctggaggcgctcggcgaggactggtcgctgagcctgctcggtccgcgcgatcgcctcgaggccgccgtgcgcccggccctggcccggctcctcgcggcgccgcccgactggcgcgcgagcggcgagcgtctgtcctccgccgagcggcgccgcagcgccactggcctgccgatccggcagttgctggacgccttgcccggcctactcggcgagccgctggcggaggtcgacgactggcggcggacgcgctgggacgccttggtcatgcaggccgcgatgccagatccccgatggatgcccggccaggctgccggcgagcgcctggagcctctgccgccgaggcccggacggcatcgccgcgaactggccatggacggcgagtcggcgttgctgctgttctgtccgctgcccacgcaggaggtgccgatggaggcggcctggcgcttgctggcgcgcctgcacgaaccggccttccagcggcgcctgcgcgacgagctgcaactgggctacgcgttgttctgcggcttccgcgaggtcggcgcccggcgcggcctgctgttcgccgcgcaatctccgcgtgcctgcccggtacgcctgctggagcatatggagaccttcctccagcgctccgccgaggcgctcgcgcaactgccggcgcgacgcctggccggcctgcgcgaagccctcgccgacgacctgcgccgagcaccgggtag

SEQ ID NO: 15321 - DNA, 1248 bp, Pseudomonas aeruginosa
tcggctccgccacgaccggcccggtcgtttcacctcgcggagtgcgccatgaacaagaacaacaccgccgttcgccgaatcctgccgctgaccctggcctcgctgggtgccctgggcggcctgcaaccggccgccgccgatatcctgctgtacgacaaggacgagaccacattttccaccgacggctacttcaacgccttctacgtcaacagcgacgtcgaccgccagggcgagacctacgatcgccgccagtcgcgggtgaagatgggattcctgccgaactacatcggcttcaacttcggcaggaaggtcgacgagctgagcctcggtggtcgcgcttccttctgggtgaccatcaacgacagcgagaccgacggcaccgataccgccatcgacgtccgtcagttctacggcacggtcgccggcgactggggcgaggtgctgatcggcaaggacttcggcctgttctcgcgctcgaacatcttcctcgacgaactgctggccggtttcggcaaccccagcgacaccctcggcctggtggacggcaagggcgtctccttcggcaacatcggcaccggctatccgtatccgttccccacctcgcagatcacctaccgcaacaacaacctgctgcccggcctgcgcatcgccgtgggcatcctcgacccgatcgactccaaccagatcgacaaagatgccagcgacggcctcgacgacaaggcctaccaggacaacccgcgctacgagagcgaggtcagctaccagttcgacctggccggggcgcaggtctacagctggatcaacggcggttaccagacttcgaagaacaccagcgacagcgtcgacagcgtgacttccaagggggtcggctatggcttgcaggtgaagatgggcggcttctccgtgaccggttcggggttcaccgccaagggcatcaatcccttcttcaccaacaacgccggcgaagccgcgctgcgcgaggtggacagccgcggcgcattgctgcagggctcgtattcatggggcaagaaccgcctggcgctgtcctacggcaagaccgtcgacgacggcaacggcctgggttccgcggccgactacgagagtcgcggcatcgcctatttccgcacgatcaacgacaacctcaagctggtcgccgagctgaaccgctaccggatcgacgggcgcgacggtgccgcgctcgacgaggacaccgacaccgtggcgctcggcgccgtactgaactggtga

SEQ ID NO: 15322 - DNA, 1227 bp, Pseudomonas aeruginosa
gataggggccgcggcggcgcccttcgtagaatgctggcgaggcggaacgacgggggagcgggcatgtacgaagggcagggggaaggggtctgcaggggcatgtccagcgcgcgcgacgtcgaagtggtggcccaggacctggcgcgccagcttatccatccgcacctgggcttcgtgctgttcttctgttccgcggaatacgacctgccggcccttgccgagatgctcgaacgctacttcggcggtatcgacctggtcggctgcaccacagccggcgagatcactccggcgggctacgggcgcggctgcgtcagcgcggtgggcttcgacgtgcgcagcttcgccatcagcagcgcgctgatcgacgaaatggagcgcttcagcctgctggacgcgcagcagatggtcgagaccctggtggccggctgtcgccgcggcggcctggcgccgatcaaggaccacagcttcgccctgaccttgctcgacggcctgtccagccgcgaagaggtggtgctcgccgcgcttggcgcggcgctcggcgcgatcccgcacttcggtggctcggccggcgacgaccgccacctgacccacacccatgtctaccaccagggccagttccatacaggggcggcagtggtggtgctggtcaacacctggctggacttcgaggtcttcaccacccatcacgtggtgccgcgcgccgaaaagttggtggtgacccgcgccgacagcggcagccggcgggtccacgaactcaacgccgagccggcggcgctggaatacgcccggctggtcggggtggcaccgcaggcgctggatttcgccctgttctccgcgcatccgctggcggtgcgggtcgacgaacgctattacgtgcgctcgatccagcaggccaacgaggacctgagcctgacgttctactgtgcggtggagaacggcatcgttctcaccgcgatgagcaccggtccgctgttgcccaacctggaggcgcagttccgccgcctccacgagcgcctcggaccgccgttgctgaccatcggttgcgactgcttcctgcggcgcctggagctggaggtcggcggtgacacgcaagctaccgccgcgtttctccgcagccagcaggtgatcggcttcaacacctacggagagcaattcaatggcatgcatatcaaccagaccttcaccggggtcgccattggccgaccccgcggaggtgtccgtcgctga

SEQ ID NO: 15323 - DNA, 2376 bp, Pseudomonas aeruginosa
cggcgggctgatcgtcgaggagcagcgcggcggcgaccagcagaccctgtaccgcctgcgcgacgagcgctggctgcggatgagcgagcgaccgacccgcgacggcgggctggcggtgctctacagcgacgtcaccgagatcaagctcagcgagaccgcgcgccgcgagcaggcgctggcgcagaagtcgcacctgttgcagcgggcggtggacaatctctcccagggcgtggcgatggtcggtgccgacggcgtgctggagttgtggaaccggcgcttcctggagctctgcgggctggccccgatcgccgggcaccgggccttcgccgaagtgatggcggagagcgaattgccgttgctcacgccgcgcagccaggactcccaggggagtccgctgagcgcccgcgagcagcgcctgttcgatggccgggtgctggagatccgtacccatgcgctgcccaccggcggcttcgtcaacaccttcaccgacatcaccgaacgctatcgccacgccgaggcgttgcgcgccagcgagcgctggatccgcctgatcaccgaccaggtgccggcgctgatcgcctatctcagcgacgaactggtctacgaattcaccaacaaggtctacgaggagtggtaccgctggcccagcggctcgatgctcggccgctgcctgcgcgacgtgcatggcgccgagcactgccggcgcctggagccgtacttcgagcgggccctggccggcgaaagcgtgaccttcgagatcgccgagaccgcgttgtccggcgaggagcgctacatgcagcgctcctacgtgccgaaccgccaggccgacggccgggtcgccgggctgttcgtgctgattcgggatatcaccgagcgccggcggaccgccgaggcgctgcaccaggcctaccagaacctcgaacagcgggtgcgcgagcggaccgccgagctgaccaccctcaacgaccagttcaagcgcgagatccacgagcgcagccaggtcgaggcgcgcctgcgcgaggccaagcgcgaggcggaacaggccaacctgtcgaagaccaagttcctcgcggcggtcagccacgacctgctgcaaccgctgaacgccgcgcggctgttcaccagcgccttgcaggagcgcggcagcgcggcgcgggacaacgaggcgctggtgaacaacatcagccattcgctggaggacgtggagaacctgctcggcaccctggtggacatttccaagctggacgccggcgtgatcaccccggacatcgccccgttcgagcttggcgaactgctcggcaacctggccgcggagtaccgccaggtagccgccagcgaagggctacgcctggacttcgtggcctgcggggcgctggtccgcagcgaccagcaactgctcgcgcgaatcctccgcaacctgctttccaacgccatccgctataccccgcgagggcgcgtgctgctgggttgccgccggcatcggcagcgcctgtcgatcgaggtctgggacaccggggtgggcatcgccgccgacaagctcggcgagattttccaggaattcaagcgcggcgagtcacagcgttgtcaccaagaccgcgggctcggcctgggattggcgatcgtcgacaagatcgcccgcatgctcggccaccgggtccgggtcggctcgctgccgggcaagggctcatgcttcgccatcgaggtaccgctggcccgccatgccccgcgcagtcgcgccgagccgctggccagcgcggacgacctgcgcgagcgcctgcgtggttcgcgggtgtgggtgctggacaacgatgcggcgatctgcgcaggcatgcgcacgttgctcgaagcctggggctgccgggtagtgacggcgctgtcggaggaagacctggcgcgacaggtcgacaactaccatgccgaggccgacctgctgatcgtcgactatcacctcgacgaccagcgcaacggcgtcgacgcggtcgccgcgatcaacgcccggcgcggctcgccgctgccggcgctgatgatcaccgccaactacagcaacgagctcaagcagcaggtccgcgagcttggccataccctgatgcacaagccggtgcggccgatgaagctgaagaccgcgctctgccacttgctggagcgcgaagcctcggtctgattcaggcgtcttcgcgcgccgcgcggcccaggcgcggggcgaggatcagggcgatcccgccgagcaccgccagggtcgccggcggcaatcgcggggcgagcggctcgccgagcagcagggcgccgcagagggcggcgagcaccggcacgctgagctgcaccgaggcgccctggatcgccgtcagccccggcagtgcgctgtaccagacggcgtag

SEQ ID NO: 15324 - DNA, 837 bp, Pseudomonas aeruginosa
catgtctcgacaacgacaatggacaggagtcgccgccatgcgcatcgccgtcaccctggtgttgcccatcctgctgatcctcagcctgctcgggttcgatttcctctattcccgccacctcggccaggaaagacctgccgcctgcgccgtcggacaggcctgtcggatcgccccctgagccacgccatggatgacctgcgacccgccggcccggcggagtaccgctggctgctcgccgtgcaggagcgcgagcggcgcttgctggcccaggcggtgcatgacgatatcggccagtacctgacgggcatccgcacccaactgttgttgctgcgctgcacggcaggcgacgggcagccggcgctggcacgcctggagcgctactgccaggggctggacgacagcttccgcgcgctgctgcgcggtctaccgccgccggccctgcaacgccagtcgctggacgaggcgctgcgcgcctgcgtggcggactggcaggaaggccagggcatcgcctgcgagctgcgcctgggcggtccgctgccgcccctggatgcggcggccgggacccatctctaccgcctgttgcaggaggcgctgaacaacgtcgcccggcatgccggcgccagccgcgtgcggatccgcctgcaatgccgtggcggctttctctacctgagcgtacgcgacgacggtcgcggctgcgcggcggacccggcacccggcttcggcctggactcgatgcgccagcgcgcgcgctgcctgggcgctgaactgagcctgcgcagccgtcccggacagggcctggcgttgcgcctgcggatgccgctggaacgcgacgactga

SEQ ID NO: 15325 - DNA, 690 bp, Pseudomonas aeruginosa
gaggagaggacgatgaagatcctgctggtggacgatcatttcgtggtccgcgaagggctggccgcgctgttgcgcgggctgctccccgacgtggaggtgaacgaggccggcgacggcgaagaagccttgcaggcggtgcagcgggaaattccttcgctggtcatcgtcgatctcggcctgccgggcatcagcggcctggaactgactcgccggctgcgccagcgcctgccgcagttgcgtgtgctgttcttcagcctccatgacgaactggccctggtgcgccaggcgctggatgccggtgcccgcggctacgtgaccaagcgagcggcgccgacggtgctgctggaggcgatacggcgagtgctcgccggccagctctatctggagcagcccctggccacgcgcctggcctgccagtcgtgggaagagcagggcggggcagcgttgcgcgggctgacccgtcgcgagttcgagatcttccgcctgctcgcgcgtggcctggccctgcgcgaggtggccgagcacctgggggtaagcgccaagaccgtgtccaaccatgtcagcctgctcaagcagaagttgcaggtgagtacccaggcggaactggtgcaccgggccatcgacagcggcgtgctgcggctgggcctgccgctgccgctcgccgaggaggctcgcggcagcctcggctag

SEQ ID NO: 15326 - DNA, 2049 bp, Pseudomonas aeruginosa
agtgatgaacaagaacaacgccttgcgcggcctgctggtgctggccggtctcagcctctcgagcctggcgctggcccacggcgatgtgaccccccaggcagtggacaccaagggactcgagccgctgggcaaggaatggcgcgacaccaacccctaccgcaagccctacgccaagcacgacctcgccgtcgagatcggcgcctccgcctacaaccagaactgcgcgcgctgccacggcctggaagccaagtccggcggcatcgccccggacctgcgcctgctggagaccggcgccgagggcgacgaatggttcaaggagcgggtcatcaacggcgcggtgcgcgatggcgcggtgtacatgccgaagatggccgacttcatcagccaggaaggcctctgggcgatccgcagctatctggaaagcgtgcacgtcgacgagtgacgcgcccgacccttcgccgccgaccgcggcgcccttgcacgagtccgccgcgccacggcggaacgaccacacaggagagcttcgccatgatttacgcagcgcccggaacccccggtgccgtcgttaccttcaagcctcgctacggcaactacatcggcggcgagttcgtgcctccggtcaagggccagtacttcaccaacacctcgccggtgaacggccagccgatcgccgagttcccccgttccaccgccgaggacatcgacaaggccctcgacgccgcccacgccgccgccgacgcctggggccgtacctcggtgcaggagcgttcgaacatcctgctgaagatcgccgaccgcatcgagcagaacctggaactgctcgccgtcaccgagacctgggacaacggcaaggccgtgcgcgagaccctcaacgccgacatccccctggccgccgaccacttccgctacttcgccggctgcatccgcgcccaggaaggctccgccgccgagatcaacgacagcaccgtggcctaccacatccatgagccgctgggcgtggtcgggcagatcatcccgtggaacttcccgctgctgatggccgcctggaagctggccccggcgctggccgccggcaactgcgtggtgctcaagccggccgagcagaccccgctgggcatctgcgtgctgctggaactcatcggcgacctgctgccgccgggcgtgctcaacgtcgtccagggcttcggcagggaggccggcgaggccctggccaccagcaagcgcatcgccaagatcgccttcaccggttccaccccggtcggctcgcacatcctcaagtgcgcggcggagaacatcattccctccaccgtcgagctgggcggcaagagcccgaacatctatttcgaagacatcatgcaggccgagccggcgttcatcgagaaggccgccgagggcctggtgctggccttcttcaaccagggcgaggtgtgcacctgcccgtcccgcgcgctggtccaggagtcgatctacccggcattcatggaagaggtgctgaaaaaggtcagggcgatcaagcgcggcgacccgctggacaccgagaccatggtcggcgcccaggcttcccagcagcagtacgagaagatcctctcctacctcgacatcgcccagcaggaaggcgccgagctgctcgccggcggcagcgtcgagaagctcgaaggcaacctggccagcggctactacatccagccgaccctgctcaaggggcacaacggcatgcgcgtgttccaggaggaaatcttcggcccggtggtcggagtcaccaccttcaaggacgaagccgaggccctggccatcgccaacgacaccgagtacggcctcggcgccggcctctggacccgcgacatcaaccgcgcctaccgcatgggccgcgggatcaaggccggtcgcgtgtggaccaactgctaccacctgtacccggcccacgccgcgttcggcggctacaagaagtccggcgtcggtcgcgagacgcacaagatgatgctcgaccactaccagcagaccaagaacctgctggtgagctacgacatcaacccgctgggcttcttctag

SEQ ID NO: 15327 - DNA, 1551 bp, Pseudomonas aeruginosa
tcggctacttcgccctgtacagtcggcatcacctggtgtccggcaccccggaagaagagttcgccgcgatccaggcggcggaacaggacctgcgctgagagcgacaacgacaaagcccggcccgccgcatggcgaggccgggcactggagacacacatggcacgtttcacccatagcgtcggcggcgaaacctaccgcttcgacagcctcaaggacgtgatggccaaggccagccccgcgcgctccggcgatttcctcgccggcgtcgcggcgagcaacgacggcgagcgggtcgccgcgcagatggccctggccgacatcccgctcaaacacttcctcgacgaggcgctgattccctacgaggacgacgaggtcacccgcctgatcatcgacacccaccagcgcgacgccttcgccccggtgtcccatctcaccgtcggcggcttccgcgactggctgctcggcgacgccgccgacgaggccagcctgcgcgccctggctccgggcctgacgccggaaatggcagcggcggtatcgaagatcatgcgtgtccaggacctggtcctggtggcgcagaagatccgcgtggtcacccgcttccgcaacaccctcggccttcgcggccggctctccacccgcctgcaaccaaaccacccgaccgacgacccggccggaatcgccgcgagcatcctcgacggcctgctgttcggcaatggcgacgcgatgctcgggatcaatcctgccaccgacagcatggcctcgatctgcgccctgctggagatgctcgacgcgatcatccagcgctacgagattcctacccaggcctgcgtgctgacccacgtcaccagctccatcgaggcgatcaaccgcggcgtgccgctggacctggtgttccagtcgatcgccggcaccgaggcggccaatgccagcttcggcatcagcctgaagatcctccaggaaggctacgaggccgggctcagccagaagcgcggcaccctaggcaacaacctgatgtacttcgagaccggccagggcagcgcgctctcggccaacgcccaccacggcgtcgaccagcagacctgcgagacccgcgcctatgcggtggctcgtcacttcaagccgttcctggtgaacaccgtggtcggcttcatcggtcccgagtacctgtacaacggcaagcagatcatccgcgccggcctggaagaccacttctgcggcaagctgctcggcgtgccgatgggttgcgacatctgctacaccaaccatgccgaggccgaccaggacgacatggacatgctcctgaccctgctgggcgtcgccgggatcaacttcatcatgggcattcccggctccgacgacgtgatgctcaactaccagaccacctccttccacgacgccctctatgcgcgccagacgctgggcctgaagccggcgccggaattcgaggactggttgcagcggatgggaatcttcacccaggccgacgggcgcatccgcttcggtgacgagttaccgccggcgttccgccaggccctggcgcaactggcctga

SEQ ID NO: 15328 - DNA, 525 bp, Pseudomonas aeruginosa
ggagatgccgatgaacgacaagcacctgcccgacgccagcgccgagaacccctggctgccgctgcgccagctgacccccgcgcggatcgccctgggccgcaccggcaccagcctgccgacccgcccgcaactggacttccagtacgcccacgcccaggcgcgcgacgccgtgcacctgcccttcgaccatgcggccatcagcgacggcctgcgccagcgcggccgcgacagcctgctgctgcacagcgccgccgccgaccgccacgtctacctgcaacgcccggacctcggccggcgcctcgacgaggcctcggtgcaacgcctgcgcgaacacgccgccggctacgacgggcagatcgacctggccatcgtggtcgccgacggcctctccgcgctggccgtgcagcgtcacaccctgcccttcctcgaacgcctggaggaacaggcgctggccgaaggctggtcgctgtcgccggtggtcctggtggaacagggacgggtggcggtggccgacgagatcggtga

SEQ ID NO: 15329 - DNA, 1203 bp, Pseudomonas aeruginosa
attgctgcgggcgaagatgagcgtgatcctgatcggcgagcgtcccggcctcagctcgccggacagcctcggcctgtacttcacctgggccccgcgggtcggcctcaccgacgcctatcgcaactgcatctccaacgtccgcctggaaggcctcagctacggcatggccgcgcaccgcctgctctacctgatgcgcgaggcctgccggcggcagctttccggggtcaacctgaaggacgaggcggaggtccaggcgctggacggcgaggctccgcgcaccggcaacttcctcctggcgagggactgagcctcccggccgaaggatgggccggcgcgcgtcgcccctccttcggccgattcaaacgttcgcttggattgcgctttccagggagattgggcagcatcgaagcgttgctggcatgcagcctgcatcgtcccggcagccccttcccgcaatgcgaggcccgtcatgcgaatcgtgcaagccaccctcgaacacctcgacctgctggcgccgctgttcgtcaagtaccgcgaattctacggcatgctctcctaccccgagtcctcgcggaaattcctcgagaaacgcctgcgccgcaaggagtcggtgatctacctggcgctggccgacgaagaagaccgcctgctcggtttctgccagctctatccgagcttctcctcgctgtcgctcaagcgcgtctggatcctcaacgacatctacgtcgccgaggaggcgcgccggcaactggtcgccgaccacctgctgcaacacgccaagcagatggcccgggaaacccatgcggtgcgcatgcgtgtctccaccagcgtcgacaacgaggtagcgcagaaagtctacgagtcgatcggcttccgcgaagaccaggagttcaagaactacaccctgccgatcagcgacgaactaagctgaagacaaaggcacggcacctcccaaccgatcgctcagagcagaggcatccatgggttcgcgcacctggcactggcccggcgtcctgctcggcctgctcctcgccacggccggcgcgcaggccgacaccctgcgcgtggcgaccctcgactgggcgccctacgtcggccccgacctgccgggcaagggcctcgccagccgcatcctcgacgaagccctggccctcgacgggcaccgcgccgaactggtgttcctgccctggcaacgtgccctga

SEQ ID NO: 15330 - DNA, 1155 bp, Pseudomonas aeruginosa
gttctacgaacgccacggcggcaagaccgtgaccctggcgcgcttcctgcccatcgtgcggaccttcgcgcccttcgtcgccggcatggcgaagatgcactacccgcgcttcgtcatgttcagcgtggtgggcaccgtggcctgggtcggcggcctggtgaccctgggctacttcttcggcaacgtgccgttcatcaagaagaacctgtcgctgctggtgatcggcatcatcctgctgtcgctgctgccgatgatcctcggcttcattcgccatcgcctgcaggcgagcgccgccaaacaggccaaggcccagagcgactgagcatgtggtcgttccgcgcctggcggcgccggcgcctgctggcacgccacccggtggccgaagagctctggcagcgggtacgccggcacctgccgatcctcgacggcctggacgccgacgaggaccgccgcctgcgcgagcgggccgtgctgtttctcgccgacaagcacctgaccgcactcgccggcgtcgatctcgacgacttcggccgcctgctgctggcggcgcaggcgcaactgccgctgttgcacctgccggagctgaactggtaccagggcttccacgagctggtgctgtatcccgatgatttcgtcagcccgcagaaacaccgcgacgccagcggcgtagtccatgagttcgacgacgaacgcagcggcgagacgtccctgcaagggccggtggtcctggcctggcccggcgtcgtcggcgggggtggctgggatgcctacaacctggtgatccacgaactggcgcacaagctggacatgctcaacggcgacgccaacggcctgccgccgctgcacgccggcatgcgcatcggcgactgggcgagcgccatgcaggccgcctacgacgagatgaacgccctgctcgaccgcgaccccgacgcgcagaccgccatcgacccctatgcggcggaagatccggcggagttcttcgccgttaccagcgagtatttcttcaccgccccggatctcctccacgaggcctatccggcggtataccggcagctccagttgttctaccgccaggacccgctgcaacgcctgcgccgcctgcaggccgagcatccggactaccgcgaggcggcgggcgacacgactaacggctga

SEQ ID NO: 15331 - DNA, 699 bp, Pseudomonas aeruginosa
tcgcggcctcttttttggccagaaacctctggagtcacccatgagctacagcaagatcccggccggcaaggacctgccgaacgacatctacgtcgctatcgagattccggccaaccatgcgccgatcaagtacgagatcgacaaggacaccgactgcctgttcgtcgaccgtttcatggccaccccgatgttctacccggccaactacggcttcatcccgaacactctggccgacgacggcgacccgctggacgtgctggtggtgaccccctatccggtcgctcccggttcggtgatccgcgcgcgcccggttggcgtcctgcacatgaccgacgaggcaggcggcgacgccaagctgatcgccgtgccgcacgacaagctgagcgtcctgtacaaggacgtgaaggaatacaccgacctgccggccctgctgctggaacagatcaagcacttcttcgagaactacaaggatctcgagaaaggcaagtgggtcaaggtcgaaggctggggcaacgccgacgccgcccgcgccgagatcaccaaggccgtggccgcgttccagaagtaagcgcgcctcgccgaaaagaagccccgcagccgcggggctttttcattctccctcgccgaccgccaaggtcggtctcgccaccccgctccgctcagtcgaccgtcgccacgctctccaaccgatatccgtag

SEQ ID NO: 15332 - DNA, 633 bp, Pseudomonas aeruginosa
tcttcagcgaaccctcctccaatccggacagcgaccgccagttggcaagatcgctgtgccgggccggcaacgtcctcctgccactgctgcgcgaaagcgtgccgcgctacggcgaaccgccacgggagataccgccgaccgcgccgctggccggctgcgccgccggcatcgggcatatcaacgtcgaagcggacagcgacggcacggtgcgcagcgtctacctgcgcgaaggaccgctcggccagccgcgcccgctgctcgcctggcaagcattcgccgatgccggcgccatgcccatgcccggcctcgacgacatgcgcaacctgcccggctggcagcgtgaccacgccatccgcattcccttcatcggtgccgacgcgggcttccccagcgtgccctacgtcagcgtgttgcgcggcgaggtgccagacagcctgctgcgcgaccgcctggtcctggtcggcgccaccgcgccgggcctcggcgaccgctatgtcaccccgctgtcggccagcctcggcaccacgccgggggtggagatccaggccaacattctcaacggcctgttgcagcagcgcaccgccgtcgacctgcaaccctggctcgccgccctgctctccgccgccagcgtag

SEQ ID NO: 15333 - DNA, 1284 bp, Pseudomonas aeruginosa
gcgcaggagcatcatcgaaaccctgtccaagggcttcaagcgccgcgtcgcgctggcccaggcgatcctccacgatcccgagctgctcctgctcgacgagcccaccgacggcctcgacccgaatcagaagcaccaggtccggcaactggtgaagaacctctcggaaagcaagatcgtggtgatttccacgcacatcctcgaggaagtctcgttcatgtgcagccgcgccctggtgatcaacggcggccgcctgctggccgacaacaccccgggcgaactcaggacccgcagccgctaccaccatgccgtcagcctcagcatcgaagcaccggtagacccgctggccatcgccatgctccccggcgtcgccggtatcgaaggacgccccgaccgggccggcaccctgaccattctggcccgccccggcgtgcagatccttcccgcgctcaaccgcctgatccacggcagcggctggcgggtatccggggtgcgtaccgaacacggccaactggaagaagtgttccgccaactgacccgagaaacccccgcatgaccgccatcggcaccattttcagacgcgagctgggcagctacttcgccacgccgctcgcctatgtgttcaccctggtattcctcgtcctctccggcgtggccaccttctacctgggcgatttcttcgagcgcggccaggccgacctggcgccgttcttttccagcctgccctggctctacctcctgctgatccccgcgctggccatgcgcctgtgggccgaggagcgcaagtccggctccatcgagatgctgatgaccctgcccgtctcccgcgccaccctggtcaccggcaagttcctcgcggcctggttctgcgccgggctggcgttgctgctgaccttcccgatgccgctgacggtgaactacctcggctcgcccgacaacggcgcgatcatcgccggctacctggccggctggctgctgtccggcggctacctggccatcggatcctgcatgtcggcgctggcgaagaaccagatcatcgcctttgccctgaccgttctcgtctgcctgctattcgtcggcgccggcactccccacgtacaacaggcgctctccggctggcttccgcaatggctgctggacggcattgcctcgctgagcgtgctggtccgtttcgaggcgctcggccggggcgtgctcgacgtccgcgacctggcctacttctgcagcctgatcgtcgcctggctggtcgccaccaccatcgtcatcgacctgaaaaaggcagcgtag

SEQ ID NO: 15334 - DNA, 1812 bp, Pseudomonas aeruginosa
gaaacatccatgaaacgaaccctgtactcgggcgtcggcctgctgctggtcggcctgctgttcctcgctttcaacctgctgtccagcctgctgctgcgcgaccagcagttcgacctcacccagcagaagctctacaccttcagcgccggcacccaggaagtcctcgacagtctcgacgaaccgctcaacctctacctgttcttttcgaaaagccgcgccagtgacctgcccgccctgcgcaactacgcccgccgcgtcgaggaagtgctggacctctatgcacggcggagccatggcaatgtccgattgttcgtgatcgatcccctgccattctccgacgacgaggaccgtgccgcgcgcttcggcctgcaggcgccgcccatcggcccgaatggcgaagccatctactttggcctggcggccaccaacccgaccgacggcctccaggtgatcccgttcttctcgccggaagaagagccgcttctggaatacgatctcagccgcctggtccaggcactcgcacagcgggaacgcacggtagtcggcctgatgagctcgctgccgatgaccgggcaggcgcccaccgacgggcagccgggcagcaggccctgggcgatgatggacaagctctaccaacagttcgacatccgcaccctggggctcgcttcgacggaaatccccgccgaagtctcggtgttgatgctggtgcaccccaggcaattgtccgaacagacccaatacgccatcgaccagttcgtcctgcgcggcggcaagctgctggccttcgtcgaccctctgagtctcgccgatgcagacggcgggaaaagctccgacctggccccgttgctgcgctcctggggcgtccagttgcggccggataccctgctggcggatgcctcgttcgccatgatcaagccaaacgccgaacgtcgcccggagcgcaatccgacctggctacacctccccggcgacacgttcccccacgacaacgtgctgaccaccggcctggaaagcctcaacctcgccagcgtcggcctgctcgaacctctcggcggagcctcgacgcgcttcattccgttgctgcacagctcggcgcacagcatgccgctgtcgctggaacgcttccgccaatcctcgacggagcagctcaacgccaccctggtcccgaccggggaacgctacgtgctggccgccaaggtcgaggggccggcgacgagtgccttccctgcggaccgcgggaagcaaggcgaaggcctgagcgacagcgcgaacatccatgtgctgttggtcgccgatacggacctgctgagcaatccgctctggctccaggaacagcccggccacaacgagccgcaggtatgggcggacaacgacctgttcgtcggcaatgccctcgactacctctccggttcggacgcgctgatcgacctacgctcgcgaggccatacgaagcgcccgttcacccgcgtggaagcgctccgccgcgaggccgggctgcgcgcccaggaacagctcaacgcgctgcagcaaagcctcaacgacaccgacaggaacctgcgcaccttgcagcaatcgatggacgccggcgaccaggaggtgactccggaaatggaagcgacgctgcgccgcttcatcgatgacaaattgcgcatccgccagcaactgcgtcaattgcagttccagctgaatgccgatgtcgagcgcctgggggaacaggtgaaactggccaatacggtcctgctgccggcactgctcaccctgttcctcctgctgcattggagctggcgcagcatgcgccggaggaggggctga

SEQ ID NO: 15335 - DNA, 195 bp, Pseudomonas aeruginosa
gcttttgcatccatcatcaacctccagccagccgaattagctatggggcagactgtaagcgatcacccaagccgcgtgcagaaagatgcttacgtaaaaaaatacgctaagcaaattacctcagcaattcctgacataagaactaacccgactacaacccagcctcaaaaaagaaccaaccagcacagtgattaa

SEQ ID NO: 15336 - DNA, 300 bp, Pseudomonas aeruginosa
aggcttccgatcaagggcgttcgcaattcgaaggatgttaagaaaggtgacgtttcgctcgccgcgttcgattttccccatgtgggaacgatcgatttcagctgcatcggccaacgcctcctgcgacaggccaagagcgacgcggtgagcgcgcactacagcccccagacggaccaaatcgcgatttttatcatgactaacggagactcttcccatgcatggaatcgtcacgctatgatgtgtttacgaccacggcatttacgacccatttctataaaaaatcctgcctttggcatctaa

SEQ ID NO: 15337 - DNA, 510 bp, Pseudomonas aeruginosa; identical to SEQ ID NO: 4421

SEQ ID NO: 15338 - DNA, 1293 bp, Pseudomonas aeruginosa
gccatttgtcgccgttcgcccaggtcgggtggcgatcagcccggagtggcccagcaacccacgcacttcattgcacaaccccgtgcgggcccgcaccagagactgcgccacccgatgcaccgactgcacggcctgctgctctgcgctcttcaccgggacatagcgcatgctcggacgactggcggcttcgcagatcgcctcggcgtcgtgtgcatcgtgcttgtcccccttgacgtagggtttgacgaactgcggtgcgatcaggcgtaccgtgtggcccagctcccgcaactcgcgcgcccagtagtgcgcactgccgcaggcctccatcgccaccaggcacggcggcagttggcgaaagaaatcccgcacctgtgcccgcttgagttggcgacgacataccacatgctcgtgacgatcaacgccgtgcacctggaatacttgttttgccagatccagaccaatgcgactaaggttcatgctgactccccctccgggacttgtggctgcaccattagtctggcgcttgacgccgtaggagggaggagtccatttcattgccctacgcggcctcgaagcccacccaaccgcacgcggtcatgcgtcctgcgcggactcggagtccggcccagacgatgttcggggttggacgccgtagccgaatgcccggcgcaatccggcgatcgcctgttgccgatccatgccgcgcacggccggcggatcggcgcgttcgcagaattcgcgccagacgaacagggtcagctcggcgccatcggtaaggggttcggcggtcggcacgccgaactgctggagcgtccggtaacgcgtgtcctcccagaacagttcctcgacccagtcgtacagtggaatcaggtggaaatgcaccggcaggccgggcatgtggccgtagcggccgacatagatgcgtcgcggccgcagcagcgcgtccatttcgcgctcgaccctggccagcagcggcccgaattcggcgagggcctgttccggcaactggtggaaggccgtcgccggttgccgcgagccgagcatgcagtagccgggcagggccgagtcgatccgctggttcagcgtccagtggcgggtctggtggatgatcagctcgggcgggatatgcatggacggcgctccgcagatgggacgcccactgtaacccgtcgtcagggaagatccagcccggtcttgcgccgtttcatttcgtcgatgcgttgtcgcagcgccaggcgctgggcttccggcttggccagccaccagtcgcgcaccgccgagttgtcgtag

SEQ ID NO: 15339 - DNA, 468 bp, Pseudomonas aeruginosa
gggccgctcggcgccggtagcggcgcgaccgggaacaggtacagcgcggcgattgccagcagcaccagcaggccgtacagcgaaccggtccggaacggcaggccgcgcacgggcttccggcgcagacaggcgccgagcagcagggagaaaccggcgaaggcgccgacgccggcttgccagcggtcgtcccatacagcgtacaggccggcgccgagcgccagcgtcgaggcgagcgccagcaggccacggcggccgggcagggcgggtatccaccaggcgagcagggccgccagcagggtcgcgaccagcagcaggtcgacagcggtcatggtgcttcgctcctcgtttccacggggcgcgtcggttggctcggccagaacgccgccagcgccagcagcagaccgaccagcgcgtagggggcgcggctgtcaaattggtggagcagcgtgccgagcagcggcccgctga

SEQ ID NO: 15340 - DNA, 1332 bp, Pseudomonas aeruginosa
ctgcgcgccgagctggcggcgggcgcctcggcggcaagcagggcgggggccgctccggcgagggcgagggtcatggcggcggcgtggatggccagggacagcgaacgggggcgaagcgtgcgtacgggcatgtacagggttcctcgtggtctctgcggaccttgggtcggggcggattcctctacttgccagccgagaaggaaaaaggtctcaggtcgaggcggttatttttctgcggagcacggtatgtcgatggcaacgcctgttccggcgcaacggcggacggcctgccggggtggacgcgagggggcggttgccacggggatggcggccgcgccgtcacgccggcaccaggctgatccagtagtcggtcaccccgcgcaccttcagcggataggtggcctgcagcatgcccagcgtgcgccgcaggtccagcagcggataggcgcccgacaccgccagcctggccagttgcgggtcgcagcgcagtacgccgcgacggtagcgggcgagttcggcgagcacctcggccagcggcatccggtcggccatcagcatgccgcgggtccaggcgtccggcaggccgtcgaagaccagccggcgcgcttcgccgtcggcgcccaggcgcaccgactcgccgctttccagccagcgcccgcgtccgtggagcgggctcagttcgacccgtccggcgagtaccgcgacccgggtcgcggccatctcctggcgtacgttgaagcgggcggcaccggcatgcagccgcgcttcggcggtggcgacgcggaacggacgcgggtcggcgcggctatcgacgaagatctcgccgcgcagcaggcgtaccagccgctggctggcgtcgaaggccaggtccacggcgctgtcggtgttcagggtcagcaggctgccgtcgggcagggtcaggcggcgctgttcgccgacgccggtgcgctggtcggccagccagtcgcgcaacggttcggcctgccaggtggcgagccccagcgaggcgccgccgaggaccagggcgaggtgcttgatcgcgcgccgccggtccagcccgtgctcgcggccgagggtcggcagggccagcgccggcggcagtcggccgaggcattgcagcaggcgctcggcgcgctcccaggcatgggcgtgctgcgggctgcgctgccgccactgggcgcaggcctggcgcgtgtcgtcggtgcagccgctgtcctgcaggcgcaccagccactcggcggcctcgtcgaggatcggcgagggaatccggccttcgcccgcggcgttcattccatcagctccaggcactggcggaaggcctgctgcatgtag

SEQ ID NO: 15341 - DNA, 480 bp, Pseudomonas aeruginosa
gcgaagggttcatgccatgggctcctcaggatttgtcttcaaggccggcgggggcgaagcgcgcgagaaagcggtcggtggccgagggcgcggtaccggcgagttccgcgcgttccttgcgcaggacggcgttgcgcaccagggagccacccaggtagcgcagcggctcgggggggaagctccggcagcggcgttctaccagcggacaacggctccacgggtcgtcgcggccgagggcgaggctggcgaggatccgcccgcccaggcggctcggtcccacgccgttgccgctccagccgatgccgtagtggatgttctcgtgcaggcggccgaagaccggcaggctgtcgtaggtacggtcgatggggccggaccagccgtcgaccagcgggatgtcgcctagcgagggataggtgcggcggaagtcggcctcggtcagggccaggctctcccggtcgacgtcgaatacccggccgatga

SEQ ID NO: 15342 - DNA, 300 bp, Pseudomonas aeruginosa
tcgccgccgaggacctgcggcggcgcccggtgcgcgacctgcaggaagccctgcgcggttcggaaagcctgcagttcaacggcgtcggcatgtcccggcggggcatcagcgttcgcggcatgtccagcgagcacaccctggtgctggtggacggccagcggatctccacctcgtccggggccatcgcccattccgacttcgacctcggctgggggccggtggagagcatcgagcgcatcgaggtggtacgcgggccgatgtcctcgctctacggttcggaagccctcggcggggtggtga

SEQ ID NO: 15343 - DNA, 768 bp, Pseudomonas aeruginosa
cgctgcgcggcggcatcgagaaccttggcgaccagcgcctggccgacgacgacacgcacttcacctatgccgaacctgggcggaccttccatctcggcctggtggcgagcttctgatgcgccgttcgctactcttctgcggcgcgctgctggccagtctctgtgcctgggcggagccggcccaggtgcgtctgctcagcagcgatttcgtcctcccgggcaagcaccagcgcctagccggttgggcgcgcgaggccggtgtcgagttgcgcggcctgcgcctcggcatcggcgaggcgccgcccggcgagtggctggacggcggcaacctgctgatcctcgacacgccgcggccgaccgatcgcgcccaggtcgaggaggcgctgggcgagcgcttgcaaggcgggacgcaaccctggatccgcgtcggcggcggtcctccgggcttcggcaacctgccggcggcgctgggcgggcgcctggtcggctactacgcgaacggcggcgaagccaacctgcgccggctgttcgaggcggtccaacgctggcatgccggcctgcccgtcgacgcgttgccggcgccgcagcccctggcgcaggccggcttctatcatcccgacgcaccggcgccgttcgccggcctcgccgactacctggcctggggcgcctcgcgctgggccagcgatgccccgcgcatcgccttcctgatcccgcgcggcgccatcgccgacgcccagaccggcgccatcgacgaactgttgcggcgtag

SEQ ID NO: 15344 - DNA, 2163 bp, Pseudomonas aeruginosa
tctgctgctgttgccgcagccgccgcgtgccggccgtccgggcgaggcctaccacgacagcgcggtgccgccggaccatctctacctggcggtctaccagttcgtccgcgagggtttcggcgccgacgcgctgatccatttcggcacccatggcacccaggaatggctacccggcaaggaccgcgggctggcggtgggcgactacccgctgcggacgctcggcgacctgccggtgttctacccgtacatccaggacaacgttggcgaggcgatccaggcgcgccggcgcgggcgcgcggtcaccgtcagccaccagacgccgtcgttcgccccggccgggctgtacgacgaactgcgcgacctgcaccagctgatccacgaataccagcaactggacgagggcgcggtgcgcgaacgcagcgccgagcagatccgcgcggcggtgcgggcggcgcacatgaacgacgacctgggctggagcgaggcagcgatgcgcgaggatttcccggcgttcctcggcgtgctccacgaccacctgcaccgactggccggctcggcgatgccgctggggctgcacaccttcggtgtcgccgcctcgccggagctgcgcctgggcaccgtcatgcagcagctcggcgagccctactaccgcgcgctcggtctcgaccccgacgaactgttcgccgccgatttcagggcgctgcgggaaggtcgtgcctaccgcacgctgcaacgctacctgcgcgacggtggcgagatcgccaaggtggccgatccgcgcctgcgcgagcagttgctgcgcgcccgcgaactggaccgccagctcgccgacaccggcgaactggaggcgctgctcgccggcctcgccgggcgcttcgtcgcgcccgggccgggcggcgatccgatccgcaatccgcaggtacccagcgggcgcaacctgttcgccttcgaggccgacaaggtaccgacccgcgccgcctacgaagccggcgccgaggccttcggccaactgctggaaagctaccgcgccgagcaccagggcagggcgccggaaaagctcgccttcagcctctggtcgtcggaaaccatgcgccacctgggcatcgtcgaaagccaggcgctgcacgccctcggcctgcgcccgcgctgggacgccggtggccgcctgctggcgctggacatcgtgccggcggcggaactggggcgtccacgggtggacgtggtgctacaggtgaccagtgtctaccgcgaccagttcgacggcttcatgcgcctgctcgccgaggccatcgagcgcctcgccgcgctggacgagccgggcaacccgctggcgcgcaacagccaggcgctggagcggcgcctgcgcgaacgcggcgtcgaagcgccactggcgcagcgcctgtcgcgcctgcggctgttcggcaatgcgccgggcgactacggcaccggggtaacgcaactgaccctcgattccacccgctgggacgacgactcggcgctcgccgagcagttcctcgggcgcttgcagtacgcctacggcagtcgcgactggggcgtgaagctggatggcggcaacctgttcgccgaacagttgaagggtgtacaggcggcgatcctctcgcgctcctcgacgctcaacggcgtgctctccaccgaccacccgttcgagtacctcggcggcctgtcgctggcggtacgccacctcgacggcgccagcccggcgctgtacatcgccgacctgcgccagcgccagccgcgcaccacggccgccgcgcagttcctcgccagcgagctgcgcgggcgctacctcagcccgcagtggatcgccgcgatgcagcgcgagggctacgccggcagcctggaaatgctcgacctggccaacaacctgtggggctggcaggcggcggatcgcaccatggtccgcgccgaccagtggcaggcgttgcacgacaccttcgtcatggaccgccgcgagctgggtctcgccgagtggttcgaaacgcacaatccgaccgcccaggcgcagatcatcgcgcgcatggccgaggccatccgcaagggctactgggacgccagcgagcagacccgccgcgaactggccgagcgctggcggcaactggcggccgccggcgccggcgaggtcggcgcggcgaccacccgtga

SEQ ID NO: 15345 - DNA, 711 bp, Pseudomonas aeruginosa
attcatcgaacggatggccggcggtttcggcgaggccgcggcgcaggcagagggcgcggccgcgtccggtgccggcgaaacggtcagcggccgcgtcctcgaagaagtcgcgccgccgccgtccggcgagccgcagccgtggctccggctggccgccgccgtgctgctcgcgctgttcgccgccggcgccgtccggcaatccgtagtcaatcgtcgtccgatggaaaatcgctcatgaatggtctggaaaccagcctctacgaactcacccgcctgttcctgctgccggtgctgctgttgatcctcgccgcgctggcctacgccttcgtcgccctcggcggcttcgccatggaagcctggcagcgccgtcgcgggcgctaccgctcgcgcctggcggcctggcaggcgctgcatggcggcaacagcgacgacctcgaactgtggatcatgcagcgcctggaatggctgcggatcacctcgcgcagcgcgccgatgctcggcctggtggcgaccatgatccccatgggaccggcactgctggcgctgacccgcaacgacgcccaggggatcggcgagaacctggtggtggcgttttccgcggtgatcctggccctggtcgccgccagcatcaccttcttcatccttaccgtgcgtcgccgctggctgctccaggaactgcgcgccgtcgaacgcgcgcgggaggccggctga

SEQ ID NO: 15346 - DNA, 2283 bp, Pseudomonas aeruginosa
tttcacggtgatcgccgaccagccgatccgctacaagggcgacggctccgcgccggggccgttcgactacttcctggcgtcgtcggcgctgtgtgccgcctacttcgtcaagctgtactgccagacgcgcaacatccccaccgacaacatacgcctgtcgcagaacaacatcgtcgacccggagaaccgctaccggcagatcttcaagatccaggtggaactgccggccgacatctcggagaaggaccgccagggcatcctccgctccatcgaccgctgcacggtgaagaaggtggtgcagaccgggcccgagttcgtcatcgaggaggtcgacaacctcgatgccgacgcccaggcgctgctgatgcccggcaccgatgccgccggctgcacgcgcatcccgggcaaggacctgccgctggagcagaccatcgccaacctgtcggccatcctcgccggcctcggcatgaagatcgagatcgcctcctggcgcaacatcgtgcccaacgtctggtcgctgcacatccgcgatgcgcagtcgccgatgtgcttcaccaacggcaagggcgcgagcaaggaaagcgcgctggcctcggcgctgggcgaattcatcgagcggctgaactgcaacttcttctacaacgaccagtactggggagaagagatcgccaatgcggcgttcgtccattacccggacgaacgctggttcaagcccggccgcgacgatgcgctgccgctgggactgctcgacggccattgcctggcgatctacgaccccgacggcgagctgcgcggctcgcacctgtacgacaccaactcgggcaacgtgcagcgcggtatctgcgccttgcccttcgtgcgccagtccgacggccaggtggtgtatttcccctccaacctgatcgagaacctctacctcagcaacggcatgagcgccggcaataccctggccgaggcgcaggtgcagtgcctgtcggagatcttcgagcgtgcggtcaagcggcaaatcctcgaaggcgagctggcgctgccggacgtgccgccggaggtgctggccaagtacccgggcatcctcgccgggatccgcggcctggaagagcagggcttcccggtactggtcaaggacgcctcgctgggcggcgaattcccggtgatgtgcgtgaccctgatgaatccgcgcaccggcggcgtgttcgcttccttcggcgctcacccgagcttcgaggtggccctggagcgcagcctgaccgaactgctccaggggcgcagcttcgaaggcctgaacgacctgccccagccgaccttcgaaagccatgcgctgaccgagccgaacaacttcgtcgagcatttcatcgattccagcggcgtggtgtcctggcgcttcttcagcgccaaggccgatttcccgttcgtcgagtgggacttcacccggcagggcgaggctgccaacgccgaggaagccgcgaccctgttcggcatcctcgaagccatgggcaagcaggtctacatggcggtgtacgagaacctcggcgctacggcctgccggatcctggtgccgggctactcggaaatctatccggtggaagacctgatctgggacaacaccaacaaggccctggcgttccgcgaggacatcctcaacctgcaccgcctcgacgacgccgcgctcggggcgttgctggagcgcctggaagactgcgaggtggacgactacaccgacatcaccacgctgatcggcgtcgagttcgacgacaacacggtctggggccaactgaccatcctcgagctgaaagtgctcatcggcctcgccctgaagcgcttcgaagacgccaaggaaggcgtggaggcgttcctccagtacaacgacaacagcgtcgagcgcggcctgttctaccaggcgctgaacgtggtgctggaggtcgtcctcgacgacgagctggagatcgccgactacgaggccaatttccgccgcatgttcggcgacgcgcggatggatgccgcgctgggctcggtggacggcagcgtgcgcttcttcggcctgacgccgaccagcatgaagctggaagggctcgaccggcacctgcggctgatcgacagctacaagaagctgcacgcggcgcgagccaggatgcagcccttggtcgacggcgaggccggcgctgccgcggctggcggtctcaagcctcggcgcatggcgatccgcaagcgcaagtgaggagggcgccgaggtcagggcgcgaggatgatcatgagggaaacttgatttcatcacgaagaaattga

SEQ ID NO: 15347 - DNA, 909 bp, Pseudomonas aeruginosa
ccaggtgctgacccattcgctgaccttcggcgtgatccccgagcgcttccgggcgcacggcgaggccgggccgaccctgcataccctgttcggcatggcccgtggcgtcagcgacgacagttgttgcggcggtgcccatgcccaggaaatgaccaagtggttcgacaccaactatcactacctggtccccgagttcagcgccgatcagcagttccagctgagctgggaacaactgttcgaggaggtcgacgaggccagggccctcggccaccaggtgaagccggtgctgatcggtccgctgacctacctgtggctgggcaagggcaagggcgccgagttcgacaggctcgacctgctggaccgcctgctgccgctctacggccagatcttgcgccgcctcgccggccagggcgtggagtgggtgcagatcgacgagccgatcctggtcctcgacctgccgcaggcatggaagaacgccttcgagcgcgcctacaacctgctacagagcgaaccgctgaagaagctggtcgccacctacttcggcggcctggaagacaacctgggcctggccgccaacctcccggtggacggcctgcacatcgacctggtgcgagcgccggaacagtatccgagcatcctcgaccgcctgccggcctacaaggtcgtctcgctgggcctggtcaacggacgcaacgtctggcgctgcgacctggagaaagccctggaagtggtacgccatgcccgggagcgcctgggcgagcggctgtgggtcgcgccgtcctgctcgctgctgcacagcccggtggacctggagcgcgaagacgggctggacgccgagctgaagagctggctggccttcgccgtgcagaagtgccgcgaagtcgcggtgctggcccgtgccgccactga

SEQ ID NO: 15348 - DNA, 1320 bp, Pseudomonas aeruginosa
gccggaggccgccgaggtgcttgccgccctggaagagagccgtgcggtccaggccagccgcgcttcttcgccgcgaatccacaagccggccgtgcaggcgcgcctggccgcgatcaaggccagcgacgcccagcgccgctcgccgttcgccgaacgcatcgccaggcagcgcgccggactcgacctgccggcgttcccgaccaccaccatcggctccttcccgcagacctcgtcgatccgcctggcccgccagtcgttcaagcagggcaagctgagcgaggccgagtacatcgaggcgatgcacagcgagatccgccatgcggtgcagatccaggagcaactggggctggacgtgctggtgcacggcgaggccgagcgcaacgacatggtcgagtacttcgccgagcaactggacggctacgtcttcacccgcttcggctgggtgcagagctacggctcgcgctgcgtgaagccggcggtgatctatggcgacctgagccgtccgcgggccatgaccgtggagtggatcaggtacgcccagagccttaccgacaaggtgatgaagggcatgctgaccggcccggtgaccatgctgatgtggtccttcccgcgcgaggacgtgtctcgcgaggtgcaggcgcgccagttggccctggcgatccgcgacgaagtggtcgacctggaggccgccggcatcaggatcgtgcagatcgacgaggcggctttccgcgaaggcctgccgctgcgccgcaacgcctggccgcactatctggagtgggccaccgaggccttccgcctgtgcgcctccggagtccgcgacgaaacccagatccatacgcacatgtgctacagcgagttcaacgatgtgatcgagtccatcgccgccatggacgccgacgtgatcaccatcgagacttcgcgttcggacatggagctgctggaggccttcgagcagttcgactacccgaacgagatcggtccgggcgtctacgacatccattcgccgcgcgtgccgagccgggaagagatcgtcgcgctgctgcgcaaggcggcccggcggatacccgccgagcggctctgggtcaacccggactgcggcctgaagacccgcgcctggccggaaaccgaggcagcgctggtgaacatggtcgccgccgcccgcgaactgcgtggcgacctcgcccgcggttgaccggcgggcctggtgagcggaacgggacgcctggcgtcccgttccgcatttgcacgtcggttcagcgcggagcgtccaccagcgcccgtagcacatggtcttcccagaccccggcgatcttcaggtag

SEQ ID NO: 15349 - DNA, 591 bp, Pseudomonas aeruginosa
acgtatcttcgagccgttcggtcggacctgaaaaagcggcatccgccgcgccgatgcaccgaccgtgaggcttgtaccatgaccaatccggagccggcggacctgccgatcagcctgctgatcaatggccagcgccgagagctgagagtacccccgtggctgacgctgctcgacctgctgcgcgagcggctcgacctggtgggcagcaagaagggctgcgaccacggccaatgcggcgcttgcacggtgttgcgcaacggtcgccggatcaacgcctgcctgacgctggcggtgatgtgcgacggcgatgcactgactaccatcgaaggtctggccgagggtgatcgcctgcatcccctgcaacaggcgttcatccgccatgatgccttccagtgcggctactgcacgcccggacagatctgttcggcccttggcctggcgagcgaggggcgggcgcgctcgcgggcggagatccgcgagggcatgagcggcaacctgtgccgctgcggcgcctacggcaatatcctcgacgctgtggaagacgccttgccgctgctcgatcgcgacggacagggagggcagcgcgcatga

SEQ ID NO: 15350 - DNA, 753 bp, Pseudomonas aeruginosa
aggtgcgcgaccgggcctcctacgccttcgccctggtctcggtggcggcggccctggaaccggacggcgagcgcattggcgaactgcgcctggcgctcggcggcgtggcccacaagccatggcgcgtcgcagagctggaggaacgtttcaggggccacccggcgaaccgggacagctatgtccgcttcgccgaagcgctgctgcgtgacgccaggccgctggcccacaacgccttcaagatcggattggcgcgcaacgccatcgttcgcgcactggaagaagcccactcgggagggatcggccaatgagcagcctgccacacagcaccgggcaagccctggatcgcgtcgacgggccagccaaggtcaccggccaggctcgctacgccgccgaatatcctgccgccgacctgctccacggcagcgtggtcagcagcgacgtcgcccgcggccgggtgcgcggcatcgactgtgcggcggccctggcggtacccggggtggtcgcggtactgcatcacctgaaccggccgccgatggcgggcgacgacgagccctacaaggacgccgatgccgccgaaggcgaacccttccgcccgctgttcgacgaccgcgtcctgtacagcggccagccccttgccctggtcctggcacggagcctggaactggcccgctacgcgggctcgctgctgcgcatcgacatcgagcccgagccgcaccagaccgacctgctggccgccctcgaccaggcccatga

SEQ ID NO: 15351 - DNA, 1293 bp, Pseudomonas aeruginosa
ggctcccgccgaactgcccgccgagcgcggcgatttctacaccgcctaccgcgccgcgccgattcgggtcgaggccagctacagcacgccgatcgagcaccacaatcccatggaaccgcacgcgtccacggtcatcgtccagcccgacggcagcctgctggtgcacgacaagacccaggggacgcagaacagccaggcctacctgcaaaaggtcttcggcctgcccgccgacaaggtaagggtctgtgccgcctacgtcggcggcgccttcggctccggcctgcgtccgcaataccagttggccctggcggtgatggcggcgctgcaactgcggcggtcggtgcgcgtagtgctgacccgccagcagatgttcaccttcggctaccggccgcgcaccctgcagcgccttcaactgggcgccgatgccgaggggcgcctccttgcgctgggccaccaggcgacagcgcagacctcgcgcttcgaagacttcaccgagcacgtggtggagtggagcggcatgctctatcgctgcgagaacctttccctggcctaccgtctggtgccgctggacgtctataccccgctggacatgcgcgcccccggcgcggcgctggggctgatcgggctggaatgcgcgatggacgaactggcggtgcggctcggcatggaccccatcgcgctgcgccggttcaacttcgccgagcgcaacggcaacgaggacaagccgtactccagcaaggcgctgctggcctgctacgaggagggcgcccggcgcttcggttggcaggcccgcgacccacggccacggagcatgagcgaagggcgccagttgctcggctggggcatggccggcggcgtctgggaggccatgcagagcaaggccagcgcgagggcgcggctggaggcggacggcctgctgcgggtggccagcgcgaccacggatatcggcaccggcacctacacggtgatgacccagatcgccgccgacgccgctggcatggcgccggaagaggtgcgcttccagcttggcgacagtgcgttgcccaaggctccattgcagggcggctcgttcaccgtctcgtcggtcggttccgccgtccgcctggcctgcctgcgcctgcgccaggccctggtcgcccatgccagggcccgccatccggagctggccggcaccgccgaagaacgcttccgcatatgccgtggccatctggaagcgggcgatacgcgatacgccctggccgacctgctgcaagggctgccggaagacgcgttgcaggtggaggtggaagctga

SEQ ID NO: 15352 - DNA, 276 bp, Pseudomonas aeruginosa
ctggatttggcattgtgtcttttccccggtgctgcccacgatccttcttttagcaaattattgctgcgtacgcccttggatggcgcgcagcgcatccccggtgtgcagcctggcgcgcgcctgctgctgcacgctgagggagagaacccggtgcgcgccgtgctggcacgcattgacgccatcgaggcgctgggcatcgcgcctgtcggcgtctcgcccgcgtactggcgcacgctcgctaaccggctcgcggcacgcttaccgctcgcgttgtga

SEQ ID NO: 15353 - DNA, 186 bp, Pseudomonas aeruginosa
aaacaggtgatcagcgatcgcatccgccaatctgatctgagcggcaacgacctggggctggcgcaggctgaggacgtgtcggtcatgggcgatgccagtgccctgggcatcctgctcaacaacctgacggccaaaaggggccaaaaggacggccaaaaggggacggatttatttttcctattctaa

SEQ ID NO: 15354 - DNA, 483 bp, Pseudomonas aeruginosa
cgcagagtaggaaatggtcgcttcccgtgcacgggagatgtaaggggcgagcttagcatccaactcagcgcgttgctgagcttcctccttttgcctctcctcgtcctgaattttttgacattcctcgcacggttgattggagcgttgaattaccttcttggcctcggtccggccacctatctggatttgcccatcgcacttgggacaggtctgattttcgtcataagccgtgcagatctgccggacaaatttagcgaccatgctggcctgggtaatttctcggaaagggaggagatcggctacgcgttccaggtacgcgccttcctcgtccatggcccaataccgcttcgccaactcaatctcttgactgtctgtagtttcaaattccaacctaactgccatgtagcgacctgcatcatcaaagagttcaacgacttggagaaatccgttttgcctcgctcaagctccaagaaaggcagctga

SEQ ID NO: 15355 - DNA, 750 bp, Pseudomonas aeruginosa
tccagtccgagctgttcggccacgagaagggcgccttcaccggcgcgcaccagcgcaaggtcgggcggatcgaggcggccgacggcggcaccctgttcctcgacgagatcggcgacctgccgctggagttgcaggccaacctgttgcgctttctccaggaacagcagatcgagcgggtcggcggtagccggccggtcgaggtggacgtgcgggtgctggcggcgacccatgtcgacctggaggcggcgatcgatgccgggacgttccgcgaggacctctactaccggctcaacgtcctgcaggtcggcaccgcgccgttgcgcgaacggagcgaggacctgccgctgctggcccagcatttctcccggctctacagcctggagaccggccgccgcccgcgccgcttcagcgaggacgcgctggcggcgatggcgatgcacgcctggccgggcaatgtccgcgaactggccaaccgggtacgtcgcgggttggtcctggcagagggaaagcagatcgaggcccaggacctcggcctggaatgcgcgcgcggcgacggcccgccgttgtccagcctggaggtctacaagctctgcgccgagcgccaggcgatgtgtgatgcgctggcccgttacggcgacaacctcagcgtggccgcgcggatgctcggggtgtcgcggccgaccttctaccgcctgttgcacaagcaccggttgcgctgagtgggcggcgggagatctgccggccaggtaa

SEQ ID NO: 15356 - DNA, 1734 bp, Pseudomonas aeruginosa
ggtgtcgttcgaggtgcgcgcgggggagatcttcggcatttccggactgatcggctccgggcgcaccgaattgttgcgcctgatctacggcgccgaccgcgccgacggtgggcaggtcctgctcggcgatccgccgcagcgcctgagcctgcgttcgccggccgactcggtgcgccagggggtggcgctgatcaccgaggaccgcaagggcgagggcctgctgctggaccagtcgatcagcgccaacctggccctgggcaacctgccggcgctggcgcgccacggggtgatcgaccggcgccgcgaggaagccctggcgcggcgccaggtggaggcgctgcgggtgcgctgcgcggacaccgcgcaggcggtgggcgaactgtccggcggcaaccagcagaaggtggtgatcggccgctggctggagcgcgactgccaggtgctgctgttcgacgagccgacccgtggcatcgacgtcggcgccaagttcgacatctatgccttgctcgccgaactgacccgccggggcaaggcgctggtggtggtgtccagcgacctgcgcgagctgatgctgatctgcgatcgcatcggcgtgctctcggcgggacgtatggtggacaccttcgagcgcgacgcctggacccaggacgcgctgctggcggcggccttcgccggttacaagaaacgcgacgcgctgctggcgacgtcgtgaacacgcaacgcaaggaaccagaaatgagcgacccgacgtcttccgctaccgccgccgcagcgccaaccctgcgacgcggcaactatttcggcctgggcacctacctcggcctggccggcgcgctgctggcgatgatcgcgctgttctcggcgctgagcagccacttcctcagctatggcaccttcctcgccatcgccaaccagatccccgacctggtggtgctggcggtgggcatgaccttcatcctgatcgtcggcggcatcgatctctcggtaggttcggtgctggccctggcggcctcggcggtaagcctggcgacgctcggctggggctggggcgtgctgccggcggcgatgctcgggatggcctgcgcgaccctggccggctgcgtcaccggttcgatcacggtggcctggcggattccctcgttcatcgtgtccctcggggtgctggagatggcccgtgggctggcctaccagatgaccgactcgcgcacggcctatatcggcgacgcctatgcctggctgtccaatccgctggcgttcggcatctcgccggccttcgtgatcgccctgctggtgatgttcgccgcccaggcggtgctcacccgcacggtgtttggccgctacctgatcggcatcggcaccaacgaagaagcggtgcgattggccggtgtgaacccgaaaccctataagattgcagtattcgccctgatggggctgctcgccgggttggccgcgctgttccagatctcgcgtctggaagcggccgaccccaacgccggggtcggcctggaactccaggtcatcgccgcggtggtgatcggcggcaccagcctgatgggcgggcgaggttcggtggtcagcaccttcttcggcgtgctgatcatttccgtattggcggcggggctggcgcagatcggtgcgtcggagccgaccaaacgaatcattaccggggcggtgatcgtggtagcggtggtgctggatacctaccgcagccatcgcgcccgcagacagggctga

SEQ ID NO: 15357 - DNA, 1017 bp, Pseudomonas aeruginosa
acgatggcgacaatgaaggacgtggcggcgatggcgggggtttccttcaccaccgtatcgcatgtggtgaacaggacgcggccggtcagcgacgcggtgcgcaagaaggtcgaggacgccatcgcgcagctgcactacgtgcccagcgcggtggcgcgctcgctgaaggtgcgcaccacctcgatcatcggcctgctggtgccgaacagcaccaacccgtatttcgccgagctgtcgcggggcatcgaggattgctgcgagcgcaacggctactgcgtgatcctctgcaactccgacgacaacccgcagaagcaggccaactacctgcgcgtgctccaggagaaacgcatcgacggcctggtcctggcgtccgccggcggcgacggcgcgctggccaaggggctggcgaacatgcgcacgccgaccgtgatcgtcgaccgcgaggtggaaggcgtggaagccgaccgggtgcagatcgaccatgagatgggcgcctacctggcgacccgccacctgctcgagctgggccatcgcgacatcgcctgcatcggcgggccgctgtcgaccaaggtttcgacgctgcgggtcgagggctaccggcgggcgatggccaaggccggcctggaggtgcgcccgcagtggctgctggaaagcgagttcagcagccccggcggctaccacgcggcgctcggcctgctgggcggcgagggcgagcgaccgacggcgatcgtcgccggcaacgacatgatcggcatcggcgtgctgcgcgccgcggccgagctgaatatcagggtgccgcacgaactgtcggtgatcggcttcgacgatatcgagctgagccgcttcgtgtttcccgccttgaccaccgtgggccagtcgatccgcctgctcggcgagatcgccgcgcaactgctgctgcaacgcatcgccgagcgcgaggagccgatgcagcggcgggtggtggcgccggcgctggtcctgcgcgaatccaccgcgccgccgctggtgcgggtctga

SEQ ID NO: 15358 - DNA, 1401 bp, Pseudomonas aeruginosa
cgcctgcggcgttatccgccctgcgcagctaggcgaggatcgctcccaggctcacgcatcccttcgaggggtaaggcatgcccaggctcgaacggtggcccctcagaagtagtaggggaatttcacgccgaaggtgaagtccggcgcgtccggagtgatgccgatggacaggctgggcacgatgctgaacctgttgctcaccgcataggtcatgcccaggccgaagtagccggcgttggcgtcgctgccgctgacggtctgccagctttggccgtcctgcttgaccttgctcttctggctgatcagttcggagaaggagaacgacatgctcatcttctcgttcagcgcgaaggccacgccgacgccgagttggaaccagttgccgagcttgaccttgccgccggtcttcacgccttgctgcgggttgatgtcgtcgaacgactcttcgaagttgtaggtatacgacaggctgccgaacagcaccgccgggtccaccgtcttcaccagcgagatgcccggggtgatcgaccagacgccgttgccggtgggcaggtcgtcgggcacgttgaggttgttgttgcccggtacctgcttcagcttgatgccgtagggatccttgccggtgggcgccttgacccgcaggctgaccaccgcgtccggggtgctctcgctttcgtcgaggaacttgtaggcgacgccgaagctgacgtcgcccaggcgtgggtcgccggtcaccgatttctcggtgatctgcgaggtcgagccgccggcgccggcggactggtaggtcgattcgcgatagaccaccggggcgttgatatccacctgccagcgctggttccagttgtagcggccggtcaggtcgagggtccagatgtcggcatcgatctggtccacgccgatgttgccgaggaagatcgagtccagcgccaggaagccgttgaggaacaactggcgggtgtcgtagtggctgtaggtgaggccggtctccaggctgaaggtgccgccgccgaagaagccgctggcgtcctggtagatgttttccacgctgggcgcgggcgcgccatcgtccttgaggctggcgccgtaggtgccggcgaccgcgttggcgtcgttgcgcgcctgcgccggcggctggatcgacttgaccaggcgttgcggctgcggcgcctggggttgcgcctcgacctggcgcacgcgctgttcgaggaccatcagggcgttctgctgggcctcgtagcgttggcgcagctccaggagttccttcttcagcgcctcgacctcggactccgtcgcggcctgcgccaggaacggggaaaccagggtggtggcgcagaggacagctcgcagcgagagtgtctgggtcatgtttgccgttccgtttttatggccttccgatag

SEQ ID NO: 15359 - DNA, 912 bp, Pseudomonas aeruginosa
ggccttcataaaagacggcgagtgtatcgccgagaacaacgaaagctcgttcgggacagtagtagaagggggagaaacatggagtggtggactgctttccaggcgttcatcctgggcgtcgtggaggggctgaccgagttcctgccgatttccagcaccgggcaccagatcatcgtcgccgacctcatcggcttcggcggcgaacgcgccaaggcgttcaacatcatcatccaactggcggcgatcctcgctgtcgtctgggaatttcggggaaagatctttcaagtcgtccgtgacctgccgagccagcgccaggcccagcgtttcaccgccaacctgctgatcgcgttcttcccggcggtagtcctcggcgtcctgttcgccgacctgatccacgagtggctgttcaatccgatcaccgtcgccctggcgctggtggtgggcggggtggtcatgctctgggccgagcgccggaagcatgtgatccgcgccgaacacgtcgacgacatgaactggaaggacgccctgaagatcggctgtgcccagtgcctggcgatgatccccggcacctcgcggtccggcgcgaccatcatcggcggcctgctgttcggcctttcgcgcaaggcggccaccgagttctcgttcttcctggcgatgccgaccatggtcggcgcggcggtctattccggatacgtgtaccgcgacctgttccgccccgaggacctgccggtgttcgccgtcggcttcgtcacctcgttcgtcttcgccatgctggcggtgcgtgccttgctgaagttcatcggcaaccacagctacgcggctttcgcctggtatcggatcgccttcggcctgctgatcctggcgacctggcaattccacctgatcgactggagcaccgccggcgaggtgtga

SEQ ID NO: 15360 - DNA, 780 bp, Pseudomonas aeruginosa
aggtcgttgaggtcgtggggcatgcaggcgctccgctggggggaaaaacagattgtcctatgtgtgggacgaatagtcatgtttctaccgactaatcgtcgattggccttgccggtaggatgcaaaccactcgatcgccacactgcgatcccccactttcaggagcgagacatgaaacttttgcatatcgattccagcatcctcggcgacgcctccgcttcccgccaactgagcgccgagctggtccaggcctggcggcagaacgaagacgggcttgacgtcacctaccgcgacctggccgccgacgcggtggcgcatttctccgccctgaccctggccgccggcagcaccccggcggagctgcgcgatgccgcgctgaagcatgaagtcgcggtgggtgaagaagtgctggaagagttcctcgccgccgacgtcgtggtaatcggcgcgccgatgtacaacttcaccatctccagccagctcaaggcctggatcgatcgcatcgcggtcgtcggcaagaccttccgctacaccgagaacggcccggttggcctggccggcgacaagaaagtggtgatcgtctccaccgccggtggcgtgcatgccggccagccgaccggcgcggcccacgaaggctacctgcgcaccgtgctgggtttcttcggcatcaccgatatcgaagtggttcgcgccgaaggcctggcctatggcgaggagccccgcgcccaggccatcgccgccgcccgccggcagatcgccgggcagttcgccgcggcctga

SEQ ID NO: 15361 - DNA, 288 bp, Pseudomonas aeruginosa
ttgtccagcgccaggttcagcgcctcgatggactccatgtccaggtggttggtcggctcgtccatcaccagcacgttggggcgcttgaggatcagccggccgaacagcatgcggccctgctcgccgccggagatcactttcaccgacttcttgatctcgtcgttggagaacagcatgcggccgagggtgccgcgcaccagttgttcgccgccctgggtccactgggccatccagtcgaacaggctcatgtcgtcggcgaagtcgtcggcatggtcctgggcgaaatag

SEQ ID NO: 15362 - DNA, 657 bp, Pseudomonas aeruginosa
aatcccgctccccattccccgcaaggcccgccagcatgccgcatctcgtcatcgaagccactgccaacctccgcctcgaaacgtcccccggcgaactgctggagcaggccaatgccgcgctgttcgcttccgggcaattcggcgaggcggacatcaagtcgcgcttcgtcaccctggaggcctaccggcagggaaccgcggcggccgagcgcgcctacctgcatgcctgcctgtcgatcctcgacgggcgcgacgcggcgacccgccaggcactgggcgagtcgctctgcgaggtgctcgccggagcggtggcgggcggcggcgaggagggcgtgcaggtcagcgtcgaagtgcgcgagatggagcgcgccagctacgccaagcgcgtcgtcgcccggcagcgctgagagactggcgcgcgcctggctcagatccaggcgttcagcgtcgcgcgggcctgcgtcgggtcctcttgccgtcccggcgcctggccgttctgcatggcgatcatctcgcgcatgcgttcgccgatgcctttctccacctgttcgcgtttctccggcggcatcgcgtccagttcctcctcggttaggccgaggctcttcaggacctgctcgcgcatccgctcggcgggcgatttctgcatgtactccttga

SEQ ID NO: 15363 - DNA, 450 bp, Pseudomonas aeruginosa
gcggcgactgaagctggcgaatttgtcagcgcggattgcagtttcgccaggaaacccatgccactggtaaggtggcgatcccagaagatcagaggaggcggtatgcctttgaagcagttttccagtgcactcgttctcgcggccctgctcgccggttgcagcagcaacggcgacggcccgtccaccgaaggcgccagcgtagccaccggcagcgccagcgcgcccgcggccaccccggcagcggacggccgttgcgacgccaatgcggtgcaggcctatgtcggcaagcaggcttccgcggccatcgtcgaggaggcccgccgcgccgccggagcggaagtcgcccgggcgctgcgcccgcacgatgcggtgaccatggactacaacccgcgccggctgaacatcgatgtcgacgacacgctggtgatcaagcgcctgtcctgcggctga

SEQ ID NO: 15364 - DNA, 726 bp, Pseudomonas aeruginosa
acgcgggaagaagcgctgccggcggcgccagccgggccgtggggtggacgacgcgattggcgccgcccgccggcatgtcccgcgctcggccgggagaacaagcggcaggccgctggggcctgctcaggcggcgacttgcgcaggcttgcccagcaggcggtcgaccaggctgcaggcggcgagagtggcgaccgaggggatcaaccaggccaggccctgttcggccaacggcaggtgcagcagccattgcgggaagtcctggcccaggcccgccgccttcagggcatcgagcacgccgaacgccagggaaaccagcatcaccggggcgaggatgcgcgtcgccgaatgccagaggccgatgcagaagctcagcgccaccagcacgatgcacggcggatagatcgcggtgagcaccgggatcgagacctggatcagcttggtcaggccgaggttggaaacgatgaaggagaaccctgccaggatgatcaccaggctgcggtaggacagcggcaggcgctggcagaagtactcggcgcaggcgcaggtcaggccgaccgcggtgaccaggcaggccagcgcgataagtcccgccaggaacgagctgccgaggctgccgaaggtatgttgcacgtaggcatgcaggaccgccgcgccgttgctggcgtcggcggcgatggcatggctgccggcgccgagccggaacaggctgacgtagaccagcactag

SEQ ID NO: 15365 - DNA, 768 bp, Pseudomonas aeruginosa
gccgacaccggcgatcagcccggcgacgatggcatagcgggtgatcagccgcggcgactgcacgccgcgggaacggatggcgttgacgatgacgatgccgaagaccagcgcggcgagggtgtccatggtcaggtagccgttgacgaaaccctgggagaacgcggcctgggtgtactccggctgggccgtgccgatcgggccggcgggccagaggaaggcggcgacgccgagaatcgccagggcgaggatcttcagcggggcgaggaagcgtccgacggtgtccagcaggcgaccggggtagagggagatggccagggcgaggaggaagtacgccaggctgtagacgaacagcgccgtgccgctctcgccgagcagcggcaccacgccgacctcgaaggacaccgtggcggtgcgcggaatggcgaacagcgggccgaccgccaggtagcagaccgccgccagcaggccgccggcatacctgccgatcggatggctgagggcgtcgaccgaaccgccgaccttggccagggcgatcacggtgatcaccggcagccccaccgcggtgatcaggaagcccagcgccgccagccacacatgggggccggactgcaagccgacgatgggcgggaagatgatgttgccggccccgacgaacagggcaaaggtcataaaaccaagcgccaggatgtcccggcctttcaaagcgttcatgctggagaggtaccgcgctgctcgaggaaattcacagaagggtttcccggggggtag

SEQ ID NO: 15366 - DNA, 1233 bp, Pseudomonas aeruginosa
  unsure (1040),(1054): Identity of nucleotide at the above locations are unknown.
aatccggctgaaagccccggaatacaagggctgcggcgcttccgaagggttacgttttctgtaggtattcttcacgaaagattgacggattgccgagcagactgccgccgtcgtcgagtgctgccaggggcaacgctgcgcacggcaacccggaagtcagtgaagatccgtgcccatgtcgaaagcccgcgccgtccgtcccgaactgctgaccctgctggtcagcctcgccttcctgctgttctacaacctgccgctgtggcaacgcctgctggcgatcaccccggcgggctggcagggcctcggcatgatgctggcagtcggcctgatgatcgccgcgatcttcaacctggcgctgaccctgctggcgttccgctggctgctcaagccggcgctgaccctgctgatcctggcggccgccggtaccacctacttcatgacccagtacggcgtgctgatggacgtcggcatgctgcgcaacgtcatgcagaccaacccggccgaggtcgccgacctgctttcgccgaagctcgccgtctacctggcgttgcttggcgcgctgccggtctggctgctgtggcgcacgccggtgcgctaccggccgtggccacgcgagctgctgagcaagctgctggtggcgctcgcctgcctggccctgcttgccggggtggcgctggccaattaccaggggctgtcctcgctgttccgcaacaacaaggaactgcgcctgcaggtcaccccgagcaacctggtcggcgccgccatcggctacgccaagggccaggcccaggccgccagccagccgctgcggccgatcgccgtcgatgcccggcgcgccgccctgtggcagggccatgcgcgcaagtcgctgaccgtgctggtggtgggcgagagcgcgcgggcacagaacttcggcctcaacggctacgctcgcgagaccaacccgcggctgaaggccgaagaaggcctgatcaacttctccaacgtgcactcctgcggtaccgagaccgcggtgtcggtgccctgcatgttctccaacntgggccgcgcggantacagcgacgctcgcgcgcgcacccaggaaggccttctcgatgtgttgcagcgcgcaggcctgcgggtcctgtggcgggacaaccagtccggctgcaagggcacctgcgaccgcgtcgccttccaggacctgagcgagagcaaggatccggccctgtgcgccggcggcgagtgccatga

SEQ ID NO: 15367 - DNA, 945 bp, Pseudomonas aeruginosa
cgagatcctcctgcgcgacttgcaggccttcatcgacgggctgcaacaggacaccgtgctggtcctgcaccagatgggcagccacggcccggcctacttcaagcgctatcccagggagtacgagaagttcaccccggtctgcgccagcaacgacttcagcgcctgctcgcgggacagcatcatcaacggctacgacaacaccctgctgtacaccgaccacgtgctggccagcctgatcgacctgctgcgcaagaacgaagagcgcatcgataccggcatgctctacctctccgaccatggcgagtcgctcggcgagtacaacctctacctgcatggcacgccttacctgctggcgccggaccagcagaagcacgtcggcatgctggcctggttctcgcccggctaccagagcgccttcggcctcgacagtggctgcctgcgccagcgcagcaacgaggagctgtcccaggacaacctgttccactcgatgctcggcctgctggaagtgcgcaccggcgcctacgatcccggcctcgacctgttcgccccgtgccgtgcgccggaggtcctgcaggcgctcaaggccgacggcggacgggcgctgtactccgaggaagcgtctggccaggagccgccggcttcctgatacgacccggcgaaaggactatttccttcgcctcgcggaagggtaaggttcagcctcggaacccgcgaggacgcccatggatcgccacgcccaacaccaccccaggagccgcgcctgcgtgctgcccaacggcctgcgcctgcacctggcgcatgatccggcggcatcgcgcgccgctgcctggctgcgggtggcggcgggcagccacgacgagccgagcgcgcatcccggcctggcccacttcctcgagcacctgtcgtttctcggcggcgcggcgtttcccggcgacgagcgcctga

SEQ ID NO: 15368 - DNA, 1887 bp, Pseudomonas aeruginosa
tcgacgcggcgctggccctcggcttgcccgccggacacccccctgcggcgtttcgctgccgggcgccgcgacagcctggccctggagaacgatgcgttccagcgggccctgcgcgaattccatgccgcccactatcacgccggcaattgccagctatggctgcaagggccgcaggcactggacgagctggagaggctggcgcagcgtgcctgcgccgacctgccggggcgcgcgccaggcgcgaatccgccgccgccgccgttgctgcccttcgccggcgaagcgctggcgctgcgcctgccgggaccgccgcggctggtgctgggctttgccctcgacgctttgcgggaggccgacgaacagaccctgcaggcgttcgccgaattgctcggcgatcgctcgccgggcgggttgctggcggcactcggcgaacagggcctgggcgaatcggcggcgctgcgggtggttcaccgggatgcgcggcaggcgctcctggcgttgaccttcgaactgttcgacggcagcgcggcggcggcgctggaggcggcctttttcgactggctgggcgacctgcgcgacgatgccgccagcctgctggcggcgcgccggccgttgctggcggagcccactgcaccgctggagcgactacgccagcgcgttcttggcctgccagcggagattcgcccggcctgcctggacgcgctgcgcgccgaccgttgcctgcggctgcacctggacagcgaactcgacggtgccgaagcgcgctggtcggcgggcttccgcctgagtgtggcgccggttgccgcagcgccgccgctggccgcgcagcggcatgcctggcgcttcgaactgccgttgccgcccagtgccgccgccgagggcgcgctgttcctgcgctggcgctttcccggtgtgcccgcacggtcacgctttctggcgctgcgccaggcgttgcgtccgctgtgcggccaggcacgcctggggggtgtggagatgggcctggaggcgctcggcgaggactggtcgctgagcctgctcggtccgcgcgatcgcctcgaggccgccgtgcgcccggccctggcccggctcctcgcggcgccgcccgactggcgcgcgagcggcgagcgtctgtcctccgccgagcggcgccgcagcgccactggcctgccgatccggcagttgctggacgccttgcccggcctactcggcgagccgctggcggaggtcgacgactggcggcggacgcgctgggacgccttggtcatgcaggccgcgatgccagatccccgatggatgcccggccaggctgccggcgagcgcctggagcctctgccgccgaggcccggacggcatcgccgcgaactggccatggacggcgagtcggcgttgctgctgttctgtccgctgcccacgcaggaggtgccgatggaggcggcctggcgcttgctggcgcgcctgcacgaaccggccttccagcggcgcctgcgcgacgagctgcaactgggctacgcgttgttctgcggcttccgcgaggtcggcgcccggcgcggcctgctgttcgccgcgcaatctccgcgtgcctgcccggtacgcctgctggagcatatggagaccttcctccagcgctccgccgaggcgctcgcgcaactgccggcgcgacgcctggccggcctgcgcgaagccctcgccgacgacctgcgccgagcaccgggtagcttcgccgagcgagcacggcgcgcctgggcggagcaccttggcggtggcgccggtcgctcccggctgctcgccgaggccgccctcggcctgagcggcgacgacctgctcgcggcccaggcccggttgctggaggcgcgcggcggctggtgggtgctttccagtcggcgctga

SEQ ID NO: 15369 - DNA, 408 bp, Pseudomonas aeruginosa
tcggcaaggacttcggcctgttctcgcgctcgaacatcttcctcgacgaactgctggccggtttcggcaaccccagcgacaccctcggcctggtggacggcaagggcgtctccttcggcaacatcggcaccggctatccgtatccgttccccacctcgcagatcacctaccgcaacaacaacctgctgcccggcctgcgcatcgccgtgggcatcctcgacccgatcgactccaaccagatcgacaaagatgccagcgacggcctcgacgacaaggcctaccaggacaacccgcgctacgagagcgaggtcagctaccagttcgacctggccggggcgcaggtctacagctggatcaacggcggttaccagacttcgaagaacaccagcgacagcgtcgacagcgtga

SEQ ID NO: 15370 - DNA, 2676 bp, Pseudomonas aeruginosa
tcggcttcaacacctacggagagcaattcaatggcatgcatatcaaccagaccttcaccggggtcgccattggccgaccccgcggaggtgtccgtcgctgagctgcaggcgcgggtcgtcgccctcgaagaagagcggcacaagttgcagcggatcaaccaggcgctgatcggacgcatcgagtcgagcgccgcgcagagcgacgaggcctacggcgccttccagtattccgtggtgctggccgagcaggtccgcgagcgcaccgacgcgctgagccagacgatgctcgaactgaaggccagcaaccagttgctcagcgacgctcgcctgcgtgccgagaccgcccaccagcatctgctcgacgctatcgaaagcatctccgacgccttcgtcctgttcgatccgcagcaacgcatcgtgttgttcaacgagcgcttccgcgcgctgtggatcgacagccgggcgcggatcggtcctggcatgcgtcgcgccgaactgcaccgactggcgcgtagcggcgggctgatcgtcgaggagcagcgcggcggcgaccagcagaccctgtaccgcctgcgcgacgagcgctggctgcggatgagcgagcgaccgacccgcgacggcgggctggcggtgctctacagcgacgtcaccgagatcaagctcagcgagaccgcgcgccgcgagcaggcgctggcgcagaagtcgcacctgttgcagcgggcggtggacaatctctcccagggcgtggcgatggtcggtgccgacggcgtgctggagttgtggaaccggcgcttcctggagctctgcgggctggccccgatcgccgggcaccgggccttcgccgaagtgatggcggagagcgaattgccgttgctcacgccgcgcagccaggactcccaggggagtccgctgagcgcccgcgagcagcgcctgttcgatggccgggtgctggagatccgtacccatgcgctgcccaccggcggcttcgtcaacaccttcaccgacatcaccgaacgctatcgccacgccgaggcgttgcgcgccagcgagcgctggatccgcctgatcaccgaccaggtgccggcgctgatcgcctatctcagcgacgaactggtctacgaattcaccaacaaggtctacgaggagtggtaccgctggcccagcggctcgatgctcggccgctgcctgcgcgacgtgcatggcgccgagcactgccggcgcctggagccgtacttcgagcgggccctggccggcgaaagcgtgaccttcgagatcgccgagaccgcgttgtccggcgaggagcgctacatgcagcgctcctacgtgccgaaccgccaggccgacggccgggtcgccgggctgttcgtgctgattcgggatatcaccgagcgccggcggaccgccgaggcgctgcaccaggcctaccagaacctcgaacagcgggtgcgcgagcggaccgccgagctgaccaccctcaacgaccagttcaagcgcgagatccacgagcgcagccaggtcgaggcgcgcctgcgcgaggccaagcgcgaggcggaacaggccaacctgtcgaagaccaagttcctcgcggcggtcagccacgacctgctgcaaccgctgaacgccgcgcggctgttcaccagcgccttgcaggagcgcggcagcgcggcgcgggacaacgaggcgctggtgaacaacatcagccattcgctggaggacgtggagaacctgctcggcaccctggtggacatttccaagctggacgccggcgtgatcaccccggacatcgccccgttcgagcttggcgaactgctcggcaacctggccgcggagtaccgccaggtagccgccagcgaagggctacgcctggacttcgtggcctgcggggcgctggtccgcagcgaccagcaactgctcgcgcgaatcctccgcaacctgctttccaacgccatccgctataccccgcgagggcgcgtgctgctgggttgccgccggcatcggcagcgcctgtcgatcgaggtctgggacaccggggtgggcatcgccgccgacaagctcggcgagattttccaggaattcaagcgcggcgagtcacagcgttgtcaccaagaccgcgggctcggcctgggattggcgatcgtcgacaagatcgcccgcatgctcggccaccgggtccgggtcggctcgctgccgggcaagggctcatgcttcgccatcgaggtaccgctggcccgccatgccccgcgcagtcgcgccgagccgctggccagcgcggacgacctgcgcgagcgcctgcgtggttcgcgggtgtgggtgctggacaacgatgcggcgatctgcgcaggcatgcgcacgttgctcgaagcctggggctgccgggtagtgacggcgctgtcggaggaagacctggcgcgacaggtcgacaactaccatgccgaggccgacctgctgatcgtcgactatcacctcgacgaccagcgcaacggcgtcgacgcggtcgccgcgatcaacgcccggcgcggctcgccgctgccggcgctgatgatcaccgccaactacagcaacgagctcaagcagcaggtccgcgagcttggccataccctgatgcacaagccggtgcggccgatgaagctgaagaccgcgctctgccacttgctggagcgcgaagcctcggtctga

SEQ ID NO: 15371 - DNA, 1989 bp, Pseudomonas aeruginosa
cgcggacgtcgtcgatgtcgtcggcggcctgggccaggccggcgccgagcagggcggcgcagaggaggaaggtcttcatcgggatactccgcaggcggggaaagccgcgcctcgcagggcgcggcgcggggatcagcggctggcggtgcggttgtcccagctgggcagcttgaatacccagaaggaaccgccctgggccaccggccgggtcaggtcggccatgtcgccgccccacagcggcacggcgccgccgtagccgacggtcacgccgaggtactgctcgccgtcctgttcccaggtgatcggtggcgagacgatgccgctgccggtctggaatttccacagctccttgccgctcttcgcgtcgaaggccttgaagtagccgtcgccggtgccggtgaacaccaggttgccggcggtggccagcaccccggcccagagcggcaggtgttccttgtgttcccagaccaccttgccgctgaccgggtccatggcgcgcaggctgccgacgtggtcgtcgtacatgcgcttgatccggaagcccatgccaaggtaggcgctgcccttcgtatagctgacctcctcggtccagtagtcttccttccagtggttggccggcacgtagaacaggccggtgtcctggctgtaggccatcgggttccagttcttgccgccgaggaacggcggcgatacttccaccgccttgccatgcttctgccccggttccggcagcggcgggcgctggccctcgcgctccaccgggcggccggtcttcaggtcgatgtggctggcccaggtgatgttgtcgacgaaggggaaggcgttctgcaacttgccgttgctgcggtcgaccacatagaagaagccgttgcggtcggcgtgggcggtggccttgacgatcttgccgtccttggccttgtagtcgaacagcaccagttcgttgttgccggagaagtcccaggcgtcgttgggggtgtgctggtagaaccacttcacctcgccgctgctcgggtccaccccgacctggccggaggtgtagaggctgtcgtagtcgtgcggattgccgcccttggcggtgcgcgcccaggtgttccacgggccggggttgccggcgccgacgatgatggtgttggtctcggcgtcgaagctggcgctctgccagggagcgccgccgccgtggctccacgactcgaccttgccggtcggcgagttgcgatcgtccggccaggagggcgccttgacgtcgccggtcaccgtgctgtccttgccgttcaggcggcccatgtggccttcgacgaagggacgcatccagatttcctcgccggtatccggatcgcgggcgaacaggcggccgaccacgccgaactcgtcgcccgaactgccgtggatcagcaggaccttgccggtcttgccgtccttcacgatggtcggcgcgccagtcatggtgtagccggcgccgtgatcggcgaacttcttcttccacaccaccttgccggtgttcttgttcagcgccaccaccgaggcgtcgagggtgccgaagaacaccttgtcgccatagatcgcggcgccgcggttgaccacgtcgcagcacgggcggatgtcgtcgggcaggcggtggttgtaggtccacaggcgcttgccggtcttcgcatcgagggcgaacagccgcgagtaggaggcggtcacgtagatcacgccgtcgctgacgatggcctgggactcctggccgcgctgtttctcgtcgccgaaggagtacgaccaggccggggtcagcttgaacacgttgtcggcgttgacctgcttgagcgggctccagcgctgggcgtgggtgcccatgccgtactgcagcacgtcgccggtggtcttgtcgtcgttggcgatgtcctcccaggtcacatccttggccagcgcggcgccagcgctgcccagggcgacggcgaaggcgaggcagtgcaggctcgggcgcaggaggccggcaggggcgggtga

SEQ ID NO: 15372 - DNA, 546 bp, Pseudomonas aeruginosa
gcgaggacgcccaaagcaggattcgggtgcgcggcggagcttcctaggatggcgatgagcgccgtttggcgcccgtgccttgtcctgtctccccggaggaatgaagtgatgaacaagaacaacgccttgcgcggcctgctggtgctggccggtctcagcctctcgagcctggcgctggcccacggcgatgtgaccccccaggcagtggacaccaagggactcgagccgctgggcaaggaatggcgcgacaccaacccctaccgcaagccctacgccaagcacgacctcgccgtcgagatcggcgcctccgcctacaaccagaactgcgcgcgctgccacggcctggaagccaagtccggcggcatcgccccggacctgcgcctgctggagaccggcgccgagggcgacgaatggttcaaggagcgggtcatcaacggcgcggtgcgcgatggcgcggtgtacatgccgaagatggccgacttcatcagccaggaaggcctctgggcgatccgcagctatctggaaagcgtgcacgtcgacgagtga

SEQ ID NO: 15373 - DNA, 459 bp, Pseudomonas aeruginosa
tggccgcctggaagctggccccggcgctggccgccggcaactgcgtggtgctcaagccggccgagcagaccccgctgggcatctgcgtgctgctggaactcatcggcgacctgctgccgccgggcgtgctcaacgtcgtccagggcttcggcagggaggccggcgaggccctggccaccagcaagcgcatcgccaagatcgccttcaccggttccaccccggtcggctcgcacatcctcaagtgcgcggcggagaacatcattccctccaccgtcgagctgggcggcaagagcccgaacatctatttcgaagacatcatgcaggccgagccggcgttcatcgagaaggccgccgagggcctggtgctggccttcttcaaccagggcgaggtgtgcacctgcccgtcccgcgcgctggtccaggagtcgatctacccggcattcatggaagaggtgctga

SEQ ID NO: 15374 - DNA, 483 bp, Pseudomonas aeruginosa
aaaaggtcagggcgatcaagcgcggcgacccgctggacaccgagaccatggtcggcgcccaggcttcccagcagcagtacgagaagatcctctcctacctcgacatcgcccagcaggaaggcgccgagctgctcgccggcggcagcgtcgagaagctcgaaggcaacctggccagcggctactacatccagccgaccctgctcaaggggcacaacggcatgcgcgtgttccaggaggaaatcttcggcccggtggtcggagtcaccaccttcaaggacgaagccgaggccctggccatcgccaacgacaccgagtacggcctcggcgccggcctctggacccgcgacatcaaccgcgcctaccgcatgggccgcgggatcaaggccggtcgcgtgtggaccaactgctaccacctgtacccggcccacgccgcgttcggcggctacaagaagtccggcgtcggtcgcgagacgcacaagatga

SEQ ID NO: 15375 - DNA, 1578 bp, Pseudomonas aeruginosa
aaaacccatgtccctcgaacaaaccggccatgcgcccgcaacttccggggtcgacttcgaaagcgtcgacgccgactacttccaacaccgtcaactgaagaaaggcgccgccggctgggtcctgctggtcgggctcggcgtcgcctacgtgatctccggcgactacgccggctggaacttcggcctggcccagggcggctggggcgggatgttcctcgccaccctgctgatggccaccatgtacctgtgcatgtgcttctcgctcgccgagctgtcttcgatgatccctaccgccggcggcggaaacggcttcgcccgcagcgccttcgggccctggggcggcttcctcaccggcaccgcgatcctcatcgaatacgccatcgccccggcggccatcgcctgcttcatcggcgcctactgcgagtcgctgttcggcgtcggcggctggctgatctacctggtgttctacatcgtattcatcggcatccacatcctcggcgccggcgaggcgctgaagctgatgttcgtcatcaccgcggtggcggccatcgccctcggcgtgttcattgtcgcgatggttccgcacttcgactcggccaacctgttcaacatcccgcagaccgcggcgaccggcgccagcagcttcctgccgttcggctatgtcggggtctgggcggcgatcccctacgcgatctggttcttcctcgccgtcgaaggcgtgccgctggccgccgaggaaaccaagaaccccaagcgcgacctgccgcgcggactgatcggcgccatgttggtgcttctcgccttcgccgcactgattctggtcgtcggtcccggggccgccggagccaaggagctgatgggctcgggcaatcccctggtggaagcgctggagtcggcctacaagggttcgacctggatgagccagttcgtcaacctggtcggcctggccgggctgatcgccagcttcttctcgatcatctatgcctactcgcggcagatcttcgccctctcccgcgccggctacctgccgcgcagcctctcgctgaccaaccgcaagaaggcgccggtactggccctggtggtgccgggggtgatcggcttcggcttgtcgctgaccggccagggcgacctgctgatcctggtcgcggtgttcggcgcgaccatctcctacgtgctgatgatggccgcgcacatcaccctgcgcatccgccgcccggacatgcagcgcccctaccgcacccctggcggcatcctcacctccggcgtatccctggcgctggcctgcgtcgcggtggtcgccggcttcctggtcgacccgcgggtcgtggtcggcgcggtggcgatctacgctgtactgatcggctacttcgccctgtacagtcggcatcacctggtgtccggcaccccggaagaagagttcgccgcgatccaggcggcggaacaggacctgcgctgagagcgacaacgacaaagcccggcccgccgcatggcgaggccgggcactggagacacacatggcacgtttcacccatagcgtcggcggcgaaacctaccgcttcgacagcctcaaggacgtga

SEQ ID NO: 15376 - DNA, 957 bp, Pseudomonas aeruginosa
agccggcgccggaattcgaggactggttgcagcggatgggaatcttcacccaggccgacgggcgcatccgcttcggtgacgagttaccgccggcgttccgccaggccctggcgcaactggcctgaggagatgccgatgaacgacaagcacctgcccgacgccagcgccgagaacccctggctgccgctgcgccagctgacccccgcgcggatcgccctgggccgcaccggcaccagcctgccgacccgcccgcaactggacttccagtacgcccacgcccaggcgcgcgacgccgtgcacctgcccttcgaccatgcggccatcagcgacggcctgcgccagcgcggccgcgacagcctgctgctgcacagcgccgccgccgaccgccacgtctacctgcaacgcccggacctcggccggcgcctcgacgaggcctcggtgcaacgcctgcgcgaacacgccgccggctacgacgggcagatcgacctggccatcgtggtcgccgacggcctctccgcgctggccgtgcagcgtcacaccctgcccttcctcgaacgcctggaggaacaggcgctggccgaaggctggtcgctgtcgccggtggtcctggtggaacagggacgggtggcggtggccgacgagatcggtgaattgctgcgggcgaagatgagcgtgatcctgatcggcgagcgtcccggcctcagctcgccggacagcctcggcctgtacttcacctgggccccgcgggtcggcctcaccgacgcctatcgcaactgcatctccaacgtccgcctggaaggcctcagctacggcatggccgcgcaccgcctgctctacctgatgcgcgaggcctgccggcggcagctttccggggtcaacctgaaggacgaggcggaggtccaggcgctggacggcgaggctccgcgcaccggcaacttcctcctggcgagggactga

SEQ ID NO: 15377 - DNA, 624 bp, Pseudomonas aeruginosa
gcctcccggccgaaggatgggccggcgcgcgtcgcccctccttcggccgattcaaacgttcgcttggattgcgctttccagggagattgggcagcatcgaagcgttgctggcatgcagcctgcatcgtcccggcagccccttcccgcaatgcgaggcccgtcatgcgaatcgtgcaagccaccctcgaacacctcgacctgctggcgccgctgttcgtcaagtaccgcgaattctacggcatgctctcctaccccgagtcctcgcggaaattcctcgagaaacgcctgcgccgcaaggagtcggtgatctacctggcgctggccgacgaagaagaccgcctgctcggtttctgccagctctatccgagcttctcctcgctgtcgctcaagcgcgtctggatcctcaacgacatctacgtcgccgaggaggcgcgccggcaactggtcgccgaccacctgctgcaacacgccaagcagatggcccgggaaacccatgcggtgcgcatgcgtgtctccaccagcgtcgacaacgaggtagcgcagaaagtctacgagtcgatcggcttccgcgaagaccaggagttcaagaactacaccctgccgatcagcgacgaactaagctga

SEQ ID NO: 15378 - DNA, 1488 bp, Pseudomonas aeruginosa
agacaaaggcacggcacctcccaaccgatcgctcagagcagaggcatccatgggttcgcgcacctggcactggcccggcgtcctgctcggcctgctcctcgccacggccggcgcgcaggccgacaccctgcgcgtggcgaccctcgactgggcgccctacgtcggccccgacctgccgggcaagggcctcgccagccgcatcctcgacgaagccctggccctcgacgggcaccgcgccgaactggtgttcctgccctggcaacgtgccctgaaggaagccgccgaggggcgcttcgacgctctcatgccggcctacctgtcgcccgagcggcgcgaactgttccacgccaccatccccctgctcgactcgcaactgggcttcttccgccagcgcgagcgcctgctgccggtcaatcccgcgcatctggaaagcctgcgtccgtaccgcatcggcgtggtccgcggctacgtcaaccgggaggatttcgacgccgaccgcagcctgaccaaggacgcggtgaccaacgactggcagaacctcgagaagctcctgcgcgggcgtatcgacctggccgtggtcgatcgctacaccggctaccacctgctggcgcgcaacgtgccggcgctgaaggatcgcctggtgttcatcgaaccgccgctggaggtcaagccgctctatgtactggtgccgaaaagacacgcccgcggcgccgcccttgccgccagcctcgaccgcaacctgcgcctgatgcgtcgcagcggccggctggaacaactgatcgccgaagcacacctcgaacgcagcgggcagacccgcacgctggccgtcgatccgttaaccggccaggccgaccagcagcgcagccccggccaggagcaggaccagggccagcacgccccgttgcaaccggcgtggcgcgaagacccgctggggatgcgctagcggcttctgcaaggccagccagaattccgacaacgcttcgaagcgcgcctccggacgcggcgccagggcccgcgccaataccccatcccagccgaccggcaggtccgcctgacgctcgcccaggggctcgtagcggcatccgccgtcgctctccgggcaggcgatcgacggccagcgaccacagagcagccaatagaacagcgccgccagggcgaactggtcggcccggccatcgagcgcctcgccgcgacgcaactccggcgccagcggcacgctgtccgcaggcagcgcctggcgcgccacccccggcaggatcgccgccgcctcggggaggaacagcaggcgcccgccctcgtccagcaggatctgccgcggcgcccagccacaagccctgtacgccgcgccgctgcaaggcgcgaaccgcatccataagttgctccaggaggaccagcgcgcattgcggttccagcggcaggtgcgctggcgcccaatccagcaggctgcgcatcggccagcgcggcggagcgaacaactggaaggcatga

SEQ ID NO: 15379 - DNA, 534 bp, Pseudomonas aeruginosa
cgacgcaaccggggcgacgacaatactcgcggcaggctctccgcacggcagcgccgcaatgcccattcgcgctgccagaacgcttcgtcggcatcgaccgccgcgagcagcagcaacgcctcgcgtccttgctcgtcgcaggcgcggaatagccgcccgggcgggccgaacgcgcaagctgcctgcaaggtccagccatccacgcagtcgccggggcacgccgcgcccagcgctggccagccggtatgccgtggcgccgccggggcgcgctcgagcgcccccggcaagaccagcgccaccgcccccggcgcatgcagcaacggctgcagcacgccctccaggcgccccgtggccagccccgcacaacgctctccgagggcgcgcaggtcggccacttcgagcagcggctggggcgccagcaacaagggctcgccggccacctgggtcaggttgtgctggaccagcgccagctccgcgctgctacccagcggctggccgctccctcccaggcgctgcaggctgccctggcgataa

SEQ ID NO: 15380 - DNA, 711 bp, Pseudomonas aeruginosa
tggcggccctctgccgctcaacgcgttgtctccgcaggttgctcaatggacttcaacccaatcgatctgattctccacctggatacctacctggccatgctggtcagcaactatggcgtctggatctacgccatcctgttcctggtgatcttctgtgaaaccggcctggtggtgactccgttcctccccggcgactcgctgctgttcatcgccggcgccatctgcgccaccggcggcatggacccatggctgctcggcgggctgctgatggtcgcggcgatcaccggcgacagcaccaactacgtgatcggccggaccctcggcaagcggctgttcagcaaccccgactcgaaggtattccgccgcgactacctcgaccgcacccatgagttctacgaacgccacggcggcaagaccgtgaccctggcgcgcttcctgcccatcgtgcggaccttcgcgcccttcgtcgccggcatggcgaagatgcactacccgcgcttcgtcatgttcagcgtggtgggcaccgtggcctgggtcggcggcctggtgaccctgggctacttcttcggcaacgtgccgttcatcaagaagaacctgtcgctgctggtgatcggcatcatcctgctgtcgctgctgccgatgatcctcggcttcattcgccatcgcctgcaggcgagcgccgccaaacaggccaaggcccagagcgactga

SEQ ID NO: 15381 - DNA, 858 bp, Pseudomonas aeruginosa
acgccctgctcgaccgcgaccccgacgcgcagaccgccatcgacccctatgcggcggaagatccggcggagttcttcgccgttaccagcgagtatttcttcaccgccccggatctcctccacgaggcctatccggcggtataccggcagctccagttgttctaccgccaggacccgctgcaacgcctgcgccgcctgcaggccgagcatccggactaccgcgaggcggcgggcgacacgactaacggctgaatgccggtacatggcatcgacaaccgaatatgcctataatcgcggcctcttttttggccagaaacctctggagtcacccatgagctacagcaagatcccggccggcaaggacctgccgaacgacatctacgtcgctatcgagattccggccaaccatgcgccgatcaagtacgagatcgacaaggacaccgactgcctgttcgtcgaccgtttcatggccaccccgatgttctacccggccaactacggcttcatcccgaacactctggccgacgacggcgacccgctggacgtgctggtggtgaccccctatccggtcgctcccggttcggtgatccgcgcgcgcccggttggcgtcctgcacatgaccgacgaggcaggcggcgacgccaagctgatcgccgtgccgcacgacaagctgagcgtcctgtacaaggacgtgaaggaatacaccgacctgccggccctgctgctggaacagatcaagcacttcttcgagaactacaaggatctcgagaaaggcaagtgggtcaaggtcgaaggctggggcaacgccgacgccgcccgcgccgagatcaccaaggccgtggccgcgttccagaagtaa

SEQ ID NO: 15382 - DNA, 333 bp, Pseudomonas aeruginosa
ccattaagcgggacgaagagcccgcgagccagcgccagcctgacctatcaaggagtcgtagccatgggtttccggccagttagccaacgtttgcgtgacatcaacctgcaggccctcggcaagttttcctgccttgccctggtcctcggcctggaatcggtaagccatccggccggcccggtccaggccccgtcgttcagccagggcaccgccagcccgtccttcgctactccgctcggcctcgacggcccggcccgcgccagggccgagatgtggaacgtcggcctgtccggcgccgtcagcgtgcgtgacgagttgcgctgggtgttttga

SEQ ID NO: 15383 - DNA, 2112 bp, Pseudomonas aeruginosa
aaaggacctcatcatgaagcaatacggagcagagttcttcggcaccttctggctggtattgggcggctgcggcagcgcagtactcgctgccggcgtaccggaactgggaatcggctacctcggcgtggccctggcgttcggcctcagcgtgctgaccatggcctatgccatcggcccgatctccggcgcccacctgaaccccgcggtatcggtaggcctgtgggtcggcgggcgcttcccggccagccaactgctgccctatgtcgtcgcccaggtcctcggtggcctcgccgccggcggcgtgctgtacctgatcgccagcggcaaggccggcttcgacctggccgccggcttcgcctccaacggctacggcgaacactcgccgggcggctactcgttgcaagccgcgctggtcagcgaagtggtacttaccggcatgttcctgctgatcatcctcggcgccacctccaagcgcgcgccgcagggcttcgcgccgatcgccatcggcctgaccctgaccctgatccacctgatcagcatcccggtcaccaacacctcggtgaacccggcgcgcagcaccgcggtcgccctgtacgtcggcgactgggcggtttcccagctgtggctgttctgggtcgcgccgattctcggtgcggtactcggcgccctggcctatcgcctgatcggcgacaagaacgactgaaccgaagcgcctggcccaaccgccaggcgctgcggccgaggaaacgacaagggagcctgcgggctcccgatgtcgttgcaaggattgcgaaaccggcgcccgatcaggcagattgcagcctgaccggaccgccagcgatacctgacccgccgcccagtgaagcctatgacagccctcgcccttacttcccgatccctctttccggcttgcgccgccctggcgctgggcggactgttgacgctgctcgccggctccgtcgcggccgcgccggccaagacgaaacggccgccgttcatcgagcagggcgaaacgtgcctgccccagccgctccccgccagcgtgctctacctcgccggcgacgcctggaagctcgacgccaagggcaaccagacgcccctggaagaaggcatggacatcgacgaactggaaggcgtcaagacctctccgaccgccttcgtcagcctgctgctcggcgacggcagccgcatcgtcctgccctccagttcggaagtcaccctgcacctcgacgaggacaccggcattccgcagatcgccctgcgcgcggggcaggtcgagtcctatgtcctgaagagaaagagcgatcacgaccgcttccaggtgctgaccccggtcggcgtactgggcgtgcgcggtacccacttccgcgcccgcaccgaagacggccaggcgctgaccgaagtgctcgacgggcgcgtcgcggtgaaccgcgagctgaccagcgacgacctgccgctcaacggcaggcgcccggcccgcaaggcggcgcaggccgagccggacgaggacgtgctggtcgacgcccgccgcggcctgaaggtcaagccgcagggcaagctgacgccggtggacctgctacccgccccgcaattgcgcggccagggcggcgagcacggcgagtcgccggtttggaagctctatcttgccccgctgcacggcgccaagcgctaccgtgcccaggtagccagcgatccggacttcctgcgcatccagcaggagcgtttctcgagcaccccggaagtcagtttcagcggactcaaggcggccttctaccacgtccgtctctcggccttcgacaacgacggactggagggcgagaccagcgtatacgacattctctactacccgcgaggcggcagtgcccgatagggcaccggggcctcgccgatgaaggcgctcgaccgccaggacgagcccagccaggcgcagcggctgttccgcggcctggtgcgcgaatggctgctggtcagcctgctgctccttccgctcaccgccctgctttcgctgagcagcggcctgccgctgaacaacctgctctacgaccgcctgcgcaacctcgccccgctggccgtcgatccgcgcatcctcgtcgtcgccatcgacgaccgtag

SEQ ID NO: 15384 - DNA, 444 bp, Pseudomonas aeruginosa
cctggaaagcctcggtcgctggccctggccgcgcagcgtccacgccgagctgctggatcgcctggccgccgccggcgcacgcagcgtactgctcgacgtgatcttcagcgaaccctcctccaatccggacagcgaccgccagttggcaagatcgctgtgccgggccggcaacgtcctcctgccactgctgcgcgaaagcgtgccgcgctacggcgaaccgccacgggagataccgccgaccgcgccgctggccggctgcgccgccggcatcgggcatatcaacgtcgaagcggacagcgacggcacggtgcgcagcgtctacctgcgcgaaggaccgctcggccagccgcgcccgctgctcgcctggcaagcattcgccgatgccggcgccatgcccatgcccggcctcgacgacatgcgcaacctgcccggctggcagcgtga

SEQ ID NO: 15385 - DNA, 999 bp, Pseudomonas aeruginosa
ccacgccatccgcattcccttcatcggtgccgacgcgggcttccccagcgtgccctacgtcagcgtgttgcgcggcgaggtgccagacagcctgctgcgcgaccgcctggtcctggtcggcgccaccgcgccgggcctcggcgaccgctatgtcaccccgctgtcggccagcctcggcaccacgccgggggtggagatccaggccaacattctcaacggcctgttgcagcagcgcaccgccgtcgacctgcaaccctggctcgccgccctgctctccgccgccagcgtagcgctgctgctcggcctgatgctgttccgctcgcgccacgccttgctcctcaccctggcctgcgcggccctggccctgggtctttcctgggcgctgctgctcaacggctggtggtggtcgccgctggccagcctggtcggcctgctgctggcctacctgatctggagctggcgccggctgaacgcggtgctcgcctacttcggctgggaactggcgcgcctcgaccgcgagcccaaggtgctgcccgagcgggccagccccccgcgcgccggcaacgatccattgcagaaccgcatcgccgccctggagcaggcggtcagccgcacccgcgacagccggcggttcatggccgacggcctggaatgcctgccggtggcgaccctgatctgcgacccgcaggggcagatcctgctggccaaccgcaaggcacgcgacctgttcggcggcgagctgcgcggcgccgaactgcgccagcgcctggccgaactcggccatccgagcctcgccggtggcgcccgcccaacgctggaaaccctggaagccatcgagttccgcgaccaccgggaacgcgacctgcgcctcgacctggcgcgcctgctgccggtcgaaagcgaaaccgccatcggctggctggtgagcctgatcgacctgagcgccgaacgcgatgccgagcgccagcgcgccaccctcctgcgcttcctctcccatga

SEQ ID NO: 15386 - DNA, 1038 bp, Pseudomonas aeruginosa
ctaatcttaaaaagagcccactggaaaaaccagccaataactcccggtaatctaccgcgctcatgcgatcccctacgcatatcagcaaacggctcaacttccagtgaaaccatgatcgacatagacagactgagcaaacgcttttccggccggacggtggtaaacgacttgagcttccgcatcgaccggggagagatcgtcggtctcctcggccccaacggagcgggcaagtcgaccaccctgaagatgctttccggcttcctcgcgccgagcgccggcagcgtacgcatcttcggcttcgacatgcaggacaaggcgcgccaggcacagaagctgatcggctacctgccggagaacgctcccagctacggagaaatgacggtcgagggctttctcgccttcgtcgcgtccatccgcgactacagcggacgggaaaaacgtcggcgcatcgacagcgccatggactgcatggagctgcgggatgagcgcaggagcatcatcgaaaccctgtccaagggcttcaagcgccgcgtcgcgctggcccaggcgatcctccacgatcccgagctgctcctgctcgacgagcccaccgacggcctcgacccgaatcagaagcaccaggtccggcaactggtgaagaacctctcggaaagcaagatcgtggtgatttccacgcacatcctcgaggaagtctcgttcatgtgcagccgcgccctggtgatcaacggcggccgcctgctggccgacaacaccccgggcgaactcaggacccgcagccgctaccaccatgccgtcagcctcagcatcgaagcaccggtagacccgctggccatcgccatgctccccggcgtcgccggtatcgaaggacgccccgaccgggccggcaccctgaccattctggcccgccccggcgtgcagatccttcccgcgctcaaccgcctgatccacggcagcggctggcgggtatccggggtgcgtaccgaacacggccaactggaagaagtgttccgccaactgacccgagaaacccccgcatga

SEQ ID NO: 15387 - DNA, 1101 bp, Pseudomonas aeruginosa
aactggccaatacggtcctgctgccggcactgctcaccctgttcctcctgctgcattggagctggcgcagcatgcgccggaggaggggctgacatgcgcctgcgtaacgtagcgggactcgctctcgccctggcgctgttcgccggaatcttgggctggctccacgaacggcagcaaccgcccgcgcaaccgcctgcgagccgcgcctggctgccagggctgaaaccgcaccaggtgaccgcgctgtgcatcgccacccccggccaaccgacgatccgcgccaggcgcgatggcaaggactggacgctcgccagcaaggacggctatcccgcctcgggggaaaccatccggcagctgttgcgcagcctggccgacgcgcgcctgctggaggaaaagagcgcctcgccggaaaaccgcgaacgcatgggactctccgaccagggcaagggccaggccagccggatcaccctggagcgcggcgacgcgccgccgctggtcctgttgctgggcaagcgcacctcgcagggcgggcagttggtcaggcaggccgacgatgagcgggcctggctgatcgaccgaacggtcggcctgccggtcaacgacctggccctgctcgaccctcggttgaccgacctgccattcgaacagttgcgcgagctgaccctgtcctatggcaacggtgtacggctgaacatttcccgagccagcgaaaaggacgatggcatccgcctgcgacagttcccatccaggccacagttgatgggcgaggcggaagccgagcaggccgcacgcctgttcgctgcgctcaggctgctggaggtcgcgccggccaaggcctcgcggcaaaaaccgctgctgaccttcacgctcaagagtttcgccggcggcacgctgcagggccagcttctggaactggagcgccagtactggttgcaactgaccgacagcaagggcttcgccgacgggcaggtctcagccgtcaagggttggcgctaccgcgtggagggtctgagtccggataccgctcccgcgccccagctacccaaggcatcgccggtgaagaaaagcaagccggccaagccctcgtcgcccaagtgctga

SEQ ID NO: 15388 - DNA, 1281 bp, Pseudomonas aeruginosa
agtggggggcccgatggggggacgagggacgacaggggaaatccaatgggtaagctgaatccgaaacaagtcgaaaacctgaccgaacccggcacctatgaagatggtgatgggcttcgcttggtcgtcaaacctaccgggcgtaaatcttggttgcttcgctaccaactggcaggtcggcgaagggagatgggattgggctcatttcctgaggtaagtctcaagaaagctaggcttgaagccagtgccaagcgcagcctactaagcaacggaatagatccgctagctgcccgtgacatcgaacgagcagcacagcgcgaagctcagaaagcaagtgaggcgaaacagctaaaatttgaggccatcgcgaaagactactgcgatgcacacagcgcctcttggtcggataagtggcgcaaaggctggttacgcaagcttgagctgtatgcgtttgagcacattggtaggcttcctgctgatgaaattgacacacctcaagtacttaaggtccttcaacctatctggcagaccaaaacccgcacagccgacgaagtgcgcgggcagattgagcagattctagacgcagcaaaagcacgcggcctacgccagggagaaaatcccgctcgctggcggggacacttggacaatctgctcagtcgtgctgaaaagaaaaaagcccgaaaacgagagcattttgaagctctgcgctggcaggatgtccctgccctaatggtcaaactcagagcaaacaccgcgccagcgtcgttggccgctcagctcctgataatgacaggcgcacgcgctcacatggtgagattcgcacgttgggacgagttcgaccttaatgctgccacctggtctcttcctgaagagcgcatgaaaatgcgggtggcctttgtaatcccactacccgatcaagtcgtggagctagttcaaagcattccgagagaatcaggatcccccttccttttccctggccaaggcaagacaggagtcatgcacgcaaatgccatacgcacccttctgcatgaaatggaatacaaacacattacccgacacggctttcggtcttcatttcgggactgggcaggcgagagcacaaattatcctcgcgaagtctgcgaaatggcgcttgctcatgacgaacgcgaccaaactgaaggggcgtactctcgctctgactttctcgacaaacgacgagcactgatgaacgactgggctaaattcttactttcaaataaagacacgctccagcagcgggaggtgaataatgctttttga

SEQ ID NO: 15389 - DNA, 339 bp, Pseudomonas aeruginosa
ggaaaccacatgtacaacctatgcccgaattgcaactccagtcgtgtaacaacaaagaatctcggaaaacaaacagggggattaattggtgcagcgggcggtgctgctagtggtgccgctggcgctatgtccggcgcggaagtcggtgcggtgctaggcgtggtcggtggcccagtagggatagccattggcagtattgctggcgctcttatcggtggactgcttggcggagtagctggcggcataactggtgccacgattggcgaacaggttgatgaaaagattctcaataactatcaatgcctgcattgtggttacagcttcagcatcaagagttaa

SEQ ID NO: 15390 - DNA, 1008 bp, Pseudomonas aeruginosa
aacggccttatttccgctcattcgtcagggacatctcacatggctcatttcattgaacaaatggcttacattggcgtaaccccgtggcatggcctgggaagacgcctttccccgaaacaaccaatcgaagtatggcagcgtgaagctggcatggactggaagatccaagacagcccggtacatttcaagtccaacagcatcggtgctctgggatcaatttataccttccctgaacagaaggtactttaccgatccgacaccaagactccattgtcagtagtctccagccggtatcaggtggtgcagccccgtgaagtactggagttctaccgggacctcactgaagtctcggggtatgaactggaaacagccggggtgctgaaggggggtcgcaagttctgggctttggcccgtaccgggcaaagcacggtgctgaaggacaacgatcaagtggatagctaccttctgctagctacttcctgcgacggcaccttagctactaccgccactccaactaccgtacgtgtagtctgcaataacacgctggccatcgccttggatgggagcaatcgtgcgatcaaggttccacataacacccgcttcgattcgcaggcagtgaaaaagcagttaggcattgccgtctcgcaatgggacgagttcatgtaccgcatgcgagcactgactgaacgcaaggtgcagtggcatgaagcaatgggctttttcatgaacgtgctgtgtgatgtagctcctgatgacaaactgcccgaagcccttccaaacgagcgggcattgcgcagagtccaggggctgtacgaaggcggaggtcggggagctttactaaagtccgcccaggggactgcatggggcttgctcaacgctgtgacagagtatgtcgatcacgaacgtcgagcgcgcagcattgagtaccgcatggattccgcctggttcggaaatggtgcgcagattaagcaaagggcgttggacgcggcgctaagactcgctgcttga

SEQ ID NO: 15391 - DNA, 186 bp, Pseudomonas aeruginosa
caggttcccaaccaatcgcctcaatcacgcttgccgctacagcccgggcaagcggtggtggaacagcgttacctacctgccttgccccgtgccatttcgttacatgcgtccgaaaccaatcaggaaacccatgtaatcgaagcatttctcgaaccgttatacaacgtgggtacttgtaatggatag

SEQ ID NO: 15392 - DNA, 987 bp, Pseudomonas aeruginosa
gagactggaagtcgccaaacacccaatccactcaggacgcccaaccggatgaacacccataagcatgcccgacttacctttgcccgccgactcgagatggtcaagcagatgacgctggaaggcttggatgccgtgcgagccgcagccgcgcacggcgtcactgcgccaacggccaggaagtggctcggtcgttacctggccggtggccaagccgccttggccgatgcctcttccaggccgctgcgatcgcccagggccatcgatgcgggcaaggctttgctcatcgtcgagctgcgcaaacgtcgaatgctgcaggctcgcatcgcacgcagtgtgggcgtctcggagtccacggtcagccgcgttctggcgcgagcgggcatgtccaggttgagcgacctggagcccgtcgaagccgttgtgcgctacgagcacgaggcgcccggggacctgctgcacatcgacaccaagaagctcgggcgcatcgtgcggcccagccaccgcgtcacaggcaaccgtcgcgactcggtcgatggtgcaggctgggagacgctgttcgtggccatcgatgatcacgcaaggttggcgttcaccgccatgcatcccgatgagaagacggcgcaggcggtcctgttcctgcgcaatgccgtggcctattacgcccgcctgggcatcaccgtgcagcgactgctgacggacaacggcgcggcgttccgctcgcgtgagttcaggtcaacctgcgtcgagctgggcatcaagcacaacttcacgcgaccctatcgacctcaaacaaacggcaaggccgagaggttcatccaattcaccgttgcgcgagtgggcctacggctggacctaccaaaactcagcccatcgaaccgatgccctggcaagctgggcaacaccactacaactggcatcgcccgcacagcggcatcggcggcatcgcgcctatgtccagactcaactcgtcaagaaataacctcttga

SEQ ID NO: 15393 - DNA, 1152 bp, Pseudomonas aeruginosa
tcccccagtccgtatcttcggctaacagccgatgatattcgtgaggctgccaatataggcactcgaaatgttgatattgtctttggcggcgccccttgccaagggtttagcctaattggtcaacgtgccctcgatgacccgcgtaactcattggtaaaagattttgtccggattgtggtagggttggactcttcgtacttcgtttttgagaacgtcaaaggtattacggttggcaagcataaacaatttctagccgagttgatcgaggagtttcagggtaaagggtataatgttttaccctggaaggttcttaatgctgcgaattatggggtgccacaagagcgcgaaaggcttatattgattggaggaaagcgtggtctaacgcttccggaatatcctgctcctgttacccgatcccctcgatctaatctgttgatggattcggaattgccgaatggaccgacctgccaagatgctctgggcgacatcccggatgcagaagcttatgaagagcttatggaggcggattctgctgtggttcaatggggcaagcctagctcctacgcgaaagttcttcgagatttagtctccggatcaaatttttacggatataaaagaagttgggataaaaatcttttaacgtgcagcttgcgcacaaatcactcagagctttctcgaacacgcttcgcttcaactgagatggggcagatagaaccgacctctcgattctttaagcttcacgctaatggagtatccaataccttgcgcgcgggtaccgattctgcgcgcggtgctttcacaagtccacgacctatccattacaagtacccacgttgtataacggttcgagaaatgcttcgattacatgggtttcctgattggtttcggacgcatgtaacgaaatggcacggggcaaggcaggtaggtaacgctgttccaccaccgcttgcccgggctgtagcggcaagcgtgattgaggcgattggttgggaacctgctagtcccgacgatactcttctgttaggggatgaaaagctgctttctatggatatggggcaagcgtctcgctactttgaaatcaatgtgcccattaagcagcgagaccgcaaaggatcaccaaagcctaaacaggctatgcttaatttggcataa

SEQ ID NO: 15394 - DNA, 225 bp, Pseudomonas aeruginosa
gctaaggctttgcacaggaaagttgggggtcgactcagaagggcgaaaatcttcgtcaaggctgtcgagagctccctctatgccatgaacgaattcaaaaatggcaccatctcctgtcctttggacacctccaatcccaagatctttcaaccgttgcggccaaattctagatgcgctttttcctcttacgatatctttcatgaagttgtaaggattaccgtctag

SEQ ID NO: 15395 - DNA, 282 bp, Pseudomonas aeruginosa
tcgcttacagtctgccccatagctaattcggctggctggaggttgatgatggatgcaaaagctcacgcacctatgagggtgcttaggctaagacaagtgcaggagcgtattggtttatcgcgatccactatctatgaccggatgaatgttgactctcctcgttacgacagtacgtttcccaagcctatgaaaattgggtgttctgctgtcggttggttggaggagagcgtaaatgactggattcgatcaaagatggatggggcgcatcgcggaaaggactga

SEQ ID NO: 15396 - DNA, 2427 bp, Pseudomonas aeruginosa
ttcggcggccgcgatacctttgccctggtcgacgatccggcagctcagccagtcgccttcgaggcggatgctcaggctgacgacggtccccgccgggctgtacttgaccgcattctccagcaggttgaacagcgcgcgcgtgagcaggccggggtcggcccagaccatcggttcctgctcgtcgtcccagtcgcgccgcaggtcgatgtctttctgttgcgcgaggggccagagctggtcggcggcgtccatcgccaacatggtgaacatgcacgcttcgaagcggtaggcgtcggattcggccttggccagttgcacgaaggcgtcggtcaggcccagggcgcgacggacctgctgctctatctgtcggtagacctgctggccggcttcgtcctcggcggggcggacgtcgagcagggcgaggatcgccgagtgcggcgcgcgcaggtcatgggagaggaagcgcaggagggtggcgcgctggcgctcggcatcgcgttcggcgctcaggtcgatcaggctcaccagccagccgatggcggtttcgctttcgaccggcagcaggcgcgccaggtcgaggcgcaggtcgcgttcccggtggtcgcggaactcgatggcttccagggtttccagcgttgggcgggcgccaccggcgaggctcggatggccgagttcggccaggcgctggcgcagttcggcgccgcgcagctcgccgccgaacaggtcgcgtgccttgcggttggccagcaggatctgcccctgcgggtcgcagatcagggtcgccaccggcaggcattccaggccgtcggccatgaaccgccggctgtcgcgggtgcggctgaccgcctgctccagggcggcgatgcggttctgcaatggatcgttgccggcgcgcggggggctggcccgctcgggcagcaccttgggctcgcggtcgaggcgcgccagttcccagccgaagtaggcgagcaccgcgttcagccggcgccagctccagatcaggtaggccagcagcaggccgaccaggctggccagcggcgaccaccaccagccgttgagcagcagcgcccaggaaagacccagggccagggccgcgcaggccagggtgaggagcaaggcgtggcgcgagcggaacagcatcaggccgagcagcagcgctacgctggcggcggagagcagggcggcgagccagggttgcaggtcgacggcggtgcgctgctgcaacaggccgttgagaatgttggcctggatctccacccccggcgtggtgccgaggctggccgacagcggggtgacatagcggtcgccgaggcccggcgcggtggcgccgaccaggaccaggcggtcgcgcagcaggctgtctggcacctcgccgcgcaacacgctgacgtagggcacgctggggaagcccgcgtcggcaccgatgaagggaatgcggatggcgtggtcacgctgccagccgggcaggttgcgcatgtcgtcgaggccgggcatgggcatggcgccggcatcggcgaatgcttgccaggcgagcagcgggcgcggctggccgagcggtccttcgcgcaggtagacgctgcgcaccgtgccgtcgctgtccgcttcgacgttgatatgcccgatgccggcggcgcagccggccagcggcgcggtcggcggtatctcccgtggcggttcgccgtagcgcggcacgctttcgcgcagcagtggcaggaggacgttgccggcccggcacagcgatcttgccaactggcggtcgctgtccggattggaggagggttcgctgaagatcacgtcgagcagtacgctgcgtgcgccggcggcggccaggcgatccagcagctcggcgtggacgctgcgcggccagggccagcgaccgaggctttccaggctacggtcgtcgatggcgacgacgaggatgcgcggatcgacggccagcggggcgaggttgcgcaggcggtcgtagagcaggttgttcagcggcaggccgctgctcagcgaaagcagggcggtgagcggaaggagcagcaggctgaccagcagccattcgcgcaccaggccgcggaacagccgctgcgcctggctgggctcgtcctggcggtcgagcgccttcatcggcgaggccccggtgccctatcgggcactgccgcctcgcgggtagtagagaatgtcgtatacgctggtctcgccctccagtccgtcgttgtcgaaggccgagagacggacgtggtagaaggccgccttgagtccgctgaaactgacttccggggtgctcgagaaacgctcctgctggatgcgcaggaagtccggatcgctggctacctgggcacggtagcgcttggcgccgtgcagcggggcaagatagagcttccaaaccggcgactcgccgtgctcgccgccctggccgcgcaattgcggggcgggtag

SEQ ID NO: 15397 - DNA, 1629 bp, Pseudomonas aeruginosa
caggtccaccggcgtcagcttgccctgcggcttgaccttcaggccgcggcgggcgtcgaccagcacgtcctcgtccggctcggcctgcgccgccttgcgggccgggcgcctgccgttgagcggcaggtcgtcgctggtcagctcgcggttcaccgcgacgcgcccgtcgagcacttcggtcagcgcctggccgtcttcggtgcgggcgcggaagtgggtaccgcgcacgcccagtacgccgaccggggtcagcacctggaagcggtcgtgatcgctctttctcttcaggacataggactcgacctgccccgcgcgcagggcgatctgcggaatgccggtgtcctcgtcgaggtgcagggtgacttccgaactggagggcaggacgatgcggctgccgtcgccgagcagcaggctgacgaaggcggtcggagaggtcttgacgccttccagttcgtcgatgtccatgccttcttccaggggcgtctggttgcccttggcgtcgagcttccaggcgtcgccggcgaggtagagcacgctggcggggagcggctggggcaggcacgtttcgccctgctcgatgaacggcggccgtttcgtcttggccggcgcggccgcgacggagccggcgagcagcgtcaacagtccgcccagcgccagggcggcgcaagccggaaagagggatcgggaagtaagggcgagggctgtcataggcttcactgggcggcgggtcaggtatcgctggcggtccggtcaggctgcaatctgcctgatcgggcgccggtttcgcaatccttgcaacgacatcgggagcccgcaggctcccttgtcgtttcctcggccgcagcgcctggcggttgggccaggcgcttcggttcagtcgttcttgtcgccgatcaggcgataggccagggcgccgagtaccgcaccgagaatcggcgcgacccagaacagccacagctgggaaaccgcccagtcgccgacgtacagggcgaccgcggtgctgcgcgccgggttcaccgaggtgttggtgaccgggatgctgatcaggtggatcagggtcagggtcaggccgatggcgatcggcgcgaagccctgcggcgcgcgcttggaggtggcgccgaggatgatcagcaggaacatgccggtaagtaccacttcgctgaccagcgcggcttgcaacgagtagccgcccggcgagtgttcgccgtagccgttggaggcgaagccggcggccaggtcgaagccggccttgccgctggcgatcaggtacagcacgccgccggcggcgaggccaccgaggacctgggcgacgacatagggcagcagttggctggccgggaagcgcccgccgacccacaggcctaccgataccgcggggttcaggtgggcgccggagatcgggccgatggcataggccatggtcagcacgctgaggccgaacgccagggccacgccgaggtagccgattcccagttccggtacgccggcagcgagtactgcgctgccgcagccgcccaataccagccagaaggtgccgaagaactctgctccgtattgcttcatgatgaggtccttttcagatccaggatgggacgcggatcgaggcgtccggatagcgggaggggatga

SEQ ID NO: 15398 - DNA, 732 bp, Pseudomonas aeruginosa
acaggaccagcttttatgcgtgtcgcgatactggacgacgagtcggccgaactggaccgggtcgagcagaccttgcagcagatacccgcgcagggcgaacaggcctggacggtgcaccgtttcgcccgtggcgaggacctgctcaagcagctcaagcgggaaaccttcgacctgctgatcctcgactggcagttgccggacctcagcggcctgcaattgctgcgctggagccgcgagcatctggatgcgccgccgccggcgatcatgctgaccagccgtgacgccgaacaggacatcgtgcaggcgttgaacagcggcgccgacgactatgtcagcaagccgttccgacccaacgaactgaaggcgcgggtagccgccgtgctgcgtcgccacgggggaacgcgtcccgcgcagcatgaggtgcagactttcaacgacctcagcttcgacgatgccgagctgaccgtgacccgggccggcgcgccgatcagcctgaccgaacgcgaataccgcctggcccgctgcctgttcgccaacctgggacggccgttgtcgcgggaatatctctacgagcgcttctggccccacgaggaagtgttgtcctcgcggccgctggatacccacatctatcgcctgcgcaacaagcttggcctgaccgccgagcgcggttggcagttgctgaccatctacggctacggatatcggttggagagcgtggcgacggtcgactga

SEQ ID NO: 15399 - DNA, 504 bp, Pseudomonas aeruginosa
gcatcccagccacccccgccgacgacgccgggccaggccaggaccaccggcccttgcagggacgtctcgccgctgcgttcgtcgtcgaactcatggactacgccgctggcgtcgcggtgtttctgcgggctgacgaaatcatcgggatacagcaccagctcgtggaagccctggtaccagttcagctccggcaggtgcaacagcggcagttgcgcctgcgccgccagcagcaggcggccgaagtcgtcgagatcgacgccggcgagtgcggtcaggtgcttgtcggcgagaaacagcacggcccgctcgcgcaggcggcggtcctcgtcggcgtccaggccgtcgaggatcggcaggtgccggcgtacccgctgccagagctcttcggccaccgggtggcgtgccagcaggcgccggcgccgccaggcgcggaacgaccacatgctcagtcgctctgggccttggcctgtttggcggcgctcgcctgcaggcgatggcgaatga

SEQ ID NO: 15400 - DNA, 1098 bp, Pseudomonas aeruginosa
cccaggtggccggcgagcccttgttgctggcgccccagccgctgctcgaagtggccgacctgcgcgccctcggagagcgttgtgcggggctggccacggggcgcctggagggcgtgctgcagccgttgctgcatgcgccgggggcggtggcgctggtcttgccgggggcgctcgagcgcgccccggcggcgccacggcataccggctggccagcgctgggcgcggcgtgccccggcgactgcgtggatggctggaccttgcaggcagcttgcgcgttcggcccgcccgggcggctattccgcgcctgcgacgagcaaggacgcgaggcgttgctgctgctcgcggcggtcgatgccgacgaagcgttctggcagcgcgaatgggcattgcggcgctgccgtgcggagagcctgccgcgagtattgtcgtcgccccggttgcgtcgtcatgccttccagttgttcgctccgccgcgctggccgatgcgcagcctgctggattgggcgccagcgcacctgccgctggaaccgcaatgcgcgctggtcctcctggagcaacttatggatgcggttcgcgccttgcagcggcgcggcgtacagggcttgtggctgggcgccgcggcagatcctgctggacgagggcgggcgcctgctgttcctccccgaggcggcggcgatcctgccgggggtggcgcgccaggcgctgcctgcggacagcgtgccgctggcgccggagttgcgtcgcggcgaggcgctcgatggccgggccgaccagttcgccctggcggcgctgttctattggctgctctgtggtcgctggccgtcgatcgcctgcccggagagcgacggcggatgccgctacgagcccctgggcgagcgtcaggcggacctgccggtcggctgggatggggtattggcgcgggccctggcgccgcgtccggaggcgcgcttcgaagcgttgtcggaattctggctggccttgcagaagccgctagcgcatccccagcgggtcttcgcgccacgccggttgcaacggggcgtgctggccctggtcctgctcctggccggggctgcgctgctggtcggcctggccggttaa

SEQ ID NO: 15401 - DNA, 243 bp, Pseudomonas aeruginosa
cgggcctcgcattgcgggaaggggctgccgggacgatgcaggctgcatgccagcaacgcttcgatgctgcccaatctccctggaaagcgcaatccaagcgaacgtttgaatcggccgaaggaggggcgacgcgcgccggcccatccttcggccgggaggctcagtccctcgccaggaggaagttgccggtgcgcggagcctcgccgtccagcgcctggacctccgcctcgtccttcaggttga

SEQ ID NO: 15402 - DNA, 1608 bp, Pseudomonas aeruginosa
gtttcgccgccgacgctatgggtgaaacgtgccatgtgtgtctccagtgcccggcctcgccatgcggcgggccgggctttgtcgttgtcgctctcagcgcaggtcctgttccgccgcctggatcgcggcgaactcttcttccggggtgccggacaccaggtgatgccgactgtacagggcgaagtagccgatcagtacagcgtagatcgccaccgcgccgaccacgacccgcgggtcgaccaggaagccggcgaccaccgcgacgcaggccagcgccagggatacgccggaggtgaggatgccgccaggggtgcggtaggggcgctgcatgtccgggcggcggatgcgcagggtgatgtgcgcggccatcatcagcacgtaggagatggtcgcgccgaacaccgcgaccaggatcagcaggtcgccctggccggtcagcgacaagccgaagccgatcacccccggcaccaccagggccagtaccggcgccttcttgcggttggtcagcgagaggctgcgcggcaggtagccggcgcgggagagggcgaagatctgccgcgagtaggcatagatgatcgagaagaagctggcgatcagcccggccaggccgaccaggttgacgaactggctcatccaggtcgaacccttgtaggccgactccagcgcttccaccaggggattgcccgagcccatcagctccttggctccggcggccccgggaccgacgaccagaatcagtgcggcgaaggcgagaagcaccaacatggcgccgatcagtccgcgcggcaggtcgcgcttggggttcttggtttcctcggcggccagcggcacgccttcgacggcgaggaagaaccagatcgcgtaggggatcgccgcccagaccccgacatagccgaacggcaggaagctgctggcgccggtcgccgcggtctgcgggatgttgaacaggttggccgagtcgaagtgcggaaccatcgcgacaatgaacacgccgagggcgatggccgccaccgcggtgatgacgaacatcagcttcagcgcctcgccggcgccgaggatgtggatgccgatgaatacgatgtagaacaccaggtagatcagccagccgccgacgccgaacagcgactcgcagtaggcgccgatgaagcaggcgatggccgccggggcgatggcgtattcgatgaggatcgcggtgccggtgaggaagccgccccagggcccgaaggcgctgcgggcgaagccgtttccgccgccggcggtagggatcatcgaagacagctcggcgagcgagaagcacatgcacaggtacatggtggccatcagcagggtggcgaggaacatcccgccccagccgccctgggccaggccgaagttccagccggcgtagtcgccggagatcacgtaggcgacgccgagcccgaccagcaggacccagccggcggcgcctttcttcagttgacggtgttggaagtagtcggcgtcgacgctttcgaagtcgaccccggaagttgcgggcgcatggccggtttgttcgagggacatgggtttttcacctcaatcttgttgttatcgaccccggttttcccggtggtgtgctgtacgtggtga

SEQ ID NO: 15403 - DNA, 2637 bp, Pseudomonas aeruginosa
agccgccgcggcccgagcagcggcctgccgtttctcgaccctcactccaaacgggaacccgatcatgacaacaagaacctcacccgcccctgccggcctcctgcgcccgagcctgcactgcctcgccttcgccgtcgccctgggcagcgctggcgccgcgctggccaaggatgtgacctgggaggacatcgccaacgacgacaagaccaccggcgacgtgctgcagtacggcatgggcacccacgcccagcgctggagcccgctcaagcaggtcaacgccgacaacgtgttcaagctgaccccggcctggtcgtactccttcggcgacgagaaacagcgcggccaggagtcccaggccatcgtcagcgacggcgtgatctacgtgaccgcctcctactcgcggctgttcgccctcgatgcgaagaccggcaagcgcctgtggacctacaaccaccgcctgcccgacgacatccgcccgtgctgcgacgtggtcaaccgcggcgccgcgatctatggcgacaaggtgttcttcggcaccctcgacgcctcggtggtggcgctgaacaagaacaccggcaaggtggtgtggaagaagaagttcgccgatcacggcgccggctacaccatgactggcgcgccgaccatcgtgaaggacggcaagaccggcaaggtcctgctgatccacggcagttcgggcgacgagttcggcgtggtcggccgcctgttcgcccgcgatccggataccggcgaggaaatctggatgcgtcccttcgtcgaaggccacatgggccgcctgaacggcaaggacagcacggtgaccggcgacgtcaaggcgccctcctggccggacgatcgcaactcgccgaccggcaaggtcgagtcgtggagccacggcggcggcgctccctggcagagcgccagcttcgacgccgagaccaacaccatcatcgtcggcgccggcaaccccggcccgtggaacacctgggcgcgcaccgccaagggcggcaatccgcacgactacgacagcctctacacctccggccaggtcggggtggacccgagcagcggcgaggtgaagtggttctaccagcacacccccaacgacgcctgggacttctccggcaacaacgaactggtgctgttcgactacaaggccaaggacggcaagatcgtcaaggccaccgcccacgccgaccgcaacggcttcttctatgtggtcgaccgcagcaacggcaagttgcagaacgccttccccttcgtcgacaacatcacctgggccagccacatcgacctgaagaccggccgcccggtggagcgcgagggccagcgcccgccgctgccggaaccggggcagaagcatggcaaggcggtggaagtatcgccgccgttcctcggcggcaagaactggaacccgatggcctacagccaggacaccggcctgttctacgtgccggccaaccactggaaggaagactactggaccgaggaggtcagctatacgaagggcagcgcctaccttggcatgggcttccggatcaagcgcatgtacgacgaccacgtcggcagcctgcgcgccatggacccggtcagcggcaaggtggtctgggaacacaaggaacacctgccgctctgggccggggtgctggccaccgccggcaacctggtgttcaccggcaccggcgacggctacttcaaggccttcgacgcgaagagcggcaaggagctgtggaaattccagaccggcagcggcatcgtctcgccaccgatcacctgggaacaggacggcgagcagtacctcggcgtgaccgtcggctacggcggcgccgtgccgctgtggggcggcgacatggccgacctgacccggccggtggcccagggcggttccttctgggtattcaagctgcccagctgggacaaccgcaccgccagccgctgatccccgcgccgcgccctgcgaggcgcggctttccccgcctgcggagtatcccgatgaagaccttcctcctctgcgccgccctgctcggcgccggcctggcccaggccgccgacgacatcgacgacgtccgcgtcatcgccggctgccgcctggagcccggcgcgcgctgcgccaaggccgacctgcgcggcgccgacctgcgcaacctcgacctcggccgcatcgacctggccggcgccgatctctccggcgccgacctgcgtcacgccaggctcgacctggccaacctggaaaaagccaacctgcgtggtgccgacctcacccgtgccagcctgcagcaagccaacctgcgcggggccgacctctccggcgccagggcggtggcgatccaggcctggggcctgttcgcccagggcgcccagtggcaaggcgccgacctcaccgccgcctacctggagttcgcccgtctcagcggcggccgcctgcaccaggccacgctgcgcgccgccgacctggagatgacctggctgtcccgcgccgatctcaagggcgccgacctgcgcgacgccaacctgcaggaagtcaagctggccgaggccaacctggaagatgccgacctgcgcggcagcaaggtgcgcttcggcaacttccagggcagcaacatgcagggttgcaaggattgccccgcgggctggcagtga

SEQ ID NO: 15404 - DNA, 738 bp, Pseudomonas aeruginosa
gcgcattcgcatccgcccgcgtgccccgagccgccaccagccgcccataacgacaataacgaggtgcaggccatgtacaagatcctgatcgccgacgaccacccgctgttccgcgaggccatccacaatgtcatcgccgacggattccccggcagcgaagtgatggaaaccgccgaccttgacagcgccctgggcctgacccaggaacacgacgacctcgacctgatcctgctcgacctgaacatgcccggcatgcacggcctcaacggcctgatgaacctgcgcaacgaggccccgaccattcccgtggttatcgtctccgccgagcaggacaagcaggtggtgctacaggccatcacctacggcgcggtgggcttcatcaccaagtcctcgccacgcgcgcagatgaccgaagccatcgagcagatcctcaacggcaacgtctacctgccctcggacgtgatccgcacccagaagagttcgccgcgacgcagcggccacgaagaacacggcatctccccggaactgctccaggccctgacccgcaagcagctgctggtgctggagcggatgaccaagggcgagtcgaacaagcagatcgcctacaacctggacatcgccgagaccacggtgaaggcgcacgtctcggcgatcctgcgcaagctcaaggtacacaaccgggtccaggcgatcctcagcgccggcgacatcgacttcgccgcctacctgcgccgctga

SEQ ID NO: 15405 - DNA, 873 bp, Pseudomonas aeruginosa
gacccgccgatgcccgaccgccgtaccctgctgctcactgtcctggcgatgctggccttcgccggcaattcgctgctctgccgcgcggcgctgaaggacaccgccatcgacgcggtcagtttcaccgccctgcgtctcttctccggcgccctcatgctcgccatcctgctgcatctgcgccggggcccggccacgcccgcgcgcggcggctggcgcggggcggcggcgctgttcgtctacgcggccgcgttctcctacgcctacgtgcagctggacgccggcaccggcgcgctgctgctattcggcgcggtacaggtcaccctgctgctggccggcctgctgcgcggcgaacggctgggcggacaggcgctgctcggtttcctgctggccctgggcggcctgctgttcctgttgctccccggagccagcgcgccgccgctgggcggtgccctgctgatgctcctgtccggcctcgcctggggcctctataccctgctcggccgcggcggcggcgatccgctggcggtcagcgcgggcaacttcctgcgtgcccttgccttcgccgccctgctgctcctggcattccacgggcagttgcggctggacggcgccgggctggcctatgccctgctttccggcgccctcgcctccggcctcggctacgccgtctggtacagcgcactgccggggctgacggcgatccagggcgcctcggtgcagctcagcgtgccggtgctcgccgccctctgcggcgccctgctgctcggcgagccgctcgccccgcgattgccgccggcgaccctggcggtgctcggcgggatcgccctgatcctcgccccgcgcctgggccgcgcggcgcgcgaagacgcctga

SEQ ID NO: 15406 - DNA, 873 bp, Pseudomonas aeruginosa
aacgaccgggccggtcgtggcggagccgattatcgaaaccgggaaagccctgccatacgcttccttgggcctgcttcgacgcttcttcatggtgggcgtgggtgccgctgcgcaaggcgcgggcagcgctcctccggcggtagcgcaaccttggtcgcggcgggagcgccaccgaagcagcgcggctttcgacctaacgccgcagtgacgccggcaaggctgtcgtcgagttaccgcgtggctcgcttcagcgccgactggaaagcacccaccagccgccgcgcgcctccagcaaccgggcctgggccgcgagcaggtcgtcgccgctcaggccgagggcggcctcggcgagcagccgggagcgaccggcgccaccgccaaggtgctccgcccaggcgcgccgtgctcgctcggcgaagctacccggtgctcggcgcaggtcgtcggcgagggcttcgcgcaggccggccaggcgtcgcgccggcagttgcgcgagcgcctcggcggagcgctggaggaaggtctccatatgctccagcaggcgtaccgggcaggcacgcggagattgcgcggcgaacagcaggccgcgccgggcgccgacctcgcggaagccgcagaacaacgcgtagcccagttgcagctcgtcgcgcaggcgccgctggaaggccggttcgtgcaggcgcgccagcaagcgccaggccgcctccatcggcacctcctgcgtgggcagcggacagaacagcagcaacgccgactcgccgtccatggccagttcgcggcgatgccgtccgggcctcggcggcagaggctccaggcgctcgccggcagcctggccgggcatccatcggggatctggcatcgcggcctgcatga

SEQ ID NO: 15407 - DNA, 1419 bp, Pseudomonas aeruginosa
ccaaggcgtcccagcgcgtccgccgccagtcgtcgacctccgccagcggctcgccgagtaggccgggcaaggcgtccagcaactgccggatcggcaggccagtggcgctgcggcgccgctcggcggaggacagacgctcgccgctcgcgcgccagtcgggcggcgccgcgaggagccgggccagggccgggcgcacggcggcctcgaggcgatcgcgcggaccgagcaggctcagcgaccagtcctcgccgagcgcctccaggcccatctccacaccccccaggcgtgcctggccgcacagcggacgcaacgcctggcgcagcgccagaaagcgtgaccgtgcgggcacaccgggaaagcgccagcgcaggaacagcgcgccctcggcggcggcactgggcggcaacggcagttcgaagcgccaggcatgccgctgcgcggccagcggcggcgctgcggcaaccggcgccacactcaggcggaagcccgccgaccagcgcgcttcggcaccgtcgagttcgctgtccaggtgcagccgcaggcaacggtcggcgcgcagcgcgtccaggcaggccgggcgaatctccgctggcaggccaagaacgcgctggcgtagtcgctccagcggtgcagtgggctccgccagcaacggccggcgcgccgccagcaggctggcggcatcgtcgcgcaggtcgcccagccagtcgaaaaaggccgcctccagcgccgccgccgcgctgccgtcgaacagttcgaaggtcaacgccaggagcgcctgccgcgcatcccggtgaaccacccgcagcgccgccgattcgcccaggccctgttcgccgagtgccgccagcaacccgcccggcgagcgatcgccgagcaattcggcgaacgcctgcagggtctgttcgtcggcctcccgcaaagcgtcgagggcaaagcccagcaccagccgcggcggtcccggcaggcgcagcgccagcgcttcgccggcgaagggcagcaacggcggcggcggcggattcgcgcctggcgcgcgccccggcaggtcggcgcaggcacgctgcgccagcctctccagctcgtccagtgcctgcggcccttgcagccatagctggcaattgccggcgtgatagtgggcggcatggaattcgcgcagggcccgctggaacgcatcgttctccagggccaggctgtcgcggcgcccggcagcgaaacgccgcaggggggtgtccggcgggcaagccgagggccagcgccgcgtcgatcagggtctgctcgtcggccgagcgcgccaggtattcggcctcgagtacttcgcgctcgcgccgttgcgcatcgatgtccagcaaggggcgggcgagcatgtcgatcagccgtgccagaccggcgccaatgtgctccgccgtcacctcgaagaaatag

SEQ ID NO: 15408 - DNA, 1848 bp, Pseudomonas aeruginosa
  unsure (844),(858): Identity of nucleotide at the above locations are unknown.
tcctttcgccgggtcgtatcaggaagccggcggctcctggccagacgcttcctcggagtacagcgcccgtccgccgtcggccttgagcgcctgcaggacctccggcgcacggcacggggcgaacaggtcgaggccgggatcgtaggcgccggtgcgcacttccagcaggccgagcatcgagtggaacaggttgtcctgggacagctcctcgttgctgcgctggcgcaggcagccactgtcgaggccgaaggcgctctggtagccgggcgagaaccaggccagcatgccgacgtgcttctgctggtccggcgccagcaggtaaggcgtgccatgcaggtagaggttgtactcgccgagcgactcgccatggtcggagaggtagagcatgccggtatcgatgcgctcttcgttcttgcgcagcaggtcgatcaggctggccagcacgtggtcggtgtacagcagggtgttgtcgtagccgttgatgatgctgtcccgcgagcaggcgctgaagtcgttgctggcgcagaccggggtgaacttctcgtactccctgggatagcgcttgaagtaggccgggccgtggctgcccatctggtgcaggaccagcacggtgtcctgttgcagcccgtcgatgaaggcctgcaagtcgcgcaggaggatctcgtcatggcactcgccgccggcgcacagggccggatccttgctctcgctcaggtcctggaaggcgacgcggtcgcaggtgcccttgcagccggactggttgtcccgccacaggacccgcaggcctgcgcgctgcaacacatcgagaaggccttcctgggtgcgcgcgcgagcgtcgctgtantccgcgcggcccangttggagaacatgcagggcaccgacaccgcggtctcggtaccgcaggagtgcacgttggagaagttgatcaggccttcttcggccttcagccgcgggttggtctcgcgagcgtagccgttgaggccgaagttctgtgcccgcgcgctctcgcccaccaccagcacggtcagcgacttgcgcgcatggccctgccacagggcggcgcgccgggcatcgacggcgatcggccgcagcggctggctggcggcctgggcctggcccttggcgtagccgatggcggcgccgaccaggttgctcggggtgacctgcaggcgcagttccttgttgttgcggaacagcgaggacagcccctggtaattggccagcgccaccccggcaagcagggccaggcaggcgagcgccaccagcagcttgctcagcagctcgcgtggccacggccggtagcgcaccggcgtgcgccacagcagccagaccggcagcgcgccaagcaacgccaggtagacggcgagcttcggcgaaagcaggtcggcgacctcggccgggttggtctgcatgacgttgcgcagcatgccgacgtccatcagcacgccgtactgggtcatgaagtaggtggtaccggcggccgccaggatcagcagggtcagcgccggcttgagcagccagcggaacgccagcagggtcagcgccaggttgaagatcgcggcgatcatcaggccgactgccagcatcatgccgaggccctgccagcccgccggggtgatcgccagcaggcgttgccacagcggcaggttgtagaacagcaggaaggcgaggctgaccagcagggtcagcagttcgggacggacggcgcgggctttcgacatgggcacggatcttcactgacttccgggttgccgtgcgcagcgttgcccctggcagcactcgacgacggcggcagtctgctcggcaatccgtcaatctttcgtgaagaatacctacagaaaacgtaa

SEQ ID NO: 15409 - DNA, 1503 bp, Pseudomonas aeruginosa
atttcctcgagcagcgcggtacctctccagcatgaacgctttgaaaggccgggacatcctggcgcttggttttatgacctttgccctgttcgtcggggccggcaacatcatcttcccgcccatcgtcggcttgcagtccggcccccatgtgtggctggcggcgctgggcttcctgatcaccgcggtggggctgccggtgatcaccgtgatcgccctggccaaggtcggcggttcggtcgacgccctcagccatccgatcggcaggtatgccggcggcctgctggcggcggtctgctacctggcggtcggcccgctgttcgccattccgcgcaccgccacggtgtccttcgaggtcggcgtggtgccgctgctcggcgagagcggcacggcgctgttcgtctacagcctggcgtacttcctcctcgccctggccatctccctctaccccggtcgcctgctggacaccgtcggacgcttcctcgccccgctgaagatcctcgccctggcgattctcggcgtcgccgccttcctctggcccgccggcccgatcggcacggcccagccggagtacacccaggccgcgttctcccagggtttcgtcaacggctacctgaccatggacaccctcgccgcgctggtcttcggcatcgtcatcgtcaacgccatccgttcccgcggcgtgcagtcgccgcggctgatcacccgctatgccatcgtcgccgggctgatcgccggtgtcggcctagtgctggtctacgtcagcctgttccggctcggcgccggcagccatgccatcgccgccgacgccagcaacggcgcggcggtcctgcatgcctacgtgcaacataccttcggcagcctcggcagctcgttcctggcgggacttatcgcgctggcctgcctggtcaccgcggtcggcctgacctgcgcctgcgccgagtacttctgccagcgcctgccgctgtcctaccgcagcctggtgatcatcctggcagggttctccttcatcgtttccaacctcggcctgaccaagctgatccaggtctcgatcccggtgctcaccgcgatctatccgccgtgcatcgtgctggtggcgctgagcttctgcatcggcctctggcattcggcgacgcgcatcctcgccccggtgatgctggtttccctggcgttcggcgtgctcgatgccctgaaggcggcgggcctgggccaggacttcccgcaatggctgctgcacctgccgttggccgaacagggcctggcctggttgatcccctcggtcgccactctcgccgcctgcagcctggtcgaccgcctgctgggcaagcctgcgcaagtcgccgcctgagcaggccccagcggcctgccgcttgttctcccggccgagcgcgggacatgccggcgggcggcgccaatcgcgtcgtccaccccacggcccggctggcgccgccggcagcgcttcttcccgcgttcagccgaacgaataagcactatcgagcaggatga

SEQ ID NO: 15410 - DNA, 645 bp, Pseudomonas aeruginosa
ccgcggaacgccgttgccgttcgcggcaagcgcttgcctccgccccgccctgcgccatgcgccgagccctctggcgcggggttcggcgacctggcacggcccttgcgacggagcggcggtcattcatttccatggaagcaggtcatgaacagcataggtcccgccagcctttccggctggtctgcgcgttacctgaacaaccagcggcaagccaacaccgagatcggcaacggcgatctgctgaaaccgcgccccgcccttggcacgccattgcgcaacgaggccgtcgatcccgccgcggagtccgcccgccaggccatggacgagggttttgcgaagctgaacctgacactgaagcagaaccaggcgaatgcccctgccggcgccagcgaaggcaagtcggcctatgacgagttcaaggagtacatgcagaaatcgcccgccgagcggatgcgcgagcaggtcctgaagagcctcggcctaaccgaggaggaactggacgcgatgccgccggagaaacgcgaacaggtggagaaaggcatcggcgaacgcatgcgcgagatgatcgccatgcagaacggccaggcgccgggacggcaagaggacccgacgcaggcccgcgcgacgctgaacgcctggatctga

SEQ ID NO: 15411 - DNA, 993 bp, Pseudomonas aeruginosa
tcgactttctcgtggaagccctgcaacgcccctcgggcgagaccggcccggcctaccgccgcgcccgcgagtgagccgcgccgttcagccgatccgctgcaacagcgcggcggacaggcgcccgccgagcaggctgtcgagccagaacagctggtgcagcaggacgatgccccagaacaccagttggaacgagagcttgcgggtcttgtggcggaatacctgctgcgcgaccagcgcgccaggccagccgccgagcagctcgaacaggtgcaggcggacctccggggtacgccagtcgccgcgtgcggcgctgcgcttgtcccgccagtagagggcgaatgcgagcaggctggccagcggataggccagcagcggccagagggcctgtccgtccaggtacatccgccaggcgccagcggccggcagcacgcagaggatcagcaggaccagcagcttcgccaacgggcgctgcaacgcgctcggcggagtcggcgccggccgcgcctgggcccgcgtcaccggcgcctgggcgccacggcggacagttggcggatcgatggtcagcgcgtccagccgcgccctctcggcgcgcaggcggccctgggcgtcctggctggcgagaaaccacacctggtcgccctggcggggacggcggtcgccgcggaacgcggagatatgcaggaagacttcttccccgccggtcttcggcaggatgaagccgaagcccttgtcgtcataccagcggctgatcatgcccggcttttccatatccacatccactcgctcgctacccgtttcgcgctgcattctagccacccgcggcggccagacgaaaaaaggcgcggctcgcgccgcgcctcttgcctgttcccgggcctcacacctcgccggcggtgctccagtcgatcaggtggaattgccaggtcgccaggatcagcaggccgaaggcgatccgataccaggcgaaagccgcgtagctgtggttgccgatga

SEQ ID NO: 15412 - DNA, 522 bp, Pseudomonas aeruginosa
ttagggctcagcgccaacgaaggaagcgccatcatgtcggggagttcgctacgcatcgtcgttccagcgctgctggtcatcgtcggctccgtgccggtgagcctccccgcgcatgcggcggacggtacgatcgtcgtccagcgccaggtccagccacgggtcgcctaccgtccgagcatggtgcccgacccacatcccaccgtcgtcgacaccaacgtctccgccgaggtcgacgccctcgccaacggggcggccagcggcaataccgtgagccgcgaactgggcgatgccgacttcgccatcgtgaccagcggttccgggattcgcagcatgattctccccggtggcgccctgccgggtttcgccagccagccggcgaacccggcgacggtccaggccgtcggcaacctcggcaccacccacggcgcgggaggcggcgccggcgcaggcctcgccgggcagatcaacggcagcctcaagcagggcctggcaccgctgcagatgctcgggggtggtcaatga

SEQ ID NO: 15413 - DNA, 840 bp, Pseudomonas aeruginosa
acatcgccgccggtggcggcaaccagcagagcaactccctgtccatcgccgccggttgcagcagctgcccggccggtggcgagagccttggcttctgatcctggcccaggggttccggcgccagccggaacccttttccatccgacacaggaaccggccatgcgcacgctcatcctttccctgctgctgctcgtcgacctcaccgcccaggcggcgaccctcggctttcccgccctgcccggcggcggcctggtctacaagcaggtgcagagcatccgcgagcggcgcttcgccgacctggtcgagcagaagaccgatttcagctgcggcgccgcggccctcgcgaccatcctggagaaggcctacggcgccccgctcgacgagcaggcggtgatccagggcatgctcgcccacgccgacccggagatcgtccgcacccagggcttctccatgctcgacatgaagcgctacgtcgaatccatgggcatgcgcgcgcgcggctaccgcatcgaggcggcgcaactggaacaactgaagatacccgccatcgtgctgatggaaatccgcggctacaagcacttcgtcgtcctgcaacgcacccagggcgagtacgtgtacgtgggtgacccggcgctggggcacaaacgctacgcgctgacagagttcgccaagggctggaacggcatcgtcttcgccgtgatcggccagggatacgaccgcggcaatccgctgctgacgccgcccgagccgctgaccgcgcgcaatcgcctggaccgcttcaaaccggtcagggacgccgaactgatggaattcggcttcatccagagcgatttcttctga

SEQ ID NO: 15414 - DNA, 783 bp, Pseudomonas aeruginosa
  unsure (305),(310): Identity of nucleotide at the above locations are unknown.
tcgcaggagccggatgctccgggagcacgccatgtacacgcaccactgcttcgtcctcgcctgctgcctgggcgctgcgctgcccgcccccgccagcgacctcttcgcccccgccgaactgagcgaccaggagctttcccagttgcgcgggcgctacgtgctgccggggcggatcgtcagcttcggggtgaccatgagcagcacctggcagaacgccagcggccaggtcctcggcgcgcgcgtcgacctgcaggtgcggcagaacctggcgcgcccggtcctcaacgtcaccctggtcgatcggncaggngacgccccaccacccgccgccggcaacggccaggtcctcggcggcgccggactggcacagacccaaggggtcagccagagcatccgcaccgccggcgaccacaacagcgccagcaatggcgtcagcatcgaggtccgccacggcgacgcgccgccgccactgccgggcggcacgccgctggaaggtgcgctcgccctcagcggcgaggccggcacggtcaaggtcacgccgaacggcggcgccctgcaactggcgatccaggccagcggccagggcgccagcctgcaaagcctcggcgccggcggcctggtgcagagcgtggcgctcagcggaaaccgcaacctggtgcagaacctggcggcgctcgaggtgatgctcaaggaccggccgggcgccgatccggcactgaattgcgcctgggagcaattgcgcgcgctgcgccccagcggctactgaaagttgatctagtctga

SEQ ID NO: 15415 - DNA, 1356 bp, Pseudomonas aeruginosa
aaacggaacggcaaacatgacccagacactctcgctgcgagctgtcctctgcgccaccaccctggtttccccgttcctggcgcaggccgcgacggagtccgaggtcgaggcgctgaagaaggaactcctggagctgcgccaacgctacgaggcccagcagaacgccctgatggtcctcgaacagcgcgtgcgccaggtcgaggcgcaaccccaggcgccgcagccgcaacgcctggtcaagtcgatccagccgccggcgcaggcgcgcaacgacgccaacgcggtcgccggcacctacggcgccagcctcaaggacgatggcgcgcccgcgcccagcgtggaaaacatctaccaggacgccagcggcttcttcggcggcggcaccttcagcctggagaccggcctcacctacagccactacgacacccgccagttgttcctcaacggcttcctggcgctggactcgatcttcctcggcaacatcggcgtggaccagatcgatgccgacatctggaccctcgacctgaccggccgctacaactggaaccagcgctggcaggtggatatcaacgccccggtggtctatcgcgaatcgacctaccagtccgccggcgccggcggctcgacctcgcagatcaccgagaaatcggtgaccggcgacccacgcctgggcgacgtcagcttcggcgtcgcctacaagttcctcgacgaaagcgagagcaccccggacgcggtggtcagcctgcgggtcaaggcgcccaccggcaaggatccctacggcatcaagctgaagcaggtaccgggcaacaacaacctcaacgtgcccgacgacctgcccaccggcaacggcgtctggtcgatcaccccgggcatctcgctggtgaagacggtggacccggcggtgctgttcggcagcctgtcgtatacctacaacttcgaagagtcgttcgacgacatcaacccgcagcaaggcgtgaagaccggcggcaaggtcaagctcggcaactggttccaactcggcgtcggcgtggccttcgcgctgaacgagaagatgagcatgtcgttctccttctccgaactgatcagccagaagagcaaggtcaagcaggacggccaaagctggcagaccgtcagcggcagcgacgccaacgccggctacttcggcctgggcatgacctatgcggtgagcaacaggttcagcatcgtgcccagcctgtccatcggcatcactccggacgcgccggacttcaccttcggcgtgaaattcccctactacttctgaggggccaccgttcgagcctgggcatgccttacccctcgaagggatgcgtgagcctgggagcgatcctcgcctag

SEQ ID NO: 15416 - DNA, 402 bp, Pseudomonas aeruginosa
caacggcaccgtccctctcaagcctcgccagcgagcgcccgctcgacttcctcgcgcgaggggatcgaggtctgcgcgccgaggcgggtcaccgagatcgccgcggcggcctggccgaaacggatcgccgccgcctcgtcgaggccgcgcgcaagggccgcggcgaagccaccgacgaaggtgtcgccggccgccgtggtatccagcgccttgacccgcgccaccgggaaatgctcgacccgcccctcgcccaccagcagggcgccctgggcgccgagggtgacgatcaccctgccggcgcccatttcgcgcaggcgctcggcggcacgcccggcgctctccagggagtccaccggcaggcggcagagcagttcgctttcggtctcgttggggaccaggtag

SEQ ID NO: 15417 - DNA, 480 bp, Pseudomonas aeruginosa
gcatcgtcgccaaggcagccgatcatcgccaccccagcgccgagacgcgccgcggcgaccgcctggttggcgcccttgccgccgggaatggtggtgaaggactgcccggcgagggtctcgccgccccgtggcaggcgcggcgcgcgcaccaccaggtccatgttcaggctgcccaccaccagtactttcgcttgcatcgttgcgtccttgttccagcctctctctagcgagggcgcccccggcgcccggttcagacccgcaccagcggcggcgcggtggattcgcgcaggaccagcgccggcgccaccacccgccgctgcatcggctcctcgcgctcggcgatgcgttgcagcagcagttgcgcggcgatctcgccgagcaggcggatcgactggcccacggtggtcaaggcgggaaacacgaagcggctcagctcgatatcgtcgaagccgatcaccgacagttcgtgcggcaccctga

SEQ ID NO: 15418 - DNA, 474 bp, Pseudomonas aeruginosa
actcgctttccagcagccactgcgggcgcacctccaggccggccttggccatcgcccgccggtagccctcgacccgcagcgtcgaaaccttggtcgacagcggcccgccgatgcaggcgatgtcgcgatggcccagctcgagcaggtggcgggtcgccaggtaggcgcccatctcatggtcgatctgcacccggtcggcttccacgccttccacctcgcggtcgacgatcacggtcggcgtgcgcatgttcgccagccccttggccagcgcgccgtcgccgccggcggacgccaggaccaggccgtcgatgcgtttctcctggagcacgcgcaggtagttggcctgcttctgcgggttgtcgtcggagttgcagaggatcacgcagtagccgttgcgctcgcagcaatcctcgatgccccgcgacagctcggcgaaatacgggttggtgctgttcggcaccagcaggccgatga

SEQ ID NO: 15419 - DNA, 2640 bp, Pseudomonas aeruginosa
cggaagacgtcgggtcgctcatttctggttccttgcgttgcgtgttcacgacgtcgccagcagcgcgtcgcgtttcttgtaaccggcgaaggccgccgccagcagcgcgtcctgggtccaggcgtcgcgctcgaaggtgtccaccatacgtcccgccgagagcacgccgatgcgatcgcagatcagcatcagctcgcgcaggtcgctggacaccaccaccagcgccttgccccggcgggtcagttcggcgagcaaggcatagatgtcgaacttggcgccgacgtcgatgccacgggtcggctcgtcgaacagcagcacctggcagtcgcgctccagccagcggccgatcaccaccttctgctggttgccgccggacagttcgcccaccgcctgcgcggtgtccgcgcagcgcacccgcagcgcctccacctggcgccgcgccagggcttcctcgcggcgccggtcgatcaccccgtggcgcgccagcgccggcaggttgcccagggccaggttggcgctgatcgactggtccagcagcaggccctcgcccttgcggtcctcggtgatcagcgccaccccctggcgcaccgagtcggccggcgaacgcaggctcaggcgctgcggcggatcgccgagcaggacctgcccaccgtcggcgcggtcggcgccgtagatcaggcgcaacaattcggtgcgcccggagccgatcagtccggaaatgccgaagatctcccccgcgcgcacctcgaacgacacctcatgcaccttgccgcgccggctcagccgctccacccgcagcagcggcgcaccggtctgccgtgggcccaggtcgaagcgctcgcccagttcgcggccgaccatcagggtcaccagttggtcggcgtcgtagcgctcgatcggctcgacgcagaccaggcggccatcgcgcaacaccgcgatgcgctgcgaaatccgcgccagctcttccaggcgatgggagatgtagacgatcgccacgccgcgttcgcgcagccgctcgacctgctcgaagagcatgtccacctcgcgcgcggtaagcatcgccgtgggttcgtcgaggatcagcaagcggcagtcgccgatcaggttgcgggcgatctcgaccatctgctggtggccgatgccgaggtcgccgaccagcgtgtcgggatcgatcgcctccaggccgacctgggccatcgcctcgcgggccgccgcgcgcaggcgccgacggtcgatccagccggcgcgccggggcaggtcgtggaggaacaggttctccgccaccgacagggtcggcagcaggttcagttcctgcatcaccatgcgcacgcccagcgcctcggcctcgcggcggctagcgggggcgtaaggccggccgaggagctccaggctgccggcgccgggacgttccaggccgccgacgatcttcgacaaggtgctcttgccggcaccgttctcgccggtcagggccagcacctcgccgccgaacagttgcaggtcgatctccgccagcaccggctgcgcgtaggtcttgccgaccccgcggatgctcagcagcggcaatgcgtcgctagacatgggaaggctccatcggacggctcagggcgcagtcaccaactcgacaggcgtctcgaccacgccgtccttctcatgttccggggtttgcccggcgagcagcttgagcgcggtctggataccgaacaccgcctgcttcgcggcgaactggtcggcagtggccagcacccggccatccttgagcatcggcttgatcgcctggatattgtcgtagccgaccaccttcacctgcccggcgcggcccgccgcgcgcaccgccgataccgcgccgagggccatgctgtcgttgccggcgagcagcgccttgaggtccggatgctcgttgagcatcgccgaagccaccgcgttgcccttctcgatttcccagttgcccgactgcaaggagacgatcttcatccccgccgcgtccatcgcatccctgaagccggcggtgcgctgctgggcattggtggtcgtggagaccccttcgatgatgccgacctcgtcgccggccttcagtcgcttcgccaggtactcgccgaccagccgcgcacccttgcggttgtcgggcccgacgaagggcacgccgatcttcttcgcctgcagcacctgcgggtcgaagcggttgtcgatgttgaccaccacgatgccggcgtccagcgctttcttcaccaccggcaccagcgccttggaatcggccggcgcgatcaccagtgcgtcgaccccggaaacgatcatctgctcgacgatgcggatctggctggaggtatcggtctcgtccttgatgccgttggaaaccagttcgaaccggtcggcatgctccttctggtaggccttggcgccgtcctccatggtcaggaagaactcgttcgccagcgacttcatcaccagcgcgatcctgggcttctcgggagtttccgcgtggacggcggacaggggcaggaacgaggaacaggcagtcagcacaacggcagccaacaggcgccgggaagcgacccgcttcatggtgtatcctccagcttttcttatcgttgtattgaggcttttccaggagattatccagacgcaaacgtttgcgttaggtga

SEQ ID NO: 15420 - DNA, 927 bp, Pseudomonas aeruginosa
aggtcctcgcggaacgtcccggcatcgatcgccgcctccaggtcgacatgggtcgccgccagcacccgcacgtccacctcgaccggccggctaccgccgacccgctcgatctgctgttcctggagaaagcgcaacaggttggcctgcaactccagcggcaggtcgccgatctcgtcgaggaacagggtgccgccgtcggccgcctcgatccgcccgaccttgcgctggtgcgcgccggtgaaggcgcccttctcgtggccgaacagctcggactggatcaggtgctcgggaatcgccccgcagttgatcgcgacgaacggcttgtccgcgcgccgcgactgccggtgcagggtacgcgcgaccagttccttgccggtgccgctctcgccacggatcagtaccggcgagtcggtcggcgccagcttcgccagcagccggcgcaggtcgcgtacggccaggctctcgccgagcagttcgtgctcgccctcggcatcgccgggcaccgtgccgcgcccgcgcaggcgggccatgccaaaggcgcggccgagggtcacctgcacccgcgccatgtcgaacggcaaggtatggaagtcgaagaaccattcgcagacgaaatcgccgacaccattcagcggcaaggtgtccgggctgagcacggcgatccactcggtgccgctgcggctgatcaggtccttcaccgtttccggccgctccaggtggaacggccgcaggcgcagcaggccgacgtcgcaagcgcgttcgcgcgccgtttccagcgcgcagctgtccactgcccaacccgcctcgcgaaggcccggcaacaggcgccggcaatcgtcgcacgggtccaccaccagcagacggcggaggttcgatgcatctaacatgtgtgctcctttgcggcgccaattctttgaaccgtcataa

SEQ ID NO: 15421 - DNA, 1335 bp, Pseudomonas aeruginosa
gacgtccagtcttccttgcgttccacgatgatgaacagcttgctcacgacacctcccggggtgacagcgaaaccacggcgcattcggaaccggcttgccggcgcacgcatcccggccaatactcggcgggaatcccttgcgaaaccgctctatggcgcctgccagcaaaccgaagcgtacagcacccattacagcacgcccgcgcggaagttcccgcccgcggccgtggagaccgctatgaacctgaccctccgcccggccggtgtggacgacctgtccgccctggtcgagctggaaaaccgctgcttcgactacgatcgcctgtcccgccgcaacttccagtggatgctcacccgcgcccacgccagcctgacggtagccgagggcgacggcggcgtgctcggctacgccctggtgctgttccacgaaggcacctcgctggcccgcctctactccatcgccatcgacccgcgcgcccgcggcatcggcctcggccagaagctgctggaagccgccgagcaggccgcgcgggacaacgaccgcgcctacatgcgcctggaagtgcgcccggacaaccgtggcgccatcgccctctacgagcgcaacggctaccgtcccttcgccaccgtgcgcgactactacgaggaccacagcgaagcgctgcgcttcgagaaacgcatccgcaaccccggccacgaacagcgccgccacgtgcccttctaccggcagaccaccgatttcacctgcggcccggcctgcctgctgatggccatgggcgcgctgcaaccggagcgccagttgacccgccgcgaggaactgcgcctgtggcgcgaggcgaccaccatctacatgaccgccgggcacggcggctgtagcccccagggcctggcgctggccgcctggcggcgcggcttccgggtcaagctggtactgtccgccggcggcccgctgttcctcgacggcgtacgcaacgaagacaagaaggcggtgatgcgcctggtccacgaggacttctgcgaggaactggacgcctcgggcgtcgagcagaaacgctcggccaggctcgacatcccacgccagctggccaggggcggccagccgctggtgctgatcagcagctaccgcctgacccgctccaaggccccgcactgggtgctggtcacccactacgacgaggacttcgtctacctccacgatcccgacgtcgaccacagccagcaccgccagccgctggattgccaacacatcccggtaagccacgccgagttcgacaagatgagccgcttcggccgcagcaagctgcgcgcggcggtgatcctgttcaacccggaatga

SEQ ID NO: 15422 - DNA, 1083 bp, Pseudomonas aeruginosa
cagcttgccaatatgccaacgccttggcataacggtgcccaaaaaaggcctacaaggacgttcctgatgcgcaccgtgaaaaaggctctgctggttgtcggcgtgatcgtgctggcggtcgtcggggtggtggtctactacctcgccaatcccaacctcccccactaccaggcgccgagcgaggtacgctacctgccgcaatggcaggacgaggcccgccagcgcttctactacacgccccagggcaccctggtgaagggcctgcactacgactggttcaccgccctcgaactgcccttctccgaagaacccttcgccgcccccgaatacctcgcccgcttcggcttcctcgtcgatccgcagcagaaggccagcgacctcaaccccggcaacctgccggtgggcttcagccagcaccgcgacgagaagaccggcacccgctacctggacatcacctgcgccgcctgccacaccggcgaactgcgctaccagggcaagtcgctgcgcatcgacggcggcgccgccatgcactccatcgccgccaccgtgccgaccctgcgcggcggcgccttcggccaggcgctcggcgcgagcatggccgccacctactacaacccgttcaagttcaaccgcttcgccaggaaagtcctcggcgaacgctacgaacaggacaagtcgcaactgcgcgccgacttcaaggccgtactcgacaccctcctgcgcaccgcctggaacgacacccgccgccacctctaccccaccgaggaaggccccggccgcaccgacgccttcgggcgcatcgccaacagcgtcttcggcgatgccatcgacccgggcaactaccgcgtcgccaacgccccggtgagctatccgcaggtctgggacatctggaaattcgactgggtgcaatggaacggctcggccatgcagccgatggcgcgcaatatcggcgaggccctcggcgtcggcgcgcgcctgcagatcttcgacgagcacggccagccgctgcagggcgagcagcgctacgcctccagcgtacgcctgcacgacctgcacgccctggaagaaacctgcaacaactga

SEQ ID NO: 15423 - DNA, 1263 bp, Pseudomonas aeruginosa
cagcccctctcccttcaggggggacgcctagccagaggacggggagaagcaatcgtggcgcactccccgcccaagaagaataaaagcccacagccaacgcacaccaccaaggacacccactccatgcgcgcactcctcacccacgcctggctgttcctcggcaaatggctcggccgcctgctcctcctgctgctggccgtcggcctcggcggctgggccatcggcagcctctactacgcctggaaattctccggcccggtgtccgcggaagagcagatcgccccggacgaagcccgcatcacccaggcgatcatccaggacgccatccgcgtggtcgaacagcaccgcgacaacacccgcgtcctgcgcgatgcccacgccaaggcccacggctgcgtgaaggccgaattcaaggtacgcgccgacctcgacccgaccctgcgtcgcggcgtgttcgccgaagcgggcaaaagctggaacgcctgggtgcgcttctccaacggcaacgcctacccgcagttcgacagcaagaacgacgcgcgcggcatggccatcaagctgctcgacgtgcccggcgaaaaactcctgcccggccgcggccatgacggcgagcaggacttcgtcatgttcaaccagccggtgttcttcatccgcgacatcgccgaataccggcagaacttcgccgcccaggccgacggcaagaaagccctggccttcttccccaactggaaccccgccagctgggaactgcgccacctgctgatcgccctgcgcaccctcgcccccgccccggacagcccgctgcacgccggctacaacggcatctcgccgtacaagctgggcgaacacaacatcaagttccgcgtcgtccccgccccggagaagtgcccggcctacgagctgccgaagcagaaccaggacctgcccaacttcctccgcgccgccctgtaccagcaactctccatcgaccgcgcccccgcctgctacgccttccaagtgcagcgccaggacccgggcaagtacatgcccatcgaagacaccagcgtcgaatggaaggagtcggacgcgcccttcgctaccatagccgacatcattgtgccagctcaggattttgatagccgggaacagaacctgttctgtgacaacctctcgttcaacccctggcacgcactgccggagcatcggccgatcggcgggatcaaccggttgcggaaggcggtttacgaggcggtcagtgggtataggttggggaggaatgggtga

SEQ ID NO: 15424 - DNA, 288 bp, Pseudomonas aeruginosa
tcgaaatccagggctgttccagtaacgccagctgcgaagtggtcggagttagcgccgcccctcctctgcacctgtctgcgcaggagcacccgtgaggcaggtaaagctaggcagccactaaagcttgccgccgatcgaaattcgcgccgacgcgttgagatcacttcttccaaccaggggcgcagcattgtggtaggtagcgaaagcaccaagacttaccacaacgccctgatcagacctctgtgtaaaaggggaaagatttatttattgcactctaattctgcctga

SEQ ID NO: 15425 - DNA, 1407 bp, Pseudomonas aeruginosa
aagaaggatcgtgggcagcaccggggaaaagacacaatgccaaatccagttatggatcatttcaggctgcggccgatttcagagtctgacattgaccaggttgttgaagatgccaggggaaaacgggcacatccggatgctgatcgccgagagcaaattggggctgactatgtgctgggcaactgcgttatagagttaaaggcgctggatgatgagggcttagcaaagccagagagacaagccaaacttgctgcgttgttccgcccttttaacgccgacagaccggttgtcgttctggatcgtggctctttgccgccgcctgagcagagaaattatgatcggattctagaaggtccaatcaaaacggcaatcagcaaagccaaaaaacaactcaagcagtccaggcttgaacatgaaggaacgacgacttcaattatttggtttgtcaacaacggctacaccgcgctcgatcacgatgcattgctcacgctaatagctcaccgagtgcggaatgacaccaatgagattgatgggatcattgtttcgggctgctacttccacagcgattccttcgacagctttttcctgtggccctttgaatacgtccccataaacctggataaggattttccagagttcgatgacttgcaccgtgcctggaacgatcttgccacaaggagcatgactgctctcatgcaaaaatttcccggaaagcaggagataaaggggccggtggtagatacacaattcgacattgataacatcacctacgtgaaaccggcaccgccgattggagggaaatcagatttcttccggcatggccgcccaagattgaatagcacgggaataacgacatctcctccggtgggactggtttttggcgatctgtcgcttgggcaatggacaacatttcgtgaaaacctgccaaatgcacaatggcttcggaaaaactatgaggactggaagctgaaaagagcagatgctgccaagcaagcaacaaacagacaggtatttatctcaattcctgtaacttgggatgcttggctcaagtggaatgaggagtcaggagggaatcggcgattgacaacgcaccattatgcaacccatgtctttcaagagaaaatatccgaacttctaaacgaagcaaaagatatagatggggtaggaatattgcccaacaggtacatgcttatcgttaccgaagaaattgggcaagacaaatgcaacgacatttcccacgccgccattgttatagaaaacccggacggaacccaggattttgaagagatatttttcaatcaaaggctgttccatgaatatgcaatgacactgggctgcgcacacgcgattgcccgaggcattggagtggtcagatggcgtaagaacaagacttacgcatggcgctaa

SEQ ID NO: 15426 - DNA, 3309 bp, Pseudomonas aeruginosa
atgatttcagattcgcgccgaaaccttcgaaagctgtttcctcgcacccgaaagccgccgaggctgccctgcggctttcgctgcgcaacggctacccgcctacttgcaccggtcgctcagcctgaccagcgatgcgccgtacaccgcgtcgtcctcggaggcgaagatcgcctcgccttcgacggtggcccccggcttgagggtctcggcggtgagttcctcgtccacggtatccagcctgaaggactggccggcggcggactgcgccaccaggcagctgttcttcaggctgatctcgctcttcgccgcattcaccaggcggaccttgaaggcctgggtgcggaagtgcttgtcgccgacggatacgctgcccttgtcgccctggcgggcgaagaccatcactgcgtccggcgcggcggcgaagccgagggaaggagcggccagcaggccggccagggtcagggccattgcgttcttcatactgatttcctttggcaaagactgaacgacccggtgattttccgtgggtcttttcgccgcgatcaagcgcagtgccaaggaatgcggggtgcctcgtgttctgcaagtcggagggtttccagcggaacttttcccgcaaccgtgcttccaggcgaaaaccgctcgctacgcggaacgccggtcttccaacccacacggtcctcgcgcccgccaggttgccctcgaacgcttgcaaccacaggccggacgctcggcccaggccgatggcccaatgggcgccgggcatgtccgcttccggcgtggccgcgatgcaacaagtgcgcctggaccggcatcgcggtagcgctcggcgagggcgccaccgaggctgtcggcggcatgtcgtgttcgactccgttgcgggtggcgagcggggcctgcgatcttcccttgggggagagtccagcccggcgacccggcaggtggccgccaagccgcttgcgcaggctgccgggctcagccgagcaacttgtcgacggtcagcgggaagtcgcgcaggcggcggccggtggcgtggtacacggcattcgccactgcggcggcgacgccgacgatgcctatttcgccgacgcccttggagcccagttcgttaacgatatcgtcgggttcgtcaacgaagatcacctcgatatcgccaatatcggcgttaaccgggatgtggtactcggcgaggttgtggttcatgcagcggcccagcgcatggtcgacctgggtttcctcctgcaaggccatgcccaggccccagaccaccccgccgagtatctggctgcgagcggtcttcgggttgatcacccgccccgccgcgaccgcgctgaccacccggctcacacgcagggtaccgagggcttcgtcgatccgcacctcgacgaataccgccgaatgggtcgcggtggcgtagcctttgcgccgcgccgagggttcagcttccacctccacctgcaacgcgtcttccggcagcccttgcagcaggtcggccagggcgtatcgcgtatcgcccgcttccagatggccacggcatatgcggaagcgttcttcggcggtgccggccagctccggatggcgggccctggcatgggcgaccagggcctggcgcaggcgcaggcaggccaggcggacggcggaaccgaccgacgagacggtgaacgagccgccctgcaatggagccttgggcaacgcactgtcgccaagctggaagcgcacctcttccggcgccatgccagcggcgtcggcggcgatctgggtcatcaccgtgtaggtgccggtgccgatatccgtggtcgcgctggccacccgcagcaggccgtccgcctccagccgcgccctcgcgctggccttgctctgcatggcctcccagacgccgccggccatgccccagccgagcaactggcgcccttcgctcatgctccgtggccgtgggtcgcgggcctgccaaccgaagcgccgggcgccctcctcgtagcaggccagcagcgccttgctggagtacggcttgtcctcgttgccgttgcgctcggcgaagttgaaccggcgcagcgcgatggggtccatgccgagccgcaccgccagttcgtccatcgcgcattccagcccgatcagccccagcgccgcgccgggggcgcgcatgtccagcggggtatagacgtccagcggcaccagacggtaggccagggaaaggttctcgcagcgatagagcatgccgctccactccaccacgtgctcggtgaagtcttcgaagcgcgaggtctgcgctgtcgcctggtggcccagcgcaaggaggcgcccctcggcatcggcgcccagttgaaggcgctgcagggtgcgcggccggtagccgaaggtgaacatctgctggcgggtcagcactacgcgcaccgaccgccgcagttgcagcgccgccatcaccgccagggccaactggtattgcggacgcaggccggagccgaaggcgccgccgacgtaggcggcacagacccttaccttgtcggcgggcaggccgaagaccttttgcaggtaggcctggctgttctgcgtcccctgggtcttgtcgtgcaccagcaggctgccgtcgggctggacgatgaccgtggacgcgtgcggttccatgggattgtggtgctcgatcggcgtgctgtagctggcctcgacccgaatcggcgcggcgcggtaggcggtgtagaaatcgccgcgctcggcgggcagttcggcgggagcctcatgggcctggtcgagggcggccagcaggtcggtctggtgcggctcgggctcgatgtcgatgcgcagcagcgagcccgcgtagcgggccagttccaggctccgtgccaggaccagggcaaggggctggccgctgtacaggacgcggtcgtcgaacagcgggcggaagggttcgccttcggcggcatcggcgtccttgtagggctcgtcgtcgcccgccatcggcggccggttcaggtgatgcagtaccgcgaccaccccgggtaccgccagggccgccgcacagtcgatgccgcgcacccggccgcgggcgacgtcgctgctgaccacgctgccgtggagcaggtcggcggcaggatattcggcggcgtagcgagcctggccggtgaccttggctggcccgtcgacgcgatccagggcttgcccggtgctgtgtggcaggctgctcattggccgatccctcccgagtgggcttcttccagtgcgcgaacgatggcgttgcgcgccaatccgatcttgaaggcgttgtgggccagcggcctggcgtcacgcagcagcgcttcggcgaagcggacatag

SEQ ID NO: 15427 - DNA, 807 bp, Pseudomonas aeruginosa
tcggcaggtccgccggctccggattggtcatggtacaagcctcacggtcggtgcatcggcgcggcggatgccgctttttcaggtccgaccgaacggctcgaagatacgttcaaagtaaatgacggccatggccatgccacaaaggcgggcggatgctcgacgcctgcgccgctatcggccgccggagccctgcgccgaggtcacttgaacaggctcgacaccacccgcgccacgtgctcggcgcccttgctgatctcctgcatgatgccggccacggtggtgatctggttgttgttctcctgggcgctggactcgatggtctgcatgttgtggttgatctgctgggtcagcttgacgttctcggtgaccacgttcttgatctccaccgtggcgccgctggtgcgcgccgccagttgccgcacctcgtcggcgaccaccgcgaagccgcgccccatgtcgccggcgcgagccgcctcgatggcggcgttgagggccagcaggttggtctgttcggcgacgctctggatggtggtgacgatgttctcgatgtccttggtctggtgggtgagctgggaaatcaggccgacggcggtgttgaccatcgacagggtcttggccgacagggcgacggactggtcgagggagtcgatgccgcgggtggaaatctgcgcggtctcttccgcggtggagaacgacagctcggcggcgcgccgtacttcctcgttgcgattgacctgctcggtaacgtcgatggcgaacttgatgaccttgattatccgccccgaactgtccttgaccgggttgtag

SEQ ID NO: 15428 - DNA, 1722 bp, Pseudomonas aeruginosa
agatcgccggggtctgggaagaccatgtgctacgggcgctggtggacgctccgcgctgaaccgacgtgcaaatgcggaacgggacgccaggcgtcccgttccgctcaccaggcccgccggtcaaccgcgggcgaggtcgccacgcagttcgcgggcggcggcgaccatgttcaccagcgctgcctcggtttccggccaggcgcgggtcttcaggccgcagtccgggttgacccagagccgctcggcgggtatccgccgggccgccttgcgcagcagcgcgacgatctcttcccggctcggcacgcgcggcgaatggatgtcgtagacgcccggaccgatctcgttcgggtagtcgaactgctcgaaggcctccagcagctccatgtccgaacgcgaagtctcgatggtgatcacgtcggcgtccatggcggcgatggactcgatcacatcgttgaactcgctgtagcacatgtgcgtatggatctgggtttcgtcgcggactccggaggcgcacaggcggaaggcctcggtggcccactccagatagtgcggccaggcgttgcggcgcagcggcaggccttcgcggaaagccgcctcgtcgatctgcacgatcctgatgccggcggcctccaggtcgaccacttcgtcgcggatcgccagggccaactggcgcgcctgcacctcgcgagacacgtcctcgcgcgggaaggaccacatcagcatggtcaccgggccggtcagcatgcccttcatcaccttgtcggtaaggctctgggcgtacctgatccactccacggtcatggcccgcggacggctcaggtcgccatagatcaccgccggcttcacgcagcgcgagccgtagctctgcacccagccgaagcgggtgaagacgtagccgtccagttgctcggcgaagtactcgaccatgtcgttgcgctcggcctcgccgtgcaccagcacgtccagccccagttgctcctggatctgcaccgcatggcggatctcgctgtgcatcgcctcgatgtactcggcctcgctcagcttgccctgcttgaacgactggcgggccaggcggatcgacgaggtctgcgggaaggagccgatggtggtggtcgggaacgccggcaggtcgagtccggcgcgctgcctggcgatgcgttcggcgaacggcgagcggcgctgggcgtcgctggccttgatcgcggccaggcgcgcctgcacggccggcttgtggattcgcggcgaagaagcgcggctggcctggaccgcacggctctcttccagggcggcaagcacctcggcggcctccggctcagtggcggcacgggccagcaccgcgacttcgcggcacttctgcacggcgaaggccagccagctcttcagctcggcgtccagcccgtcttcgcgctccaggtccaccgggctgtgcagcagcgagcaggacggcgcgacccacagccgctcgcccaggcgctcccgggcatggcgtaccacttccagggctttctccaggtcgcagcgccagacgttgcgtccgttgaccaggcccagcgagacgaccttgtaggccggcaggcggtcgaggatgctcggatactgttccggcgctcgcaccaggtcgatgtgcaggccgtccaccgggaggttggcggccaggcccaggttgtcttccaggccgccgaagtaggtggcgaccagcttcttcagcggttcgctctgtag

SEQ ID NO: 15429 - DNA, 756 bp, Pseudomonas aeruginosa
caggttgtaggcgcgctcgaaggcgttcttccatgcctgcggcaggtcgaggaccaggatcggctcgtcgatctgcacccactccacgccctggccggcgaggcggcgcaagatctggccgtagagcggcagcaggcggtccagcaggtcgagcctgtcgaactcggcgcccttgcccttgcccagccacaggtaggtcagcggaccgatcagcaccggcttcacctggtggccgagggccctggcctcgtcgacctcctcgaacagttgttcccagctcagctggaactgctgatcggcgctgaactcggggaccaggtagtgatagttggtgtcgaaccacttggtcatttcctgggcatgggcaccgccgcaacaactgtcgtcgctgacgccacgggccatgccgaacagggtatgcagggtcggcccggcctcgccgtgcgcccggaagcgctcggggatcacgccgaaggtcagcgaatgggtcagcacctggtcataccaggcgaaatcgccgaccggcagcaactggatgccggcatccttctgtacctgccagtgggcagcgcgcagctgccgaccgacggcccgcaggccggcctcgtccagctcgcccttccagaacgcttcctgggcttttttcagttcgcgatcgcgtccgatgcgtgggaagccgagagtgtgggccagggccatgggtgttcctccagtcgaaaggtcgatggagggattctcgggagactcatgccatga

SEQ ID NO: 15430 - DNA, 2463 bp, Pseudomonas aeruginosa
gacaaactcaatttcttcgtgatgaaatcaagtttccctcatgatcatcctcgcgccctgacctcggcgccctcctcacttgcgcttgcggatcgccatgcgccgaggcttgagaccgccagccgcggcagcgccggcctcgccgtcgaccaagggctgcatcctggctcgcgccgcgtgcagcttcttgtagctgtcgatcagccgcaggtgccggtcgagcccttccagcttcatgctggtcggcgtcaggccgaagaagcgcacgctgccgtccaccgagcccagcgcggcatccatccgcgcgtcgccgaacatgcggcggaaattggcctcgtagtcggcgatctccagctcgtcgtcgaggacgacctccagcaccacgttcagcgcctggtagaacaggccgcgctcgacgctgttgtcgttgtactggaggaacgcctccacgccttccttggcgtcttcgaagcgcttcagggcgaggccgatgagcactttcagctcgaggatggtcagttggccccagaccgtgttgtcgtcgaactcgacgccgatcagcgtggtgatgtcggtgtagtcgtccacctcgcagtcttccaggcgctccagcaacgccccgagcgcggcgtcgtcgaggcggtgcaggttgaggatgtcctcgcggaacgccagggccttgttggtgttgtcccagatcaggtcttccaccggatagatttccgagtagcccggcaccaggatccggcaggccgtagcgccgaggttctcgtacaccgccatgtagacctgcttgcccatggcttcgaggatgccgaacagggtcgcggcttcctcggcgttggcagcctcgccctgccgggtgaagtcccactcgacgaacgggaaatcggccttggcgctgaagaagcgccaggacaccacgccgctggaatcgatgaaatgctcgacgaagttgttcggctcggtcagcgcatggctttcgaaggtcggctggggcaggtcgttcaggccttcgaagctgcgcccctggagcagttcggtcaggctgcgctccagggccacctcgaagctcgggtgagcgccgaaggaagcgaacacgccgccggtgcgcggattcatcagggtcacgcacatcaccgggaattcgccgcccagcgaggcgtccttgaccagtaccgggaagccctgctcttccaggccgcggatcccggcgaggatgcccgggtacttggccagcacctccggcggcacgtccggcagcgccagctcgccttcgaggatttgccgcttgaccgcacgctcgaagatctccgacaggcactgcacctgcgcctcggccagggtattgccggcgctcatgccgttgctgaggtagaggttctcgatcaggttggaggggaaatacaccacctggccgtcggactggcgcacgaagggcaaggcgcagataccgcgctgcacgttgcccgagttggtgtcgtacaggtgcgagccgcgcagctcgccgtcggggtcgtagatcgccaggcaatggccgtcgagcagtcccagcggcagcgcatcgtcgcggccgggcttgaaccagcgttcgtccgggtaatggacgaacgccgcattggcgatctcttctccccagtactggtcgttgtagaagaagttgcagttcagccgctcgatgaattcgcccagcgccgaggccagcgcgctttccttgctcgcgcccttgccgttggtgaagcacatcggcgactgcgcatcgcggatgtgcagcgaccagacgttgggcacgatgttgcgccaggaggcgatctcgatcttcatgccgaggccggcgaggatggccgacaggttggcgatggtctgctccagcggcaggtccttgcccgggatgcgcgtgcagccggcggcatcggtgccgggcatcagcagcgcctgggcgtcggcatcgaggttgtcgacctcctcgatgacgaactcgggcccggtctgcaccaccttcttcaccgtgcagcggtcgatggagcggaggatgccctggcggtccttctccgagatgtcggccggcagttccacctggatcttgaagatctgccggtagcggttctccgggtcgacgatgttgttctgcgacaggcgtatgttgtcggtggggatgttgcgcgtctggcagtacagcttgacgaagtaggcggcacacagcgccgacgacgccaggaagtagtcgaacggccccggcgcggagccgtcgcccttgtagcggatcggctggtcggcgatcaccgtgaaatcatcgaacctggcttccagtcgaaggttatcgagaaaattgacctttacttccacggcgagcaccaagagaaacggaaaccggccattatccgggaactccgggcaaaagtcccagctctccgccgtacgcgtcgctacttgccggcctccccgccgctctccggcacgtag

SEQ ID NO: 15431 - DNA, 1494 bp, Pseudomonas aeruginosa
ccattcctgggtgccatgggtgccgaaatggatcagcgcgtcggcgccgaaaccctcgcggacgaactggtagaccgccaggtagagatggtccggcggcaccgcgctgtcgtggtaggcctcgcccggacggccggcacgcggcggctgcggcaacagcagcagattacccaggcgcgccgccgggaacacgaagcgtcgctggccgtcgatatcgcgcaaggcccaatgtcgacgcgggtcgccccagcgcgcgcgcatctcctcgcgcaggtccgccggcagcgcctcgagccagtgcaggtaggcgtccagcggcaggctcgcggcgaggccgtcgcgatacagcgcgtccagggtctgcggccggtagtagccgccgagcaggcgctgggcggtatcgatcagcgcgctttcgtcgctcgtcgcaacccggtagccggccgcccgcagcgcttcgccgagacgggccaggctggccggtacattgagatgcgaggcggcgacgttcttctcgccctccgggtggttccagaacatcagcgccaggtgcttgtccgccaccggcaggcgacgcaggcgcagcagccggtcgagcttgtccagcagggcctcggcctgcccggccatcagcttcggctcgccgttctccagggcgctgatgaccagcggatcgctcattccccaggtttccggcatgccgaggaaggccgccacggtacgcggcgccaccccgctggcggcggccagccagtcggcctcgttgccgtcgcggtagccgagggtctgcaataccggcacgtccagcgcgaggaactcggcacggcgcgccgggccgttctgcaggtgctgcaggttgaccagcgcctggacatcggcgccagcgaaggacttcctcaacgcctccggatcgctgtcgtcgaaccacaccgccagcggcgcctggccgtgccgctcgctacgccgcaacagttcgtcgatggcgccggtctgggcgtcggcgatggcgccgcgcgggatcaggaaggcgatgcgcggggcatcgctggcccagcgcgaggcgccccaggccaggtagtcggcgaggccggcgaacggcgccggtgcgtcgggatgatagaagccggcctgcgccaggggctgcggcgccggcaacgcgtcgacgggcaggccggcatgccagcgttggaccgcctcgaacagccggcgcaggttggcttcgccgccgttcgcgtagtagccgaccaggcgcccgcccagcgccgccggcaggttgccgaagcccggaggaccgccgccgacgcggatccagggttgcgtcccgccttgcaagcgctcgcccagcgcctcctcgacctgggcgcgatcggtcggccgcggcgtgtcgaggatcagcaggttgccgccgtccagccactcgccgggcggcgcctcgccgatgccgaggcgcaggccgcgcaactcgacaccggcctcgcgcgcccaaccggctag

SEQ ID NO: 15432 - DNA, 258 bp, Pseudomonas aeruginosa
acggcgtgccggggcgggtcgaggccggtccgccgaagcacctgggcagcgccctggggcagatggtcaacttcctcggcaccctgcagaacgaatgggccggggcccaggccttcagctccttcgatacctacctggcgccctacgtgcgcaaggaccgcctcgactacgccagcgtgcgccaggccctccaggagttcatctacaacctcaacgtgccgtcgcgctggggcacccagacgcccttcaccaacctga

SEQ ID NO: 15433 - DNA, 444 bp, Pseudomonas aeruginosa
acggcctgcacgagatggtgcgcaacttcagcgacgaccgcgagggactgcacagcgaagccgggcgcgagatggccctggccctgctcgatcacgtgcgcgcgcggctggtgggtttccaggaggacagcgggcacctctacaacctggaagccacgcccgccgagggcaccacctatcgcttcgcccgcgaggaccgcaagcgctatccgcgcatcctccaggccggcacgccggaggcaccctactacaccaactcctcgcaactgccggtgggcttcaccgacgacccgttcgaggcgctggagctgcaggacgccctgcaatgcaagtacaccggcggcaccgtgctgcatctctacatggccgagcggatttcctccgccgaagcctgcaagaccctggtgcgcaccgccctcggtcgcttccgcctgccgtacctga

SEQ ID NO: 15434 - DNA, 324 bp, Pseudomonas aeruginosa
ccgtcacccccaccttctcgatctgcccgcggcacggctacctggccggcgagcacgagttctgcccgaagtgcgacgaggagctgctgcaacgctccacgcccaagagctgttgcggcggctgcggcggttgagtcgcctgtcgttcctttcatccaccagcaaggagtaccaccgatgaaccccaaccagttgcccgaaggccagcgccagcgctgcgaagtctggacccgcgtgatgggctaccaccgtcccgtggcagcgttcaatgccggcaagcagtccgagcatcgcgaacgccgccatttccgcgagacgcgatga

SEQ ID NO: 15435 - DNA, 2163 bp, Pseudomonas aeruginosa
  unsure (1464): Identity of nucleotide at the above locations are unknown.
tcgcgccgcgcggcgcggaggaaatcccctggccacgcctgctcgacttcctccgccgacgccagggcctgttgcaggcggtggtcttcagcggcggcgaggcgaccctgcaggcggccctcggcgacgccatgcgcacggtccgcgaactgggcttccgcgtcggcctgcacagcgccggcatcaacccccgcgccttcgcccgggtgctggcgcagagcgactgggtgggcttcgacgtcaaggcgccggccgaggacgtcgccgccattaccggcgtggacggcagcggcgcggccaactggcgcagcctggaatgcctgctggacagcggcgtggcctacgaatgccggaccacggtgcactggcgcttgttcgatagcgaacgcctctggcgcctggcgacgcgcctgcgcgagatgggcgtggagcgcttcgccgtacaactggcgcgcccggcccgccagctcgatccgcagcttctcgcgaagcccgcgccgcagggcgctgcgcagctatggcgagaactggaagagctgtttcccgccttcgaactgcgcgacgcctgagcctccggttcagcggcgccgctcgggcctgccagctcgctcggacagggcgggcagtcccaaccaggcctgtccttcacaagactcatacgatcgtacgagagcacctcctcgattcctagttgcgtccaattgtcgcggacggcgccgctcgccacccttgctccagattcagcgaccccggacccgcgccatgaaactcacgctcacccctcccctgacccccagccactggatgcgctcgaccgacctggccgacgccgccagcgcccccctcgtcggcacccactcggcggacgtggcgatagtcggcggcggtttcgtcgggctctggaccgccatcaccctcaaacaactggagccggacgcacgggtcctgctgctggagcaggacgtctgcggcggcggcgcttccggcaggaacggtggtttcgtgatgtcctggtggccgaagatcggtaccttgctgggcttctgcagcgaggcgcaggcgcgcttccttggcgaaagcgcggagcgggcgatccaggaactcggggagttctgcgcgcggcatgacatcgatgcgcacttccagcagaagggctggctgtggaccgccaccacggcgcaccacctcgacgcctggaacgataccctcgccgcctgcgaacggctcggcgtcagtcccttcgaacgcctcgacgccagcgaagtggcacgccggaccggttcgccggtgcatctcgccggggtcttcgagcgcagcaatgccaccgtgcaaccagccttgctggtgcaaagcatgcgccgcgtggcactggccctcggcgtggaaatccacgagcgctgtggcgtcagccagatcgttcccggccagccggcacaactgctgaacgccggggcccgggtccangccaaggcggtggttctcgcgaccaacgcctggtcggccgccctgcccaggctctccaggctgatcgtgccggtgaacagttccatcgcggttaccgaggcgataccgcaacggctggagcgaatcggctggaccggcggggaagccatcaccgattcccaactgatggtggactactaccgcaccacccgcgacgggcgcatcgccttcggcaagggcaccggcgccatcagctactgctcgctcatcggccgggtattcgacgtcgaccgggagagcctggccctgaccgaggccgacttccgccgcacctatccctcgctaggcgacatcccgctggtcgacggctggtccggccccatcgaccgtacctacgacagcctgccggtcttcggccgcctgcacgagaacatccactacggcatcggctggagcggcaacggcgtgggaccgagccgcctgggcgggcggatcctcgccagcctcgccctcggccgcgacgacccgtggagccgttgtccgctggtagaacgccgctgccggagcttcccccccgagccgctgcgctacctgggtggctccctggtgcgcaacgccgtcctgcgcaaggaacgcgcggaactcgccggtaccgcgccctcggccaccgaccgctttctcgcgcgcttcgcccccgccggccttgaagacaaatcctga

SEQ ID NO: 15436 - DNA, 360 bp, Pseudomonas aeruginosa
ggagcccatggcatgaacccttcgctcatccgtctcgacgacgaaagtcctttcacctcgcccacgcccgtcggccagccgctgggcgaaccggtagccctgacccgtaccgcggcccaccgcccgctcgccgacggcaacggcgtgaccggcatctgggaatgcaccccggggcgcttccgccgacaggtcgagcaggccgagtacagctacatcgtcagcggtgaaggtcgcttcacccccgacgaaggccaggccgtggagtttcgcgccggcgacgcgctctatttcgccgctgccacccagggcacctgggacatccgccagaccgtgcgcaagacctacctgatcttcgactga

SEQ ID NO: 15437 - DNA, 1065 bp, Pseudomonas aeruginosa
actgcccctgccgcatcgtcaccaggctcctgcgtgaccgaagcctgcctgagaacccgcggcaacaaccagctcagcggcctctcccggcgttacctgggcccgctcggcggatggctgattttcatcgcggtggcggccaacagatacggggccatggtcgcctacatgaccgacagcggcaacatcatggtagagttattcggccagtacggcctcacgcgcgaggtcggcagcctgatcttgttagtcccctcggcgctggtgctatacctgggcctgaaggcgctcggcgtgggcgagaagctgatcagcgccggcatggtggccatcgtctgcatcctcatcggcgctaccctgatgcaggacgacgcccgtctcgcccacctttggcagagccagtggcaatacgtggttccagtgttcaacctggcggtcttcgtgttcggcgcgcagttcctggttccggagttggtgcgcggcaacctggcaacccccgggcgcgtgccgcgcctgatcgtggtcggcatgctgctgaccttcttgggtggtggcggccattcctgccctcggtcatcgcccctggtcgccccggacgacatcagcgaggtggcgaccttgagctggggacgctccttcggccgatgggcctactacgtggcgaacactttcgcctggttggcgatgctgacctcgtactggggactcggcgggtgcctgttcaccaatatcttcgaccacttccgcgtgggcagcgaaacccacgggcgcaaacgcctggcggtgctcgccgcggtctcggtcccgccgttcctgctggcctatgcggggctcggcggcttcgtgaacgcgctgtacttcgccggtaccttcggcggcgtactgatgggcatcatccccatcctcctgctcaacgcggcgcggcgccacggcgaccaactgccggcattcagctgcggctggtatgcccatccgctgatacaggggctgatcgtcctggtgttcgcctccagcggggtctacgcgatcgcctcggcactggggatgctgcccgccagttggtga

SEQ ID NO: 15438 - DNA, 1614 bp, Pseudomonas aeruginosa
cagggcgcgctgcctgcgcccggggcgattacactgaaggcccatgcctggagtttcctggacatgccgcagagcatccgccacctgatcgccctccccgaactccgttcgcgcctgctgagcggagccggcggcctcgaccgcccggttcgctgggcgcatgtctgcgaactcgacgaccccaccgaatggctcggcgagggtgacctgctgatgaccaccgggctgggcataccgagcgacgccgagcggcaacggcgttacgtccgaaaactggccgaggccggcctggcaggcatgatgatcggcgagaacatggaagccccgagcgacctcgatgccctgcgcgagacggccgaggccctgggctttccgttgattctcacccactacggcgtccctttcgccgccgtgacccgggccatcgtcgatgcgggacagaaagacgaatacgagcgccgcaacgccctggcccggatatacgaaagcgcccggttgagcatgcagggactgggcctgccggcgctgctgcaacgcctcggcaaggacgtgcggagcagcctctacctcatcgttcccgacaccctggcggcctggcagccaggcctgccagggctgcccgcggagttggccgacgcgctgcgcaaccgccgtcgcgagcaggcggagccgcagcccgatggtccttcgccatccgctcgcggaaggcgaagcgctcagcatcggcattccttccgaccggaactgcctgctgatagccctgggcgagcggctgccggactacagtctcctgcaccacctgacggcagtgctcggcatagagatcgaacggctgcgcgtcgaaagcgaacgccacctgcgcctgggttcggaattgctccacgacctgctgcacggacggctataccggggaaccaagccgaggagcggctggaggaactgctgcccgggctcgatctcgacgatgcagtcgtttccgtggcaagttccgaggggctcgcgaccgaccctatcggtcttttccggggccacgactcacgcctgctggttcgcgcgcagggccaggaaatcattttgctgcaccaggccggcctcgcctcgacactgcaggaagccctggacagctcgctgggcgtgagcgccccgctccgtcgtgccgaacgttgcgccgaggccttgcgcgaagcgcgtctggccctggcccacagccattcccggcgaccgttgtgtcgctacgcggaactggacgacgaggcgccctggctacccagaagcctcgccgaggccgagcgggcgttccgtctggtcctcggcgccctccacgactatgacgcggccaatggctccgcactgctacacacgctgcaggtctttctcgaggaaaacaggtcctggttgaacgccgcgcagcggctacacatacacaagcagagcctggtctaccggatacgccgcatcgaggaaatcagcggtcgctcgctggacagcaccgccgatgtggcgaccctctggttcgccttgcaggcaacccggctgtcgccggaagcgaggggcaggacggcgaagggcagcctcctggagcagtccgcgcaccatggcggcgacatggactga

SEQ ID NO: 15439 - DNA, 1587 bp, Pseudomonas aeruginosa
gacggaagcccatcggcgcggcgcaaaggaggcctgcgatgcgtaacggaatcgacgctgtatccgccccgctacccaccctgttcgtatctcctctggcggtcttcaccgcctccctcgagcgacttcccccacgcgctcggcaggcccccgccgcccagcgcccgccggggtcgcccggcattcccggcagcgcccggttgcagactggcgccaccacgtcccgctgacgtcccaacgccgacggccatgccgtcgcaagcgcttcatcccccgcgatccgcccgtcgcgctcgtccccatcgggaccaaccgggccgcccccggcccgctccttcgaacctgcgtggagtccatcccatgaacggaagcagatccacctttctctaccttctcgccgccgccggcctggcgctgacacccgcggcccaggccgaccggggcaacgacgtggtcgcccggctcaaccagttgtacaacgacacccgccaggattgcggcggaccgtcgaagccggcattcctctgttccggcgtactgttccgcgccacctggccttcgaccgactacatgttctacagcatcagtccgaagagccagaaaagcggcggcgtctccgcctcctacctgcgcaaggacgccaagtaccgcaagctcgcctatggcctgaagagtggcttcatcttcgacaccatcttcggtaatccgaaggaccaccaggactatgcggtgctctgttccttccccatcgacgccgccaccgacgaccgcgcccagcagggttgcaccgattcgcggcgcacgccgaacagcgtcgagaagtcctgccaggacatcaacgtcagcaccgccgagcagtgggcggcgaactaccggcagaaccgcggcgaccattcgcggcagtgctccttcgacgtccgcgacgagcgcaataccgccgccggcccggccttctaccagagcatccgggcgatggcgcagatcgccgacgaatccttcaccacccagaacgaactgcgcctggccaagtgggaggaaaacccgccgaagtcgccgtcgatcctcgccgcgttctacaccgaggacgccggcctggagggcgctcggctcaaccagatccagtggtatcagtcggtccaggcattcctcccgatcatcaacatgcgactgccgcagacccgccagcaggacgcgcagttcgcctacgacgggcgtaagcaggcgatctacccgaccagcgagaagaatgcctgcgagcgctatgtggaaagcgccacctgggtggagcgcgacgatccgggcttcaggaagaagatcatgaccctggaagtggtaccgaccgattgcgggcgcaagatccaggacaaccagaccaacaatttcttcaacgagctggtggtcgaccactacctggacagcgaatggaaggacaacccggacaaccgcgacagcaatatcggcagcatgcgccgacaactggtctgccacttcaacgtcgcccgcaacaagcccgagtggaacctggaaccctcgcggccgtacacctccaacgaggactccatcgccaagggctgcaataacacctga

SEQ ID NO: 15440 - DNA, 489 bp, Pseudomonas aeruginosa
tggaatgaacgccgcgggcgaaggccggattccctcgccgatcctcgacgaggccgccgagtggctggtgcgcctgcaggacagcggctgcaccgacgacacgcgccaggcctgcgcccagtggcggcagcgcagcccgcagcacgcccatgcctgggagcgcgccgagcgcctgctgcaatgcctcggccgactgccgccggcgctggccctgccgaccctcggccgcgagcacgggctggaccggcggcgcgcgatcaagcacctcgccctggtcctcggcggcgcctcgctggggctcgccacctggcaggccgaaccgttgcgcgactggctggccgaccagcgcaccggcgtcggcgaacagcgccgcctgaccctgcccgacggcagcctgctgaccctgaacaccgacagcgccgtggacctggccttcgacgccagccagcggctggtacgcctgctgcgcggcgagatcttcgtcgatag

SEQ ID NO: 15441 - DNA, 624 bp, Pseudomonas aeruginosa
ccgcgccgacccgcgtccgttccgcgtcgccaccgccgaagcgcggctgcatgccggtgccgcccgcttcaacgtacgccaggagatggccgcgacccgggtcgcggtactcgccggacgggtcgaactgagcccgctccacggacgcgggcgctggctggaaagcggcgagtcggtgcgcctgggcgccgacggcgaagcgcgccggctggtcttcgacggcctgccggacgcctggacccgcggcatgctgatggccgaccggatgccgctggccgaggtgctcgccgaactcgcccgctaccgtcgcggcgtactgcgctgcgacccgcaactggccaggctggcggtgtcgggcgcctatccgctgctggacctgcggcgcacgctgggcatgctgcaggccacctatccgctgaaggtgcgcggggtgaccgactactggatcagcctggtgccggcgtgacggcgcggccgccatccccgtggcaaccgccccctcgcgtccaccccggcaggccgtccgccgttgcgccggaacaggcgttgccatcgacataccgtgctccgcagaaaaataaccgcctcgacctgagacctttttccttctcggctggcaagtag

SEQ ID NO: 15442 - DNA, 324 bp, Pseudomonas aeruginosa
ccctcgccctcgccggagcggcccccgccctgcttgccgccgaggcgcccgccgccagctcggcgcgcagctatgacatcgcccccggcccgctcggtcgcaccctgtcggccttcgccagcgacaacggggtgtccctggcgttcgacccggcgctcaccgagggtcgccgcagcgccgccctgcgcggccgctacgcgccggtcgaggcgctgcaccgcctgctgctgggcagcggcctggagttgcagcagcgcagcgacggcagctacaccctggtgccggcaaccaccgatggcgcgctggaactgcaatcctcgctga

SEQ ID NO: 15443 - DNA, 582 bp, Pseudomonas aeruginosa
cggcgttcgccagcatcggcggccgccagagcaactacgaaaccatcgccgccaacagcatcctcgtcggcaaccagggcgatatcgtcaacagcctggcacgccagcgcggcgaccgccgcacctattccgccgaggtcggcctgcgcggcaacttcgacaccggcccgctccgccacgactggacgctcagcgccaaccgcctgcacgaacggctgggcatggtctatgccttcaccgggatgcagccgggcaacctctaccagacctcgccgcatacgccgctgccggacttctccagcctcgacgggagcattccgaagaccaatgaaaccgacctcggcggcgtggcgctggccgacaggctgtcgttcctcgatgatcgcgtgcaggtcaccctgggcgtgcgccgccagcagatcgagtcgcgcaactacgaccagaccagcggcgcgcgcaccagccacgacaagcggcacgtgtggacgccgatggccagcgtgctggtcaagccgctgcaggacctgtcgctgtacgccaactacatccagggcctcagccagggcgaggcggcgccgatga

SEQ ID NO: 15444 - DNA, 1176 bp, Pseudomonas aeruginosa
ccagaaaccgccgatgaccagccaatgaccgcgaaaaccctgcgcacctggtacctggtgcacaaatggaccagcctgatctccacgatcttcctgctgatgctttgcctcaccgggttgccgctgatcttccacgaggagatcgagcactacttcgagccgcatccgcagctcgagccgctcaccgccgagtcgccgcgcatcgactacgacgacgtgatcgtccgcgccctggccgcccggccgggcgaagtggtgcgcttcctggtattcgaaaaggacgacccgctgggcctggtgatcagcgcgccgagcctggtaccgccgccggagaacggccacatgcagccgttcgacgcgcgcaccggggaattcttcgacgcactaccgccgccgggcggcttcatgtacctgatgctgaagctgcacaccgacctgttcctcggcctgcccggctacctgttcctcggcctgatgggcctgctgctggtggcctcgctggtgtccggggtggtggtatacacgccgttcatgcgcaagctggacttcgccacggtacgcgccgaacgcagccgtcgcctgaagtggctggacctgcacaacctgctgggcatcgtcaccctgtcctgggtactggtggtcggcgtgaccggagtgatcaacaccctggccctgccgatcctgatgctctggcaaggcgggcagttggcggaaatgaccgcgccctacaaggacgcgccgccgctacagcgcctcggctcgctcgacgcggccctggccacggcacgccgggcggcgccggacatggaggtcagcttcgtcggcttccccggcacccagttcagcagccagcatcactatgcggtgttcatgcgcggcaacacgccgctcaccgagcgcctgctgaagccggcactgatcgacgcgcagagcggcgaactcaccgacatgcgcgagatgccgctgtacgtgaagacgctcctgctgtcgcagccgctgcacttcggcgactacggcggcatgccgctgaagatcgtctgggcgctgctcgacctcgtcagcatcgtcatcctcgccagcggtctctacctctggctcggccgacgcaagacgccattggagaagcgcctggcggaactgccggacggcagcctggcgacggagggcaaggcatga

SEQ ID NO: 15445 - DNA, 438 bp, Pseudomonas aeruginosa
tcttccgctggcccctgctactggccctgctcggcctcttcgggctgctctcggcgctgctcggcgacggcctctacgacctgctctcctggctcgccctgggcactccgctggtgctggtcggctgggtctggctgcgcctgccgcgaacccgaaggaacccctgagatgaccaccccgccgccctccgccaacaccctggacctgcgtccgctgatgttggagaccttcgtctgcaccctcgcggtgatgtccttcgtcgccctggtcggcccgctcgcccgcaagctcggcctggcgccctggcaggccggcgccgcggtgaccgtcggcggcatcgcctggatgctcgcggcgcggccctggggcatcgccagcgaccggcatgggcgacggcggatactgctcggcgggctggccggcttcgccctctcctaa

SEQ ID NO: 15446 - DNA, 942 bp, Pseudomonas aeruginosa
gcctcgctctgcctgttcatcgtgctcgccctgcactggacgttgccgaccctgctcgccttcgccggtattgttctcctgcgcggcctcgccggcggtttatacgccgcggtgccggcctgcacggcggcactggtggccgatcacgtcgaggcgcaacgacgcgccgcggcgctggccggactcggcgcggccagcgcgataggcatggtgatcgggccggggctggccggactgctggcgactcacgggctggtcctgccgttgctggtcaccggcgcgctgcccctggtcgccctgctggcgctctggcgctggctgccgcgcgaggagcgtcgccagccgaaccgcggcgccgccctggcgatcggcgaccgccgcctgcggcggccgctggcggtgggcttcgtggcgatgttcagcgtcaccgtggcgcagatcaccgtgggcttcttcgccctcgaccggctgcgcctggattccgccgacgccgcgcgggtggccggcatcgccctgaccgcagtgggcgtcgcgctgatcctggcccagctcctggtgcgccgcctggactggccaccgccgcgactgatccgggtcggcgggctggtcgccgccatcggcttcgccgccgtgtgcttcgccgactcgccgccgctgctctggctggccttcttcgtcgccgcggcgggcatgggttgggtattcccggcagtctcggtgctcaacgccaatgccgtgcgcgccgaggaacagggtgccgccgccggcaccctggtggccgtacatggcttcggcctgatcagcgggccgctgctcggcacgctgctccaccaatttgacagccgcgccccctacgcgctggtcggtctgctgctggcgctggcggcgttctggccgagccaaccgacgcgccccgtggaaacgaggagcgaagcaccatga

SEQ ID NO: 15447 - DNA, 666 bp, Pseudomonas aeruginosa
ccgctgtcgacctgctgctggtcgcgaccctgctggcggccctgctcgcctggtggatacccgccctgcccggccgccgtggcctgctggcgctcgcctcgacgctggcgctcggcgccggcctgtacgctgtatgggacgaccgctggcaagccggcgtcggcgccttcgccggtttctccctgctgctcggcgcctgtctgcgccggaagcccgtgcgcggcctgccgttccggaccggttcgctgtacggcctgctggtgctgctggcaatcgccgcgctgtacctgttcccggtcgcgccgctaccggcgccgagcggcccctatgcggtcggcgtgcgcgatttcgaactggacgaccccagccggcccggcctgctcggcgccccggccgggcagccgcggcgcctgctggtacgtgcctggtacccggcgcgcccgatcgccggcgccgcaccacgccactacttcgacccggacgaggcacgcagcaccgcgcggggcttcggtgaaatactcggctttccgccgttgctcgcctacctcaagcacctgcgcaccaattcctatccggacgccccgctacgcgacgactccgctcgcctgccggtggtgttctacagccacggctacagcgccttcgccggcggcaactggaccctga

SEQ ID NO: 15448 - DNA, 510 bp, Pseudomonas aeruginosa
tggaagaactggccagccacggctacgcggtctacgccatccagcacagcggcgacgcgtcgccgacccgcctgcccaacggcacgctgctgcccatggaccccgggctggtcgaacacctgcgtcgggccgcccacgacggcttgccgcaggccatgcgccagggctatgtcagcgacgatctcgaccagcgcctcgacggccagttgcacaccgccctcgacctgcccgccccggccaaccgcgccgtcaacctcagcgcgccggtatggctggccgaccgcctgttcgtccatgaccgcctgcaggccggcgaggtcccggacagggtcgccgacctggtggccgccagcgacttcgagcacaccggcgagatgggcatgtccttcggcggctcgaccaccggcgcggtctgcatggtcgaccgacgctgcgcggcggccgtcaacctcgacggcggcgacttcgacttcgcgcccttcgatagcgatttcccggcgccgctgctga

SEQ ID NO: 15449 - DNA, 786 bp, Pseudomonas aeruginosa; identical to SEQ ID NO: 6040

SEQ ID NO: 15450 - DNA, 477 bp, Pseudomonas aeruginosa
ttagaccttgcccgcgtatgccgagacccagaaggcggactaatggtagatgtacgttctcctgagcaacgccgtgcgatcatgcagtctgtcggaacggctcatacaggcccggaaatgaccgtacgtcggattcttcatggcttggggtatcggtacagattgcatcgtaaggatttgccggggagaccggatgttgtctttaccaaaaagcgtaaggtcattttcgtgcatgggtgtttctggcacggtcatgggtgctctaaagggaggctgcccaagagtaggcttgactactgggagccaaaaattgctcgtaaccaccagcgtgatcaagacgtcgaaaatgcccttcgctcgctcgggtggcaggtcttgacgatctggcagtgtgagctcaaggaccttcagggcgtagaggcacgcctgtcggcgtttctagggcctagagaaaaaaccgatcgacataggaggtga

SEQ ID NO: 15451 - DNA, 237 bp, Pseudomonas aeruginosa
aatcgcgtaaattcccccctcgttaaaggcgatgatgtgctcgccgtgggaggaatacagatgacacgaccgattggaattgatcttttcgctggggctggtgggatgtccctaggctttgagcaggctggtttcgacgtggtggcggccgtaagagatcgatccaatccatgccgctgttcactcttacaattttcccaattgtacggtaatcccccagtccgtatcttcggctaa

SEQ ID NO: 15452 - DNA, 240 bp, Pseudomonas aeruginosa
cgaatgagcggaaataaggccgtttcaccaaaagcgacggctgctcccaaaaacttaactcttgatgctgaagctgtaaccacaatgcaggcattgatagttattgagaatcttttcatcaacctgttcgccaatcgtggcaccagttatgccgccagctactccgccaagcagtccaccgataagagcgccagcaatactgccaatggctatccctactgggccaccgaccacgcctag

SEQ ID NO: 15453 - DNA, 963 bp, Pseudomonas aeruginosa
aaatggtgccgatggcggtcatgcgggggtttctcgggtcagttggcggaacacttcttccagttggccgtgttcggtacgcaccccggatacccgccagccgctgccgtggatcaggcggttgagcgcgggaaggatctgcacgccggggcgggccagaatggtcagggtgccggcccggtcggggcgtccttcgataccggcgacgccggggagcatggcgatggccagcgggtctaccggtgcttcgatgctgaggctgacggcatggtggtagcggctgcgggtcctgagttcgcccggggtgttgtcggccagcaggcggccgccgttgatcaccagggcgcggctgcacatgaacgagacttcctcgaggatgtgcgtggaaatcaccacgatcttgctttccgagaggttcttcaccagttgccggacctggtgcttctgattcgggtcgaggccgtcggtgggctcgtcgagcaggagcagctcgggatcgtggaggatcgcctgggccagcgcgacgcggcgcttgaagcccttggacagggtttcgatgatgctcctgcgctcatcccgcagctccatgcagtccatggcgctgtcgatgcgccgacgtttttcccgtccgctgtagtcgcggatggacgcgacgaaggcgagaaagccctcgaccgtcatttctccgtagctgggagcgttctccggcaggtagccgatcagcttctgtgcctggcgcgccttgtcctgcatgtcgaagccgaagatgcgtacgctgccggcgctcggcgcgaggaagccggaaagcatcttcagggtggtcgacttgcccgctccgttggggccgaggagaccgacgatctctccccggtcgatgcggaagctcaagtcgtttaccaccgtccggccggaaaagcgtttgctcagtctgtctatgtcgatcatggtttcactggaagttga

SEQ ID NO: 15454 - DNA, 564 bp, Pseudomonas aeruginosa
acgggaagcggaatagcccggccgcctggatcttccgaacttcgagaccaatgcaagttggaggaagacccgacttccgccagtagcggttattcctcgcctttcagcagcggaaggcgaatctcgaaagtggtgccctggccaacctggctctggcaaccgatcctgccgccgtgccggtcgatcaccgtcttgaccatggccagccccaggcccaggccggcgctgccctcggcggaagcgaagcgctggtactggctgaacaggcgcggtagttcggcggccgcgatacctttgccctggtcgacgatccggcagctcagccagtcgccttcgaggcggatgctcaggctgacgacggtccccgccgggctgtacttgaccgcattctccagcaggttgaacagcgcgcgcgtgagcaggccggggtcggcccagaccatcggttcctgctcgtcgtcccagtcgcgccgcaggtcgatgtctttctgttgcgcgaggggccagagctggtcggcggcgtccatcgccaacatggtgaacatgcacgcttcgaagcggtag

SEQ ID NO: 15455 - DNA, 591 bp, Pseudomonas aeruginosa
acctgctggccggcttcgtcctcggcggggcggacgtcgagcagggcgaggatcgccgagtgcggcgcgcgcaggtcatgggagaggaagcgcaggagggtggcgcgctggcgctcggcatcgcgttcggcgctcaggtcgatcaggctcaccagccagccgatggcggtttcgctttcgaccggcagcaggcgcgccaggtcgaggcgcaggtcgcgttcccggtggtcgcggaactcgatggcttccagggtttccagcgttgggcgggcgccaccggcgaggctcggatggccgagttcggccaggcgctggcgcagttcggcgccgcgcagctcgccgccgaacaggtcgcgtgccttgcggttggccagcaggatctgcccctgcgggtcgcagatcagggtcgccaccggcaggcattccaggccgtcggccatgaaccgccggctgtcgcgggtgcggctgaccgcctgctccagggcggcgatgcggttctgcaatggatcgttgccggcgcgcggggggctggcccgctcgggcagcaccttgggctcgcggtcgaggcgcgccagttcccagccgaagtag

SEQ ID NO: 15456 - DNA, 396 bp, Pseudomonas aeruginosa
ccgattcccagttccggtacgccggcagcgagtactgcgctgccgcagccgcccaataccagccagaaggtgccgaagaactctgctccgtattgcttcatgatgaggtccttttcagatccaggatgggacgcggatcgaggcgtccggatagcgggaggggatgattcgaacaaggaaggggagatgacacatccgtgtgtcgaagccagccctggggggattggcttggttgcctggggcgatcgtccgttaccgacccctgactgtggttcgagtggtctcgttccacggcccgccggagcgggtttacacatccctgtgtcggagcaatccatttgctccttggcctactcagcggttggaaatctaccaagcgcgatttgtctgctgtga

SEQ ID NO: 15457 - DNA, 576 bp, Pseudomonas aeruginosa
aaaagccccgcggctgcggggcttcttttcggcgaggcgcgcttacttctggaacgcggccacggccttggtgatctcggcgcgggcggcgtcggcgttgccccagccttcgaccttgacccacttgcctttctcgagatccttgtagttctcgaagaagtgcttgatctgttccagcagcagggccggcaggtcggtgtattccttcacgtccttgtacaggacgctcagcttgtcgtgcggcacggcgatcagcttggcgtcgccgcctgcctcgtcggtcatgtgcaggacgccaaccgggcgcgcgcggatcaccgaaccgggagcgaccggatagggggtcaccaccagcacgtccagcgggtcgccgtcgtcggccagagtgttcgggatgaagccgtagttggccgggtagaacatcggggtggccatgaaacggtcgacgaacaggcagtcggtgtccttgtcgatctcgtacttgatcggcgcatggttggccggaatctcgatagcgacgtagatgtcgttcggcaggtccttgccggccgggatcttgctgtagctcatgggtga

SEQ ID NO: 15458 - DNA, 981 bp, Pseudomonas aeruginosa
cgaaatcatcgggatacagcaccagctcgtggaagccctggtaccagttcagctccggcaggtgcaacagcggcagttgcgcctgcgccgccagcagcaggcggccgaagtcgtcgagatcgacgccggcgagtgcggtcaggtgcttgtcggcgagaaacagcacggcccgctcgcgcaggcggcggtcctcgtcggcgtccaggccgtcgaggatcggcaggtgccggcgtacccgctgccagagctcttcggccaccgggtggcgtgccagcaggcgccggcgccgccaggcgcggaacgaccacatgctcagtcgctctgggccttggcctgtttggcggcgctcgcctgcaggcgatggcgaatgaagccgaggatcatcggcagcagcgacagcaggatgatgccgatcaccagcagcgacaggttcttcttgatgaacggcacgttgccgaagaagtagcccagggtcaccaggccgccgacccaggccacggtgcccaccacgctgaacatgacgaagcgcgggtagtgcatcttcgccatgccggcgacgaagggcgcgaaggtccgcacgatgggcaggaagcgcgccagggtcacggtcttgccgccgtggcgttcgtagaactcatgggtgcggtcgaggtagtcgcggcggaataccttcgagtcggggttgctgaacagccgcttgccgagggtccggccgatcacgtagttggtgctgtcgccggtgatcgccgcgaccatcagcagcccgccgagcagccatgggtccatgccgccggtggcgcagatggcgccggcgatgaacagcagcgagtcgccggggaggaacggagtcaccaccaggccggtttcacagaagatcaccaggaacaggatggcgtagatccagacgccatagttgctgaccagcatggccaggtaggtatccaggtggagaatcagatcgattgggttgaagtccattga

SEQ ID NO: 15459 - DNA, 468 bp, Pseudomonas aeruginosa
cagggaagggcgtgcgatgacactccagccttttgcccagccaccgctcagtctcgccctgggcgccgggcgcgacctcccggggcaggccgcgcgggttcgcgccgaatggctcgcgcctcgccccggacgggctccggcgtttctcctggcgctgctctggggacgcggttgcgccaacgtggtgcaggccatcgaaggccatctcgacgccctgttcgccgactacgcctgtacccccgagggttggccggaagcgcaggcggcgcggcaggtcctggcttcgctgaacatgcagctctatcgccggcgccgcgaaggcgagccgggcgtgctcgagctggcggtggggttgctgctggtccatgccggaggcgtgcactttctccagtgcggcgccgtcggcctgctgcgttatcgccagggcagcctgcagcgcctgggagggagcggccagccgctgggtag

SEQ ID NO: 15460 - DNA, 1029 bp, Pseudomonas aeruginosa
cagcgcggagctggcgctggtccagcacaacctgacccaggtggccggcgagcccttgttgctggcgccccagccgctgctcgaagtggccgacctgcgcgccctcggagagcgttgtgcggggctggccacggggcgcctggagggcgtgctgcagccgttgctgcatgcgccgggggcggtggcgctggtcttgccgggggcgctcgagcgcgccccggcggcgccacggcataccggctggccagcgctgggcgcggcgtgccccggcgactgcgtggatggctggaccttgcaggcagcttgcgcgttcggcccgcccgggcggctattccgcgcctgcgacgagcaaggacgcgaggcgttgctgctgctcgcggcggtcgatgccgacgaagcgttctggcagcgcgaatgggcattgcggcgctgccgtgcggagagcctgccgcgagtattgtcgtcgccccggttgcgtcgtcatgccttccagttgttcgctccgccgcgctggccgatgcgcagcctgctggattgggcgccagcgcacctgccgctggaaccgcaatgcgcgctggtcctcctggagcaacttatggatgcggttcgcgccttgcagcggcgcggcgtacagggcttgtggctgggcgccgcggcagatcctgctggacgagggcgggcgcctgctgttcctccccgaggcggcggcgatcctgccgggggtggcgcgccaggcgctgcctgcggacagcgtgccgctggcgccggagttgcgtcgcggcgaggcgctcgatggccgggccgaccagttcgccctggcggcgctgttctattggctgctctgtggtcgctggccgtcgatcgcctgcccggagagcgacggcggatgccgctacgagcccctgggcgagcgtcaggcggacctgccggtcggctgggatggggtattggcgcgggccctggcgccgcgtccggaggcgcgcttcgaagcgttgtcggaattctggctggccttgcagaagccgctag

SEQ ID NO: 15461 - DNA, 963 bp, Pseudomonas aeruginosa
atcggccgaaggaggggcgacgcgcgccggcccatccttcggccgggaggctcagtccctcgccaggaggaagttgccggtgcgcggagcctcgccgtccagcgcctggacctccgcctcgtccttcaggttgaccccggaaagctgccgccggcaggcctcgcgcatcaggtagagcaggcggtgcgcggccatgccgtagctgaggccttccaggcggacgttggagatgcagttgcgataggcgtcggtgaggccgacccgcggggcccaggtgaagtacaggccgaggctgtccggcgagctgaggccgggacgctcgccgatcaggatcacgctcatcttcgcccgcagcaattcaccgatctcgtcggccaccgccacccgtccctgttccaccaggaccaccggcgacagcgaccagccttcggccagcgcctgttcctccaggcgttcgaggaagggcagggtgtgacgctgcacggccagcgcggagaggccgtcggcgaccacgatggccaggtcgatctgcccgtcgtagccggcggcgtgttcgcgcaggcgttgcaccgaggcctcgtcgaggcgccggccgaggtccgggcgttgcaggtagacgtggcggtcggcggcggcgctgtgcagcagcaggctgtcgcggccgcgctggcgcaggccgtcgctgatggccgcatggtcgaagggcaggtgcacggcgtcgcgcgcctgggcgtgggcgtactggaagtccagttgcgggcgggtcggcaggctggtgccggtgcggcccagggcgatccgcgcgggggtcagctggcgcagcggcagccaggggttctcggcgctggcgtcgggcaggtgcttgtcgttcatcggcatctcctcaggccagttgcgccagggcctggcggaacgccggcggtaactcgtcaccgaagcggatgcgcccgtcggcctgggtga

SEQ ID NO: 15462 - DNA, 2058 bp, Pseudomonas aeruginosa
agcctcggaaggccttacgcggggctttggcagcaagtccaagtcatgccccgtccgggaagtcttcccggacgaatcgggcgatcttccgttcccgtcggcgcgccccgcttccaccatgaagccgccgcggcccgagcagcggcctgccgtttctcgaccctcactccaaacgggaacccgatcatgacaacaagaacctcacccgcccctgccggcctcctgcgcccgagcctgcactgcctcgccttcgccgtcgccctgggcagcgctggcgccgcgctggccaaggatgtgacctgggaggacatcgccaacgacgacaagaccaccggcgacgtgctgcagtacggcatgggcacccacgcccagcgctggagcccgctcaagcaggtcaacgccgacaacgtgttcaagctgaccccggcctggtcgtactccttcggcgacgagaaacagcgcggccaggagtcccaggccatcgtcagcgacggcgtgatctacgtgaccgcctcctactcgcggctgttcgccctcgatgcgaagaccggcaagcgcctgtggacctacaaccaccgcctgcccgacgacatccgcccgtgctgcgacgtggtcaaccgcggcgccgcgatctatggcgacaaggtgttcttcggcaccctcgacgcctcggtggtggcgctgaacaagaacaccggcaaggtggtgtggaagaagaagttcgccgatcacggcgccggctacaccatgactggcgcgccgaccatcgtgaaggacggcaagaccggcaaggtcctgctgatccacggcagttcgggcgacgagttcggcgtggtcggccgcctgttcgcccgcgatccggataccggcgaggaaatctggatgcgtcccttcgtcgaaggccacatgggccgcctgaacggcaaggacagcacggtgaccggcgacgtcaaggcgccctcctggccggacgatcgcaactcgccgaccggcaaggtcgagtcgtggagccacggcggcggcgctccctggcagagcgccagcttcgacgccgagaccaacaccatcatcgtcggcgccggcaaccccggcccgtggaacacctgggcgcgcaccgccaagggcggcaatccgcacgactacgacagcctctacacctccggccaggtcggggtggacccgagcagcggcgaggtgaagtggttctaccagcacacccccaacgacgcctgggacttctccggcaacaacgaactggtgctgttcgactacaaggccaaggacggcaagatcgtcaaggccaccgcccacgccgaccgcaacggcttcttctatgtggtcgaccgcagcaacggcaagttgcagaacgccttccccttcgtcgacaacatcacctgggccagccacatcgacctgaagaccggccgcccggtggagcgcgagggccagcgcccgccgctgccggaaccggggcagaagcatggcaaggcggtggaagtatcgccgccgttcctcggcggcaagaactggaacccgatggcctacagccaggacaccggcctgttctacgtgccggccaaccactggaaggaagactactggaccgaggaggtcagctatacgaagggcagcgcctaccttggcatgggcttccggatcaagcgcatgtacgacgaccacgtcggcagcctgcgcgccatggacccggtcagcggcaaggtggtctgggaacacaaggaacacctgccgctctgggccggggtgctggccaccgccggcaacctggtgttcaccggcaccggcgacggctacttcaaggccttcgacgcgaagagcggcaaggagctgtggaaattccagaccggcagcggcatcgtctcgccaccgatcacctgggaacaggacggcgagcagtacctcggcgtgaccgtcggctacggcggcgccgtgccgctgtggggcggcgacatggccgacctgacccggccggtggcccagggcggttccttctgggtattcaagctgcccagctgggacaaccgcaccgccagccgctga

SEQ ID NO: 15463 - DNA, 465 bp, Pseudomonas aeruginosa
agaccttcctcctctgcgccgccctgctcggcgccggcctggcccaggccgccgacgacatcgacgacgtccgcgtcatcgccggctgccgcctggagcccggcgcgcgctgcgccaaggccgacctgcgcggcgccgacctgcgcaacctcgacctcggccgcatcgacctggccggcgccgatctctccggcgccgacctgcgtcacgccaggctcgacctggccaacctggaaaaagccaacctgcgtggtgccgacctcacccgtgccagcctgcagcaagccaacctgcgcggggccgacctctccggcgccagggcggtggcgatccaggcctggggcctgttcgcccagggcgcccagtggcaaggcgccgacctcaccgccgcctacctggagttcgcccgtctcagcggcggccgcctgcaccaggccacgctgcgcgccgccgacctggagatga

SEQ ID NO: 15464 - DNA, 1257 bp, Pseudomonas aeruginosa
ccagcgaaggaatttcccgctgcaccgcctgcaaggcttcttcgccgtcgccggcctcgttcacctccacgtcggggagcagcccgcgcaacagcgcggccagcccttcgcggaccacgaaatgatcgtccaccagcaggatcttcatcgtcctctcctctcagtcgtcgcgttccagcggcatccgcaggcgcaacgccaggccctgtccgggacggctgcgcaggctcagttcagcgcccaggcagcgcgcgcgctggcgcatcgagtccaggccgaagccgggtgccgggtccgccgcgcagccgcgaccgtcgtcgcgtacgctcaggtagagaaagccgccacggcattgcaggcggatccgcacgcggctggcgccggcatgccgggcgacgttgttcagcgcctcctgcaacaggcggtagagatgggtcccggccgccgcatccaggggcggcagcggaccgcccaggcgcagctcgcaggcgatgccctggccttcctgccagtccgccacgcaggcgcgcagcgcctcgtccagcgactggcgttgcagggccggcggcggtagaccgcgcagcagcgcgcggaagctgtcgtccagcccctggcagtagcgctccaggcgtgccagcgccggctgcccgtcgcctgccgtgcagcgcagcaacaacagttgggtgcggatgcccgtcaggtactggccgatatcgtcatgcaccgcctgggccagcaagcgccgctcgcgctcctgcacggcgagcagccagcggtactccgccgggccggcgggtcgcaggtcatccatggcgtggctcagggggcgatccgacaggcctgtccgacggcgcaggcggcaggtctttcctggccgaggtggcgggaatagaggaaatcgaacccgagcaggctgaggatcagcaggatgggcaacaccagggtgacggcgatgcgcatggcggcgactcctgtccattgtcgttgtcgagacatgctaggacgcgcggagccacggcgtgctactaccttggtactgccgggccgctacttttgcgcggccacccgcctccagccgcccttgcgggcgccgccgatgcagcaggagcgctgcgcaagcgcctggtcctgctactttggtactggttcacccctccggacgtcgaatttccaaagcagcgcgcctgccctgtaatgacgcatacaagaagaaacgacgagaagccgccatgccccgccttgccttgccccgcgtag

SEQ ID NO: 15465 - DNA, 234 bp, Pseudomonas aeruginosa
cgcccgactaccctgcggcggtcccgccgcagtaccgagttcgccttctccgcctacccggccgccgacgctccgcgacgcgtccccggcagcgcgcggcggaacgcccacccgctgggctatcgcgcccacgactgctaccgtgagcgcattcgcatccgcccgcgtgccccgagccgccaccagccgcccataacgacaataacgaggtgcaggccatgtacaagatcctga

SEQ ID NO: 15466 - DNA, 1803 bp, Pseudomonas aeruginosa
cccttcgctggcggctacctggcggtactccgcggccaggttgccgagcagttcgccaagctcgaacggggcgatgtccggggtgatcacgccggcgtccagcttggaaatgtccaccagggtgccgagcaggttctccacgtcctccagcgaatggctgatgttgttcaccagcgcctcgttgtcccgcgccgcgctgccgcgctcctgcaaggcgctggtgaacagccgcgcggcgttcagcggttgcagcaggtcgtggctgaccgccgcgaggaacttggtcttcgacaggttggcctgttccgcctcgcgcttggcctcgcgcaggcgcgcctcgacctggctgcgctcgtggatctcgcgcttgaactggtcgttgagggtggtcagctcggcggtccgctcgcgcacccgctgttcgaggttctggtaggcctggtgcagcgcctcggcggtccgccggcgctcggtgatatcccgaatcagcacgaacagcccggcgacccggccgtcggcctggcggttcggcacgtaggagcgctgcatgtagcgctcctcgccggacaacgcggtctcggcgatctcgaaggtcacgctttcgccggccagggcccgctcgaagtacggctccaggcgccggcagtgctcggcgccatgcacgtcgcgcaggcagcggccgagcatcgagccgctgggccagcggtaccactcctcgtagaccttgttggtgaattcgtagaccagttcgtcgctgagataggcgatcagcgccggcacctggtcggtgatcaggcggatccagcgctcgctggcgcgcaacgcctcggcgtggcgatagcgttcggtgatgtcggtgaaggtgttgacgaagccgccggtgggcagcgcatgggtacggatctccagcacccggccatcgaacaggcgctgctcgcgggcgctcagcggactcccctgggagtcctggctgcgcggcgtgagcaacggcaattcgctctccgccatcacttcggcgaaggcccggtgcccggcgatcggggccagcccgcagagctccaggaagcgccggttccacaactccagcacgccgtcggcaccgaccatcgccacgccctgggagagattgtccaccgcccgctgcaacaggtgcgacttctgcgccagcgcctgctcgcggcgcgcggtctcgctgagcttgatctcggtgacgtcgctgtagagcaccgccagcccgccgtcgcgggtcggtcgctcgctcatccgcagccagcgctcgtcgcgcaggcggtacagggtctgctggtcgccgccgcgctgctcctcgacgatcagcccgccgctacgcgccagtcggtgcagttcggcgcgacgcatgccaggaccgatccgcgcccggctgtcgatccacagcgcgcggaagcgctcgttgaacaacacgatgcgttgctgcggatcgaacaggacgaaggcgtcggagatgctttcgatagcgtcgagcagatgctggtgggcggtctcggcacgcaggcgagcgtcgctgagcaactggttgctggccttcagttcgagcatcgtctggctcagcgcgtcggtgcgctcgcggacctgctcggccagcaccacggaatactggaaggcgccgtaggcctcgtcgctctgcgcggcgctcgactcgatgcgtccgatcagcgcctggttgatccgctgcaacttgtgccgctcttcttcgagggcgacgacccgcgcctgcagctcagcgacggacacctccgcggggtcggccaatggcgaccccggtga

SEQ ID NO: 15467 - DNA, 456 bp, Pseudomonas aeruginosa
cctggccgccgcgcacctgcaaccacggcatcaggcgctcgtcgccgggaaacgccgcgccgccgagaaacgacaggtgctcgaggaagtgggccaggccgggatgcgcgctcggctcgtcgtggctgcccgccgccacccgcagccaggcagcggcgcgcgatgccgccggatcatgcgccaggtgcaggcgcaggccgttgggcagcacgcaggcgcggctcctggggtggtgttgggcgtggcgatccatgggcgtcctcgcgggttccgaggctgaaccttacccttccgcgaggcgaaggaaatagtcctttcgccgggtcgtatcaggaagccggcggctcctggccagacgcttcctcggagtacagcgcccgtccgccgtcggccttgagcgcctgcaggacctccggcgcacggcacggggcgaacaggtcgaggccgggatcgtag

SEQ ID NO: 15468 - DNA, 273 bp, Pseudomonas aeruginosa
  unsure (273): Identity of nucleotide at the above locations are unknown.
gccgggccgtggctgcccatctggtgcaggaccagcacggtgtcctgttgcagcccgtcgatgaaggcctgcaagtcgcgcaggaggatctcgtcatggcactcgccgccggcgcacagggccggatccttgctctcgctcaggtcctggaaggcgacgcggtcgcaggtgcccttgcagccggactggttgtcccgccacaggacccgcaggcctgcgcgctgcaacacatcgagaaggccttcctgggtgcgcgcgcgagcgtcgctgtan

SEQ ID NO: 15469 - DNA, 1383 bp, Pseudomonas aeruginosa
gtgccgtttcccctaccccccgggaaacccttctgtgaatttcctcgagcagcgcggtacctctccagcatgaacgctttgaaaggccgggacatcctggcgcttggttttatgacctttgccctgttcgtcggggccggcaacatcatcttcccgcccatcgtcggcttgcagtccggcccccatgtgtggctggcggcgctgggcttcctgatcaccgcggtggggctgccggtgatcaccgtgatcgccctggccaaggtcggcggttcggtcgacgccctcagccatccgatcggcaggtatgccggcggcctgctggcggcggtctgctacctggcggtcggcccgctgttcgccattccgcgcaccgccacggtgtccttcgaggtcggcgtggtgccgctgctcggcgagagcggcacggcgctgttcgtctacagcctggcgtacttcctcctcgccctggccatctccctctaccccggtcgcctgctggacaccgtcggacgcttcctcgccccgctgaagatcctcgccctggcgattctcggcgtcgccgccttcctctggcccgccggcccgatcggcacggcccagccggagtacacccaggccgcgttctcccagggtttcgtcaacggctacctgaccatggacaccctcgccgcgctggtcttcggcatcgtcatcgtcaacgccatccgttcccgcggcgtgcagtcgccgcggctgatcacccgctatgccatcgtcgccgggctgatcgccggtgtcggcctagtgctggtctacgtcagcctgttccggctcggcgccggcagccatgccatcgccgccgacgccagcaacggcgcggcggtcctgcatgcctacgtgcaacataccttcggcagcctcggcagctcgttcctggcgggacttatcgcgctggcctgcctggtcaccgcggtcggcctgacctgcgcctgcgccgagtacttctgccagcgcctgccgctgtcctaccgcagcctggtgatcatcctggcagggttctccttcatcgtttccaacctcggcctgaccaagctgatccaggtctcgatcccggtgctcaccgcgatctatccgccgtgcatcgtgctggtggcgctgagcttctgcatcggcctctggcattcggcgacgcgcatcctcgccccggtgatgctggtttccctggcgttcggcgtgctcgatgccctgaaggcggcgggcctgggccaggacttcccgcaatggctgctgcacctgccgttggccgaacagggcctggcctggttgatcccctcggtcgccactctcgccgcctgcagcctggtcgaccgcctgctgggcaagcctgcgcaagtcgccgcctga

SEQ ID NO: 15470 - DNA, 303 bp, Pseudomonas aeruginosa
cgcagcggcgcggttgttagcctttcgaccattcccccaggaaagcgaatccaggagccggtcatggccaaggcactcatcagcgtactgttgttctccctcgccctcgccggctgcgccagcgactacaacccctctcgcccgtacagcagcgacgaggtcaggcaactggcgctggaggacctggcccggcgcagcctgtcgttcgaggaataccaggccaagcgtcaggcaattctcgaggaaaaaccgcaaaccgccgtcagccagtccaacgccgccctacgcagtaccgccatctga

SEQ ID NO: 15471 - DNA, 1185 bp, Pseudomonas aeruginosa
gacaattcgccgaatgccaggcatcacaccccgccttcatcgcgctacagccacgtcatgacgctggctgcggcactccacgaatgcccgcaggatcgccccatgctccagatggagcgcagcggaaagccgagaccggtagcagaccggtatcgccatggtccaggcgtgcgtaagtcctctataggtaaagaagttgatctccaccgcgaatatcaccatgcagttcggcgccaagccgctgttcgagaacgtttccgtcaagttcggcaacggcaaccgctacggcctgatcggcgccaacggttgcggcaagtcgaccttcatgaagatcctcggcaacgacctggagccgagcgccggccaggtcatgctggaacccaacgtgcgcctgggcaagctgcgccaggaccagttcgcctacgaggacttcagcgtcatcgatacggtgatcatgggccacgaggaactctgggcggtgaaggccgaacgcgaccgcatctactccctgccggaaatgagcgaggcagatggcatggcggtggccgagctggaagtccagttcgccgagttcgacggctacaccgccgagtcccgcgccggcgagctgctgctcggcctgggcatcccgctggagcagcacttcggcccgatgagcgccgtcgctcccggctggaagctgcgcgtactgctggcccaggcgctgttctcggacccggacgtgctgctgctcgacgaaccgaccaaccacctggacatcaacaccatccgctggctggaaggcgtgctcaccgcgcgcaacagcaccatgatcatcatttcccacgatcgccacttcctgaacagcgtctgcacccacatggccgacctggactacggcgagctgcgcctgttcccgggcaactacgacgagtacatgaccgccgccgaacaggcccgcgagcgcctgctgtcggacaacgccaagaagaaggcgcagatcgccgagctgcaatccttcgtcagccgcttctcggccaacgcctccaaggccaagcaggccaccagccgcgcccggcagatcgacaagatccagttggaagaggtcaagccgtccagccgggtcagcccgttcatccgcttcgagcaatacaagaagctgcaccgccaggcggtgaccgtggaaaacatcagcaagggctatga

SEQ ID NO: 15472 - DNA, 624 bp, Pseudomonas aeruginosa
gacaatctgtttttccccccagcggagcgcctgcatgccccacgacctcaacgacctctactacttcgccaaggtggtggaatgcggcggcttcgccgcggccggacgcgagacggggattcccaagtcgcgcctgtcgcggcgcatcgccgagctggaggagcgccttcaggtgcgcctgctgcaccgcacgacacgcaagctggcgctcacggaggtcggcgaacgctacctgcagcactgccgcaacctgctgctggaagcggagatggccgaacaggtgatcgccgagctgagcgtcgagccgcgtggccggctgcgcctttccgcaccggtggccatggcttcgagcaacctggccgacctgttgccgcggtttctcgaacgacacccgcaggtccagctggaaatcctcctgaccaaccgccgggtcgacctgctcaacgagggggtggacgtggcactgcgcgtgcgcgaactcggcgacgaggaccctgcgctggtctgccggcgcctggctccggcgaccacgcagatcctcgccgccccgtcgctgatcgccgggcgtcgcctggaacatccggaagacctcgaagacctgcccttcctcggcgctattcataa

SEQ ID NO: 15473 - DNA, 1644 bp, Pseudomonas aeruginosa
gccagcagcggccagagggcctgtccgtccaggtacatccgccaggcgccagcggccggcagcacgcagaggatcagcaggaccagcagcttcgccaacgggcgctgcaacgcgctcggcggagtcggcgccggccgcgcctgggcccgcgtcaccggcgcctgggcgccacggcggacagttggcggatcgatggtcagcgcgtccagccgcgccctctcggcgcgcaggcggccctgggcgtcctggctggcgagaaaccacacctggtcgccctggcggggacggcggtcgccgcggaacgcggagatatgcaggaagacttcttccccgccggtcttcggcaggatgaagccgaagcccttgtcgtcataccagcggctgatcatgcccggcttttccatatccacatccactcgctcgctacccgtttcgcgctgcattctagccacccgcggcggccagacgaaaaaaggcgcggctcgcgccgcgcctcttgcctgttcccgggcctcacacctcgccggcggtgctccagtcgatcaggtggaattgccaggtcgccaggatcagcaggccgaaggcgatccgataccaggcgaaagccgcgtagctgtggttgccgatgaacttcagcaaggcacgcaccgccagcatggcgaagacgaacgaggtgacgaagccgacggcgaacaccggcaggtcctcggggcggaacaggtcgcggtacacgtatccggaatagaccgccgcgccgaccatggtcggcatcgccaggaagaacgagaactcggtggccgccttgcgcgaaaggccgaacagcaggccgccgatgatggtcgcgccggaccgcgaggtgccggggatcatcgccaggcactgggcacagccgatcttcagggcgtccttccagttcatgtcgtcgacgtgttcggcgcggatcacatgcttccggcgctcggcccagagcatgaccaccccgcccaccaccagcgccagggcgacggtgatcggattgaacagccactcgtggatcaggtcggcgaacaggacgccgaggactaccgccgggaagaacgcgatcagcaggttggcggtgaaacgctgggcctggcgctggctcggcaggtcacggacgacttgaaagatctttccccgaaattcccagacgacagcgaggatcgccgccagttggatgatgatgttgaacgccttggcgcgttcgccgccgaagccgatgaggtcggcgacgatgatctggtgcccggtgctggaaatcggcaggaactcggtcagcccctccacgacgcccaggatgaacgcctggaaagcagtccaccactccatgtttctcccccttctactactgtcccgaacgagctttcgttgttctcggcgatacactcgccgtcttttatgaaggccttacgactccgaagaacccgaccagttcccccactgccgaagtcgaaaccggcgggcatgctaccagagcggccggccaggaatcttggaattcttgccagccggcgtctgaacaaatctgtccgcgcccgtcccctccgccctggtcttcgcgaagcgccggatacattcgctacaatgcgtcctcgtcgcatgagggccttccgtgtcaccccttga

SEQ ID NO: 15474 - DNA, 1086 bp, Pseudomonas aeruginosa
actcttcgccgcttcgctcggcgccatcgccgtctacctgaccgtccgccagaatccctggtgctggcctatcggcctggtgatggtggcgctctacgcctggatattcttcgaggtgaagctttattcggacatgctcctgcaaatggtctacgcggcgctacagctctatggctggtggcagtggacccgcggcgggcaggaccacgacggccgctcggtgagccgcctgaacgccgcgcagcgcctctacgggctcggtgcgggcctggtcggcagcgtcgcgctcggttacctgatggccaaccacaccgatgccgccagtccctggtgggacgccggattgaccgccttcagcctggtggcgcaatgctggatggcgcagaagcgcctggaatgctgggccctgtggatcgccgtagacgtgctgttcgtggcgctcttcgccagcaaggcgctgtacctgaccgccgccctctacgccctcttcaccctgctggcgatccacggctggcggacctggcgccgcgacccggcattgcgcgagggcgtcgccgcatgaaggtgctggtactcaccgggcccgaatccagcggcaagagctggcttgcggagcagctccaggcccgcttcggcggccgggtggtcggcgagtacgtccgccacttcatcgacgaacagcgccgcgacacctgctacgccgacatccccgccatcgcccgcgggcaactggcctgggaggacgccgctcgcgcggaacggccggcgctgctgatcctcgatacccacctgctgagcaacatcctctggagccggattctcttcggcgcctgcccggactggctcgaacccgccctgctgcggcggcgctacgacctgcacctgctgctctcgccggaaggcgtggcctggagcgccgacggccagcgctgccagccggaactggcgcagcgccaggcattccatcgcgaatgccatgcctggctggagcgccatcggcagccctaccgcgccatcgccggcgactgggccgagcgccggcgccaggctttcgccgcagtgcaaggactgctccgggacggctga

SEQ ID NO: 15475 - DNA, 780 bp, Pseudomonas aeruginosa
cagcgttctcgcgcaaagcgtggcgctgaccaaagtctccggttcggccactccggtcccggggggacgcagcgtctcgacggacgatcgcgccttcgccgggagcagcggcgtggtgcaggtgaaccagagcgctggggtgggcaatcagtcgatgaacaccctcagcgtcagggtcatggaatgagtctgccaagccaacacaagcccaacactaagcacagaaatgcaaggagaaacgccatgaaagcgactatggtcccgaccccgctggccctggcaatggctgcagtgctgtcggtatcggcatacgcccggaaacgaaggtggctggcacccgccgaaacccaacccgcagtcgaacaacaagggcggagccacggccctggtggtggatacgcagcagaactacaacaacaaggtcagcaacttcggcacgctgaacaatgcctcggtgagcggctcgatcaaggatgcctcgggcaacgtcggggtcaacgtcgccgccggcgacaacaaccagcaggccaacgccgccgcgctggccagcgccgacgccagcttcgtgttcggcaccgcgaccgccagcaccagcgtgctgcagagcggctacggcaatacgctgaacaactactccaaccccaacaccgcatcgctgagcaactcggccaacaacgtctcgggcaacctgggcgtgaacgtcgccgccggcaacttcaaccagcagaagaacgacctggccgccgccgtctccaacggccagtacagcactgccggtag

SEQ ID NO: 15476 - DNA, 801 bp, Pseudomonas aeruginosa
  unsure (340),(345): Identity of nucleotide at the above locations are unknown.
tggaattcggcttcatccagagcgatttcttctgatcgcaggagccggatgctccgggagcacgccatgtacacgcaccactgcttcgtcctcgcctgctgcctgggcgctgcgctgcccgcccccgccagcgacctcttcgcccccgccgaactgagcgaccaggagctttcccagttgcgcgggcgctacgtgctgccggggcggatcgtcagcttcggggtgaccatgagcagcacctggcagaacgccagcggccaggtcctcggcgcgcgcgtcgacctgcaggtgcggcagaacctggcgcgcccggtcctcaacgtcaccctggtcgatcggncaggngacgccccaccacccgccgccggcaacggccaggtcctcggcggcgccggactggcacagacccaaggggtcagccagagcatccgcaccgccggcgaccacaacagcgccagcaatggcgtcagcatcgaggtccgccacggcgacgcgccgccgccactgccgggcggcacgccgctggaaggtgcgctcgccctcagcggcgaggccggcacggtcaaggtcacgccgaacggcggcgccctgcaactggcgatccaggccagcggccagggcgccagcctgcaaagcctcggcgccggcggcctggtgcagagcgtggcgctcagcggaaaccgcaacctggtgcagaacctggcggcgctcgaggtgatgctcaaggaccggccgggcgccgatccggcactgaattgcgcctgggagcaattgcgcgcgctgcgccccagcggctactga

SEQ ID NO: 15477 - DNA, 1314 bp, Pseudomonas aeruginosa
tctgaaatcactgtgctatcggaaggccataaaaacggaacggcaaacatgacccagacactctcgctgcgagctgtcctctgcgccaccaccctggtttccccgttcctggcgcaggccgcgacggagtccgaggtcgaggcgctgaagaaggaactcctggagctgcgccaacgctacgaggcccagcagaacgccctgatggtcctcgaacagcgcgtgcgccaggtcgaggcgcaaccccaggcgccgcagccgcaacgcctggtcaagtcgatccagccgccggcgcaggcgcgcaacgacgccaacgcggtcgccggcacctacggcgccagcctcaaggacgatggcgcgcccgcgcccagcgtggaaaacatctaccaggacgccagcggcttcttcggcggcggcaccttcagcctggagaccggcctcacctacagccactacgacacccgccagttgttcctcaacggcttcctggcgctggactcgatcttcctcggcaacatcggcgtggaccagatcgatgccgacatctggaccctcgacctgaccggccgctacaactggaaccagcgctggcaggtggatatcaacgccccggtggtctatcgcgaatcgacctaccagtccgccggcgccggcggctcgacctcgcagatcaccgagaaatcggtgaccggcgacccacgcctgggcgacgtcagcttcggcgtcgcctacaagttcctcgacgaaagcgagagcaccccggacgcggtggtcagcctgcgggtcaaggcgcccaccggcaaggatccctacggcatcaagctgaagcaggtaccgggcaacaacaacctcaacgtgcccgacgacctgcccaccggcaacggcgtctggtcgatcaccccgggcatctcgctggtgaagacggtggacccggcggtgctgttcggcagcctgtcgtatacctacaacttcgaagagtcgttcgacgacatcaacccgcagcaaggcgtgaagaccggcggcaaggtcaagctcggcaactggttccaactcggcgtcggcgtggccttcgcgctgaacgagaagatgagcatgtcgttctccttctccgaactgatcagccagaagagcaaggtcaagcaggacggccaaagctggcagaccgtcagcggcagcgacgccaacgccggctacttcggcctgggcatgacctatgcggtgagcaacaggttcagcatcgtgcccagcctgtccatcggcatcactccggacgcgccggacttcaccttcggcgtgaaattcccctactacttctga

SEQ ID NO: 15478 - DNA, 2229 bp, Pseudomonas aeruginosa
aggactgcccggcgagggtctcgccgccccgtggcaggcgcggcgcgcgcaccaccaggtccatgttcaggctgcccaccaccagtactttcgcttgcatcgttgcgtccttgttccagcctctctctagcgagggcgcccccggcgcccggttcagacccgcaccagcggcggcgcggtggattcgcgcaggaccagcgccggcgccaccacccgccgctgcatcggctcctcgcgctcggcgatgcgttgcagcagcagttgcgcggcgatctcgccgagcaggcggatcgactggcccacggtggtcaaggcgggaaacacgaagcggctcagctcgatatcgtcgaagccgatcaccgacagttcgtgcggcaccctgatattcagctcggccgcggcgcgcagcacgccgatgccgatcatgtcgttgccggcgacgatcgccgtcggtcgctcgccctcgccgcccagcaggccgagcgccgcgtggtagccgccggggctgctgaactcgctttccagcagccactgcgggcgcacctccaggccggccttggccatcgcccgccggtagccctcgacccgcagcgtcgaaaccttggtcgacagcggcccgccgatgcaggcgatgtcgcgatggcccagctcgagcaggtggcgggtcgccaggtaggcgcccatctcatggtcgatctgcacccggtcggcttccacgccttccacctcgcggtcgacgatcacggtcggcgtgcgcatgttcgccagccccttggccagcgcgccgtcgccgccggcggacgccaggaccaggccgtcgatgcgtttctcctggagcacgcgcaggtagttggcctgcttctgcgggttgtcgtcggagttgcagaggatcacgcagtagccgttgcgctcgcagcaatcctcgatgccccgcgacagctcggcgaaatacgggttggtgctgttcggcaccagcaggccgatgatcgaggtggtgcgcaccttcagcgagcgcgccaccgcgctgggcacgtagtgcagctgcgcgatggcgtcctcgaccttcttgcgcaccgcgtcgctgaccggccgcgtcctgttcaccacatgcgatacggtggtgaaggaaacccccgccatcgccgccacgtccttcattgtcgccatcgttcagccctgtctgcgggcgcgatggctgcggtaggtatccagcaccaccgctaccacgatcaccgccccggtaatgattcgtttggtcggctccgacgcaccgatctgcgccagccccgccgccaatacggaaatgatcagcacgccgaagaaggtgctgaccaccgaacctcgcccgcccatcaggctggtgccgccgatcaccaccgcggcgatgacctggagttccaggccgaccccggcgttggggtcggccgcttccagacgcgagatctggaacagcgcggccaacccggcgagcagccccatcagggcgaatactgcaatcttatagggtttcgggttcacaccggccaatcgcaccgcttcttcgttggtgccgatgccgatcaggtagcggccaaacaccgtgcgggtgagcaccgcctgggcggcgaacatcaccagcagggcgatcacgaaggccggcgagatgccgaacgccagcggattggacagccaggcataggcgtcgccgatataggccgtgcgcgagtcggtcatctggtaggccagcccacgggccatctccagcaccccgagggacacgatgaacgagggaatccgccaggccaccgtgatcgaaccggtgacgcagccggccagggtcgcgcaggccatcccgagcatcgccgccggcagcacgccccagccccagccgagcgtcgccaggcttaccgccgaggccgccagggccagcaccgaacctaccgagagatcgatgccgccgacgatcaggatgaaggtcatgcccaccgccagcaccaccaggtcggggatctggttggcgatggcgaggaaggtgccatagctgaggaagtggctgctcagcgccgagaacagcgcgatcatcgccagcagcgcgccggccaggccgaggtaggtgcccaggccgaaatagttgccgcgtcgcagggttggcgctgcggcggcggtagcggaagacgtcgggtcgctcatttctggttccttgcgttgcgtgttcacgacgtcgccagcagcgcgtcgcgtttcttgtaa

SEQ ID NO: 15479 - DNA, 411 bp, Pseudomonas aeruginosa
atgtcgaacttggcgccgacgtcgatgccacgggtcggctcgtcgaacagcagcacctggcagtcgcgctccagccagcggccgatcaccaccttctgctggttgccgccggacagttcgcccaccgcctgcgcggtgtccgcgcagcgcacccgcagcgcctccacctggcgccgcgccagggcttcctcgcggcgccggtcgatcaccccgtggcgcgccagcgccggcaggttgcccagggccaggttggcgctgatcgactggtccagcagcaggccctcgcccttgcggtcctcggtgatcagcgccaccccctggcgcaccgagtcggccggcgaacgcaggctcaggcgctgcggcggatcgccgagcaggacctgcccaccgtcggcgcggtcggcgccgtag

SEQ ID NO: 15480 - DNA, 597 bp, Pseudomonas aeruginosa
ccgaccaccttcacctgcccggcgcggcccgccgcgcgcaccgccgataccgcgccgagggccatgctgtcgttgccggcgagcagcgccttgaggtccggatgctcgttgagcatcgccgaagccaccgcgttgcccttctcgatttcccagttgcccgactgcaaggagacgatcttcatccccgccgcgtccatcgcatccctgaagccggcggtgcgctgctgggcattggtggtcgtggagaccccttcgatgatgccgacctcgtcgccggccttcagtcgcttcgccaggtactcgccgaccagccgcgcacccttgcggttgtcgggcccgacgaagggcacgccgatcttcttcgcctgcagcacctgcgggtcgaagcggttgtcgatgttgaccaccacgatgccggcgtccagcgctttcttcaccaccggcaccagcgccttggaatcggccggcgcgatcaccagtgcgtcgaccccggaaacgatcatctgctcgacgatgcggatctggctggaggtatcggtctcgtccttgatgccgttggaaaccagttcgaaccggtcggcatgctccttctggtag

SEQ ID NO: 15481 - DNA, 273 bp, Pseudomonas aeruginosa
tcaccccgcgcgagaagctgccgtcgggaatcttcagcaccagcgggaagcccaggcgctcgccgaccttctccagttcctgcgggttctccttgtagagaatctccgtggccggcatgcccagcttgtggctgcgcagcaggtcggccaggtacaccttgttggtgcagcgcaggatcgacaccgggtcgtccatcaccaccaacccttcgctctcggccttcttggcgaaacggtaggtgtggtcggcgacattggtggtctcgcggatga

SEQ ID NO: 15482 - DNA, 312 bp, Pseudomonas aeruginosa
tcctgttcaacccggaatgatccgcatcgccccgccctgcggcggggagatgttctcacctatcaatcaattccatcgatagtggctagtgagactatccatttttcattcgccaacgccgatgtttacatagtcgccagatccccgaataaccagaacggaactggagacgacaccatgagctactccgccaaatccttctcggccctgatcaatgccatgcgcgccgacggcatcacccgcctggaacaactggcccgccagcccttccgcaacgcccagggcttctggagcgcggaggcgaagaaatga

SEQ ID NO: 15483 - DNA, 609 bp, Pseudomonas aeruginosa
agggcctgcactacgactggttcaccgccctcgaactgcccttctccgaagaacccttcgccgcccccgaatacctcgcccgcttcggcttcctcgtcgatccgcagcagaaggccagcgacctcaaccccggcaacctgccggtgggcttcagccagcaccgcgacgagaagaccggcacccgctacctggacatcacctgcgccgcctgccacaccggcgaactgcgctaccagggcaagtcgctgcgcatcgacggcggcgccgccatgcactccatcgccgccaccgtgccgaccctgcgcggcggcgccttcggccaggcgctcggcgcgagcatggccgccacctactacaacccgttcaagttcaaccgcttcgccaggaaagtcctcggcgaacgctacgaacaggacaagtcgcaactgcgcgccgacttcaaggccgtactcgacaccctcctgcgcaccgcctggaacgacacccgccgccacctctaccccaccgaggaaggccccggccgcaccgacgccttcgggcgcatcgccaacagcgtcttcggcgatgccatcgacccgggcaactaccgcgtcgccaacgccccggtga

SEQ ID NO: 15484 - DNA, 1182 bp, Pseudomonas aeruginosa
gctatccgcaggtctgggacatctggaaattcgactgggtgcaatggaacggctcggccatgcagccgatggcgcgcaatatcggcgaggccctcggcgtcggcgcgcgcctgcagatcttcgacgagcacggccagccgctgcagggcgagcagcgctacgcctccagcgtacgcctgcacgacctgcacgccctggaagaaacctgcaacaactgaaaccaccgacctggccggaagacctcttcggccgcatcgacctgcaacgcgcctcccagggccgcgccctattcgaagccaactgcgccttctgccatgcgcccaaggtgcaaccggcggaatacgccgcccccggacgcaatcccgagtggcgcatgcacatggtgccgaccgaggtgatcggcaccgacccgaccaccgccgacaacatcgccgaccaccgctacgacctgcgcaagctcggctggagcgtcgacgaactggcgcggatgaacgtccagctgatcggcgccgatccgcagcaactcgacctctcgcaactgtcctcggccaagggcctggcctacatcaccgccctcgtcgagcagcacgcctaccgggacgccggcatcccgccggaacagcagaagaccatgaacggcttcgacctgccgatcggcgtacaggaactgcgcgcctacaaggcccgcccgctggacggcgtctgggcgaccccgccgttcctgcacaacggctcggtgcccaacctgttccaactgctctccccggccgccgaacgctcgccgcagttctacgtcggcaccttcgaattcgatccgaaattcgttggattccgcaccgagaaattccccggcggcttcctcctcgacacccgtctcaccggcaaccgcaacagcggccacgaattccgcgacggctgccggcagaacggcgtgatcggccgcgccctcagcccggaagaacgctgggcgctggtggaatacctgaaggtgctcggcaaccccgaattcgagcgccgcctggtcccggcccagaccccaccctggacgcccggcccgaaatgcccggcgccggagcaacggaccgcgcaacgctgaacctgggaaatggagaagcgcgaggcatggcgccgccgcccctctccacccctagcagcccctctcccttcaggggggacgcctag

SEQ ID NO: 15485 - DNA, 369 bp, Pseudomonas aeruginosa
ccagaggacggggagaagcaatcgtggcgcactccccgcccaagaagaataaaagcccacagccaacgcacaccaccaaggacacccactccatgcgcgcactcctcacccacgcctggctgttcctcggcaaatggctcggccgcctgctcctcctgctgctggccgtcggcctcggcggctgggccatcggcagcctctactacgcctggaaattctccggcccggtgtccgcggaagagcagatcgccccggacgaagcccgcatcacccaggcgatcatccaggacgccatccgcgtggtcgaacagcaccgcgacaacacccgcgtcctgcgcgatgcccacgccaaggcccacggctgcgtga

SEQ ID NO: 15486 - DNA, 363 bp, Pseudomonas aeruginosa
aggccgaattcaaggtacgcgccgacctcgacccgaccctgcgtcgcggcgtgttcgccgaagcgggcaaaagctggaacgcctgggtgcgcttctccaacggcaacgcctacccgcagttcgacagcaagaacgacgcgcgcggcatggccatcaagctgctcgacgtgcccggcgaaaaactcctgcccggccgcggccatgacggcgagcaggacttcgtcatgttcaaccagccggtgttcttcatccgcgacatcgccgaataccggcagaacttcgccgcccaggccgacggcaagaaagccctggccttcttccccaactggaaccccgccagctgggaactgcgccacctgctga

SEQ ID NO: 15487 - DNA, 1380 bp, Pseudomonas aeruginosa
gcgaggcaaaacggatttctccaagtcgttgaactctttgatgatgcaggtcgctacatggcagttaggttggaatttgaaactacagacagtcaagagattgagttggcgaagcggtattgggccatggacgaggaaggcgcgtacctggaacgcgtagccgatctcctccctttccgagaaattacccaggccagcatggtcgctaaatttgtccggcagatctgcacggcttatgacgaaaatcagacctgtcccaagtgcgatgggcaaatccagataggtggccggaccgaggccaagaaggtaattcaacgctccaatcaaccgtgcgaggaatgtcaaaaaattcaggacgaggagaggcaaaaggaggaagctcagcaacgcgctgagttggatgctaagctcgccccttacatctcccgtgcacgggaagcgaccatttcctactctgcgctacctgacgacactgtactcatcctgcaagcaatccatgcactggtcggccctctgcttacgcaagggaccttttcgctggacgactgtgaagcgatgactcctcagggaacaggcggcctcattgatcgcctctacaagcaaaacatcctgcaagacgaccctgcagcagctaaaccggggacctactggatccaagacgagaagctctggttctccaaagcttcagctcgttactttcttcctccggatgctgacctaggaggaagtcaggcagcgctcaacatgctgtttgagcgagagttctcagattccgtagcgctgaccgaactctggctggaccatgccgtcacagacgtgatgtgctacttcgaatatcaatgcgacgtgcacaaccacatcctctgcgctgcagatgtagacaagatcaaagccaccgtgcgccatgggatgcgcaaatacagcgtcgcgcagatgtggttcatcatgtggaaggtcactcgagatgcagcagcccttgctagccgtagctactacaaccgcgagacagccgccgccactattcctaataagattcgtaagcaactggaaaacgccgatcaaggtaccgagcttcgaaacgaatggacccggccagaaccccacataacgggctcattgggaatgatgttctactcactctttgggctggacgaatacactaaagggacagatgcgcaggcgttgtttgatcgcctaggcgaaaagagtgggggcgaaataaatcttcacgcgttagccgcagccttcatgaaaacagctctggaaaacgaaagcgcgctgtttgctttggaggacttcgcggaaatggtcagagtgggacttacaaccgaggacgcattgaaagaaacaattgatcgaaatccagggctgttccagtaa

SEQ ID NO: 15488 - DNA, 456 bp, Pseudomonas aeruginosa
ggcaggcattggtacgcccagacaatcgccccgcgcccgcgcatcagccaggctgcgagccatgccagcgccggtccgcgctatgatcgctgcgcccggactgaccgcgctccgacctcgcgccgtcgtatcccgaaacccacttccaggaggaagcacatggcaatcgatctctacgcgctggccgaacaggtcgaggacgaagcgggtttcctgcacttcctcgccgcgctggcggcggactgggaggaagaccgccgcctcgccgccgccaacccgccgaaaccgttcggccccagcccgctgggttgggagaacggcagcatcggtggcttcctcgatgccgccgcgacctggggcgaggactcccacgacggcctgccgggctattccaggccggagaatgcctggcggcgcgcggcgcagctgatgctggcgggcaagttctatgaatga

SEQ ID NO: 15489 - DNA, 882 bp, Pseudomonas aeruginosa
cttcaaatctgccctggcgcccttcccgcccggctacccgagggtcttgccgggcaaccggcggcaggtgccgatactgcatcgcgacgcggacttcctcctgcgcgcgctgcaacccgacgatttcgtccggaccagccgctacgagaacgccaaccgcgagcacctggcgccatgggagccgctgcgcgacccggggtatttttccgtggacaacgcccgcgcccgcaccctgctacaggtggcgagcatggacgaaggcgaggcgcttctcctgctgttgctcgatcccgacgacggcgaggtgctggggcgctgcagctacaccaatatcgtccgcggggtattccaggcctgccacctgggcttttccctggccgctgcggcgcagggccgcggcctgatggcacgagccctgcgggtagccaaccggtattgcttcgagcagctcggcctgcaccggatcatggccagccacctgccgcgcaacgcacgcagcgagcgcctgctggaaagcctcggcttcgagaaggaaggctacgcccgcgcctacctgaagatcgccggggtctgggaagaccatgtgctacgggcgctggtggacgctccgcgctgaaccgacgtgcaaatgcggaacgggacgccaggcgtcccgttccgctcaccaggcccgccggtcaaccgcgggcgaggtcgccacgcagttcgcgggcggcggcgaccatgttcaccagcgctgcctcggtttccggccaggcgcgggtcttcaggccgcagtccgggttgacccagagccgctcggcgggtatccgccgggccgccttgcgcagcagcgcgacgatctcttcccggctcggcacgcgcggcgaatggatgtcgtag

SEQ ID NO: 15490 - DNA, 672 bp, Pseudomonas aeruginosa
ccgtccagttgctcggcgaagtactcgaccatgtcgttgcgctcggcctcgccgtgcaccagcacgtccagccccagttgctcctggatctgcaccgcatggcggatctcgctgtgcatcgcctcgatgtactcggcctcgctcagcttgccctgcttgaacgactggcgggccaggcggatcgacgaggtctgcgggaaggagccgatggtggtggtcgggaacgccggcaggtcgagtccggcgcgctgcctggcgatgcgttcggcgaacggcgagcggcgctgggcgtcgctggccttgatcgcggccaggcgcgcctgcacggccggcttgtggattcgcggcgaagaagcgcggctggcctggaccgcacggctctcttccagggcggcaagcacctcggcggcctccggctcagtggcggcacgggccagcaccgcgacttcgcggcacttctgcacggcgaaggccagccagctcttcagctcggcgtccagcccgtcttcgcgctccaggtccaccgggctgtgcagcagcgagcaggacggcgcgacccacagccgctcgcccaggcgctcccgggcatggcgtaccacttccagggctttctccaggtcgcagcgccagacgttgcgtccgttgaccaggcccagcgagacgaccttgtag

SEQ ID NO: 15491 - DNA, 861 bp, Pseudomonas aeruginosa
ccatcgagaggatcgggtcgtccgcctcgtcgtgttcgaggaagcgcatcagccggcctcccgcgcgcgttcgacggcgcgcagttcctggagcagccagcggcgacgcacggtaaggatgaagaaggtgatgctggcggcgaccagggccaggatcaccgcggaaaacgccaccaccaggttctcgccgatcccctgggcgtcgttgcgggtcagcgccagcagtgccggtcccatggggatcatggtcgccaccaggccgagcatcggcgcgctgcgcgaggtgatccgcagccattccaggcgctgcatgatccacagttcgaggtcgtcgctgttgccgccatgcagcgcctgccaggccgccaggcgcgagcggtagcgcccgcgacggcgctgccaggcttccatggcgaagccgccgagggcgacgaaggcgtaggccagcgcggcgaggatcaacagcagcaccggcagcaggaacaggcgggtgagttcgtagaggctggtttccagaccattcatgagcgattttccatcggacgacgattgactacggattgccggacggcgccggcggcgaacagcgcgagcagcacggcggcggccagccggagccacggctgcggctcgccggacggcggcggcgcgacttcttcgaggacgcggccgctgaccgtttcgccggcaccggacgcggccgcgccctctgcctgcgccgcggcctcgccgaaaccgccggccatccgttcgatgaattcacgggtggtcgccgcgccgacctcgccggcgccggcggccgccagttgccgccagcgctcggccagttcgcggcgggtctgctcgctggcgtcccagtag

SEQ ID NO: 15492 - DNA, 918 bp, Pseudomonas aeruginosa
agaatgcccgccgtttcttcttcatcgaggcgagggaacgtctcgctcgccgtatccctcgaagcacaggaccccactctcaaccgggcatgccccccaggaggaaagatgaccgcaaccgagcagatcatggcgctcctcgaacgctgggaccgccagcaggagggctacatccgccagcgcgaggagcgctacgaggcgatgttccagttgctcgaagacctcttcggccgcgacgggcgcttcaccgccatcgacgccgcctgcggcccgggctccctcggccggcgcctgctcgaacgcttcccggcggcgcgggtggtggcgctggacgccgacgtcatgctgctggagatcgcgcgtacggcgctggccggtttcgccgaacgggtccgcgtggtggagtgcgacctcaccgatccaggctggaccgaacgggtcgccgaagcgcgcgagtccctcgccggcgaacggcccgcggcgctgctctcttccaccgcgttgcactggctgtcgcccgccgaactcgccgggttctacgcccaggccggcgagctgctcgcccccggcggcgtgctgctgaacgccgaccacatgcgctacgaccgacgctggccgggactcgcggaattgtcccggaagcaccgcgagcgggtcctccaggcgtccgtggccagcggcgcggacagttgggaagactggtggcaacgcgccgcgcagatcccccggctggccccgctgaaggcgcagcgcgacgcccatttcgcgcggcgcccgctcaggcgcgccagcgaagacgaagactgctcgctcgatttccatctcgccgccctgcgccaggcgggcttcgccgaggccgccacggtctggcagcagttggacaactacgtcgtcttcgcccgcctcgcccaggcctga

SEQ ID NO: 15493 - DNA, 1617 bp, Pseudomonas aeruginosa
ggtctacgatgccgacatcgccgccgcccaccgcgacgccgacctgcatatccacgacctcgacatgctcgccggctattgcgccggctggtcgctgcgcaccttgctgaacgaaggcctgaacggcgtgccggggcgggtcgaggccggtccgccgaagcacctgggcagcgccctggggcagatggtcaacttcctcggcaccctgcagaacgaatgggccggggcccaggccttcagctccttcgatacctacctggcgccctacgtgcgcaaggaccgcctcgactacgccagcgtgcgccaggccctccaggagttcatctacaacctcaacgtgccgtcgcgctggggcacccagacgcccttcaccaacctgaccttcgactgggtctgcccggacgacctgcgcgaccaggtgccgcgcatcggcggcgaggagatgcccttcgcctacggcgagctgcaggccgagatggacctgatcaaccgcgcctacatcgaggtgatgcaggccggcgacgcccatggccgggtgttcaccttcccgatcccgacctacaacatcacccacgacttcccctgggacagcgacaacgccacgcgcctgttcgagatgaccgcgcgctacggcctgccctacttccagaacttcctcaactcggacatgcagcccaaccaggtgcgctcgatgtgctgccgcctgcaactggacgtgcgcgaactgctcaagcgtggcaacggcctgttcggctcggcggagcagaccggctcgctgggcgtggtgacgatcaactgcgcgcgcctgggctatcgccaccgtggcgacgccgccggcctctaccgccagctcgaccacctgctcgaactcgccttcgccagcctggagctgaagcgcaaggtgatccagcagcacatggatgccggcctctatccctacacccgacgctacctgggtaccctgcgcaaccatttctccaccatcggcgtgaacggcctgcacgagatggtgcgcaacttcagcgacgaccgcgagggactgcacagcgaagccgggcgcgagatggccctggccctgctcgatcacgtgcgcgcgcggctggtgggtttccaggaggacagcgggcacctctacaacctggaagccacgcccgccgagggcaccacctatcgcttcgcccgcgaggaccgcaagcgctatccgcgcatcctccaggccggcacgccggaggcaccctactacaccaactcctcgcaactgccggtgggcttcaccgacgacccgttcgaggcgctggagctgcaggacgccctgcaatgcaagtacaccggcggcaccgtgctgcatctctacatggccgagcggatttcctccgccgaagcctgcaagaccctggtgcgcaccgccctcggtcgcttccgcctgccgtacctgaccgtcacccccaccttctcgatctgcccgcggcacggctacctggccggcgagcacgagttctgcccgaagtgcgacgaggagctgctgcaacgctccacgcccaagagctgttgcggcggctgcggcggttgagtcgcctgtcgttcctttcatccaccagcaaggagtaccaccgatga

SEQ ID NO: 15494 - DNA, 651 bp, Pseudomonas aeruginosa
agagtggcttcatcttcgacaccatcttcggtaatccgaaggaccaccaggactatgcggtgctctgttccttccccatcgacgccgccaccgacgaccgcgcccagcagggttgcaccgattcgcggcgcacgccgaacagcgtcgagaagtcctgccaggacatcaacgtcagcaccgccgagcagtgggcggcgaactaccggcagaaccgcggcgaccattcgcggcagtgctccttcgacgtccgcgacgagcgcaataccgccgccggcccggccttctaccagagcatccgggcgatggcgcagatcgccgacgaatccttcaccacccagaacgaactgcgcctggccaagtgggaggaaaacccgccgaagtcgccgtcgatcctcgccgcgttctacaccgaggacgccggcctggagggcgctcggctcaaccagatccagtggtatcagtcggtccaggcattcctcccgatcatcaacatgcgactgccgcagacccgccagcaggacgcgcagttcgcctacgacgggcgtaagcaggcgatctacccgaccagcgagaagaatgcctgcgagcgctatgtggaaagcgccacctgggtggagcgcgacgatccgggcttcaggaagaagatcatga

SEQ ID NO: 15495 - DNA, 765 bp, Pseudomonas aeruginosa
ggcgtcccctgcgaacagcgatatggccttttgatatcacacgttctaccatgccgtctttccaagccgccagggaacgaacgcatggctttcgatgccgcccgctatgtccaccgctactacgccagcctggcgcccgccccgggcaacgaatacccgcgcctgagggcctgggagtacctctgggagtatgtctgggaccccagtcgcagctgggacgacctgaccgcccccgaacagctcgacaccaccgccctgcacctgggtttctacctggccaactggggcatgttccgtggctcctcgggactgctgcagaacagcaacctggacctgatgaaagcgctggcccggcagctcttcagcggtgccggaccggaactcttcgagctgtccctggtggatttcgccggcaacggcgcgcgcctggcgcacaaccgcaagctgctggaaacggtactcgggtcgatggacgccctcagcagccgggtgagctggaccgacaccctgaagagcaagatcctgctcggcgtctggggcgagtttcccgccctcgaccgccactacgtggccgcctgtcgcgcgctgtatccacgccggggcctgacgagcgtcaacggcgggaccctcaccgcgctgcaccgcctgatcggcgaagaaaggctgtcgttcccgcgcctggagaccgcccgcaaggggctcctctaccccaccgggcgcctggccgacatggctttcttccagtacggcctggaaaacgcctga

SEQ ID NO: 15496 - DNA, 1119 bp, Pseudomonas aeruginosa
agtagacgccctgctcggcagcctgccggacagggtccgccaggcgtttctcctggcgcagatcgaaggcctgaagtacgaagccatcgccgagcgcctgggcgtgtccctgggttcggtcaagcgctacatgcagcaggccttccgccagtgcctggagctgatggaatgaacgccgcgggcgaaggccggattccctcgccgatcctcgacgaggccgccgagtggctggtgcgcctgcaggacagcggctgcaccgacgacacgcgccaggcctgcgcccagtggcggcagcgcagcccgcagcacgcccatgcctgggagcgcgccgagcgcctgctgcaatgcctcggccgactgccgccggcgctggccctgccgaccctcggccgcgagcacgggctggaccggcggcgcgcgatcaagcacctcgccctggtcctcggcggcgcctcgctggggctcgccacctggcaggccgaaccgttgcgcgactggctggccgaccagcgcaccggcgtcggcgaacagcgccgcctgaccctgcccgacggcagcctgctgaccctgaacaccgacagcgccgtggacctggccttcgacgccagccagcggctggtacgcctgctgcgcggcgagatcttcgtcgatagccgcgccgacccgcgtccgttccgcgtcgccaccgccgaagcgcggctgcatgccggtgccgcccgcttcaacgtacgccaggagatggccgcgacccgggtcgcggtactcgccggacgggtcgaactgagcccgctccacggacgcgggcgctggctggaaagcggcgagtcggtgcgcctgggcgccgacggcgaagcgcgccggctggtcttcgacggcctgccggacgcctggacccgcggcatgctgatggccgaccggatgccgctggccgaggtgctcgccgaactcgcccgctaccgtcgcggcgtactgcgctgcgacccgcaactggccaggctggcggtgtcgggcgcctatccgctgctggacctgcggcgcacgctgggcatgctgcaggccacctatccgctgaaggtgcgcggggtgaccgactactggatcagcctggtgccggcgtga

SEQ ID NO: 15497 - DNA, 1419 bp, Pseudomonas aeruginosa
catcgcccccggcccgctcggtcgcaccctgtcggccttcgccagcgacaacggggtgtccctggcgttcgacccggcgctcaccgagggtcgccgcagcgccgccctgcgcggccgctacgcgccggtcgaggcgctgcaccgcctgctgctgggcagcggcctggagttgcagcagcgcagcgacggcagctacaccctggtgccggcaaccaccgatggcgcgctggaactgcaatcctcgctgatcaccgcccaggccgccggtgccgagaccctgcccgccgagtacgccggcggccaggtagcccgtggcgcgcgcctgggcatgctgggcaacgccgacgtgatggacgcgccattcagcatcaccagctacaccgccaggaccatcgagcagcagcaggcgcgcagcgtcgccgacctgctacaggccaacgatccgtcggtgcgggtggtcggcgggcgcggcgacctggtggacagctacacgattcgcggcttcagcgtgcagaacgccgacgtcgccttcaacggtctctatggcctgctgccgttctggcgggtaccgatcgaattcgccgagcgcgtggaagtgctcaagggaccaaacgccctgctcggcgggatttcccccggcggcagcgtcggcggcaccatcaacctggtgcccaagcgcgccgacgaccagccgctgacccgcgtcagcgtcgattggacccagcgcagccagctcggcactcacctcgacatcggccggcgcttcggcgagaacaacgccttcggcgtgcgcttcaacggcgtctaccgcaacggcgataccgccgtcgaccatcagagccgcgagtttcccatgctctccctgggcctggacttccgtggcgagcgcctgcgcctgtccagcgacctgctgtaccagaaggaaagcctggaaggcgtggtgcgcccgctgctgaccggcccgggaaccacccacatcccccatgccccggactcgaagacacgcttcggcctgcgcgattcctacctggaccaggaggattactccatggtcaaccgcggcgagtacgacctcgccgacaacctgacggcgttcgccagcatcggcggccgccagagcaactacgaaaccatcgccgccaacagcatcctcgtcggcaaccagggcgatatcgtcaacagcctggcacgccagcgcggcgaccgccgcacctattccgccgaggtcggcctgcgcggcaacttcgacaccggcccgctccgccacgactggacgctcagcgccaaccgcctgcacgaacggctgggcatggtctatgccttcaccgggatgcagccgggcaacctctaccagacctcgccgcatacgccgctgccggacttctccagcctcgacgggagcattccgaagaccaatga

SEQ ID NO: 15498 - DNA, 852 bp, Pseudomonas aeruginosa
tcgcgtgcaggtcaccctgggcgtgcgccgccagcagatcgagtcgcgcaactacgaccagaccagcggcgcgcgcaccagccacgacaagcggcacgtgtggacgccgatggccagcgtgctggtcaagccgctgcaggacctgtcgctgtacgccaactacatccagggcctcagccagggcgaggcggcgccgatgaccgcggccaacgccggccaggtgctggcgccatacaaggccgagcagtacgagatcggcgccaagtacgacctgggcggcttcaccaccaccctggcgctgttcgagatcaggaaaccgaacgcctataccgacgccagcaacgtcttccgcgccgacggcgagcaacgcaaccgcggcgtggagctgagcctctatggcgaaccgctggacggcgtgcgggtgatggccggcgccacctacatcaagcccgagcagaacaagaccggcgaccctgccagcgaaggcaaggacgcgcccggcgtggcccgccgccaggccaacctgggggtcagctgggacaccccgttcgtcgacggactgaccctcgacagccgctggatctacaccggctcggcctatgtggacagcgccaacgccctcgccgtgccgcactggaaccgcgtcgacctcggcgccgcctacgccttccaggtcgccggcaagccgctggtggcgcgcgccaacctggagaacgcactgggcaaggactactggaccgcagccaacggctacctgtcgatcagctcgccgcgcaccctttccctttccctcacggcggacttctgagtccgccccaccataaccagaaaccgccgatgaccagccaatga

SEQ ID NO: 15499 - DNA, 450 bp, Pseudomonas aeruginosa
aatactcggctttccgccgttgctcgcctacctcaagcacctgcgcaccaattcctatccggacgccccgctacgcgacgactccgctcgcctgccggtggtgttctacagccacggctacagcgccttcgccggcggcaactggaccctgatggaagaactggccagccacggctacgcggtctacgccatccagcacagcggcgacgcgtcgccgacccgcctgcccaacggcacgctgctgcccatggaccccgggctggtcgaacacctgcgtcgggccgcccacgacggcttgccgcaggccatgcgccagggctatgtcagcgacgatctcgaccagcgcctcgacggccagttgcacaccgccctcgacctgcccgccccggccaaccgcgccgtcaacctcagcgcgccggtatggctggccgaccgcctgttcgtccatga

SEQ ID NO: 15500 - DNA, 1062 bp, Pseudomonas aeruginosa
cgatttcccggcgccgctgctgatgctgcacgccgaccttggcaacttctaccggctgttcggcatcgaaccgccggcccgcccgagaagcttcaacgacttttcctacgaacgcttcgagcacgccggccagcgccaggacattcatcgcctgatactgcgcgattcggcccatgccgggcttaccgacaatccgctgttcatccgccggccgctgcgcgacgggctgctcggctcggcaccgacggaagtcctcatccaggctcccaacgccctggtgctgggtttcttcgatcactacctgcgcggccgcgccaacgactttccgcaagcgcagatggcgcgcttccccgcctggctgacgcgctacgacaactcggcggtgcgcgactggtggctggccaagccggaagcccagcgcctggcgctgcgacaacgcatcgacgaaatgaaacggcgcaagaccgggctggatcttccctgacgacgggttacagtgggcgtcccatctgcggagcgccgtccatgcatatcccgcccgagctgatcatccaccagacccgccactggacgctgaaccagcggatcgactcggccctgcccggctactgcatgctcggctcgcggcaaccggcgacggccttccaccagttgccggaacaggccctcgccgaattcgggccgctgctggccagggtcgagcgcgaaatggacgcgctgctgcggccgcgacgcatctatgtcggccgctacggccacatgcccggcctgccggtgcatttccacctgattccactgtacgactgggtcgaggaactgttctgggaggacacgcgttaccggacgctccagcagttcggcgtgccgaccgccgaaccccttaccgatggcgccgagctgaccctgttcgtctggcgcgaattctgcgaacgcgccgatccgccggccgtgcgcggcatggatcggcaacaggcgatcgccggattgcgccgggcattcggctacggcgtccaaccccgaacatcgtctgggccggactccgagtccgcgcaggacgcatga

SEQ ID NO: 15501 - DNA, 597 bp, Pseudomonas aeruginosa
ccgcgtgcggttgggtgggcttcgaggccgcgtagggcaatgaaatggactcctccctcctacggcgtcaagcgccagactaatggtgcagccacaagtcccggagggggagtcagcatgaaccttagtcgcattggtctggatctggcaaaacaagtattccaggtgcacggcgttgatcgtcacgagcatgtggtatgtcgtcgccaactcaagcgggcacaggtgcgggatttctttcgccaactgccgccgtgcctggtggcgatggaggcctgcggcagtgcgcactactgggcgcgcgagttgcgggagctgggccacacggtacgcctgatcgcaccgcagttcgtcaaaccctacgtcaagggggacaagcacgatgcacacgacgccgaggcgatctgcgaagccgccagtcgtccgagcatgcgctatgtcccggtgaagagcgcagagcagcaggccgtgcagtcggtgcatcgggtggcgcagtctctggtgcgggcccgcacggggttgtgcaatgaagtgcgtgggttgctgggccactccgggctgatcgccacccgacctgggcgaacggcgacaaatggc

SEQ ID NO: 15502 - DNA, 1794 bp, Pseudomonas aeruginosa
atgcgacttcacagactttgtattagcggtttcaaacgccttcatgatgttcaagtagaattcggaaacgccacctttttaatcggtgctaataatgcgggaaaaagctctgtcctaaaggctatagagtggctgctttcgaacaataaaagaatggaacccgggtactattgttcagaggtagatgaagacacgggcgaaaacaaaatagtttgtaaaacaattgtcttggaagcggagtttaggaacgtacctgaaaaagcttctgaatggcgcggttttaagggtcggatattcagttacgatgcaggcgactctggagaaagtggaaagtcaatattctatcggaagacttatccgttgggtgaggacgtaaagattgagttgaagagtctcactaggtcaatgaaggcagagtttgtcggtttgcaaaagcccgaggagttcattgccgcgggggctgagtccgctgtgatagaagaaatattctcggtactggataaaaagatttctgccggtgagaaagaaaaactagaacttgttgatgatatttgggagttgtctgatgagcagcaatggataacaaacccaggcggtatcggaaccgttgtgttgtcgaagttgccatcggtccttatcattccagctgaagcagccgctcatgaaattgatcaaaaaaatggagtgttgcacaaaatacttaatgaattgtttaaggaggttcgtgaaagttcgaagaactataaagatgctcaggtctgtcttgatttgttagcaaaggagttagatccaggtgatgctgggtctgagtttggaaaaatgatgtctgaacttaatacggttctaggcggagtttttccagagtcacgaatatacgcatccgcagacttgtccagtcctgaatcgctaactccgactttcgcgatcgagatgtctagtaatgtgagaacgagcatcgcccatcaaggaacggggatggtcagagcggcagtttttggcctattacgcttccgccaacaatggttaaaaaaacgtgccggaaacgatgatcgcggtctgataattggttttgaggagccggaaatctatttgcaccctagtgcggcaaatcagatgcgcgatttaatctacgagctttcagatagtgcttcgcaaattgtagcaactacacattctccatatttgatcgacttgtcaagaaagccgaggcaagtgttgaatcgttttcactatggtaataatcatactacgatcctaccgttttctgtttctgaagagtttaagaagctgcaaggggatgataaagatcaagttaaaatgcttattaagctagatgatcatgtgtcgcgaattttcttcacaaaaaaagttcttgtggttgaaggtgatacagaagaaattcttattaaagaagctattaggcggatgccgtctgatatgcgggttagggttttatctaatactgagttggtgaaggcgagagggaaggcgtcaattattggcttggttaagtatctgtcggcgctgaaagttaatttctttgttgtgcatgatcgtgataaaggcgtggcaggcgctgaaaagtttaatgatcctatccttaaggttgttggagataaagaaaaggtaataatgctagaggagtgtgttgaggactttctcggatatccgccgccaacctcagaaaagcctttcaatgcttacaagcattcgattggttggggtgaggattggggtggagtgccagataagttaaaagaattgctgaaaaaagcttatcatcctttgatgtga

SEQ ID NO: 15503 - DNA, 273 bp, Pseudomonas aeruginosa
acacatcatagcgtgacgattccatgcatgggaagagtctccgttagtcatgataaaaatcgcgatttggtccgtctgggggctgtagtgcgcgctcaccgcgtcgctcttggcctgtcgcaggaggcgttggccgatgcagctgaaatcgatcgttcccacatggggaaaatcgaacgcggcgagcgaaacgtcacctttcttaacatccttcgaattgcgaacgcccttgatcggaagccttcagtgcttctggccgaagccgggctctga

SEQ ID NO: 15504 - DNA, 1107 bp, Pseudomonas aeruginosa
aacatgaagaagaaagagtttctgtctgttgaagcggctttgttggaaagtacaattacgtatttcgatacctacaatgctaacgttatggctgttggtggtgagagaaacgctgtactgaaaattaaagatatagaaatgttggtaaaggaaatatctgctagtgatgaagttcatttctatgaaaaaatcagtcatggtgtggctagggctgatttgacaaagactgggaagcgattattaatgaatgtgtgggcatgggaggaaatagagcgttactatccaatccatgacttcactccaggcgtaaaggttttttttgagtgtactaaggagtatgccagagctttctattatcgcaggaatcttcgactttttgatggtagtccttcggcggttatagagtctctgaataacgtggttgagcgtataagatccatcgttagagggtgtgcatttaagtctgagcaaaatgcacatcgtcgactttcaaataaaaactacaaaagcttgcttggttatattgatgcgatttttgagaggcggtcacgagtgctagttctaagggtggacttgggctactcaaagctactagctcaaaggagctttcgagagtctctaaatttcgatgaggttaaaaggcatcgagagaaattgttaagactgttaaggcgtaaactgcctgctaaaactttccttgggcatgcgtggaaattggagtttgggttgtctaaatcttatcattatcactgtgtgttttttctagatggatcaaggctgcgtgaggacgtcgcatgggcgaggactattggtgagctttgggttggcagagctacagaggggagaggggtgtattataactgcaaccgtgcaaagggtaattaccgtgcctgtgggattggcatggttgagcactctgataggtctatgcgtaaaaatctacaaaaggcggcagtttaccttactaaggtggagtactacatacgcattgcaactgagggccgagctcgaacttttggtcgtggcgaaatgcctaaaagaaatattaaaaagatggggcgacctaggcaatcgcccgaactggaggatggtaaacctacagcttga

SEQ ID NO: 15505 - DNA, 771 bp, Pseudomonas aeruginosa
caggcagacgagaacggtcagggcaaaggcgatgatctggttcttcgccagcgccgacatgcaggatccgatggccaggtagccgccggacagcagccagccggccaggtagccggcgatgatcgcgccgttgtcgggcgagccgaggtagttcaccgtcagcggcatcgggaaggtcagcagcaacgccagcccggcgcagaaccaggccgcgaggaacttgccggtgaccagggtggcgcgggagacgggcagggtcatcagcatctcgatggagccggacttgcgctcctcggcccacaggcgcatggccagcgcggggatcagcaggaggtagagccagggcaggctggaaaagaacggcgccaggtcggcctggccgcgctcgaagaaatcgcccaggtagaaggtggccacgccggagaggacgaggaataccagggtgaacacataggcgagcggcgtggcgaagtagctgcccagctcgcgtctgaaaatggtgccgatggcggtcatgcgggggtttctcgggtcagttggcggaacacttcttccagttggccgtgttcggtacgcaccccggatacccgccagccgctgccgtggatcaggcggttgagcgcgggaaggatctgcacgccggggcgggccagaatggtcagggtgccggcccggtcggggcgtccttcgataccggcgacgccggggagcatggcgatggccagcgggtctaccggtgcttcgatgctgaggctgacggcatggtggtag

SEQ ID NO: 15506 - DNA, 561 bp, Pseudomonas aeruginosa
ccgatcagcttctgtgcctggcgcgccttgtcctgcatgtcgaagccgaagatgcgtacgctgccggcgctcggcgcgaggaagccggaaagcatcttcagggtggtcgacttgcccgctccgttggggccgaggagaccgacgatctctccccggtcgatgcggaagctcaagtcgtttaccaccgtccggccggaaaagcgtttgctcagtctgtctatgtcgatcatggtttcactggaagttgagccgtttgctgatatgcgtaggggatcgcatgagcgcggtagattaccgggagttattggctggtttttccagtgggctctttttaagattagttacttatattgttgggaaacttcctacgaactctcgttaaaagatggaagttatcgagacttccagggcagccctgtagctggcgcagcgccttggttccgctgtgggaacgcggccatgtcgcgctcgctggtgcctatgttggggacgcgtcgattccccctgcggagtttcacgagggaaggcagttgccgtttcgatagacgggaagcggaatag

SEQ ID NO: 15507 - DNA, 549 bp, Pseudomonas aeruginosa
acatgcacgcttcgaagcggtaggcgtcggattcggccttggccagttgcacgaaggcgtcggtcaggcccagggcgcgacggacctgctgctctatctgtcggtagacctgctggccggcttcgtcctcggcggggcggacgtcgagcagggcgaggatcgccgagtgcggcgcgcgcaggtcatgggagaggaagcgcaggagggtggcgcgctggcgctcggcatcgcgttcggcgctcaggtcgatcaggctcaccagccagccgatggcggtttcgctttcgaccggcagcaggcgcgccaggtcgaggcgcaggtcgcgttcccggtggtcgcggaactcgatggcttccagggtttccagcgttgggcgggcgccaccggcgaggctcggatggccgagttcggccaggcgctggcgcagttcggcgccgcgcagctcgccgccgaacaggtcgcgtgccttgcggttggccagcaggatctgcccctgcgggtcgcagatcagggtcgccaccggcaggcattccaggccgtcggccatga

SEQ ID NO: 15508 - DNA, 1842 bp, Pseudomonas aeruginosa
ttgcaggatgtttcggtaatttttccgaaattggtcggcataaagtctgcaagaacaggagaaatttctagcagggaagggcgtgcgatgacactccagccttttgcccagccaccgctcagtctcgccctgggcgccgggcgcgacctcccggggcaggccgcgcgggttcgcgccgaatggctcgcgcctcgccccggacgggctccggcgtttctcctggcgctgctctggggacgcggttgcgccaacgtggtgcaggccatcgaaggccatctcgacgccctgttcgccgactacgcctgtacccccgagggttggccggaagcgcaggcggcgcggcaggtcctggcttcgctgaacatgcagctctatcgccggcgccgcgaaggcgagccgggcgtgctcgagctggcggtggggttgctgctggtccatgccggaggcgtgcactttctccagtgcggcgccgtcggcctgctgcgttatcgccagggcagcctgcagcgcctgggagggagcggccagccgctgggtagcagcgcggagctggcgctggtccagcacaacctgacccaggtggccggcgagcccttgttgctggcgccccagccgctgctcgaagtggccgacctgcgcgccctcggagagcgttgtgcggggctggccacggggcgcctggagggcgtgctgcagccgttgctgcatgcgccgggggcggtggcgctggtcttgccgggggcgctcgagcgcgccccggcggcgccacggcataccggctggccagcgctgggcgcggcgtgccccggcgactgcgtggatggctggaccttgcaggcagcttgcgcgttcggcccgcccgggcggctattccgcgcctgcgacgagcaaggacgcgaggcgttgctgctgctcgcggcggtcgatgccgacgaagcgttctggcagcgcgaatgggcattgcggcgctgccgtgcggagagcctgccgcgagtattgtcgtcgccccggttgcgtcgtcatgccttccagttgttcgctccgccgcgctggccgatgcgcagcctgctggattgggcgccagcgcacctgccgctggaaccgcaatgcgcgctggtcctcctggagcaacttatggatgcggttcgcgccttgcagcggcgcggcgtacagggcttgtggctgggcgccgcggcagatcctgctggacgagggcgggcgcctgctgttcctccccgaggcggcggcgatcctgccgggggtggcgcgccaggcgctgcctgcggacagcgtgccgctggcgccggagttgcgtcgcggcgaggcgctcgatggccgggccgaccagttcgccctggcggcgctgttctattggctgctctgtggtcgctggccgtcgatcgcctgcccggagagcgacggcggatgccgctacgagcccctgggcgagcgtcaggcggacctgccggtcggctgggatggggtattggcgcgggccctggcgccgcgtccggaggcgcgcttcgaagcgttgtcggaattctggctggccttgcagaagccgctagcgcatccccagcgggtcttcgcgccacgccggttgcaacggggcgtgctggccctggtcctgctcctggccggggctgcgctgctggtcggcctggccggttaacggatcgacggccagcgtgcgggtctgcccgctgcgttcgaggtgtgcttcggcgatcagttgttccagccggccgctgcgacgcatcaggcgcaggttgcggtcgaggctggcggcaagggcggcgccgcgggcgtgtcttttcggcaccagtacatagagcggcttga

SEQ ID NO: 15509 - DNA, 513 bp, Pseudomonas aeruginosa
ctcgtcaccgaagcggatgcgcccgtcggcctgggtgaagattcccatccgctgcaaccagtcctcgaattccggcgccggcttcaggcccagcgtctggcgcgcatagagggcgtcgtggaaggaggtggtctggtagttgagcatcacgtcgtcggagccgggaatgcccatgatgaagttgatcccggcgacgcccagcagggtcaggagcatgtccatgtcgtcctggtcggcctcggcatggttggtgtagcagatgtcgcaacccatcggcacgccgagcagcttgccgcagaagtggtcttccaggccggcgcggatgatctgcttgccgttgtacaggtactcgggaccgatgaagccgaccacggtgttcaccaggaacggcttgaagtgacgagccaccgcataggcgcgggtctcgcaggtctgctggtcgacgccgtggtgggcgttggccgagagcgcgctgccctggccggtctcgaagtacatcaggttgttgcctag

SEQ ID NO: 15510 - DNA, 1101 bp, Pseudomonas aeruginosa
ggtgccgcgcttctggctgagcccggcctcgtagccttcctggaggatcttcaggctgatgccgaagctggcattggccgcctcggtgccggcgatcgactggaacaccaggtccagcggcacgccgcggttgatcgcctcgatggagctggtgacgtgggtcagcacgcaggcctgggtaggaatctcgtagcgctggatgatcgcgtcgagcatctccagcagggcgcagatcgaggccatgctgtcggtggcaggattgatcccgagcatcgcgtcgccattgccgaacagcaggccgtcgaggatgctcgcggcgattccggccgggtcgtcggtcgggtggtttggttgcaggcgggtggagagccggccgcgaaggccgagggtgttgcggaagcgggtgaccacgcggatcttctgcgccaccaggaccaggtcctggacacgcatgatcttcgataccgccgctgccatttccggcgtcaggcccggagccagggcgcgcaggctggcctcgtcggcggcgtcgccgagcagccagtcgcggaagccgccgacggtgagatgggacaccggggcgaaggcgtcgcgctggtgggtgtcgatgatcaggcgggtgacctcgtcgtcctcgtagggaatcagcgcctcgtcgaggaagtgtttgagcgggatgtcggccagggccatctgcgcggcgacccgctcgccgtcgttgctcgccgcgacgccggcgaggaaatcgccggagcgcgcggggctggccttggccatcacgtccttgaggctgtcgaagcggtaggtttcgccgccgacgctatgggtgaaacgtgccatgtgtgtctccagtgcccggcctcgccatgcggcgggccgggctttgtcgttgtcgctctcagcgcaggtcctgttccgccgcctggatcgcggcgaactcttcttccggggtgccggacaccaggtgatgccgactgtacagggcgaagtagccgatcagtacagcgtagatcgccaccgcgccgaccacgacccgcgggtcgaccaggaagccggcgaccaccgcgacgcaggccagcgccagggatacgccggaggtga

SEQ ID NO: 15511 - DNA, 2127 bp, Pseudomonas aeruginosa
ggatcatcgaagacagctcggcgagcgagaagcacatgcacaggtacatggtggccatcagcagggtggcgaggaacatcccgccccagccgccctgggccaggccgaagttccagccggcgtagtcgccggagatcacgtaggcgacgccgagcccgaccagcaggacccagccggcggcgcctttcttcagttgacggtgttggaagtagtcggcgtcgacgctttcgaagtcgaccccggaagttgcgggcgcatggccggtttgttcgagggacatgggtttttcacctcaatcttgttgttatcgaccccggttttcccggtggtgtgctgtacgtggtgaacgcaggcaatagctatgccagccgctctgcaatcggcctggcgaggaggtggaaggggcgccgccgtcagcctcggcggcgtgtttcacgagccggcgcgaccgctccgggaaagagcggtcgcggccggtccggggtcctactagaagaagcccagcgggttgatgtcgtagctcaccagcaggttcttggtctgctggtagtggtcgagcatcatcttgtgcgtctcgcgaccgacgccggacttcttgtagccgccgaacgcggcgtgggccgggtacaggtggtagcagttggtccacacgcgaccggccttgatcccgcggcccatgcggtaggcgcggttgatgtcgcgggtccagaggccggcgccgaggccgtactcggtgtcgttggcgatggccagggcctcggcttcgtccttgaaggtggtgactccgaccaccgggccgaagatttcctcctggaacacgcgcatgccgttgtgccccttgagcagggtcggctggatgtagtagccgctggccaggttgccttcgagcttctcgacgctgccgccggcgagcagctcggcgccttcctgctgggcgatgtcgaggtaggagaggatcttctcgtactgctgctgggaagcctgggcgccgaccatggtctcggtgtccagcgggtcgccgcgcttgatcgccctgacctttttcagcacctcttccatgaatgccgggtagatcgactcctggaccagcgcgcgggacgggcaggtgcacacctcgccctggttgaagaaggccagcaccaggccctcggcggccttctcgatgaacgccggctcggcctgcatgatgtcttcgaaatagatgttcgggctcttgccgcccagctcgacggtggagggaatgatgttctccgccgcgcacttgaggatgtgcgagccgaccggggtggaaccggtgaaggcgatcttggcgatgcgcttgctggtggccagggcctcgccggcctccctgccgaagccctggacgacgttgagcacgcccggcggcagcaggtcgccgatgagttccagcagcacgcagatgcccagcggggtctgctcggccggcttgagcaccacgcagttgccggcggccagcgccggggccagcttccaggcggccatcagcagcgggaagttccacgggatgatctgcccgaccacgcccagcggctcatggatgtggtaggccacggtgctgtcgttgatctcggcggcggagccttcctgggcgcggatgcagccggcgaagtagcggaagtggtcggcggccagggggatgtcggcgttgagggtctcgcgcacggccttgccgttgtcccaggtctcggtgacggcgagcagttccaggttctgctcgatgcggtcggcgatcttcagcaggatgttcgaacgctcctgcaccgaggtacggccccaggcgtcggcggcggcgtgggcggcgtcgagggccttgtcgatgtcctcggcggtggaacgggggaactcggcgatcggctggccgttcaccggcgaggtgttggtgaagtactggcccttgaccggaggcacgaactcgccgccgatgtagttgccgtagcgaggcttgaaggtaacgacggcaccgggggttccgggcgctgcgtaaatcatggcgaagctctcctgtgtggtcgttccgccgtggcgcggcggactcgtgcaagggcgccgcggtcggcggcgaagggtcgggcgcgtcactcgtcgacgtgcacgctttccagatag

SEQ ID NO: 15512 - DNA, 510 bp, Pseudomonas aeruginosa
agaccggccgcccggtggagcgcgagggccagcgcccgccgctgccggaaccggggcagaagcatggcaaggcggtggaagtatcgccgccgttcctcggcggcaagaactggaacccgatggcctacagccaggacaccggcctgttctacgtgccggccaaccactggaaggaagactactggaccgaggaggtcagctatacgaagggcagcgcctaccttggcatgggcttccggatcaagcgcatgtacgacgaccacgtcggcagcctgcgcgccatggacccggtcagcggcaaggtggtctgggaacacaaggaacacctgccgctctgggccggggtgctggccaccgccggcaacctggtgttcaccggcaccggcgacggctacttcaaggccttcgacgcgaagagcggcaaggagctgtggaaattccagaccggcagcggcatcgtctcgccaccgatcacctgggaacaggacggcgagcagtacctcggcgtga

SEQ ID NO: 15513 - DNA, 1908 bp, Pseudomonas aeruginosa
cccggccggtggcccagggcggttccttctgggtattcaagctgcccagctgggacaaccgcaccgccagccgctgatccccgcgccgcgccctgcgaggcgcggctttccccgcctgcggagtatcccgatgaagaccttcctcctctgcgccgccctgctcggcgccggcctggcccaggccgccgacgacatcgacgacgtccgcgtcatcgccggctgccgcctggagcccggcgcgcgctgcgccaaggccgacctgcgcggcgccgacctgcgcaacctcgacctcggccgcatcgacctggccggcgccgatctctccggcgccgacctgcgtcacgccaggctcgacctggccaacctggaaaaagccaacctgcgtggtgccgacctcacccgtgccagcctgcagcaagccaacctgcgcggggccgacctctccggcgccagggcggtggcgatccaggcctggggcctgttcgcccagggcgcccagtggcaaggcgccgacctcaccgccgcctacctggagttcgcccgtctcagcggcggccgcctgcaccaggccacgctgcgcgccgccgacctggagatgacctggctgtcccgcgccgatctcaagggcgccgacctgcgcgacgccaacctgcaggaagtcaagctggccgaggccaacctggaagatgccgacctgcgcggcagcaaggtgcgcttcggcaacttccagggcagcaacatgcagggttgcaaggattgccccgcgggctggcagtgaagcgccggacagcagcgacggcccccctagccgaggctgccgcgagcctcctcggcgagcggcagcggcaggcccagccgcagcacgccgctgtcgatggcccggtgcaccagttccgcctgggtactcacctgcaacttctgcttgagcaggctgacatggttggacacggtcttggcgcttacccccaggtgctcggccacctcgcgcagggccaggccacgcgcgagcaggcggaagatctcgaactcgcgacgggtcagcccgcgcaacgctgccccgccctgctcttcccacgactggcaggccaggcgcgtggccaggggctgctccagatagagctggccggcgagcactcgccgtatcgcctccagcagcaccgtcggcgccgctcgcttggtcacgtagccgcgggcaccggcatccagcgcctggcgcaccagggccagttcgtcatggaggctgaagaacagcacacgcaactgcggcaggcgctggcgcagccggcgagtcagttccaggccgctgatgcccggcaggccgagatcgacgatgaccagcgaaggaatttcccgctgcaccgcctgcaaggcttcttcgccgtcgccggcctcgttcacctccacgtcggggagcagcccgcgcaacagcgcggccagcccttcgcggaccacgaaatgatcgtccaccagcaggatcttcatcgtcctctcctctcagtcgtcgcgttccagcggcatccgcaggcgcaacgccaggccctgtccgggacggctgcgcaggctcagttcagcgcccaggcagcgcgcgcgctggcgcatcgagtccaggccgaagccgggtgccgggtccgccgcgcagccgcgaccgtcgtcgcgtacgctcaggtagagaaagccgccacggcattgcaggcggatccgcacgcggctggcgccggcatgccgggcgacgttgttcagcgcctcctgcaacaggcggtagagatgggtcccggccgccgcatccaggggcggcagcggaccgcccaggcgcagctcgcaggcgatgccctggccttcctgccagtccgccacgcaggcgcgcagcgcctcgtccagcgactggcgttgcagggccggcggcggtag

SEQ ID NO: 15514 - DNA, 1554 bp, Pseudomonas aeruginosa
cagcgccctgggcctgacccaggaacacgacgacctcgacctgatcctgctcgacctgaacatgcccggcatgcacggcctcaacggcctgatgaacctgcgcaacgaggccccgaccattcccgtggttatcgtctccgccgagcaggacaagcaggtggtgctacaggccatcacctacggcgcggtgggcttcatcaccaagtcctcgccacgcgcgcagatgaccgaagccatcgagcagatcctcaacggcaacgtctacctgccctcggacgtgatccgcacccagaagagttcgccgcgacgcagcggccacgaagaacacggcatctccccggaactgctccaggccctgacccgcaagcagctgctggtgctggagcggatgaccaagggcgagtcgaacaagcagatcgcctacaacctggacatcgccgagaccacggtgaaggcgcacgtctcggcgatcctgcgcaagctcaaggtacacaaccgggtccaggcgatcctcagcgccggcgacatcgacttcgccgcctacctgcgccgctgagacccgccgatgcccgaccgccgtaccctgctgctcactgtcctggcgatgctggccttcgccggcaattcgctgctctgccgcgcggcgctgaaggacaccgccatcgacgcggtcagtttcaccgccctgcgtctcttctccggcgccctcatgctcgccatcctgctgcatctgcgccggggcccggccacgcccgcgcgcggcggctggcgcggggcggcggcgctgttcgtctacgcggccgcgttctcctacgcctacgtgcagctggacgccggcaccggcgcgctgctgctattcggcgcggtacaggtcaccctgctgctggccggcctgctgcgcggcgaacggctgggcggacaggcgctgctcggtttcctgctggccctgggcggcctgctgttcctgttgctccccggagccagcgcgccgccgctgggcggtgccctgctgatgctcctgtccggcctcgcctggggcctctataccctgctcggccgcggcggcggcgatccgctggcggtcagcgcgggcaacttcctgcgtgcccttgccttcgccgccctgctgctcctggcattccacgggcagttgcggctggacggcgccgggctggcctatgccctgctttccggcgccctcgcctccggcctcggctacgccgtctggtacagcgcactgccggggctgacggcgatccagggcgcctcggtgcagctcagcgtgccggtgctcgccgccctctgcggcgccctgctgctcggcgagccgctcgccccgcgattgccgccggcgaccctggcggtgctcggcgggatcgccctgatcctcgccccgcgcctgggccgcgcggcgcgcgaagacgcctgaatcagaccgaggcttcgcgctccagcaagtggcagagcgcggtcttcagcttcatcggccgcaccggcttgtgcatcagggtatggccaagctcgcggacctgctgcttgagctcgttgctgtag

SEQ ID NO: 15515 - DNA, 1605 bp, Pseudomonas aeruginosa
gcctcgtcgctctgcgcggcgctcgactcgatgcgtccgatcagcgcctggttgatccgctgcaacttgtgccgctcttcttcgagggcgacgacccgcgcctgcagctcagcgacggacacctccgcggggtcggccaatggcgaccccggtgaaggtctggttgatatgcatgccattgaattgctctccgtaggtgttgaagccgatcacctgctggctgcggagaaacgcggcggtagcttgcgtgtcaccgccgacctccagctccaggcgccgcaggaagcagtcgcaaccgatggtcagcaacggcggtccgaggcgctcgtggaggcggcggaactgcgcctccaggttgggcaacagcggaccggtgctcatcgcggtgagaacgatgccgttctccaccgcacagtagaacgtcaggctcaggtcctcgttggcctgctggatcgagcgcacgtaatagcgttcgtcgacccgcaccgccagcggatgcgcggagaacagggcgaaatccagcgcctgcggtgccaccccgaccagccgggcgtattccagcgccgccggctcggcgttgagttcgtggacccgccggctgccgctgtcggcgcgggtcaccaccaacttttcggcgcgcggcaccacgtgatgggtggtgaagacctcgaagtccagccaggtgttgaccagcaccaccactgccgcccctgtatggaactggccctggtggtagacatgggtgtgggtcaggtggcggtcgtcgccggccgagccaccgaagtgcgggatcgcgccgagcgccgcgccaagcgcggcgagcaccacctcttcgcggctggacaggccgtcgagcaaggtcagggcgaagctgtggtccttgatcggcgccaggccgccgcggcgacagccggccaccagggtctcgaccatctgctgcgcgtccagcaggctgaagcgctccatttcgtcgatcagcgcgctgctgatggcgaagctgcgcacgtcgaagcccaccgcgctgacgcagccgcgcccgtagcccgccggagtgatctcgccggctgtggtgcagccgaccaggtcgataccgccgaagtagcgttcgagcatctcggcaagggccggcaggtcgtattccgcggaacagaagaacagcacgaagcccaggtgcggatggataagctggcgcgccaggtcctgggccaccacttcgacgtcgcgcgcgctggacatgcccctgcagaccccttccccctgcccttcgtacatgcccgctcccccgtcgttccgcctcgccagcattctacgaagggcgccgccgcggcccctatcctacttgggtcgcggcggggtccttcgaaagtttcggtatcaccagttcagtacggcgccgagcgccacggtgtcggtgtcctcgtcgagcgcggcaccgtcgcgcccgtcgatccggtagcggttcagctcggcgaccagcttgaggttgtcgttgatcgtgcggaaataggcgatgccgcgactctcgtagtcggccgcggaacccaggccgttgccgtcgtcgacggtcttgccgtaggacagcgccaggcggttcttgccccatga

SEQ ID NO: 15516 - DNA, 432 bp, Pseudomonas aeruginosa
cgccgcagtgacgccggcaaggctgtcgtcgagttaccgcgtggctcgcttcagcgccgactggaaagcacccaccagccgccgcgcgcctccagcaaccgggcctgggccgcgagcaggtcgtcgccgctcaggccgagggcggcctcggcgagcagccgggagcgaccggcgccaccgccaaggtgctccgcccaggcgcgccgtgctcgctcggcgaagctacccggtgctcggcgcaggtcgtcggcgagggcttcgcgcaggccggccaggcgtcgcgccggcagttgcgcgagcgcctcggcggagcgctggaggaaggtctccatatgctccagcaggcgtaccgggcaggcacgcggagattgcgcggcgaacagcaggccgcgccgggcgccgacctcgcggaagccgcagaacaacgcgtag

SEQ ID NO: 15517 - DNA, 1038 bp, Pseudomonas aeruginosa
cccagttgcagctcgtcgcgcaggcgccgctggaaggccggttcgtgcaggcgcgccagcaagcgccaggccgcctccatcggcacctcctgcgtgggcagcggacagaacagcagcaacgccgactcgccgtccatggccagttcgcggcgatgccgtccgggcctcggcggcagaggctccaggcgctcgccggcagcctggccgggcatccatcggggatctggcatcgcggcctgcatgaccaaggcgtcccagcgcgtccgccgccagtcgtcgacctccgccagcggctcgccgagtaggccgggcaaggcgtccagcaactgccggatcggcaggccagtggcgctgcggcgccgctcggcggaggacagacgctcgccgctcgcgcgccagtcgggcggcgccgcgaggagccgggccagggccgggcgcacggcggcctcgaggcgatcgcgcggaccgagcaggctcagcgaccagtcctcgccgagcgcctccaggcccatctccacaccccccaggcgtgcctggccgcacagcggacgcaacgcctggcgcagcgccagaaagcgtgaccgtgcgggcacaccgggaaagcgccagcgcaggaacagcgcgccctcggcggcggcactgggcggcaacggcagttcgaagcgccaggcatgccgctgcgcggccagcggcggcgctgcggcaaccggcgccacactcaggcggaagcccgccgaccagcgcgcttcggcaccgtcgagttcgctgtccaggtgcagccgcaggcaacggtcggcgcgcagcgcgtccaggcaggccgggcgaatctccgctggcaggccaagaacgcgctggcgtagtcgctccagcggtgcagtgggctccgccagcaacggccggcgcgccgccagcaggctggcggcatcgtcgcgcaggtcgcccagccagtcgaaaaaggccgcctccagcgccgccgccgcgctgccgtcgaacagttcgaaggtcaacgccaggagcgcctgccgcgcatcccggtga

SEQ ID NO: 15518 - DNA, 600 bp, Pseudomonas aeruginosa
tgggcggcatggaattcgcgcagggcccgctggaacgcatcgttctccagggccaggctgtcgcggcgcccggcagcgaaacgccgcaggggggtgtccggcgggcaagccgagggccagcgccgcgtcgatcagggtctgctcgtcggccgagcgcgccaggtattcggcctcgagtacttcgcgctcgcgccgttgcgcatcgatgtccagcaaggggcgggcgagcatgtcgatcagccgtgccagaccggcgccaatgtgctccgccgtcacctcgaagaaatagtcggtggtcctgccccgggtgctggcgttgacctggccgccgcgcacctgcaaccacggcatcaggcgctcgtcgccgggaaacgccgcgccgccgagaaacgacaggtgctcgaggaagtgggccaggccgggatgcgcgctcggctcgtcgtggctgcccgccgccacccgcagccaggcagcggcgcgcgatgccgccggatcatgcgccaggtgcaggcgcaggccgttgggcagcacgcaggcgcggctcctggggtggtgttgggcgtggcgatccatgggcgtcctcgcgggttccgaggctga

SEQ ID NO: 15519 - DNA, 396 bp, Pseudomonas aeruginosa
gcgcctgcaggacctccggcgcacggcacggggcgaacaggtcgaggccgggatcgtaggcgccggtgcgcacttccagcaggccgagcatcgagtggaacaggttgtcctgggacagctcctcgttgctgcgctggcgcaggcagccactgtcgaggccgaaggcgctctggtagccgggcgagaaccaggccagcatgccgacgtgcttctgctggtccggcgccagcaggtaaggcgtgccatgcaggtagaggttgtactcgccgagcgactcgccatggtcggagaggtagagcatgccggtatcgatgcgctcttcgttcttgcgcagcaggtcgatcaggctggccagcacgtggtcggtgtacagcagggtgttgtcgtagccgttga

SEQ ID NO: 15520 - DNA, 1599 bp, Pseudomonas aeruginosa
gtaaagaagttgatctccaccgcgaatatcaccatgcagttcggcgccaagccgctgttcgagaacgtttccgtcaagttcggcaacggcaaccgctacggcctgatcggcgccaacggttgcggcaagtcgaccttcatgaagatcctcggcaacgacctggagccgagcgccggccaggtcatgctggaacccaacgtgcgcctgggcaagctgcgccaggaccagttcgcctacgaggacttcagcgtcatcgatacggtgatcatgggccacgaggaactctgggcggtgaaggccgaacgcgaccgcatctactccctgccggaaatgagcgaggcagatggcatggcggtggccgagctggaagtccagttcgccgagttcgacggctacaccgccgagtcccgcgccggcgagctgctgctcggcctgggcatcccgctggagcagcacttcggcccgatgagcgccgtcgctcccggctggaagctgcgcgtactgctggcccaggcgctgttctcggacccggacgtgctgctgctcgacgaaccgaccaaccacctggacatcaacaccatccgctggctggaaggcgtgctcaccgcgcgcaacagcaccatgatcatcatttcccacgatcgccacttcctgaacagcgtctgcacccacatggccgacctggactacggcgagctgcgcctgttcccgggcaactacgacgagtacatgaccgccgccgaacaggcccgcgagcgcctgctgtcggacaacgccaagaagaaggcgcagatcgccgagctgcaatccttcgtcagccgcttctcggccaacgcctccaaggccaagcaggccaccagccgcgcccggcagatcgacaagatccagttggaagaggtcaagccgtccagccgggtcagcccgttcatccgcttcgagcaatacaagaagctgcaccgccaggcggtgaccgtggaaaacatcagcaagggctatgacggcaagccgctgttcaagggcctgagcctgcaggtcgaggccggcgagcgcgtcgccatcatcggccccaacggcatcggcaagaccaccctgttgcgctgcctggtcggcgacctgccggtggacggcggcgaggtgaaatggaccgacagcgccgacgtcggctatttcgcccaggaccatgccgacgacttcgccgacgacatgagcctgttcgactggatggcccagtggacccagggcggcgaacaactggtgcgcggcaccctcggccgcatgctgttctccaacgacgagatcaagaagtcggtgaaagtgatctccggcggcgagcagggccgcatgctgttcggccggctgatcctcaagcgccccaacgtgctggtgatggacgagccgaccaaccacctggacatggagtccatcgaggcgctgaacctggcgctggacaactatccgggcacgctgatcttcgtcagccacgaccgcgaattcgtttcctcactggctacccgcatcatcgagctgggcgagaacggcgtgaccgacttcagcggcagctatgacgactacctgcgcagccagggcgtgatcgtctga

SEQ ID NO: 15521 - DNA, 1071 bp, Pseudomonas aeruginosa
aagtgggggatcgcagtgtggcgatcgagtggtttgcatcctaccggcaaggccaatcgacgattagtcggtagaaacatgactattcgtcccacacataggacaatctgtttttccccccagcggagcgcctgcatgccccacgacctcaacgacctctactacttcgccaaggtggtggaatgcggcggcttcgccgcggccggacgcgagacggggattcccaagtcgcgcctgtcgcggcgcatcgccgagctggaggagcgccttcaggtgcgcctgctgcaccgcacgacacgcaagctggcgctcacggaggtcggcgaacgctacctgcagcactgccgcaacctgctgctggaagcggagatggccgaacaggtgatcgccgagctgagcgtcgagccgcgtggccggctgcgcctttccgcaccggtggccatggcttcgagcaacctggccgacctgttgccgcggtttctcgaacgacacccgcaggtccagctggaaatcctcctgaccaaccgccgggtcgacctgctcaacgagggggtggacgtggcactgcgcgtgcgcgaactcggcgacgaggaccctgcgctggtctgccggcgcctggctccggcgaccacgcagatcctcgccgccccgtcgctgatcgccgggcgtcgcctggaacatccggaagacctcgaagacctgcccttcctcggcgctattcataacgaccgcaaggtccacgcgaccctgatcgggccggatggcagccgctaccagttggaacgcgaaccgcgcctgggcgtcgacgacttcgtcctgcgcaagaaagccgccgtggccggcctcggcgtcaccttgctgcccgaaggctactgcgacagggaactggccgatggcagcctggtgcgcatcctgccgcagtggaccttgccgaaaagcaccatgcaggccgcctacctgccgcgcagcagccagattccggcgatccgtgctttgatcgactttctcgtggaagccctgcaacgcccctcgggcgagaccggcccggcctaccgccgcgcccgcgagtga

SEQ ID NO: 15522 - DNA, 642 bp, Pseudomonas aeruginosa
gccgcgccgttcagccgatccgctgcaacagcgcggcggacaggcgcccgccgagcaggctgtcgagccagaacagctggtgcagcaggacgatgccccagaacaccagttggaacgagagcttgcgggtcttgtggcggaatacctgctgcgcgaccagcgcgccaggccagccgccgagcagctcgaacaggtgcaggcggacctccggggtacgccagtcgccgcgtgcggcgctgcgcttgtcccgccagtagagggcgaatgcgagcaggctggccagcggataggccagcagcggccagagggcctgtccgtccaggtacatccgccaggcgccagcggccggcagcacgcagaggatcagcaggaccagcagcttcgccaacgggcgctgcaacgcgctcggcggagtcggcgccggccgcgcctgggcccgcgtcaccggcgcctgggcgccacggcggacagttggcggatcgatggtcagcgcgtccagccgcgccctctcggcgcgcaggcggccctgggcgtcctggctggcgagaaaccacacctggtcgccctggcggggacggcggtcgccgcggaacgcggagatatgcaggaagacttcttccccgccggtcttcggcaggatga

SEQ ID NO: 15523 - DNA, 585 bp, Pseudomonas aeruginosa
gggccttccgtgtcaccccttgaactcttcgccgcttcgctcggcgccatcgccgtctacctgaccgtccgccagaatccctggtgctggcctatcggcctggtgatggtggcgctctacgcctggatattcttcgaggtgaagctttattcggacatgctcctgcaaatggtctacgcggcgctacagctctatggctggtggcagtggacccgcggcgggcaggaccacgacggccgctcggtgagccgcctgaacgccgcgcagcgcctctacgggctcggtgcgggcctggtcggcagcgtcgcgctcggttacctgatggccaaccacaccgatgccgccagtccctggtgggacgccggattgaccgccttcagcctggtggcgcaatgctggatggcgcagaagcgcctggaatgctgggccctgtggatcgccgtagacgtgctgttcgtggcgctcttcgccagcaaggcgctgtacctgaccgccgccctctacgccctcttcaccctgctggcgatccacggctggcggacctggcgccgcgacccggcattgcgcgagggcgtcgccgcatga

SEQ ID NO: 15524 - DNA, 1257 bp, Pseudomonas aeruginosa
aacagctccgggcgcttccccggcaggcttgaccccatggtcggcgggcctgctgttgcacggatgcaacactgtccgccagattcccccggcgctcacctccaagcccttgatggacaaggaaaacgcaaaaccggcacgccccatgctcgctccctgccaacgctgattagggctcagcgccaacgaaggaagcgccatcatgtcggggagttcgctacgcatcgtcgttccagcgctgctggtcatcgtcggctccgtgccggtgagcctccccgcgcatgcggcggacggtacgatcgtcgtccagcgccaggtccagccacgggtcgcctaccgtccgagcatggtgcccgacccacatcccaccgtcgtcgacaccaacgtctccgccgaggtcgacgccctcgccaacggggcggccagcggcaataccgtgagccgcgaactgggcgatgccgacttcgccatcgtgaccagcggttccgggattcgcagcatgattctccccggtggcgccctgccgggtttcgccagccagccggcgaacccggcgacggtccaggccgtcggcaacctcggcaccacccacggcgcgggaggcggcgccggcgcaggcctcgccgggcagatcaacggcagcctcaagcagggcctggcaccgctgcagatgctcgggggtggtcaatgaagcgcctgtccgccctcctcctcgccttcgcctgtatcgcgtcgctccaggccgacccgctggcctcacgcaatcgcgccagcatcgatgacagcggcacctaccgtggcaacttcgccctcaaccaggccgccggcgacgcccagcaacagagcaacgttcgtgtcgtcgcggtaggctccgcggccctcgtcggcagcgaccagcgccagcatctgcaactcgacgccagccagccgatcgcggccagcgccagcatctcgggggcggcgctgcgcggcagcggcatcctcggcgtcaaccagggcgccggcctcggcaaccaacagatcaacgccttccggctgagtctcagcaacggcccggaaagcctggatgacagcgttctcgcgcaaagcgtggcgctgaccaaagtctccggttcggccactccggtcccggggggacgcagcgtctcgacggacgatcgcgccttcgccgggagcagcggcgtggtgcaggtgaaccagagcgctggggtgggcaatcagtcgatgaacaccctcagcgtcagggtcatggaatga

SEQ ID NO: 15525 - DNA, 1020 bp, Pseudomonas aeruginosa
aagcgactatggtcccgaccccgctggccctggcaatggctgcagtgctgtcggtatcggcatacgcccggaaacgaaggtggctggcacccgccgaaacccaacccgcagtcgaacaacaagggcggagccacggccctggtggtggatacgcagcagaactacaacaacaaggtcagcaacttcggcacgctgaacaatgcctcggtgagcggctcgatcaaggatgcctcgggcaacgtcggggtcaacgtcgccgccggcgacaacaaccagcaggccaacgccgccgcgctggccagcgccgacgccagcttcgtgttcggcaccgcgaccgccagcaccagcgtgctgcagagcggctacggcaatacgctgaacaactactccaaccccaacaccgcatcgctgagcaactcggccaacaacgtctcgggcaacctgggcgtgaacgtcgccgccggcaacttcaaccagcagaagaacgacctggccgccgccgtctccaacggccagtacagcactgccggtagcgccgcgtcgcagacctccaccggcaacaccaccgtcaacagcgccaactacgcctatggcggcacctacgtgtcgctgaagctgaacgccgacggcagctacaagggcacctccgaccagatcggcgacgtctacctcgacacctgggaaggccagacccatccgggcggcagcaataccggccacatcgacgtggacagccaggcccagggcgccaaggacctgaaccacgacggcggcgcgttcgccttcaaggaaaagggcgacgtcgacctgaaaggcacggtgtccggcttcatcccggcgatcgtcggcttcaagaccccggtcaccaacaacgccagcctgagcaactcgttgcagaacgtctcgggcaacgtcggggtgaacatcgccgccggtggcggcaaccagcagagcaactccctgtccatcgccgccggttgcagcagctgcccggccggtggcgagagccttggcttctga

SEQ ID NO: 15526 - DNA, 486 bp, Pseudomonas aeruginosa
  unsure (108),(113): Identity of nucleotide at the above locations are unknown.
gcagcacctggcagaacgccagcggccaggtcctcggcgcgcgcgtcgacctgcaggtgcggcagaacctggcgcgcccggtcctcaacgtcaccctggtcgatcggncaggngacgccccaccacccgccgccggcaacggccaggtcctcggcggcgccggactggcacagacccaaggggtcagccagagcatccgcaccgccggcgaccacaacagcgccagcaatggcgtcagcatcgaggtccgccacggcgacgcgccgccgccactgccgggcggcacgccgctggaaggtgcgctcgccctcagcggcgaggccggcacggtcaaggtcacgccgaacggcggcgccctgcaactggcgatccaggccagcggccagggcgccagcctgcaaagcctcggcgccggcggcctggtgcagagcgtggcgctcagcggaaaccgcaacctggtgcagaacctggcggcgctcgaggtga

SEQ ID NO: 15527 - DNA, 300 bp, Pseudomonas aeruginosa
gtatccagcaccaccgctaccacgatcaccgccccggtaatgattcgtttggtcggctccgacgcaccgatctgcgccagccccgccgccaatacggaaatgatcagcacgccgaagaaggtgctgaccaccgaacctcgcccgcccatcaggctggtgccgccgatcaccaccgcggcgatgacctggagttccaggccgaccccggcgttggggtcggccgcttccagacgcgagatctggaacagcgcggccaacccggcgagcagccccatcagggcgaatactgcaatcttatag

SEQ ID NO: 15528 - DNA, 300 bp, Pseudomonas aeruginosa
gccagcccacgggccatctccagcaccccgagggacacgatgaacgagggaatccgccaggccaccgtgatcgaaccggtgacgcagccggccagggtcgcgcaggccatcccgagcatcgccgccggcagcacgccccagccccagccgagcgtcgccaggcttaccgccgaggccgccagggccagcaccgaacctaccgagagatcgatgccgccgacgatcaggatgaaggtcatgcccaccgccagcaccaccaggtcggggatctggttggcgatggcgaggaaggtgccatag

SEQ ID NO: 15529 - DNA, 558 bp, Pseudomonas aeruginosa
ttgccgcgtcgcagggttggcgctgcggcggcggtagcggaagacgtcgggtcgctcatttctggttccttgcgttgcgtgttcacgacgtcgccagcagcgcgtcgcgtttcttgtaaccggcgaaggccgccgccagcagcgcgtcctgggtccaggcgtcgcgctcgaaggtgtccaccatacgtcccgccgagagcacgccgatgcgatcgcagatcagcatcagctcgcgcaggtcgctggacaccaccaccagcgccttgccccggcgggtcagttcggcgagcaaggcatagatgtcgaacttggcgccgacgtcgatgccacgggtcggctcgtcgaacagcagcacctggcagtcgcgctccagccagcggccgatcaccaccttctgctggttgccgccggacagttcgcccaccgcctgcgcggtgtccgcgcagcgcacccgcagcgcctccacctggcgccgcgccagggcttcctcgcggcgccggtcgatcaccccgtggcgcgccagcgccggcaggttgcccagggccaggttggcgctga

SEQ ID NO: 15530 - DNA, 489 bp, Pseudomonas aeruginosa
tcagcgccaccccctggcgcaccgagtcggccggcgaacgcaggctcaggcgctgcggcggatcgccgagcaggacctgcccaccgtcggcgcggtcggcgccgtagatcaggcgcaacaattcggtgcgcccggagccgatcagtccggaaatgccgaagatctcccccgcgcgcacctcgaacgacacctcatgcaccttgccgcgccggctcagccgctccacccgcagcagcggcgcaccggtctgccgtgggcccaggtcgaagcgctcgcccagttcgcggccgaccatcagggtcaccagttggtcggcgtcgtagcgctcgatcggctcgacgcagaccaggcggccatcgcgcaacaccgcgatgcgctgcgaaatccgcgccagctcttccaggcgatgggagatgtagacgatcgccacgccgcgttcgcgcagccgctcgacctgctcgaagagcatgtccacctcgcgcgcggtaa

SEQ ID NO: 15531 - DNA, 1386 bp, Pseudomonas aeruginosa
ttcgctacggctgggaaacgcaggatattttacctggccggcagatctcccgccgcccactcagcgcaaccggtgcttgtgcaacaggcggtagaaggtcggccgcgacaccccgagcatccgcgcggccacgctgaggttgtcgccgtaacgggccagcgcatcacacatcgcctggcgctcggcgcagagcttgtagacctccaggctggacaacggcgggccgtcgccgcgcgcgcattccaggccgaggtcctgggcctcgatctgctttccctctgccaggaccaacccgcgacgtacccggttggccagttcgcggacattgcccggccaggcgtgcatcgccatcgccgccagcgcgtcctcgctgaagcggcgcgggcggcggccggtctccaggctgtagagccgggagaaatgctgggccagcagcggcaggtcctcgctccgttcgcgcaacggcgcggtgccgacctgcaggacgttgagccggtagtagaggtcctcgcggaacgtcccggcatcgatcgccgcctccaggtcgacatgggtcgccgccagcacccgcacgtccacctcgaccggccggctaccgccgacccgctcgatctgctgttcctggagaaagcgcaacaggttggcctgcaactccagcggcaggtcgccgatctcgtcgaggaacagggtgccgccgtcggccgcctcgatccgcccgaccttgcgctggtgcgcgccggtgaaggcgcccttctcgtggccgaacagctcggactggatcaggtgctcgggaatcgccccgcagttgatcgcgacgaacggcttgtccgcgcgccgcgactgccggtgcagggtacgcgcgaccagttccttgccggtgccgctctcgccacggatcagtaccggcgagtcggtcggcgccagcttcgccagcagccggcgcaggtcgcgtacggccaggctctcgccgagcagttcgtgctcgccctcggcatcgccgggcaccgtgccgcgcccgcgcaggcgggccatgccaaaggcgcggccgagggtcacctgcacccgcgccatgtcgaacggcaaggtatggaagtcgaagaaccattcgcagacgaaatcgccgacaccattcagcggcaaggtgtccgggctgagcacggcgatccactcggtgccgctgcggctgatcaggtccttcaccgtttccggccgctccaggtggaacggccgcaggcgcagcaggccgacgtcgcaagcgcgttcgcgcgccgtttccagcgcgcagctgtccactgcccaacccgcctcgcgaaggcccggcaacaggcgccggcaatcgtcgcacgggtccaccaccagcagacggcggaggttcgatgcatctaa

SEQ ID NO: 15532 - DNA, 2352 bp, Pseudomonas aeruginosa
atctttgtttatatcgccaatgccgaaatcgtcttatcagtcgtagccgcgacgcttgacttccaggcgccggacgaactcctccaggaccagcttgtaaaggtcgtcgccgaggtagacatcctccaccccgcagtcgatgttcgggttgtcgttcacctcgatcaccaccaccttgtcgccggcctgcttcaggtccaccccgtaaaggccgtcgccgatcaggttggcggtcttcaccgccagctccaccaccttgcgcggcgcctcgtgcacgggcatggtgcggaaatcgccgctgacctcctcggcgtccgggctgtggtcgtagatctgccagtggcccttggacatgaagtactggcaggcgaagatcggcttgcggttgagcacgccgatacgccagtcgtactcggtatagaagaactcctgggcaaggatcagcaccgagcgctcgaaaagctcggcgctggctgccagcaactgctcctggtcctccaccttgatcaccccgcgcgagaagctgccgtcgggaatcttcagcaccagcgggaagcccaggcgctcgccgaccttctccagttcctgcgggttctccttgtagagaatctccgtggccggcatgcccagcttgtggctgcgcagcaggtcggccaggtacaccttgttggtgcagcgcaggatcgacaccgggtcgtccatcaccaccaacccttcgctctcggccttcttggcgaaacggtaggtgtggtcggcgacattggtggtctcgcggatgaacagcgcgtcgtactcggcgatccgcgaatagtccttgcgctcgatcaggtcgacgtcgatgccgaggctgcggccgacccgcacgaagtttttcagcgccttggcgtcggaaggcgggaacgcctcgccggggtcgtggaggatcgccagatcgtagcggaacggcttgcgcgaacgcggcttgcgccagatctgccggctgaagctgtccagggcgttggcgaagaggtcttcctggtcctcgcgcagcttgtggatggcgccgggcttgatgccctcgatgtgccaggtgcggttgcgcttgaactccaccagcagcaacgggcagggaaacgcctcgaacagttgtcgcgccaggtcctgcagcggctcgatatcggtacggccgaaatacagggtcagggtgaaaccatcggtgctgccgtaggggtgcgcggccagggccttgtccagggtgcgatccagatcttccaggaccaggctgtacagcgacttcctggccagctcgctgatggtccgcaccgaggggatcaccttgtgcccgcgcgcctcggcgagcagcgagcagtagtagccatggcgcaggtacttgtagtgccggcacaggttgatcacctggacccgcttgccagtgtcgtcgtcgatgggcagttccaggtattcctgggcggtgaccacatcctcgctggggtaataggacgtccagtcttccttgcgttccacgatgatgaacagcttgctcacgacacctcccggggtgacagcgaaaccacggcgcattcggaaccggcttgccggcgcacgcatcccggccaatactcggcgggaatcccttgcgaaaccgctctatggcgcctgccagcaaaccgaagcgtacagcacccattacagcacgcccgcgcggaagttcccgcccgcggccgtggagaccgctatgaacctgaccctccgcccggccggtgtggacgacctgtccgccctggtcgagctggaaaaccgctgcttcgactacgatcgcctgtcccgccgcaacttccagtggatgctcacccgcgcccacgccagcctgacggtagccgagggcgacggcggcgtgctcggctacgccctggtgctgttccacgaaggcacctcgctggcccgcctctactccatcgccatcgacccgcgcgcccgcggcatcggcctcggccagaagctgctggaagccgccgagcaggccgcgcgggacaacgaccgcgcctacatgcgcctggaagtgcgcccggacaaccgtggcgccatcgccctctacgagcgcaacggctaccgtcccttcgccaccgtgcgcgactactacgaggaccacagcgaagcgctgcgcttcgagaaacgcatccgcaaccccggccacgaacagcgccgccacgtgcccttctaccggcagaccaccgatttcacctgcggcccggcctgcctgctgatggccatgggcgcgctgcaaccggagcgccagttgacccgccgcgaggaactgcgcctgtggcgcgaggcgaccaccatctacatgaccgccgggcacggcggctgtag

SEQ ID NO: 15533 - DNA, 1929 bp, Pseudomonas aeruginosa
cggtgcccaaaaaaggcctacaaggacgttcctgatgcgcaccgtgaaaaaggctctgctggttgtcggcgtgatcgtgctggcggtcgtcggggtggtggtctactacctcgccaatcccaacctcccccactaccaggcgccgagcgaggtacgctacctgccgcaatggcaggacgaggcccgccagcgcttctactacacgccccagggcaccctggtgaagggcctgcactacgactggttcaccgccctcgaactgcccttctccgaagaacccttcgccgcccccgaatacctcgcccgcttcggcttcctcgtcgatccgcagcagaaggccagcgacctcaaccccggcaacctgccggtgggcttcagccagcaccgcgacgagaagaccggcacccgctacctggacatcacctgcgccgcctgccacaccggcgaactgcgctaccagggcaagtcgctgcgcatcgacggcggcgccgccatgcactccatcgccgccaccgtgccgaccctgcgcggcggcgccttcggccaggcgctcggcgcgagcatggccgccacctactacaacccgttcaagttcaaccgcttcgccaggaaagtcctcggcgaacgctacgaacaggacaagtcgcaactgcgcgccgacttcaaggccgtactcgacaccctcctgcgcaccgcctggaacgacacccgccgccacctctaccccaccgaggaaggccccggccgcaccgacgccttcgggcgcatcgccaacagcgtcttcggcgatgccatcgacccgggcaactaccgcgtcgccaacgccccggtgagctatccgcaggtctgggacatctggaaattcgactgggtgcaatggaacggctcggccatgcagccgatggcgcgcaatatcggcgaggccctcggcgtcggcgcgcgcctgcagatcttcgacgagcacggccagccgctgcagggcgagcagcgctacgcctccagcgtacgcctgcacgacctgcacgccctggaagaaacctgcaacaactgaaaccaccgacctggccggaagacctcttcggccgcatcgacctgcaacgcgcctcccagggccgcgccctattcgaagccaactgcgccttctgccatgcgcccaaggtgcaaccggcggaatacgccgcccccggacgcaatcccgagtggcgcatgcacatggtgccgaccgaggtgatcggcaccgacccgaccaccgccgacaacatcgccgaccaccgctacgacctgcgcaagctcggctggagcgtcgacgaactggcgcggatgaacgtccagctgatcggcgccgatccgcagcaactcgacctctcgcaactgtcctcggccaagggcctggcctacatcaccgccctcgtcgagcagcacgcctaccgggacgccggcatcccgccggaacagcagaagaccatgaacggcttcgacctgccgatcggcgtacaggaactgcgcgcctacaaggcccgcccgctggacggcgtctgggcgaccccgccgttcctgcacaacggctcggtgcccaacctgttccaactgctctccccggccgccgaacgctcgccgcagttctacgtcggcaccttcgaattcgatccgaaattcgttggattccgcaccgagaaattccccggcggcttcctcctcgacacccgtctcaccggcaaccgcaacagcggccacgaattccgcgacggctgccggcagaacggcgtgatcggccgcgccctcagcccggaagaacgctgggcgctggtggaatacctgaaggtgctcggcaaccccgaattcgagcgccgcctggtcccggcccagaccccaccctggacgcccggcccgaaatgcccggcgccggagcaacggaccgcgcaacgctga

SEQ ID NO: 15534 - DNA, 522 bp, Pseudomonas aeruginosa
aagcccacagccaacgcacaccaccaaggacacccactccatgcgcgcactcctcacccacgcctggctgttcctcggcaaatggctcggccgcctgctcctcctgctgctggccgtcggcctcggcggctgggccatcggcagcctctactacgcctggaaattctccggcccggtgtccgcggaagagcagatcgccccggacgaagcccgcatcacccaggcgatcatccaggacgccatccgcgtggtcgaacagcaccgcgacaacacccgcgtcctgcgcgatgcccacgccaaggcccacggctgcgtgaaggccgaattcaaggtacgcgccgacctcgacccgaccctgcgtcgcggcgtgttcgccgaagcgggcaaaagctggaacgcctgggtgcgcttctccaacggcaacgcctacccgcagttcgacagcaagaacgacgcgcgcggcatggccatcaagctgctcgacgtgcccggcgaaaaactcctgcccggccgcggccatga

SEQ ID NO: 15535 - DNA, 510 bp, Pseudomonas aeruginosa
cggcgagcaggacttcgtcatgttcaaccagccggtgttcttcatccgcgacatcgccgaataccggcagaacttcgccgcccaggccgacggcaagaaagccctggccttcttccccaactggaaccccgccagctgggaactgcgccacctgctgatcgccctgcgcaccctcgcccccgccccggacagcccgctgcacgccggctacaacggcatctcgccgtacaagctgggcgaacacaacatcaagttccgcgtcgtccccgccccggagaagtgcccggcctacgagctgccgaagcagaaccaggacctgcccaacttcctccgcgccgccctgtaccagcaactctccatcgaccgcgcccccgcctgctacgccttccaagtgcagcgccaggacccgggcaagtacatgcccatcgaagacaccagcgtcgaatggaaggagtcggacgcgcccttcgctaccatagccgacatcattgtgccagctcaggattttga

SEQ ID NO: 15536 - DNA, 1458 bp, Pseudomonas aeruginosa
tcgattcaaatcagcggggggacgtctatgaagcgttttatccagggagagcatcgaggccaaagctcgctgcttcccgagagcctggatgactacgtggcggacaccaacccggtgcgggtggtcgatgttttcgtcgatgaactcgaccttggccagctgggtttcgacggcgtcgtcccggctgaaacaggtcgtcccgcttaccatcctgccgacctcctgaagatctacatctacggctatctcaatcgcatccagtccagccgccgtctcgaacgtgaggctcagcgcaacgttgagttgatgtggctgaccggacgtttgatgccggacttcaagaccatcgctaacttccgcaaagataacggcaaggcaatccgcggtgtctgtcggcagttcgtggtgctgtgccagcagcttggcctgttctctgaagcgctggtggccatcgacggcagcaagttcaaggcggtcaacaaccgcgaccgcaatttcaccagcgccaagcttcaacggcgaatggaggagatcgagtccagcatcaatcgctacctgagcgcactggataccgctgatcgtcaggaacctgccgtggcgcaggtcaaagccgaacgcctccacgacaagatcgcgaccttgaaagcgaagctgcaggagctcaaggagatcgaggttcagctcaacgaaataccggataaacagatctccctgaccgatcccgatgctcgttcgatgaaaacgcgtggcaccggaatggtcggctacaacgtgcaggcagcggtcgatgcgaagcaccacctgatcgtgacgcacgaggtcacgaacgacggagtcgatcgagaccagctgagcgccatggccaagcaggcgcgagaggccatgggtgtcgaggaactctcggcggtcgcagacagagggtatttcaaaggcgaagaaatcctcgcctgtcatgaggctggaatcactgttttcgtgcccaaaacgctgacctcgggcgcgacagcggcgggccgcttcggcaaaggtgatttcatctatgacgcagcaaagaacgagtaccgatgccctgctgggcaaagcctgatctggcgtttctctagcgtcgagaaagggctaaagctgcaccgttactggagttcacactgccaaggttgtgccttgaaagaacactgtacgcctagctcagagcgccgagtgagccgctgggagcatgaagcagtactcgaagcgatgcagagtcgcctggatcaagcgcccgagatgatgcggatccgccgtcagacggtcgagcacccgttcggcacgctgaagagctggatgggtgccacccatttcctcaccaggacgctcgaccgggtgagtaccgagatgagcctgcatgtgctcgcctacaacctcaaacgcgtgttgaccatgctgggcagcggtgccttgatggcagcgatgaaggcctga

SEQ ID NO: 15537 - DNA, 456 bp, Pseudomonas aeruginosa
ccgtggacgcgtgcggttccatgggattgtggtgctcgatcggcgtgctgtagctggcctcgacccgaatcggcgcggcgcggtaggcggtgtagaaatcgccgcgctcggcgggcagttcggcgggagcctcatgggcctggtcgagggcggccagcaggtcggtctggtgcggctcgggctcgatgtcgatgcgcagcagcgagcccgcgtagcgggccagttccaggctccgtgccaggaccagggcaaggggctggccgctgtacaggacgcggtcgtcgaacagcgggcggaagggttcgccttcggcggcatcggcgtccttgtagggctcgtcgtcgcccgccatcggcggccggttcaggtgatgcagtaccgcgaccaccccgggtaccgccagggccgccgcacagtcgatgccgcgcacccggccgcgggcgacgtcgctgctga

SEQ ID NO: 15538 - DNA, 744 bp, Pseudomonas aeruginosa
cggccatggccatgccacaaaggcgggcggatgctcgacgcctgcgccgctatcggccgccggagccctgcgccgaggtcacttgaacaggctcgacaccacccgcgccacgtgctcggcgcccttgctgatctcctgcatgatgccggccacggtggtgatctggttgttgttctcctgggcgctggactcgatggtctgcatgttgtggttgatctgctgggtcagcttgacgttctcggtgaccacgttcttgatctccaccgtggcgccgctggtgcgcgccgccagttgccgcacctcgtcggcgaccaccgcgaagccgcgccccatgtcgccggcgcgagccgcctcgatggcggcgttgagggccagcaggttggtctgttcggcgacgctctggatggtggtgacgatgttctcgatgtccttggtctggtgggtgagctgggaaatcaggccgacggcggtgttgaccatcgacagggtcttggccgacagggcgacggactggtcgagggagtcgatgccgcgggtggaaatctgcgcggtctcttccgcggtggagaacgacagctcggcggcgcgccgtacttcctcgttgcgattgacctgctcggtaacgtcgatggcgaacttgatgaccttgattatccgccccgaactgtccttgaccgggttgtaggtggcttcgatatgtacccgctcgccggcggcgctgcggcgctcgaaatgcccgcgtga

SEQ ID NO: 15539 - DNA, 1272 bp, Pseudomonas aeruginosa
gaattcgccgtgccgcagccgagcccagaaatccgggttctcccgatagaactcgtcgaagcagagcatgcggtggtgctggcccttgagcgacttgaggctgtagccgaagagacgcaggaagttttcgttggcatcgagtatctcgccgtccggggtgaactcgatgaccgccatggactggcgtatggcgtcgttgatcgcgttgagcaggagcagttcggaatggttgcgggtcacgtcggcggcgatcttcagcacctcgacgaccgccccttcggcattcttcaccgggaaataggtggcctccagccagaccggcgtaccatcgcgccgcaggcgcttgaacacgccgcgctggggcgtgccgctggccagttccttccagaagcgcacgtaggcggcggaggcctggaagtcctcgtcgcagaagatccgatggtgcttgccgaccagctcgtccgccgagtagccgaccaccgcgaggaacagcgggttggcggacagtatctggccatcgggagtgaaacggatggtggcgacgttctgcccgatggcatcgagtcgccacgccaggtcttcatccttggcggcgctttccaccgccctgctttttctgccgaagagcatcgcgcacgactccttgatggcgcctgtccatcgcgagggagtggagaaccggagatagccgtcctaccgctaaacgccagtgtagatcgggctccggcaactttcctcggcgcccgcatcgccgtccgtcccctagcgggcgggacccagcggggcgcgcgatgccaggatcgccaggccggccagcccgactaccgagacgctctggttgaggcaggcattggtacgcccagacaatcgccccgcgcccgcgcatcagccaggctgcgagccatgccagcgccggtccgcgctatgatcgctgcgcccggactgaccgcgctccgacctcgcgccgtcgtatcccgaaacccacttccaggaggaagcacatggcaatcgatctctacgcgctggccgaacaggtcgaggacgaagcgggtttcctgcacttcctcgccgcgctggcggcggactgggaggaagaccgccgcctcgccgccgccaacccgccgaaaccgttcggccccagcccgctgggttgggagaacggcagcatcggtggcttcctcgatgccgccgcgacctggggcgaggactcccacgacggcctgccgggctattccaggccggagaatgcctggcggcgcgcggcgcagctga

SEQ ID NO: 15540 - DNA, 642 bp, Pseudomonas aeruginosa
tgctggcgggcaagttctatgaatgacttcaaatctgccctggcgcccttcccgcccggctacccgagggtcttgccgggcaaccggcggcaggtgccgatactgcatcgcgacgcggacttcctcctgcgcgcgctgcaacccgacgatttcgtccggaccagccgctacgagaacgccaaccgcgagcacctggcgccatgggagccgctgcgcgacccggggtatttttccgtggacaacgcccgcgcccgcaccctgctacaggtggcgagcatggacgaaggcgaggcgcttctcctgctgttgctcgatcccgacgacggcgaggtgctggggcgctgcagctacaccaatatcgtccgcggggtattccaggcctgccacctgggcttttccctggccgctgcggcgcagggccgcggcctgatggcacgagccctgcgggtagccaaccggtattgcttcgagcagctcggcctgcaccggatcatggccagccacctgccgcgcaacgcacgcagcgagcgcctgctggaaagcctcggcttcgagaaggaaggctacgcccgcgcctacctgaagatcgccggggtctgggaagaccatgtgctacgggcgctggtggacgctccgcgctga

SEQ ID NO: 15541 - DNA, 486 bp, Pseudomonas aeruginosa
ccaggcccagcgagacgaccttgtaggccggcaggcggtcgaggatgctcggatactgttccggcgctcgcaccaggtcgatgtgcaggccgtccaccgggaggttggcggccaggcccaggttgtcttccaggccgccgaagtaggtggcgaccagcttcttcagcggttcgctctgtagcaggttgtaggcgcgctcgaaggcgttcttccatgcctgcggcaggtcgaggaccaggatcggctcgtcgatctgcacccactccacgccctggccggcgaggcggcgcaagatctggccgtagagcggcagcaggcggtccagcaggtcgagcctgtcgaactcggcgcccttgcccttgcccagccacaggtaggtcagcggaccgatcagcaccggcttcacctggtggccgagggccctggcctcgtcgacctcctcgaacagttgttcccagctcagctggaactgctgatcggcgctga

SEQ ID NO: 15542 - DNA, 624 bp, Pseudomonas aeruginosa
ccgcgcgcccgcgccggcgcgcctggatcgcctcgccaacgttgtcctggatgtacgggtagaacaccggcaggtcgccgagcgtccgcagcgggtagtcgcccaccgccagcccgcggtccttgccgggtagccattcctgggtgccatgggtgccgaaatggatcagcgcgtcggcgccgaaaccctcgcggacgaactggtagaccgccaggtagagatggtccggcggcaccgcgctgtcgtggtaggcctcgcccggacggccggcacgcggcggctgcggcaacagcagcagattacccaggcgcgccgccgggaacacgaagcgtcgctggccgtcgatatcgcgcaaggcccaatgtcgacgcgggtcgccccagcgcgcgcgcatctcctcgcgcaggtccgccggcagcgcctcgagccagtgcaggtaggcgtccagcggcaggctcgcggcgaggccgtcgcgatacagcgcgtccagggtctgcggccggtagtagccgccgagcaggcgctgggcggtatcgatcagcgcgctttcgtcgctcgtcgcaacccggtagccggccgcccgcagcgcttcgccgagacgggccaggctggccggtacattga

SEQ ID NO: 15543 - DNA, 672 bp, Pseudomonas aeruginosa
ccagcgcctggacatcggcgccagcgaaggacttcctcaacgcctccggatcgctgtcgtcgaaccacaccgccagcggcgcctggccgtgccgctcgctacgccgcaacagttcgtcgatggcgccggtctgggcgtcggcgatggcgccgcgcgggatcaggaaggcgatgcgcggggcatcgctggcccagcgcgaggcgccccaggccaggtagtcggcgaggccggcgaacggcgccggtgcgtcgggatgatagaagccggcctgcgccaggggctgcggcgccggcaacgcgtcgacgggcaggccggcatgccagcgttggaccgcctcgaacagccggcgcaggttggcttcgccgccgttcgcgtagtagccgaccaggcgcccgcccagcgccgccggcaggttgccgaagcccggaggaccgccgccgacgcggatccagggttgcgtcccgccttgcaagcgctcgcccagcgcctcctcgacctgggcgcgatcggtcggccgcggcgtgtcgaggatcagcaggttgccgccgtccagccactcgccgggcggcgcctcgccgatgccgaggcgcaggccgcgcaactcgacaccggcctcgcgcgcccaaccggctaggcgctggtgcttgcccgggaggacgaaatcgctgctga

SEQ ID NO: 15544 - DNA, 1326 bp, Pseudomonas aeruginosa
  unsure (92): Identity of nucleotide at the above locations are unknown.
ctgcttcaggctcggcgcattgtagccgcggcagacgccggcgcgcagggtcagcgcatcggaaaggtggtgcagcaggtacaggcgcggantgctttcccagccgaacgcctcgtgcttgtcgaagcggctgccgagggtcagcgaccagtccgggccgaaggcgatctcgtcctgcaggaacagcgccttgtgtcgcgcgctggcgtcgccggcggtattcaccgagcgatcctccagttcttccttgcgccattcgccgccgagggtgaagagatgtcgctcgaaggccggcacgctgaggtggccgtcgaccacgctgtcggtaagccgctgcgggttgctcggcggttgtccgtcggaacgcgtgttgtgccgctccaggcggttgcggtaggtgcgcagctggctgctaccccagtcccactggccattgtgggcgagcgaccagcgctcgcgttcgatcacgtcgcgcgactcgtagtagcgcgagcgcggccctccggtctcgctgttgcgccagcgtcgttcgcgcccgcgctggtggccgaggtcgatgcgctgggcgtcgtccggggtccagctgaggttcagcccaccgctgtcggcgttgccgccttccagctcggagagtcggcgctcatcggcgtccggggtttcctgctggcggcggctctcgccgttcagggcgaggcccagcttgccgggcaccagcggcccggcgagataggcgccgagctggtggctctgcccaccgaggccgtcctcgcgcacgccgccatcgagcagaccgctgcccatccaggtatcggtggcgcgccgggtgatcacgttcaccaccccgccgagggcttccgaaccgtagagcgaggacatcggcccgcgtaccacctcgatgcgctcgatgctctccaccggcccccagccgaggtcgaagtcggaatgggcgatggccccggacgaggtggagatccgctggccgtccaccagcaccagggtgtgctcgctggacatgccgcgaacgctgatgccccgccgggacatgccgacgccgttgaactgcaggctttccgaaccgcgcagggcttcctgcaggtcgcgcaccgggcgccgccgcaggtcctcggcggcgatcagcgaaacgctggccggggcgtcgcgcagcttgcgctcggtagtggtggcgctgaccacggtcggctccaggtcgaccggcgcggccagcgccaggcagggaagcaggtagaggaacggcacggcgcgggccagccgcagcggaggaagacggtgcggggaggaatggggggtcatggtcggcaggtatga

SEQ ID NO: 15545 - DNA, 471 bp, Pseudomonas aeruginosa
ccgcaaccgagcagatcatggcgctcctcgaacgctgggaccgccagcaggagggctacatccgccagcgcgaggagcgctacgaggcgatgttccagttgctcgaagacctcttcggccgcgacgggcgcttcaccgccatcgacgccgcctgcggcccgggctccctcggccggcgcctgctcgaacgcttcccggcggcgcgggtggtggcgctggacgccgacgtcatgctgctggagatcgcgcgtacggcgctggccggtttcgccgaacgggtccgcgtggtggagtgcgacctcaccgatccaggctggaccgaacgggtcgccgaagcgcgcgagtccctcgccggcgaacggcccgcggcgctgctctcttccaccgcgttgcactggctgtcgcccgccgaactcgccgggttctacgcccaggccggcgagctgctcgcccccggcggcgtgctgctga

SEQ ID NO: 15546 - DNA, 2361 bp, Pseudomonas aeruginosa
aggcgcagcgcgacgcccatttcgcgcggcgcccgctcaggcgcgccagcgaagacgaagactgctcgctcgatttccatctcgccgccctgcgccaggcgggcttcgccgaggccgccacggtctggcagcagttggacaactacgtcgtcttcgcccgcctcgcccaggcctgatacgccgtcagccgggcacggggaatacctccaatggaacccgggcaatccgccggacgttgacgcagatcaacgccggctcggcgtcgctcgccagaatccacaacatcttgttgttttgcaaaatcaaaacacatcatgttgtggagaagttgaaatgacccagccccggaaggctacctggccggccaccctgctcaagcgcaacggacgtgaagtccctttcgatcccggcaagatcgaacgcgccatcgccgccgccggccaagccaccggcgagttcgacccgcagcaggcgcaggcgctcgccgaacgcgtggtggaacgcctgccggaacgcgcctgcctggatatcgaacgggtccaggacctggtcgaacgggtgctgatggaggccggccactaccccacggcgcgcgcctacgtggtctaccgcgaacgccacggccggctgcgccgcgagcgcaagaccctggtggacgtcgccgcgtcgatgaacgaatacctttcccgcgaggattggcgggtgcgcgccaacgccaaccagggctattccctcggcgggctgatcctcaacgtatccggcaaggtcaccgcgaactactggctggatgaggtctacgatgccgacatcgccgccgcccaccgcgacgccgacctgcatatccacgacctcgacatgctcgccggctattgcgccggctggtcgctgcgcaccttgctgaacgaaggcctgaacggcgtgccggggcgggtcgaggccggtccgccgaagcacctgggcagcgccctggggcagatggtcaacttcctcggcaccctgcagaacgaatgggccggggcccaggccttcagctccttcgatacctacctggcgccctacgtgcgcaaggaccgcctcgactacgccagcgtgcgccaggccctccaggagttcatctacaacctcaacgtgccgtcgcgctggggcacccagacgcccttcaccaacctgaccttcgactgggtctgcccggacgacctgcgcgaccaggtgccgcgcatcggcggcgaggagatgcccttcgcctacggcgagctgcaggccgagatggacctgatcaaccgcgcctacatcgaggtgatgcaggccggcgacgcccatggccgggtgttcaccttcccgatcccgacctacaacatcacccacgacttcccctgggacagcgacaacgccacgcgcctgttcgagatgaccgcgcgctacggcctgccctacttccagaacttcctcaactcggacatgcagcccaaccaggtgcgctcgatgtgctgccgcctgcaactggacgtgcgcgaactgctcaagcgtggcaacggcctgttcggctcggcggagcagaccggctcgctgggcgtggtgacgatcaactgcgcgcgcctgggctatcgccaccgtggcgacgccgccggcctctaccgccagctcgaccacctgctcgaactcgccttcgccagcctggagctgaagcgcaaggtgatccagcagcacatggatgccggcctctatccctacacccgacgctacctgggtaccctgcgcaaccatttctccaccatcggcgtgaacggcctgcacgagatggtgcgcaacttcagcgacgaccgcgagggactgcacagcgaagccgggcgcgagatggccctggccctgctcgatcacgtgcgcgcgcggctggtgggtttccaggaggacagcgggcacctctacaacctggaagccacgcccgccgagggcaccacctatcgcttcgcccgcgaggaccgcaagcgctatccgcgcatcctccaggccggcacgccggaggcaccctactacaccaactcctcgcaactgccggtgggcttcaccgacgacccgttcgaggcgctggagctgcaggacgccctgcaatgcaagtacaccggcggcaccgtgctgcatctctacatggccgagcggatttcctccgccgaagcctgcaagaccctggtgcgcaccgccctcggtcgcttccgcctgccgtacctgaccgtcacccccaccttctcgatctgcccgcggcacggctacctggccggcgagcacgagttctgcccgaagtgcgacgaggagctgctgcaacgctccacgcccaagagctgttgcggcggctgcggcggttga

SEQ ID NO: 15547 - DNA, 885 bp, Pseudomonas aeruginosa
gtcgcctgtcgttcctttcatccaccagcaaggagtaccaccgatgaaccccaaccagttgcccgaaggccagcgccagcgctgcgaagtctggacccgcgtgatgggctaccaccgtcccgtggcagcgttcaatgccggcaagcagtccgagcatcgcgaacgccgccatttccgcgagacgcgatgagcgccacgctcagggtcgggggcctggtgcccctgaccaccctcgactaccccggcctgctcgcctgcgtgctgttctgccagggctgcgcctggcgctgccgctactgccacaacccagagctgatcgcgccgcgcggcgcggaggaaatcccctggccacgcctgctcgacttcctccgccgacgccagggcctgttgcaggcggtggtcttcagcggcggcgaggcgaccctgcaggcggccctcggcgacgccatgcgcacggtccgcgaactgggcttccgcgtcggcctgcacagcgccggcatcaacccccgcgccttcgcccgggtgctggcgcagagcgactgggtgggcttcgacgtcaaggcgccggccgaggacgtcgccgccattaccggcgtggacggcagcggcgcggccaactggcgcagcctggaatgcctgctggacagcggcgtggcctacgaatgccggaccacggtgcactggcgcttgttcgatagcgaacgcctctggcgcctggcgacgcgcctgcgcgagatgggcgtggagcgcttcgccgtacaactggcgcgcccggcccgccagctcgatccgcagcttctcgcgaagcccgcgccgcagggcgctgcgcagctatggcgagaactggaagagctgtttcccgccttcgaactgcgcgacgcctga

SEQ ID NO: 15548 - DNA, 1461 bp, Pseudomonas aeruginosa
cagaggaaacaagaaatgggtatgcgagaagcgaacgacaacgcatcgggcctcaaggcccatcccctgggctcgctcgagacgatcgctatcatcatcggcaccaacatcggcgccggcgtgctgagcatggcctacgccgcccgcaaggtcggctacgtgcaagttgcttggtatgcctggcccctgaactgcccctgccgcatcgtcaccaggctcctgcgtgaccgaagcctgcctgagaacccgcggcaacaaccagctcagcggcctctcccggcgttacctgggcccgctcggcggatggctgattttcatcgcggtggcggccaacagatacggggccatggtcgcctacatgaccgacagcggcaacatcatggtagagttattcggccagtacggcctcacgcgcgaggtcggcagcctgatcttgttagtcccctcggcgctggtgctatacctgggcctgaaggcgctcggcgtgggcgagaagctgatcagcgccggcatggtggccatcgtctgcatcctcatcggcgctaccctgatgcaggacgacgcccgtctcgcccacctttggcagagccagtggcaatacgtggttccagtgttcaacctggcggtcttcgtgttcggcgcgcagttcctggttccggagttggtgcgcggcaacctggcaacccccgggcgcgtgccgcgcctgatcgtggtcggcatgctgctgaccttcttgggtggtggcggccattcctgccctcggtcatcgcccctggtcgccccggacgacatcagcgaggtggcgaccttgagctggggacgctccttcggccgatgggcctactacgtggcgaacactttcgcctggttggcgatgctgacctcgtactggggactcggcgggtgcctgttcaccaatatcttcgaccacttccgcgtgggcagcgaaacccacgggcgcaaacgcctggcggtgctcgccgcggtctcggtcccgccgttcctgctggcctatgcggggctcggcggcttcgtgaacgcgctgtacttcgccggtaccttcggcggcgtactgatgggcatcatccccatcctcctgctcaacgcggcgcggcgccacggcgaccaactgccggcattcagctgcggctggtatgcccatccgctgatacaggggctgatcgtcctggtgttcgcctccagcggggtctacgcgatcgcctcggcactggggatgctgcccgccagttggtgacagggcgcgctgcctgcgcccggggcgattacactgaaggcccatgcctggagtttcctggacatgccgcagagcatccgccacctgatcgccctccccgaactccgttcgcgcctgctgagcggagccggcggcctcgaccgcccggttcgctgggcgcatgtctgcgaactcgacgaccccaccgaatggctcggcgagggtga

SEQ ID NO: 15549 - DNA, 540 bp, Pseudomonas aeruginosa
gactcattctcaattacaacagcgatcccctccatgccgccggccgacgcctctctgcacgacgctgtgagccatctctaccaggaccaccatggctggctgcaaggctggttgcggcgacgcctgggctgcgcggaaaacgccgccgacctggcccaggacaccttcgcccgcctgctcgcctcgcgccgggtactggatgcgcgcgaaccgcgcgcctacctgaccaccgtcgccaaggggctgatgatcaactggttccagcgccagtcgctggagcgcgcctacctcgatgccctggccaacctcccggaagacctcgcgccgccgccggaacagcggttgatggtgctggaaaccctgcatgaagtagacgccctgctcggcagcctgccggacagggtccgccaggcgtttctcctggcgcagatcgaaggcctgaagtacgaagccatcgccgagcgcctgggcgtgtccctgggttcggtcaagcgctacatgcagcaggccttccgccagtgcctggagctgatggaatga

SEQ ID NO: 15550 - DNA, 2508 bp, Pseudomonas aeruginosa
ccgcctcgacctgagacctttttccttctcggctggcaagtagaggaatccgccccgacccaaggtccgcagagaccacgaggaaccctgtacatgcccgtacgcacgcttcgcccccgttcgctgtccctggccatccacgccgccgccatgaccctcgccctcgccggagcggcccccgccctgcttgccgccgaggcgcccgccgccagctcggcgcgcagctatgacatcgcccccggcccgctcggtcgcaccctgtcggccttcgccagcgacaacggggtgtccctggcgttcgacccggcgctcaccgagggtcgccgcagcgccgccctgcgcggccgctacgcgccggtcgaggcgctgcaccgcctgctgctgggcagcggcctggagttgcagcagcgcagcgacggcagctacaccctggtgccggcaaccaccgatggcgcgctggaactgcaatcctcgctgatcaccgcccaggccgccggtgccgagaccctgcccgccgagtacgccggcggccaggtagcccgtggcgcgcgcctgggcatgctgggcaacgccgacgtgatggacgcgccattcagcatcaccagctacaccgccaggaccatcgagcagcagcaggcgcgcagcgtcgccgacctgctacaggccaacgatccgtcggtgcgggtggtcggcgggcgcggcgacctggtggacagctacacgattcgcggcttcagcgtgcagaacgccgacgtcgccttcaacggtctctatggcctgctgccgttctggcgggtaccgatcgaattcgccgagcgcgtggaagtgctcaagggaccaaacgccctgctcggcgggatttcccccggcggcagcgtcggcggcaccatcaacctggtgcccaagcgcgccgacgaccagccgctgacccgcgtcagcgtcgattggacccagcgcagccagctcggcactcacctcgacatcggccggcgcttcggcgagaacaacgccttcggcgtgcgcttcaacggcgtctaccgcaacggcgataccgccgtcgaccatcagagccgcgagtttcccatgctctccctgggcctggacttccgtggcgagcgcctgcgcctgtccagcgacctgctgtaccagaaggaaagcctggaaggcgtggtgcgcccgctgctgaccggcccgggaaccacccacatcccccatgccccggactcgaagacacgcttcggcctgcgcgattcctacctggaccaggaggattactccatggtcaaccgcggcgagtacgacctcgccgacaacctgacggcgttcgccagcatcggcggccgccagagcaactacgaaaccatcgccgccaacagcatcctcgtcggcaaccagggcgatatcgtcaacagcctggcacgccagcgcggcgaccgccgcacctattccgccgaggtcggcctgcgcggcaacttcgacaccggcccgctccgccacgactggacgctcagcgccaaccgcctgcacgaacggctgggcatggtctatgccttcaccgggatgcagccgggcaacctctaccagacctcgccgcatacgccgctgccggacttctccagcctcgacgggagcattccgaagaccaatgaaaccgacctcggcggcgtggcgctggccgacaggctgtcgttcctcgatgatcgcgtgcaggtcaccctgggcgtgcgccgccagcagatcgagtcgcgcaactacgaccagaccagcggcgcgcgcaccagccacgacaagcggcacgtgtggacgccgatggccagcgtgctggtcaagccgctgcaggacctgtcgctgtacgccaactacatccagggcctcagccagggcgaggcggcgccgatgaccgcggccaacgccggccaggtgctggcgccatacaaggccgagcagtacgagatcggcgccaagtacgacctgggcggcttcaccaccaccctggcgctgttcgagatcaggaaaccgaacgcctataccgacgccagcaacgtcttccgcgccgacggcgagcaacgcaaccgcggcgtggagctgagcctctatggcgaaccgctggacggcgtgcgggtgatggccggcgccacctacatcaagcccgagcagaacaagaccggcgaccctgccagcgaaggcaaggacgcgcccggcgtggcccgccgccaggccaacctgggggtcagctgggacaccccgttcgtcgacggactgaccctcgacagccgctggatctacaccggctcggcctatgtggacagcgccaacgccctcgccgtgccgcactggaaccgcgtcgacctcggcgccgcctacgccttccaggtcgccggcaagccgctggtggcgcgcgccaacctggagaacgcactgggcaaggactactggaccgcagccaacggctacctgtcgatcagctcgccgcgcaccctttccctttccctcacggcggacttctga

SEQ ID NO: 15551 - DNA, 1344 bp, Pseudomonas aeruginosa
ccagccaatgaccgcgaaaaccctgcgcacctggtacctggtgcacaaatggaccagcctgatctccacgatcttcctgctgatgctttgcctcaccgggttgccgctgatcttccacgaggagatcgagcactacttcgagccgcatccgcagctcgagccgctcaccgccgagtcgccgcgcatcgactacgacgacgtgatcgtccgcgccctggccgcccggccgggcgaagtggtgcgcttcctggtattcgaaaaggacgacccgctgggcctggtgatcagcgcgccgagcctggtaccgccgccggagaacggccacatgcagccgttcgacgcgcgcaccggggaattcttcgacgcactaccgccgccgggcggcttcatgtacctgatgctgaagctgcacaccgacctgttcctcggcctgcccggctacctgttcctcggcctgatgggcctgctgctggtggcctcgctggtgtccggggtggtggtatacacgccgttcatgcgcaagctggacttcgccacggtacgcgccgaacgcagccgtcgcctgaagtggctggacctgcacaacctgctgggcatcgtcaccctgtcctgggtactggtggtcggcgtgaccggagtgatcaacaccctggccctgccgatcctgatgctctggcaaggcgggcagttggcggaaatgaccgcgccctacaaggacgcgccgccgctacagcgcctcggctcgctcgacgcggccctggccacggcacgccgggcggcgccggacatggaggtcagcttcgtcggcttccccggcacccagttcagcagccagcatcactatgcggtgttcatgcgcggcaacacgccgctcaccgagcgcctgctgaagccggcactgatcgacgcgcagagcggcgaactcaccgacatgcgcgagatgccgctgtacgtgaagacgctcctgctgtcgcagccgctgcacttcggcgactacggcggcatgccgctgaagatcgtctgggcgctgctcgacctcgtcagcatcgtcatcctcgccagcggtctctacctctggctcggccgacgcaagacgccattggagaagcgcctggcggaactgccggacggcagcctggcgacggagggcaaggcatgaggcgcggtctctggatgatcttccgctggcccctgctactggccctgctcggcctcttcgggctgctctcggcgctgctcggcgacggcctctacgacctgctctcctggctcgccctgggcactccgctggtgctggtcggctgggtctggctgcgcctgccgcgaacccgaaggaacccctga

SEQ ID NO: 15552 - DNA, 1110 bp, Pseudomonas aeruginosa
gatgaccaccccgccgccctccgccaacaccctggacctgcgtccgctgatgttggagaccttcgtctgcaccctcgcggtgatgtccttcgtcgccctggtcggcccgctcgcccgcaagctcggcctggcgccctggcaggccggcgccgcggtgaccgtcggcggcatcgcctggatgctcgcggcgcggccctggggcatcgccagcgaccggcatgggcgacggcggatactgctcggcgggctggccggcttcgccctctcctaagcctcgctctgcctgttcatcgtgctcgccctgcactggacgttgccgaccctgctcgccttcgccggtattgttctcctgcgcggcctcgccggcggtttatacgccgcggtgccggcctgcacggcggcactggtggccgatcacgtcgaggcgcaacgacgcgccgcggcgctggccggactcggcgcggccagcgcgataggcatggtgatcgggccggggctggccggactgctggcgactcacgggctggtcctgccgttgctggtcaccggcgcgctgcccctggtcgccctgctggcgctctggcgctggctgccgcgcgaggagcgtcgccagccgaaccgcggcgccgccctggcgatcggcgaccgccgcctgcggcggccgctggcggtgggcttcgtggcgatgttcagcgtcaccgtggcgcagatcaccgtgggcttcttcgccctcgaccggctgcgcctggattccgccgacgccgcgcgggtggccggcatcgccctgaccgcagtgggcgtcgcgctgatcctggcccagctcctggtgcgccgcctggactggccaccgccgcgactgatccgggtcggcgggctggtcgccgccatcggcttcgccgccgtgtgcttcgccgactcgccgccgctgctctggctggccttcttcgtcgccgcggcgggcatgggttgggtattcccggcagtctcggtgctcaacgccaatgccgtgcgcgccgaggaacagggtgccgccgccggcaccctggtggccgtacatggcttcggcctgatcagcgggccgctgctcggcacgctgctccaccaatttga

SEQ ID NO: 15553 - DNA, 1740 bp, Pseudomonas aeruginosa
cagccgcgccccctacgcgctggtcggtctgctgctggcgctggcggcgttctggccgagccaaccgacgcgccccgtggaaacgaggagcgaagcaccatgaccgctgtcgacctgctgctggtcgcgaccctgctggcggccctgctcgcctggtggatacccgccctgcccggccgccgtggcctgctggcgctcgcctcgacgctggcgctcggcgccggcctgtacgctgtatgggacgaccgctggcaagccggcgtcggcgccttcgccggtttctccctgctgctcggcgcctgtctgcgccggaagcccgtgcgcggcctgccgttccggaccggttcgctgtacggcctgctggtgctgctggcaatcgccgcgctgtacctgttcccggtcgcgccgctaccggcgccgagcggcccctatgcggtcggcgtgcgcgatttcgaactggacgaccccagccggcccggcctgctcggcgccccggccgggcagccgcggcgcctgctggtacgtgcctggtacccggcgcgcccgatcgccggcgccgcaccacgccactacttcgacccggacgaggcacgcagcaccgcgcggggcttcggtgaaatactcggctttccgccgttgctcgcctacctcaagcacctgcgcaccaattcctatccggacgccccgctacgcgacgactccgctcgcctgccggtggtgttctacagccacggctacagcgccttcgccggcggcaactggaccctgatggaagaactggccagccacggctacgcggtctacgccatccagcacagcggcgacgcgtcgccgacccgcctgcccaacggcacgctgctgcccatggaccccgggctggtcgaacacctgcgtcgggccgcccacgacggcttgccgcaggccatgcgccagggctatgtcagcgacgatctcgaccagcgcctcgacggccagttgcacaccgccctcgacctgcccgccccggccaaccgcgccgtcaacctcagcgcgccggtatggctggccgaccgcctgttcgtccatgaccgcctgcaggccggcgaggtcccggacagggtcgccgacctggtggccgccagcgacttcgagcacaccggcgagatgggcatgtccttcggcggctcgaccaccggcgcggtctgcatggtcgaccgacgctgcgcggcggccgtcaacctcgacggcggcgacttcgacttcgcgcccttcgatagcgatttcccggcgccgctgctgatgctgcacgccgaccttggcaacttctaccggctgttcggcatcgaaccgccggcccgcccgagaagcttcaacgacttttcctacgaacgcttcgagcacgccggccagcgccaggacattcatcgcctgatactgcgcgattcggcccatgccgggcttaccgacaatccgctgttcatccgccggccgctgcgcgacgggctgctcggctcggcaccgacggaagtcctcatccaggctcccaacgccctggtgctgggtttcttcgatcactacctgcgcggccgcgccaacgactttccgcaagcgcagatggcgcgcttccccgcctggctgacgcgctacgacaactcggcggtgcgcgactggtggctggccaagccggaagcccagcgcctggcgctgcgacaacgcatcgacgaaatgaaacggcgcaagaccgggctggatcttccctga

SEQ ID NO: 15554 - DNA, 561 bp, Pseudomonas aeruginosa
tgcatacagaggaacaccatagcgaatgtcggctacatccgagtcagtactacggatcagaacacagagcgccagctcgagggcctcgccatggacaagactttcactgacaaggtgagtggtgcaacgaccaaccgcccccagcttcaggccatgctggagtttgtcagggagggtgatgttatccacgtacacagcatcgaccgcctagcccgctctctagtcgatctgctggcgctggtgagggaacagacagcacggggtgttcacatccacttccacaaggaagctctgttgttcactggcgagagcaatccaacccaagagctgatgctgagcatcatggattctgtcgcccagttcgaacgagcaatgatcaaggaacgccagaaggaaggcatcgccaaggccaagcagaaaggcgtctacaagggccgtgtgaagacggttgatgacgctgctatccgtgcccatgttgcagccggaaacagcatcaggaagacggcagaagcctttggagtgaacccttccaccgtgcaacgggcgatgaaagccgagtga

SEQ ID NO: 15555 - DNA, 189 bp, Pseudomonas aeruginosa
tccgcaccaacttattttcgatttaccggagttcaggctagccccctgtgctgcgggttaaacgcctcggatgtacaccggagttattttcccagccgcacaccagagcaccccacctcctgtgcctgtgcgatttcctacaaaatttttgaaggtttctgctggaaactacctgtccttctactgtga

SEQ ID NO: 15556 - DNA, 249 bp, Pseudomonas aeruginosa
aagcaatgtataaatatcacccacaaatcgttcttccgcaaaaagctttcttaccgtagaaaactcccgcctaaactcccgctgcgtaaaaatcaatacttcattcaaagtattctgagcatcgaaatccgtatgcctaacatcatcaggctcttcggttattcttcgactaagttttgtcaagagactaacaacagctccactttcagcctgatcatccccaaggaaaatagcgagagtatccaataa

SEQ ID NO: 15557 - DNA, 234 bp, Pseudomonas aeruginosa
cgcaccatacgcttcctgaatcagttccagtatttgctctgccactggagcagaagtatattctttggaaatttcatcgatagctgcgagcacttcagccctacctgcctgatctttcatggcaagagcctttactctatcaagctcattttctgcgaggctatagcccccctcacccacaacaacccgcccttctttcttgaggagagaaacacgagatttgaaaacaggtaa

SEQ ID NO: 15558 - DNA, 744 bp, Pseudomonas aeruginosa
acgacgcatacttctcctcaccgcgatggaaggagaaggcgatccggtaatcgctgccgccgaacagcttcaccggaaactcgcggacctggccgggccggatctccccggagaaggtttccacgccctgctccttgtagctgtaggcgatcggcgccgaagcctggccactgtaatgcagcaggatgcgcggccgctcgctccaacccacgtaggcgccgaacagcaccaccaatgcgagcacgcccagcaaccgctgctttcttgccttgtccatcgttaactccagtcttcggaaatctttcgcagcagcgccgccgcttcagcgggcgacgccgtgctcgtcgaacagtttcagcaggccgtcttcgtcgagcaccttcacgcccagctcgttggccttggccagcttcgagccggcgccgggcccggcgaccacgcagtgggtcttggccgacaccgagccggccaccttggcgccgagcccttccagcttgtccttggccacgtcccggctcatcgcctccagggtgccggtcagcacccaggtctgcccggccagaggcaggccttcgaccgccttgcgctcgctctgccaatgcatgccgaactcacgcaactgcgcctcgatggccagggcacgctgcacgttggccggctcgtcgaagaaatcgcgcaggcttttcgccgctcgctcgggcagacgctccacctggcgtagatcgagccagtcggcgcggatga

SEQ ID NO: 15559 - DNA, 312 bp, Pseudomonas aeruginosa
acagcccggctcatgcatggtcacgcccatcaactgatcggccatttccatggcgatcttgttgtgggtgatatagatgaactgcaccttttccgacatctccttcaccaatcgcgcataacgtccgacgttggcatcgtccaatggcgcatcgacttcgtcgagcatgcagaacggcgccgggttcaactggaagatggcgaataccagcgccagcgcggtcagcgccttttccccgccggacaacaagtggatggtgctgttcttcttgcccggcgggcgcgccatgatcgccacaccggtatcgagtag

SEQ ID NO: 15560 - DNA, 3402 bp, Pseudomonas aeruginosa
atcttcgccggtaagttccagatatgccgtaccgccgccgaataccttcgggaacaatgcctgaaggccagcattgatctggtcgaaggtttccttgaaacgattgcgggtttcccggtcgatcttgcggatgacgttttccagcgtctccagcgcttcggccaggtcgtcgttctgcgagtccaggtagcgcttgcgctcggactgctgctggtactcctcgatcgccgccaggttgatcggccccagacgctggatgcgcgccgcgagactctcgagacgctcctcccaatcgcgttcgctggcatccaggggcaggttggccagtaccgtatgcaggtcgtagccgtcttcggcgagctgctcctgcaaggctttgcgccgcaccaccagcccctgccactccaggcgctgctgctccagctggccacgcagcagttgcgattgctgctcggcctggccgcggcgcttctccacctcgcgcagttcgcgatcggcgtcttccagggccagccgcgcctgcttgagttcgtcctcgacggccatccgccgctccagcaactcctcgagcttcatgcgcagctcttccagcggtgccgccccctcctccagattgaggttgagctgttcgcaacgctcgttgaggcgcgccgactgctggtcgaggcgctccagggcctgctgggtggaattgtgctgcgccttcagcgagccgacccgcaccgccaactggtgcgcatggtccttgtgggtgcgggcatcctggcgaatccggtcgagccgttcgcgcagggcgtcacgctccgccagcagggtttcccggcgctcggtgtccagcgccatgctatccagcgcttcctgcagggtcaggcgcgcctcgctcagttgctcctgttccagcgcgcgctgctcggccagttccgccacttcttcgtcgagacggcggcgacgcagtaccagttgctcgaccttggcctgctgcgcggacaactgcgccttcagctcgccgtgccggcgcccctcctcctggacctggcgccgcacctgctcgcgcgcgccttccagctcgcgctgctcgtcgcgggccgcagccagacgctcctcgccttcggagacacgggtttccaggggctcccgccgctcctgcaacgcctccagttcctgggcgcgggcgatcatgccgccctgggcctcgtcgctgcgccggacccgcaggaagtgccggccgacccagtagccatcgcgactgatcaggctctcgccgtcgtccagggcgccgcgctgggcgagcgcctgttccagggtctccaccggtttcacccgggccaaccagggactcaggtcggcgtcggcgcggaccttgtccagcagcgaaccggccgccgtcgcggctccgcgagcggggctgagcaggcgcagctcgcccttgccgaagccggccagggcgagcccgtcgaagccgtccagcaagaccgcctgcagatccgcgccgagcacggtctccaccgccagctcccaacccggctcgacacgcaagccttcggcgaggcgcggacgttgttccaggccctgctcgcgcaaccactccaaggcgccctgtccgggatcgagagcggcctgctgcagggcctccagcgaagcgatgcgcccgttcaggcgctgcaactcgccctgcgcctggtgctgttcggcggccagctgctgcaattcctggcgcaattgttcgagtcgctcggcttggccctgctcctgcaattgcagttcttccagggccagttcggcgatcgccacctgttcgttgagttcgaggatcgccgcgtcctcggggtcggccgccaactggccacgctcctcctgcaggcgccgctcgcgatcctgcaggcgctccaggctctgctccaggtgctggatgcgcgactgctgcacctcggcctggcggcggggttcggcgctctgctggttgaaggcatcccactgctgctgccaggcctgcatgccctgctcggcctgttccagggcgatgcccgcttcttccgcggcggccgcgctgagttcctgttccggtgcgagcatggccatttcctcggccagggtcgcgagcaaggtacggtcatgcccgaggtgcgattcggtttcctggcgggtccgttcggcttcgcgcaagtcgtcctgcaactggcgctggcgctgctggccatgctggatgctctgctcgacccgggcgatgtcgccgccgaccgaatagaagcgtgcctgcacctggttgaagcgttcggacaactcgtgatggccgtcgcgcagccgttcgatgccggcatcggcaccgcgctgctcggccaccagggcctcgaaggcgatctcctggtcgccgatgacccgctcgcgctgaccgacctgctcgttcaggtcgcgccagcgcacggcgcccagctgggctttgagctggcgctcctcggccttgtgctcctggtatttttccgccgactgggcctgccggtgcaggcgttccagttgccgccccagctcttcgcgcaggtcggtgaggcgtgccaggttttcctgggtccgacggatgcggctttcggtttcgcggcggcgctccttgtacttggaaatgcccgcggcttcctcgatgaagttgcgcaggtcttccggacgcgcctcgatcagcttggagatcatgccctgttcgatgatcgagtagctgcgcggccccaggccggtgccgaggaagatgtcggtgatgtcgcgccgccggcacttggtgccgttgaggaaataggtgttctgcccatcccgcgagacccgccggcgaatggatatctcggcgtactgggcgtattcgcccaccagtgtggtctcggcgttgtcgaagatcagctcgatgctcgcctggctcaccggcttgcgggtattcgagccgttgaagatgacatcggtcatcgactcgccgcgcaggttcttcgccgagctttcgcccatcacccagcgcaccgcgtcgatgatgttcgacttgccgcagccgttcggccctaccactgccgccatgttgctggggaagttcaccgtggtcggatcgacgaaggacttgaaccccgccagcttgatgctcttcaggcgcatgcgtgcgctcccgccagggtcgccatcagcgttcggcgagcgcggccagcaccagctggcagttgtggcggccgtattccagcaggacctcgcggatcctcgcctcgtcacgggcgatcaccgcttgcaggagctgagcaaaactgccgaggaactggttcatttccgccttgcgccgttccagcgccaggtggtaggcgcgactcaccgccggcagcaggttttcgacggtctcctgcaggtagggattgttcgcgaaaggaaaggccgcgcgcatga

SEQ ID NO: 15561 - DNA, 423 bp, Pseudomonas aeruginosa
tcgccctcggcgcgaagatcgtcctgcgccgcggcgaacggcgccgcgagctgccgctggaggagtacttcctcgactacaaggtcaccgcccgcgaagaaggcgagttcatcgagaagatcctggtcccgcgtgcccggcccagccaggcgttcaaggcctacaaggtctccaagcgcatcgacgacgatatttccgcggtctgcgccgccatcagcctcgacctggaagatggccggatcgtccgcgccagggtcgccttcggcggcatggcggcgattcccaagcgcgccgccgcctgcgaagcggcgctgcaaggcgcgcgcctggaagccgccagcttcgaacgcgccgccgccgccctggcgaacgacttcaccccgctcagcgacttccgcgcgagcaaggaatatcgcctgctga

SEQ ID NO: 15562 - DNA, 2406 bp, Pseudomonas aeruginosa
ccgcctatgtctaaccatcgcaagccgcacaagagccaggaagagctggccgacctgttccgcgccgagttgaccaccggggtcggccgcagcgtcaagcacgaaagcgcccccaagcacgtcagcggcgaggcgatctacatcgacgatcgcctggagtttcccaaccagttgcacgtctatgcgcgcctgagcgagcgcgcccacgcccgcatcacccgcctcgacgtgacgccctgctaccagttccccggcgtcgccatcgccctcaccgccgccgacgttcccggccagctcgacatcggcccggtggtggccggcgacccgctgctggccgatggcaaggtggagtatgtcggacagatggtcctggcggtcgccgccgacagcctggaaaccgcgcgcaaggcggccatggcggcgatcgtcgagtacgaagacctggagccggtgctcgacgtggtcgaggccctgcgcaagcgccatttcgtcctcgacagccaccagcaccgcatcggcgattccgccgccgcgctggccggcgcgccgcatcgcctgcaaggcacgctgcacatcggcggccaggagcatttctacctggagacgcagatttcctcggtaatgcccagcgaagacggcggcatgatcgtctattgctcgacgcagaaccccaccgaagtgcagaagctggtggccgaggtcctcggggtttccttcaaccgcatcgtcatcgacatgcgccgcatgggcggcggcttcggcggcaaggaaacccaggccgcggcgccggcctgcctgtgcgcggtggtcgcctaccacaccgggcgtccggcgaagatgcgcctgccgcgcatggaggacatgcagatcaccggcaagcgtcacccgttctacgtcgaatacgacgtcggcttcgacgacgatggccgcctgcacggcatccagatcgacctggccggcaattgcggctattcgccggacctctccggctcgatcgtcgaccgcgccatgttccactcggacaacgcctacttcctcggcaacgccaccatcaacggccaccgttgcaagaccaacaccgcctcgaacaccgcctaccgcggtttcggcgggccccagggaatggtcgccatcgaggagatcatggacgccgtggcccgcagcctgggcaaggatccgctggaggtgcgcaagctcaactactacggcaagaacgagcgcaacgtcacccattaccaccagaccgtcgagcacaacctgttggcggagatgaccgccgagctggaagcgagcagcgagtacgcccgccgccgcgaggaaatccgtgccttcaatgccgccagcccggtcctgaagaaaggcctggcgctgaccccggtgaagttcggcatttcgttcaccgcgaccttcctcaaccaggcaggtgcgctgatccacatctataccgacggcagcatccacctgaaccatggcggcaccgagatgggccagggcctcaataccaaggtcgcccaggtggtcgccgaggtcttccaggtcgacgtggagcgcatccagatcaccgccaccaataccgacaaggtacccaatacctcgcccaccgccgcctcctcgggcaccgacctgaacggcaaggccgcgcagaatgccgccgaaaccatcaagcggcgcctggtggagttcgccgcgcggcactggaaggtcagcgaggaagacgtcgagttccgcaacaaccaggtgcgtatccgcgagctgatcctgccgttcgaggaactggtccagcaggcctacttcggccaggtttcgttgtccagcaccggcttctaccgcacgccgaagatcttctacgaccgcgagcaggcccgtggccggcccttctattattttgcctacggcgccgcctgctcggaggtgatagtcgataccctcaccggcgaataccgcatgctgcgcaccgacatcctgcatgacgtcggcgactcgctgaacccggccatcgacatcggccaggtcgaaggcggcttcgtccagggcatgggctggctgaccatggaggaactggtctggaacgccaagggcaagctgatgaccagcggcccggccagctacaagattcccgccgtcgccgacatgccgctggacctgcgggtgaaacttctggagaaccgcaagaatccggagcagaccgtgttccattccaaggccgtgggcgagccgccgttcatgctcggcatctcggtctggtgcgcgatcaaggacgccgtggccagcctcgccgactaccgcgcgcaacccgccatcgacgcgccggcgacgcccgagcgggtgctctggggcgtggaacagatgcgccggttgaagaccgcccaggcgcaagcggcggacgccgcggtcgagccggcctga

SEQ ID NO: 15563 - DNA, 744 bp, Pseudomonas aeruginosa
tcgagcgctggcacggccagggccgtctgctcttacgcagtgaccccgcgcttcgccccgaccagcaccgcggaacagctggacatggcggcgcggctgctgcgcgagcatcccggcgtatacctgcacacccacctgtcggagaacctcaaggaaatcgagtgggtgaaggagctgttccccgagcgcagcggctacctggacgtctacgaccaccacggcctgctcgggccgcgctcggtgttcgcccatggcgtgcacctgtgcgacggcgaatgccagcgcctggcggagactggctcgccagtggcgttttgccggacatccaacctgttcctcggcagcggtctgttcgacgtgccgaagctggagcgctacaaggtcaaggtcggcctgggcacggatgtcggcgccggcaccagcttctcccagttgcagtccctgaacgaggcgtacaaggtcatgcagttgcagggcgcccgcctcgatccgttcaagtcgctctacctcgccaccctcggcggcgcccgcgcgctggagctggacgaccggatcggcagcttcgccaccggcaacgaggcggacttcgtggtcctcgactaccacgccaccccgctgctctcctaccgcctgagccaggccggcagcctggccgaacggctgttcgcgctgaccatcctcggcgacgaccgcacggtgaaggaaaccttcgccgccggtcgctcggtgcatcgccgcgactga

SEQ ID NO: 15564 - DNA, 1800 bp, Pseudomonas aeruginosa
ccaaccggcccgcaggacctaacaacaagagcgatgaggagtacctgctgtggaaagcaccaaacaagaagaacaagggatctacgctgcgacaccgcccgccaccggcctgctcgaacgcctgttcaagctccgccagcatggtacgacggtcaggaccgagctggcggccgggctgaccaccttcatcaccatggcctacatcatcttcgtcaatcccaacatcatggccgacgccggcatcgaccacggcgcggcgttcgtcgccacgtgcctggcagccgccctcggctgcttcctgatgggcctgtacgccaactggccggtgggcctggcgccgggaatgggactgaacgccttcttcacctacaccgtggtcggcaccatgggctacagctggcagatcgccctgggcgcggtgttcatctccggggtgatgttcatgctgctgaccttctcccgggtccgcgaatggctgctcaacagcatcccccgcagcctcaggttcgccatgggtgcgggagtcggcctgttcctcggcctgatcggcctgaagaccgccggcatcgtggtggccagcccggcgaccctgatcaagctcggccacctcacctcgcccggcccgctgctggcggcactgtgcttcctgatgatcgccgtgctcgagtaccgccgggtgttcggcggcatcctcatcagcatcctcagcgtcaccctggtcggctgggccctcggcctggtgcagtacggcggggtgttctcggcgccgccgagcctggcgccgaccttcctggcgatggacatcgccggcgcgttcaacgtcaccatgatcagcgtgatcctggccttcctcttcgtgcacatgttcgataccgccggcactctcatgggcgtcgcccagcgcgcgcacctggtgaaggaggacgggcgcatcgagaacctgtcgaaagcgatgaaggccgacagcgcctccagcgtgttcggcggcatgctcggtgtcccgccggtgaccagttacgtggagagcgccgcgggcgtggccgccggcggacgtaccgggctcaccgcggtggtggtcggcgtgctgttcgtcgccgcgatgttcttcgccccgctggccgggatgatccccgccttcgccaccgccggcgcgctgatctacgtggccatgctgatgatgggcggaatggcgcacatcgactgggacgagcacaccgagaccatcccggcgatcgtcacggtgatcatgatgccgctgaccttctcggtggccgacggtatcgccctgggcttcatcacctacgtcgcgatgaaggtcctcaccggcaagcaccgcgaagtctcggccagcctctatgcgttgttcgtgatcttcgtcgccaagttcatcttcctctgacccgcccggatggcggatggccgcacgcggctatccgcctcgaacctgtcgttgccccgcagggctcgcgacgcgcagcttcatcccccgcccattcgtaccctgcgccgcatttcccttcctgcccacgagtggcggataaccggcaaccctcggcgcactccccgcgaacgaaaaaaagcccgctcgatggcgggccagggaaaaggactcggagagtcagtgtttcgtggcacgcacctagctgccgcgataggtcgaatagctgtagggcgagatcagcagcggcacgtggtagtgatcgtcggcggaggcgatgccgaaacgcagcaccacctggtcgaggaaggccggctccggcaattgcacgccgcgggcgcgatagtagtcgccggcgttga

SEQ ID NO: 15565 - DNA, 540 bp, Pseudomonas aeruginosa
gcatcctttccaggagaccgaggcatgagccgtttccagaccctgacccccgcctcgctgtcccgcgaggccttcgtcgaagccttcgccgacatctacgaacactccccctgggtcgccgagaaggcctatgacctgggtatcgacgacagcctcaacgatatcgagggcctgcaccagcgcatggccgacattctcctgtcggcaagccgcgaggcccagctggcgctgatcaacgcccacccggacctcgccggcaaggcggcgatccgtggcgaactgaccgcctccagcacctccgagcaggccggcgccgggattcacgaatgcagcgccgaggagttcgcccgcttcaccgaactcaacgacgcctacaaggccaggttcggcttccccttcatcaaggcggtgaagggcagcaaccgccatcagatcctggcggccttcgaggaacgcatccagcactccgccgacgaggagttcgctaccgcgctggccgagatcaacaagatcgccctgttccgcctgcagcagctctga

SEQ ID NO: 15566 - DNA, 774 bp, Pseudomonas aeruginosa
agctggccagcgacaagaacgccatcgatttcaagcaggtactcgaccagccgggcaccttcaccctctggcaggacggccgtccggcccgctacgtccatggcatcgtcagccacttcacccaaggcagctcgggttttcgccggacccgctacgaactgctgctggaaccacagttggcgcgcctggagctgtgctgcaactggcggatcttccaggagaagagtgttccggagattctccaggcgctgctcaaggaacaccgggtgctcgactacgaacagcgcatctaccatgagcacctgccgcgcgaatactgcgtgcaggccggcgacagcgatcactacctgcacgaccggctggccttcgaggaaggcctggtctactacttccgcttcgacgaacaccgccacaccctggtctgcagcgaccggctctacgtccaggagcgtatcgccggcggcccggtgctgttcagcgcccagccggagggcgacaacccgcagccggtgcttcattctttccgctacagcgaaaatgttcgtacggctcgacagacccagcgggactacagcttcaagcgcccgacctacgaccaggagcatcatctcgctggcgaggcgctcgagcatcagggctcgtcctacgagcgctacgactaccccggtcgctacaagcagagcggcgccggccggcctttcagcgaaagccgcctcagagggcaccggcgcgatgcgcgggtggcatcggtcagcggcgacgacccgcggctga

SEQ ID NO: 15567 - DNA, 525 bp, Pseudomonas aeruginosa
gcaggtcaaggggctcccgggaaggaccgggctgccgcagggttttcaccagcgcatcttcaccgtacgcaagcgcaatggcgagaaggaaaagatcggcgggcacgcccctccccatgtctatcctcttctgctggccggcgagaagacctgggaagacaccgggctgggcggcaaggacagattcggccgggcgaacttcgaccagggcgacagcgtgctgctgaccgcgccgcgtctgccgttgccgacggaagcgcgattcgatttcgacggagccgtcacggcgccgggagagaactccgccagcggcgtctatcaggtgcgcgataccctcgatccgatcgacgccgccatcggcgtaagcaacggcggctggaaggaaaaggacagcgggcacgccgtcgcgcaacaggtggacgccgcgctggcgtaccgctacgggcgcgacgcgcgcagcgtggagagggcgttgaacgaaggcaaggaattggcccagcagacccatgtattttccgctcgtga

SEQ ID NO: 15568 - DNA, 1629 bp, Pseudomonas aeruginosa
tcgctattacgatcgccctgtttgctttggagggccgatctaatgcgtttgacgtttcctgtcttgtctctcgttgggattctgttgagctgctctgtcgggcaagcagccgagccgcaattgtcctcgatgcgctgcttcgccagtccggcggcgcccgttaccgcctacgccccggccaaggaggccgccatgtccgctgatgcttatcacgctccgaaaacgtcgccgcgcctggaaaccctggatgtactcagcgtaggcatgagtctggatgtgtttcgccaggggcaggtgtggaaggccttgcaggagcaaaatgccatgcaggccgaggccttacatgtcggcagcatcctgccgatggacccgaggaagtatccggttacagccgatgacaaggatattgcttctgaaaagcgagaggctgatgctctggagctaggactgaagaactttctggagaaatggcctattcctaccgtaacggtggtacgtggttggaacccgaatacaccgaatttgcgcttcactcctgaagagactcagggaagcctatcagcaatggttaatgacatgcgcattccagcaggactgcactggcatcgtattgtcaatctgcaggatggcattatctgcaacgatacgcctgaaggagtattggaggcgttgttcagattgttcgaacgcaatcctgacttgccggcagtactgatatatgccaatgaaggcttcaacatggccctgtccctgatggcaaaaggagagaagcccatcggtgtgggaactggcccaagacagccgggcgagttgactgacaccatggtcgccctgatcgtcggccgccccgagcgggtcgactggctacgccagttcgccccctacaccaaggtcaacgaaaaccggatcgaccccgagttccgtggctggggctggcgcaagccgccggtggagttccgccccacgccgttcattccccagccctggaccgagcgggctctggagcagtgggatgcgttgccggtgctggccaggctgcatcggccggtgagtgtgccgctgacccgcccggataccggcgaacggctcaagcgcgaagctctcaccgcacaactggccgctgcctggaagacggccagtgccgggctcaggccggcgcccgcccggctgttctacgacggcggtttgaacgccacgccgctggccgaactcaccccggcgctgggcgccgcgcagagttcgctggacttgctggactcgcgggaaagctacgacctgacccagcgcctgggcgacaccggcgcggcctcgcccttcgttggcatcgccctggcgaccatggccagctacctcaacggcgacagcagcatggtgatgccgttgcggcgcaaggaccaggcgaccctgatcggcatcagctcgccgacgcctgggaagaagcccgctcacgacccgttcggcgtcgacctgctgccgcagaccgccagcggcgacggtccgccgccatcggccgacccggtggcgcccgccagtcggctcacgacccggttgccgcccggcgaagactatgccctggaagagttcctgagcagcctcaaacccagcaccgactggcaggacgatttgtag

SEQ ID NO: 15569 - DNA, 984 bp, Pseudomonas aeruginosa
ttctgcatgctcggatgccgttcctaccaggactcccacaggagcaacaggatgcgctcatggcatggcgtagtcacgaaaatcgccaagcaaggcaagggcgccgtggtcaagaatcgactcggcccggaagagcttctggtgcccttcacagtgagtacgctcgtcgaggtcgacctggacgcaaggatctacggaacggatgtggacgacacgccctgggcggagggcgacgaacgaaaggaggtgctggtcggtaccgaagtagaactgctgaccgatacggatacctttcctacccatgcgtcccaggtgctcagcgccaatttccgtttcgccctcgacatcgtcaagggagggctcagcggcccggtcaggaaaggggcggtcctggtcatctaccacgacttccagcaggagatccggagaggcgactccggcagcgccttcgcggaggcggtcgtcgcctatgcgcggaacaagctctacaagccggccttcgcgatcaaggcagataccaactacgcccagttggttcgggatctaggcaaggttgccgcggagagcggcgaacagtacttcatcgatacgatcctcatcgccacccacggcacggctggccaactctggctgggcaacccccacggcgagagcaccgcggacgtcatggcccggcgtgtccagggcaagcagttcgtcgagccccaggcctttggtgcgacccttctcgaactgttcggcaaggaactggccatcgccctctacgggtgcgacttcgccggggacgaggacggagaagcggcggccctcgagctgcgcatcgccgccaacgcgagagcggtctacgccggcaagggcacggtgtatctcaatgccagcaaagagggtcgttccacggtgacctgcagcaaggcgatggtggtctaccggaccgacaagatcgaggtactgggtggaaaccaggtaccggtattcgatatctga

SEQ ID NO: 15570 - DNA, 1797 bp, Pseudomonas aeruginosa
cgctcttgccggcgccacgaaaacaatgctgcccacgccaccagaagggtgagtacgccggtgacagccgtgatcgcatccataatgcccgctgtatcgcacgcttccatgtttcctccacgacggcgctcgccgatcctgtgccgcgactgcgcaaggaagcttgccagggcttccaaccagccatatatcttgcctaggtggcgaccttccggccagcccgcgaaccgaccgggctccgcttgcctaaagaacgcatcagcacataagatgcatgcacacgcacttatatggagtggcgagccgatgaaccgcagcgccctggatttccgccacttcgtcgaccacctgcgtcgccagggtgacctggtggacgtgcacaccgaggtcgacgccaacctggagatcggcgccatcacccgccgggtctacgaacgccgcgcacccgccccgctgttccacaacatccgcgacagcctgcccggcgcgcgggtactgggcgcgccggccggcctgcgcgccgacagggcccgcgcccattcgcgcctggcgctgcatttcggcctgccggaacacagcgggccgcgggacatcgtggccatgctgcgcgccgcgatgcgcgcggaaccgatcgcgccgcgccggctggagcgcgggccggtgcaggaaaacgtctggctcggcgagcaggtggacctgacccgcttcccggtccccttgctccatgagcaggacggcgggcgctatttcggcacctacggtttccacgtggtacagacgccggacggcagttgggacagctggtcggtgggccggctgatgctggtggaccgcaacaccctggcgggtccgaccattcccacccagcacatcggcatcatccgcgagcagtggcgccgccagggcaagccaacgccctgggcgatggccctcggcgcaccgccggcggcactcgcggcggccggcatgccgttgccggagggggtcagcgaagccggctacgtaggcgccctggtcggcgagccggtggaggtggtgcgcacgcagaccaacggcctgtgggttccggccaatgccgagatcgtcctggagggcgagatcagcctcgacgaaaccgcgctggaaggcccgatgggcgaataccacggctattccttccccaccggcaagccgcagccgctgttccacgtccatgcgctgagcttccgcgaccagccgatcctgccgatctgcgtcgccggcacgccaccggaggaaaaccacaccatctggggcaccatgatttccgcgcaactgctggacgtggtgcagaacgccggactgccggtggacatggtctggtgctcctacgaggcggcgacctgctgggccgtgctgtcgatcgacgtacagcgcctggcggccctgggcaccgacgccgcggccttcgccgcacgggtcgccgagaccgtcttcggctcgcatgccggacacctggtgccgaagctgatcctggtcggcaacgacatcgacgtcaccgagatcgaccaggtggtatgggcgctggcgacccgcgcgcatccgctgcacgaccatttcgccttcccgaagatccgtgacttcccgatggttccctacctcgatgccgaggacaaggcacgaggcagcggcggtcggctggtgatcaactgcctgtacccggaacagttcgccgggcaaatgcgtgccgctacggcgtcgttccgccacgcctatccgacggcgctgcgcaggcgagtcgaagaacgctggagcgactacggattcgccgacgcctga

SEQ ID NO: 15571 - DNA, 981 bp, Pseudomonas aeruginosa
gaacggctccggaggggcgcgtatgaaaaccgtggcacaactgttgaacgccaagcagaaccagcaggtgtacaccatcggagcggacgagatggtgctcgacgccctgcgcctgatggcggaaaagaacatcggcgcgctgctggtggtgaaccatggcgaggtggtcggggtggtcagcgagcgcgactatgcgcgcaagatggtcctcaagggccgttcgtccatcggtacgccgatcagcgcgatcatgagcgcgccggtggtcagcgtggactcgaagcagagcgtcgacacctgcatgaacctgatgaccgatcgccacctgcgccacctgccggtcgtggaagacggccagttgctcggcctgctgtccatcggcgacctggtcaaggcggcgatcgccgagcaggccgagctgatccagcaactggaacagtacatccgcggcgactgaagcgtacatgccggccctgcccttttcccgccggctcacgcgataatccgcggctgttcccgttgcgagccgccgccatgtcctctccgccgaagatccgccgctacattcccgccgaccgcgatgccaccctcgccatctggctggaggcctcgcgcgtcggccacggtttcctcggcgaagccgagttgcagaagcagaaggcactggttcgcgatcattatctggatgcctcggaaacctggctggcgctggacggcgatacgccgctgggcttcatcggcctgctcgatgccttcatcggcggcctgttcgtcgccccgacggcccacgggcgcgggatcggccggcaactggtggagcacgcggcaaccctgaagggcgcgctggaagtcgaggtctacgccgccaaccgcgaggcgctggggttctacgcgcgctgcggcttcgtcgagagcggccgacgcccgcgtgatgacgagggacgcgcgctggagatcgtccagttgcgccgcgaacactag

SEQ ID NO: 15572 - DNA, 1638 bp, Pseudomonas aeruginosa
ccctgcgcggccgcggcgcgacgcaaccgacggcaggcgagtgagcggacgccgataatcgaacgctttcgtcccgtcggcgacggcgtccggtttacaaaagtaaccgttcggtacattttcccggcatcgatgacatcattgctgtggaggctgcgccatgacgcgcacggtactggtcctgaacggccccaacctgaatctgctcggcacccgcgagccacagacctacggccggcggaccctgggcgaaatcgccgacgaatgcgcggccttcgccgagacgcgcggcttcgccgtggacttccgccagaccaaccaggaaggccaactgctcgactggatccaccaggcccgcggccgggtcgccggcatcgtcatcaaccccgccgcctggacccacacctcggtggcgctgcgcgacgccctggccgcggtggaactgccggtggtcgaagtgcacctgtccaacgtccaccagcgcgaagcgttccgccaccactcctacgtctcgccggtggcgctgggagtgatctgcggattcggcagcctcggctaccgcctggccctggaacatttcgccgagcgtttcgaggcggccgcatgagcgcgccgcgatcggttctcgccggcctgatcggtgccggcatccaggcgtcgcggacccctgccctgcacgagcgcgagggcgacgcccagggcatccgctatctgtaccggctgatcgatctcgacccgctgggcaagtcggcggacgacctggagttcctgctcgccgccgccagcgacctcggcttcaccgggctgaacgtcaccttcccctgcaagcaggcgatcatccccctgctcgacgacctctccgccgaggcacgcggcatcggcgcggtgaacaccgtggtgctgcgcgatggccggcgcatcggccacaacaccgactgcctgggcttcgccgagggctttcggcgcggcctggccgacgcgccgcgccagcgcgtggtgcagatgggcgcgggcggcgccggcgcggcagtggcccatgcgctgctcgccgagggcgtcgagcggctggtcctgttcgacgtcgacccggcgcgggccccaggccctcgcggacaacctcaaccagcacttcggcgcgccacgagcgctcgccggcagcgacctggccggcgccctgggcgacgcccagggattggtcaacaccaccccggtgggcatggccaagctacccggcatgccggtgccggcggaactgttgcgcgccgacctgtgggtcgccgaggtgatctactttccgctggaaaccgagctgctgcgccaggcccgcgccctcggctgccgcacactggacggcggcaccatggcggtgttccaggcggtgaaggcattcgaactgttcagcggggtgacggccgacgccgcgcgcatgcaggcgcacttcgccagcctgggcgactgagtggcgcccctctcccaccaaggggagaggggaccggagtcaggcacggatgtagcgcaataccgcctcgccaatcatccgccggtgccgctggcgaacctcggcgtcgtgcaggtcggtgcgaaagatccgcgacacggtgtagcgattggacacccggtagaagcagaacgaactga

SEQ ID NO: 15573 - DNA, 2052 bp, Pseudomonas aeruginosa
gaagagcacctgccggagccccgacaattctcacagcttgacccggcgcacaccccgccgcgcttgcgccatcgccgccaggcgcaccggcacgttggccgcgccgtagccggcgtagccgtggcggcgctggaggatctcgaagaagaagcgctcctcgaacggctcggtgaacacatggaacagctcgccgccctgggcgtcgcggtcgtagaggacgttgtagtaggccagttcgctgaggaactcgtcgtcgaagtcgaagcgcgcggcgaggtcgtcgtaatagttcagcgggatttccagcagtgcgaccccggcctccttggcctgggccacggcggcgaagatgtcggcgcaatcgaaggcgatgtggtgcacgccggaaccgcgatagctggacagcgaacgggcgatggcggtgttgcggtcctcggaaatgttcagcggcaggcgcacgctgccgcaggggctacgcacggcgcgactggtgaccaggccataggggtcgggcagcaccacctcgtcatcggcgccgaagtcgaacaggctcttgtagaacagcacccagctgtccaggccttcggcgggcagcgccagggccacgtggtcgacgcgccgcaggccgaggccggaggtgtcggcgtcgttcgtcacgaagtcgctgtcgtagatgctgcggccctcggtgtgccgctcgaccagatacagcaggctgccgtcgagggcgcgcaccgccgggatttcccgctcgttggggccgagcagtccgcggtacggctggcctccgtacgcacgagcgcgctccagcgcctggccggcgtcacgcacgcacagcgcggtggcgcacaaggacggtccgtgggcctcgaagaaaccgtgggcgaaggaatagggctcggcgttcagcaccaggttgatgtcgccctggcgcaacaggctgacattcttcgaacggtgctcaccggccctggcgaagcccagtcgttgcaaccactggccaaggcgcgcgccgagcgtctcgtcgacggcgaactcaaggaactcgatgccgtcgcagaggttcgccggcggcggcgcgaacagctcgtccaccgccacgtgcggcgtctggcgttgcaggcgctcgcgggtcttctcctcgaggtagagcagcgagcgcaggccgtcgacggcgttggcgcgggtcggcgcggcgcggaagccgtcgttgaagacctccagcgacagcggaccgcgatagccggacgcgacgaccggcgcgaggaagcctgccaggtcgaagccgccctgacccgggaagcagcggaagtgccggctccattccagcacgtccattgccagcaagggcgcgtcggccatctgcacgaagaagatcttttcccccggaagatcggcgatgccgcggggatcgccgtccagcgagagggtgtggaagctgtcgaggatcagcccgaggttcgcctggtcggcccgccgcaccaggtcccaggcctgctcccaggtgttcacctggcgcccccaggccagcgcctcgtagccgatgcgcaggccgcggacggcggcgcgctcggccagctgccagaggtcatcggccagcagcgccggttcgccgagggcatcggcagcgacgttgctgcacaccagcaccaggtcggtgccgagttcctgcatcaggtcgaacttgcgttcggcgcgctccaggtttcgccccaggcgttcccggcggcagccctcgaagtcgcggaacggctggaacagcaggatctccaggcccaggtcggcacacagccggcgtacgtcgcgcgggctgccgtcgtaatgaagcaggtcgttctcgaagatttccaccccgtcgaaaccggcggcggcgatggcctcgagcttttccggcagggtgccgctcagggatacggtggcgatcgaacgctgcatgcttcgactcctcaatgcgccctacggcgcctggcgccgcgcgagggccggcggcggaacggcggaggcgcggatagcccgcgcgggatgcgccgggaagccacttcgggtcgctga

SEQ ID NO: 15574 - DNA, 843 bp, Pseudomonas aeruginosa
agaacaagaacgaagggacacacccatgtcgcacccgagccacgtccgcgcgctctgcgcttccctctgcctgggcgccggcctgccagtccatgccgggcacgtccacgccgggcaaggtttcctcgaagacgccaaggccagcctcaccgcgcgcaatttccacctgcaccgcaacttcgtcggcgatgccagccagggcaaggccgaggagtggacgcagagcttcatcctcgacgcccgctccggcttcacccagggcagcgtcggcttcggcctcgatgtcctcggtctctacagcctgaagctggatggcggcaagggaacggccggcacccaactgctgccgatccacgacgacggccgcccggccgacgacttcggacgcctggcggtggccggcaagctgcgcgtctcgaacagcgaactgaagatcggcgaatggatgccggtgctgccgatcctccgctccgacgatggccgctcgctgccgcagaccttccgcggcggccagctcagcgccaacgagatcgccggcctgaccctctacgccggccagttccgcggcaacagcccgcgcaacgacgcaagcatgcaggacatgtcgctgttcggccggccagccgccacttccgaccgcttcgatttcgccggcggcgaatatcgcttcaatggcgaacgcagcctgctcggcctgtggaacgccgagctgaaggacatctaccgccaacagtacctgcaactgcaacacagccagccgctcggcgactggctgctgggcgccaacctcggcggattccgtggccgcgacgctggcagcgcgcgcgccggcaagctcgataa

SEQ ID NO: 15575 - DNA, 954 bp, Pseudomonas aeruginosa
ggggtcgcctgtcgccacggcctccacgctggccgccagcgggtcgtgccagccctgccgggcctcggcgtagcgccagcggcggagctggggaaggctcagggcaccctcggtgccggccagcaggtagcagggttgctcggcctggcgtggatagaccgggttctccccggctgccagctcccagctccagggcgccgccgcagcgtcgcaaccggtcaggctgcccagggcgccattggcgaagcgcaggagcagcgcgatgttgtcttcgttgggcaggccacggatagcgttgccggccagcgcctgcacctcccgcacttccccgcacaggtggcggagcaggtcgaggtcatggatcaggttggtcagcaacattcccgcaccgggctcgcgacgccaggccacctcgaaataactgtcgggcttcttcaactgccagagcgcggtgaccgacagcaaccgaccgagcgcgccctcggcgatcaattggcgcgcccgcacgaccagcggattgtgccgacgatggtgaccgaccagcagcggaacgccagatcgccgggcgacggccaccagctcgctcacttcgtcgagctgcacgccgaccggtttttccagcagcagcggcaccccggcggcgaggcagtcgagggcggtggcgacatgcaggttgttcggattggcgacgatcgccgcttgcggccgggcttcttccagcaacctccgatgatcgccgaaccagggcacgccggcatccgcggcgaacgcctggccctggggatcggccaccgcacacaggcgcgcgccggcgattcgctgcaagcggtggtaatgctggcggcccatattgccggcgccgatgagggcgatgcgaagcggtgcgtccaaggcggtccccaatcgttgttttcttgttcgcttcatgattccagaacgtcgttccagatttag

SEQ ID NO: 15576 - DNA, 753 bp, Pseudomonas aeruginosa
tcctgctgttccgcctgccggaatcggcgcgctacctggtggtgcgcaaccgcggcagcgagcgggtacgccaggtgctggcccccatcgccccggcgcaggtggcgctggcacggagtttccacgtccccgagcagcagacggtgcaggccccgcaacgtgttcgcggtgatcttttccggtacctacagcgccggcaccctgctgctctggctgacctacttcatgggcctggtgatcgtctacctgctcaccagctggctgccgaccctgatgcgcgatagcggcgcgagcctggagcaggcggcgttcatcggcgcgctgttccagttcggcggggtgctcagcgccgtagcggtgggctgggcgatggatcgcttcaacccgcacaaggtgatcggcctgttctacctgctggcgggggtgttcgcctggtgcgtcggccagagcctcggccaggtcaccctgctggcgaccctggtgctgctggccggcatgtgcatcaacggcgcgcagtcggcgatgccgtcgctggcagcgcgcttctatccgacccaggggcgggccacgggggtctcctggatgctcggtatcggccgcttcggcgccatcctcggcgcctggatcggcgccaccctgctgggcctgggctggaacttcgaacaggtgctgaccgccctggtgctgccggctgcactggccaccgccgcggtgctgctgaaggggttggtcagtcacgcggatgcggggtga

SEQ ID NO: 15577 - DNA, 1053 bp, Pseudomonas aeruginosa
ccaaagaacagaatatcgaacataccgatgccgaaacggcatcagcggacgggcaagctcgggcaagccgtctggcatcggcgcgagcgccgctcaggcctcgttcaggcgcgcttcctcgcgctcgcgcaggcgcacttcctcggcgatctgccgggccagggcgtccaccgccaccggcaggtaacggccggtgcgcacgtagaggccgaggtcgctgtggatgccgccattgtctttcagcggcaggaaacgcagctcgccctgggcgatgtcggcctcgatccccaggcgggtctggaaggcgacgccgagcccgcgccgcgccagttgtcgcgacagctccagggagctgctctccagcaccgcccggcgcggttcgcgcaaacggcgctggagcggcgccagcaggtgatggatggacagctcgctcttggccatgatcaggccatgttcgacgcaatcggcgaaggcgatggcctggtgtcgcgccaacgggtgctgcggggagacgatggcaccgaggcggaaatggccgacgctgacctgttgcaggtcggcgctgcgcggcagggcgaaggccaggccgaggtcgaccgcgccactgctcaccgcctcgggtatcgcctgggaaccgagcagggtgacgccgacggtgatgtccgagtagcgttcgcgcatcgccttgagcacgcagggcagcaggtcgctggtcaccgcttcgatggtggcgatctccacatggccggtgcgcaggccttgcagcgcgtccagttcggaacgcacgcgctccatgtcctgcaggaccacggtgacgtggcgcgcgaagatctccccggctccggtcaggcgcaggccgccgggcaggcggtcgaacagcggcgcgccgatctcgtcctccagcttgaggatctgccggttcaccgccgacgaggcgacgttcaggcgccgcgcggcttcgcggatcgaatggcagcggcgaaccatgtcgaagtagtggatcgcgggcgcgtggatatgcagcttgcggctcatggcggaccgaagggatga

SEQ ID NO: 15578 - DNA, 1203 bp, Pseudomonas aeruginosa
ccgccgttggccctcggggtatcggcggataacgcctgcgacgccattcgccctaccgctagcgccgccggcgacctaccgggacgcctgctgcgactccacgccaagctcgtcccacaccgattcggcgaggtggaaggtcgcgttggccgcgggaataccgcagtagatggcgctctgcatgatcacttccttgatctcgtcgcggctcaccccgttgttcttcgccgcgcgcagatgcagcttgagttcctcgttgcggttcatgccgatcagcatggcgatggtgaccaggctgcgggtgtgtcgcggcagccccggacgggtccagatgtcgccccaggcgtggcgggtgatcatttcctggaactcttcgttgaacggcgtcaggttggccaggctgcgctcgacatgggcgtcgccgagcaccgcgcggcgcacttgcatgccggcttcgtagcgttgtttctcgtccatcggcggggctcctcaggcggacagcaggaaatcgaccaggcggcggctgaaggcgtcgcccgcttcgacgttggacaggtgcgcggcggcgaactcgaccaactgcgcgtcggcgatgcgcgcctgcatgaagcgggcgttgtccggagtggtcacggcatcgtggctgccggcgacgatcagcgtcggcgcctggaccagcccgagctgctcgcggaaatcggcgtcgcgtaccgcagcgcagttggccgcgtagccctgcggcgaggtggccgcgagcatcgcgacgatgcgctcgacctgcgccggttcgcgctcggcgaagcccgcggtgaaccagcgcgccaccgaggcgtcgcgcaggacacgcatggcctgctcgccgcctttcaggacggtatcgatgcgggtgttccagacctcgtcgctggcaatcttcgccgcggtgttgcacagcaccagccggccgagccgctcgccggcgtggatgcccagccactggccgatcaggccgcccatggacagcccgcagaaatgcacgcgcggcagctcgagggcatcgagcaaggcaagcacgtcggcgccgagctggccgatggcgtacggtccgggggtgaccagcgaggcgccgtggccgcgggtgtcgtagcgcagcacgcggaaatgggcggtgagtgcggggatctgcgtgtcccacatgcccaggtcggtgcccagcgagtttga

SEQ ID NO: 15579 - DNA, 1521 bp, Pseudomonas aeruginosa
caacagcaggaccggcgcgccggccggtccttccagggagtagttcaggtcgccgtcggcgaggcgtacggttggcacgaaggggatctccagtcaggcgggatggggttcgaagcccagggcatggtgttcggcgagcgcgcgctcgacccaggcgcgggcctggccgaggtaatgggcgggatcgagcaggcggtccagttcgtcgccggacaactcggcgctcacccgcgcctcttcgccgagcaccgcgcgcaactcgcggcgctgctcgacggcgcggcggcagcactgttccaccagatggtgcgcggcttcgcggccgatacggcgggccagggcgatgctcaccgcctcggcgagcaccaggccgtgggtcaggccaaggttgcggcgcatccgctgggcgtccacctccaggccttcgagcaggccgatcgcctgttgcagcgcgccggcaaccaggcaacagagttccggcagggtttcccactcggcgtgccagagaccgaggctgcgctcgtgttcctgcggcatcgccgcgaacagggtcgagaccagccccggcgcacgggtggcggcggcgatcagcaccgcgctgctcaccgggttgcgcttgtgcggcatggtcgaggaaccgccgcgcccggcgccggccggctcgaagacctcgccggcctcggtctgcatcagcaggctgacatcgcgaccgaacttgccgaggttaccggccaccaggccgagcacgctggcgaattccaccaggcggtcgcgctgggtgtgccagggttgttcgggcagagccaggcccagctcctcggccagcgccgcggccaccggcagggcctgttcgccgagcgcggcgagcgtccccgaggcgccgccgaattgcagcaccagcaggcgcgggcgcaactcgcgcaggcgctggcggtgccgggtcaaggcaccgagcaggccggcgagcttcatgcccagggtcaccggggtggcgtgctgcaaccaggtgcgcccggccagcggcgtgtcggcatgccgttcggcctggtccgccaggacctcggcaagacgttgcagatcctgctcgagcaaggccagcgcacggcgcagttgcagcaccaggccgctgtccatggcgtcctggctggtggcgccgagatgcacgtagcgctcggcctcggcgtcgccagccgccacctggcggcccagcgccttgaccagcgggatcgccgagttgccggcagtggcgaccgcctcggccagcgccagcgggtcgtacagttcggcgcggcaggccgcctcgatcggcgccaccgccgtcgcgggaaccaccccggtgcgcgcctcggcgcgggccatggcggcctcgaagtcgagcatgccttgcaggcggccgcggtcggagaacaccgcgcgcatcggcgccgccatgaaataggcatcgaacaactggttggcgggtatgtcgctcatcggttttccttttcccggcccgtcagggctcgtcgttcaggtagctga

SEQ ID NO: 15580 - DNA, 1992 bp, Pseudomonas aeruginosa
ggaagccggcggcgaagaccccggcggtgttcagcaactgcaccgtggggttgtcggaggggaagaaggccggtgcgaagtagatcgcgcagaaggcgtagacgtagaagtcgaaccattccacgaggttgccggaggaggcgccgacgatggcgaagatgcgcttgcggcgttcttcgttgctgtactggtgaacaggggcagtcatgctgttgttctctcgacagggtccgtttcatcctgaccgtgcgacggagcgtcctgttccgctgcacacgcgccgcgccgccgccgaaacatgggcagcgccgcgcgacgcgcgctcttgataccgggcgggcgacccggttgtgccagtcagacccgctcgatggccagcgccaggccttggccgacgcctacgcacatggtcgccaggccgcgccggccgccgctcttctcaagttgatggagcgcggtgaggaccagccgcgcaccgctcatccccagcgggtggccgagggcgatggcaccgccgttcgggttgaccttctcactgtcgtcggccacgcccagttcgcgcaggcaggccaggccctggctggcgaaggcttcgttgagttcgatcacgtcgaaggcgtcgatcgccaggtccaggcgccgcagcagcttgcgcaccgccggcaccgggccgatgcccatgatccgtggggcgacgccggcgctggccatgcccagcacccgcgcgcgcggagtcaggccgtgcttctccactgcctcggcggaggccaggaccagcgcggcggcgccgtcgttgaccccggacgcgttgccggcggtgacggtcttctccggcccgttgaccggcttgagccgggccagcgcctccagggtggtgtcgggacgcggatgctcgtcgtgctcgaccagggtgtcgcccttgcgcccgcgaatcgtcaccgggacgatttcctcggcgaagaaaccggcctcctgcgccctgccggcgcgctgctggctgcgcagggcgaaggcatcctggtcggcacgcgacacgcgatagtcgtcggcgacgttgtcggcggtctgcggcatcgggtcgatgccgtactgctccttcatcagcggattgacgaagcgccagccgatggtggtgtcctcgatcttctggccgcgcccgaaggcgctatcggccttgcccatcacgtacggcgcgcgcgacatcgactcgacgccgccggcgatggccagctccatctcgccgcaggcgatggcgcggaacgccgtgccgatggcgtccatccccgaggcgcagaggcggttgagggtgacgccgggcacgctctccggcaaaccggccagcagcagcgccatgcgcgccacgttacggttgtcctcgccggcctggttggcgcagccgaggaacacctcgtccaacgccgaccagtcgacccccgggttgcgctcgaccagggccttcagcggcaccgccgcgaggtcgtcggcgcgcaccgcggaaagactgccgccgaaacggccgatcggcgtgcgcacggcatcgcagatgaatacctcgcggctcattcgtcgctccccttctgtccatgggcggccgcggtgcgcgcctcgaggtcgcgcagcgcggcgagttcgacctcgctcggcgcgggcgtctcggagacccgctcggcgaagcggatcgcccagccggtggcctcgaccacctgctcgcgggtcacgcccggatgcagcgaagtgaccacgaactcgttgctgccggcttccggctccatgatgcacaggtcggtgatgatcgccaccggccccttgcccggcaagcccaggcgctggcgcgagtcgccaccctcgccatggccgaccgaggtgacgaaggccagcttgtcgacgaaggtgcggtgcgactgcttgaggatgatcagcacttccttggcgctgccggcgatttccggcgcgccgccggctcccggcaggcgcaccttgggctggcggtag

SEQ ID NO: 15581 - DNA, 966 bp, Pseudomonas aeruginosa
gctgaacgacctttcccaccaggtccgtcctggcatttcccactcaatgtcacgggtacatccaatgtccgcatccatccacggcatcatcggctacaccatcacccccttcgccgccgacggaggtctcgacctgccggccctcggccgctccatcgagcgcctgatcgacggcggcgtgcacgccatcgccccgctcggcagcaccggcgaaggcgcctacctgagcgacccggaatgggacgaggtggtcgacttcaccctgaagaccgtcgcccatcgcgtgccgaccatcgtcagcgtctccgacctgaccaccgccaagaccgtgcgccgcgcgcagttcgccgaatccctcggcgccgaggcggtgatggtcctgccgatctcctactggaagctcaacgaggcggaagtgttccagcactaccgcgcggtgggcgaagctatcggcgtgccggtgatgctctacaacaacccgggcaccagcggcatcgacatgtcggtggaactgatcctgcgcatcgtccgcgaagtggacaacgtaaccatggtcaaggagagcaccggcgacatccagcgcatgcacaagctgcgcctgctcggcgaaggccgggtgcccttctacaacggctgcaacccgctggcgctggaggccttcgtggccggcgcgaaaggctggtgcagcgccgcgccgaacctgatcccgacgctcaacggccagctgtaccaggcggtgctcgacggcgacctggagaaggcccgcgcgctgttctaccggcagttgccgctgctcgacttcatcctccgccggggcctgccgaccaccatcaaggccggcctgggcctctccggcctggaggtgggggcgccgcgccttccggtgcaggcgctggataccgagggctgtcggtatctgcaggggttgttggaagagctgcgctgatcaccccgtcagcgctttga

SEQ ID NO: 15582 - DNA, 1383 bp, Pseudomonas aeruginosa
cccgacgggcccggacgacttggggcccgtcgttttttttgccgacgcgcagcgcgctcagcgcgccgcccaggcattgaaacgctgttccagctcctcgccgtggtccacccagaactcggcatccaccgcccgcgcgccttcgaggttggccggcgcggtcggcagcgcctcctgcaccgtcttcggcagcaacgccagggtgcccttgtgtaccggcccgtaggggatctgctcggagaacaccttctgcgtctgcggctggctggcgaaggcgatgaatttctccgccagcgccttgttcggcgtgcccttcaccaccgcccagtactccggatcgtagagactgccgggccagacgatggccagtttcaccccctccttctgcgcagcggcgatgcgcccgttgtaggccgcgctcatcaccacgtcgccggccgccagccattgcggcggctgggcgccggcctcccaccactggatgttcggcttgagctggtcgagcttggcgaaggcgcggctgaccccctccggggtggcaagtaccttgtagaggtcctccgccttcaccccgtcggccagcaacgccacttccagggtgtacttggcgcccttgcgcaggccacgcttgccggggaactcgcggacgttccagaaatccgcccaggactgcggcgccctggccagcttcgtcgagtcgtaggccatcaccatcgaccagacgtaggtggccaccccgcactcgctgaaagtgccggggacgaactgcgcggggtcgccgaaacgcgccgggtcgaggcgttcgaacagcccctcgtcgcagccgcggagcagttcggggctctccacctcgaccacgtcccagctgaccttgccgacgtcgaccatggccttcaccttggccatttcgccgttgtattcgccggcgaccacctgcccgccgccgcttcgctcgaagggtttgaaataggcctgttcctgggcggccttggtcgcgccgccgaaggagatcaccgtcaggctctggctctgcgcctgggccgccgcggcgaacgccaggccgaacagggacaaccgggaaaacacgtgtgcgtactggtgcaaggacttgaacatggaacactcccacagccgattggcattgttgtgatgttgctgaggcagttgccggccagaggccgaaacggttccgcgcgcggtcgccaggcgccgcatcgtcgttatggggggacgctccgtgtcgcagtcgacccggccgaggccgggccgccggggcgcgtcagagcacgccgatctcgcgggcggtgcgatccaccgcgatacgggtcttgtcgatcagttcgtcgatctcggcacgcccggccaccagcgccggggccatga

SEQ ID NO: 15583 - DNA, 309 bp, Pseudomonas aeruginosa
agagcatctcggaaagctccaccaccgccgggtgggtggtgtggaagaacatgttgtagtacggcagttgttccagctggcggctggcggcggcggcgaggtcctggcggccgtagccgaggttggtgcaccagaggccggacatgccgtccaggtagcgcttgccgtcgttgtcccagagctgcaggccatcgccgcggaccatcacccgcgggccttcgcggttcagcgccttctggtcgaggaaggcgtggatgtggtgcgcggcgtccagttgctggtagtcgcgggtgtcgcgctgcgggttga

SEQ ID NO: 15584 - DNA, 261 bp, Pseudomonas aeruginosa
agaacatggagctggacgccatcctggtgtcgctcaacgacagcgtcagcgatcccgactgcgagcacctgccgctgttctccgatgacatcttcctcgccgtgccggtggactcgccctacgccaggctcgccgagatcgatctcagcaccctgcgcgacacgcccttcgtcacgctcacccagggcttcgccacccatcaggacggcacccgggtgttccagcaggccggcttcgaaccgcagatcgccatgcaggtga

SEQ ID NO: 15585 - DNA, 231 bp, Pseudomonas aeruginosa
  unsure (29): Identity of nucleotide at the above locations are unknown.
ccgaacgccatggccaccgcgaccccggngacgaaggacgaaccgactccgaggaacagcgacaccaccccggaaacccctgcccgacgcagttcctcgacattcaccccgaaggccgtggcgacgatggcgaagtcgcgcagcatggcgccacccagcaggccgattccggacatcaggggcacgtccaccaatcctttctgcccgccggtggcgacgccgccgacgtag

SEQ ID NO: 15586 - DNA, 531 bp, Pseudomonas aeruginosa
  unsure (306),(379),(403): Identity of nucleotide at the above locations are unknown.
tcattattgttgtcctcggttgcggatcgatgttgttgtttttatgcctcgaacgaacgcttatcgggttctcttttcctcctcgcgcaacagcgcgtccagggtatccgcccgggagccttcgaaggccggcgtggcgcagccgaacagaggccgcgccagaccgctgaggacccgtcccggcggcagctcgagatgcaggcgggcaccgcgctcgtaggcgctgcgcaatgtcgccagccactcgacgcggcgcgccatgttgccggcgagatcgtcggccagcgcggccggttcggcgaccangcgcgcccggctgctgctcatgtatgggcacgcgcggccgatgcaggcggatgccggcgaaggcttcggccangcgcgcggccggttcgtcgagcancgcacagtgcgacggtacgctcaccgccaggcgcttcgccgcgctggcgccggcgggcacggcgcgttcggcgaaggcgggcaaatccgcttcgctgccggccaccaccagttgccgctcggcgttga

SEQ ID NO: 15587 - DNA, 969 bp, Pseudomonas aeruginosa
gctatgactgaaaatctggtccactcttcaaccagcgggatctcggcagaattcggctattacccagcaacttgcgatatcgagagcgaacagttttccattcaaacgcttcccaaccacaggcagaccgtctcctctatcgttgaagatgtaaatgtcgtcgacggctggctctacccgagaccacagaaacgattggatttcgtgagcagaacggtccgatcaatgccctatagcagtcgcgtcttcgggctgcccaaaactcatgctttgacacttcatagaagcaagaaccaagacgacctcgactttgtagtctggtgcctatccttttttattggcatgcgcctgacgactacagaggtgggctttcttgatgcgactcctgttaagccacacaagctcgttgacttcgtccttcaccgctgcacgctaaacgaagctgtgcatttggcactcaacttcctagagcaggagcacgatgctcctcgtgcaaccaagagagtcgccgcagtcattcatgccttgttcttggcacaataccctcagagtcttccttttgagcggtttcagtacctctacatggcattagatggctgtttcaagcttctcaaagtcagagaggaagccaatgtaagcgtgtctcatgcaggacgaatccaatggatgtgtaaaaaattcaacatccccttacccgaatgggcagagagccaagcaggaccttcgcccctatcaactgcccgtaacgatgctatccatgaagccctattcttcgatgaacctttagggttctcgatttacggtggtaacaagcctgatggaaatcctaccaacgtcaccctgcaaatgagggcattggtatgtcgacttctggtcgccatcctcggaagggctgataccatatatgtcaaatccccagttaacacccgaatgatacatagccttgagttgtcagatcgcgtcacctaa

SEQ ID NO: 15588 - DNA, 438 bp, Pseudomonas aeruginosa
ctccagtcttcggaaatctttcgcagcagcgccgccgcttcagcgggcgacgccgtgctcgtcgaacagtttcagcaggccgtcttcgtcgagcaccttcacgcccagctcgttggccttggccagcttcgagccggcgccgggcccggcgaccacgcagtgggtcttggccgacaccgagccggccaccttggcgccgagcccttccagcttgtccttggccacgtcccggctcatcgcctccagggtgccggtcagcacccaggtctgcccggccagaggcaggccttcgaccgccttgcgctcgctctgccaatgcatgccgaactcacgcaactgcgcctcgatggccagggcacgctgcacgttggccggctcgtcgaagaaatcgcgcaggcttttcgccgctcgctcgggcagacgctccacctggcgtag

SEQ ID NO: 15589 - DNA, 2001 bp, Pseudomonas aeruginosa
atcgagccagtcggcgcggatgatgccgtcgagcgaaccgaagcggctggccagcttttccgcgccggtggcggcgatgaagggaatgttcagcttgtcgatgaaaccggccagcgaggcacaagcggcgaactccgcggcgacctcgccctcttcctgcaactgcacgccatgttcggcatcgcgcaactgggcgatcacctggcggttgtgctcgtcggcgaagaagttgtggatctcgtaggccacctcggcgccgacgtccggcaggtaggtcaacacttccggcagcgccttgccgatccgctcgagcgaacccagcgaacgcgccagcagcttggcggtttcctcgccgacgtcgggaatccccagggcgaagatgaagcgcgccagcgaaggcttgcggctgtcggcgatggccgccagcaggttgttggtggacagctcggcgaacccttccagctcgaacacctgttcataggtcagggtatagagatccgccggcgaggcgaccagcccgcgatccaccagttgctcgacgatcttgtcgccaagaccgtcgatgtccattgcccggcgcgatacgaaatggatgatcgcctgcttcaactgcgcctgacaggagaggcggccgacgcagcgatagatggcgccctcgctgatcgactccttgcccttgctgcgcttgaccaactgggtccgctccacggccgagccgcagaccgggcaatgctcgggcacctcgatagcctgcgcatccgccgggcggcgctcgagcaccacctgcatgacctgcggaatcacatcgccagcacggcggatcaccaccgtatcgccgatgcgcaggcccaggcgggcgacttcatccatgttgtgcagggtcgcattggacaccgtgacgccggccacctgcaccggcttgaggcgtgccaccggggtcacggcgccggtgcggccgacctggaactcgacacccagcagctcggtcagctcctcgcgcgcggggaacttgtgggcgatcgcccaacgcggctcgcgcgcgcggaagcccagttcgcgctggaaggcgatgcggttgaccttgaacaccacgccgtcgatctcgtaggccagcgcatcgcgtcggcgaccgatgtcgtcgtagtagtcgcggcaggcctgggcgcccttgaccaggcgcagctcgcgactgatggggataccccagccgcggaacgcctcgaggatgcccacctgggtgtccggcagcgacccgctgacctggccgaagccgtaggcacagaactccagcgggcgactggcggtgatcttcgaatccagctggcgcaggctgccggccgccgcgttgcgcgggttggcgaaggtcttgccgccggtttccacggccttggcgttgagcgcctcgaaaccggccttggacatgaacacctcgccgcgcacttcgaggatctccggccagccttcgccatgcagcttcagaggtacgttgcgaatggtgcgtacgttgctggtgatgtcctcgccggtgctgccatcgccgcgggtggcgccgcgcaccagttggccgcgctcgtagagcaggctgacggccaggccgtccagcttcggctcgcaactgtactcgacctccgcgccaccgccgagcaggtcgccgccaggcaacaggtcggccagtccttcgcgtacgcggcggtcgaagtccagcaggtcctgctcctcgaaggcgttgccgaggctgagcatggggatctcatggcgcacttcgccgaacgccgaggccggcgtgccgctgacccgctgggtcggcgagtcgggcgtcagcagttgcgggtactcggcctccagcgcctgcaactcgcggaacaggcgatcgtattcggcgtcgggaatgctcggttcgtcgagcacgtagtaacggtaattgtgggtgtccagttcggttcgcagttgcgcgatgcgttcggcggcagcctgggtgtcggtcatggtgggagtccgtga

SEQ ID NO: 15590 - DNA, 921 bp, Pseudomonas aeruginosa
ttcgccccctcccgtacgaagaaaggggctgtggccggatcagcgcttctgcatcaggctgcgacgctcatggtcgatgatgcgctggcggtagtgctcgatggtctgggcggtcaacacgctgcgctgctcgtccttcagctcgccgttcagctcgtgggccagcttgcgcgcggcggcaaccatcacgtcgaaggcctgcttcggatggcgcggccccggcaggccgaggaagaagctcacggcgcgggtgctgaagttgtcgatgtcgtccaggtcgaaagtgcccggtttcaccgcattggccatggagaacaggatctcgccattgccggccatgctttcgtggcgatggaagatgtccatgtcgccgaagcgcaggccgctctcgaggatgttctgcaacaatgccggccccttgaagccgctctcgtcgcgggcgatgacgttgatgatcagcacctcgtcgaccggggcaggttcggcagcaaccgcaggggctttctcccgctctttctccttgcggcccttcgacttgcccttgcgcggctccactgtctcggcggcatcgctcgggtccgcctccagggccagcccctcgtcgaggtccagatcgccctggcgcggctcttcctggcgcttgccgcccttgcgttccttggcttcgcgggcgctgacgctgggcaggtcctgttcgtcgaaggatggctcgcgatgctcgaccacgcgcgccggccccagcagttcagccgagtcgccgtcgtcgtccggcagattggcgaaactgcggtcgagcttgaacttcaacttgcccttgccgccccgcatccgccgccaaccgtccaagagaatgccggcgatcacgataagcccgataacgataagccattcgcgcagaccgatatccatgtaattccgtag

SEQ ID NO: 15591 - DNA, 891 bp, Pseudomonas aeruginosa
ccgtcttcggcgagctgctcctgcaaggctttgcgccgcaccaccagcccctgccactccaggcgctgctgctccagctggccacgcagcagttgcgattgctgctcggcctggccgcggcgcttctccacctcgcgcagttcgcgatcggcgtcttccagggccagccgcgcctgcttgagttcgtcctcgacggccatccgccgctccagcaactcctcgagcttcatgcgcagctcttccagcggtgccgccccctcctccagattgaggttgagctgttcgcaacgctcgttgaggcgcgccgactgctggtcgaggcgctccagggcctgctgggtggaattgtgctgcgccttcagcgagccgacccgcaccgccaactggtgcgcatggtccttgtgggtgcgggcatcctggcgaatccggtcgagccgttcgcgcagggcgtcacgctccgccagcagggtttcccggcgctcggtgtccagcgccatgctatccagcgcttcctgcagggtcaggcgcgcctcgctcagttgctcctgttccagcgcgcgctgctcggccagttccgccacttcttcgtcgagacggcggcgacgcagtaccagttgctcgaccttggcctgctgcgcggacaactgcgccttcagctcgccgtgccggcgcccctcctcctggacctggcgccgcacctgctcgcgcgcgccttccagctcgcgctgctcgtcgcgggccgcagccagacgctcctcgccttcggagacacgggtttccaggggctcccgccgctcctgcaacgcctccagttcctgggcgcgggcgatcatgccgccctgggcctcgtcgctgcgccggacccgcaggaagtgccggccgacccagtag

SEQ ID NO: 15592 - DNA, 1008 bp, Pseudomonas aeruginosa
ccatcgcgactgatcaggctctcgccgtcgtccagggcgccgcgctgggcgagcgcctgttccagggtctccaccggtttcacccgggccaaccagggactcaggtcggcgtcggcgcggaccttgtccagcagcgaaccggccgccgtcgcggctccgcgagcggggctgagcaggcgcagctcgcccttgccgaagccggccagggcgagcccgtcgaagccgtccagcaagaccgcctgcagatccgcgccgagcacggtctccaccgccagctcccaacccggctcgacacgcaagccttcggcgaggcgcggacgttgttccaggccctgctcgcgcaaccactccaaggcgccctgtccgggatcgagagcggcctgctgcagggcctccagcgaagcgatgcgcccgttcaggcgctgcaactcgccctgcgcctggtgctgttcggcggccagctgctgcaattcctggcgcaattgttcgagtcgctcggcttggccctgctcctgcaattgcagttcttccagggccagttcggcgatcgccacctgttcgttgagttcgaggatcgccgcgtcctcggggtcggccgccaactggccacgctcctcctgcaggcgccgctcgcgatcctgcaggcgctccaggctctgctccaggtgctggatgcgcgactgctgcacctcggcctggcggcggggttcggcgctctgctggttgaaggcatcccactgctgctgccaggcctgcatgccctgctcggcctgttccagggcgatgcccgcttcttccgcggcggccgcgctgagttcctgttccggtgcgagcatggccatttcctcggccagggtcgcgagcaaggtacggtcatgcccgaggtgcgattcggtttcctggcgggtccgttcggcttcgcgcaagtcgtcctgcaactggcgctggcgctgctggccatgctggatgctctgctcgacccgggcgatgtcgccgccgaccgaatag

SEQ ID NO: 15593 - DNA, 1191 bp, Pseudomonas aeruginosa
gtgttctgcccatcccgcgagacccgccggcgaatggatatctcggcgtactgggcgtattcgcccaccagtgtggtctcggcgttgtcgaagatcagctcgatgctcgcctggctcaccggcttgcgggtattcgagccgttgaagatgacatcggtcatcgactcgccgcgcaggttcttcgccgagctttcgcccatcacccagcgcaccgcgtcgatgatgttcgacttgccgcagccgttcggccctaccactgccgccatgttgctggggaagttcaccgtggtcggatcgacgaaggacttgaaccccgccagcttgatgctcttcaggcgcatgcgtgcgctcccgccagggtcgccatcagcgttcggcgagcgcggccagcaccagctggcagttgtggcggccgtattccagcaggacctcgcggatcctcgcctcgtcacgggcgatcaccgcttgcaggagctgagcaaaactgccgaggaactggttcatttccgccttgcgccgttccagcgccaggtggtaggcgcgactcaccgccggcagcaggttttcgacggtctcctgcaggtagggattgttcgcgaaaggaaaggccgcgcgcatgatgtcgaagctggcctcgacgaagccgtcgatatcgctttgcgccaggttgttcagcaggcgctgctggatgaccaggaacggtgccagctcggcttcgctgcgccagcgccgggcgacgctttccgccagcaggatgtagagctgcacgatcagcgcgtagaggctttccacatgttgcggggacagttcggacacctgggcgccgcggcgcggcaggatgttcaccaggtggcggcgttcgagaatcagcagcgcctcgcggaccgagccgcgactgacgttgagggtctgggtgaccttctgctcctggatacgttcccgttccttgagttctccccggatgatgcgttccgcgaggtggtgggcgatctgctctgccaggctgtccggggccttgaacgtcatggtgatccttttatccaggggcgcgttttccgggggtatatggatgggaagtgtaacacagggcgttaccccgccggcttcccggcgaagcggcggacagaacgaaggttgggatggggcaggccggtcaagggaggacaattgtcagacaatctaacaagataa

SEQ ID NO: 15594 - DNA, 1149 bp, Pseudomonas aeruginosa
atacgaggacttcccatgtttgcctcgctttcctctgcctggatgctgcgtctgaaaaagtacggctactggatctggctgatcgcggtgctcggcatcccgctcagctactggtggtcgctcggtagcgactaccccaacgcctggccctggctggtgatcagcgtggtgttcgggctgatcccgatcctcgatgccatcgtcggccgcgatccggccaaccccgaggaagccagcgaagtgccggagatggaagcacagggctactaccgcgtactgtccctggccaccgtcccgctgttgctgggcatgctcgtctggtccggctggatcctcgcccacgagacccgctgggactgggtcggccaactgggctggatcctgtcggtgggcaccgtgatgggcgccatcggcatcaccgtctcccacgaactgatccacaaggacccgcaactggaacagaacgccggcggcctgctgctggcagcggtgtgctatgccggcttcaaggtcgaacacgtgcgcggccaccatgtacacgtctcgaccccggaagatgcctcgtcctcgcgctacggccagagcctctactcgttcctcccgcacgcctacaagcacaacttcctcaacgcctggcgcctggaggccgagcgcctgaagcgcaagggcctgccggccctgcactggcgcaacgagctgatctggtggtacgccatcagcgccctcttcctgctcggcttcagcctggccttcggctggctgggagcgatcttcttcctcggccagtcggtgatggccttcaccctgctggagatcgtcaactacgtcgagcactacggcctgcatcggcggcgcctggacaacggccgctacgaacgcaccacgccggaacactcgtggaacagcaatttcctcctgaccaacctgttccttttccacctgcagcgccattccgaccaccatgcctacgccaagcgccgctaccaggtgctgcgccactacgacagcagcccgcaactgcccaacggctacgccgggatgatcgtcctcgccctgttcccgccgctctggcgcgcggtgatggacccgaaggtgcgcgcctactatgccggcgaggaataccagcttaccgacacccagcgcatctga

SEQ ID NO: 15595 - DNA, 627 bp, Pseudomonas aeruginosa
tcgtctattgctcgacgcagaaccccaccgaagtgcagaagctggtggccgaggtcctcggggtttccttcaaccgcatcgtcatcgacatgcgccgcatgggcggcggcttcggcggcaaggaaacccaggccgcggcgccggcctgcctgtgcgcggtggtcgcctaccacaccgggcgtccggcgaagatgcgcctgccgcgcatggaggacatgcagatcaccggcaagcgtcacccgttctacgtcgaatacgacgtcggcttcgacgacgatggccgcctgcacggcatccagatcgacctggccggcaattgcggctattcgccggacctctccggctcgatcgtcgaccgcgccatgttccactcggacaacgcctacttcctcggcaacgccaccatcaacggccaccgttgcaagaccaacaccgcctcgaacaccgcctaccgcggtttcggcgggccccagggaatggtcgccatcgaggagatcatggacgccgtggcccgcagcctgggcaaggatccgctggaggtgcgcaagctcaactactacggcaagaacgagcgcaacgtcacccattaccaccagaccgtcgagcacaacctgttggcggagatga

SEQ ID NO: 15596 - DNA, 462 bp, Pseudomonas aeruginosa
cgccgaggccctgctcggcgagatcggcgacgtcgaggtcttcgagtaccgcgacgcgctgatcacccccggcttcatcgacacccacatccatttcccgcagaccgggatgatcgcctcctacggcgagcaactgctggactggctgaacacctataccttccccaccgaacgccagttcggcgacaaggcccacgccgaccaggtcgccgagatcttcctgcaggaactgctgcgcaacggcaccaccaccgcgctggtcttcggcagcgtgcaccggcaatcggtggaatcgctgttcgaggccgcccggcgcctggacctgcgcctgatcgccggcaaggtgatgatggaccgcaacgcgccggactacctgaccgacaccgccgagagcagctaccgcgacagcaaggcgctgatcgagcgctggcacggccagggccgtctgctcttacgcagtga

SEQ ID NO: 15597 - DNA, 1362 bp, Pseudomonas aeruginosa
ggagtacctgctgtggaaagcaccaaacaagaagaacaagggatctacgctgcgacaccgcccgccaccggcctgctcgaacgcctgttcaagctccgccagcatggtacgacggtcaggaccgagctggcggccgggctgaccaccttcatcaccatggcctacatcatcttcgtcaatcccaacatcatggccgacgccggcatcgaccacggcgcggcgttcgtcgccacgtgcctggcagccgccctcggctgcttcctgatgggcctgtacgccaactggccggtgggcctggcgccgggaatgggactgaacgccttcttcacctacaccgtggtcggcaccatgggctacagctggcagatcgccctgggcgcggtgttcatctccggggtgatgttcatgctgctgaccttctcccgggtccgcgaatggctgctcaacagcatcccccgcagcctcaggttcgccatgggtgcgggagtcggcctgttcctcggcctgatcggcctgaagaccgccggcatcgtggtggccagcccggcgaccctgatcaagctcggccacctcacctcgcccggcccgctgctggcggcactgtgcttcctgatgatcgccgtgctcgagtaccgccgggtgttcggcggcatcctcatcagcatcctcagcgtcaccctggtcggctgggccctcggcctggtgcagtacggcggggtgttctcggcgccgccgagcctggcgccgaccttcctggcgatggacatcgccggcgcgttcaacgtcaccatgatcagcgtgatcctggccttcctcttcgtgcacatgttcgataccgccggcactctcatgggcgtcgcccagcgcgcgcacctggtgaaggaggacgggcgcatcgagaacctgtcgaaagcgatgaaggccgacagcgcctccagcgtgttcggcggcatgctcggtgtcccgccggtgaccagttacgtggagagcgccgcgggcgtggccgccggcggacgtaccgggctcaccgcggtggtggtcggcgtgctgttcgtcgccgcgatgttcttcgccccgctggccgggatgatccccgccttcgccaccgccggcgcgctgatctacgtggccatgctgatgatgggcggaatggcgcacatcgactgggacgagcacaccgagaccatcccggcgatcgtcacggtgatcatgatgccgctgaccttctcggtggccgacggtatcgccctgggcttcatcacctacgtcgcgatgaaggtcctcaccggcaagcaccgcgaagtctcggccagcctctatgcgttgttcgtgatcttcgtcgccaagttcatcttcctctga

SEQ ID NO: 15598 - DNA, 1050 bp, Pseudomonas aeruginosa
atggcagggatcggcaagcaggattgtatttacagaccgcaggcaaacttgtatacaataaatccatcacggcatccccggcccgtccggcccgccgccccatccacaataaggaacactgctgtgagcgctgactacccacgcgacctgatcggatacggcaacaaccctccccaccctcactggcccggcgatgcccgcatcgccctgtccttcgtgctcaattacgaagaaggtggcgagcgctgcgtcctgcatggcgacaaggagtccgaggcgttcctttccgagatggtggctgcccagcccttgcagggcgtgcgccacatgagcatggaatcgctctacgaatacggcagccgcgccggggtctggcgcctgctcaagctgttcaagcgacgcaacgtgccgctcaccgtgttcgccgtggccatggcggcgcagcgcaaccctgaggtgatcttggcgatggtcgccgacggccacgagatctgcagccacggctaccgctggatcgactaccagtacatggacgaggcccaggagcgcgagcacatgctcgaagccatccgcatcctcaccgaactcaccggccagcgcccggtgggctggtacaccggacgcaccggcccgaacacccggcgcctggtgatggaggaaggcggcttcctctatgactccgacacctacgacgacgacctgccctactgggacccggccagcaccgcggagaaaccgcacctggtgattccctataccctggacaccaacgacatgcgcttcacccaggtgcagggcttcaacaatggcgagcagttcttccagtacctgaaggacgccttcgacgtgctctacgaagaaggcgcgacggcgccgaagatgctctccatcggcctgcattgccggttgatcggtcgcccggcgcggatggccgctttggagcgcttcatccagtacgcgcagagccacgacaaggtctggttcgcccgccgcgaagacatcgcccgccattggcaccgtgagcatcctttccaggagaccgaggcatga

SEQ ID NO: 15599 - DNA, 1248 bp, Pseudomonas aeruginosa
aggcctgtccggagacctctgggcaatccacggtggcggcatctaccacctggagaagtacaagctggctccgccgaaaatgccggagaacctgcactggttcaaatgggaggcctactccacctggatgtccggggtggtgttgctgaccatcgtgttctacctgaacccgaccctctacctgatcgcccccggcagcgacctggcgccggcggcggccatcgccatcggtatcggttcgctggtctgcggctggttcgtctacaccatcctctgcgattcggcgctgggcaagacccctgccctgctcggcctggtcctgttcgtcctgctggtcgccgccgcctacggcctgacccaggtgttcagcggccgcggcgcctacctgcacgtcggcgcgatcatcggcaccatcatggtcggcaacgtgttcagggtgatcatgccggcccagcgcgcgctggtgaaagccatcgaagaaaaccgcgagcccgatccggtgctgccggccaagggcctgctgcgctcccggcacaacaactacttcaccctgccggtgctgttcatcatgatcagcaaccacttcccgagcacctacggcagccagtacaactggctgatcctggccgccatcgcggtgctcgcggtactggtacgccactacttcaacacccgccacgaaagcaaccgcttcgcctgggcactgcccgccggcgcgctgggcatgatcgccctggccttcgtcaccacgccgaactaccagcaggcttccgcaccgctggccagcaccccggcggcggcaccggcacaaccggcgaccggcggcgacgcaccagccgcgcccgccgcgccccaggcctccaatgccgggaccgcgagcggagccgacttcgacaaggtccatcacgtgatccaggagcgctgcaccgtctgccactcggcgaaaccgaccagccagctgttcagcaccgcgccaggcgggatcatgctcgacaccccgcagcagatccagcaactggcaccgaagatccaggcccaggccgtggcctcgcagatcatgccgctgggcaacatcacgcagatgacccaggaagaacgcaacctgatcggcagctggatcgccaagggcgcacagatcaactgagccttggccgaaaggcgaagaaccgcacctccggttccccgcagcagaacaaccctgctggccctaccccaaaagccctctccatagagggcttttggccataa

SEQ ID NO: 15600 - DNA, 573 bp, Pseudomonas aeruginosa
  unsure (384): Identity of nucleotide at the above locations are unknown.
caccgatgcccccggcatatcgcctgggcactttcaacgacaaggaacgtatccatggcaacccccgcctatatgtccatcaccggcaccaagcagggcctgatcaccgccggcgccttcaccgaggattcggtcggcaacacctaccaggaaggccacgaggaccaggtgatggtccagggcttcaaccacgaagtgatcatcccgcgcgacccgcagtccggccagccgaccggccagcgcgtgcacaagccggtggtcatcaccaaggtcttcgacaaggcctcgccgctgctgctggccgccctgacctccggcgagcgcctgaccaaggtcgagatccagtggtaccgcacctccgccgccggcacccaggagcactantacaccaccgtcctggaagacgcgatcatcgtcgacatcaaggactacatgcacaactgccaggacccgggcaacgcccacttcacccacctggaagacgtgcacttcacctaccgcaagatcacctggacccacgaagtctccggcacctccggctccgacgactggcgctcgccggtcgcagggtga

SEQ ID NO: 15601 - DNA, 2208 bp, Pseudomonas aeruginosa
gttcagtacctgctggatacgggtcgcgcagaactgggcgggtgccgactggggacacatggcgatcccgcggattggccaggaggtgatcgtcgattacctggacggcgactgcgaccagccgatcgtcaccgggcgcacctaccgggcgaccaaccgaccgccctacgcgctgcccgaccacaagatcctcagcaccatcaagagcaaggagtacaagggcagtcgggccaacgagctgcgcatcgacgacaccacggcgcagatcagtgcggcgctgatgagcgaccacggtgccagcgcgctgcacctgggctacctaacccatcctcggcccgaaggcggcaagccgcgcggcgagggcttcgaactgcgcaccgacgaacatggcgcggtgcgtgcggccaaggggctgctgctgagcaccgaggagcagctcagggccggcgccggccatctcgaccgaggcgtcgtggtgcaggtgctggaggcggcgctggagctggcccgcgagctgggcgactacgccggggagcaccagggcgtggggcacgacgcggcgccgcagcaaaccctccaggaagccgtgcgcgacctcggccacggtgccaacgacgagtccggcaagagcaacggaggcaagccggcgatcgccttgagcggtccggcagggatcgccgcggcgacgccggcgagcctgaccctggccgccggcgagcacgtcgacagcgtggcccggcagaaccagcaggtgaccgccgggcagaaggtggtgatcaacgccggcagcgacatcggcctgttcgcccagggcggcgagctgcgccagatcacccaccagggcccgatgctgctgcaggcgcagaagaacgacatccgcctggaagccgagcagagcgtggaggtcagcgccagccagcagcacgtgctggtcaccgcgaaggagcacatcaccctgatgtgcggcggcgcctacctgaccctcaagggcggcaacatcgagctgggcatgcccggcaacttcgtggtcaaggcggcgaagcacagtcatgtcggcgcggccagcctggaagccgagctgccgcagttcgaggtgggcgagacgcagcggcggttcgtcctcaagcaactggacgggcagacggccatgcccaacgtgccctataccatcaccatggccaacggcgaggtcatcgagggcgtcaccgacgccgaaggcgctacccagctgctgcagaaggatgcgatgaacatcgccaaggtcgatatgaaacacacgaaatcgcccgcctccgcagttgccgggatagcagcggcggttggcgcggcggttgcagtcggcaagctcctgagtggccccgacgccgaggccggacgtgctctcagcgaaggggaaatcagcctggcgaaaggcgtattcggcgattccatcgactattccacggtccgcctgcgcgacgaggactatgtcccctggcagggcaaggactacgtgatggcgccgaacggccacatctacttcggcgaggagttgcgcggcgtggcggactggagcctggagagcctgcagcgccagggtctgttcattcacgaaatgacccatgtctggcagcaccagcatggcgtcaacgtccttctggtgggggcctaccagcaagccaggcagtttctcctaggcgaccagtacgcctaccggttggagccgggaaagacgttgaaggactacaacatcgaacagcagggagacatcgttcgagattatttcctcgagaagaacgagttcggggaagcctctgcgaacagcaggttcgctggcgtactgaaaaacttcccaacgggatactgaccaatgaaatgcaagaccttgctcattgcctgcctgttcggcctgggaagcgcccaggccctggccgtttccaaactgccaccgcagatcccggtgcacgccggctccgggcgcgtgacactggatctacgccccttgctggcggaaaccaacgacgtcgagatcacccgtgtttcggtatgtcggcgggtcggcagccattgccaggaaacgctgtggcggatcgagctcccgcccgggtggcgtgccggggagatcgaggtcttcggcgactatcccggctccagcgtgctcctgcgccggccggagcgcttgcagccagatgggagctacaacgcattcattcatttcaacgagcgtag

SEQ ID NO: 15602 - DNA, 2292 bp, Pseudomonas aeruginosa
ccgtcggcaccagcaaacggtttccagcattgccgtcgaattctgcctggccggcgaacctggcaactggatgctgctcgacgaagcgacctgcctggcacgacgcaacgccgaggagcggcaaggagagaagccatgaacgatagggttcggtcgaggacgatcgtctctgcccagtccatcaccttgcccaagggcggcgacgtgcacctggtgccgcctccgcccaagccttgcgtgaccatcgtggtgcatggcgtcaacgatctcgcgggttgctacgaacggatcgagcgagggctctgccaggggctcaatgaacgcctggacatgccgccgaccttgcccggcgggcaggccaatcccggctacctgacgccggcgggctacagcctgccggcggacgacgaaggcaaggcggagaaccccgacgtcgtctactaccggcgcaagttcgccagtggcgccggcggggccgccgtacgcagcgtagtcgtacctttctactggggcttccgcgaggaagagcaatacatcaacaagaccgcggcccacggcgaatggctggaccgcaacggcaaccggctggacaagtccggcaccaaggaaggcgggcagttcgtcaatgccaccaccaacctgccggacatgtggggccagggtttcaacggcaagctgttcggtttcatctcgctggactggttcggcggcaccatgacccatccgctgttttcggcggcagggcgcaagtacatggtccttgcggccatgcgcctggccatgttgatcaagatcatccgcaagcgttacccggacgacaccatcaatgtcgtcgggcacagccagggcaccctgttaaccctgctggcacatgccttcctcaaggatgacggcgtggagccggcggacggggtgatcatgctcaactcaccctacggcctgttcgaacccctcaacgagaagctccagggctggagcagccagcagaccagagaggcgcggctggccacgctcaaaggtatcctcgagttcatctgcggccgacgccatccggtccccgcgctgagcagcgtcgcgttgcgcaactgccaaggctacggcgcgataggcggccccggctgggtgggtggccagggctgccagacgaccatcgacggggaacggctcagcttcgatgagcgcgacaatcgcggcagtgtctacctgtatttcacgccccaggaccagacggtgggacttgccaacgtccagggtatcggctggcgcggcattgctgagcaggtcaaggggctcccgggaaggaccgggctgccgcagggttttcaccagcgcatcttcaccgtacgcaagcgcaatggcgagaaggaaaagatcggcgggcacgcccctccccatgtctatcctcttctgctggccggcgagaagacctgggaagacaccgggctgggcggcaaggacagattcggccgggcgaacttcgaccagggcgacagcgtgctgctgaccgcgccgcgtctgccgttgccgacggaagcgcgattcgatttcgacggagccgtcacggcgccgggagagaactccgccagcggcgtctatcaggtgcgcgataccctcgatccgatcgacgccgccatcggcgtaagcaacggcggctggaaggaaaaggacagcgggcacgccgtcgcgcaacaggtggacgccgcgctggcgtaccgctacgggcgcgacgcgcgcagcgtggagagggcgttgaacgaaggcaaggaattggcccagcagacccatgtattttccgctcgtgaactgggcaccggcatggttctggtcacccgcgcggaaactccctacgaggcccggctgcgcctgcagacggcggagggccatctggagcccttgtcgttccactcggccatacccaacaacccggagcataaccggcgggtactggcctatgacctggccatcggggccggggacagcgtggatgatgtggttttctatcagtatctgtgtcgggtggcggattggcggttggattggaatgcaactcgcgcaaaaggaagagcgcaagttgagtcagataccgaactagacctgcctgatgaagatgttcgcgccttatatcgcgcggaagaagctggaaaccgtaaactgatcgattccacagagatttatcgcagaagtggggccattccctcgattgttggaaataccttacctagcttagtggcgacgcaaacgataaatgatcgctattacgatcgccctgtttgctttggagggccgatctaa

SEQ ID NO: 15603 - DNA, 489 bp, Pseudomonas aeruginosa
gttgtcccgtcagtaccggagcacgtttgggcggcggacattacttacctgccagccagtagcggcccgctgtacctatgcctggtaacggatgcgtattccagaaaaattgttggccatcatgtgcatgaaagcctgcatgccaagtcagttgcacaagcctttaggcaggccctacgcaaacggcagcgtcgccagtcactggtccaccactcggatcgcggtattcaatattgctcggcgctgtatcagtcactgcatgcacggcatggcgtccagtgctcgatgactgacggatatgactgctaccagaacgcgctagctgagcgcatcaacgggatcctcaaaacagagctgctgctgagtagccctgaaaatctggagcaggcaaggaagatggttgctgaagccgtgcagatctacaacacagagcggcctcacatggccctgaaaaacaaaacgcccgatgcggtgcatcgggcgttttga

SEQ ID NO: 15604 - DNA, 354 bp, Pseudomonas aeruginosa
gcaaggttgccgcggagagcggcgaacagtacttcatcgatacgatcctcatcgccacccacggcacggctggccaactctggctgggcaacccccacggcgagagcaccgcggacgtcatggcccggcgtgtccagggcaagcagttcgtcgagccccaggcctttggtgcgacccttctcgaactgttcggcaaggaactggccatcgccctctacgggtgcgacttcgccggggacgaggacggagaagcggcggccctcgagctgcgcatcgccgccaacgcgagagcggtctacgccggcaagggcacggtgtatctcaatgccagcaaagagggtcgttccacggtga

SEQ ID NO: 15605 - DNA, 756 bp, Pseudomonas aeruginosa
gatcgggagtccgcactggggcggaccttctcttcctgcgggtggtttctccggatgcttccagacagcatggtgggtagcagcgcgcggcgccttcgtttgcggcggacgcgcgggcgtgtcgggctcggcctggtggccgggctgtcggtactggcaggcatgaccgacgccatcggtttcctcgccaccggcgacttcgtttccttcatgagcggcaacaccacgcgcctggcggtatcgctgggcgagggcgacttcggcgggctggtgcggctgagcgtcgccctggccagtttcgtcgtcggcaacgcgctgggagtgatactggcgcgcttcagcgggcgccgggcggcgccgatcctggtctgctgcgcgatgctgctggcgttgtcggcggtctggccattcgactggaacgtgccggcgctggtcgccgcgatcctcgccatgggcatgctcaacgccgtggtcgagcaggtcaacggcctgcccatcggcctgacctacgtcaccggcgccctctcccgcttcggccgcggcctcggccgctggctgctaggcgagcggcgcaacggctggcgggtgcaactggtgccctggagcggcatgtgcgtcggcgcggtgctcggcgccctgctggaacagcaactgggcctcgcggcgatggcggcgagcgcagcgctggcggctcttctcgcgttgctggcactggtgattccgcggccatggcagatggactatatggtgcgttga

SEQ ID NO: 15606 - DNA, 651 bp, Pseudomonas aeruginosa
tcaactgcctgtacccggaacagttcgccgggcaaatgcgtgccgctacggcgtcgttccgccacgcctatccgacggcgctgcgcaggcgagtcgaagaacgctggagcgactacggattcgccgacgcctgagcgctacaatccccgccctggcgaaagaggatcgaggaaggtgaccgggccaatgaccgagacgaacgcactggggctgccccaaggcccgctgtacctgatgacggagatcgtccgccagcgcgaacggcaactcaccgccctgcttgcccctctcgaactggggctgcatgaatggcgtgcgttgcggatcatccacgccttcgacggtgacgtgccgatgagcgtgctcatcgagcactcacagaccgaccgcaccgcgctgggccggaccatcgaacggctggtgcggcgcggctgggtcagccgcctgccggacccggacgacgggcgcgccgtgctggtgcgccgcagccccgcggcacaggcggtgttcgagcaggcactggcacaggtcgcagggctcgacgaaaggctgctggcggctctcggcgccggcccggaagaagaggcgctgaccctcgccctgggcaagttgctgcgggccttcgacgggctttcccgcgtgacgcaatag

SEQ ID NO: 15607 - DNA, 969 bp, Pseudomonas aeruginosa
ggacctgcgccacctgcagtggctcgccggcctgccgttccacgaacgcctggccctcggccacggacacagcgtggcattcggtttcccgctctacgagcacagcctgctgcgtcacttccttctcctaccgaccccgctgggcgaagatgccgccctgttcgacggtttcgacctgtccgcccatccggtcgacctgctctgggtcgtgccgctgaccgagcaggaataccaggtgaaagtgaacaagcacctggaaggcatcgccgaagtgctgaacgacgccggacatccgctcagcctcgaccggcatcgccattgctacgtcaccggccaacgtccggaagggttcgagcggatactgcattaggtcgccgggcaaccggagcaagaggcccgtcgccaggccctaccttcgtcggggaagccggcgatgacgtttttcaatcggttcgatgccgttttccccgcttgccgatccgctcgccgtctacgattcttgctggacgtgagaacggctccggaggggcgcgtatgaaaaccgtggcacaactgttgaacgccaagcagaaccagcaggtgtacaccatcggagcggacgagatggtgctcgacgccctgcgcctgatggcggaaaagaacatcggcgcgctgctggtggtgaaccatggcgaggtggtcggggtggtcagcgagcgcgactatgcgcgcaagatggtcctcaagggccgttcgtccatcggtacgccgatcagcgcgatcatgagcgcgccggtggtcagcgtggactcgaagcagagcgtcgacacctgcatgaacctgatgaccgatcgccacctgcgccacctgccggtcgtggaagacggccagttgctcggcctgctgtccatcggcgacctggtcaaggcggcgatcgccgagcaggccgagctgatccagcaactggaacagtacatccgcggcgactga

SEQ ID NO: 15608 - DNA, 552 bp, Pseudomonas aeruginosa
ggcggcgcgccacgctgttcaggtgtgccggggagatgcccaggcgacgcgcgtactcgtcgattcccaggtgctcgcggaaatgccgctcgaccagttgcgaaaaggccgataggtattcctgaccacgacccggccgtgcctccgcccgccggaccatcacctgccgccccagccacaccgccagcacgccgatcagcgactgcaacaacagctcgcgcgccggcgcagcgccggcgtactcgccgtctatggcgtcgaacagcgtgtcgatatagcgccggtccgcgcccaccgggtacaaccccggcgcctccagcgcctggcgctgcgcgccgaggtgcgcctgcaagcgcgccagcaacggtgcggcgagcgtcagcacgtagccgtcgatgcgctcggagaactggaagccatggatgcacaacggcggtacgaactggatggaaggctgctcgacgcgagtcggctcgccctcgacctggagctgcgcccagcccttgcgcacgtagagcaactgagcgagatcggcgtgccggtgcggcttga

SEQ ID NO: 15609 - DNA, 1560 bp, Pseudomonas aeruginosa
tgcccgctgccttcgcgttccgtccgccccaggtgccgtcttgtccgatctcgcccagaacccgcccgccgtccgtaccgtcctcgccggcctgatgctgtcgatcttcctcagcgccctcgaccagaccatcgtcgccgtctccctgccggcgatctcggccgacttcgccgacctcgacctgctggcctgggtgatctcggcctacatggtggcgatgaccgtatcgatgccgatctacggcaagctcggcgacctctacggccgccgccgtctgatgctcttcgccatcgtcgtgttcaccgccgcctcgctgctttgcgggctcgcgcagagcatgggccaactggtgctggcgcgagtgctgcaggggatcggcgcgggcgggctgatggcggtgagccaggcgatcatcggcgacatcgtcccgccgcgcgagcgcggccgctaccagggttacttcagcagcatgtacgccatcgccagcgtcgccggcccggtgctcgggggcctgctcaccgagtacctgtcgtggcgctgggtattctggatcaacctgccgatcggccttctcgcgctggccatctcgcggcgaaccctggtcggcctgccggtgccgcgccggcaaccggtgatcgactacctgggcatcgtgctgatggtggtgggcctcaccgcgctgctcctggccatcacccagatcggccagggcgcagcctggagcgaccctgcgctgctcggcctgttcgccctggcggcgctcgccctgctgctgttcgtcgcccaggagcggcgcttccgcgaaccgctggtgccgatgcaactgttcgccgtccgcgccgccaccctcagttggctggttgcgttcttcgccagcttccaggccatctcgctgaccgtgctggtaccgctgcgctaccagagcgttaccggcgccggcgccgacagcgccgcgctgcatctgctgccgctggtcatgggcctgccgctgggcgcgtactgctgcgggcggctgaccgccagcctgggacgctacaagccgctgatcctgctcggcgccgtcctgttgccctgcggcatcgccggcctggccctggtcccggtcggcgaccactggctgtccgggctgtgcatgctgctcaccgggatcgccatcggtacccagttcccgaccagcctggtggccgcgcagaacgccgtggagcaacgccacatcggcgtcgccaccagcaatgcgacgttgttccgctccctcggcggggcggtcggggtggcgctgatgtcggcgatcctgctggccctgctcaagcacctgcggatcggcggcgggctcgaccagggcttttccgagagcgccctgctgagcagcctggacgccgccagcgggccggcccgggtgatcctccagcatgtcctcgcggatgccttcaaggtgctcttcctggtcaacgcggcggtggcgctgctcggcctggcggtggcctcggcactgcccgacatgaccctgcgcggccgcggcgcgacgcaaccgacggcaggcgagtgagcggacgccgataa

SEQ ID NO: 15610 - DNA, 471 bp, Pseudomonas aeruginosa
catcattgctgtggaggctgcgccatgacgcgcacggtactggtcctgaacggccccaacctgaatctgctcggcacccgcgagccacagacctacggccggcggaccctgggcgaaatcgccgacgaatgcgcggccttcgccgagacgcgcggcttcgccgtggacttccgccagaccaaccaggaaggccaactgctcgactggatccaccaggcccgcggccgggtcgccggcatcgtcatcaaccccgccgcctggacccacacctcggtggcgctgcgcgacgccctggccgcggtggaactgccggtggtcgaagtgcacctgtccaacgtccaccagcgcgaagcgttccgccaccactcctacgtctcgccggtggcgctgggagtgatctgcggattcggcagcctcggctaccgcctggccctggaacatttcgccgagcgtttcgaggcggccgcatga

SEQ ID NO: 15611 - DNA, 570 bp, Pseudomonas aeruginosa
acaccgtggtgctgcgcgatggccggcgcatcggccacaacaccgactgcctgggcttcgccgagggctttcggcgcggcctggccgacgcgccgcgccagcgcgtggtgcagatgggcgcgggcggcgccggcgcggcagtggcccatgcgctgctcgccgagggcgtcgagcggctggtcctgttcgacgtcgacccggcgcgggccccaggccctcgcggacaacctcaaccagcacttcggcgcgccacgagcgctcgccggcagcgacctggccggcgccctgggcgacgcccagggattggtcaacaccaccccggtgggcatggccaagctacccggcatgccggtgccggcggaactgttgcgcgccgacctgtgggtcgccgaggtgatctactttccgctggaaaccgagctgctgcgccaggcccgcgccctcggctgccgcacactggacggcggcaccatggcggtgttccaggcggtgaaggcattcgaactgttcagcggggtgacggccgacgccgcgcgcatgcaggcgcacttcgccagcctgggcgactga

SEQ ID NO: 15612 - DNA, 2859 bp, Pseudomonas aeruginosa
caatttcaagaatcgggtacccgctcatgtccatcgccgacctctccgtccgccctccatcccgtccgctggccgctcgtccggcccgaccgcccctggcccgctgacaccggcgcggcccctggcccgcccgcgtgcaacccagaacgacaaatccaggccgggcgcccaggcaccggccgccgaaaggatggccccgtcaatgatccactcttccagctctcgactgctcgccgccgacgccccgcgggaatcccgcggcggcaggatccgcaacgccttcgccgtcggccggacgcgctggggcatgctcgccctggtgttcttcgccaccaccctgaactacatcgatcgcgccgccctcggcgtgatgcagccgatccttgccgagaagatgagctggacggcaatggactacgccaacatcaacttctggttccaggtcggctacgccatcggcttcatcctccagggccgcttcatcgacaaggtcggggtcaagcgcgcgttcttcctcgccgtgctgctctggagcctggccaccggcgcccacggcctggcgacctcggcggcgggcttcatggtctgtcgcttcatcctcggcctgaccgaggcggccaactacccggcctgcgtgaagaccacccgcctgtggttccccgccggggaacgggcggtggccaccggcatcttcaacgccggcaccaatgtcggcgcgatggtcaccccggccctgttgccgctgatcctcagcgtctggggctggcaggcggcgttcctctgcatgtcggcgctgggcctggtctggctggtgttctggtggcgcaactactacaaccccgaggagcatccgcgggtgaagcagagcgagctggaatacatccagcagcaggaggagccgcccgccacccgcgtgcccttctcgcagattctccgccgccgcggcacctgggccttcgccctggcctactcgatcaccgcgccggtgttctggttctacctctactggctgccgccgttcctcaaccagcagtacggcctgggcatcagcgtgacgcagatgggcatcccgctgatcctgatctggttgaccgccgacttcggcagcgtcggcggcggcatcctttcgtcctggctgatcggccgcggcatgccggcgatccgcgcgcgcctgctgtcgatgctgctgttcgcctgcaccatcgtcggcgtggtgttcgccgccaacgccagcggcctgtggatcgccgtgctggccatcgccctggcggtcggcgcgcaccaggcgtggacggcgaacatctggagcctggtgatggactacacgcccaagcacctgatgagcacggtgttcggcttcggcggcatgtgcgcggcgctgggcgggatgttcatgacccagatcgtcggcggcgtactgaccgcgacgaacaacaactacgcggtgctcttcaccatgatcccggcgatgtacttcatcgccctgacctggctgtacttcatggctccgcgccggatcgaagcctgagtccaagcgcccggcgctcgccgggcacctccctgcctagagaacaagaacgaagggacacacccatgtcgcacccgagccacgtccgcgcgctctgcgcttccctctgcctgggcgccggcctgccagtccatgccgggcacgtccacgccgggcaaggtttcctcgaagacgccaaggccagcctcaccgcgcgcaatttccacctgcaccgcaacttcgtcggcgatgccagccagggcaaggccgaggagtggacgcagagcttcatcctcgacgcccgctccggcttcacccagggcagcgtcggcttcggcctcgatgtcctcggtctctacagcctgaagctggatggcggcaagggaacggccggcacccaactgctgccgatccacgacgacggccgcccggccgacgacttcggacgcctggcggtggccggcaagctgcgcgtctcgaacagcgaactgaagatcggcgaatggatgccggtgctgccgatcctccgctccgacgatggccgctcgctgccgcagaccttccgcggcggccagctcagcgccaacgagatcgccggcctgaccctctacgccggccagttccgcggcaacagcccgcgcaacgacgcaagcatgcaggacatgtcgctgttcggccggccagccgccacttccgaccgcttcgatttcgccggcggcgaatatcgcttcaatggcgaacgcagcctgctcggcctgtggaacgccgagctgaaggacatctaccgccaacagtacctgcaactgcaacacagccagccgctcggcgactggctgctgggcgccaacctcggcggattccgtggccgcgacgctggcagcgcgcgcgccggcaagctcgataaccgcaccgtttccgcgctgttctccgcgcgctacgggctgcataccctctatctcggcctgcagaaggtcagtggcaacgacggctggatgcgggtcaacggcaccagcggcggaaccctggccaacgacagctacaacgccagctacgacaatcccggcgagcgctcctggcaactgcgctacgacttcgacttcgttggcctcggcctacccggcctgaccttcatgacccgctacctgcatggcgaccatgtgcgcctggccggagtcaccgacgacggcagcgaatggggacgcgagagcgagctgggctacacgctgcagagcggcgccttcaagcgtctcaacgtccgctggcgcaactccagccagcgccgcgactggggcagcaatacccgcttcgacgagaaccggctgatcgtcagctatccgctgagcctgttgtga

SEQ ID NO: 15613 - DNA, 471 bp, Pseudomonas aeruginosa
gcacgccgagagcccgtccgtcctcggggtggcgcaccagtgcggccatcgccgccatgcccggcgccgagcattcgatctgccacgcatagccgtgctcgcgggcgcgcttcaggtaacgcagcagctcgctcctggagcgcggcgcgttgggaccgaagtcccgcgccgcccctacgccctggcgctccaccagcgccagcgccgccttgtggctcaggctggccagccaggcgtgcccggatgcagtgtagaacagcggcgcctcgcgccccatgtcggggtcgtagcgtagcccggaggtggcgccctgggacttggcgatccaggtctggcgatcgccttcgattacccccaggcgcaccagttcgccggtctcccgggcgagcccgtcgagcaccggctggaccagatcgaccaccccgctggacgcgaggaagcggaagcccagcgcggccaggcgggtgctga

SEQ ID NO: 15614 - DNA, 822 bp, Pseudomonas aeruginosa
gccacgcgtccgaccctcgtcccacgccctcactctcgccgcggaacccgtcccatgaacagccccagcctgcccgccgtcgaacgactcgacgtgcaagccttcatcaatgcccagccgctttcgccgtaccaatggcggatcgtcctgctgtgcttcctgatcgtcttcctcgatggcctcgacaccgccgcgatgggcttcatcgctccggcgctgacccaggactggggcatcgaccgcgccagcctcggtccggtgatgagcgccgcgctgatcggcatggtcttcggcgccctcggttccggaccgctggccgaccgctacggacgcaagctggtattggtcgcggcggtcttcctcttcggcctgttcagcctggcctcggcctacagcaccaacgttcgagcaactgctggcgctgcgcttcctcaccggcctcggcctcggtgcggcgatgcccaacgccaccaccctgctttccgaatacacccccgagcgcctcaagtcgctactggtaaccagcatgttctgtggcttcaacctgggcatggcctgcggcggattcgtctcggcgaagctgatcccgctgttcggctggcacagcctgatgctgctcggcggcctggtaccgctggtcctggcggtagtcctgctgttccgcctgccggaatcggcgcgctacctggtggtgcgcaaccgcggcagcgagcgggtacgccaggtgctggcccccatcgccccggcgcaggtggcgctggcacggagtttccacgtccccgagcagcagacggtgcaggccccgcaacgtgttcgcggtga

SEQ ID NO: 15615 - DNA, 993 bp, Pseudomonas aeruginosa
tgggcgggatcgagcaggcggtccagttcgtcgccggacaactcggcgctcacccgcgcctcttcgccgagcaccgcgcgcaactcgcggcgctgctcgacggcgcggcggcagcactgttccaccagatggtgcgcggcttcgcggccgatacggcgggccagggcgatgctcaccgcctcggcgagcaccaggccgtgggtcaggccaaggttgcggcgcatccgctgggcgtccacctccaggccttcgagcaggccgatcgcctgttgcagcgcgccggcaaccaggcaacagagttccggcagggtttcccactcggcgtgccagagaccgaggctgcgctcgtgttcctgcggcatcgccgcgaacagggtcgagaccagccccggcgcacgggtggcggcggcgatcagcaccgcgctgctcaccgggttgcgcttgtgcggcatggtcgaggaaccgccgcgcccggcgccggccggctcgaagacctcgccggcctcggtctgcatcagcaggctgacatcgcgaccgaacttgccgaggttaccggccaccaggccgagcacgctggcgaattccaccaggcggtcgcgctgggtgtgccagggttgttcgggcagagccaggcccagctcctcggccagcgccgcggccaccggcagggcctgttcgccgagcgcggcgagcgtccccgaggcgccgccgaattgcagcaccagcaggcgcgggcgcaactcgcgcaggcgctggcggtgccgggtcaaggcaccgagcaggccggcgagcttcatgcccagggtcaccggggtggcgtgctgcaaccaggtgcgcccggccagcggcgtgtcggcatgccgttcggcctggtccgccaggacctcggcaagacgttgcagatcctgctcgagcaaggccagcgcacggcgcagttgcagcaccaggccgctgtccatggcgtcctggctggtggcgccgagatgcacgtag

SEQ ID NO: 15616 - DNA, 495 bp, Pseudomonas aeruginosa
aacataccagtagaagacgttctccatccctaccgacttcagccccagggcgacgtactcggccgagccgccgaagatcgcgttgcccaccgcgtaggacactccgacgccgagggcgcgcacctccggcgggaacatctcggccttgatcaggccgctgatggaggtgtacaggctgacgatggccagcgccaggatgatcaggaagaaggccatgtagggactgctcacggtcttcagcgcgagcaggatcggcagggtgcacagcgtgcccagggtgccgaaccagagcatcgaggtcttgcgcccgatgcgatcggaaagcatgccgaacagcggttgcatcagcatgtacgccagcagggcgaaggtcatcaccgcgctggcggtcttggcgctcatcccggcggtgttgaccaggtacttctgcatgtaggtggtgaaagtgtagaagatcagcgagccgccggcggtgaagccgagcacggtgaataa

SEQ ID NO: 15617 - DNA, 756 bp, Pseudomonas aeruginosa
ggcccgcttgtgcttgaacagctcggcgaaggtgccggattccttgcgctccagggtcgacttcgaagcggtctcgttcagcgagcgccgcagccagagggcgatcaccgcggtgatcgcgccgatcacgaagggaatccgccagccccaggcgcgcagttcgtcttcgctcagcaactgctgcaggatcaccaccaccagcaccgccagcaactgtccgccgatcagggtgacgtactggaacgaggcgaagaagccgcgctggcccttgagcgccacctcgctcatgtaggtcgcactggtgccgtactcgccgcccaccgacaggccctggaacatccgcgccagcaacagcagggccggcgccagggtgccgatgctggcgtaggtgggcatgcaggcgatcgccagggagccggcgcacatcatcaccaccgagatcagcatggcggtcttgcgcccgtgcttgtcggcgatgcggccgaacatccagccgccgatggggcgcatgaggaagccggcggcgaagaccccggcggtgttcagcaactgcaccgtggggttgtcggaggggaagaaggccggtgcgaagtagatcgcgcagaaggcgtagacgtagaagtcgaaccattccacgaggttgccggaggaggcgccgacgatggcgaagatgcgcttgcggcgttcttcgttgctgtactggtgaacaggggcagtcatgctgttgttctctcgacagggtccgtttcatcctga

SEQ ID NO: 15618 - DNA, 594 bp, Pseudomonas aeruginosa
tggagcgcggtgaggaccagccgcgcaccgctcatccccagcgggtggccgagggcgatggcaccgccgttcgggttgaccttctcactgtcgtcggccacgcccagttcgcgcaggcaggccaggccctggctggcgaaggcttcgttgagttcgatcacgtcgaaggcgtcgatcgccaggtccaggcgccgcagcagcttgcgcaccgccggcaccgggccgatgcccatgatccgtggggcgacgccggcgctggccatgcccagcacccgcgcgcgcggagtcaggccgtgcttctccactgcctcggcggaggccaggaccagcgcggcggcgccgtcgttgaccccggacgcgttgccggcggtgacggtcttctccggcccgttgaccggcttgagccgggccagcgcctccagggtggtgtcgggacgcggatgctcgtcgtgctcgaccagggtgtcgcccttgcgcccgcgaatcgtcaccgggacgatttcctcggcgaagaaaccggcctcctgcgccctgccggcgcgctgctggctgcgcagggcgaaggcatcctggtcggcacgcgacacgcgatag

SEQ ID NO: 15619 - DNA, 696 bp, Pseudomonas aeruginosa
tcgtcggcgacgttgtcggcggtctgcggcatcgggtcgatgccgtactgctccttcatcagcggattgacgaagcgccagccgatggtggtgtcctcgatcttctggccgcgcccgaaggcgctatcggccttgcccatcacgtacggcgcgcgcgacatcgactcgacgccgccggcgatggccagctccatctcgccgcaggcgatggcgcggaacgccgtgccgatggcgtccatccccgaggcgcagaggcggttgagggtgacgccgggcacgctctccggcaaaccggccagcagcagcgccatgcgcgccacgttacggttgtcctcgccggcctggttggcgcagccgaggaacacctcgtccaacgccgaccagtcgacccccgggttgcgctcgaccagggccttcagcggcaccgccgcgaggtcgtcggcgcgcaccgcggaaagactgccgccgaaacggccgatcggcgtgcgcacggcatcgcagatgaatacctcgcggctcattcgtcgctccccttctgtccatgggcggccgcggtgcgcgcctcgaggtcgcgcagcgcggcgagttcgacctcgctcggcgcgggcgtctcggagacccgctcggcgaagcggatcgcccagccggtggcctcgaccacctgctcgcgggtcacgcccggatgcagcgaagtga

SEQ ID NO: 15620 - DNA, 1281 bp, Pseudomonas aeruginosa
tgttgccgaagcggtcgacctgggccgcgccgaggaagccgacgtcgatccgtccgccctgcagccagtagcggaagatctcgccggtggggaccacggtatcggcggtctcggccaactcgccgtcgccgatggacagcggcaggacgctgggcttggcgccgatcggcccggactcgtagatcagcacgacgtccggcgaggaagtcaggcgcgccaggttggcggccttcgacggcaggccgatgccgacgaagcacaccgcgccgttgtgcaggcggcgggcggcggccacggtcatcatctcgttggtgctgtagctgctcatcgcttgccctccgcgagcttggcctggaaggccccgaaatcctcggtcccccggatgtattcgtcgatccacgcggtgaagctttcgcggtcgcgggcgatcggatcccagtcctggtagaagcggttgtcgcgctcgtagtagccgtgggcataggacggatgcgcgccgccgggcaccaggcacacggcgctgagcgcccagctcggcaggacgcaggcgttcatcggggcgtccagttcgtcgacgatctcctcgacggtgacgatgcagcgcttcgccgccagggccgcttccttctgcacgccgaggatgccccagagcagcacgttgcccttgcggtcggccttctgcgcgtggatcacgctgacgtccggacgcaccgagggcaccgccgccagcacttcgccggtgaacgggcaggtgacgctgcggatcagcgggttgaccttcggcaggtcggagccggcgtaggcgcgcagcactgcgaagggcagcccggaggcgccggcgacataggcgttggcgaggtcggcgtggctgtgttcctcgatctccagcggttgcggccagcccttctccaccgcgtcgcgcaggcggtgcagcgaaccgacgccggggttgccgccccaggagaacaccagcttcttcgcgcagcctgcaccgatcagcaggtcgtagaccaggtcgggagtcatgcggatcagcgtcaggtctttcctgccctggcggatcagctcgtggccggcggccgtcgggatcaggtgagtgaagccttcgagggcgacgctgtcgccatcgtggacgaagcgtcgcaccgcttcgcgcagggagaggatttcagccatcggtcgggtctcgtcttgttgtgcgctgcctggacggcacgtgacgagaaccttacgccggggtccgagggctcacaatccgataatcgattaacagttcgataa

SEQ ID NO: 15621 - DNA, 1632 bp, Pseudomonas aeruginosa
ccggcaaaagctggccctgacctgccggattctcttcgaggccggccacgactccgggctcgccgggcagatcacctcgcgcggcccggaggcggggacctactacacccagcaactgggcctgggcttcgacgagatcagcgccggcaacctgctgctggtcgacgaagacctcaacgtcctccacgggcacggcatggcgaatccggccaatcgcttccacagctgggtctatcgcgcccgcccggacgtcaactgcatcatccacacccacccgctgcacatcgccgcgctgtcgaccctggaagtaccgctgcaggtctcgcacatggacctttgcccgctatacgacgactgcgccttcctcaaggactggccgggcgtgccggtaggcaacgaggaaggcgagatcatctccgccgccctcggcgacaagcgcgccatcctgctctcccaccacggcctgctggccaccggtgcgagcatcgaggaggcctgcgtgatcgcggtgctgctcgagcgcgcggcgaagatgcagttgctggcgatggccgccggggagatcaagccgatcccgccggccctggcgcgcgaggcccacgactggatctccaccccgaagcgccacggcgccgcattcaactactacgcccggcgctgcctgccgcgcaacagcgactgcctgagctgaacgacctttcccaccaggtccgtcctggcatttcccactcaatgtcacgggtacatccaatgtccgcatccatccacggcatcatcggctacaccatcacccccttcgccgccgacggaggtctcgacctgccggccctcggccgctccatcgagcgcctgatcgacggcggcgtgcacgccatcgccccgctcggcagcaccggcgaaggcgcctacctgagcgacccggaatgggacgaggtggtcgacttcaccctgaagaccgtcgcccatcgcgtgccgaccatcgtcagcgtctccgacctgaccaccgccaagaccgtgcgccgcgcgcagttcgccgaatccctcggcgccgaggcggtgatggtcctgccgatctcctactggaagctcaacgaggcggaagtgttccagcactaccgcgcggtgggcgaagctatcggcgtgccggtgatgctctacaacaacccgggcaccagcggcatcgacatgtcggtggaactgatcctgcgcatcgtccgcgaagtggacaacgtaaccatggtcaaggagagcaccggcgacatccagcgcatgcacaagctgcgcctgctcggcgaaggccgggtgcccttctacaacggctgcaacccgctggcgctggaggccttcgtggccggcgcgaaaggctggtgcagcgccgcgccgaacctgatcccgacgctcaacggccagctgtaccaggcggtgctcgacggcgacctggagaaggcccgcgcgctgttctaccggcagttgccgctgctcgacttcatcctccgccggggcctgccgaccaccatcaaggccggcctgggcctctccggcctggaggtgggggcgccgcgccttccggtgcaggcgctggataccgagggctgtcggtatctgcaggggttgttggaagagctgcgctga

SEQ ID NO: 15622 - DNA, 1791 bp, Pseudomonas aeruginosa
ggcagttgccggccagaggccgaaacggttccgcgcgcggtcgccaggcgccgcatcgtcgttatggggggacgctccgtgtcgcagtcgacccggccgaggccgggccgccggggcgcgtcagagcacgccgatctcgcgggcggtgcgatccaccgcgatacgggtcttgtcgatcagttcgtcgatctcggcacgcccggccaccagcgccggggccatgatcatgcggccgagggtggagcggatgatcacgccctcctcgaagccgatggtgcggcagcgccaggccagatcgttctcgttggcgaagcgcttgcgggtcaccttgtcctcggcgaactgcagcgcggcgacgaagccggcgccctggacctcgccgaccagcggatggtcgccgaagacctcgcgcaggcagcgttgcaggtagggtccggtctcctccctgacccgcgtgaccacgccctcgtcgcgcagcgccttgaggttggcgatggccaccgccgccgccaccgggtggccggaataggtcaggccgtgggcgaacaccccgccctgatccaccagcacctcggcgatgcgcttgccgagtaccaggccgcccatggggatgtagccggacgtcaggcccttggcgatggacagggtgtccggctggaagccgaagtgttcgtgggcgaaccattcgccggtgcggccgaagccgccgatcagttcgtcggcgcacagcagcacgtcgtactgccggcagatgcgctggatctccggccaatagctttgcggcgggaagatcatgccgccggcgccctggaagggctcggcgacgaaggcggcgacgttctccgcgcccagttcgaggatcttctcctccagttgcagcgccgcgcggcgaccgaactcggccgggctcagctcgccgccgttggcgtaccagtagggttcgtcgatgtgggcgaagtccggcagcatgccgcccatctcgtgcatgaacttcatcccgccgagcgcggtgctgcccagggtcgagccgtggtagccgttccagcggccgatcatgatcttcttctgcgacttgccgaggatctgccagtagcgccgcacggtacggatcagcacctcgttggcctcggagccggagttggtgtagatcgcgtggctgtagtggtccggcagcaggctgaagagcatctcggaaagctccaccaccgccgggtgggtggtgtggaagaacatgttgtagtacggcagttgttccagctggcggctggcggcggcggcgaggtcctggcggccgtagccgaggttggtgcaccagaggccggacatgccgtccaggtagcgcttgccgtcgttgtcccagagctgcaggccatcgccgcggaccatcacccgcgggccttcgcggttcagcgccttctggtcgaggaaggcgtggatgtggtgcgcggcgtccagttgctggtagtcgcgggtgtcgcgctgcgggttgagctgagcggtcatcgtctgtgttctccttgttcccttggcgcgtcaggccgaaggggattgcaggggatcgagggcgacggacttgccctgggcagtctcaccggccgtctcgagcggttcgggtacgaaaaggggcttgcgcatcacgcccttgatccacaccaccgccaccagcgagaccacgccgagcaccacgccggcgctggcgaaaatccgtccggtcatttccggggtcggcgagacgtggaccaccgcgtatatcatcccggcgatgccgaacagttgcggcagcgggtataa

SEQ ID NO: 15623 - DNA, 2679 bp, Pseudomonas aeruginosa
cggcgtgcggaacggacgggcgatgtgcggatagcgacggcgcagggccagcacgtctacgtgggcgatgatgtatgccagcagccaggccagcgcggcggcgagcagcagcaggttgatcgaatccgggtcctggccgaagatcatgatctgcacgccggtgatcgcagccacgaacagcaccgccacccagggcgtgcgcgcccgccggctgagctgcttgaattgcgggaaggcctggccgttctgcgccatcccgtagagcatccgcgggatcgccgccagcgacgagttgagggtgctgcaggtggcggtgatcgcggcgatcaccaggaacagctggccgtactcgccgaacacgcggttggcgaagaggaagtgtggcagcgggtcgccggccagttccgcctgcgggatgcacagcagcgcaccgaagcagtagagggcgatggtcaggaagatgatgctcaggccgaggatcatcgaacgcgggatgttgcgctccggacgccgcgtctcctccaccagcgggcagacgaactcggcgccgacgaagccccacacggccatcgcggtgagcgccagggcgcttaccccgagcgggttccagccgctcgccagggcggtctgcgcggaagcgtggtcgctgctcaccgcacccaggccgagcaccagcaggacgatcatcatcagcagcgccagcgcgctctgcaggcgcgcgaagatgtcgatgccgagcaggttgagcagggtgaacaggccgagcacgccgtaggccaccagcatcggcggcagcgcgccggggtagaccttgccgatgatcaggtcgagcagcagcagttccgccgagagggcgaacatcgccaccaccacgtagccggaaaaggtcgccaggatcgccgggaaatgcccgatggccacctcggtgtagctgctcaggctaccggcgcggggaatcatcagggccagctcggaaaaggaaaaggcgtagctcagcgccagcaggtaggccactcccagcggcacgatgaagcccaggccggccgtcccggcgccttgcagcatcagtaccatcacgccctgggaaaccaccaggccgatggccaccgccagcagcggtcccagcccgagcacgcggcgcagggccggctcacgcacgttcggcgtgtcgttcattcgatcgtcctcttgttgtcgttatcggcatcgagtcgtgtcgcgtccgtcgcgtcttcagcgcaactggaaccaggtcgtcttcaactgggtgtacttgtcgaaggaatgcagcgacaggtcgcgaccgaagccggactgcttgccgccgccgaaaggcaccgcgacgtccagcgcgtccacggtattcaccgacaccgttccggcattcaagcgccgcgccacccggtgtgcacggtgcaggtcgtcgctccacagcgaggcggcgaggccgtagcggctgtcgttggccaggcgtatggcctcgtcctcggagtcgaaggcgctgatcgccagcaccggaccgaagatttcctcgcgggccagctgcatgtccgggcgtacgtcgccgaacagggtcggttcgatgaagttgtccgaaccgttgatcgtcaactggcggccaccgccgagcagggtcgcgccctcgccttgcgcccgctcgatggcggcgagaatcccggcgatctgccggcggtcgacgatggcgccggcgcggctggccgggtccagcggatcgcccggctgccagtcgcgggccttggccagcaggcgctcgacgaactcgtcgtggatcgaacgctccaccagcaagcgcgagttcgccgaacagacctcgccctggttgaagaaaatgccgaaggcggccttttccgccgccaggtcaagatcgcggcaatcggcgaacaccaggttcggactcttgccgccgcactccagccagacctgcttgaggttggattgcgcggaatactgcatgaagtacttgccgacctcggtggagccggtgaacaccagtgcgtccacctccgggtgcaagccgagggccttgccggcctgctcgccgaggcccggcaccacgttcagcacgccttccggcacccccgcctccagggccagctcggccaggcgcagggcggagaacggcgactgctcggccggcttgagcaccaccgagttgccggcggccagggccggggcgagcttccaggcggccatgtcgagcgggaagttccacggcaccaccgcgccgatcacccccagcggcacgcgggtaatggtggccagggtctgctgggcggtcggcgcgacctggtcgtagagcttgtcgaggctttccgcataccaggcgaagacgtgggcggcgccgggtacatcgatgttccaggcgtccatcaccggcttgcccatgttcagcgagtcgagcagcgccagctcttcgcgatgggccagcatcagctcggccaggcgcagcagcacgcgcttgcgctcgaccggggcgagacgcgcccaggggccttcgtcgaaggcgcggcgggcggcggccactgccgcgtcaacgtcggccgcatcgcaggccgcgacccgcgccagcaggcgattgctcgccggatcgatggcgtcgaaggtagcgccggctggcggctggacgctggcggccgccgatcagggcctggtcgatga

SEQ ID NO: 15624 - DNA, 456 bp, Pseudomonas aeruginosa
atcatcatagagagtcagatgaagaagttcctgttgcccgccctgctgttcgccgcggcctcgctgaccggctgcgccagctacaacgtcagccagcccatcgccccggtggccggcgcggtgaaaaccgacctcaaggccgacgtcgccgtcggcgagccgatcagcggagactcctcggtcaatatcctgttcggcttcctcaagttcggcggcgacagccagttcgccgacggcgtcacctacggcgcagaaagcggctcgggcctgagcctcggcgccttcgacccggtgtcctcggccaaggccgccgccgcgttcaaggcggtgaagaactccaatgccgacctgatcgtggcgccgcgctacgaggtttcggtgaacgactacttcctgttcaagaaggtcgacgtcaaggtcaccggcagcaagggcaccatccgctccatccgctga

SEQ ID NO: 15625 - DNA, 321 bp, Pseudomonas aeruginosa; identical to SEQ ID NO: 8545

SEQ ID NO: 15626 - DNA, 276 bp, Pseudomonas aeruginosa
tgtgtcatcagtcagtatgttcacgaccagagtgcatccaaccatcatgcagggatgcagaaaaaccagcacctacgaaaggcctttggccaacgaatccgagacctacgcagcagccaaggcttcagccaagaagcattcgcagacaaatgcggctttgtccgcacctacatgtctcgcatcgaaaccggtactgccaaccccagccttgaggcagccaaggtgcttgctgacggcctgaacatgtctctttctgagctgcttcagggtctgtaa

SEQ ID NO: 15627 - DNA, 669 bp, Pseudomonas aeruginosa
tcggtacatccaaaaagatacagggtcatcaacatgttcattcgggcctacctccgtgcatccaccgacaaacatgcaacccgtgctaagcagttgctgattgacttcgccagtgagcatggacaaaagattgcagccttctatgttgagaatgagtcgggcaccaagcttgatcgtcctgagctattcaggctgcttgaggacagccacgaaggggattgcatactcattgagcaagtggacagattgtctcacctctcgccagatgactgggcaagtttgaaagccatcatcgcagctaagagggtggtagtggtatcgctcgatctggccaccagtcatgcagctctgaagcctgctgccaccatggatgacttcactaaggggatgattgcagcggtcaatggcatgttgctggatatgctggctgtagttgctcgtaaagattacgaagatcgtcgtcgccgtcagagccaaggcatcgctaaagccaaggaaatgggtgcatataaaggcaggcaagctgatgaggatcttcatgctcgcatcaagcacgccctgtcctctggcatgagccttcgtaaggcagctaccactgtaggttgtgccctgagcacagtgcagcgtgtagcgaagatgcagctcaaacccgcctctccggacttctag

SEQ ID NO: 15628 - DNA, 750 bp, Pseudomonas aeruginosa
gcgccgaacagcaccaccaatgcgagcacgcccagcaaccgctgctttcttgccttgtccatcgttaactccagtcttcggaaatctttcgcagcagcgccgccgcttcagcgggcgacgccgtgctcgtcgaacagtttcagcaggccgtcttcgtcgagcaccttcacgcccagctcgttggccttggccagcttcgagccggcgccgggcccggcgaccacgcagtgggtcttggccgacaccgagccggccaccttggcgccgagcccttccagcttgtccttggccacgtcccggctcatcgcctccagggtgccggtcagcacccaggtctgcccggccagaggcaggccttcgaccgccttgcgctcgctctgccaatgcatgccgaactcacgcaactgcgcctcgatggccagggcacgctgcacgttggccggctcgtcgaagaaatcgcgcaggcttttcgccgctcgctcgggcagacgctccacctggcgtagatcgagccagtcggcgcggatgatgccgtcgagcgaaccgaagcggctggccagcttttccgcgccggtggcggcgatgaagggaatgttcagcttgtcgatgaaaccggccagcgaggcacaagcggcgaactccgcggcgacctcgccctcttcctgcaactgcacgccatgttcggcatcgcgcaactgggcgatcacctggcggttgtgctcgtcggcgaagaagttgtggatctcgtag

SEQ ID NO: 15629 - DNA, 462 bp, Pseudomonas aeruginosa
atggcgccctcgctgatcgactccttgcccttgctgcgcttgaccaactgggtccgctccacggccgagccgcagaccgggcaatgctcgggcacctcgatagcctgcgcatccgccgggcggcgctcgagcaccacctgcatgacctgcggaatcacatcgccagcacggcggatcaccaccgtatcgccgatgcgcaggcccaggcgggcgacttcatccatgttgtgcagggtcgcattggacaccgtgacgccggccacctgcaccggcttgaggcgtgccaccggggtcacggcgccggtgcggccgacctggaactcgacacccagcagctcggtcagctcctcgcgcgcggggaacttgtgggcgatcgcccaacgcggctcgcgcgcgcggaagcccagttcgcgctggaaggcgatgcggttgaccttgaacaccacgccgtcgatctcgtag

SEQ ID NO: 15630 - DNA, 819 bp, Pseudomonas aeruginosa
tgctcgatggtctgggcggtcaacacgctgcgctgctcgtccttcagctcgccgttcagctcgtgggccagcttgcgcgcggcggcaaccatcacgtcgaaggcctgcttcggatggcgcggccccggcaggccgaggaagaagctcacggcgcgggtgctgaagttgtcgatgtcgtccaggtcgaaagtgcccggtttcaccgcattggccatggagaacaggatctcgccattgccggccatgctttcgtggcgatggaagatgtccatgtcgccgaagcgcaggccgctctcgaggatgttctgcaacaatgccggccccttgaagccgctctcgtcgcgggcgatgacgttgatgatcagcacctcgtcgaccggggcaggttcggcagcaaccgcaggggctttctcccgctctttctccttgcggcccttcgacttgcccttgcgcggctccactgtctcggcggcatcgctcgggtccgcctccagggccagcccctcgtcgaggtccagatcgccctggcgcggctcttcctggcgcttgccgcccttgcgttccttggcttcgcgggcgctgacgctgggcaggtcctgttcgtcgaaggatggctcgcgatgctcgaccacgcgcgccggccccagcagttcagccgagtcgccgtcgtcgtccggcagattggcgaaactgcggtcgagcttgaacttcaacttgcccttgccgccccgcatccgccgccaaccgtccaagagaatgccggcgatcacgataagcccgataacgataagccattcgcgcagaccgatatccatgtaa

SEQ ID NO: 15631 - DNA, 606 bp, Pseudomonas aeruginosa
ggcgcgccgactgctggtcgaggcgctccagggcctgctgggtggaattgtgctgcgccttcagcgagccgacccgcaccgccaactggtgcgcatggtccttgtgggtgcgggcatcctggcgaatccggtcgagccgttcgcgcagggcgtcacgctccgccagcagggtttcccggcgctcggtgtccagcgccatgctatccagcgcttcctgcagggtcaggcgcgcctcgctcagttgctcctgttccagcgcgcgctgctcggccagttccgccacttcttcgtcgagacggcggcgacgcagtaccagttgctcgaccttggcctgctgcgcggacaactgcgccttcagctcgccgtgccggcgcccctcctcctggacctggcgccgcacctgctcgcgcgcgccttccagctcgcgctgctcgtcgcgggccgcagccagacgctcctcgccttcggagacacgggtttccaggggctcccgccgctcctgcaacgcctccagttcctgggcgcgggcgatcatgccgccctgggcctcgtcgctgcgccggacccgcaggaagtgccggccgacccagtagccatcgcgactga

SEQ ID NO: 15632 - DNA, 1479 bp, Pseudomonas aeruginosa
caagaacccgcctggaggcacgccttgatcaggttcctgctcaaccgggagatccgcgtcgaagaacgcctggaccccaacctcaccgtcctcgactacctgcgccggcacctcggcaagaccggcaccaaggaaggctgcgcctccggcgattgcggcgcctgcaccgtggtggtcggcgaactggtcaccggcgaggatggtgccgaacgcatccgctatcgcagcctgaactcctgcctgaccttcgtttccgcccttcacggcaagcaattgatcaccgtcgaggacctcaagcaccaggaccgcctgcacgacgtgcagcaggcgatggtcgactgccatggctcgcagtgcgggttctgcacgccgggtttcgtcatgtcgctgttcgccctgcagaaggacagcgccggcgccgatccggccaaggcccacgaggcgctcgccggcaacctctgccgctgcaccggctaccggccgatcctcgacgccgccgagcaggcctgctgccacaggcgcgcagaccagttcgacgcccgggaagccgccaccatcgagcaattgcgcgacatcgctccgcgcgaaaccgccgagctgaacagcggtgaccggcgctgcctgctgccgctcaccgtcgccgacctggccgacctctacggcgccaatccgcaggcacgcctgctggccggcggcaccgacctggcgctggaggccacccagttccatcgcgaactgccggtgatgatctatgtcggccacatccgcgaaatgaaacgcatcgaagtgggcgccaactgcctggaaatcggcgccgccaccccgctgaccgactgctaccaggcgctggccgcggactacccggacttcggcgagttgctgcagcgtttcgcgtccctgcagatccgcaaccagggcactctcggcggcaatatcggcaacgcctcgccgatcggcgacgccccgccgctgctgatcgccctcggcgcgaagatcgtcctgcgccgcggcgaacggcgccgcgagctgccgctggaggagtacttcctcgactacaaggtcaccgcccgcgaagaaggcgagttcatcgagaagatcctggtcccgcgtgcccggcccagccaggcgttcaaggcctacaaggtctccaagcgcatcgacgacgatatttccgcggtctgcgccgccatcagcctcgacctggaagatggccggatcgtccgcgccagggtcgccttcggcggcatggcggcgattcccaagcgcgccgccgcctgcgaagcggcgctgcaaggcgcgcgcctggaagccgccagcttcgaacgcgccgccgccgccctggcgaacgacttcaccccgctcagcgacttccgcgcgagcaaggaatatcgcctgctgaccgcgcagaacctgctgcgcaaatgcttcctggagctgcacgctcccgccgtcgaaacccgggtgaccgcctatgtctaa

SEQ ID NO: 15633 - DNA, 1956 bp, Pseudomonas aeruginosa
ccatcgcaagccgcacaagagccaggaagagctggccgacctgttccgcgccgagttgaccaccggggtcggccgcagcgtcaagcacgaaagcgcccccaagcacgtcagcggcgaggcgatctacatcgacgatcgcctggagtttcccaaccagttgcacgtctatgcgcgcctgagcgagcgcgcccacgcccgcatcacccgcctcgacgtgacgccctgctaccagttccccggcgtcgccatcgccctcaccgccgccgacgttcccggccagctcgacatcggcccggtggtggccggcgacccgctgctggccgatggcaaggtggagtatgtcggacagatggtcctggcggtcgccgccgacagcctggaaaccgcgcgcaaggcggccatggcggcgatcgtcgagtacgaagacctggagccggtgctcgacgtggtcgaggccctgcgcaagcgccatttcgtcctcgacagccaccagcaccgcatcggcgattccgccgccgcgctggccggcgcgccgcatcgcctgcaaggcacgctgcacatcggcggccaggagcatttctacctggagacgcagatttcctcggtaatgcccagcgaagacggcggcatgatcgtctattgctcgacgcagaaccccaccgaagtgcagaagctggtggccgaggtcctcggggtttccttcaaccgcatcgtcatcgacatgcgccgcatgggcggcggcttcggcggcaaggaaacccaggccgcggcgccggcctgcctgtgcgcggtggtcgcctaccacaccgggcgtccggcgaagatgcgcctgccgcgcatggaggacatgcagatcaccggcaagcgtcacccgttctacgtcgaatacgacgtcggcttcgacgacgatggccgcctgcacggcatccagatcgacctggccggcaattgcggctattcgccggacctctccggctcgatcgtcgaccgcgccatgttccactcggacaacgcctacttcctcggcaacgccaccatcaacggccaccgttgcaagaccaacaccgcctcgaacaccgcctaccgcggtttcggcgggccccagggaatggtcgccatcgaggagatcatggacgccgtggcccgcagcctgggcaaggatccgctggaggtgcgcaagctcaactactacggcaagaacgagcgcaacgtcacccattaccaccagaccgtcgagcacaacctgttggcggagatgaccgccgagctggaagcgagcagcgagtacgcccgccgccgcgaggaaatccgtgccttcaatgccgccagcccggtcctgaagaaaggcctggcgctgaccccggtgaagttcggcatttcgttcaccgcgaccttcctcaaccaggcaggtgcgctgatccacatctataccgacggcagcatccacctgaaccatggcggcaccgagatgggccagggcctcaataccaaggtcgcccaggtggtcgccgaggtcttccaggtcgacgtggagcgcatccagatcaccgccaccaataccgacaaggtacccaatacctcgcccaccgccgcctcctcgggcaccgacctgaacggcaaggccgcgcagaatgccgccgaaaccatcaagcggcgcctggtggagttcgccgcgcggcactggaaggtcagcgaggaagacgtcgagttccgcaacaaccaggtgcgtatccgcgagctgatcctgccgttcgaggaactggtccagcaggcctacttcggccaggtttcgttgtccagcaccggcttctaccgcacgccgaagatcttctacgaccgcgagcaggcccgtggccggcccttctattattttgcctacggcgccgcctgctcggaggtgatagtcgataccctcaccggcgaataccgcatgctgcgcaccgacatcctgcatga

SEQ ID NO: 15634 - DNA, 1302 bp, Pseudomonas aeruginosa
cgtcggcgactcgctgaacccggccatcgacatcggccaggtcgaaggcggcttcgtccagggcatgggctggctgaccatggaggaactggtctggaacgccaagggcaagctgatgaccagcggcccggccagctacaagattcccgccgtcgccgacatgccgctggacctgcgggtgaaacttctggagaaccgcaagaatccggagcagaccgtgttccattccaaggccgtgggcgagccgccgttcatgctcggcatctcggtctggtgcgcgatcaaggacgccgtggccagcctcgccgactaccgcgcgcaacccgccatcgacgcgccggcgacgcccgagcgggtgctctggggcgtggaacagatgcgccggttgaagaccgcccaggcgcaagcggcggacgccgcggtcgagccggcctgaaccgccgcgatcgggaggatgacgagatgaactggatcagcgccctggccgagttgcagcgtagcggcgaaccttgcgtcctggtgactatcatcgaggagcgcggctcgaccccgcgcaacgccggctcgaagatggtggtcagcgccgagcggctctacgacaccatcggcggcggccacctggaatacagggcccaggccattgcccgggaaatgctcgccgcgcggacccaggacacccgtctggagcgcttcagcctgggcgccagtctcggccagtgctgcggcggcgccacggtgctgctgttcgagccgatgggccagccgcaggcacacatcgccgtgttcggcgcgggccacgtcggtcgcgccctggtacccttgctcgccagcctgccctgccgggtgcgctggatcgattcgcgggaacacgaatttcccgcgctcctgcccgacggcgtggagaaagtggtgaacgacgaagtgctcgacgaggtcgagcggatgccgcccggcagccacttcatcgtcatgacccacaaccacccgctggacctggagcttaccgcggcgatcctggcgcgcaacgacttcgcctacttcggcctgatcggctcgaagaccaagcgcgtcaagttcgagcaccgcctgcgcgaacgtggcgtcgacgccgaacgcctgcaacggatgcgctgcccgatgggcctggatcaggtgaaaggcaagctgccggcggagatcgccatctccatcgccggcgaggtgatcgccacctacaacgccgccttcggcctggaacgcaagcaggggccgtcgagcgtcacccggctgaccccggagtcgcgccgcgcccacgaatcctga

SEQ ID NO: 15635 - DNA, 1983 bp, Pseudomonas aeruginosa
gcggccccccgctcccccgcgtccgccgccaggcggcggacctcccacgaacctttttttttcgagactgccatgacccgcaacgccaaagcctaccgcgccgccatcctgcacagcatcgccgaccccgcggaggtcggcgtcgaacgctcctatgaatacttcgaggacggcctgttgctggtggaggacggcaaggtcgctcgcctcggtgacgccgaggccctgctcggcgagatcggcgacgtcgaggtcttcgagtaccgcgacgcgctgatcacccccggcttcatcgacacccacatccatttcccgcagaccgggatgatcgcctcctacggcgagcaactgctggactggctgaacacctataccttccccaccgaacgccagttcggcgacaaggcccacgccgaccaggtcgccgagatcttcctgcaggaactgctgcgcaacggcaccaccaccgcgctggtcttcggcagcgtgcaccggcaatcggtggaatcgctgttcgaggccgcccggcgcctggacctgcgcctgatcgccggcaaggtgatgatggaccgcaacgcgccggactacctgaccgacaccgccgagagcagctaccgcgacagcaaggcgctgatcgagcgctggcacggccagggccgtctgctcttacgcagtgaccccgcgcttcgccccgaccagcaccgcggaacagctggacatggcggcgcggctgctgcgcgagcatcccggcgtatacctgcacacccacctgtcggagaacctcaaggaaatcgagtgggtgaaggagctgttccccgagcgcagcggctacctggacgtctacgaccaccacggcctgctcgggccgcgctcggtgttcgcccatggcgtgcacctgtgcgacggcgaatgccagcgcctggcggagactggctcgccagtggcgttttgccggacatccaacctgttcctcggcagcggtctgttcgacgtgccgaagctggagcgctacaaggtcaaggtcggcctgggcacggatgtcggcgccggcaccagcttctcccagttgcagtccctgaacgaggcgtacaaggtcatgcagttgcagggcgcccgcctcgatccgttcaagtcgctctacctcgccaccctcggcggcgcccgcgcgctggagctggacgaccggatcggcagcttcgccaccggcaacgaggcggacttcgtggtcctcgactaccacgccaccccgctgctctcctaccgcctgagccaggccggcagcctggccgaacggctgttcgcgctgaccatcctcggcgacgaccgcacggtgaaggaaaccttcgccgccggtcgctcggtgcatcgccgcgactgactcccggcggaaacgaaaaagccccgcatcgcggggcttttcaatgcttcggatcaggccgccgaatcgctgtcggccttggcccggcgtggcttcttcttgccgccgaggaggtgcgagaacaccgcgtgcaggtcgccggaagcgttgtcgctctccaggttgagcttgctgtcgatgtgctccatgtggtgcatcatcagggtcaccgcgcgctccttgtcgcccttctcgatggcgtcgaggatctcgttgtgctcgtcgaacgagcagtgcgagcgaccgccgctttcgtactgggcgatgatcagcgaggtctgcgacaccaggctgcgctggaaactcaccagaggagcgttgcgcgccatctcggcgagcttcaggtggaactcgccggacaggcggatgccggcgccccggtcgccacgggcgaagctggattgttcctgcaccaccatctcgcgcaactcggccaggcgctcggcggtggcgttgtcggtggccagttcggtgatggcgcgctcgacggtgcggcgggcgaaaaggatctgccgggcctcgtcgatgctcgggctggcgaccaccgcgccccggttcggccgtaa

SEQ ID NO: 15636 - DNA, 1422 bp, Pseudomonas aeruginosa
cctgggtatcgacgacagcctcaacgatatcgagggcctgcaccagcgcatggccgacattctcctgtcggcaagccgcgaggcccagctggcgctgatcaacgcccacccggacctcgccggcaaggcggcgatccgtggcgaactgaccgcctccagcacctccgagcaggccggcgccgggattcacgaatgcagcgccgaggagttcgcccgcttcaccgaactcaacgacgcctacaaggccaggttcggcttccccttcatcaaggcggtgaagggcagcaaccgccatcagatcctggcggccttcgaggaacgcatccagcactccgccgacgaggagttcgctaccgcgctggccgagatcaacaagatcgccctgttccgcctgcagcagctctgaggcctgcggagacgagcatgaacgccgaacactcgcccttccgccactacctcgacctcgccgacgcgcgcctgggcagccaggtggtcgccgtcagcgacgaatggttcgccccggccagccgcatgctgcaggccggcgaaccggtgtggaaggaaggcgtattcgacgacagcggcaagtggatggacggctgggaaacccgccgcaagcgcttcgagggccatgaccaggcggtgatccgcctgggtgtgccgggcgtgctgaagggcgtcgacatcgacacccgcttcttcaccggcaaccatccgccggcggcttccctggatggctgcttctgcaccgaaggcgacccggacgacagcacgtcctggagcgaagtgctgccggcggtggggctgcagggcgatagccatcactaccacccgatagacgacgaacgtccctggacccacctgcgtctgaacatctacccggacggcggtatcgcccgcctgcgcctctatggcgtgccctaccgcgactggagcagccagccgccgggaacggcgctcgacctggccgcagcggtcaacggcggccgggcgctggcctgttccgaccagcatttcggacgcatgggcaacctgctcaaccccggacgtgccatcaacatgggcgacggctgggaaaccggccgccgccgcacgccgggccacgactgggtgatcgtcgccctcggccatcccggcagcatcgaggcggcggtcgtcgataccttgcacttcaagggcaactatccggaaagctgcagcatccaggccgccttcgtggaaggcggaaacgaggcccggatcgaggcgcagagcctcttctggcgcgagctgctgccagcgcagaagctggaaatgcaccaggaacaccggttcgagcggcacctcaacgccctcggcccgatcacccatgtacgcctgaacatctttcccgacggcggcgtcagccgcctacgcctgttcggcaggccacaattaccgtga

SEQ ID NO: 15637 - DNA, 564 bp, Pseudomonas aeruginosa
gacccgggccccgcgtgcgtccggaatacaacaaacagaatcgacaggatcagtatgcgcactctcaagatcgagccgttgaccaaggaagccttcgccccgttcggtgacgtgatcgaaaccgccggcagcgactatttcatgatcaacaacggctccacccgccgttatcacaagctggccacggtcgagaccgcgcagccggaagataacgcgatcatcagcatcttcagcgccgagaagctggaaatgccgttgcgcatccgcatgctggaacgccatccgctgggcagccaggccttcatcccgctgctcggcaacccctttctggtcgtggtcgcgccacttggcgatgtacctgtaccgggcctcgtccgcgccttcctgaccaacggaaggcagggcgtcaattaccaccgcggcgtctggcaccatccggtgctgacgatcgaaaagcgggatgacttcctggtggtcgatcgcagcggttccgggaacaactgcgacgagcatttcttcaccgaggacgaacagctcctcctcgacccccaatcaaaccaataa

SEQ ID NO: 15638 - DNA, 1326 bp, Pseudomonas aeruginosa
gagaggtcctgccgccggtccgccggccagggcaagaggtacaagactgtggaagcacatctcatcgaatggctgaacctgctggtgcgctggattcacatgatcgtcgggatcgcgtggatcggcgcttcgttctatttcgtctggctggagaacaacctcaaccgcagcaacccgcgtgaaggcctgtccggagacctctgggcaatccacggtggcggcatctaccacctggagaagtacaagctggctccgccgaaaatgccggagaacctgcactggttcaaatgggaggcctactccacctggatgtccggggtggtgttgctgaccatcgtgttctacctgaacccgaccctctacctgatcgcccccggcagcgacctggcgccggcggcggccatcgccatcggtatcggttcgctggtctgcggctggttcgtctacaccatcctctgcgattcggcgctgggcaagacccctgccctgctcggcctggtcctgttcgtcctgctggtcgccgccgcctacggcctgacccaggtgttcagcggccgcggcgcctacctgcacgtcggcgcgatcatcggcaccatcatggtcggcaacgtgttcagggtgatcatgccggcccagcgcgcgctggtgaaagccatcgaagaaaaccgcgagcccgatccggtgctgccggccaagggcctgctgcgctcccggcacaacaactacttcaccctgccggtgctgttcatcatgatcagcaaccacttcccgagcacctacggcagccagtacaactggctgatcctggccgccatcgcggtgctcgcggtactggtacgccactacttcaacacccgccacgaaagcaaccgcttcgcctgggcactgcccgccggcgcgctgggcatgatcgccctggccttcgtcaccacgccgaactaccagcaggcttccgcaccgctggccagcaccccggcggcggcaccggcacaaccggcgaccggcggcgacgcaccagccgcgcccgccgcgccccaggcctccaatgccgggaccgcgagcggagccgacttcgacaaggtccatcacgtgatccaggagcgctgcaccgtctgccactcggcgaaaccgaccagccagctgttcagcaccgcgccaggcgggatcatgctcgacaccccgcagcagatccagcaactggcaccgaagatccaggcccaggccgtggcctcgcagatcatgccgctgggcaacatcacgcagatgacccaggaagaacgcaacctgatcggcagctggatcgccaagggcgcacagatcaactga

SEQ ID NO: 15639 - DNA, 3132 bp, Pseudomonas aeruginosa
gcaagagtaacgtggggctcgcttctccaacggatgggggaggaaccgcccgccaggaacaaggaacgatccatgcgtcaaagggacctgaaattcaccttcgtcgtcggcgaagggaaactcgcgttcgatgtcgtcgagttcgaactggaagaagcgctctgcgagcctttccgcctgaacctgaagctggccagcgacaagaacgccatcgatttcaagcaggtactcgaccagccgggcaccttcaccctctggcaggacggccgtccggcccgctacgtccatggcatcgtcagccacttcacccaaggcagctcgggttttcgccggacccgctacgaactgctgctggaaccacagttggcgcgcctggagctgtgctgcaactggcggatcttccaggagaagagtgttccggagattctccaggcgctgctcaaggaacaccgggtgctcgactacgaacagcgcatctaccatgagcacctgccgcgcgaatactgcgtgcaggccggcgacagcgatcactacctgcacgaccggctggccttcgaggaaggcctggtctactacttccgcttcgacgaacaccgccacaccctggtctgcagcgaccggctctacgtccaggagcgtatcgccggcggcccggtgctgttcagcgcccagccggagggcgacaacccgcagccggtgcttcattctttccgctacagcgaaaatgttcgtacggctcgacagacccagcgggactacagcttcaagcgcccgacctacgaccaggagcatcatctcgctggcgaggcgctcgagcatcagggctcgtcctacgagcgctacgactaccccggtcgctacaagcagagcggcgccggccggcctttcagcgaaagccgcctcagagggcaccggcgcgatgcgcgggtggcatcggtcagcggcgacgacccgcggctgatcccgggccacgcctttgccatggaaggtcatccgcgtgccgacttcaacgcctggtggcggccggtgcgggtggtccatcgcggcacccagtatgccggccaggaggaagagtccgccgacgcccctctgggggtgagctacgacctgcgcgccgaactggtacccgaggacgtcgaatggcgtcccgcaccgctgcctcggccacgtatcgatggtccgcagatcgcgacggtagtcggcccggcaggggaagagatccattgcgacgagtggggacgggtgaaagtccagttcccctgggatcgcgagggacgtcacgatgagttcagtacctgctggatacgggtcgcgcagaactgggcgggtgccgactggggacacatggcgatcccgcggattggccaggaggtgatcgtcgattacctggacggcgactgcgaccagccgatcgtcaccgggcgcacctaccgggcgaccaaccgaccgccctacgcgctgcccgaccacaagatcctcagcaccatcaagagcaaggagtacaagggcagtcgggccaacgagctgcgcatcgacgacaccacggcgcagatcagtgcggcgctgatgagcgaccacggtgccagcgcgctgcacctgggctacctaacccatcctcggcccgaaggcggcaagccgcgcggcgagggcttcgaactgcgcaccgacgaacatggcgcggtgcgtgcggccaaggggctgctgctgagcaccgaggagcagctcagggccggcgccggccatctcgaccgaggcgtcgtggtgcaggtgctggaggcggcgctggagctggcccgcgagctgggcgactacgccggggagcaccagggcgtggggcacgacgcggcgccgcagcaaaccctccaggaagccgtgcgcgacctcggccacggtgccaacgacgagtccggcaagagcaacggaggcaagccggcgatcgccttgagcggtccggcagggatcgccgcggcgacgccggcgagcctgaccctggccgccggcgagcacgtcgacagcgtggcccggcagaaccagcaggtgaccgccgggcagaaggtggtgatcaacgccggcagcgacatcggcctgttcgcccagggcggcgagctgcgccagatcacccaccagggcccgatgctgctgcaggcgcagaagaacgacatccgcctggaagccgagcagagcgtggaggtcagcgccagccagcagcacgtgctggtcaccgcgaaggagcacatcaccctgatgtgcggcggcgcctacctgaccctcaagggcggcaacatcgagctgggcatgcccggcaacttcgtggtcaaggcggcgaagcacagtcatgtcggcgcggccagcctggaagccgagctgccgcagttcgaggtgggcgagacgcagcggcggttcgtcctcaagcaactggacgggcagacggccatgcccaacgtgccctataccatcaccatggccaacggcgaggtcatcgagggcgtcaccgacgccgaaggcgctacccagctgctgcagaaggatgcgatgaacatcgccaaggtcgatatgaaacacacgaaatcgcccgcctccgcagttgccgggatagcagcggcggttggcgcggcggttgcagtcggcaagctcctgagtggccccgacgccgaggccggacgtgctctcagcgaaggggaaatcagcctggcgaaaggcgtattcggcgattccatcgactattccacggtccgcctgcgcgacgaggactatgtcccctggcagggcaaggactacgtgatggcgccgaacggccacatctacttcggcgaggagttgcgcggcgtggcggactggagcctggagagcctgcagcgccagggtctgttcattcacgaaatgacccatgtctggcagcaccagcatggcgtcaacgtccttctggtgggggcctaccagcaagccaggcagtttctcctaggcgaccagtacgcctaccggttggagccgggaaagacgttgaaggactacaacatcgaacagcagggagacatcgttcgagattatttcctcgagaagaacgagttcggggaagcctctgcgaacagcaggttcgctggcgtactgaaaaacttcccaacgggatactga

SEQ ID NO: 15640 - DNA, 501 bp, Pseudomonas aeruginosa
ccaatgaaatgcaagaccttgctcattgcctgcctgttcggcctgggaagcgcccaggccctggccgtttccaaactgccaccgcagatcccggtgcacgccggctccgggcgcgtgacactggatctacgccccttgctggcggaaaccaacgacgtcgagatcacccgtgtttcggtatgtcggcgggtcggcagccattgccaggaaacgctgtggcggatcgagctcccgcccgggtggcgtgccggggagatcgaggtcttcggcgactatcccggctccagcgtgctcctgcgccggccggagcgcttgcagccagatgggagctacaacgcattcattcatttcaacgagcgtagccgtcggcaccagcaaacggtttccagcattgccgtcgaattctgcctggccggcgaacctggcaactggatgctgctcgacgaagcgacctgcctggcacgacgcaacgccgaggagcggcaaggagagaagccatga

SEQ ID NO: 15641 - DNA, 1275 bp, Pseudomonas aeruginosa
ttcctcggggctggccgtttcacgtctatagttctgcatgctcggatgccgttcctaccaggactcccacaggagcaacaggatgcgctcatggcatggcgtagtcacgaaaatcgccaagcaaggcaagggcgccgtggtcaagaatcgactcggcccggaagagcttctggtgcccttcacagtgagtacgctcgtcgaggtcgacctggacgcaaggatctacggaacggatgtggacgacacgccctgggcggagggcgacgaacgaaaggaggtgctggtcggtaccgaagtagaactgctgaccgatacggatacctttcctacccatgcgtcccaggtgctcagcgccaatttccgtttcgccctcgacatcgtcaagggagggctcagcggcccggtcaggaaaggggcggtcctggtcatctaccacgacttccagcaggagatccggagaggcgactccggcagcgccttcgcggaggcggtcgtcgcctatgcgcggaacaagctctacaagccggccttcgcgatcaaggcagataccaactacgcccagttggttcgggatctaggcaaggttgccgcggagagcggcgaacagtacttcatcgatacgatcctcatcgccacccacggcacggctggccaactctggctgggcaacccccacggcgagagcaccgcggacgtcatggcccggcgtgtccagggcaagcagttcgtcgagccccaggcctttggtgcgacccttctcgaactgttcggcaaggaactggccatcgccctctacgggtgcgacttcgccggggacgaggacggagaagcggcggccctcgagctgcgcatcgccgccaacgcgagagcggtctacgccggcaagggcacggtgtatctcaatgccagcaaagagggtcgttccacggtgacctgcagcaaggcgatggtggtctaccggaccgacaagatcgaggtactgggtggaaaccaggtaccggtattcgatatctgaggccccgccccgcactgtcattgccgattgaccaggatcttcggccccagacgctccgcctcgcccctggccttttccctggggagagccttaagatcgggagtccgcactggggcggaccttctcttcctgcgggtggtttctccggatgcttccagacagcatggtgggtagcagcgcgcggcgccttcgtttgcggcggacgcgcgggcgtgtcgggctcggcctggtggccgggctgtcggtactggcaggcatga

SEQ ID NO: 15642 - DNA, 387 bp, Pseudomonas aeruginosa
cgcaatagcctttcgagggcatctccgggtttgcgaagcaactctcatcccggtcatggactgaccatccggccccctatttgctggccgattgatagcatgggcggccttcgcaagcccattcgacccgcaatgccacgacacccgcacaccaccctgctcctctgcctttgcctgatcctgcccggttgcgagagcggccgcagctacagcctttccgaaggcgcgcctgtcacaggcatccgcatccagcgcgacgaccgctcgccgttgcagcgcctgcgggactgcgaacgccagggttgcagcgagcggcagaagatcgacccattcacccccgatcctgactacctgcgcgcggaaggccacttcccgctgccctggtaa

SEQ ID NO: 15643 - DNA, 909 bp, Pseudomonas aeruginosa
gcttccctcttcgcccgttcccgacgggcttttttccgttcccgacagataccctcagctgccctcagcgctttcctacgcaccaagaaggaaagcctctcgcctctctcggaacgagccgatttctcggcagtcgccgttcgcattccattggtcacccaacggcaacgaggatcggccatgactggattgccctcgcatggcaacggacgcgcctccggcgcctgcccatgtccggccctacccgccccactccgaggactgaagatgaacgactacatcgcccggctgcgcgagaaatacgacgaccatttcggctgtgcgccgagcatcgtcctggactgccgtgacttctggagacactgcgtagcggcgccggaaatggcggtgttcggctaccgcctggaaagcagccggcgcccgcaccacgtggtgatcaccgcggggatgagccaggcacggatgcacttcgcgccctatatgggcagcgcgcgctggtccagcgagctgatctgctaccttgacgtcctcggcggtgaggacctgcgccacctgcagtggctcgccggcctgccgttccacgaacgcctggccctcggccacggacacagcgtggcattcggtttcccgctctacgagcacagcctgctgcgtcacttccttctcctaccgaccccgctgggcgaagatgccgccctgttcgacggtttcgacctgtccgcccatccggtcgacctgctctgggtcgtgccgctgaccgagcaggaataccaggtgaaagtgaacaagcacctggaaggcatcgccgaagtgctgaacgacgccggacatccgctcagcctcgaccggcatcgccattgctacgtcaccggccaacgtccggaagggttcgagcggatactgcattag

SEQ ID NO: 15644 - DNA, 1281 bp, Pseudomonas aeruginosa
cactccacggcaaacaaaaatacagccacctccagacaagatcagcgccggcgcatgcgccgccggccagccataacagcgagagggctatccgcaatgaagactcaagtcgccatcatcggcgccggtccgtccggcctcctgctcggccagttgctgcacaaggccggcatcgacaacgtgatcctcgaacgccagaccccggactacgtgctcggccgcatccgcgccggcgtgctggaacagggtatggtcgacctgctgcgcgaggccggcgtcgaccggcgcatggcgcgcgacgggctggtccacgaaggcgtggaaatcgccttcgccgggcagcgccggcgcatcgacctgaagcgcctgagcggcggcaagacggtgatggtctacggccagaccgaggtcacccgcgacctcatggaggcccgcgaagcctgcggcgccactaccgtctaccaggccgccgaggtgcgcctgcacgacctgcaaggtgagcgcccctacgtgaccttcgaacgcgacggcgaacggctgcgcctggattgcgactacatcgccggctgcgatggcttccacggcatctcgcggcaatcgatcccggcggagcggctgaaggtcttcgagcgggtctatccgttcggctggctcggcctgctcgccgacaccccgccggtgagccacgaactgatctacgccaatcatccgcgcggcttcgccctgtgcagccagcgttcggccacccgcagccgctactacgtgcaggtgccattgtcggagaaggtcgaggactggtccgacgagcgcttctggacggaactgaaggcgcgactcccgtccgaggtggcggagaaactggtgaccggaccttcgctggagaagagcatcgcgccgctgcgcagcttcgtggtcgagccgatgcagcatggccggctgttcctcgccggcgacgccgcgcacatcgtgccgcccaccggcgccaagggactgaacctggcggccagcgacgtcagcacgctctaccggctgctgctgaaggcctaccgcgaagggcgcggcgaactgctggaacgctactcggcaatctgcctgcggcggatctggaaggccgaacgcttctcctggtggatgacttcggtgctgcatcgcttccccgacaccgacgcgttcagccagcgcatccagcagaccgaactggagtactacctgggctccgaggcgggcctggcgaccatcgccgagaattatgtcggcctgccctacgaggaaatcgagtag

SEQ ID NO: 15645 - DNA, 1680 bp, Pseudomonas aeruginosa
gccgcgccaccccggcgcaacgccggggcacctttcccaaggcgggaagcaacgttggcgcaggcgaatatcgacgaaagacggcccacggatcgattctccgcggcacctgtcctaccccaggcgcagtatgatgcccgctgccttcgcgttccgtccgccccaggtgccgtcttgtccgatctcgcccagaacccgcccgccgtccgtaccgtcctcgccggcctgatgctgtcgatcttcctcagcgccctcgaccagaccatcgtcgccgtctccctgccggcgatctcggccgacttcgccgacctcgacctgctggcctgggtgatctcggcctacatggtggcgatgaccgtatcgatgccgatctacggcaagctcggcgacctctacggccgccgccgtctgatgctcttcgccatcgtcgtgttcaccgccgcctcgctgctttgcgggctcgcgcagagcatgggccaactggtgctggcgcgagtgctgcaggggatcggcgcgggcgggctgatggcggtgagccaggcgatcatcggcgacatcgtcccgccgcgcgagcgcggccgctaccagggttacttcagcagcatgtacgccatcgccagcgtcgccggcccggtgctcgggggcctgctcaccgagtacctgtcgtggcgctgggtattctggatcaacctgccgatcggccttctcgcgctggccatctcgcggcgaaccctggtcggcctgccggtgccgcgccggcaaccggtgatcgactacctgggcatcgtgctgatggtggtgggcctcaccgcgctgctcctggccatcacccagatcggccagggcgcagcctggagcgaccctgcgctgctcggcctgttcgccctggcggcgctcgccctgctgctgttcgtcgcccaggagcggcgcttccgcgaaccgctggtgccgatgcaactgttcgccgtccgcgccgccaccctcagttggctggttgcgttcttcgccagcttccaggccatctcgctgaccgtgctggtaccgctgcgctaccagagcgttaccggcgccggcgccgacagcgccgcgctgcatctgctgccgctggtcatgggcctgccgctgggcgcgtactgctgcgggcggctgaccgccagcctgggacgctacaagccgctgatcctgctcggcgccgtcctgttgccctgcggcatcgccggcctggccctggtcccggtcggcgaccactggctgtccgggctgtgcatgctgctcaccgggatcgccatcggtacccagttcccgaccagcctggtggccgcgcagaacgccgtggagcaacgccacatcggcgtcgccaccagcaatgcgacgttgttccgctccctcggcggggcggtcggggtggcgctgatgtcggcgatcctgctggccctgctcaagcacctgcggatcggcggcgggctcgaccagggcttttccgagagcgccctgctgagcagcctggacgccgccagcgggccggcccgggtgatcctccagcatgtcctcgcggatgccttcaaggtgctcttcctggtcaacgcggcggtggcgctgctcggcctggcggtggcctcggcactgcccgacatgaccctgcgcggccgcggcgcgacgcaaccgacggcaggcgagtga

SEQ ID NO: 15646 - DNA, 333 bp, Pseudomonas aeruginosa
atctgctcggcacccgcgagccacagacctacggccggcggaccctgggcgaaatcgccgacgaatgcgcggccttcgccgagacgcgcggcttcgccgtggacttccgccagaccaaccaggaaggccaactgctcgactggatccaccaggcccgcggccgggtcgccggcatcgtcatcaaccccgccgcctggacccacacctcggtggcgctgcgcgacgccctggccgcggtggaactgccggtggtcgaagtgcacctgtccaacgtccaccagcgcgaagcgttccgccaccactcctacgtctcgccggtggcgctgggagtga

SEQ ID NO: 15647 - DNA, 798 bp, Pseudomonas aeruginosa
agacctccagcgacagcggaccgcgatagccggacgcgacgaccggcgcgaggaagcctgccaggtcgaagccgccctgacccgggaagcagcggaagtgccggctccattccagcacgtccattgccagcaagggcgcgtcggccatctgcacgaagaagatcttttcccccggaagatcggcgatgccgcggggatcgccgtccagcgagagggtgtggaagctgtcgaggatcagcccgaggttcgcctggtcggcccgccgcaccaggtcccaggcctgctcccaggtgttcacctggcgcccccaggccagcgcctcgtagccgatgcgcaggccgcggacggcggcgcgctcggccagctgccagaggtcatcggccagcagcgccggttcgccgagggcatcggcagcgacgttgctgcacaccagcaccaggtcggtgccgagttcctgcatcaggtcgaacttgcgttcggcgcgctccaggtttcgccccaggcgttcccggcggcagccctcgaagtcgcggaacggctggaacagcaggatctccaggcccaggtcggcacacagccggcgtacgtcgcgcgggctgccgtcgtaatgaagcaggtcgttctcgaagatttccaccccgtcgaaaccggcggcggcgatggcctcgagcttttccggcagggtgccgctcagggatacggtggcgatcgaacgctgcatgcttcgactcctcaatgcgccctacggcgcctggcgccgcgcgagggccggcggcggaacggcggaggcgcggatag

SEQ ID NO: 15648 - DNA, 1638 bp, Pseudomonas aeruginosa
cgctttttcgaccaatcgcgcaccatcgctgccacccgtgcaggccgtcccgatctgccggaagcgctccgcgcttctttccgggcacctgcgcaacccacgcgacataacaatttcaagaatcgggtacccgctcatgtccatcgccgacctctccgtccgccctccatcccgtccgctggccgctcgtccggcccgaccgcccctggcccgctgacaccggcgcggcccctggcccgcccgcgtgcaacccagaacgacaaatccaggccgggcgcccaggcaccggccgccgaaaggatggccccgtcaatgatccactcttccagctctcgactgctcgccgccgacgccccgcgggaatcccgcggcggcaggatccgcaacgccttcgccgtcggccggacgcgctggggcatgctcgccctggtgttcttcgccaccaccctgaactacatcgatcgcgccgccctcggcgtgatgcagccgatccttgccgagaagatgagctggacggcaatggactacgccaacatcaacttctggttccaggtcggctacgccatcggcttcatcctccagggccgcttcatcgacaaggtcggggtcaagcgcgcgttcttcctcgccgtgctgctctggagcctggccaccggcgcccacggcctggcgacctcggcggcgggcttcatggtctgtcgcttcatcctcggcctgaccgaggcggccaactacccggcctgcgtgaagaccacccgcctgtggttccccgccggggaacgggcggtggccaccggcatcttcaacgccggcaccaatgtcggcgcgatggtcaccccggccctgttgccgctgatcctcagcgtctggggctggcaggcggcgttcctctgcatgtcggcgctgggcctggtctggctggtgttctggtggcgcaactactacaaccccgaggagcatccgcgggtgaagcagagcgagctggaatacatccagcagcaggaggagccgcccgccacccgcgtgcccttctcgcagattctccgccgccgcggcacctgggccttcgccctggcctactcgatcaccgcgccggtgttctggttctacctctactggctgccgccgttcctcaaccagcagtacggcctgggcatcagcgtgacgcagatgggcatcccgctgatcctgatctggttgaccgccgacttcggcagcgtcggcggcggcatcctttcgtcctggctgatcggccgcggcatgccggcgatccgcgcgcgcctgctgtcgatgctgctgttcgcctgcaccatcgtcggcgtggtgttcgccgccaacgccagcggcctgtggatcgccgtgctggccatcgccctggcggtcggcgcgcaccaggcgtggacggcgaacatctggagcctggtgatggactacacgcccaagcacctgatgagcacggtgttcggcttcggcggcatgtgcgcggcgctgggcgggatgttcatgacccagatcgtcggcggcgtactgaccgcgacgaacaacaactacgcggtgctcttcaccatgatcccggcgatgtacttcatcgccctgacctggctgtacttcatggctccgcgccggatcgaagcctga

SEQ ID NO: 15649 - DNA, 345 bp, Pseudomonas aeruginosa
gtccaagcgcccggcgctcgccgggcacctccctgcctagagaacaagaacgaagggacacacccatgtcgcacccgagccacgtccgcgcgctctgcgcttccctctgcctgggcgccggcctgccagtccatgccgggcacgtccacgccgggcaaggtttcctcgaagacgccaaggccagcctcaccgcgcgcaatttccacctgcaccgcaacttcgtcggcgatgccagccagggcaaggccgaggagtggacgcagagcttcatcctcgacgcccgctccggcttcacccagggcagcgtcggcttcggcctcgatgtcctcggtctctacagcctga

SEQ ID NO: 15650 - DNA, 558 bp, Pseudomonas aeruginosa
gcctgttgtgaagcctacgcgccgaccccgttgcgttcagcggccacggcgccaggcgaccaccaggccgctggcgcagatgacgaggatgccgagcagcgcccaggcatccggcacgtggccgaacaccagcaggccgagcaggccggcgaagatgatctggccatagctgaacggcgccagggtcgccggcggcgcatggcggaaggcctgggtcagcagcaggtggccgcccatgccgcaaccgcccagggcgatcatcatcaggccgtggagaagacttggagtctgccagaagaacggcaccagcaggctcatgatgagcgtgttgaagatgccggcgaggaagttgctggtggtcgggctgtcgctgttggcgagcatccgcgtgagcagttggtagagcccgaagcacagcgccgagccgagcgggaacaacgccgccggggtgaacagcgcgccaccgggacgcacgatgaagagcacgccgatgaagccggtgagcaccgccagccattggccgaggctgaccttctccttcagcagcggcacggataa

SEQ ID NO: 15651 - DNA, 759 bp, Pseudomonas aeruginosa
cgcggtcaccagcagcggtgccaggaagttcaccgcggtcgcctcggccaagggcaggtagcgcaggccggtggtgaagaacaggctggtgccgatcaggcacagcgcccgcgccaactgcatgagcggacggcggctgcggatcaccgcgaggccgttgcgcggcacgaacacggcgaccatcaacagggtgtgcaccaggtagcgggcccagaccaccatgacgatcgggtagaaaccggaaaggaacttggacaacccgtcgtggctggcgaacaggaacaccgcggcacagatcagcaggatgccgcgcagggtctggtcgctggcgggcagcggggaggtggatgcgttcatcggagggtccgggcaccagggcaaatcgatagcaggctatttattctgacggtacccgccatcgaggaaagaaacgatcggcttcaacgtttggaaactatagaaccccgttccattatgcaaacgggcaacctgcctgcgcggtggcgctacaggcgggcgagcagcgcccgggtccgctcgatcgccagccgcgcccgctccgcgccatccacgccgcgcgcgagcagatccagcgcgggcacctccaggctcagcggcaggttctccggcaaggcgcgcagcagcgccagcagatcgagcccgccatcgccagggaagcgccgttcctcgcgggcctggcgaaggatttcgtccatcgacgtcggacgcggcccgacgacatcgcagagttgcgcgtag

SEQ ID NO: 15652 - DNA, 768 bp, Pseudomonas aeruginosa
cgcgcgccgaactcggcgccgacctccagcaccgcggcgaactcgccgacgcgggtgtccggacgcaggcgcaggatctccacgtccagcgtgcgcactccggctgtcgcgcagccgcgccagggtccgccggcgcaggccggcatcggccagcagcggatagtggtgctcttccacggtggccggcaccaggcgcaggccgacatgactgtagccggcgcgggcggcagcctcgaccatgtccgggggcgacagctcgagcacggtgagcgccgccagggaaagaatcctcgattccatgcactacctcatcgtcagcggttcagaaactggccggcgcgcaggcccggccactgcgcgcggcctcgcgaaccgcctcgaccagcgccagggtgcgagcggcgtcggtggcatccatcaatggcgcttcctcgccccgcgcgacccggacgaagtgctctagctggcgttgtagggggtcgcctgtcgccacggcctccacgctggccgccagcgggtcgtgccagccctgccgggcctcggcgtagcgccagcggcggagctggggaaggctcagggcaccctcggtgccggccagcaggtagcagggttgctcggcctggcgtggatagaccgggttctccccggctgccagctcccagctccagggcgccgccgcagcgtcgcaaccggtcaggctgcccagggcgccattggcgaagcgcaggagcagcgcgatgttgtcttcgttgggcaggccacggatag

SEQ ID NO: 15653 - DNA, 402 bp, Pseudomonas aeruginosa
cccggaggtggcgccctgggacttggcgatccaggtctggcgatcgccttcgattacccccaggcgcaccagttcgccggtctcccgggcgagcccgtcgagcaccggctggaccagatcgaccaccccgctggacgcgaggaagcggaagcccagcgcggccaggcgggtgctgaggcggtagcggctggtgtcgtggtcctggctcacgtagccgagccggatcagctcggcgagcatgcggtgcgcggcgctcttggggatatccaggcggtccgccagttgttgcaggggcaggccgcgggcatcgctggcgaggagttcgagcaagccgagggcgcgttcgatgaggctaccggccatggaaggacgttcctgagtcgagggaaggcaggattctag

SEQ ID NO: 15654 - DNA, 657 bp, Pseudomonas aeruginosa
tcggcatggtcttcggcgccctcggttccggaccgctggccgaccgctacggacgcaagctggtattggtcgcggcggtcttcctcttcggcctgttcagcctggcctcggcctacagcaccaacgttcgagcaactgctggcgctgcgcttcctcaccggcctcggcctcggtgcggcgatgcccaacgccaccaccctgctttccgaatacacccccgagcgcctcaagtcgctactggtaaccagcatgttctgtggcttcaacctgggcatggcctgcggcggattcgtctcggcgaagctgatcccgctgttcggctggcacagcctgatgctgctcggcggcctggtaccgctggtcctggcggtagtcctgctgttccgcctgccggaatcggcgcgctacctggtggtgcgcaaccgcggcagcgagcgggtacgccaggtgctggcccccatcgccccggcgcaggtggcgctggcacggagtttccacgtccccgagcagcagacggtgcaggccccgcaacgtgttcgcggtgatcttttccggtacctacagcgccggcaccctgctgctctggctgacctacttcatgggcctggtgatcgtctacctgctcaccagctggctgccgaccctgatgcgcgatag

SEQ ID NO: 15655 - DNA, 588 bp, Pseudomonas aeruginosa
cggcgcgagcctggagcaggcggcgttcatcggcgcgctgttccagttcggcggggtgctcagcgccgtagcggtgggctgggcgatggatcgcttcaacccgcacaaggtgatcggcctgttctacctgctggcgggggtgttcgcctggtgcgtcggccagagcctcggccaggtcaccctgctggcgaccctggtgctgctggccggcatgtgcatcaacggcgcgcagtcggcgatgccgtcgctggcagcgcgcttctatccgacccaggggcgggccacgggggtctcctggatgctcggtatcggccgcttcggcgccatcctcggcgcctggatcggcgccaccctgctgggcctgggctggaacttcgaacaggtgctgaccgccctggtgctgccggctgcactggccaccgccgcggtgctgctgaaggggttggtcagtcacgcggatgcggggtgaagctgccccatcgcgtagggcgaataaccgcttgcggttatccgccgtcgggcttcggtgtatcggcggataacgccggtggcgttattcgccctaccccagggggcggcatcgcgtaa

SEQ ID NO: 15656 - DNA, 1485 bp, Pseudomonas aeruginosa
  unsure (415): Identity of nucleotide at the above locations are unknown.
ccgcttgcggttatccgccgtcgggcttcggtgtatcggcggataacgccggtggcgttatccgccccaccccacggttggcggcatcgcataaggcgacggcgcttcgcttcagaaggtgaattccatattcaacgtcggcgtcgaggtgcggctgccggtgccaccgtcgacgccgaacttgttgtgccaatactcgtagccgacgccgagccacaggttcggctggcgcttgtcgcctggcagggcggcgaccatcagggcggtgcggaccagggtttccgccgcggtgtccttgtcgttgtagtcctcgcccttctctcccacgtagttgacgaagccctggaacttcgccgcatggttgccgaccttgaacggccgcatccaggtcaggttgagcatgtaggtggtgtcnaaggtgtggtcgggatggcgcgcgccgggcacgccgaagtggttcttctcgcggtagtagagcaggctcaggtcgagcacgccgggaccgttgaacttgagggtcgggccgaacaccagggcgcgcttcttggccgaagccaggttgttgttgcggctggcgtcgaagcccagggtgaaggcgtagtccttgaccaggccggtgcccagcggccggtcgaacacccgcgaagcgtagagctggtggcggtagaccgcatagacttcgctgccaccatggtcggtgcccttgcgcgggtcgcggttgtcggaaaggaacacatcgagattgaagaaattgctgccgtagcgatagccgtcggcgtgggtgaagctgtagatgcgcttggcgaacttgtccgggttgttcgggttggtgaattgctggccgtaacggaaaccgacgctgttgctcatccattccagcgccatgctctccccggcgccgacgagcgcgatcagggcggcggcgccctgcatcatcttcttcatgctgtgtgtcctgctggttgcttgttgttcttgtggcgactcagcccccggtttcgcgccggggtcgcggggcagtatcggcacttcgccgcgctgaccaaagaacagaatatcgaacataccgatgccgaaacggcatcagcggacgggcaagctcgggcaagccgtctggcatcggcgcgagcgccgctcaggcctcgttcaggcgcgcttcctcgcgctcgcgcaggcgcacttcctcggcgatctgccgggccagggcgtccaccgccaccggcaggtaacggccggtgcgcacgtagaggccgaggtcgctgtggatgccgccattgtctttcagcggcaggaaacgcagctcgccctgggcgatgtcggcctcgatccccaggcgggtctggaaggcgacgccgagcccgcgccgcgccagttgtcgcgacagctccagggagctgctctccagcaccgcccggcgcggttcgcgcaaacggcgctggagcggcgccagcaggtgatggatggacagctcgctcttggccatga

SEQ ID NO: 15657 - DNA, 753 bp, Pseudomonas aeruginosa
gtgcggggatctgcgtgtcccacatgcccaggtcggtgcccagcgagtttgacaacagcaggaccggcgcgccggccggtccttccagggagtagttcaggtcgccgtcggcgaggcgtacggttggcacgaaggggatctccagtcaggcgggatggggttcgaagcccagggcatggtgttcggcgagcgcgcgctcgacccaggcgcgggcctggccgaggtaatgggcgggatcgagcaggcggtccagttcgtcgccggacaactcggcgctcacccgcgcctcttcgccgagcaccgcgcgcaactcgcggcgctgctcgacggcgcggcggcagcactgttccaccagatggtgcgcggcttcgcggccgatacggcgggccagggcgatgctcaccgcctcggcgagcaccaggccgtgggtcaggccaaggttgcggcgcatccgctgggcgtccacctccaggccttcgagcaggccgatcgcctgttgcagcgcgccggcaaccaggcaacagagttccggcagggtttcccactcggcgtgccagagaccgaggctgcgctcgtgttcctgcggcatcgccgcgaacagggtcgagaccagccccggcgcacgggtggcggcggcgatcagcaccgcgctgctcaccgggttgcgcttgtgcggcatggtcgaggaaccgccgcgcccggcgccggccggctcgaagacctcgccggcctcggtctgcatcagcaggctga

SEQ ID NO: 15658 - DNA, 516 bp, Pseudomonas aeruginosa
catcgcgaccgaacttgccgaggttaccggccaccaggccgagcacgctggcgaattccaccaggcggtcgcgctgggtgtgccagggttgttcgggcagagccaggcccagctcctcggccagcgccgcggccaccggcagggcctgttcgccgagcgcggcgagcgtccccgaggcgccgccgaattgcagcaccagcaggcgcgggcgcaactcgcgcaggcgctggcggtgccgggtcaaggcaccgagcaggccggcgagcttcatgcccagggtcaccggggtggcgtgctgcaaccaggtgcgcccggccagcggcgtgtcggcatgccgttcggcctggtccgccaggacctcggcaagacgttgcagatcctgctcgagcaaggccagcgcacggcgcagttgcagcaccaggccgctgtccatggcgtcctggctggtggcgccgagatgcacgtagcgctcggcctcggcgtcgccagccgccacctggcggcccagcgccttga

SEQ ID NO: 15659 - DNA, 336 bp, Pseudomonas aeruginosa
aagatcagcgagccgccggcggtgaagccgagcacggtgaataaggcccgcttgtgcttgaacagctcggcgaaggtgccggattccttgcgctccagggtcgacttcgaagcggtctcgttcagcgagcgccgcagccagagggcgatcaccgcggtgatcgcgccgatcacgaagggaatccgccagccccaggcgcgcagttcgtcttcgctcagcaactgctgcaggatcaccaccaccagcaccgccagcaactgtccgccgatcagggtgacgtactggaacgaggcgaagaagccgcgctggcccttgagcgccacctcgctcatgtag

SEQ ID NO: 15660 - DNA, 888 bp, Pseudomonas aeruginosa
cactttgtgtcatataacttgatccgtgtcatttacagccgggtcgttgcgtggcgcgcaactgcctggcgtttcccccgactcgctccgtcaaaggaacctcgcatggctacgacactggaattacccaaggatcaactgatccagcacgcgctgaagcagatgaaaagcagcctcggcgataatacgtggactgaccggcaaaagctggccctgacctgccggattctcttcgaggccggccacgactccgggctcgccgggcagatcacctcgcgcggcccggaggcggggacctactacacccagcaactgggcctgggcttcgacgagatcagcgccggcaacctgctgctggtcgacgaagacctcaacgtcctccacgggcacggcatggcgaatccggccaatcgcttccacagctgggtctatcgcgcccgcccggacgtcaactgcatcatccacacccacccgctgcacatcgccgcgctgtcgaccctggaagtaccgctgcaggtctcgcacatggacctttgcccgctatacgacgactgcgccttcctcaaggactggccgggcgtgccggtaggcaacgaggaaggcgagatcatctccgccgccctcggcgacaagcgcgccatcctgctctcccaccacggcctgctggccaccggtgcgagcatcgaggaggcctgcgtgatcgcggtgctgctcgagcgcgcggcgaagatgcagttgctggcgatggccgccggggagatcaagccgatcccgccggccctggcgcgcgaggcccacgactggatctccaccccgaagcgccacggcgccgcattcaactactacgcccggcgctgcctgccgcgcaacagcgactgcctgagctga

SEQ ID NO: 15661 - DNA, 864 bp, Pseudomonas aeruginosa
cggctgtcgttggccaggcgtatggcctcgtcctcggagtcgaaggcgctgatcgccagcaccggaccgaagatttcctcgcgggccagctgcatgtccgggcgtacgtcgccgaacagggtcggttcgatgaagttgtccgaaccgttgatcgtcaactggcggccaccgccgagcagggtcgcgccctcgccttgcgcccgctcgatggcggcgagaatcccggcgatctgccggcggtcgacgatggcgccggcgcggctggccgggtccagcggatcgcccggctgccagtcgcgggccttggccagcaggcgctcgacgaactcgtcgtggatcgaacgctccaccagcaagcgcgagttcgccgaacagacctcgccctggttgaagaaaatgccgaaggcggccttttccgccgccaggtcaagatcgcggcaatcggcgaacaccaggttcggactcttgccgccgcactccagccagacctgcttgaggttggattgcgcggaatactgcatgaagtacttgccgacctcggtggagccggtgaacaccagtgcgtccacctccgggtgcaagccgagggccttgccggcctgctcgccgaggcccggcaccacgttcagcacgccttccggcacccccgcctccagggccagctcggccaggcgcagggcggagaacggcgactgctcggccggcttgagcaccaccgagttgccggcggccagggccggggcgagcttccaggcggccatgtcgagcgggaagttccacggcaccaccgcgccgatcacccccagcggcacgcgggtaatggtggccagggtctgctgggcggtcggcgcgacctggtcgtag

SEQ ID NO: 15662 - DNA, 750 bp, Pseudomonas aeruginosa
agcttgtcgaggctttccgcataccaggcgaagacgtgggcggcgccgggtacatcgatgttccaggcgtccatcaccggcttgcccatgttcagcgagtcgagcagcgccagctcttcgcgatgggccagcatcagctcggccaggcgcagcagcacgcgcttgcgctcgaccggggcgagacgcgcccaggggccttcgtcgaaggcgcggcgggcggcggccactgccgcgtcaacgtcggccgcatcgcaggccgcgacccgcgccagcaggcgattgctcgccggatcgatggcgtcgaaggtagcgccggctggcggctggacgctggcggccgccgatcagggcctggtcgatgaagcgctgtgtcgcggcgcgccgttgccaatcgctgagttcgaacaccccaccttctccttgttatctcgccggtctgcgccggtcgtggttctgcacgcatggcccggaccgccgggaggcggaccgctgtccatggggtcgatggggaaggatggtcgcgcaagccgcggcgaaggaaaattattaaaaatgtcctcgggacataagaaaaagctggccaggcgtgccccggcaaagtgcgtcgtgctgggttatcgtgcaggcgggcaatcgtcgtcgcggccagcgccgcgacgctcggcagcggcctgcaacttgcttgcagcgcggcggacacaacaatcgaggcgcgcacgcccggcccgggggaggatgatgcgccgatga

SEQ ID NO: 15663 - DNA, 930 bp, Pseudomonas aeruginosa
ggtcttgcagtggcgtcctataccttgcggcaactcaagtatttcgtgaccaccgtggaatgcggcagcgtggccgaggcctcgcgcaagctgtacatcgcccagccgtcgatctccacggcggtgaagggtctggaggaaagcttcggcgtgcagctgttcatccgccaccacgcccagggcgtgtcgctgacccccgccggcgcgcgcttctaccgcaaggcccaggaactgctgcggatggctcacgagttcgagcagaacgccctggccgacaacgacgtgatcgccgggcagatcgacatcggctgcttcgagacggtcgccccgctctacctgccgggcctgatcgccggctttcgccaggcctatccgggggtggagatccgcatacgcgacggcgagcagcaggaactggtgcaaggcctcacctccgggcgcttcgacctggccttcctctacgagcacgacctcgactcgaccatcgagaccgagccgctgatgccgccgcaacgaccccacgcgctgctccccgaagggcaccgcttcgccgggcaggcgcaagtgtcgctgcgcgacctgtgcctggaaccgatgatcctgctcgacgtgcagcccagccgcacctatttcgtcagcctgttcgaggaactcggcctgacgccgaacatcgccttcagctcgccgtccatcgagatggtgcgcggcatggtcggccagggcttcggcttctccctgctggtcacccgcccgcattcggaatgcacctacgacggcaagaaggtggtcatggtcgacctcgccgagccggtgtccacctccgggctcgccgccgcctggctgaaacgcgcgcaactgaccaagccggcacgattgttcgtcgactactgccgggagcaactgggcaagcttgccgagcgccggcactga

SEQ ID NO: 15664 - DNA, 999 bp, Pseudomonas aeruginosa
cggccctttttacccctcccgcgccgcctcaggcacaatcccccgacgccaccggccaggggaacgcggatgctgatagacgaagaaatcaccctcaagaagctggaaaccttcctcgccttcatgcgcaccggcaacctggcgcgcgcggcggcggaactgggcaccagcaacgtcagcgtgcaccgcgccatccactcgctggaaagcgccctgcgctgcccgctgttcaagcacgagggacgcaacctgaccccgctggaaagcgcctacgtgctcgaggagcgcgcgcagaagctggtccaggaggtactcgacacggtgcgcctgacccgcgaggcggccggcttctccgccgagcgtttcaagctcggcgcgctctattcgctgacggtgaagaccgtgccgcaactgatcatgggcctcaagctgcgacgcagcgcgctgaacatcgacctgatcctcggctccaacgtcgatctgttctaccagctgaagaacatggagctggacgccatcctggtgtcgctcaacgacagcgtcagcgatcccgactgcgagcacctgccgctgttctccgatgacatcttcctcgccgtgccggtggactcgccctacgccaggctcgccgagatcgatctcagcaccctgcgcgacacgcccttcgtcacgctcacccagggcttcgccacccatcaggacggcacccgggtgttccagcaggccggcttcgaaccgcagatcgccatgcaggtgaacgacatattcaccctcctcagcatggtcagctcgggggtcggccatgcgctgctgcccaaacgcatcgaggcggtctacgagaaccgcgtgcggctgatcccgctgcaaccgcgctatcgcctgcagcagcacatcggcgtggtgttcctcaaggccaaggagcgcgacccgaacctgctggcgttgctcgcggagtgccggatgtacagcctgcgcctggagcaggaggcggcgggatag

SEQ ID NO: 15665 - DNA, 1050 bp, Pseudomonas aeruginosa
  unsure (486): Identity of nucleotide at the above locations are unknown.
cggacggaaatccacattaccgctggcccgctgacctatccccaaccctcgcccttcagggagagggtgcccggacgagcccgctcacccaaccaggccgcgcacgctgaaatacagcagcgacggccccagcaggcaaccgatggcggtatagaacgccgcggtcaggcaaccgtagggcaccagcttcgggtcggtggcggcgaggccgccggcgacgccgctggaggtgcccatgagaccaccgaagatcaccgccgtacgtggattgttcaggccgatgtagggcgcgacgaaaggcgtcaggaccatcaccaggatcgccttcaccaacccggcggcgatgatcagcgccatcacctcggagctggcccccagggcggcgccggtcaccggtccgacgatgtaggtgaccgcgccggcgccgatggtggtcaggctgaccgcatcggtatagccgaacgccatggccaccgcgaccccggngacgaaggacgaaccgactccgaggaacagcgacaccaccccggaaacccctgcccgacgcagttcctcgacattcaccccgaaggccgtggcgacgatggcgaagtcgcgcagcatggcgccacccagcaggccgattccggacatcaggggcacgtccaccaatcctttctgcccgccggtggcgacgccgccgacgtaggacagcaccaggccgaggaagatcgcgatcgccgagccgtgcaggcgcccgcgggtgaggcgcgccgacaaccagtaggacaccgccatggtcacgccgatgatggcgaagccgctgatcaggccgtagccattgatgactttgttcagggactcgaacatggcgctcacccctgcacgctggtgcgcggtttcaatggccgggcgccttcggctttcttccggccgaagcggtcgagcagcgggaccagggcgaaggccacggcgaccgcggcgatgccggcgaggatagcggccggcccgccgctcagcgcgccgaggacattctgctgggcggccatggcgaccacgatgggaatatag

SEQ ID NO: 15666 - DNA, 363 bp, Pseudomonas aeruginosa
  unsure (21),(45),(118): Identity of nucleotide at the above locations are unknown.
gcgtaccgtcgcactgtgcgntgctcgacgaaccggccgcgcgcntggccgaagccttcgccggcatccgcctgcatcggccgcgcgtgcccatacatgagcagcagccgggcgcgcntggtcgccgaaccggccgcgctggccgacgatctcgccggcaacatggcgcgccgcgtcgagtggctggcgacattgcgcagcgcctacgagcgcggtgcccgcctgcatctcgagctgccgccgggacgggtcctcagcggtctggcgcggcctctgttcggctgcgccacgccggccttcgaaggctcccgggcggataccctggacgcgctgttgcgcgaggaggaaaagagaacccgataa

SEQ ID NO: 15667 - DNA, 471 bp, Pseudomonas aeruginosa
acgtggtgccgggcctcggcgagcaggccggcaaggccctcggcttgcacccggaggtggacgcactggtgttcaccggctccaccgaggtcggcaagtacttcatgcagtattccgcgcaatccaacctcaagcaggtctggctggagtgcggcggcaagagtccgaacctggtgttcgccgattgccgcgatcttgacctggcggcggaaaaggccgccttcggcattttcttcaaccagggcgaggtctgttcggcgaactcgcgcttgctggtggagcgttcgatccacgacgagttcgtcgagcgcctgctggccaaggcccgcgactggcagccgggcgatccgctggacccggccagccgcgccggcgccatcgtcgaccgccggcagatcgccgggattctcgccgccatcgagcgggcgcaaggcgagggcgcgaccctgctcggcggtggccgccagttga

SEQ ID NO: 15668 - DNA, 1278 bp, Pseudomonas aeruginosa
tcgacaagacccgtatcgcggtggatcgcaccgcccgcgagatcggcgtgctctgacgcgccccggcggcccggcctcggccgggtcgactgcgacacggagcgtccccccataacgacgatgcggcgcctggcgaccgcgcgcggaaccgtttcggcctctggccggcaactgcctcagcaacatcacaacaatgccaatcggctgtgggagtgttccatgttcaagtccttgcaccagtacgcacacgtgttttcccggttgtccctgttcggcctggcgttcgccgcggcggcccaggcgcagagccagagcctgacggtgatctccttcggcggcgcgaccaaggccgcccaggaacaggcctatttcaaacccttcgagcgaagcggcggcgggcaggtggtcgccggcgaatacaacggcgaaatggccaaggtgaaggccatggtcgacgtcggcaaggtcagctgggacgtggtcgaggtggagagccccgaactgctccgcggctgcgacgaggggctgttcgaacgcctcgacccggcgcgtttcggcgaccccgcgcagttcgtccccggcactttcagcgagtgcggggtggccacctacgtctggtcgatggtgatggcctacgactcgacgaagctggccagggcgccgcagtcctgggcggatttctggaacgtccgcgagttccccggcaagcgtggcctgcgcaagggcgccaagtacaccctggaagtggcgttgctggccgacggggtgaaggcggaggacctctacaaggtacttgccaccccggagggggtcagccgcgccttcgccaagctcgaccagctcaagccgaacatccagtggtgggaggccggcgcccagccgccgcaatggctggcggccggcgacgtggtgatgagcgcggcctacaacgggcgcatcgccgctgcgcagaaggagggggtgaaactggccatcgtctggcccggcagtctctacgatccggagtactgggcggtggtgaagggcacgccgaacaaggcgctggcggagaaattcatcgccttcgccagccagccgcagacgcagaaggtgttctccgagcagatcccctacgggccggtacacaagggcaccctggcgttgctgccgaagacggtgcaggaggcgctgccgaccgcgccggccaacctcgaaggcgcgcgggcggtggatgccgagttctgggtggaccacggcgaggagctggaacagcgtttcaatgcctgggcggcgcgctga

SEQ ID NO: 15669 - DNA, 2208 bp, Pseudomonas aeruginosa
acgcctgcgtcctgccgagctgggcgctcagcgccgtgtgcctggtgcccggcggcgcgcatccgtcctatgcccacggctactacgagcgcgacaaccgcttctaccaggactgggatccgatcgcccgcgaccgcgaaagcttcaccgcgtggatcgacgaatacatccgggggaccgaggatttcggggccttccaggccaagctcgcggagggcaagcgatgagcagctacagcaccaacgagatgatgaccgtggccgccgcccgccgcctgcacaacggcgcggtgtgcttcgtcggcatcggcctgccgtcgaaggccgccaacctggcgcgcctgacttcctcgccggacgtcgtgctgatctacgagtccgggccgatcggcgccaagcccagcgtcctgccgctgtccatcggcgacggcgagttggccgagaccgccgataccgtggtccccaccggcgagatcttccgctactggctgcagggcggacggatcgacgtcggcttcctcggcgcggcccaggtcgaccgcttcggcaacatcaacaccaccgtgatcggcgactaccgccagcccaaggtgcgcctgccgggagccggcggcgcgccggaaatcgccggcagcgccaaggaagtgctgatcatcctcaagcagtcgcaccgcaccttcgtcgacaagctggccttcgtcacctcggtcggccatggcgagggtggcgactcgcgccagcgcctgggcttgccgggcaaggggccggtggcgatcatcaccgacctgtgcatcatggagccggaagccggcagcaacgagttcgtggtcacttcgctgcatccgggcgtgacccgcgagcaggtggtcgaggccaccggctgggcgatccgcttcgccgagcgggtctccgagacgcccgcgccgagcgaggtcgaactcgccgcgctgcgcgacctcgaggcgcgcaccgcggccgcccatggacagaaggggagcgacgaatgagccgcgaggtattcatctgcgatgccgtgcgcacgccgatcggccgtttcggcggcagtctttccgcggtgcgcgccgacgacctcgcggcggtgccgctgaaggccctggtcgagcgcaacccgggggtcgactggtcggcgttggacgaggtgttcctcggctgcgccaaccaggccggcgaggacaaccgtaacgtggcgcgcatggcgctgctgctggccggtttgccggagagcgtgcccggcgtcaccctcaaccgcctctgcgcctcggggatggacgccatcggcacggcgttccgcgccatcgcctgcggcgagatggagctggccatcgccggcggcgtcgagtcgatgtcgcgcgcgccgtacgtgatgggcaaggccgatagcgccttcgggcgcggccagaagatcgaggacaccaccatcggctggcgcttcgtcaatccgctgatgaaggagcagtacggcatcgacccgatgccgcagaccgccgacaacgtcgccgacgactatcgcgtgtcgcgtgccgaccaggatgccttcgccctgcgcagccagcagcgcgccggcagggcgcaggaggccggtttcttcgccgaggaaatcgtcccggtgacgattcgcgggcgcaagggcgacaccctggtcgagcacgacgagcatccgcgtcccgacaccaccctggaggcgctggcccggctcaagccggtcaacgggccggagaagaccgtcaccgccggcaacgcgtccggggtcaacgacggcgccgccgcgctggtcctggcctccgccgaggcagtggagaagcacggcctgactccgcgcgcgcgggtgctgggcatggccagcgccggcgtcgccccacggatcatgggcatcggcccggtgccggcggtgcgcaagctgctgcggcgcctggacctggcgatcgacgccttcgacgtgatcgaactcaacgaagccttcgccagccagggcctggcctgcctgcgcgaactgggcgtggccgacgacagtgagaaggtcaacccgaacggcggtgccatcgccctcggccacccgctggggatgagcggtgcgcggctggtcctcaccgcgctccatcaacttgagaagagcggcggccggcgcggcctggcgaccatgtgcgtaggcgtcggccaaggcctggcgctggccatcgagcgggtctga

SEQ ID NO: 15670 - DNA, 1416 bp, Pseudomonas aeruginosa
acgacgagccctgacgggccgggaaaaggaaaaccgatgagcgacatacccgccaaccagttgttcgatgcctatttcatggcggcgccgatgcgcgcggtgttctccgaccgcggccgcctgcaaggcatgctcgacttcgaggccgccatggcccgcgccgaggcgcgcaccggggtggttcccgcgacggcggtggcgccgatcgaggcggcctgccgcgccgaactgtacgacccgctggcgctggccgaggcggtcgccactgccggcaactcggcgatcccgctggtcaaggcgctgggccgccaggtggcggctggcgacgccgaggccgagcgctacgtgcatctcggcgccaccagccaggacgccatggacagcggcctggtgctgcaactgcgccgtgcgctggccttgctcgagcaggatctgcaacgtcttgccgaggtcctggcggaccaggccgaacggcatgccgacacgccgctggccgggcgcacctggttgcagcacgccaccccggtgaccctgggcatgaagctcgccggcctgctcggtgccttgacccggcaccgccagcgcctgcgcgagttgcgcccgcgcctgctggtgctgcaattcggcggcgcctcggggacgctcgccgcgctcggcgaacaggccctgccggtggccgcggcgctggccgaggagctgggcctggctctgcccgaacaaccctggcacacccagcgcgaccgcctggtggaattcgccagcgtgctcggcctggtggccggtaacctcggcaagttcggtcgcgatgtcagcctgctgatgcagaccgaggccggcgaggtcttcgagccggccggcgccgggcgcggcggttcctcgaccatgccgcacaagcgcaacccggtgagcagcgcggtgctgatcgccgccgccacccgtgcgccggggctggtctcgaccctgttcgcggcgatgccgcaggaacacgagcgcagcctcggtctctggcacgccgagtgggaaaccctgccggaactctgttgcctggttgccggcgcgctgcaacaggcgatcggcctgctcgaaggcctggaggtggacgcccagcggatgcgccgcaaccttggcctgacccacggcctggtgctcgccgaggcggtgagcatcgccctggcccgccgtatcggccgcgaagccgcgcaccatctggtggaacagtgctgccgccgcgccgtcgagcagcgccgcgagttgcgcgcggtgctcggcgaagaggcgcgggtgagcgccgagttgtccggcgacgaactggaccgcctgctcgatcccgcccattacctcggccaggcccgcgcctgggtcgagcgcgcgctcgccgaacaccatgccctgggcttcgaaccccatcccgcctga

SEQ ID NO: 15671 - DNA, 807 bp, Pseudomonas aeruginosa
ctggagatccccttcgtgccaaccgtacgcctcgccgacggcgacctgaactactccctggaaggaccggccggcgcgccggtcctgctgttgtcaaactcgctgggcaccgacctgggcatgtgggacacgcagatccccgcactcaccgcccatttccgcgtgctgcgctacgacacccgcggccacggcgcctcgctggtcacccccggaccgtacgccatcggccagctcggcgccgacgtgcttgccttgctcgatgccctcgagctgccgcgcgtgcatttctgcgggctgtccatgggcggcctgatcggccagtggctgggcatccacgccggcgagcggctcggccggctggtgctgtgcaacaccgcggcgaagattgccagcgacgaggtctggaacacccgcatcgataccgtcctgaaaggcggcgagcaggccatgcgtgtcctgcgcgacgcctcggtggcgcgctggttcaccgcgggcttcgccgagcgcgaaccggcgcaggtcgagcgcatcgtcgcgatgctcgcggccacctcgccgcagggctacgcggccaactgcgctgcggtacgcgacgccgatttccgcgagcagctcgggctggtccaggcgccgacgctgatcgtcgccggcagccacgatgccgtgaccactccggacaacgcccgcttcatgcaggcgcgcatcgccgacgcgcagttggtcgagttcgccgccgcgcacctgtccaacgtcgaagcgggcgacgccttcagccgccgcctggtcgatttcctgctgtccgcctga

SEQ ID NO: 15672 - DNA, 414 bp, Pseudomonas aeruginosa
ggagccccgccgatggacgagaaacaacgctacgaagccggcatgcaagtgcgccgcgcggtgctcggcgacgcccatgtcgagcgcagcctggccaacctgacgccgttcaacgaagagttccaggaaatgatcacccgccacgcctggggcgacatctggacccgtccggggctgccgcgacacacccgcagcctggtcaccatcgccatgctgatcggcatgaaccgcaacgaggaactcaagctgcatctgcgcgcggcgaagaacaacggggtgagccgcgacgagatcaaggaagtgatcatgcagagcgccatctactgcggtattcccgcggccaacgcgaccttccacctcgccgaatcggtgtgggacgagcttggcgtggagtcgcagcaggcgtcccggtag

SEQ ID NO: 15673 - DNA, 1116 bp, Pseudomonas aeruginosa
gtcgccggcggcgctagcggtagggcgaatggcgtcgcaggcgttatccgccgataccccgagggccaacggcggttatccgtcctgcgcgtgggccggcgaggcggcgcttccccttgccattcgccggcgtttcccggaaggtcgacagctccgtcatcccttcggtccgccatgagccgcaagctgcatatccacgcgcccgcgatccactacttcgacatggttcgccgctgccattcgatccgcgaagccgcgcggcgcctgaacgtcgcctcgtcggcggtgaaccggcagatcctcaagctggaggacgagatcggcgcgccgctgttcgaccgcctgcccggcggcctgcgcctgaccggagccggggagatcttcgcgcgccacgtcaccgtggtcctgcaggacatggagcgcgtgcgttccgaactggacgcgctgcaaggcctgcgcaccggccatgtggagatcgccaccatcgaagcggtgaccagcgacctgctgccctgcgtgctcaaggcgatgcgcgaacgctactcggacatcaccgtcggcgtcaccctgctcggttcccaggcgatacccgaggcggtgagcagtggcgcggtcgacctcggcctggccttcgccctgccgcgcagcgccgacctgcaacaggtcagcgtcggccatttccgcctcggtgccatcgtctccccgcagcacccgttggcgcgacaccaggccatcgccttcgccgattgcgtcgaacatggcctgatcatggccaagagcgagctgtccatccatcacctgctggcgccgctccagcgccgtttgcgcgaaccgcgccgggcggtgctggagagcagctccctggagctgtcgcgacaactggcgcggcgcgggctcggcgtcgccttccagacccgcctggggatcgaggccgacatcgcccagggcgagctgcgtttcctgccgctgaaagacaatggcggcatccacagcgacctcggcctctacgtgcgcaccggccgttacctgccggtggcggtggacgccctggcccggcagatcgccgaggaagtgcgcctgcgcgagcgcgaggaagcgcgcctgaacgaggcctga

SEQ ID NO: 15674 - DNA, 975 bp, Pseudomonas aeruginosa
  unsure (571): Identity of nucleotide at the above locations are unknown.
gtcgccacaagaacaacaagcaaccagcaggacacacagcatgaagaagatgatgcagggcgccgccgccctgatcgcgctcgtcggcgccggggagagcatggcgctggaatggatgagcaacagcgtcggtttccgttacggccagcaattcaccaacccgaacaacccggacaagttcgccaagcgcatctacagcttcacccacgccgacggctatcgctacggcagcaatttcttcaatctcgatgtgttcctttccgacaaccgcgacccgcgcaagggcaccgaccatggtggcagcgaagtctatgcggtctaccgccaccagctctacgcttcgcgggtgttcgaccggccgctgggcaccggcctggtcaaggactacgccttcaccctgggcttcgacgccagccgcaacaacaacctggcttcggccaagaagcgcgccctggtgttcggcccgaccctcaagttcaacggtcccggcgtgctcgacctgagcctgctctactaccgcgagaagaaccacttcggcgtgcccggcgcgcgccatcccgaccacaccttngacaccacctacatgctcaacctgacctggatgcggccgttcaaggtcggcaaccatgcggcgaagttccagggcttcgtcaactacgtgggagagaagggcgaggactacaacgacaaggacaccgcggcggaaaccctggtccgcaccgccctgatggtcgccgccctgccaggcgacaagcgccagccgaacctgtggctcggcgtcggctacgagtattggcacaacaagttcggcgtcgacggtggcaccggcagccgcacctcgacgccgacgttgaatatggaattcaccttctgaagcgaagcgccgtcgccttatgcgatgccgccaaccgtggggtggggcggataacgccaccggcgttatccgccgatacaccgaagcccgacggcggataa

SEQ ID NO: 15675 - DNA, 948 bp, Pseudomonas aeruginosa
cgccaccggcgttatccgccgatacaccgaagcccgacggcggataaccgcaagcggttattcgccctacgcgatggggcagcttcaccccgcatccgcgtgactgaccaaccccttcagcagcaccgcggcggtggccagtgcagccggcagcaccagggcggtcagcacctgttcgaagttccagcccaggcccagcagggtggcgccgatccaggcgccgaggatggcgccgaagcggccgataccgagcatccaggagacccccgtggcccgcccctgggtcggatagaagcgcgctgccagcgacggcatcgccgactgcgcgccgttgatgcacatgccggccagcagcaccagggtcgccagcagggtgacctggccgaggctctggccgacgcaccaggcgaacacccccgccagcaggtagaacaggccgatcaccttgtgcgggttgaagcgatccatcgcccagcccaccgctacggcgctgagcaccccgccgaactggaacagcgcgccgatgaacgccgcctgctccaggctcgcgccgctatcgcgcatcagggtcggcagccagctggtgagcaggtagacgatcaccaggcccatgaagtaggtcagccagagcagcagggtgccggcgctgtaggtaccggaaaagatcaccgcgaacacgttgcggggcctgcaccgtctgctgctcggggacgtggaaactccgtgccagcgccacctgcgccggggcgatgggggccagcacctggcgtacccgctcgctgccgcggttgcgcaccaccaggtagcgcgccgattccggcaggcggaacagcaggactaccgccaggaccagcggtaccaggccgccgagcagcatcaggctgtgccagccgaacagcgggatcagcttcgccgagacgaatccgccgcaggccatgcccaggttga

SEQ ID NO: 15676 - DNA, 891 bp, Pseudomonas aeruginosa
cctcatcgaacgcgccctcggcttgctcgaactcctcgccagcgatgcccgcggcctgcccctgcaacaactggcggaccgcctggatatccccaagagcgccgcgcaccgcatgctcgccgagctgatccggctcggctacgtgagccaggaccacgacaccagccgctaccgcctcagcacccgcctggccgcgctgggcttccgcttcctcgcgtccagcggggtggtcgatctggtccagccggtgctcgacgggctcgcccgggagaccggcgaactggtgcgcctgggggtaatcgaaggcgatcgccagacctggatcgccaagtcccagggcgccacctccgggctacgctacgaccccgacatggggcgcgaggcgccgctgttctacactgcatccgggcacgcctggctggccagcctgagccacaaggcggcgctggcgctggtggagcgccagggcgtaggggcggcgcgggacttcggtcccaacgcgccgcgctccaggagcgagctgctgcgttacctgaagcgcgcccgcgagcacggctatgcgtggcagatcgaatgctcggcgccgggcatggcggcgatggccgcactggtgcgccaccccgaggacggacgggctctcggcgtgctcagcgtggccgggccgagcgcacgcttcggcgaggcgcgcatgcacgaactggcgcccctgctcctggccgcggcgcaggacctgtcccacgccagccaggcgtccgagctgttccgctgagccatccggcccggccccagtcctttcccgacatcagcgttcgaatagcgaacgctttcttgcctgtcacgagcccgcatgcggcgggcctttccgcacttccatggatgcgccggcggtag

SEQ ID NO: 15677 - DNA, 1116 bp, Pseudomonas aeruginosa
tctccctcgctaaatctggaacgacgttctggaatcatgaagcgaacaagaaaacaacgattggggaccgccttggacgcaccgcttcgcatcgccctcatcggcgccggcaatatgggccgccagcattaccaccgcttgcagcgaatcgccggcgcgcgcctgtgtgcggtggccgatccccagggccaggcgttcgccgcggatgccggcgtgccctggttcggcgatcatcggaggttgctggaagaagcccggccgcaagcggcgatcgtcgccaatccgaacaacctgcatgtcgccaccgccctcgactgcctcgccgccggggtgccgctgctgctggaaaaaccggtcggcgtgcagctcgacgaagtgagcgagctggtggccgtcgcccggcgatctggcgttccgctgctggtcggtcaccatcgtcggcacaatccgctggtcgtgcgggcgcgccaattgatcgccgagggcgcgctcggtcggttgctgtcggtcaccgcgctctggcagttgaagaagcccgacagttatttcgaggtggcctggcgtcgcgagcccggtgcgggaatgttgctgaccaacctgatccatgacctcgacctgctccgccacctgtgcggggaagtgcgggaggtgcaggcgctggccggcaacgctatccgtggcctgcccaacgaagacaacatcgcgctgctcctgcgcttcgccaatggcgccctgggcagcctgaccggttgcgacgctgcggcggcgccctggagctgggagctggcagccggggagaacccggtctatccacgccaggccgagcaaccctgctacctgctggccggcaccgagggtgccctgagccttccccagctccgccgctggcgctacgccgaggcccggcagggctggcacgacccgctggcggccagcgtggaggccgtggcgacaggcgaccccctacaacgccagctagagcacttcgtccgggtcgcgcggggcgaggaagcgccattgatggatgccaccgacgccgctcgcaccctggcgctggtcgaggcggttcgcgaggccgcgcgcagtggccgggcctgcgcgccggccagtttctga

SEQ ID NO: 15678 - DNA, 1926 bp, Pseudomonas aeruginosa
ggcgcattgaggagtcgaagcatgcagcgttcgatcgccaccgtatccctgagcggcaccctgccggaaaagctcgaggccatcgccgccgccggtttcgacggggtggaaatcttcgagaacgacctgcttcattacgacggcagcccgcgcgacgtacgccggctgtgtgccgacctgggcctggagatcctgctgttccagccgttccgcgacttcgagggctgccgccgggaacgcctggggcgaaacctggagcgcgccgaacgcaagttcgacctgatgcaggaactcggcaccgacctggtgctggtgtgcagcaacgtcgctgccgatgccctcggcgaaccggcgctgctggccgatgacctctggcagctggccgagcgcgccgccgtccgcggcctgcgcatcggctacgaggcgctggcctgggggcgccaggtgaacacctgggagcaggcctgggacctggtgcggcgggccgaccaggcgaacctcgggctgatcctcgacagcttccacaccctctcgctggacggcgatccccgcggcatcgccgatcttccgggggaaaagatcttcttcgtgcagatggccgacgcgcccttgctggcaatggacgtgctggaatggagccggcacttccgctgcttcccgggtcagggcggcttcgacctggcaggcttcctcgcgccggtcgtcgcgtccggctatcgcggtccgctgtcgctggaggtcttcaacgacggcttccgcgccgcgccgacccgcgccaacgccgtcgacggcctgcgctcgctgctctacctcgaggagaagacccgcgagcgcctgcaacgccagacgccgcacgtggcggtggacgagctgttcgcgccgccgccggcgaacctctgcgacggcatcgagttccttgagttcgccgtcgacgagacgctcggcgcgcgccttggccagtggttgcaacgactgggcttcgccagggccggtgagcaccgttcgaagaatgtcagcctgttgcgccagggcgacatcaacctggtgctgaacgccgagccctattccttcgcccacggtttcttcgaggcccacggaccgtccttgtgcgccaccgcgctgtgcgtgcgtgacgccggccaggcgctggagcgcgctcgtgcgtacggaggccagccgtaccgcggactgctcggccccaacgagcgggaaatcccggcggtgcgcgccctcgacggcagcctgctgtatctggtcgagcggcacaccgagggccgcagcatctacgacagcgacttcgtgacgaacgacgccgacacctccggcctcggcctgcggcgcgtcgaccacgtggccctggcgctgcccgccgaaggcctggacagctgggtgctgttctacaagagcctgttcgacttcggcgccgatgacgaggtggtgctgcccgacccctatggcctggtcaccagtcgcgccgtgcgtagcccctgcggcagcgtgcgcctgccgctgaacatttccgaggaccgcaacaccgccatcgcccgttcgctgtccagctatcgcggttccggcgtgcaccacatcgccttcgattgcgccgacatcttcgccgccgtggcccaggccaaggaggccggggtcgcactgctggaaatcccgctgaactattacgacgacctcgccgcgcgcttcgacttcgacgacgagttcctcagcgaactggcctactacaacgtcctctacgaccgcgacgcccagggcggcgagctgttccatgtgttcaccgagccgttcgaggagcgcttcttcttcgagatcctccagcgccgccacggctacgccggctacggcgcggccaacgtgccggtgcgcctggcggcgatggcgcaagcgcggcggggtgtgcgccgggtcaagctgtga

SEQ ID NO: 15679 - DNA, 561 bp, Pseudomonas aeruginosa
cgtcgctggccgccaggttcagtcccttggcgccggtgggcggcacgatgtgcgcggcgtcgccggcgaggaacagccggccatgctgcatcggctcgaccacgaagctgcgcagcggcgcgatgctcttctccagcgaaggtccggtcaccagtttctccgccacctcggacgggagtcgcgccttcagttccgtccagaagcgctcgtcggaccagtcctcgaccttctccgacaatggcacctgcacgtagtagcggctgcgggtggccgaacgctggctgcacagggcgaagccgcgcggatgattggcgtagatcagttcgtggctcaccggcggggtgtcggcgagcaggccgagccagccgaacggatagacccgctcgaagaccttcagccgctccgccgggatcgattgccgcgagatgccgtggaagccatcgcagccggcgatgtagtcgcaatccaggcgcagccgttcgccgtcgcgttcgaaggtcacgtaggggcgctcaccttgcaggtcgtgcaggcgcacctcggcggcctggtagacggtag

SEQ ID NO: 15680 - DNA, 1548 bp, Pseudomonas aeruginosa
tggcgacttgagtcttcattgcggatagccctctcgctgttatggctggccggcggcgcatgcgccggcgctgatcttgtctggaggtggctgtatttttgtttgccgtggagtgctatagaaggcaaattgccgatctatttctggacttttataaagtctgttcggcaatcggccatttcgctcggagggctcgatgacggattccatccgcgacgtcccggtgttcaagctctacggcgctcccctcgaatggccgaccccggacctgctgcactgcgagtcgatccccgcccgcagtcgtctgcacgactgggagatcaagccgcaccggcacgccgatctcgctcagttgctctacgtgcgcaagggctgggcgcagctccaggtcgagggcgagccgactcgcgtcgagcagccttccatccagttcgtaccgccgttgtgcatccatggcttccagttctccgagcgcatcgacggctacgtgctgacgctcgccgcaccgttgctggcgcgcttgcaggcgcacctcggcgcgcagcgccaggcgctggaggcgccggggttgtacccggtgggcgcggaccggcgctatatcgacacgctgttcgacgccatagacggcgagtacgccggcgctgcgccggcgcgcgagctgttgttgcagtcgctgatcggcgtgctggcggtgtggctggggcggcaggtgatggtccggcgggcggaggcacggccgggtcgtggtcaggaatacctatcggccttttcgcaactggtcgagcggcatttccgcgagcacctgggaatcgacgagtacgcgcgtcgcctgggcatctccccggcacacctgaacagcgtggcgcgccgcctcagcgggcagaccgcactgggcatcgtgcaccagcgcttgctgctggaggccaagcgcgacctggtctacacggcgatgacggtgaacgagatcgccgaccgcctcggcttcagcgagccggcctacttcacccgtttcttcaagcgcctgagcggcgtctcgccgagcgctttccgcaagggcgactagtgttcgcggcgcaactggacgatctccagcgcgcgtccctcgtcatcacgcgggcgtcggccgctctcgacgaagccgcagcgcgcgtagaaccccagcgcctcgcggttggcggcgtagacctcgacttccagcgcgcccttcagggttgccgcgtgctccaccagttgccggccgatcccgcgcccgtgggccgtcggggcgacgaacaggccgccgatgaaggcatcgagcaggccgatgaagcccagcggcgtatcgccgtccagcgccagccaggtttccgaggcatccagataatgatcgcgaaccagtgccttctgcttctgcaactcggcttcgccgaggaaaccgtggccgacgcgcgaggcctccagccagatggcgagggtggcatcgcggtcggcgggaatgtagcggcggatcttcggcggagaggacatggcggcggctcgcaacgggaacagccgcggattatcgcgtga

SEQ ID NO: 15681 - DNA, 582 bp, Pseudomonas aeruginosa
ggggccggatggtcagtccatgaccgggatgagagttgcttcgcaaacccggagatgccctcgaaaggctattgcgtcacgcgggaaagcccgtcgaaggcccgcagcaacttgcccagggcgagggtcagcgcctcttcttccgggccggcgccgagagccgccagcagcctttcgtcgagccctgcgacctgtgccagtgcctgctcgaacaccgcctgtgccgcggggctgcggcgcaccagcacggcgcgcccgtcgtccgggtccggcaggcggctgacccagccgcgccgcaccagccgttcgatggtccggcccagcgcggtgcggtcggtctgtgagtgctcgatgagcacgctcatcggcacgtcaccgtcgaaggcgtggatgatccgcaacgcacgccattcatgcagccccagttcgagaggggcaagcagggcggtgagttgccgttcgcgctggcggacgatctccgtcatcaggtacagcgggccttggggcagccccagtgcgttcgtctcggtcattggcccggtcaccttcctcgatcctctttcgccagggcggggattgtag

SEQ ID NO: 15682 - DNA, 1542 bp, Pseudomonas aeruginosa
cgctcaggcgtcggcgaatccgtagtcgctccagcgttcttcgactcgcctgcgcagcgccgtcggataggcgtggcggaacgacgccgtagcggcacgcatttgcccggcgaactgttccgggtacaggcagttgatcaccagccgaccgccgctgcctcgtgccttgtcctcggcatcgaggtagggaaccatcgggaagtcacggatcttcgggaaggcgaaatggtcgtgcagcggatgcgcgcgggtcgccagcgcccataccacctggtcgatctcggtgacgtcgatgtcgttgccgaccaggatcagcttcggcaccaggtgtccggcatgcgagccgaagacggtctcggcgacccgtgcggcgaaggccgcggcgtcggtgcccagggccgccaggcgctgtacgtcgatcgacagcacggcccagcaggtcgccgcctcgtaggagcaccagaccatgtccaccggcagtccggcgttctgcaccacgtccagcagttgcgcggaaatcatggtgccccagatggtgtggttttcctccggtggcgtgccggcgacgcagatcggcaggatcggctggtcgcggaagctcagcgcatggacgtggaacagcggctgcggcttgccggtggggaaggaatagccgtggtattcgcccatcgggccttccagcgcggtttcgtcgaggctgatctcgccctccaggacgatctcggcattggccggaacccacaggccgttggtctgcgtgcgcaccacctccaccggctcgccgaccagggcgcctacgtagccggcttcgctgaccccctccggcaacggcatgccggccgccgcgagtgccgccggcggtgcgccgagggccatcgcccagggcgttggcttgccctggcggcgccactgctcgcggatgatgccgatgtgctgggtgggaatggtcggacccgccagggtgttgcggtccaccagcatcagccggcccaccgaccagctgtcccaactgccgtccggcgtctgtaccacgtggaaaccgtaggtgccgaaatagcgcccgccgtcctgctcatggagcaaggggaccgggaagcgggtcaggtccacctgctcgccgagccagacgttttcctgcaccggcccgcgctccagccggcgcggcgcgatcggttccgcgcgcatcgcggcgcgcagcatggccacgatgtcccgcggcccgctgtgttccggcaggccgaaatgcagcgccaggcgcgaatgggcgcgggccctgtcggcgcgcaggccggccggcgcgcccagtacccgcgcgccgggcaggctgtcgcggatgttgtggaacagcggggcgggtgcgcggcgttcgtagacccggcgggtgatggcgccgatctccaggttggcgtcgacctcggtgtgcacgtccaccaggtcaccctggcgacgcaggtggtcgacgaagtggcggaaatccagggcgctgcggttcatcggctcgccactccatataagtgcgtgtgcatgcatcttatgtgctga

SEQ ID NO: 15683 - DNA, 510 bp, Pseudomonas aeruginosa
gtcaggccgatgggcaggccgttgacctgctcgaccacggcgttgagcatgcccatggcgaggatcgcggcgaccagcgccggcacgttccagtcgaatggccagaccgccgacaacgccagcagcatcgcgcagcagaccaggatcggcgccgcccggcgcccgctgaagcgcgccagtatcactcccagcgcgttgccgacgacgaaactggccagggcgacgctcagccgcaccagcccgccgaagtcgccctcgcccagcgataccgccaggcgcgtggtgttgccgctcatgaaggaaacgaagtcgccggtggcgaggaaaccgatggcgtcggtcatgcctgccagtaccgacagcccggccaccaggccgagcccgacacgcccgcgcgtccgccgcaaacgaaggcgccgcgcgctgctacccaccatgctgtctggaagcatccggagaaaccacccgcaggaagagaaggtccgccccagtgcggactcccgatcttaa

SEQ ID NO: 15684 - DNA, 624 bp, Pseudomonas aeruginosa
ctggtcaccggcgggacaccgagcatgccgccgaacacgctggaggcgctgtcggccttcatcgctttcgacaggttctcgatgcgcccgtcctccttcaccaggtgcgcgcgctgggcgacgcccatgagagtgccggcggtatcgaacatgtgcacgaagaggaaggccaggatcacgctgatcatggtgacgttgaacgcgccggcgatgtccatcgccaggaaggtcggcgccaggctcggcggcgccgagaacaccccgccgtactgcaccaggccgagggcccagccgaccagggtgacgctgaggatgctgatgaggatgccgccgaacacccggcggtactcgagcacggcgatcatcaggaagcacagtgccgccagcagcgggccgggcgaggtgaggtggccgagcttgatcagggtcgccgggctggccaccacgatgccggcggtcttcaggccgatcaggccgaggaacaggccgactcccgcacccatggcgaacctgaggctgcgggggatgctgttgagcagccattcgcggacccgggagaaggtcagcagcatgaacatcaccccggagatgaacaccgcgcccagggcgatctgccagctgtag

SEQ ID NO: 15685 - DNA, 2211 bp, Pseudomonas aeruginosa
gggcacgattttctgacctctgggtcaagaactcgtgcgagcgattatgcctttgtatacaaaaaggtcaaagaatgtttgagggtgtttcgccacatttttatcagctttccgtcacgcccccttccgggcggtgccgcgcgctcggaacgaggggcggaaaggggtggtgcgtcggatgccgctgcttgtgtacactatttcgctatcagccgccggcgtgcctcacccacgcccgtgagcgaggatcagcccaggccacaagccggacgcacaaggttcgagaccgatgaccgatcagttgcaacacatcaggaagccgccgcgcaccggcaaggctgcccgcagcggtacccaggacgagatcgtctacgcccacatcttcgacgccatcctcgaacaacgcctggcccccggcaccaagctgagcgaggaggcgctcggcgagatattcggtgtcagccgcaccatcattcgccgcgccctctcgcgcctggcccacgagcaggtggtgctgttacggccgaaccggggcgcggtggtcgccagcccgagcatcgacgaggcccggcagatccttttcgcccgccgcaccgtcgagcgcgccatcaccgaactggccaccgacaacgccaccgccgagcgcctggccgagttgcgcgagatggtggtgcaggaacaatccagcttcgcccgtggcgaccggggcgccggcatccgcctgtccggcgagttccacctgaagctcgccgagatggcgcgcaacgctcctctggtgagtttccagcgcagcctggtgtcgcagacctcgctgatcatcgcccagtacgaaagcggcggtcgctcgcactgctcgttcgacgagcacaacgagatcctcgacgccatcgagaagggcgacaaggagcgcgcggtgaccctgatgatgcaccacatggagcacatcgacagcaagctcaacctggagagcgacaacgcttccggcgacctgcacgcggtgttctcgcacctcctcggcggcaagaagaagccacgccgggccaaggccgacagcgattcggcggcctgatccgaagcattgaaaagccccgcgatgcggggctttttcgtttccgccgggagtcagtcgcggcgatgcaccgagcgaccggcggcgaaggtttccttcaccgtgcggtcgtcgccgaggatggtcagcgcgaacagccgttcggccaggctgccggcctggctcaggcggtaggagagcagcggggtggcgtggtagtcgaggaccacgaagtccgcctcgttgccggtggcgaagctgccgatccggtcgtccagctccagcgcgcgggcgccgccgagggtggcgaggtagagcgacttgaacggatcgaggcgggcgccctgcaactgcatgaccttgtacgcctcgttcagggactgcaactgggagaagctggtgccggcgccgacatccgtgcccaggccgaccttgaccttgtagcgctccagcttcggcacgtcgaacagaccgctgccgaggaacaggttggatgtccggcaaaacgccactggcgagccagtctccgccaggcgctggcattcgccgtcgcacaggtgcacgccatgggcgaacaccgagcgcggcccgagcaggccgtggtggtcgtagacgtccaggtagccgctgcgctcggggaacagctccttcacccactcgatttccttgaggttctccgacaggtgggtgtgcaggtatacgccgggatgctcgcgcagcagccgcgccgccatgtccagctgttccgcggtgctggtcggggcgaagcgcggggtcactgcgtaagagcagacggccctggccgtgccagcgctcgatcagcgccttgctgtcgcggtagctgctctcggcggtgtcggtcaggtagtccggcgcgttgcggtccatcatcaccttgccggcgatcaggcgcaggtccaggcgccgggcggcctcgaacagcgattccaccgattgccggtgcacgctgccgaagaccagcgcggtggtggtgccgttgcgcagcagttcctgcaggaagatctcggcgacctggtcggcgtgggccttgtcgccgaactggcgttcggtggggaaggtataggtgttcagccagtccagcagttgctcgccgtaggaggcgatcatcccggtctgcgggaaatggatgtgggtgtcgatga

SEQ ID NO: 15686 - DNA, 2547 bp, Pseudomonas aeruginosa
tccagttcatctcgtcatcctcccgatcgcggcggttcaggccggctcgaccgcggcgtccgccgcttgcgcctgggcggtcttcaaccggcgcatctgttccacgccccagagcacccgctcgggcgtcgccggcgcgtcgatggcgggttgcgcgcggtagtcggcgaggctggccacggcgtccttgatcgcgcaccagaccgagatgccgagcatgaacggcggctcgcccacggccttggaatggaacacggtctgctccggattcttgcggttctccagaagtttcacccgcaggtccagcggcatgtcggcgacggcgggaatcttgtagctggccgggccgctggtcatcagcttgcccttggcgttccagaccagttcctccatggtcagccagcccatgccctggacgaagccgccttcgacctggccgatgtcgatggccgggttcagcgagtcgccgacgtcatgcaggatgtcggtgcgcagcatgcggtattcgccggtgagggtatcgactatcacctccgagcaggcggcgccgtaggcaaaataatagaagggccggccacgggcctgctcgcggtcgtagaagatcttcggcgtgcggtagaagccggtgctggacaacgaaacctggccgaagtaggcctgctggaccagttcctcgaacggcaggatcagctcgcggatacgcacctggttgttgcggaactcgacgtcttcctcgctgaccttccagtgccgcgcggcgaactccaccaggcgccgcttgatggtttcggcggcattctgcgcggccttgccgttcaggtcggtgcccgaggaggcggcggtgggcgaggtattgggtaccttgtcggtattggtggcggtgatctggatgcgctccacgtcgacctggaagacctcggcgaccacctgggcgaccttggtattgaggccctggcccatctcggtgccgccatggttcaggtggatgctgccgtcggtatagatgtggatcagcgcacctgcctggttgaggaaggtcgcggtgaacgaaatgccgaacttcaccggggtcagcgccaggcctttcttcaggaccgggctggcggcattgaaggcacggatttcctcgcggcggcgggcgtactcgctgctcgcttccagctcggcggtcatctccgccaacaggttgtgctcgacggtctggtggtaatgggtgacgttgcgctcgttcttgccgtagtagttgagcttgcgcacctccagcggatccttgcccaggctgcgggccacggcgtccatgatctcctcgatggcgaccattccctggggcccgccgaaaccgcggtaggcggtgttcgaggcggtgttggtcttgcaacggtggccgttgatggtggcgttgccgaggaagtaggcgttgtccgagtggaacatggcgcggtcgacgatcgagccggagaggtccggcgaatagccgcaattgccggccaggtcgatctggatgccgtgcaggcggccatcgtcgtcgaagccgacgtcgtattcgacgtagaacgggtgacgcttgccggtgatctgcatgtcctccatgcgcggcaggcgcatcttcgccggacgcccggtgtggtaggcgaccaccgcgcacaggcaggccggcgccgcggcctgggtttccttgccgccgaagccgccgcccatgcggcgcatgtcgatgacgatgcggttgaaggaaaccccgaggacctcggccaccagcttctgcacttcggtggggttctgcgtcgagcaatagacgatcatgccgccgtcttcgctgggcattaccgaggaaatctgcgtctccaggtagaaatgctcctggccgccgatgtgcagcgtgccttgcaggcgatgcggcgcgccggccagcgcggcggcggaatcgccgatgcggtgctggtggctgtcgaggacgaaatggcgcttgcgcagggcctcgaccacgtcgagcaccggctccaggtcttcgtactcgacgatcgccgccatggccgccttgcgcgcggtttccaggctgtcggcggcgaccgccaggaccatctgtccgacatactccaccttgccatcggccagcagcgggtcgccggccaccaccgggccgatgtcgagctggccgggaacgtcggcggcggtgagggcgatggcgacgccggggaactggtagcagggcgtcacgtcgaggcgggtgatgcgggcgtgggcgcgctcgctcaggcgcgcatagacgtgcaactggttgggaaactccaggcgatcgtcgatgtagatcgcctcgccgctgacgtgcttgggggcgctttcgtgcttgacgctgcggccgaccccggtggtcaactcggcgcggaacaggtcggccagctcttcctggctcttgtgcggcttgcgatggttagacataggcggtcacccgggtttcgacggcgggagcgtgcagctccaggaagcatttgcgcagcaggttctgcgcggtcagcaggcgatattccttgctcgcgcggaagtcgctga

SEQ ID NO: 15687 - DNA, 429 bp, Pseudomonas aeruginosa
ccttgtagtcgaggaagtactcctccagcggcagctcgcggcgccgttcgccgcggcgcaggacgatcttcgcgccgagggcgatcagcagcggcggggcgtcgccgatcggcgaggcgttgccgatattgccgccgagagtgccctggttgcggatctgcagggacgcgaaacgctgcagcaactcgccgaagtccgggtagtccgcggccagcgcctggtagcagtcggtcagcggggtggcggcgccgatttccaggcagttggcgcccacttcgatgcgtttcatttcgcggatgtggccgacatagatcatcaccggcagttcgcgatggaactgggtggcctccagcgccaggtcggtgccgccggccagcaggcgtgcctgcggattggcgccgtagaggtcggccaggtcggcgacggtga

SEQ ID NO: 15688 - DNA, 3606 bp, Pseudomonas aeruginosa
tcgcccgtgacgaggcgaggatccgcgaggtcctgctggaatacggccgccacaactgccagctggtgctggccgcgctcgccgaacgctgatggcgaccctggcgggagcgcacgcatgcgcctgaagagcatcaagctggcggggttcaagtccttcgtcgatccgaccacggtgaacttccccagcaacatggcggcagtggtagggccgaacggctgcggcaagtcgaacatcatcgacgcggtgcgctgggtgatgggcgaaagctcggcgaagaacctgcgcggcgagtcgatgaccgatgtcatcttcaacggctcgaatacccgcaagccggtgagccaggcgagcatcgagctgatcttcgacaacgccgagaccacactggtgggcgaatacgcccagtacgccgagatatccattcgccggcgggtctcgcgggatgggcagaacacctatttcctcaacggcaccaagtgccggcggcgcgacatcaccgacatcttcctcggcaccggcctggggccgcgcagctactcgatcatcgaacagggcatgatctccaagctgatcgaggcgcgtccggaagacctgcgcaacttcatcgaggaagccgcgggcatttccaagtacaaggagcgccgccgcgaaaccgaaagccgcatccgtcggacccaggaaaacctggcacgcctcaccgacctgcgcgaagagctggggcggcaactggaacgcctgcaccggcaggcccagtcggcggaaaaataccaggagcacaaggccgaggagcgccagctcaaagcccagctgggcgccgtgcgctggcgcgacctgaacgagcaggtcggtcagcgcgagcgggtcatcggcgaccaggagatcgccttcgaggccctggtggccgagcagcgcggtgccgatgccggcatcgaacggctgcgcgacggccatcacgagttgtccgaacgcttcaaccaggtgcaggcacgcttctattcggtcggcggcgacatcgcccgggtcgagcagagcatccagcatggccagcagcgccagcgccagttgcaggacgacttgcgcgaagccgaacggacccgccaggaaaccgaatcgcacctcgggcatgaccgtaccttgctcgcgaccctggccgaggaaatggccatgctcgcaccggaacaggaactcagcgcggccgccgcggaagaagcgggcatcgccctggaacaggccgagcagggcatgcaggcctggcagcagcagtgggatgccttcaaccagcagagcgccgaaccccgccgccaggccgaggtgcagcagtcgcgcatccagcacctggagcagagcctggagcgcctgcaggatcgcgagcggcgcctgcaggaggagcgtggccagttggcggccgaccccgaggacgcggcgatcctcgaactcaacgaacaggtggcgatcgccgaactggccctggaagaactgcaattgcaggagcagggccaagccgagcgactcgaacaattgcgccaggaattgcagcagctggccgccgaacagcaccaggcgcagggcgagttgcagcgcctgaacgggcgcatcgcttcgctggaggccctgcagcaggccgctctcgatcccggacagggcgccttggagtggttgcgcgagcagggcctggaacaacgtccgcgcctcgccgaaggcttgcgtgtcgagccgggttgggagctggcggtggagaccgtgctcggcgcggatctgcaggcggtcttgctggacggcttcgacgggctcgccctggccggcttcggcaagggcgagctgcgcctgctcagccccgctcgcggagccgcgacggcggccggttcgctgctggacaaggtccgcgccgacgccgacctgagtccctggttggcccgggtgaaaccggtggagaccctggaacaggcgctcgcccagcgcggcgccctggacgacggcgagagcctgatcagtcgcgatggctactgggtcggccggcacttcctgcgggtccggcgcagcgacgaggcccagggcggcatgatcgcccgcgcccaggaactggaggcgttgcaggagcggcgggagcccctggaaacccgtgtctccgaaggcgaggagcgtctggctgcggcccgcgacgagcagcgcgagctggaaggcgcgcgcgagcaggtgcggcgccaggtccaggaggaggggcgccggcacggcgagctgaaggcgcagttgtccgcgcagcaggccaaggtcgagcaactggtactgcgtcgccgccgtctcgacgaagaagtggcggaactggccgagcagcgcgcgctggaacaggagcaactgagcgaggcgcgcctgaccctgcaggaagcgctggatagcatggcgctggacaccgagcgccgggaaaccctgctggcggagcgtgacgccctgcgcgaacggctcgaccggattcgccaggatgcccgcacccacaaggaccatgcgcaccagttggcggtgcgggtcggctcgctgaaggcgcagcacaattccacccagcaggccctggagcgcctcgaccagcagtcggcgcgcctcaacgagcgttgcgaacagctcaacctcaatctggaggagggggcggcaccgctggaagagctgcgcatgaagctcgaggagttgctggagcggcggatggccgtcgaggacgaactcaagcaggcgcggctggccctggaagacgccgatcgcgaactgcgcgaggtggagaagcgccgcggccaggccgagcagcaatcgcaactgctgcgtggccagctggagcagcagcgcctggagtggcaggggctggtggtgcggcgcaaagccttgcaggagcagctcgccgaagacggctacgacctgcatacggtactggccaacctgcccctggatgccagcgaacgcgattgggaggagcgtctcgagagtctcgcggcgcgcatccagcgtctggggccgatcaacctggcggcgatcgaggagtaccagcagcagtccgagcgcaagcgctacctggactcgcagaacgacgacctggccgaagcgctggagacgctggaaaacgtcatccgcaagatcgaccgggaaacccgcaatcgtttcaaggaaaccttcgaccagatcaatgctggccttcaggcattgttcccgaaggtattcggcggcggtacggcatatctggaacttaccggcgaagatctactcgataccggtgtggcgatcatggcgcgcccgccgggcaagaagaacagcaccatccacttgttgtccggcggggaaaaggcgctgaccgcgctggcgctggtattcgccatcttccagttgaacccggcgccgttctgcatgctcgacgaagtcgatgcgccattggacgatgccaacgtcggacgttatgcgcgattggtgaaggagatgtcggaaaaggtgcagttcatctatatcacccacaacaagatcgccatggaaatggccgatcagttgatgggcgtgaccatgcatgagccgggctgttcacggcttgttgcagttgacgtggaagaggcggtcgcattggctgaagcctga

SEQ ID NO: 15689 - DNA, 489 bp, Pseudomonas aeruginosa
agctgcatggcgaaggctggccggagatcctcgaagtgcgcggcgaggtgttcatgtccaaggccggtttcgaggcgctcaacgccaaggccgtggaaaccggcggcaagaccttcgccaacccgcgcaacgcggcggccggcagcctgcgccagctggattcgaagatcaccgccagtcgcccgctggagttctgtgcctacggcttcggccaggtcagcgggtcgctgccggacacccaggtgggcatcctcgaggcgttccgcggctggggtatccccatcagtcgcgagctgcgcctggtcaagggcgcccaggcctgccgcgactactacgacgacatcggtcgccgacgcgatgcgctggcctacgagatcgacggcgtggtgttcaaggtcaaccgcatcgccttccagcgcgaactgggcttccgcgcgcgcgagccgcgttgggcgatcgcccacaagttccccgcgcgcgaggagctga

SEQ ID NO: 15690 - DNA, 2364 bp, Pseudomonas aeruginosa
aagcggatccctcgtcttagttttatcatcgtattaacgcgccttggaatcggtcttcgtaataaagggagtaatatggataataatgtcgggtttattaagacaattaaggttttatctgactttgaagagttggttcggcgttttgtccagaaaatttatagcgcggatgcctacttggtaggtgggccatacgatggtggtagagatttggtctatgccgttcgagggcgggaagttaggcaggccatccagatttcgactcaagagaaaaatcttgaggctaagctaaacgaagaccttgaaaaggttgttaagctggtagatgaacattcttatccacctattttgattttcttttggtcacatcaaatatctgcaagtaaagaagatgaactgaaaacgaatgctaggcgtgattatggagtaactctggaattttatgatgctaataaagtcggccaaaaaataactaatgaataccctgatattttaaggtttttgttagaggatgttcataaatatcgtccggcttcgaatgctgatgtgaatattaaacagcgtgctttctatgattatttggttctgagtaaagatactacaagtctcaagcatgttatcgtggattcgcatatcgtctcggttctgagtggcggttgtttgacagaggcggttttggtcgaggtcttgggtgagctgggtatcagtttacctgttttcaaatctcgtgtttctctcctcaagaaagaagggcgggttgttgtgggtgaggggggctatagcctcgcagaaaatgagcttgatagagtaaaggctcttgccatgaaagatcaggcaggtagggctgaagtgctcgcagctatcgatgaaatttccaaagaatatacttctgctccagtggcagagcaaatactggaactgattcaggaagcgtatggtgcgtcagtcgatattcaaatttctgaggagagttttgagccgccaaagcttgcaatagtaaaaggagcagtagagaatattgctagccttcttaggagggtttcggatatctcagataatgatgctaagcatgcatcgcaaaagctcgtagagatttctgctaaaaatgaatatttgtcaaactactgttcaactcgattatgtatcgggctgttaaatcaatctaagcttgaaaggtacgtagaggataaaaaattcttcctgtatctagacgctccggtatttatctactatttggcagttatgcggtatagggaggacgttgatgataacgcttaccgaacggtggggcatttaagggataatattaagaggcttcgtaacaaggaggttcgagttactcttgagcactttgaggagacggtccggcatctggaaaatgctgaaaaaataagccgctttgcaagcgatgagctaatcgcgagtctcggagattcaaaaaatgtgttctttaacttgtatttgcggcttaaggagaaaaaggggcgccgatatgagttttcttcttttctcgaggacttcataggctttgagaatatcaggggaggctttcctagatttgaatctctgctgctgtgtgcccgacaatatgcagagcttgggggggtgcgcgtgctgggtgtggagcaagagcagtcggaaggcttttatagagatctgcactcaaggtttatgcggttaattcgtgtgcctagaaaatggcaaaccttcaagaatgacgtattagcatgtcaagttcttggtgatgtgagtaagcatttagatgctaacggtgtttttcagacgccattactcattacttgggattctactcagcacgcacttagacgtatatacagagaaaaatttcctcatgatgagtgggttgtctatcctcctcatcgtgcttccgaacggctctctatgattgatcttaagataaatagcgaagatcttaaggatggagttttggcaatcattgatgaagattttttcaaagatgccaggagcggaagcttattggatactctcgctattttccttggggatgatcaggctgaaagtggagctgttgttagtctcttgacaaaacttagtcgaagaataaccgaagagcctgatgatgttaggcatacggatttcgatgctcagaatactttgaatgaagtattgatttttacgcagcgggagtttaggcgggagttttctacggtaagaaagctttttgcggaagaacgatttgtgggtgatatttatacattgctttcaaataccgttaagagtgagtttggtatgcgtcagaaagaagagtatgccgaaagtcttaggactctcatcgctcagattgagtctgaggagcgtgatgggagcgaggagagaagttga

SEQ ID NO: 15691 - DNA, 237 bp, Pseudomonas aeruginosa
agtagctggcgtatccggtcgctgttcatcgccactgctcgcggtgccgttgaatgccaatatcttggcgtggatcgccgggaagactgctacaagctcaaagcgggagagaggctgttgcttgccaagctgttggacgaagattacccgtatgtagagtcgttccaagaaggtgcagaagtttcaagcacgtgggcagaagaagactacgagaacttacgacgccagtacgaatga

SEQ ID NO: 15692 - DNA, 429 bp, Pseudomonas aeruginosa
gaaaaccgtccatcgcagttccatcaccggtcggtttgtcccggaaagctacgccaagaagcatccgaagacgaccgaaaaagagaaactctgagaggagtacacgatatgaccatccacatcatgctcaccgtggacctgaacggccacgtttcgaccgaagcacgggcgaagttctacgaggtgctaaagcagtaccatctggtccgtcgcaagctcacaacggtttggactgccgagttcagtccggggtccacgaaggacggtgctgttgagtacgtccggaaagccgtggaggctgcggctgtcgcctccggggtgttcgattacgaggtggctgtgctgccgagtgacgttgctccggtaacgtgggctaagtcgccccagaagctgggcttgctcggtgctgcaaccttgctcggccggtaa

SEQ ID NO: 15693 - DNA, 1212 bp, Pseudomonas aeruginosa
  unsure (811): Identity of nucleotide at the above locations are unknown.
aaacaacaacatcgatccgcaaccgaggacaacaataatgattatctacggtgtcgcactgctgtctctgtgtaccctcgccgggctgatcatcggcgagatccttggcgtgctgctcggcgtgccggccaacgtcggtggcgtcggcatcgccatgctgctgctgatcttcgtcggcagctacctgggcaagcgtggcctgctctcggcgaagaccgagcagggcgtggagttctggagcgcggtctatattcccatcgtggtcgccatggccgcccagcagaatgtcctcggcgcgctgagcggcgggccggccgctatcctcgccggcatcgccgcggtcgccgtggccttcgccctggtcccgctgctcgaccgcttcggccggaagaaagccgaaggcgcccggccattgaaaccgcgcaccagcgtgcaggggtgagcgccatgttcgagtccctgaacaaagtcatcaatggctacggcctgatcagcggcttcgccatcatcggcgtgaccatggcggtgtcctactggttgtcggcgcgcctcacccgcgggcgcctgcacggctcggcgatcgcgatcttcctcggcctggtgctgtcctacgtcggcggcgtcgccaccggcgggcagaaaggattggtggacgtgcccctgatgtccggaatcggcctgctgggtggcgccatgctgcgcgacttcgccatcgtcgccacggccttcggggtgaatgtcgaggaactgcgtcgggcaggggtttccggggtggtgtcgctgttcctcggagtcggttcgtccttcgtcnccggggtcgcggtggccatggcgttcggctataccgatgcggtcagcctgaccaccatcggcgccggcgcggtcacctacatcgtcggaccggtgaccggcgccgccctgggggccagctccgaggtgatggcgctgatcatcgccgccgggttggtgaaggcgatcctggtgatggtcctgacgcctttcgtcgcgccctacatcggcctgaacaatccacgtacggcggtgatcttcggtggtctcatgggcacctccagcggcgtcgccggcggcctcgccgccaccgacccgaagctggtgccctacggttgcctgaccgcggcgttctataccgccatcggttgcctgctggggccgtcgctgctgtatttcagcgtgcgcggcctggttgggtga

SEQ ID NO: 15694 - DNA, 1074 bp, Pseudomonas aeruginosa
gcgggctcgtccgggcaccctctccctgaagggcgagggttggggataggtcagcgggccagcggtaatgtggatttccgtccgctatcccgccgcctcctgctccaggcgcaggctgtacatccggcactccgcgagcaacgccagcaggttcgggtcgcgctccttggccttgaggaacaccacgccgatgtgctgctgcaggcgatagcgcggttgcagcgggatcagccgcacgcggttctcgtagaccgcctcgatgcgtttgggcagcagcgcatggccgacccccgagctgaccatgctgaggagggtgaatatgtcgttcacctgcatggcgatctgcggttcgaagccggcctgctggaacacccgggtgccgtcctgatgggtggcgaagccctgggtgagcgtgacgaagggcgtgtcgcgcagggtgctgagatcgatctcggcgagcctggcgtagggcgagtccaccggcacggcgaggaagatgtcatcggagaacagcggcaggtgctcgcagtcgggatcgctgacgctgtcgttgagcgacaccaggatggcgtccagctccatgttcttcagctggtagaacagatcgacgttggagccgaggatcaggtcgatgttcagcgcgctgcgtcgcagcttgaggcccatgatcagttgcggcacggtcttcaccgtcagcgaatagagcgcgccgagcttgaaacgctcggcggagaagccggccgcctcgcgggtcaggcgcaccgtgtcgagtacctcctggaccagcttctgcgcgcgctcctcgagcacgtaggcgctttccagcggggtcaggttgcgtccctcgtgcttgaacagcgggcagcgcagggcgctttccagcgagtggatggcgcggtgcacgctgacgttgctggtgcccagttccgccgccgcgcgcgccaggttgccggtgcgcatgaaggcgaggaaggtttccagcttcttgagggtgatttcttcgtctatcagcatccgcgttcccctggccggtggcgtcgggggattgtgcctgaggcggcgcgggaggggtaa

SEQ ID NO: 15695 - DNA, 189 bp, Pseudomonas aeruginosa
caaggagaaggtggggtgttcgaactcagcgattggcaacggcgcgccgcgacacagcgcttcatcgaccaggccctgatcggcggccgccagcgtccagccgccagccggcgctaccttcgacgccatcgatccggcgagcaatcgcctgctggcgcgggtcgcggcctgcgatgcggccgacgttga

SEQ ID NO: 15696 - DNA, 672 bp, Pseudomonas aeruginosa
cgcggcagtggccgccgcccgccgcgccttcgacgaaggcccctgggcgcgtctcgccccggtcgagcgcaagcgcgtgctgctgcgcctggccgagctgatgctggcccatcgcgaagagctggcgctgctcgactcgctgaacatgggcaagccggtgatggacgcctggaacatcgatgtacccggcgccgcccacgtcttcgcctggtatgcggaaagcctcgacaagctctacgaccaggtcgcgccgaccgcccagcagaccctggccaccattacccgcgtgccgctgggggtgatcggcgcggtggtgccgtggaacttcccgctcgacatggccgcctggaagctcgccccggccctggccgccggcaactcggtggtgctcaagccggccgagcagtcgccgttctccgccctgcgcctggccgagctggccctggaggcgggggtgccggaaggcgtgctgaacgtggtgccgggcctcggcgagcaggccggcaaggccctcggcttgcacccggaggtggacgcactggtgttcaccggctccaccgaggtcggcaagtacttcatgcagtattccgcgcaatccaacctcaagcaggtctggctggagtgcggcggcaagagtccgaacctggtgttcgccgattgccgcgatcttga

SEQ ID NO: 15697 - DNA, 729 bp, Pseudomonas aeruginosa
cctggcggcggaaaaggccgccttcggcattttcttcaaccagggcgaggtctgttcggcgaactcgcgcttgctggtggagcgttcgatccacgacgagttcgtcgagcgcctgctggccaaggcccgcgactggcagccgggcgatccgctggacccggccagccgcgccggcgccatcgtcgaccgccggcagatcgccgggattctcgccgccatcgagcgggcgcaaggcgagggcgcgaccctgctcggcggtggccgccagttgacgatcaacggttcggacaacttcatcgaaccgaccctgttcggcgacgtacgcccggacatgcagctggcccgcgaggaaatcttcggtccggtgctggcgatcagcgccttcgactccgaggacgaggccatacgcctggccaacgacagccgctacggcctcgccgcctcgctgtggagcgacgacctgcaccgtgcacaccgggtggcgcggcgcttgaatgccggaacggtgtcggtgaataccgtggacgcgctggacgtcgcggtgcctttcggcggcggcaagcagtccggcttcggtcgcgacctgtcgctgcattccttcgacaagtacacccagttgaagacgacctggttccagttgcgctgaagacgcgacggacgcgacacgactcgatgccgataacgacaacaagaggacgatcgaatgaacgacacgccgaacgtgcgtga

SEQ ID NO: 15698 - DNA, 1527 bp, Pseudomonas aeruginosa
gactgcccagggcaagtccgtcgccctcgatcccctgcaatccccttcggcctgacgcgccaagggaacaaggagaacacagacgatgaccgctcagctcaacccgcagcgcgacacccgcgactaccagcaactggacgccgcgcaccacatccacgccttcctcgaccagaaggcgctgaaccgcgaaggcccgcgggtgatggtccgcggcgatggcctgcagctctgggacaacgacggcaagcgctacctggacggcatgtccggcctctggtgcaccaacctcggctacggccgccaggacctcgccgccgccgccagccgccagctggaacaactgccgtactacaacatgttcttccacaccacccacccggcggtggtggagctttccgagatgctcttcagcctgctgccggaccactacagccacgcgatctacaccaactccggctccgaggccaacgaggtgctgatccgtaccgtgcggcgctactggcagatcctcggcaagtcgcagaagaagatcatgatcggccgctggaacggctaccacggctcgaccctgggcagcaccgcgctcggcgggatgaagttcatgcacgagatgggcggcatgctgccggacttcgcccacatcgacgaaccctactggtacgccaacggcggcgagctgagcccggccgagttcggtcgccgcgcggcgctgcaactggaggagaagatcctcgaactgggcgcggagaacgtcgccgccttcgtcgccgagcccttccagggcgccggcggcatgatcttcccgccgcaaagctattggccggagatccagcgcatctgccggcagtacgacgtgctgctgtgcgccgacgaactgatcggcggcttcggccgcaccggcgaatggttcgcccacgaacacttcggcttccagccggacaccctgtccatcgccaagggcctgacgtccggctacatccccatgggcggcctggtactcggcaagcgcatcgccgaggtgctggtggatcagggcggggtgttcgcccacggcctgacctattccggccacccggtggcggcggcggtggccatcgccaacctcaaggcgctgcgcgacgagggcgtggtcacgcgggtcagggaggagaccggaccctacctgcaacgctgcctgcgcgaggtcttcggcgaccatccgctggtcggcgaggtccagggcgccggcttcgtcgccgcgctgcagttcgccgaggacaaggtgacccgcaagcgcttcgccaacgagaacgatctggcctggcgctgccgcaccatcggcttcgaggagggcgtgatcatccgctccaccctcggccgcatgatcatggccccggcgctggtggccgggcgtgccgagatcgacgaactgatcgacaagacccgtatcgcggtggatcgcaccgcccgcgagatcggcgtgctctgacgcgccccggcggcccggcctcggccgggtcgactgcgacacggagcgtccccccataa

SEQ ID NO: 15699 - DNA, 450 bp, Pseudomonas aeruginosa
agggcacgccgaacaaggcgctggcggagaaattcatcgccttcgccagccagccgcagacgcagaaggtgttctccgagcagatcccctacgggccggtacacaagggcaccctggcgttgctgccgaagacggtgcaggaggcgctgccgaccgcgccggccaacctcgaaggcgcgcgggcggtggatgccgagttctgggtggaccacggcgaggagctggaacagcgtttcaatgcctgggcggcgcgctgagcgcgctgcgcgtcggcaaaaaaaacgacgggccccaagtcgtccgggcccgtcgggtcaaagcgctgacggggtgatcagcgcagctcttccaacaacccctgcagataccgacagccctcggtatccagcgcctgcaccggaaggcgcggcgcccccacctccaggccggagaggcccaggccggccttga

SEQ ID NO: 15700 - DNA, 1623 bp, Pseudomonas aeruginosa
aatcctctccctgcgcgaagcggtgcgacgcttcgtccacgatggcgacagcgtcgccctcgaaggcttcactcacctgatcccgacggccgccggccacgagctgatccgccagggcaggaaagacctgacgctgatccgcatgactcccgacctggtctacgacctgctgatcggtgcaggctgcgcgaagaagctggtgttctcctggggcggcaaccccggcgtcggttcgctgcaccgcctgcgcgacgcggtggagaagggctggccgcaaccgctggagatcgaggaacacagccacgccgacctcgccaacgcctatgtcgccggcgcctccgggctgcccttcgcagtgctgcgcgcctacgccggctccgacctgccgaaggtcaacccgctgatccgcagcgtcacctgcccgttcaccggcgaagtgctggcggcggtgccctcggtgcgtccggacgtcagcgtgatccacgcgcagaaggccgaccgcaagggcaacgtgctgctctggggcatcctcggcgtgcagaaggaagcggccctggcggcgaagcgctgcatcgtcaccgtcgaggagatcgtcgacgaactggacgccccgatgaacgcctgcgtcctgccgagctgggcgctcagcgccgtgtgcctggtgcccggcggcgcgcatccgtcctatgcccacggctactacgagcgcgacaaccgcttctaccaggactgggatccgatcgcccgcgaccgcgaaagcttcaccgcgtggatcgacgaatacatccgggggaccgaggatttcggggccttccaggccaagctcgcggagggcaagcgatgagcagctacagcaccaacgagatgatgaccgtggccgccgcccgccgcctgcacaacggcgcggtgtgcttcgtcggcatcggcctgccgtcgaaggccgccaacctggcgcgcctgacttcctcgccggacgtcgtgctgatctacgagtccgggccgatcggcgccaagcccagcgtcctgccgctgtccatcggcgacggcgagttggccgagaccgccgataccgtggtccccaccggcgagatcttccgctactggctgcagggcggacggatcgacgtcggcttcctcggcgcggcccaggtcgaccgcttcggcaacatcaacaccaccgtgatcggcgactaccgccagcccaaggtgcgcctgccgggagccggcggcgcgccggaaatcgccggcagcgccaaggaagtgctgatcatcctcaagcagtcgcaccgcaccttcgtcgacaagctggccttcgtcacctcggtcggccatggcgagggtggcgactcgcgccagcgcctgggcttgccgggcaaggggccggtggcgatcatcaccgacctgtgcatcatggagccggaagccggcagcaacgagttcgtggtcacttcgctgcatccgggcgtgacccgcgagcaggtggtcgaggccaccggctgggcgatccgcttcgccgagcgggtctccgagacgcccgcgccgagcgaggtcgaactcgccgcgctgcgcgacctcgaggcgcgcaccgcggccgcccatggacagaaggggagcgacgaatga

SEQ ID NO: 15701 - DNA, 1515 bp, Pseudomonas aeruginosa
gcgtcggccaaggcctggcgctggccatcgagcgggtctgactggcacaaccgggtcgcccgcccggtatcaagagcgcgcgtcgcgcggcgctgcccatgtttcggcggcggcgcggcgcgtgtgcagcggaacaggacgctccgtcgcacggtcaggatgaaacggaccctgtcgagagaacaacagcatgactgcccctgttcaccagtacagcaacgaagaacgccgcaagcgcatcttcgccatcgtcggcgcctcctccggcaacctcgtggaatggttcgacttctacgtctacgccttctgcgcgatctacttcgcaccggccttcttcccctccgacaaccccacggtgcagttgctgaacaccgccggggtcttcgccgccggcttcctcatgcgccccatcggcggctggatgttcggccgcatcgccgacaagcacgggcgcaagaccgccatgctgatctcggtggtgatgatgtgcgccggctccctggcgatcgcctgcatgcccacctacgccagcatcggcaccctggcgccggccctgctgttgctggcgcggatgttccagggcctgtcggtgggcggcgagtacggcaccagtgcgacctacatgagcgaggtggcgctcaagggccagcgcggcttcttcgcctcgttccagtacgtcaccctgatcggcggacagttgctggcggtgctggtggtggtgatcctgcagcagttgctgagcgaagacgaactgcgcgcctggggctggcggattcccttcgtgatcggcgcgatcaccgcggtgatcgccctctggctgcggcgctcgctgaacgagaccgcttcgaagtcgaccctggagcgcaaggaatccggcaccttcgccgagctgttcaagcacaagcgggccttattcaccgtgctcggcttcaccgccggcggctcgctgatcttctacactttcaccacctacatgcagaagtacctggtcaacaccgccgggatgagcgccaagaccgccagcgcggtgatgaccttcgccctgctggcgtacatgctgatgcaaccgctgttcggcatgctttccgatcgcatcgggcgcaagacctcgatgctctggttcggcaccctgggcacgctgtgcaccctgccgatcctgctcgcgctgaagaccgtgagcagtccctacatggccttcttcctgatcatcctggcgctggccatcgtcagcctgtacacctccatcagcggcctgatcaaggccgagatgttcccgccggaggtgcgcgccctcggcgtcggagtgtcctacgcggtgggcaacgcgatcttcggcggctcggccgagtacgtcgccctggggctgaagtcggtagggatggagaacgtcttctactggtatgtttcagccatgtgcctgctggcgctgctggtctgcgtgagcctgccggacctgcgcaaggtcagctacctgaacgacgagccctgacgggccgggaaaaggaaaaccgatga

SEQ ID NO: 15702 - DNA, 972 bp, Pseudomonas aeruginosa
  unsure (669): Identity of nucleotide at the above locations are unknown.
tgccgtttcggcatcggtatgttcgatattctgttctttggtcagcgcggcgaagtgccgatactgccccgcgaccccggcgcgaaaccgggggctgagtcgccacaagaacaacaagcaaccagcaggacacacagcatgaagaagatgatgcagggcgccgccgccctgatcgcgctcgtcggcgccggggagagcatggcgctggaatggatgagcaacagcgtcggtttccgttacggccagcaattcaccaacccgaacaacccggacaagttcgccaagcgcatctacagcttcacccacgccgacggctatcgctacggcagcaatttcttcaatctcgatgtgttcctttccgacaaccgcgacccgcgcaagggcaccgaccatggtggcagcgaagtctatgcggtctaccgccaccagctctacgcttcgcgggtgttcgaccggccgctgggcaccggcctggtcaaggactacgccttcaccctgggcttcgacgccagccgcaacaacaacctggcttcggccaagaagcgcgccctggtgttcggcccgaccctcaagttcaacggtcccggcgtgctcgacctgagcctgctctactaccgcgagaagaaccacttcggcgtgcccggcgcgcgccatcccgaccacaccttngacaccacctacatgctcaacctgacctggatgcggccgttcaaggtcggcaaccatgcggcgaagttccagggcttcgtcaactacgtgggagagaagggcgaggactacaacgacaaggacaccgcggcggaaaccctggtccgcaccgccctgatggtcgccgccctgccaggcgacaagcgccagccgaacctgtggctcggcgtcggctacgagtattggcacaacaagttcggcgtcgacggtggcaccggcagccgcacctcgacgccgacgttgaatatggaattcaccttctga

SEQ ID NO: 15703 - DNA, 861 bp, Pseudomonas aeruginosa
aatctcgaccttcgccaggctgtgaaaatccggaaccagattctagaatcctgccttccctcgactcaggaacgtccttccatggccggtagcctcatcgaacgcgccctcggcttgctcgaactcctcgccagcgatgcccgcggcctgcccctgcaacaactggcggaccgcctggatatccccaagagcgccgcgcaccgcatgctcgccgagctgatccggctcggctacgtgagccaggaccacgacaccagccgctaccgcctcagcacccgcctggccgcgctgggcttccgcttcctcgcgtccagcggggtggtcgatctggtccagccggtgctcgacgggctcgcccgggagaccggcgaactggtgcgcctgggggtaatcgaaggcgatcgccagacctggatcgccaagtcccagggcgccacctccgggctacgctacgaccccgacatggggcgcgaggcgccgctgttctacactgcatccgggcacgcctggctggccagcctgagccacaaggcggcgctggcgctggtggagcgccagggcgtaggggcggcgcgggacttcggtcccaacgcgccgcgctccaggagcgagctgctgcgttacctgaagcgcgcccgcgagcacggctatgcgtggcagatcgaatgctcggcgccgggcatggcggcgatggccgcactggtgcgccaccccgaggacggacgggctctcggcgtgctcagcgtggccgggccgagcgcacgcttcggcgaggcgcgcatgcacgaactggcgcccctgctcctggccgcggcgcaggacctgtcccacgccagccaggcgtccgagctgttccgctga

SEQ ID NO: 15704 - DNA, 330 bp, Pseudomonas aeruginosa
tgcatggaatcgaggattctttccctggcggcgctcaccgtgctcgagctgtcgcccccggacatggtcgaggctgccgcccgcgccggctacagtcatgtcggcctgcgcctggtgccggccaccgtggaagagcaccactatccgctgctggccgatgccggcctgcgccggcggaccctggcgcggctgcgcgacagccggagtgcgcacgctggacgtggagatcctgcgcctgcgtccggacacccgcgtcggcgagttcgccgcggtgctggaggtcggcgccgagttcggcgcgcgctatgtgctggtggccggcaacgatga

SEQ ID NO: 15705 - DNA, 915 bp, Pseudomonas aeruginosa
cctgctatcgatttgccctggtgcccggaccctccgatgaacgcatccacctccccgctgcccgccagcgaccagaccctgcgcggcatcctgctgatctgtgccgcggtgttcctgttcgccagccacgacgggttgtccaagttcctttccggtttctacccgatcgtcatggtggtctgggcccgctacctggtgcacaccctgttgatggtcgccgtgttcgtgccgcgcaacggcctcgcggtgatccgcagccgccgtccgctcatgcagttggcgcgggcgctgtgcctgatcggcaccagcctgttcttcaccaccggcctgcgctacctgcccttggccgaggcgaccgcggtgaacttcctggcaccgctgctggtgaccgcgttatccgtgccgctgctgaaggagaaggtcagcctcggccaatggctggcggtgctcaccggcttcatcggcgtgctcttcatcgtgcgtcccggtggcgcgctgttcaccccggcggcgttgttcccgctcggctcggcgctgtgcttcgggctctaccaactgctcacgcggatgctcgccaacagcgacagcccgaccaccagcaacttcctcgccggcatcttcaacacgctcatcatgagcctgctggtgccgttcttctggcagactccaagtcttctccacggcctgatgatgatcgccctgggcggttgcggcatgggcggccacctgctgctgacccaggccttccgccatgcgccgccggcgaccctggcgccgttcagctatggccagatcatcttcgccggcctgctcggcctgctggtgttcggccacgtgccggatgcctgggcgctgctcggcatcctcgtcatctgcgccagcggcctggtggtcgcctggcgccgtggccgctga

SEQ ID NO: 15706 - DNA, 1365 bp, Pseudomonas aeruginosa
gcagggaggtgcccggcgagcgccgggcgcttggactcaggcttcgatccggcgcggagccatgaagtacagccaggtcagggcgatgaagtacatcgccgggatcatggtgaagagcaccgcgtagttgttgttcgtcgcggtcagtacgccgccgacgatctgggtcatgaacatcccgcccagcgccgcgcacatgccgccgaagccgaacaccgtgctcatcaggtgcttgggcgtgtagtccatcaccaggctccagatgttcgccgtccacgcctggtgcgcgccgaccgccagggcgatggccagcacggcgatccacaggccgctggcgttggcggcgaacaccacgccgacgatggtgcaggcgaacagcagcatcgacagcaggcgcgcgcggatcgccggcatgccgcggccgatcagccaggacgaaaggatgccgccgccgacgctgccgaagtcggcggtcaaccagatcaggatcagcgggatgcccatctgcgtcacgctgatgcccaggccgtactgctggttgaggaacggcggcagccagtagaggtagaaccagaacaccggcgcggtgatcgagtaggccagggcgaaggcccaggtgccgcggcggcggagaatctgcgagaagggcacgcgggtggcgggcggctcctcctgctgctggatgtattccagctcgctctgcttcacccgcggatgctcctcggggttgtagtagttgcgccaccagaacaccagccagaccaggcccagcgccgacatgcagaggaacgccgcctgccagccccagacgctgaggatcagcggcaacagggccggggtgaccatcgcgccgacattggtgccggcgttgaagatgccggtggccaccgcccgttccccggcggggaaccacaggcgggtggtcttcacgcaggccgggtagttggccgcctcggtcaggccgaggatgaagcgacagaccatgaagcccgccgccgaggtcgccaggccgtgggcgccggtggccaggctccagagcagcacggcgaggaagaacgcgcgcttgaccccgaccttgtcgatgaagcggccctggaggatgaagccgatggcgtagccgacctggaaccagaagttgatgttggcgtagtccattgccgtccagctcatcttctcggcaaggatcggctgcatcacgccgagggcggcgcgatcgatgtagttcagggtggtggcgaagaacaccagggcgagcatgccccagcgcgtccggccgacggcgaaggcgttgcggatcctgccgccgcgggattcccgcggggcgtcggcggcgagcagtcgagagctggaagagtggatcattga

SEQ ID NO: 15707 - DNA, 543 bp, Pseudomonas aeruginosa
tcctcgacagcttccacaccctctcgctggacggcgatccccgcggcatcgccgatcttccgggggaaaagatcttcttcgtgcagatggccgacgcgcccttgctggcaatggacgtgctggaatggagccggcacttccgctgcttcccgggtcagggcggcttcgacctggcaggcttcctcgcgccggtcgtcgcgtccggctatcgcggtccgctgtcgctggaggtcttcaacgacggcttccgcgccgcgccgacccgcgccaacgccgtcgacggcctgcgctcgctgctctacctcgaggagaagacccgcgagcgcctgcaacgccagacgccgcacgtggcggtggacgagctgttcgcgccgccgccggcgaacctctgcgacggcatcgagttccttgagttcgccgtcgacgagacgctcggcgcgcgccttggccagtggttgcaacgactgggcttcgccagggccggtgagcaccgttcgaagaatgtcagcctgttgcgccagggcgacatcaacctggtgctga

SEQ ID NO: 15708 - DNA, 411 bp, Pseudomonas aeruginosa
ggttgtccgcgagggcctggggcccgcgccgggtcgacgtcgaacaggaccagccgctcgacgccctcggcgagcagcgcatgggccactgccgcgccggcgccgcccgcgcccatctgcaccacgcgctggcgcggcgcgtcggccaggccgcgccgaaagccctcggcgaagcccaggcagtcggtgttgtggccgatgcgccggccatcgcgcagcaccacggtgttcaccgcgccgatgccgcgtgcctcggcggagaggtcgtcgagcagggggatgatcgcctgcttgcaggggaaggtgacgttcagcccggtgaagccgaggtcgctggcggcggcgagcaggaactccaggtcgtccgccgacttgcccagcgggtcgagatcgatcagccggtacagatag

SEQ ID NO: 15709 - DNA, 1899 bp, Pseudomonas aeruginosa
cgatgccggcgacccggccgcgggcctggtggatccagtcgagcagttggccttcctggttggtctggcggaagtccacggcgaagccgcgcgtctcggcgaaggccgcgcattcgtcggcgatttcgcccagggtccgccggccgtaggtctgtggctcgcgggtgccgagcagattcaggttggggccgttcaggaccagtaccgtgcgcgtcatggcgcagcctccacagcaatgatgtcatcgatgccgggaaaatgtaccgaacggttacttttgtaaaccggacgccgtcgccgacgggacgaaagcgttcgattatcggcgtccgctcactcgcctgccgtcggttgcgtcgcgccgcggccgcgcagggtcatgtcgggcagtgccgaggccaccgccaggccgagcagcgccaccgccgcgttgaccaggaagagcaccttgaaggcatccgcgaggacatgctggaggatcacccgggccggcccgctggcggcgtccaggctgctcagcagggcgctctcggaaaagccctggtcgagcccgccgccgatccgcaggtgcttgagcagggccagcaggatcgccgacatcagcgccaccccgaccgccccgccgagggagcggaacaacgtcgcattgctggtggcgacgccgatgtggcgttgctccacggcgttctgcgcggccaccaggctggtcgggaactgggtaccgatggcgatcccggtgagcagcatgcacagcccggacagccagtggtcgccgaccgggaccagggccaggccggcgatgccgcagggcaacaggacggcgccgagcaggatcagcggcttgtagcgtcccaggctggcggtcagccgcccgcagcagtacgcgcccagcggcaggcccatgaccagcggcagcagatgcagcgcggcgctgtcggcgccggcgccggtaacgctctggtagcgcagcggtaccagcacggtcagcgagatggcctggaagctggcgaagaacgcaaccagccaactgagggtggcggcgcggacggcgaacagttgcatcggcaccagcggttcgcggaagcgccgctcctgggcgacgaacagcagcagggcgagcgccgccagggcgaacaggccgagcagcgcagggtcgctccaggctgcgccctggccgatctgggtgatggccaggagcagcgcggtgaggcccaccaccatcagcacgatgcccaggtagtcgatcaccggttgccggcgcggcaccggcaggccgaccagggttcgccgcgagatggccagcgcgagaaggccgatcggcaggttgatccagaatacccagcgccacgacaggtactcggtgagcaggcccccgagcaccgggccggcgacgctggcgatggcgtacatgctgctgaagtaaccctggtagcggccgcgctcgcgcggcgggacgatgtcgccgatgatcgcctggctcaccgccatcagcccgcccgcgccgatcccctgcagcactcgcgccagcaccagttggcccatgctctgcgcgagcccgcaaagcagcgaggcggcggtgaacacgacgatggcgaagagcatcagacggcggcggccgtagaggtcgccgagcttgccgtagatcggcatcgatacggtcatcgccaccatgtaggccgagatcacccaggccagcaggtcgaggtcggcgaagtcggccgagatcgccggcagggagacggcgacgatggtctggtcgagggcgctgaggaagatcgacagcatcaggccggcgaggacggtacggacggcgggcgggttctgggcgagatcggacaagacggcacctggggcggacggaacgcgaaggcagcgggcatcatactgcgcctggggtag

SEQ ID NO: 15710 - DNA, 1308 bp, Pseudomonas aeruginosa
gacaggtgccgcggagaatcgatccgtgggccgtctttcgtcgatattcgcctgcgccaacgttgcttcccgccttgggaaaggtgccccggcgttgcgccggggtggcgcggcctactcgatttcctcgtagggcaggccgacataattctcggcgatggtcgccaggcccgcctcggagcccaggtagtactccagttcggtctgctggatgcgctggctgaacgcgtcggtgtcggggaagcgatgcagcaccgaagtcatccaccaggagaagcgttcggccttccagatccgccgcaggcagattgccgagtagcgttccagcagttcgccgcgcccttcgcggtaggccttcagcagcagccggtagagcgtgctgacgtcgctggccgccaggttcagtcccttggcgccggtgggcggcacgatgtgcgcggcgtcgccggcgaggaacagccggccatgctgcatcggctcgaccacgaagctgcgcagcggcgcgatgctcttctccagcgaaggtccggtcaccagtttctccgccacctcggacgggagtcgcgccttcagttccgtccagaagcgctcgtcggaccagtcctcgaccttctccgacaatggcacctgcacgtagtagcggctgcgggtggccgaacgctggctgcacagggcgaagccgcgcggatgattggcgtagatcagttcgtggctcaccggcggggtgtcggcgagcaggccgagccagccgaacggatagacccgctcgaagaccttcagccgctccgccgggatcgattgccgcgagatgccgtggaagccatcgcagccggcgatgtagtcgcaatccaggcgcagccgttcgccgtcgcgttcgaaggtcacgtaggggcgctcaccttgcaggtcgtgcaggcgcacctcggcggcctggtagacggtagtggcgccgcaggcttcgcgggcctccatgaggtcgcgggtgacctcggtctggccgtagaccatcaccgtcttgccgccgctcaggcgcttcaggtcgatgcgccggcgctgcccggcgaaggcgatttccacgccttcgtggaccagcccgtcgcgcgccatgcgccggtcgacgccggcctcgcgcagcaggtcgaccataccctgttccagcacgccggcgcggatgcggccgagcacgtagtccggggtctggcgttcgaggatcacgttgtcgatgccggccttgtgcagcaactggccgagcaggaggccggacggaccggcgccgatgatggcgacttgagtcttcattgcggatag

SEQ ID NO: 15711 - DNA, 906 bp, Pseudomonas aeruginosa
agtctgttcggcaatcggccatttcgctcggagggctcgatgacggattccatccgcgacgtcccggtgttcaagctctacggcgctcccctcgaatggccgaccccggacctgctgcactgcgagtcgatccccgcccgcagtcgtctgcacgactgggagatcaagccgcaccggcacgccgatctcgctcagttgctctacgtgcgcaagggctgggcgcagctccaggtcgagggcgagccgactcgcgtcgagcagccttccatccagttcgtaccgccgttgtgcatccatggcttccagttctccgagcgcatcgacggctacgtgctgacgctcgccgcaccgttgctggcgcgcttgcaggcgcacctcggcgcgcagcgccaggcgctggaggcgccggggttgtacccggtgggcgcggaccggcgctatatcgacacgctgttcgacgccatagacggcgagtacgccggcgctgcgccggcgcgcgagctgttgttgcagtcgctgatcggcgtgctggcggtgtggctggggcggcaggtgatggtccggcgggcggaggcacggccgggtcgtggtcaggaatacctatcggccttttcgcaactggtcgagcggcatttccgcgagcacctgggaatcgacgagtacgcgcgtcgcctgggcatctccccggcacacctgaacagcgtggcgcgccgcctcagcgggcagaccgcactgggcatcgtgcaccagcgcttgctgctggaggccaagcgcgacctggtctacacggcgatgacggtgaacgagatcgccgaccgcctcggcttcagcgagccggcctacttcacccgtttcttcaagcgcctgagcggcgtctcgccgagcgctttccgcaagggcgactag

SEQ ID NO: 15712 - DNA, 741 bp, Pseudomonas aeruginosa
acccggcgggtgatggcgccgatctccaggttggcgtcgacctcggtgtgcacgtccaccaggtcaccctggcgacgcaggtggtcgacgaagtggcggaaatccagggcgctgcggttcatcggctcgccactccatataagtgcgtgtgcatgcatcttatgtgctgatgcgttctttaggcaagcggagcccggtcggttcgcgggctggccggaaggtcgccacctaggcaagatatatggctggttggaagccctggcaagcttccttgcgcagtcgcggcacaggatcggcgagcgccgtcgtggaggaaacatggaagcgtgcgatacagcgggcattatggatgcgatcacggctgtcaccggcgtactcacccttctggtggcgtgggcagcattgttttcgtggcgccggcaagagcgtcagaaagcgatattggcgtggaaggccgatctggtggactacgcctacgggtttcccaatctgccggtgatatggggttaccagacgcacaaggacgagatcgaccaggccgcagagcgtttttatcggtgcgtgaaaagctacatggtcatgcgcgagctggtgtcgcggaagcgaatgaaagcctatgagcgaatctggcgccaggctcatttcgttcatgagaaatgtacattcgaagggcaaatgacctgcgccatcgcccgggatctgctttcccaggcttacctgaacgattttctgaaatcttga

SEQ ID NO: 15713 - DNA, 1353 bp, Pseudomonas aeruginosa
gagaaactgcctggcttgctggtaggcccccaccagaaggacgttgacgccatgctggtgctgccagacatgggtcatttcgtgaatgaacagaccctggcgctgcaggctctccaggctccagtccgccacgccgcgcaactcctcgccgaagtagatgtggccgttcggcgccatcacgtagtccttgccctgccaggggacatagtcctcgtcgcgcaggcggaccgtggaatagtcgatggaatcgccgaatacgcctttcgccaggctgatttccccttcgctgagagcacgtccggcctcggcgtcggggccactcaggagcttgccgactgcaaccgccgcgccaaccgccgctgctatcccggcaactgcggaggcgggcgatttcgtgtgtttcatatcgaccttggcgatgttcatcgcatccttctgcagcagctgggtagcgccttcggcgtcggtgacgccctcgatgacctcgccgttggccatggtgatggtatagggcacgttgggcatggccgtctgcccgtccagttgcttgaggacgaaccgccgctgcgtctcgcccacctcgaactgcggcagctcggcttccaggctggccgcgccgacatgactgtgcttcgccgccttgaccacgaagttgccgggcatgcccagctcgatgttgccgcccttgagggtcaggtaggcgccgccgcacatcagggtgatgtgctccttcgcggtgaccagcacgtgctgctggctggcgctgacctccacgctctgctcggcttccaggcggatgtcgttcttctgcgcctgcagcagcatcgggccctggtgggtgatctggcgcagctcgccgccctgggcgaacaggccgatgtcgctgccggcgttgatcaccaccttctgcccggcggtcacctgctggttctgccgggccacgctgtcgacgtgctcgccggcggccagggtcaggctcgccggcgtcgccgcggcgatccctgccggaccgctcaaggcgatcgccggcttgcctccgttgctcttgccggactcgtcgttggcaccgtggccgaggtcgcgcacggcttcctggagggtttgctgcggcgccgcgtcgtgccccacgccctggtgctccccggcgtagtcgcccagctcgcgggccagctccagcgccgcctccagcacctgcaccacgacgcctcggtcgagatggccggcgccggccctgagctgctcctcggtgctcagcagcagccccttggccgcacgcaccgcgccatgttcgtcggtgcgcagttcgaagccctcgccgcgcggcttgccgccttcgggccgaggatgggttag

SEQ ID NO: 15714 - DNA, 1782 bp, Pseudomonas aeruginosa
gtagcccaggtgcagcgcgctggcaccgtggtcgctcatcagcgccgcactgatctgcgccgtggtgtcgtcgatgcgcagctcgttggcccgactgcccttgtactccttgctcttgatggtgctgaggatcttgtggtcgggcagcgcgtagggcggtcggttggtcgcccggtaggtgcgcccggtgacgatcggctggtcgcagtcgccgtccaggtaatcgacgatcacctcctggccaatccgcgggatcgccatgtgtccccagtcggcacccgcccagttctgcgcgacccgtatccagcaggtactgaactcatcgtgacgtccctcgcgatcccaggggaactggactttcacccgtccccactcgtcgcaatggatctcttcccctgccgggccgactaccgtcgcgatctgcggaccatcgatacgtggccgaggcagcggtgcgggacgccattcgacgtcctcgggtaccagttcggcgcgcaggtcgtagctcacccccagaggggcgtcggcggactcttcctcctggccggcatactgggtgccgcgatggaccacccgcaccggccgccaccaggcgttgaagtcggcacgcggatgaccttccatggcaaaggcgtggcccgggatcagccgcgggtcgtcgccgctgaccgatgccacccgcgcatcgcgccggtgccctctgaggcggctttcgctgaaaggccggccggcgccgctctgcttgtagcgaccggggtagtcgtagcgctcgtaggacgagccctgatgctcgagcgcctcgccagcgagatgatgctcctggtcgtaggtcgggcgcttgaagctgtagtcccgctgggtctgtcgagccgtacgaacattttcgctgtagcggaaagaatgaagcaccggctgcgggttgtcgccctccggctgggcgctgaacagcaccgggccgccggcgatacgctcctggacgtagagccggtcgctgcagaccagggtgtggcggtgttcgtcgaagcggaagtagtagaccaggccttcctcgaaggccagccggtcgtgcaggtagtgatcgctgtcgccggcctgcacgcagtattcgcgcggcaggtgctcatggtagatgcgctgttcgtagtcgagcacccggtgttccttgagcagcgcctggagaatctccggaacactcttctcctggaagatccgccagttgcagcacagctccaggcgcgccaactgtggttccagcagcagttcgtagcgggtccggcgaaaacccgagctgccttgggtgaagtggctgacgatgccatggacgtagcgggccggacggccgtcctgccagagggtgaaggtgcccggctggtcgagtacctgcttgaaatcgatggcgttcttgtcgctggccagcttcaggttcaggcggaaaggctcgcagagcgcttcttccagttcgaactcgacgacatcgaacgcgagtttcccttcgccgacgacgaaggtgaatttcaggtccctttgacgcatggatcgttccttgttcctggcgggcggttcctcccccatccgttggagaagcgagccccacgttactcttgctcagccgctgccgaaagtcttggctcggtgtctatttcgcgaagtagcggacattttcggctcgacggagaaccgatcgcacaggtgtacgaccggtgtgcctgtcaactcaccctgcgaccggcgagcgccagtcgtcggagccggaggtgccggagacttcgtgggtccaggtga

SEQ ID NO: 15715 - DNA, 1401 bp, Pseudomonas aeruginosa
ggccagcagggttgttctgctgcggggaaccggaggtgcggttcttcgcctttcggccaaggctcagttgatctgtgcgcccttggcgatccagctgccgatcaggttgcgttcttcctgggtcatctgcgtgatgttgcccagcggcatgatctgcgaggccacggcctgggcctggatcttcggtgccagttgctggatctgctgcggggtgtcgagcatgatcccgcctggcgcggtgctgaacagctggctggtcggtttcgccgagtggcagacggtgcagcgctcctggatcacgtgatggaccttgtcgaagtcggctccgctcgcggtcccggcattggaggcctggggcgcggcgggcgcggctggtgcgtcgccgccggtcgccggttgtgccggtgccgccgccggggtgctggccagcggtgcggaagcctgctggtagttcggcgtggtgacgaaggccagggcgatcatgcccagcgcgccggcgggcagtgcccaggcgaagcggttgctttcgtggcgggtgttgaagtagtggcgtaccagtaccgcgagcaccgcgatggcggccaggatcagccagttgtactggctgccgtaggtgctcgggaagtggttgctgatcatgatgaacagcaccggcagggtgaagtagttgttgtgccgggagcgcagcaggcccttggccggcagcaccggatcgggctcgcggttttcttcgatggctttcaccagcgcgcgctgggccggcatgatcaccctgaacacgttgccgaccatgatggtgccgatgatcgcgccgacgtgcaggtaggcgccgcggccgctgaacacctgggtcaggccgtaggcggcggcgaccagcaggacgaacaggaccaggccgagcagggcaggggtcttgcccagcgccgaatcgcagaggatggtgtagacgaaccagccgcagaccagcgaaccgataccgatggcgatggccgccgccggcgccaggtcgctgccgggggcgatcaggtagagggtcgggttcaggtagaacacgatggtcagcaacaccaccccggacatccaggtggagtaggcctcccatttgaaccagtgcaggttctccggcattttcggcggagccagcttgtacttctccaggtggtagatgccgccaccgtggattgcccagaggtctccggacaggccttcacgcgggttgctgcggttgaggttgttctccagccagacgaaatagaacgaagcgccgatccacgcgatcccgacgatcatgtgaatccagcgcaccagcaggttcagccattcgatgagatgtgcttccacagtcttgtacctcttgccctggccggcggaccggcggcaggacctctcttattggtttga

SEQ ID NO: 15716 - DNA, 828 bp, Pseudomonas aeruginosa
gcgaggatcagcccaggccacaagccggacgcacaaggttcgagaccgatgaccgatcagttgcaacacatcaggaagccgccgcgcaccggcaaggctgcccgcagcggtacccaggacgagatcgtctacgcccacatcttcgacgccatcctcgaacaacgcctggcccccggcaccaagctgagcgaggaggcgctcggcgagatattcggtgtcagccgcaccatcattcgccgcgccctctcgcgcctggcccacgagcaggtggtgctgttacggccgaaccggggcgcggtggtcgccagcccgagcatcgacgaggcccggcagatccttttcgcccgccgcaccgtcgagcgcgccatcaccgaactggccaccgacaacgccaccgccgagcgcctggccgagttgcgcgagatggtggtgcaggaacaatccagcttcgcccgtggcgaccggggcgccggcatccgcctgtccggcgagttccacctgaagctcgccgagatggcgcgcaacgctcctctggtgagtttccagcgcagcctggtgtcgcagacctcgctgatcatcgcccagtacgaaagcggcggtcgctcgcactgctcgttcgacgagcacaacgagatcctcgacgccatcgagaagggcgacaaggagcgcgcggtgaccctgatgatgcaccacatggagcacatcgacagcaagctcaacctggagagcgacaacgcttccggcgacctgcacgcggtgttctcgcacctcctcggcggcaagaagaagccacgccgggccaaggccgacagcgattcggcggcctga

SEQ ID NO: 15717 - DNA, 1659 bp, Pseudomonas aeruginosa
gagcagacggccctggccgtgccagcgctcgatcagcgccttgctgtcgcggtagctgctctcggcggtgtcggtcaggtagtccggcgcgttgcggtccatcatcaccttgccggcgatcaggcgcaggtccaggcgccgggcggcctcgaacagcgattccaccgattgccggtgcacgctgccgaagaccagcgcggtggtggtgccgttgcgcagcagttcctgcaggaagatctcggcgacctggtcggcgtgggccttgtcgccgaactggcgttcggtggggaaggtataggtgttcagccagtccagcagttgctcgccgtaggaggcgatcatcccggtctgcgggaaatggatgtgggtgtcgatgaagccgggggtgatcagcgcgtcgcggtactcgaagacctcgacgtcgccgatctcgccgagcagggcctcggcgtcaccgaggcgagcgaccttgccgtcctccaccagcaacaggccgtcctcgaagtattcataggagcgttcgacgccgacctccgcggggtcggcgatgctgtgcaggatggcggcgcggtaggctttggcgttgcgggtcatggcagtctcgaaaaaaaaaggttcgtgggaggtccgccgcctggcggcggacgcgggggagcggggggccgctcaggattcgtgggcgcggcgcgactccggggtcagccgggtgacgctcgacggcccctgcttgcgttccaggccgaaggcggcgttgtaggtggcgatcacctcgccggcgatggagatggcgatctccgccggcagcttgcctttcacctgatccaggcccatcgggcagcgcatccgttgcaggcgttcggcgtcgacgccacgttcgcgcaggcggtgctcgaacttgacgcgcttggtcttcgagccgatcaggccgaagtaggcgaagtcgttgcgcgccaggatcgccgcggtaagctccaggtccagcgggtggttgtgggtcatgacgatgaagtggctgccgggcggcatccgctcgacctcgtcgagcacttcgtcgttcaccactttctccacgccgtcgggcaggagcgcgggaaattcgtgttcccgcgaatcgatccagcgcacccggcagggcaggctggcgagcaagggtaccagggcgcgaccgacgtggcccgcgccgaacacggcgatgtgtgcctgcggctggcccatcggctcgaacagcagcaccgtggcgccgccgcagcactggccgagactggcgcccaggctgaagcgctccagacgggtgtcctgggtccgcgcggcgagcatttcccgggcaatggcctgggccctgtattccaggtggccgccgccgatggtgtcgtagagccgctcggcgctgaccaccatcttcgagccggcgttgcgcggggtcgagccgcgctcctcgatgatagtcaccaggacgcaaggttcgccgctacgctgcaactcggccagggcgctgatccagttcatctcgtcatcctcccgatcgcggcggttcaggccggctcgaccgcggcgtccgccgcttgcgcctgggcggtcttcaaccggcgcatctgttccacgccccagagcacccgctcgggcgtcgccggcgcgtcgatggcgggttgcgcgcggtag

SEQ ID NO: 15718 - DNA, 216 bp, Pseudomonas aeruginosa
ctggccgggccgctggtcatcagcttgcccttggcgttccagaccagttcctccatggtcagccagcccatgccctggacgaagccgccttcgacctggccgatgtcgatggccgggttcagcgagtcgccgacgtcatgcaggatgtcggtgcgcagcatgcggtattcgccggtgagggtatcgactatcacctccgagcaggcggcgccgtag

SEQ ID NO: 15719 - DNA, 1710 bp, Pseudomonas aeruginosa
atcgcctcgccgctgacgtgcttgggggcgctttcgtgcttgacgctgcggccgaccccggtggtcaactcggcgcggaacaggtcggccagctcttcctggctcttgtgcggcttgcgatggttagacataggcggtcacccgggtttcgacggcgggagcgtgcagctccaggaagcatttgcgcagcaggttctgcgcggtcagcaggcgatattccttgctcgcgcggaagtcgctgagcggggtgaagtcgttcgccagggcggcggcggcgcgttcgaagctggcggcttccaggcgcgcgccttgcagcgccgcttcgcaggcggcggcgcgcttgggaatcgccgccatgccgccgaaggcgaccctggcgcggacgatccggccatcttccaggtcgaggctgatggcggcgcagaccgcggaaatatcgtcgtcgatgcgcttggagaccttgtaggccttgaacgcctggctgggccgggcacgcgggaccaggatcttctcgatgaactcgccttcttcgcgggcggtgaccttgtagtcgaggaagtactcctccagcggcagctcgcggcgccgttcgccgcggcgcaggacgatcttcgcgccgagggcgatcagcagcggcggggcgtcgccgatcggcgaggcgttgccgatattgccgccgagagtgccctggttgcggatctgcagggacgcgaaacgctgcagcaactcgccgaagtccgggtagtccgcggccagcgcctggtagcagtcggtcagcggggtggcggcgccgatttccaggcagttggcgcccacttcgatgcgtttcatttcgcggatgtggccgacatagatcatcaccggcagttcgcgatggaactgggtggcctccagcgccaggtcggtgccgccggccagcaggcgtgcctgcggattggcgccgtagaggtcggccaggtcggcgacggtgagcggcagcaggcagcgccggtcaccgctgttcagctcggcggtttcgcgcggagcgatgtcgcgcaattgctcgatggtggcggcttcccgggcgtcgaactggtctgcgcgcctgtggcagcaggcctgctcggcggcgtcgaggatcggccggtagccggtgcagcggcagaggttgccggcgagcgcctcgtgggccttggccggatcggcgccggcgctgtccttctgcagggcgaacagcgacatgacgaaacccggcgtgcagaacccgcactgcgagccatggcagtcgaccatcgcctgctgcacgtcgtgcaggcggtcctggtgcttgaggtcctcgacggtgatcaattgcttgccgtgaagggcggaaacgaaggtcaggcaggagttcaggctgcgatagcggatgcgttcggcaccatcctcgccggtgaccagttcgccgaccaccacggtgcaggcgccgcaatcgccggaggcgcagccttccttggtgccggtcttgccgaggtgccggcgcaggtagtcgaggacggtgaggttggggtccaggcgttcttcgacgcggatctcccggttgagcaggaacctgatcaaggcgtgcctccaggcgggttcttgttattgaattctaggccttgcaggagaaccggccggagtggggcggtttccgcacagggctccacggtaggagctatggaggcgaatctagaaaaaactgacttttga

SEQ ID NO: 15720 - DNA, 588 bp, Pseudomonas aeruginosa
aaggatcaccatgacgttcaaggccccggacagcctggcagagcagatcgcccaccacctcgcggaacgcatcatccggggagaactcaaggaacgggaacgtatccaggagcagaaggtcacccagaccctcaacgtcagtcgcggctcggtccgcgaggcgctgctgattctcgaacgccgccacctggtgaacatcctgccgcgccgcggcgcccaggtgtccgaactgtccccgcaacatgtggaaagcctctacgcgctgatcgtgcagctctacatcctgctggcggaaagcgtcgcccggcgctggcgcagcgaagccgagctggcaccgttcctggtcatccagcagcgcctgctgaacaacctggcgcaaagcgatatcgacggcttcgtcgaggccagcttcgacatcatgcgcgcggcctttcctttcgcgaacaatccctacctgcaggagaccgtcgaaaacctgctgccggcggtgagtcgcgcctaccacctggcgctggaacggcgcaaggcggaaatgaaccagttcctcggcagttttgctcagctcctgcaagcggtgatcgcccgtga

SEQ ID NO: 15721 - DNA, 750 bp, Pseudomonas aeruginosa
acgagcaggtcggtcagcgcgagcgggtcatcggcgaccaggagatcgccttcgaggccctggtggccgagcagcgcggtgccgatgccggcatcgaacggctgcgcgacggccatcacgagttgtccgaacgcttcaaccaggtgcaggcacgcttctattcggtcggcggcgacatcgcccgggtcgagcagagcatccagcatggccagcagcgccagcgccagttgcaggacgacttgcgcgaagccgaacggacccgccaggaaaccgaatcgcacctcgggcatgaccgtaccttgctcgcgaccctggccgaggaaatggccatgctcgcaccggaacaggaactcagcgcggccgccgcggaagaagcgggcatcgccctggaacaggccgagcagggcatgcaggcctggcagcagcagtgggatgccttcaaccagcagagcgccgaaccccgccgccaggccgaggtgcagcagtcgcgcatccagcacctggagcagagcctggagcgcctgcaggatcgcgagcggcgcctgcaggaggagcgtggccagttggcggccgaccccgaggacgcggcgatcctcgaactcaacgaacaggtggcgatcgccgaactggccctggaagaactgcaattgcaggagcagggccaagccgagcgactcgaacaattgcgccaggaattgcagcagctggccgccgaacagcaccaggcgcagggcgagttgcagcgcctga

SEQ ID NO: 15722 - DNA, 888 bp, Pseudomonas aeruginosa
gatccccatgctcagcctcggcaacgccttcgaggagcaggacctgctggacttcgaccgccgcgtacgcgaaggactggccgacctgttgcctggcggcgacctgctcggcggtggcgcggaggtcgagtacagttgcgagccgaagctggacggcctggccgtcagcctgctctacgagcgcggccaactggtgcgcggcgccacccgcggcgatggcagcaccggcgaggacatcaccagcaacgtacgcaccattcgcaacgtacctctgaagctgcatggcgaaggctggccggagatcctcgaagtgcgcggcgaggtgttcatgtccaaggccggtttcgaggcgctcaacgccaaggccgtggaaaccggcggcaagaccttcgccaacccgcgcaacgcggcggccggcagcctgcgccagctggattcgaagatcaccgccagtcgcccgctggagttctgtgcctacggcttcggccaggtcagcgggtcgctgccggacacccaggtgggcatcctcgaggcgttccgcggctggggtatccccatcagtcgcgagctgcgcctggtcaagggcgcccaggcctgccgcgactactacgacgacatcggtcgccgacgcgatgcgctggcctacgagatcgacggcgtggtgttcaaggtcaaccgcatcgccttccagcgcgaactgggcttccgcgcgcgcgagccgcgttgggcgatcgcccacaagttccccgcgcgcgaggagctgaccgagctgctgggtgtcgagttccaggtcggccgcaccggcgccgtgaccccggtggcacgcctcaagccggtgcaggtggccggcgtcacggtgtccaatgcgaccctgcacaacatggatga

SEQ ID NO: 15723 - DNA, 594 bp, Pseudomonas aeruginosa
gttcggcatgcattggcagagcgagcgcaaggcggtcgaaggcctgcctctggccgggcagacctgggtgctgaccggcaccctggaggcgatgagccgggacgtggccaaggacaagctggaagggctcggcgccaaggtggccggctcggtgtcggccaagacccactgcgtggtcgccgggcccggcgccggctcgaagctggccaaggccaacgagctgggcgtgaaggtgctcgacgaagacggcctgctgaaactgttcgacgagcacggcgtcgcccgctgaagcggcggcgctgctgcgaaagatttccgaagactggagttaacgatggacaaggcaagaaagcagcggttgctgggcgtgctcgcattggtggtgctgttcggcgcctacgtgggttggagcgagcggccgcgcatcctgctgcattacagtggccaggcttcggcgccgatcgcctacagctacaaggagcagggcgtggaaaccttctccggggagatccggcccggccaggtccgcgagtttccggtgaagctgttcggcggcagcgattaccggatcgccttctccttccatcgcggtga

SEQ ID NO: 15724 - DNA, 219 bp, Pseudomonas aeruginosa
accctcgtggctacccggtcaaggggaaagcttgatttttggctccctcagctccttcccggtggtctggttcattcgacgttaagaggtatcgacatgagtcagaaacgatccagcggcggtaagaaaaccgtccatcgcagttccatcaccggtcggtttgtcccggaaagctacgccaagaagcatccgaagacgaccgaaaaagagaaactctga

SEQ ID NO: 15725 - DNA, 318 bp, Pseudomonas aeruginosa
  unsure (206): Identity of nucleotide at the above locations are unknown.
tcacacggtcatcgacctgatcgtggtggacgagcgcgaccggcaaccgattggccgtccgtatctgaccatcgccatcgacgtgtttacccgctgcgtgctcggcatggtcgtcacgctggaagcgccgtcatctgtttcggtcggcctgtgccttgtgcatgtcgcctgcgacaagcgtccctggctggagggtctgaacatanaaatggagtggccgatgagcggcaagcccaagctgctctacctggacaacgcggccgagttcaagagcgaagcgctactccgatgctgcgagcagcatggcatccggcttga

SEQ ID NO: 15726 - DNA, 981 bp, Pseudomonas aeruginosa
  unsure (178),(202),(275): Identity of nucleotide at the above locations are unknown.
ctgatcctgcgggtgcggggcgagcacccgccgatttacctggccaacgtcaacgccgagcggcaactggtggtggccggcagcgaagcggatttgcccgccttcgccgaacgcgccgtgcccgccggcgccagcgcggcgaagcgcctggcggtgagcgtaccgtcgcactgtgcgntgctcgacgaaccggccgcgcgcntggccgaagccttcgccggcatccgcctgcatcggccgcgcgtgcccatacatgagcagcagccgggcgcgcntggtcgccgaaccggccgcgctggccgacgatctcgccggcaacatggcgcgccgcgtcgagtggctggcgacattgcgcagcgcctacgagcgcggtgcccgcctgcatctcgagctgccgccgggacgggtcctcagcggtctggcgcggcctctgttcggctgcgccacgccggccttcgaaggctcccgggcggataccctggacgcgctgttgcgcgaggaggaaaagagaacccgataagcgttcgttcgaggcataaaaacaacaacatcgatccgcaaccgaggacaacaataatgattatctacggtgtcgcactgctgtctctgtgtaccctcgccgggctgatcatcggcgagatccttggcgtgctgctcggcgtgccggccaacgtcggtggcgtcggcatcgccatgctgctgctgatcttcgtcggcagctacctgggcaagcgtggcctgctctcggcgaagaccgagcagggcgtggagttctggagcgcggtctatattcccatcgtggtcgccatggccgcccagcagaatgtcctcggcgcgctgagcggcgggccggccgctatcctcgccggcatcgccgcggtcgccgtggccttcgccctggtcccgctgctcgaccgcttcggccggaagaaagccgaaggcgcccggccattgaaaccgcgcaccagcgtgcaggggtga

SEQ ID NO: 15727 - DNA, 1428 bp, Pseudomonas aeruginosa
tcggcggccgccagcgtccagccgccagccggcgctaccttcgacgccatcgatccggcgagcaatcgcctgctggcgcgggtcgcggcctgcgatgcggccgacgttgacgcggcagtggccgccgcccgccgcgccttcgacgaaggcccctgggcgcgtctcgccccggtcgagcgcaagcgcgtgctgctgcgcctggccgagctgatgctggcccatcgcgaagagctggcgctgctcgactcgctgaacatgggcaagccggtgatggacgcctggaacatcgatgtacccggcgccgcccacgtcttcgcctggtatgcggaaagcctcgacaagctctacgaccaggtcgcgccgaccgcccagcagaccctggccaccattacccgcgtgccgctgggggtgatcggcgcggtggtgccgtggaacttcccgctcgacatggccgcctggaagctcgccccggccctggccgccggcaactcggtggtgctcaagccggccgagcagtcgccgttctccgccctgcgcctggccgagctggccctggaggcgggggtgccggaaggcgtgctgaacgtggtgccgggcctcggcgagcaggccggcaaggccctcggcttgcacccggaggtggacgcactggtgttcaccggctccaccgaggtcggcaagtacttcatgcagtattccgcgcaatccaacctcaagcaggtctggctggagtgcggcggcaagagtccgaacctggtgttcgccgattgccgcgatcttgacctggcggcggaaaaggccgccttcggcattttcttcaaccagggcgaggtctgttcggcgaactcgcgcttgctggtggagcgttcgatccacgacgagttcgtcgagcgcctgctggccaaggcccgcgactggcagccgggcgatccgctggacccggccagccgcgccggcgccatcgtcgaccgccggcagatcgccgggattctcgccgccatcgagcgggcgcaaggcgagggcgcgaccctgctcggcggtggccgccagttgacgatcaacggttcggacaacttcatcgaaccgaccctgttcggcgacgtacgcccggacatgcagctggcccgcgaggaaatcttcggtccggtgctggcgatcagcgccttcgactccgaggacgaggccatacgcctggccaacgacagccgctacggcctcgccgcctcgctgtggagcgacgacctgcaccgtgcacaccgggtggcgcggcgcttgaatgccggaacggtgtcggtgaataccgtggacgcgctggacgtcgcggtgcctttcggcggcggcaagcagtccggcttcggtcgcgacctgtcgctgcattccttcgacaagtacacccagttgaagacgacctggttccagttgcgctga

SEQ ID NO: 15728 - DNA, 1455 bp, Pseudomonas aeruginosa
cgacaacaagaggacgatcgaatgaacgacacgccgaacgtgcgtgagccggccctgcgccgcgtgctcgggctgggaccgctgctggcggtggccatcggcctggtggtttcccagggcgtgatggtactgatgctgcaaggcgccgggacggccggcctgggcttcatcgtgccgctgggagtggcctacctgctggcgctgagctacgccttttccttttccgagctggccctgatgattccccgcgccggtagcctgagcagctacaccgaggtggccatcgggcatttcccggcgatcctggcgaccttttccggctacgtggtggtggcgatgttcgccctctcggcggaactgctgctgctcgacctgatcatcggcaaggtctaccccggcgcgctgccgccgatgctggtggcctacggcgtgctcggcctgttcaccctgctcaacctgctcggcatcgacatcttcgcgcgcctgcagagcgcgctggcgctgctgatgatgatcgtcctgctggtgctcggcctgggtgcggtgagcagcgaccacgcttccgcgcagaccgccctggcgagcggctggaacccgctcggggtaagcgccctggcgctcaccgcgatggccgtgtggggcttcgtcggcgccgagttcgtctgcccgctggtggaggagacgcggcgtccggagcgcaacatcccgcgttcgatgatcctcggcctgagcatcatcttcctgaccatcgccctctactgcttcggtgcgctgctgtgcatcccgcaggcggaactggccggcgacccgctgccacacttcctcttcgccaaccgcgtgttcggcgagtacggccagctgttcctggtgatcgccgcgatcaccgccacctgcagcaccctcaactcgtcgctggcggcgatcccgcggatgctctacgggatggcgcagaacggccaggccttcccgcaattcaagcagctcagccggcgggcgcgcacgccctgggtggcggtgctgttcgtggctgcgatcaccggcgtgcagatcatgatcttcggccaggacccggattcgatcaacctgctgctgctcgccgccgcgctggcctggctgctggcatacatcatcgcccacgtagacgtgctggccctgcgccgtcgctatccgcacatcgcccgtccgttccgcacgccgttatacccgctgccgcaactgttcggcatcgccgggatgatatacgcggtggtccacgtctcgccgaccccggaaatgaccggacggattttcgccagcgccggcgtggtgctcggcgtggtctcgctggtggcggtggtgtggatcaagggcgtgatgcgcaagccccttttcgtacccgaaccgctcgagacggccggtgagactgcccagggcaagtccgtcgccctcgatcccctgcaatccccttcggcctga

SEQ ID NO: 15729 - DNA, 1413 bp, Pseudomonas aeruginosa
cgcgccaagggaacaaggagaacacagacgatgaccgctcagctcaacccgcagcgcgacacccgcgactaccagcaactggacgccgcgcaccacatccacgccttcctcgaccagaaggcgctgaaccgcgaaggcccgcgggtgatggtccgcggcgatggcctgcagctctgggacaacgacggcaagcgctacctggacggcatgtccggcctctggtgcaccaacctcggctacggccgccaggacctcgccgccgccgccagccgccagctggaacaactgccgtactacaacatgttcttccacaccacccacccggcggtggtggagctttccgagatgctcttcagcctgctgccggaccactacagccacgcgatctacaccaactccggctccgaggccaacgaggtgctgatccgtaccgtgcggcgctactggcagatcctcggcaagtcgcagaagaagatcatgatcggccgctggaacggctaccacggctcgaccctgggcagcaccgcgctcggcgggatgaagttcatgcacgagatgggcggcatgctgccggacttcgcccacatcgacgaaccctactggtacgccaacggcggcgagctgagcccggccgagttcggtcgccgcgcggcgctgcaactggaggagaagatcctcgaactgggcgcggagaacgtcgccgccttcgtcgccgagcccttccagggcgccggcggcatgatcttcccgccgcaaagctattggccggagatccagcgcatctgccggcagtacgacgtgctgctgtgcgccgacgaactgatcggcggcttcggccgcaccggcgaatggttcgcccacgaacacttcggcttccagccggacaccctgtccatcgccaagggcctgacgtccggctacatccccatgggcggcctggtactcggcaagcgcatcgccgaggtgctggtggatcagggcggggtgttcgcccacggcctgacctattccggccacccggtggcggcggcggtggccatcgccaacctcaaggcgctgcgcgacgagggcgtggtcacgcgggtcagggaggagaccggaccctacctgcaacgctgcctgcgcgaggtcttcggcgaccatccgctggtcggcgaggtccagggcgccggcttcgtcgccgcgctgcagttcgccgaggacaaggtgacccgcaagcgcttcgccaacgagaacgatctggcctggcgctgccgcaccatcggcttcgaggagggcgtgatcatccgctccaccctcggccgcatgatcatggccccggcgctggtggccgggcgtgccgagatcgacgaactgatcgacaagacccgtatcgcggtggatcgcaccgcccgcgagatcggcgtgctctga

SEQ ID NO: 15730 - DNA, 1299 bp, Pseudomonas aeruginosa
cgcgccccggcggcccggcctcggccgggtcgactgcgacacggagcgtccccccataacgacgatgcggcgcctggcgaccgcgcgcggaaccgtttcggcctctggccggcaactgcctcagcaacatcacaacaatgccaatcggctgtgggagtgttccatgttcaagtccttgcaccagtacgcacacgtgttttcccggttgtccctgttcggcctggcgttcgccgcggcggcccaggcgcagagccagagcctgacggtgatctccttcggcggcgcgaccaaggccgcccaggaacaggcctatttcaaacccttcgagcgaagcggcggcgggcaggtggtcgccggcgaatacaacggcgaaatggccaaggtgaaggccatggtcgacgtcggcaaggtcagctgggacgtggtcgaggtggagagccccgaactgctccgcggctgcgacgaggggctgttcgaacgcctcgacccggcgcgtttcggcgaccccgcgcagttcgtccccggcactttcagcgagtgcggggtggccacctacgtctggtcgatggtgatggcctacgactcgacgaagctggccagggcgccgcagtcctgggcggatttctggaacgtccgcgagttccccggcaagcgtggcctgcgcaagggcgccaagtacaccctggaagtggcgttgctggccgacggggtgaaggcggaggacctctacaaggtacttgccaccccggagggggtcagccgcgccttcgccaagctcgaccagctcaagccgaacatccagtggtgggaggccggcgcccagccgccgcaatggctggcggccggcgacgtggtgatgagcgcggcctacaacgggcgcatcgccgctgcgcagaaggagggggtgaaactggccatcgtctggcccggcagtctctacgatccggagtactgggcggtggtgaagggcacgccgaacaaggcgctggcggagaaattcatcgccttcgccagccagccgcagacgcagaaggtgttctccgagcagatcccctacgggccggtacacaagggcaccctggcgttgctgccgaagacggtgcaggaggcgctgccgaccgcgccggccaacctcgaaggcgcgcgggcggtggatgccgagttctgggtggaccacggcgaggagctggaacagcgtttcaatgcctgggcggcgcgctgagcgcgctgcgcgtcggcaaaaaaaacgacgggccccaagtcgtccgggcccgtcgggtcaaagcgctgacggggtga

SEQ ID NO: 15731 - DNA, 897 bp, Pseudomonas aeruginosa
tcagcgcagctcttccaacaacccctgcagataccgacagccctcggtatccagcgcctgcaccggaaggcgcggcgcccccacctccaggccggagaggcccaggccggccttgatggtggtcggcaggccccggcggaggatgaagtcgagcagcggcaactgccggtagaacagcgcgcgggccttctccaggtcgccgtcgagcaccgcctggtacagctggccgttgagcgtcgggatcaggttcggcgcggcgctgcaccagcctttcgcgccggccacgaaggcctccagcgccagcgggttgcagccgttgtagaagggcacccggccttcgccgagcaggcgcagcttgtgcatgcgctggatgtcgccggtgctctccttgaccatggttacgttgtccacttcgcggacgatgcgcaggatcagttccaccgacatgtcgatgccgctggtgcccgggttgttgtagagcatcaccggcacgccgatagcttcgcccaccgcgcggtagtgctggaacacttccgcctcgttgagcttccagtaggagatcggcaggaccatcaccgcctcggcgccgagggattcggcgaactgcgcgcggcgcacggtcttggcggtggtcaggtcggagacgctgacgatggtcggcacgcgatgggcgacggtcttcagggtgaagtcgaccacctcgtcccattccgggtcgctcaggtaggcgccttcgccggtgctgccgagcggggcgatggcgtgcacgccgccgtcgatcaggcgctcgatggagcggccgagggccggcaggtcgagacctccgtcggcggcgaagggggtgatggtgtagccgatgatgccgtggatggatgcggacattggatgtacccgtga

SEQ ID NO: 15732 - DNA, 582 bp, Pseudomonas aeruginosa
caagagaaaagtttcatcgccatcgggagaaggctgtcctcaatgtccatgcgcttgaaattgctgagaaaaaaactcggggtcacgctggagaccctggccgacaagaccggcctgaccaagagctacctgtccaaggtcgagcgcgggctgaacacgccgtccattgccgccgcgctgaagctggcgaaggcgttgaacgtgcaggtggaggagctgttctccgaggaaagcgacggtgtcgacggctacagcatcgttcgtcgcgaccagcgcaagtcgctgtccagcggcgacgacggcccggcctacgcctccctcgcgcagcagatcggcgcccgcgcgctgttgccgttcatcgtccaccccccgcgcgatttcagtcactcgacgttcaaggagcacctcggcgaagagttcatcttcgtccatgagggccaggtcgaggtcgacttcatgaaccagcggatcatcctcgagcgcggcgacgccctgcatttcaacgcacagaagccgcaccgcatccgctccctgggggagacccaggcggaattgctggtggtgatccacagcgacgaatga

SEQ ID NO: 15733 - DNA, 924 bp, Pseudomonas aeruginosa
gccctcggaccccggcgtaaggttctcgtcacgtgccgtccaggcagcgcacaacaagacgagacccgaccgatggctgaaatcctctccctgcgcgaagcggtgcgacgcttcgtccacgatggcgacagcgtcgccctcgaaggcttcactcacctgatcccgacggccgccggccacgagctgatccgccagggcaggaaagacctgacgctgatccgcatgactcccgacctggtctacgacctgctgatcggtgcaggctgcgcgaagaagctggtgttctcctggggcggcaaccccggcgtcggttcgctgcaccgcctgcgcgacgcggtggagaagggctggccgcaaccgctggagatcgaggaacacagccacgccgacctcgccaacgcctatgtcgccggcgcctccgggctgcccttcgcagtgctgcgcgcctacgccggctccgacctgccgaaggtcaacccgctgatccgcagcgtcacctgcccgttcaccggcgaagtgctggcggcggtgccctcggtgcgtccggacgtcagcgtgatccacgcgcagaaggccgaccgcaagggcaacgtgctgctctggggcatcctcggcgtgcagaaggaagcggccctggcggcgaagcgctgcatcgtcaccgtcgaggagatcgtcgacgaactggacgccccgatgaacgcctgcgtcctgccgagctgggcgctcagcgccgtgtgcctggtgcccggcggcgcgcatccgtcctatgcccacggctactacgagcgcgacaaccgcttctaccaggactgggatccgatcgcccgcgaccgcgaaagcttcaccgcgtggatcgacgaatacatccgggggaccgaggatttcggggccttccaggccaagctcgcggagggcaagcgatga

SEQ ID NO: 15734 - DNA, 633 bp, Pseudomonas aeruginosa
cgccttcgggcgcggccagaagatcgaggacaccaccatcggctggcgcttcgtcaatccgctgatgaaggagcagtacggcatcgacccgatgccgcagaccgccgacaacgtcgccgacgactatcgcgtgtcgcgtgccgaccaggatgccttcgccctgcgcagccagcagcgcgccggcagggcgcaggaggccggtttcttcgccgaggaaatcgtcccggtgacgattcgcgggcgcaagggcgacaccctggtcgagcacgacgagcatccgcgtcccgacaccaccctggaggcgctggcccggctcaagccggtcaacgggccggagaagaccgtcaccgccggcaacgcgtccggggtcaacgacggcgccgccgcgctggtcctggcctccgccgaggcagtggagaagcacggcctgactccgcgcgcgcgggtgctgggcatggccagcgccggcgtcgccccacggatcatgggcatcggcccggtgccggcggtgcgcaagctgctgcggcgcctggacctggcgatcgacgccttcgacgtgatcgaactcaacgaagccttcgccagccagggcctggcctgcctgcgcgaactgggcgtggccgacgacagtga

SEQ ID NO: 15735 - DNA, 1326 bp, Pseudomonas aeruginosa
aacggaccctgtcgagagaacaacagcatgactgcccctgttcaccagtacagcaacgaagaacgccgcaagcgcatcttcgccatcgtcggcgcctcctccggcaacctcgtggaatggttcgacttctacgtctacgccttctgcgcgatctacttcgcaccggccttcttcccctccgacaaccccacggtgcagttgctgaacaccgccggggtcttcgccgccggcttcctcatgcgccccatcggcggctggatgttcggccgcatcgccgacaagcacgggcgcaagaccgccatgctgatctcggtggtgatgatgtgcgccggctccctggcgatcgcctgcatgcccacctacgccagcatcggcaccctggcgccggccctgctgttgctggcgcggatgttccagggcctgtcggtgggcggcgagtacggcaccagtgcgacctacatgagcgaggtggcgctcaagggccagcgcggcttcttcgcctcgttccagtacgtcaccctgatcggcggacagttgctggcggtgctggtggtggtgatcctgcagcagttgctgagcgaagacgaactgcgcgcctggggctggcggattcccttcgtgatcggcgcgatcaccgcggtgatcgccctctggctgcggcgctcgctgaacgagaccgcttcgaagtcgaccctggagcgcaaggaatccggcaccttcgccgagctgttcaagcacaagcgggccttattcaccgtgctcggcttcaccgccggcggctcgctgatcttctacactttcaccacctacatgcagaagtacctggtcaacaccgccgggatgagcgccaagaccgccagcgcggtgatgaccttcgccctgctggcgtacatgctgatgcaaccgctgttcggcatgctttccgatcgcatcgggcgcaagacctcgatgctctggttcggcaccctgggcacgctgtgcaccctgccgatcctgctcgcgctgaagaccgtgagcagtccctacatggccttcttcctgatcatcctggcgctggccatcgtcagcctgtacacctccatcagcggcctgatcaaggccgagatgttcccgccggaggtgcgcgccctcggcgtcggagtgtcctacgcggtgggcaacgcgatcttcggcggctcggccgagtacgtcgccctggggctgaagtcggtagggatggagaacgtcttctactggtatgtttcagccatgtgcctgctggcgctgctggtctgcgtgagcctgccggacctgcgcaaggtcagctacctgaacgacgagccctga

SEQ ID NO: 15736 - DNA, 771 bp, Pseudomonas aeruginosa
cgggccgggaaaaggaaaaccgatgagcgacatacccgccaaccagttgttcgatgcctatttcatggcggcgccgatgcgcgcggtgttctccgaccgcggccgcctgcaaggcatgctcgacttcgaggccgccatggcccgcgccgaggcgcgcaccggggtggttcccgcgacggcggtggcgccgatcgaggcggcctgccgcgccgaactgtacgacccgctggcgctggccgaggcggtcgccactgccggcaactcggcgatcccgctggtcaaggcgctgggccgccaggtggcggctggcgacgccgaggccgagcgctacgtgcatctcggcgccaccagccaggacgccatggacagcggcctggtgctgcaactgcgccgtgcgctggccttgctcgagcaggatctgcaacgtcttgccgaggtcctggcggaccaggccgaacggcatgccgacacgccgctggccgggcgcacctggttgcagcacgccaccccggtgaccctgggcatgaagctcgccggcctgctcggtgccttgacccggcaccgccagcgcctgcgcgagttgcgcccgcgcctgctggtgctgcaattcggcggcgcctcggggacgctcgccgcgctcggcgaacaggccctgccggtggccgcggcgctggccgaggagctgggcctggctctgcccgaacaaccctggcacacccagcgcgaccgcctggtggaattcgccagcgtgctcggcctggtggccggtaa

SEQ ID NO: 15737 - DNA, 1869 bp, Pseudomonas aeruginosa
cctcggcaagttcggtcgcgatgtcagcctgctgatgcagaccgaggccggcgaggtcttcgagccggccggcgccgggcgcggcggttcctcgaccatgccgcacaagcgcaacccggtgagcagcgcggtgctgatcgccgccgccacccgtgcgccggggctggtctcgaccctgttcgcggcgatgccgcaggaacacgagcgcagcctcggtctctggcacgccgagtgggaaaccctgccggaactctgttgcctggttgccggcgcgctgcaacaggcgatcggcctgctcgaaggcctggaggtggacgcccagcggatgcgccgcaaccttggcctgacccacggcctggtgctcgccgaggcggtgagcatcgccctggcccgccgtatcggccgcgaagccgcgcaccatctggtggaacagtgctgccgccgcgccgtcgagcagcgccgcgagttgcgcgcggtgctcggcgaagaggcgcgggtgagcgccgagttgtccggcgacgaactggaccgcctgctcgatcccgcccattacctcggccaggcccgcgcctgggtcgagcgcgcgctcgccgaacaccatgccctgggcttcgaaccccatcccgcctgactggagatccccttcgtgccaaccgtacgcctcgccgacggcgacctgaactactccctggaaggaccggccggcgcgccggtcctgctgttgtcaaactcgctgggcaccgacctgggcatgtgggacacgcagatccccgcactcaccgcccatttccgcgtgctgcgctacgacacccgcggccacggcgcctcgctggtcacccccggaccgtacgccatcggccagctcggcgccgacgtgcttgccttgctcgatgccctcgagctgccgcgcgtgcatttctgcgggctgtccatgggcggcctgatcggccagtggctgggcatccacgccggcgagcggctcggccggctggtgctgtgcaacaccgcggcgaagattgccagcgacgaggtctggaacacccgcatcgataccgtcctgaaaggcggcgagcaggccatgcgtgtcctgcgcgacgcctcggtggcgcgctggttcaccgcgggcttcgccgagcgcgaaccggcgcaggtcgagcgcatcgtcgcgatgctcgcggccacctcgccgcagggctacgcggccaactgcgctgcggtacgcgacgccgatttccgcgagcagctcgggctggtccaggcgccgacgctgatcgtcgccggcagccacgatgccgtgaccactccggacaacgcccgcttcatgcaggcgcgcatcgccgacgcgcagttggtcgagttcgccgccgcgcacctgtccaacgtcgaagcgggcgacgccttcagccgccgcctggtcgatttcctgctgtccgcctgaggagccccgccgatggacgagaaacaacgctacgaagccggcatgcaagtgcgccgcgcggtgctcggcgacgcccatgtcgagcgcagcctggccaacctgacgccgttcaacgaagagttccaggaaatgatcacccgccacgcctggggcgacatctggacccgtccggggctgccgcgacacacccgcagcctggtcaccatcgccatgctgatcggcatgaaccgcaacgaggaactcaagctgcatctgcgcgcggcgaagaacaacggggtgagccgcgacgagatcaaggaagtgatcatgcagagcgccatctactgcggtattcccgcggccaacgcgaccttccacctcgccgaatcggtgtgggacgagcttggcgtggagtcgcagcaggcgtcccggtaggtcgccggcggcgctag

SEQ ID NO: 15738 - DNA, 1287 bp, Pseudomonas aeruginosa
ggcgaatggcgtcgcaggcgttatccgccgataccccgagggccaacggcggttatccgtcctgcgcgtgggccggcgaggcggcgcttccccttgccattcgccggcgtttcccggaaggtcgacagctccgtcatcccttcggtccgccatgagccgcaagctgcatatccacgcgcccgcgatccactacttcgacatggttcgccgctgccattcgatccgcgaagccgcgcggcgcctgaacgtcgcctcgtcggcggtgaaccggcagatcctcaagctggaggacgagatcggcgcgccgctgttcgaccgcctgcccggcggcctgcgcctgaccggagccggggagatcttcgcgcgccacgtcaccgtggtcctgcaggacatggagcgcgtgcgttccgaactggacgcgctgcaaggcctgcgcaccggccatgtggagatcgccaccatcgaagcggtgaccagcgacctgctgccctgcgtgctcaaggcgatgcgcgaacgctactcggacatcaccgtcggcgtcaccctgctcggttcccaggcgatacccgaggcggtgagcagtggcgcggtcgacctcggcctggccttcgccctgccgcgcagcgccgacctgcaacaggtcagcgtcggccatttccgcctcggtgccatcgtctccccgcagcacccgttggcgcgacaccaggccatcgccttcgccgattgcgtcgaacatggcctgatcatggccaagagcgagctgtccatccatcacctgctggcgccgctccagcgccgtttgcgcgaaccgcgccgggcggtgctggagagcagctccctggagctgtcgcgacaactggcgcggcgcgggctcggcgtcgccttccagacccgcctggggatcgaggccgacatcgcccagggcgagctgcgtttcctgccgctgaaagacaatggcggcatccacagcgacctcggcctctacgtgcgcaccggccgttacctgccggtggcggtggacgccctggcccggcagatcgccgaggaagtgcgcctgcgcgagcgcgaggaagcgcgcctgaacgaggcctgagcggcgctcgcgccgatgccagacggcttgcccgagcttgcccgtccgctgatgccgtttcggcatcggtatgttcgatattctgttctttggtcagcgcggcgaagtgccgatactgccccgcgaccccggcgcgaaaccgggggctgagtcgccacaagaacaacaagcaaccagcaggacacacagcatga

SEQ ID NO: 15739 - DNA, 747 bp, Pseudomonas aeruginosa
cgcgccgattccggcaggcggaacagcaggactaccgccaggaccagcggtaccaggccgccgagcagcatcaggctgtgccagccgaacagcgggatcagcttcgccgagacgaatccgccgcaggccatgcccaggttgaagccacagaacatgctggttaccagtagcgacttgaggcgctcgggggtgtattcggaaagcagggtggtggcgttgggcatcgccgcaccgaggccgaggccggtgaggaagcgcagcgccagcagttgctcgaacgttggtgctgtaggccgaggccaggctgaacaggccgaagaggaagaccgccgcgaccaataccagcttgcgtccgtagcggtcggccagcggtccggaaccgagggcgccgaagaccatgccgatcagcgcggcgctcatcaccggaccgaggctggcgcggtcgatgccccagtcctgggtcagcgccggagcgatgaagcccatcgcggcggtgtcgaggccatcgaggaagacgatcaggaagcacagcaggacgatccgccattggtacggcgaaagcggctgggcattgatgaaggcttgcacgtcgagtcgttcgacggcgggcaggctggggctgttcatgggacgggttccgcggcgagagtgagggcgtgggacgagggtcggacgcgtggctcaggtgcaggcggtggaaggcaaggcgtgctgcggcatgtcgggattcccctgttgtttttgtag

SEQ ID NO: 15740 - DNA, 516 bp, Pseudomonas aeruginosa
cctcgacctgctccgccacctgtgcggggaagtgcgggaggtgcaggcgctggccggcaacgctatccgtggcctgcccaacgaagacaacatcgcgctgctcctgcgcttcgccaatggcgccctgggcagcctgaccggttgcgacgctgcggcggcgccctggagctgggagctggcagccggggagaacccggtctatccacgccaggccgagcaaccctgctacctgctggccggcaccgagggtgccctgagccttccccagctccgccgctggcgctacgccgaggcccggcagggctggcacgacccgctggcggccagcgtggaggccgtggcgacaggcgaccccctacaacgccagctagagcacttcgtccgggtcgcgcggggcgaggaagcgccattgatggatgccaccgacgccgctcgcaccctggcgctggtcgaggcggttcgcgaggccgcgcgcagtggccgggcctgcgcgccggccagtttctgaaccgctga

SEQ ID NO: 15741 - DNA, 825 bp, Pseudomonas aeruginosa
ggtagtgcatggaatcgaggattctttccctggcggcgctcaccgtgctcgagctgtcgcccccggacatggtcgaggctgccgcccgcgccggctacagtcatgtcggcctgcgcctggtgccggccaccgtggaagagcaccactatccgctgctggccgatgccggcctgcgccggcggaccctggcgcggctgcgcgacagccggagtgcgcacgctggacgtggagatcctgcgcctgcgtccggacacccgcgtcggcgagttcgccgcggtgctggaggtcggcgccgagttcggcgcgcgctatgtgctggtggccggcaacgatgacgacgaacggcgcagcgcggacaatttcgccgcgttgtgcgacctggcgcggccgctcggcctcgacccgcacctggagttcatgccctggaccgggatccgcgacctgcggcaggccgcgcgggtggtcgaggcggcggcgcgggataacgccggcctgttgctggacgccttccatttcgaccgctcggccagcagcctggaagacctgcgggcgatcccgcctgcgcgcctgggctacgcgcaactctgcgatgtcgtcgggccgcgtccgacgtcgatggacgaaatccttcgccaggcccgcgaggaacggcgcttccctggcgatggcgggctcgatctgctggcgctgctgcgcgccttgccggagaacctgccgctgagcctggaggtgcccgcgctggatctgctcgcgcgcggcgtggatggcgcggagcgggcgcggctggcgatcgagcggacccgggcgctgctcgcccgcctgtag

SEQ ID NO: 15742 - DNA, 1203 bp, Pseudomonas aeruginosa
cccctgcggcagcgtgcgcctgccgctgaacatttccgaggaccgcaacaccgccatcgcccgttcgctgtccagctatcgcggttccggcgtgcaccacatcgccttcgattgcgccgacatcttcgccgccgtggcccaggccaaggaggccggggtcgcactgctggaaatcccgctgaactattacgacgacctcgccgcgcgcttcgacttcgacgacgagttcctcagcgaactggcctactacaacgtcctctacgaccgcgacgcccagggcggcgagctgttccatgtgttcaccgagccgttcgaggagcgcttcttcttcgagatcctccagcgccgccacggctacgccggctacggcgcggccaacgtgccggtgcgcctggcggcgatggcgcaagcgcggcggggtgtgcgccgggtcaagctgtgagaattgtcggggctccggcaggtgctcttcctacagccgggcgggccccgcataatcggccgcaattcccgccggccacgagtgagtcaccgatgtccaagcctgatcccgccgtcgtggaagaatccgctccgcgcggcaagggacgcaagaacaatcccgagaagacccgccaggacatcctccgcgccgccatcgacgagttcgtcgcccagggcctctcgggtgcgcgggtggacaccatcgccgagcgcacgcatacctcgaagcggatgatctattactacttcggcagcaaggagcagctctaccaggccgtgctggagaagctctacagcgacatccgcggtatcgagggcaccctgcggctgggcgcgctgccgccggccaacgcgatggagaagctggtggagttcagcttcgactaccacgaccggcacgtggatttcgtgcgcatcatcagcatcgagaacatccacaagggcgagcacatcgccagcagcgaactggtgcagagcgtcaacagctcgatcgtccagagcatcgccgagattctccgccgcggcgaagcggaaggggtgttccgcgccgggctggaggcgctcgacgtgcacatgctgatcagttcgttctgcttctaccgggtgtccaatcgctacaccgtgtcgcggatctttcgcaccgacctgcacgacgccgaggttcgccagcggcaccggcggatgattggcgaggcggtattgcgctacatccgtgcctga

SEQ ID NO: 15743 - DNA, 189 bp, Pseudomonas aeruginosa
cggccgcgctcgcgcggcgggacgatgtcgccgatgatcgcctggctcaccgccatcagcccgcccgcgccgatcccctgcagcactcgcgccagcaccagttggcccatgctctgcgcgagcccgcaaagcagcgaggcggcggtgaacacgacgatggcgaagagcatcagacggcggcggccgtag

SEQ ID NO: 15744 - DNA, 294 bp, Pseudomonas aeruginosa
cggattccatccgcgacgtcccggtgttcaagctctacggcgctcccctcgaatggccgaccccggacctgctgcactgcgagtcgatccccgcccgcagtcgtctgcacgactgggagatcaagccgcaccggcacgccgatctcgctcagttgctctacgtgcgcaagggctgggcgcagctccaggtcgagggcgagccgactcgcgtcgagcagccttccatccagttcgtaccgccgttgtgcatccatggcttccagttctccgagcgcatcgacggctacgtgctga

SEQ ID NO: 15745 - DNA, 414 bp, Pseudomonas aeruginosa
cgtcgatgtcgttgccgaccaggatcagcttcggcaccaggtgtccggcatgcgagccgaagacggtctcggcgacccgtgcggcgaaggccgcggcgtcggtgcccagggccgccaggcgctgtacgtcgatcgacagcacggcccagcaggtcgccgcctcgtaggagcaccagaccatgtccaccggcagtccggcgttctgcaccacgtccagcagttgcgcggaaatcatggtgccccagatggtgtggttttcctccggtggcgtgccggcgacgcagatcggcaggatcggctggtcgcggaagctcagcgcatggacgtggaacagcggctgcggcttgccggtggggaaggaatagccgtggtattcgcccatcgggccttccagcgcggtttcgtcgaggctga

SEQ ID NO: 15746 - DNA, 462 bp, Pseudomonas aeruginosa
tgccgatgtgctgggtgggaatggtcggacccgccagggtgttgcggtccaccagcatcagccggcccaccgaccagctgtcccaactgccgtccggcgtctgtaccacgtggaaaccgtaggtgccgaaatagcgcccgccgtcctgctcatggagcaaggggaccgggaagcgggtcaggtccacctgctcgccgagccagacgttttcctgcaccggcccgcgctccagccggcgcggcgcgatcggttccgcgcgcatcgcggcgcgcagcatggccacgatgtcccgcggcccgctgtgttccggcaggccgaaatgcagcgccaggcgcgaatgggcgcgggccctgtcggcgcgcaggccggccggcgcgcccagtacccgcgcgccgggcaggctgtcgcggatgttgtggaacagcggggcgggtgcgcggcgttcgtagacccggcgggtga

SEQ ID NO: 15747 - DNA, 450 bp, Pseudomonas aeruginosa
gcgccgccgcacatcagggtgatgtgctccttcgcggtgaccagcacgtgctgctggctggcgctgacctccacgctctgctcggcttccaggcggatgtcgttcttctgcgcctgcagcagcatcgggccctggtgggtgatctggcgcagctcgccgccctgggcgaacaggccgatgtcgctgccggcgttgatcaccaccttctgcccggcggtcacctgctggttctgccgggccacgctgtcgacgtgctcgccggcggccagggtcaggctcgccggcgtcgccgcggcgatccctgccggaccgctcaaggcgatcgccggcttgcctccgttgctcttgccggactcgtcgttggcaccgtggccgaggtcgcgcacggcttcctggagggtttgctgcggcgccgcgtcgtgccccacgccctggtgctccccggcgtag

SEQ ID NO: 15748 - DNA, 726 bp, Pseudomonas aeruginosa
  unsure (376): Identity of nucleotide at the above locations are unknown.
cgcatggatcgttccttgttcctggcgggcggttcctcccccatccgttggagaagcgagccccacgttactcttgctcagccgctgccgaaagtcttggctcggtgtctatttcgcgaagtagcggacattttcggctcgacggagaaccgatcgcacaggtgtacgaccggtgtgcctgtcaactcaccctgcgaccggcgagcgccagtcgtcggagccggaggtgccggagacttcgtgggtccaggtgatcttgcggtaggtgaagtgcacgtcttccaggtgggtgaagtgggcgttgcccgggtcctggcagttgtgcatgtagtccttgatgtcgacgatgatcgcgtcttccaggacggtggtgtantagtgctcctgggtgccggcggcggaggtgcggtaccactggatctcgaccttggtcaggcgctcgccggaggtcagggcggccagcagcagcggcgaggccttgtcgaagaccttggtgatgaccaccggcttgtgcacgcgctggccggtcggctggccggactgcgggtcgcgcgggatgatcacttcgtggttgaagccctggaccatcacctggtcctcgtggccttcctggtaggtgttgccgaccgaatcctcggtgaaggcgccggcggtgatcaggccctgcttggtgccggtgatggacatataggcgggggttgccatggatacgttccttgtcgttga

SEQ ID NO: 15749 - DNA, 594 bp, Pseudomonas aeruginosa
cgaagaatgaggccctgcggggtggggcttgtggaaggaatgcccgatttcggggcggctgccgcattttcggttgtggcggtgttttttgtatacaattcatcgaaggataacttatattgcttcgcaagcggctccctggcgggctgcaagcgagcggcgccgggcaggtcccggagcgatccccatcgaacgaaggcaagaggaggagtggtgtccgccagcgggcgcccgcaacccatgggacgtttgaccacgcatgtactggattccgcacacggctgccccggccatggcatcaagatcgagctgtaccgggtagaaggccagcaactggaactgatcgccaccaccctgaccaaccacgacggccgctgcgaccagccggtgctgcaaggcgaggacttccgtcccggggtctatcaactggtgttcaacgccggcgactactatcgcgcccgcggcgtgcaattgccggagccggccttcctcgaccaggtggtgctgcgtttcggcatcgcctccgccgacgatcactaccacgtgccgctgctgatctcgccctacagctattcgacctatcgcggcagctag

SEQ ID NO: 15750 - DNA, 1758 bp, Pseudomonas aeruginosa
ccgcgtgcggccatccgccatccgggcgggtcagaggaagatgaacttggcgacgaagatcacgaacaacgcatagaggctggccgagacttcgcggtgcttgccggtgaggaccttcatcgcgacgtaggtgatgaagcccagggcgataccgtcggccaccgagaaggtcagcggcatcatgatcaccgtgacgatcgccgggatggtctcggtgtgctcgtcccagtcgatgtgcgccattccgcccatcatcagcatggccacgtagatcagcgcgccggcggtggcgaaggcggggatcatcccggccagcggggcgaagaacatcgcggcgacgaacagcacgccgaccaccaccgcggtgagcccggtacgtccgccggcggccacgcccgcggcgctctccacgtaactggtcaccggcgggacaccgagcatgccgccgaacacgctggaggcgctgtcggccttcatcgctttcgacaggttctcgatgcgcccgtcctccttcaccaggtgcgcgcgctgggcgacgcccatgagagtgccggcggtatcgaacatgtgcacgaagaggaaggccaggatcacgctgatcatggtgacgttgaacgcgccggcgatgtccatcgccaggaaggtcggcgccaggctcggcggcgccgagaacaccccgccgtactgcaccaggccgagggcccagccgaccagggtgacgctgaggatgctgatgaggatgccgccgaacacccggcggtactcgagcacggcgatcatcaggaagcacagtgccgccagcagcgggccgggcgaggtgaggtggccgagcttgatcagggtcgccgggctggccaccacgatgccggcggtcttcaggccgatcaggccgaggaacaggccgactcccgcacccatggcgaacctgaggctgcgggggatgctgttgagcagccattcgcggacccgggagaaggtcagcagcatgaacatcaccccggagatgaacaccgcgcccagggcgatctgccagctgtagcccatggtgccgaccacggtgtaggtgaagaaggcgttcagtcccattcccggcgccaggcccaccggccagttggcgtacaggcccatcaggaagcagccgagggcggctgccaggcacgtggcgacgaacgccgcgccgtggtcgatgccggcgtcggccatgatgttgggattgacgaagatgatgtaggccatggtgatgaaggtggtcagcccggccgccagctcggtcctgaccgtcgtaccatgctggcggagcttgaacaggcgttcgagcaggccggtggcgggcggtgtcgcagcgtagatcccttgttcttcttgtttggtgctttccacagcaggtactcctcatcgctcttgttgttaggtcctgcgggccggttggttaccaggtccctgacgcggctcgaaggtgatgtgagggcacgattttctgacctctgggtcaagaactcgtgcgagcgattatgcctttgtatacaaaaaggtcaaagaatgtttgagggtgtttcgccacatttttatcagctttccgtcacgcccccttccgggcggtgccgcgcgctcggaacgaggggcggaaaggggtggtgcgtcggatgccgctgcttgtgtacactatttcgctatcagccgccggcgtgcctcacccacgcccgtgagcgaggatcagcccaggccacaagccggacgcacaaggttcgagaccgatga

SEQ ID NO: 15751 - DNA, 447 bp, Pseudomonas aeruginosa
aggaaaccccgaggacctcggccaccagcttctgcacttcggtggggttctgcgtcgagcaatagacgatcatgccgccgtcttcgctgggcattaccgaggaaatctgcgtctccaggtagaaatgctcctggccgccgatgtgcagcgtgccttgcaggcgatgcggcgcgccggccagcgcggcggcggaatcgccgatgcggtgctggtggctgtcgaggacgaaatggcgcttgcgcagggcctcgaccacgtcgagcaccggctccaggtcttcgtactcgacgatcgccgccatggccgccttgcgcgcggtttccaggctgtcggcggcgaccgccaggaccatctgtccgacatactccaccttgccatcggccagcagcgggtcgccggccaccaccgggccgatgtcgagctggccgggaacgtcggcggcggtga

SEQ ID NO: 15752 - DNA, 1266 bp, Pseudomonas aeruginosa
aaaaaactgacttttgagtcaaataattttttgacctgtaggtcagtcagtttgcccataaacgaaaacggcacccgaaggtgccgtttcccaggggcgggacgctcagatgcgctgggtgtcggtaagctggtattcctcgccggcatagtaggcgcgcaccttcgggtccatcaccgcgcgccagagcggcgggaacagggcgaggacgatcatcccggcgtagccgttgggcagttgcgggctgctgtcgtagtggcgcagcacctggtagcggcgcttggcgtaggcatggtggtcggaatggcgctgcaggtggaaaaggaacaggttggtcaggaggaaattgctgttccacgagtgttccggcgtggtgcgttcgtagcggccgttgtccaggcgccgccgatgcaggccgtagtgctcgacgtagttgacgatctccagcagggtgaaggccatcaccgactggccgaggaagaagatcgctcccagccagccgaaggccaggctgaagccgagcaggaagagggcgctgatggcgtaccaccagatcagctcgttgcgccagtgcagggccggcaggcccttgcgcttcaggcgctcggcctccaggcgccaggcgttgaggaagttgtgcttgtaggcgtgcgggaggaacgagtagaggctctggccgtagcgcgaggacgaggcatcttccggggtcgagacgtgtacatggtggccgcgcacgtgttcgaccttgaagccggcatagcacaccgctgccagcagcaggccgccggcgttctgttccagttgcgggtccttgtggatcagttcgtgggagacggtgatgccgatggcgcccatcacggtgcccaccgacaggatccagcccagttggccgacccagtcccagcgggtctcgtgggcgaggatccagccggaccagacgagcatgcccagcaacagcgggacggtggccagggacagtacgcggtagtagccctgtgcttccatctccggcacttcgctggcttcctcggggttggccggatcgcggccgacgatggcatcgaggatcgggatcagcccgaacaccacgctgatcaccagccagggccaggcgttggggtagtcgctaccgagcgaccaccagtagctgagcgggatgccgagcaccgcgatcagccagatccagtagccgtactttttcagacgcagcatccaggcagaggaaagcgaggcaaacatgggaagtcctcgtatttatcttgttag

SEQ ID NO: 15753 - DNA, 804 bp, Pseudomonas aeruginosa
caattgtcctcccttgaccggcctgccccatcccaaccttcgttctgtccgccgcttcgccgggaagccggcggggtaacgccctgtgttacacttcccatccatatacccccggaaaacgcgcccctggataaaaggatcaccatgacgttcaaggccccggacagcctggcagagcagatcgcccaccacctcgcggaacgcatcatccggggagaactcaaggaacgggaacgtatccaggagcagaaggtcacccagaccctcaacgtcagtcgcggctcggtccgcgaggcgctgctgattctcgaacgccgccacctggtgaacatcctgccgcgccgcggcgcccaggtgtccgaactgtccccgcaacatgtggaaagcctctacgcgctgatcgtgcagctctacatcctgctggcggaaagcgtcgcccggcgctggcgcagcgaagccgagctggcaccgttcctggtcatccagcagcgcctgctgaacaacctggcgcaaagcgatatcgacggcttcgtcgaggccagcttcgacatcatgcgcgcggcctttcctttcgcgaacaatccctacctgcaggagaccgtcgaaaacctgctgccggcggtgagtcgcgcctaccacctggcgctggaacggcgcaaggcggaaatgaaccagttcctcggcagttttgctcagctcctgcaagcggtgatcgcccgtgacgaggcgaggatccgcgaggtcctgctggaatacggccgccacaactgccagctggtgctggccgcgctcgccgaacgctga

SEQ ID NO: 15754 - DNA, 1038 bp, Pseudomonas aeruginosa
tggcgaccctggcgggagcgcacgcatgcgcctgaagagcatcaagctggcggggttcaagtccttcgtcgatccgaccacggtgaacttccccagcaacatggcggcagtggtagggccgaacggctgcggcaagtcgaacatcatcgacgcggtgcgctgggtgatgggcgaaagctcggcgaagaacctgcgcggcgagtcgatgaccgatgtcatcttcaacggctcgaatacccgcaagccggtgagccaggcgagcatcgagctgatcttcgacaacgccgagaccacactggtgggcgaatacgcccagtacgccgagatatccattcgccggcgggtctcgcgggatgggcagaacacctatttcctcaacggcaccaagtgccggcggcgcgacatcaccgacatcttcctcggcaccggcctggggccgcgcagctactcgatcatcgaacagggcatgatctccaagctgatcgaggcgcgtccggaagacctgcgcaacttcatcgaggaagccgcgggcatttccaagtacaaggagcgccgccgcgaaaccgaaagccgcatccgtcggacccaggaaaacctggcacgcctcaccgacctgcgcgaagagctggggcggcaactggaacgcctgcaccggcaggcccagtcggcggaaaaataccaggagcacaaggccgaggagcgccagctcaaagcccagctgggcgccgtgcgctggcgcgacctgaacgagcaggtcggtcagcgcgagcgggtcatcggcgaccaggagatcgccttcgaggccctggtggccgagcagcgcggtgccgatgccggcatcgaacggctgcgcgacggccatcacgagttgtccgaacgcttcaaccaggtgcaggcacgcttctattcggtcggcggcgacatcgcccgggtcgagcagagcatccagcatggccagcagcgccagcgccagttgcaggacgacttgcgcgaagccgaacggacccgccaggaaaccgaatcgcacctcgggcatga

SEQ ID NO: 15755 - DNA, 1266 bp, Pseudomonas aeruginosa
ccgtaccttgctcgcgaccctggccgaggaaatggccatgctcgcaccggaacaggaactcagcgcggccgccgcggaagaagcgggcatcgccctggaacaggccgagcagggcatgcaggcctggcagcagcagtgggatgccttcaaccagcagagcgccgaaccccgccgccaggccgaggtgcagcagtcgcgcatccagcacctggagcagagcctggagcgcctgcaggatcgcgagcggcgcctgcaggaggagcgtggccagttggcggccgaccccgaggacgcggcgatcctcgaactcaacgaacaggtggcgatcgccgaactggccctggaagaactgcaattgcaggagcagggccaagccgagcgactcgaacaattgcgccaggaattgcagcagctggccgccgaacagcaccaggcgcagggcgagttgcagcgcctgaacgggcgcatcgcttcgctggaggccctgcagcaggccgctctcgatcccggacagggcgccttggagtggttgcgcgagcagggcctggaacaacgtccgcgcctcgccgaaggcttgcgtgtcgagccgggttgggagctggcggtggagaccgtgctcggcgcggatctgcaggcggtcttgctggacggcttcgacgggctcgccctggccggcttcggcaagggcgagctgcgcctgctcagccccgctcgcggagccgcgacggcggccggttcgctgctggacaaggtccgcgccgacgccgacctgagtccctggttggcccgggtgaaaccggtggagaccctggaacaggcgctcgcccagcgcggcgccctggacgacggcgagagcctgatcagtcgcgatggctactgggtcggccggcacttcctgcgggtccggcgcagcgacgaggcccagggcggcatgatcgcccgcgcccaggaactggaggcgttgcaggagcggcgggagcccctggaaacccgtgtctccgaaggcgaggagcgtctggctgcggcccgcgacgagcagcgcgagctggaaggcgcgcgcgagcaggtgcggcgccaggtccaggaggaggggcgccggcacggcgagctgaaggcgcagttgtccgcgcagcaggccaaggtcgagcaactggtactgcgtcgccgccgtctcgacgaagaagtggcggaactggccgagcagcgcgcgctggaacaggagcaactgagcgaggcgcgcctgaccctgcaggaagcgctggatag

SEQ ID NO: 15756 - DNA, 1098 bp, Pseudomonas aeruginosa
cgccctgcgcgaacggctcgaccggattcgccaggatgcccgcacccacaaggaccatgcgcaccagttggcggtgcgggtcggctcgctgaaggcgcagcacaattccacccagcaggccctggagcgcctcgaccagcagtcggcgcgcctcaacgagcgttgcgaacagctcaacctcaatctggaggagggggcggcaccgctggaagagctgcgcatgaagctcgaggagttgctggagcggcggatggccgtcgaggacgaactcaagcaggcgcggctggccctggaagacgccgatcgcgaactgcgcgaggtggagaagcgccgcggccaggccgagcagcaatcgcaactgctgcgtggccagctggagcagcagcgcctggagtggcaggggctggtggtgcggcgcaaagccttgcaggagcagctcgccgaagacggctacgacctgcatacggtactggccaacctgcccctggatgccagcgaacgcgattgggaggagcgtctcgagagtctcgcggcgcgcatccagcgtctggggccgatcaacctggcggcgatcgaggagtaccagcagcagtccgagcgcaagcgctacctggactcgcagaacgacgacctggccgaagcgctggagacgctggaaaacgtcatccgcaagatcgaccgggaaacccgcaatcgtttcaaggaaaccttcgaccagatcaatgctggccttcaggcattgttcccgaaggtattcggcggcggtacggcatatctggaacttaccggcgaagatctactcgataccggtgtggcgatcatggcgcgcccgccgggcaagaagaacagcaccatccacttgttgtccggcggggaaaaggcgctgaccgcgctggcgctggtattcgccatcttccagttgaacccggcgccgttctgcatgctcgacgaagtcgatgcgccattggacgatgccaacgtcggacgttatgcgcgattggtgaaggagatgtcggaaaaggtgcagttcatctatatcacccacaacaagatcgccatggaaatggccgatcagttgatgggcgtgaccatgcatga

SEQ ID NO: 15757 - DNA, 885 bp, Pseudomonas aeruginosa
gggctacggaattacatggatatcggtctgcgcgaatggcttatcgttatcgggcttatcgtgatcgccggcattctcttggacggttggcggcggatgcggggcggcaagggcaagttgaagttcaagctcgaccgcagtttcgccaatctgccggacgacgacggcgactcggctgaactgctggggccggcgcgcgtggtcgagcatcgcgagccatccttcgacgaacaggacctgcccagcgtcagcgcccgcgaagccaaggaacgcaagggcggcaagcgccaggaagagccgcgccagggcgatctggacctcgacgaggggctggccctggaggcggacccgagcgatgccgccgagacagtggagccgcgcaagggcaagtcgaagggccgcaaggagaaagagcgggagaaagcccctgcggttgctgccgaacctgccccggtcgacgaggtgctgatcatcaacgtcatcgcccgcgacgagagcggcttcaaggggccggcattgttgcagaacatcctcgagagcggcctgcgcttcggcgacatggacatcttccatcgccacgaaagcatggccggcaatggcgagatcctgttctccatggccaatgcggtgaaaccgggcactttcgacctggacgacatcgacaacttcagcacccgcgccgtgagcttcttcctcggcctgccggggccgcgccatccgaagcaggccttcgacgtgatggttgccgccgcgcgcaagctggcccacgagctgaacggcgagctgaaggacgagcagcgcagcgtgttgaccgcccagaccatcgagcactaccgccagcgcatcatcgaccatgagcgtcgcagcctgatgcagaagcgctga

SEQ ID NO: 15758 - DNA, 2475 bp, Pseudomonas aeruginosa
tccggccacagcccctttcttcgtacgggagggggcgaactactctatagagcagccgaggctgctcttttcgtttcacggactcccaccatgaccgacacccaggctgccgccgaacgcatcgcgcaactgcgaaccgaactggacacccacaattaccgttactacgtgctcgacgaaccgagcattcccgacgccgaatacgatcgcctgttccgcgagttgcaggcgctggaggccgagtacccgcaactgctgacgcccgactcgccgacccagcgggtcagcggcacgccggcctcggcgttcggcgaagtgcgccatgagatccccatgctcagcctcggcaacgccttcgaggagcaggacctgctggacttcgaccgccgcgtacgcgaaggactggccgacctgttgcctggcggcgacctgctcggcggtggcgcggaggtcgagtacagttgcgagccgaagctggacggcctggccgtcagcctgctctacgagcgcggccaactggtgcgcggcgccacccgcggcgatggcagcaccggcgaggacatcaccagcaacgtacgcaccattcgcaacgtacctctgaagctgcatggcgaaggctggccggagatcctcgaagtgcgcggcgaggtgttcatgtccaaggccggtttcgaggcgctcaacgccaaggccgtggaaaccggcggcaagaccttcgccaacccgcgcaacgcggcggccggcagcctgcgccagctggattcgaagatcaccgccagtcgcccgctggagttctgtgcctacggcttcggccaggtcagcgggtcgctgccggacacccaggtgggcatcctcgaggcgttccgcggctggggtatccccatcagtcgcgagctgcgcctggtcaagggcgcccaggcctgccgcgactactacgacgacatcggtcgccgacgcgatgcgctggcctacgagatcgacggcgtggtgttcaaggtcaaccgcatcgccttccagcgcgaactgggcttccgcgcgcgcgagccgcgttgggcgatcgcccacaagttccccgcgcgcgaggagctgaccgagctgctgggtgtcgagttccaggtcggccgcaccggcgccgtgaccccggtggcacgcctcaagccggtgcaggtggccggcgtcacggtgtccaatgcgaccctgcacaacatggatgaagtcgcccgcctgggcctgcgcatcggcgatacggtggtgatccgccgtgctggcgatgtgattccgcaggtcatgcaggtggtgctcgagcgccgcccggcggatgcgcaggctatcgaggtgcccgagcattgcccggtctgcggctcggccgtggagcggacccagttggtcaagcgcagcaagggcaaggagtcgatcagcgagggcgccatctatcgctgcgtcggccgcctctcctgtcaggcgcagttgaagcaggcgatcatccatttcgtatcgcgccgggcaatggacatcgacggtcttggcgacaagatcgtcgagcaactggtggatcgcgggctggtcgcctcgccggcggatctctataccctgacctatgaacaggtgttcgagctggaagggttcgccgagctgtccaccaacaacctgctggcggccatcgccgacagccgcaagccttcgctggcgcgcttcatcttcgccctggggattcccgacgtcggcgaggaaaccgccaagctgctggcgcgttcgctgggttcgctcgagcggatcggcaaggcgctgccggaagtgttgacctacctgccggacgtcggcgccgaggtggcctacgagatccacaacttcttcgccgacgagcacaaccgccaggtgatcgcccagttgcgcgatgccgaacatggcgtgcagttgcaggaagagggcgaggtcgccgcggagttcgccgcttgtgcctcgctggccggtttcatcgacaagctgaacattcccttcatcgccgccaccggcgcggaaaagctggccagccgcttcggttcgctcgacggcatcatccgcgccgactggctcgatctacgccaggtggagcgtctgcccgagcgagcggcgaaaagcctgcgcgatttcttcgacgagccggccaacgtgcagcgtgccctggccatcgaggcgcagttgcgtgagttcggcatgcattggcagagcgagcgcaaggcggtcgaaggcctgcctctggccgggcagacctgggtgctgaccggcaccctggaggcgatgagccgggacgtggccaaggacaagctggaagggctcggcgccaaggtggccggctcggtgtcggccaagacccactgcgtggtcgccgggcccggcgccggctcgaagctggccaaggccaacgagctgggcgtgaaggtgctcgacgaagacggcctgctgaaactgttcgacgagcacggcgtcgcccgctga

SEQ ID NO: 15759 - DNA, 423 bp, Pseudomonas aeruginosa
agcggcggcgctgctgcgaaagatttccgaagactggagttaacgatggacaaggcaagaaagcagcggttgctgggcgtgctcgcattggtggtgctgttcggcgcctacgtgggttggagcgagcggccgcgcatcctgctgcattacagtggccaggcttcggcgccgatcgcctacagctacaaggagcagggcgtggaaaccttctccggggagatccggcccggccaggtccgcgagtttccggtgaagctgttcggcggcagcgattaccggatcgccttctccttccatcgcggtgaggagaagtatgcgtcgttcagcaccaagccgggctggggcaccctggacctgtatgtcgataccgagctgagcgtatcgacccagccgccgccggagggtctgatccagcagcaatga

SEQ ID NO: 15760 - DNA, 378 bp, Pseudomonas aeruginosa
atgatacaatcgggccctgtcacttctgcaagtgttcagtcatcgctacgtgaggggagccctatgaatgaaaaactctttgtgttggctagccagaaaaagacgaccaaccacatcctgcacctgttgctgtgcatcccaacctttggcctttggctgatcgtttggcttgtggtggcatcgggcaacagcaggcacaacgctagaattcaagcccagatgaatcacatcctcggctacaagatgcagggcatgagcgacgtcgagacgtatcaacgagtgagctcagatgaggctgctcggaaaaagcgaagtgaccagatttttgtcgtgtcggtgatcgtggtgaccgtggcactgttcttcttgttgaagtag

SEQ ID NO: 15761 - DNA, 1098 bp, Pseudomonas aeruginosa
  unsure (865): Identity of nucleotide at the above locations are unknown.
cggggcgtaacgccagatgtgcaggcgactcctgacaacgcaatatcagaagtcatctgcaccaatctcgactatgctcaatactcgtgtgcaccaaagcgaggtgtgagcatggcgtcagacacatcattgattgccgagcaaggcgtggccaccctgcccgatgcggcttgggcgcaggcccggcaacgggcggaaatcatcgggccgctggcagcgcttgatgtggtcgggcatgaagccgccgatgccgctgctcacgcgcttggcctgtccaggcggcaggtgtatgtcctaatccgccgtgcccggcaaggtgctgggcttgtgacggacctggctcgcagccgatccggcggcggaaaaggcaagggacgcttgccggaatcagttgagcgcatcatccgcgagttgctgcaaaagcgcttcctgaccaagcagaagcgtagcctggcagcgttccaccgcgaggtcgcgcaggcttgcaaagcgcaaaagctgcgggcgccggcgcgcaacaccgtggctctgcggatcgccggcctcgatccgctcaaggctactcgccgccgggaaggtcaggatgcgtcccgcagcctgcaaggtgtcggtggtgagcctcccgccgtgaccgcgccactggaacaagtgcagattgatcacacggtcatcgacctgatcgtggtggacgagcgcgaccggcaaccgattggccgtccgtatctgaccatcgccatcgacgtgtttacccgctgcgtgctcggcatggtcgtcacgctggaagcgccgtcatctgtttcggtcggcctgtgccttgtgcatgtcgcctgcgacaagcgtccctggctggagggtctgaacatanaaatggagtggccgatgagcggcaagcccaagctgctctacctggacaacgcggccgagttcaagagcgaagcgctactccgatgctgcgagcagcatggcatccggcttgactatcgcccgctcgggcagccgcactacggcggcatcctggaacggatcatcggcacggcgatgcagatgatccacgaccatttgccattggacaaccttctcccacccctggaccaccgc

SEQ ID NO: 15762 - DNA, 606 bp, Pseudomonas aeruginosa
ctgttgttcagggctccggtacgaatggccacagcccctttcgcactgaccaggcccgcacggctgttgtcgaagccagtgctgttcagggtggctccagcatcggtcaccaacctgccaccctggttgttcaactcgccccggctggtaacgagcaggctacccgcactggagaaagtccccgcctggttattgacctggtcggccttcactgtcagcgacccttcgctgaccagtgcaccgctcccctggttgtccaatgcaccactgagcgttacatccaccaggcgttggctgctgagcaggccgccatcgccattgagcagttcagcgccgtccaggtgcaatccatcgcgactggcgagcacacccttggcctggttcagcaggcgctgcacggttaggctcagctcactgtcgccgatcaccttgcccccccggttgtccagttgttcccggacagccagagccaccttggccacgctggatatttccccaccgcggttatcgatctggcgtgcctcggcggtgaccccgccatcggcgctcaccaggccgccattgcggttatccaggctatcggcgtcgagagtcagcgtcccctga

SEQ ID NO: 15763 - DNA, 1953 bp, Pseudomonas aeruginosa
cttcaccgtcaggaagccccggctgtccaggctgccggcctggttatcgaacgcaccggccagggagacgtcgatacccttctggctggacagcaggccccccgcgccgttgaacaactccgtagcactcaggcgcagcccatcgcggctggcgagtacccccttgtcctggttgagcatgcgtggcgttgtgatgtccaggccactgtcaccgacgatcttgccaccgcggttgtccaactgttcgcgagcgctcgccaccaccctcgacgtgctggagatatcgcccgctcggttgtcgatcaaccgagagctcaagtcgagatcctggccggcgacaatgcgaccgctgcgattatcgagccgatccgccttcaggagcgtacggcgctcgctgaccagcttgccgcccgcactgttgtccagacgagcgacctcgatgtccatgtctcccttgctggaaaggagaccggcactgcgattgtccagtgcggcagcctggacctgcagttcgttcagaccgacgacctggccgccacggttgtcgagatcgccacgagtcttgaccacggcgcggtcccggctctgcaacaggccgtcctggcggttgtccaggctgctcgcctcgacccgcagttcgccctcggcgagcagcttgccgccacggttgtccaggtgtccgccgtcgacccggacggtcgcccccttcaggctgccgccctggttgtccagtgccaggctcgccttcgcttccagcgcgcggctggccaccaggctgccggcgttgcgcagggtgccgctgcgcagctcgaggtcgccgcgcgcgttgcgccgctcgtctggctcgacgccggcttcgatcaccccggcgttgtcgatatgcgccgcctccagcgcgatgcgttcgcgcgccgccaggctctgccggttgaccagttcctccgcgctgcggatctcggcgctgccaccggcgtaggtcttgccgttcagctccacggcctgggccgcgatcttcaggtcgccctggctggaggcctgggccaggctcagcttgccgctggcgtcgatgcggatgtcgccgccgctggcggccatgtcgccggccagccgcacccccacgccctgttcggtgccgaccaggcggatcgccccggcgtacatcccgcccagcgccgagctgtcgatcgccagctgtggcttctcgctgccatcggcggcgcgcggcgtggcctgcaggctgtcggcctggacgtcgttgcggccggtgacgatgttgaggttcttcgcgtagagcttggcgttgagcttggcgctgcgggtgatcaggtcgaactgttcgaggttgccgacgttcagttcggcgccttcgacgacgatgtcgccgccgtccacctggaagcgctccaggcgctggccgtccatgatcggcttgccggtggtgagggtcgcgcgcggcgtgttgatgaagccgcagccctggcaggtgatgccgtgcgggttggcgacgatcacccgcgccgactgcccggccacctcggtgtagccggccagggtgctgcggttgccgccggtgacctggttgaggatcacctgcgccgcctggcccttgaggttggggttgccgaggatgatcccgccgagctgggtaccctgggtcttgccggtggcgttgttgaggatcagcccgttggcgccgacgttgtagtcgcggaaatggttgttcgacagcccggcgccgttgggcgtggcgatattgacgatgggcacgccgttgcccgcctggcccaggccggtgttgccgccggcggccttgtccagcgccagccccgccgccgcggcgacgatcgggttgaggaacaggatgccggccagggacagggcgatgcactggttcagcgggctgcggatgtccatatcgttactccttggcgggtaggggcccggcgaggttaa

SEQ ID NO: 15764 - DNA, 624 bp, Pseudomonas aeruginosa
ccgtcgttgtcgatcaccagcagcgcgccggtctgggtcaggttgatcaggcgcacggtggcgtcgctgtcgttcttgaagccgagggtgacggccagttgctggtcgcgcggctcggtcttgagcacttcgacctggccgatctcggcgaagccggcgttgtcggagaccaccttggcgccatcggcgccctgggccgactggcggccgctggtgatgccctcgctgaccccgccgaggaggttcttgccggtctcgatggccgaggacaccgcggccttggccgcatccttgaccgagctgccctcctccgcggccacggcgctgccggcggccaggggcaggagcagtcccaatgcggcgatccttgcgttcattcgtccatcctctggtggtgtgggaggcagccagactaacagccgtctagcggccgttccagtggcgcgcccggcgcttgcgccaccagatgtagacaccggtcagcgacagcccggcgatggccaggccgagggcggcgatggcgatgcgtcccggcaggccggcgatgcgcccgccgtggatcgggtactgcaagcggtagaaacgctctccccaactgccctgcccggcgacttcctggcctag

SEQ ID NO: 15765 - DNA, 2814 bp, Pseudomonas aeruginosa
ccagggtacggccggcgacgccggcgaatgcccggcgcgtacgtcgcgcgccgggctgcttggccggtaccgcggcgctggcgccggggcccgggtggacggtcagaactggtagttcaccgtcgcggtgacgttgcgcttctcgccgaagtagcagaagtccaggctgtagcaggacgccacgtagtccttgtccagcaggttgttggcattgaggctgacgtccaggcctttcaggccgagcttgccgaggtcgtagccgatccgcgcgtcgaccagggtgtagtccggcacccgcaaggtgttttccttgtccgcccaggtctcgccgacgtagcgagcgccgccgccgatgctcagaccgctgagcgggccggcgtcgaaggcatagtcggcccacagcgaagccatgtgcttgggcgcctggttcggcgtatggccctggttgccgtccagcgacttggtgtaggtgatgtcggtgtaggtgtagctgccgagcagtttcaggttgtcgctgagctgggtatgggcctccagttcgagcccctgggagcgcacttcgccgaccgaggtgtagaagttgtcctggggttccttggaggcgacgttttcctgggtgatatggaacagcgaggcggtgtagaagctgttgctgcccggcgcctggaacttcaggccgagttcccactgcttgccctcggtgggcgccaggggcgtgccggaggcgtcggaataggcgttcgggttgaacgactcggagtagctgacgtagggcgccaggccgttgtcgaacaggtacagcgcgccgatccgcccggtgaatttctcccagtcatcgtcggccttgctgccggtgctgcggttcttgtcggtgacgctgacccagtcctggcgcaggccgagcgagaagcgccactggtcgatgtcgatcaggtcctggaggtagacgccggtctgctccaggcggcgggtgtggttgtcgtccgggaaatagctgatggcgtcgtcgccgtagaccgggttgaacgcgtccagcgccgaggccgagccggaacgccagtcgaccacggtgcgccggcgctggtagtcgaggccggtgagcagggtgtggcgcgccgcgccggtggcgaattcggcctgcagcatgttgtcgacgatatacgcctgcaggtgctcgcgggcgccgctgaagtagcggttcagcttgttcggctcgctggcgctccagccgtaggcgtagacctgcgacaggtcgacgtcggagtccaggtagcggaagttctgccgcgccgaccagacgtcgtcgatgcggtgctccaactggtagccgaacatccgctgggtgcggtcgaagtcgtccttgctcggctcgccatcgaagaactcgcgggagatgtgccggccgttgtggtgcgacagggtgccgtcggccggtacgccgccgtggtagcccccgttgggatcgtgttgcaggtagccttgcagggtcagggtggtgtcgtcgctgaagtcgatggccagggtcggggcgatggcgtagcgctcctccttgacgtgatcgaactgggtgtccgagcccttgccgagaccgatcaggcggtaggcgatgcgcttctcctcgtcgagcggcccgctgaaatcgaagcccatctccttctggcccatgttgccgatgctgccggtgatctggcggtagtcctcgtacaacggcttcttgctggtcagcgccaccaggccgcccggcaggctacggccgtagagcaccgaggacggccccttgagcacatcgatgcgttcgaggaagtacgggtcgacctgcatcgagctgaaggtaccgctgtcgcccatggccttgaggccgtcgaggtagatgttgtccacgctgttgtcggcgaagccgcgcatcaccacgtagtcgtagcggttggaggcgccgacctggccggtgaagatgccgggggtatagcgcatcgcctgctgcacggtcttggaggcggtgtcgtcgatctgctcgcgggtgatcaccgagacggtctggctggtttccagcagcggcttgctggtcttggtggcgatctggctatgggtggccaggtagccatcggtgctgcccaggttgttgccgagggcgaagacctccaccgcctgcatgttcagcacatcgccgtcctttgccggcgcctcgcgcaagacgaagctgccgtcgccctggtcttccgcttccagcggggtgtcggcgagcagccgggccaggccctgctgcacggtgaaactgccgcgcaacccctgggagctgtagccaccggtctgcgccggagtggccgagagggtgatgccggcttcgcgggcgaagcggttgagcacgtcgcccaactgtccggcggggatcgcatagggccgcgcgtgttccgccgccgcttcggcggccgaggcgcagagcggcgccgcgccggccgccatggccaacgacagcagggccgcgcgcaccgaacggctcaggcgcgaggcgcgggggaaatcgagggacgacggggcattgcggaggacgacggcggtggcggtcatgaacgggatccgttggagtcgttgaagggtgttcaatcggtaaagccggaccagtcgcggaaagccgacaaaaataatgaaaataattttcagtgcgtttcgctccggacgaaagcaagcgtccacgcggccgccggcgcgactcaggcggcgaccaccctcacccaccagcgggtatgtcgctgcaggcgcaccggcagggtccgcgcgagcacctgcagcagcttgtcggtgtcgtccaggcgatag

SEQ ID NO: 15766 - DNA, 1128 bp, Pseudomonas aeruginosa
ctatcagaccgaggcggccccgcctcctcccgccggagattcatcggtatgcataacgacaattccaccgagaagcgcgccgacttctatcgacgcatccgccagcagcacctcaccccgctctgggaagccctgcacagcctggtcccggcgcaacccgccggcggctgccaggcggcgctgtggcgctatcgcgaactgcgcccgttcctgctcgaggcaggcgacctgatcagcgccgaggaagcggtgcgccgcgtgctggtgctggagaacccggaccttcccggccagtcggcgatcaccccgagcctctacgccggcctgcaactgatcctgccgggcgagatcgcccccagccaccggcacacccagtcggccctgcgcttcgtcgtcgagggctacggcgcctacacctcggtggacggcgaacgcaccccgcatggagccgggcgacttcatcatcaccccgtcctggacatggcacgaccacggcaacccgcgccgccgcggaaggcggcgagccggtggtctggctggacggcctggacatcccgatgctgcgtttcttcggcgccaccttcgccgaaaaccatgatgaaccggtacagccgttgcgacgtggcgaaggcgacagcctcgcccgctacggcagcaacatgctgccgctgcgccatcagccgacgacgccgacttcgccgctgttcagctacccgtacgcgcgcagccgcgaggccctcgagcgcctggcgcgcctcgaacggcccgatccctgggaaggccacaagctgcgctacgtcaacccggccaccggcggctgggccatgccgaccatcgccacctgcctgcaactgctgccggccggcttcctcgggcagcccgcgcgcagcaccgacgccagcgtctattcggtggtggaaggcagcggcgtggcgcagatcggcggccggcgcttcgccttcgaggccaaggatctgttcgtcgtgccctcctgggccgagctgcgcctggaagccggcgccaccgactgcgtgctgttcagtttctccgaccgccctgtgcagcaggcgctcggcatcctccgcgaatcccgcgaaaccctcgcccactgaaggacccgtcccatga

SEQ ID NO: 15767 - DNA, 2502 bp, Pseudomonas aeruginosa
accgacaccgtcgcggcgccttcttcgccggcgccgcagcgggcatcgtcgagtgctgcctggtaccgcaactggccaacgcccggcgcatgggctgtgtcctggcgccctacccggcgttgctcgaactggaggggcgctgcctggcgctcgaagccttccagcgcgccagccccgagcgccagcccgactacctcccggactgacgcgctgccccgtggaaaacaacaacaagaaggacacgcccatgaccacccgcatccggaccagcctgctggccctgcccctgctgctgccctcgttccaggctatcgccgcgctgccggggatgaacctcggccagacctccttcctcgacggcaaggccctgcccggcacgctgttccagcagttcgtgaatatctacgaggccgacgacttcatggacgccaacggtcaccggcgcccgctcgacaaccgcctgcgcaccctgctcgccaccagccacttcgcccacatcagccagcaccagctgttcggcgcctactacggcgcggaaatcctcgtcccggtgttgctcgccgatcccgacttcgaaccccacgccggcagcgccaacggcctcggcaacctgatcgtcagtccgttcatcctgcaatggccgcagaccgagctgttcggccggccctactggcagcgcctgaacctcgccttccagttacccaccgggcgctacgacaggcatcgggcgatcaatcccggcagcaaccactggagcttcaacccgcactacgcgctgacctgggaattcgccgaaggctgggaagccagcgctcgcctgcagtacctgttgccgggcaagaatcgcgacccggcgccgccgttggccgacgactacctgcaaccgggccaggcgttccacgccaactactcggtatcgctggcgctggatgcgcattggcgagtcgggttgtccggctacagcctgcgacagatcaccgacgagcgggtcgacgggcacgaccgcccggactcccgcgagcgggtcgatgccatcggcccggcgctgatgttcggctggggcaagtcgcggctgttcctcaacgcctatcacgaatacggcgcacgcaaccgcagcgagggcagccggctgatcctgcgctactcgcaggtcttctgagcgtcgccttccgggacgatcggcaagcgctccagggtgcggaacaccgagctgcgccgccagcgcaggtccgtcggttccgaggccagggcgaaacggcgacgcaccaggccgcgcaatgcgcattgcaattcgagccgggccaggtacgcgcccaggcagtagtgcggaccatgggcgaacgccacgtgctgcttggcgttcgctcgctgcaattgcaggcggtcgggggcggcgaacatctccgggtcgcggttcgccgcgaggaagctcagccagaccttctctccaggcggaatccgctggccgccgatctccacctcctccagggtgcaacgcacgccgccgcgcaccgcgccatcgaagcgcagcagttcctccaccgcgttcgccgccagctccgggcaccgccgcagcaggtcgagctggtcgggatgggtgagcagcgccagcgtagcgttgccgaccatgctgatggtggtttcgaaggcggccatgaacaccatggcataggccgctaccaggtcctcgaggcccagtccggcctccagcatcgcggcgccgtcgaagatgctcggcgccgcgccggacggcgggcgcgaagagccatcgctccagccgcgcgcctggcgttgcaggtagtcgctgaaggcggccgcgctgcggttgatctgcccggcatcgccgtggctggcggcgagatcgagcccggcggccagatcgcggccccagggcagcagttgcccggtatcttcgcggggaaagccgaacagctcggcggccacccggatcgtcagcggttcggcgaaatccctgagcagatcgggctcgcggcgctccagcaagctgtcgaggagttcctccaccagcacctcgatgcgcgcttcccagcggcgcacggcgtcggggccgaaggccggagcgaacagcctgcgcaggcgggtgtgccgcggcgcgtcgttgaacagcatgaagttgtcgtagaagcgcgccagcggttgcaattgctggtggccgaaccagctggcgccgccctggcggacgccggcggcgccaaggcgagcggggtcggcggagaaacggcggtcgcgcaggcacgccgaaacatcggcatagcgactgatccaccagatcgaggcctggtcgcggcagaccggcgcacgggagcggatcagccgcaacagcggatagggatcggcgacgaagtcgggatggtaggtgtggatgtcgaaaccgtcgctccgcggggccagcgccggacgctgagcgtcatggcgcggctgcgcgctgccttcctcgctgaatgcgtcgtccatggcccttgctccgctgggttggcgtaa

SEQ ID NO: 15768 - DNA, 555 bp, Pseudomonas aeruginosa
acagcaccggctcggcgttgcgcccgccaccgcgcgccgccagccaaccgccgagcagcgcggcgccgagggcgaggaacagcagcaggtgttgcagcgagaccaccagcggccccagggaaaaactcagcatcagccgcgctcccgggtcgcctgccaatgggcgaggaagccgccggcgtcgacttcgccggtcaaccggcgcgcgcggcgctcctcgccttccgggccgatccagatcaggctcggcgggccgggtacctggtagcggtgcagcagctcgcggctggcggcgttgtccgcggtcacgtcgagccgcagcaggcgcacgccctgcagggcggcgagcacatcgggcttggcgaacacctgtttctccatgatccggcaggacacgcaccagtcagcgtagtagtcgagcagcacccattgtccctcggccttggccgcagccaactgacggtccagctcggccggctggctcaccgtgaggaacgcctcgtgggcgctggccgtcggcgtagcgccccggttcgccgccgcatacacctgtag

SEQ ID NO: 15769 - DNA, 498 bp, Pseudomonas aeruginosa
cggacgccaggggtcgtcggccccggccgcggcgcccagcaacatcgccgcgccccagagaccgaagatgcagcccgccgcgccgaacagcaccgcgtgccgcgccaggcctcgcgccgtgtgcagcgcggcgtaggccaggaccagcagcaacgcgccgccaaggccgatccacagcgcctcgccgagcagcggacgcaggagtatccaggcggtgccgaggaaaaggaagccgaacacgcccttgaccaggttcatccagggaccgggcttgggcaggaagcggctgccgaccgtcaccagcagcaacagcggcatgccgatgccgaggcccaggctgaacagcaccaggccgccatgcagggcattgccggtctgcgcgatatagagcaaggcccccggccagcggcgcggtcatgcacggccccaccagcagcccggacaacgcgccgagcgcggccgcgccggccaggctgccgcccttgcggccgcgactga

SEQ ID NO: 15770 - DNA, 714 bp, Pseudomonas aeruginosa
gaccgtcgaggcggtcgcgcagggcagccggcagttgcagttcgaagaagccgaacatcggcagcgcgaggaacacgaacagcgcggcgaagctgcccagcagccacggctgttgcagccaggcctgcaggttgccgccaagcagcgccgcgaccaccccgagtccggcgtagaccagcgccatgctcagcacgtagctaccggccagcagcaggccgcgacgagggccggcgccgctgccgaccaccagcccggcgaggatcggcagcatcggcagcgaacagggagcgaacgccagcagcaggccgaggccgaagaacagcaacaggctccaggccaggttgccggcctgcaggctgccggccaggccctggtcctcggcgacttcgccgctcgtcccggcggcggcagggccggtaccgcccaggtcgagcgcctggctctgcggcggatagcacaggccggcatcggcgcagccctgccagcccaggcgcagttgtccggcggcggccgccggcagggtcagttccaggctctggcgatagacctgcgactcgccgaagaactcgtcgctgtggctttcgccgggcggcagctgcggctgcaaggccgggtcgagtccgtcgaagcgcaggcgcttctggtacaggtagtagcccggcgcgatctgccagcgcagttgcacctggccgtcgtcgaggcgctcccaggtga

SEQ ID NO: 15771 - DNA, 2055 bp, Pseudomonas aeruginosa
tcctggcttaattcgcccgcttcagactcctatccctttaaccagcgataccgccatgcatgtactgctcaccgaagacgacgacctgatcgccagcggcatcgtcgccggcctcaacgcccagggcctgaccgtggaccgggtggccagcgccgccgatacccaggcgctgctccaggtggcgcgcttcgacgtgctggtcctcgatctcggcctgcccgacgaggacggcctgcgcctgctgcaacgcctgcgccagcagggcgtcgacctgccggtgctggtgctgaccgcgcgcgacgcggtgaccgaccgggtcgccgggctgcaggccggcgccgacgactacctgctcaagcccttcgacctgcgcgaactcggcgcccgcctgcataccttgcagcggcgctccgccgggcgttgcgtcaacgtcatcgaacacggccgcctcagctacgatccgagcacccgcgaaacctggctcgacggccgccccgtggaactgtcgcgacgcgaacaggcgctgttgcaggcattgctcaacaaccgcgggcggatcctcagcggcgagcagctcaaggacagcgtctatggcttcggcgacgaggtcgagagcaacgccctcaacgtccacatccatcacctgcggcgcaagctcggcaacgccatcgtgcagaccgtgcgcggcctcggctaccgcctcgggccggcgcgcggcgacggagacgacgcatgagcctgcgcctgcgccttaccctgatcctcggctcggccttcatcctgctctggtcgctggccgcggcctggatgctctgcgacctgcgcgggcagatgatgcgctccttcgaccaacgcctggcggcctcggcgcggatggttgccggcctgctccagcagttgccgcagccgcagccggcggacggccagaccacgcgcctcagcgcggagcaactgggaattcccaacggcatggcctgccaggtcagctcactgcgcggcgaagtcctggcgcagagccatgccaccccggagcgggcgctggacagcaccgccagcggcttccgcgaccaggaaatcaacggcgtgctgtggcgcagcttcaccgtgcaggccggcgatctgcgggtcagcaccgccgaccgcctggaagagcgcgacgtgctgcaacgctcggtggtggtggccgccgcggtgccggtgacggtcgccctgctcggcagcctggccctgctctggctcggcgccggccagggcctggcgccgctcaagcggattcgcgacgccctcacccgacgtggcgccgactcgctggagccactggagctggcggccctgccgagcgaactgaagccgctggtggaaacccagaaccagttgttccagcgcatcgcccaggccatcgaacgcgagcgacgcctgaccggcgatgccgcccacgagctgcgcagcccgctgaccgcgatcaagacccacctgcaggtcgcgcgcatgaccgagggcgccgccgccgagcaggccctggcccacgccgaggaaggcgccgaccgtctgcaccggacgctggaccagctgttgctgctggcgcgggtggaaggcagcctgtcgttcgacgacggcgtgcaatgcagcgccgaggacgccgcccgggtagccatgcacgacgccggccacggcgacgtgcggatgttcgagctgaagctggccgacggcttgtccgaggcgccgctggaagtcccctcggtgctggccatcgccgcgctgcgcaacctgctggacaacgccgtgcgccacaccgccgccggcacccgggtggagctggcggtggaaaccgcgcaaggctgcgcgcgcttccacgtccgcgaccacggtccgggcatcgccgaaaccgacctgccgcacctcacccggcgtttctggcgccacggcaagagcggcggcagcgggctcggcctggccatcgtccaggctatcgtgcaacgctgccaatgccggctggacttcgacagccgcgcggacggcctgcgggtgacgctggaaatgccgctgcgcgagtga

SEQ ID NO: 15772 - DNA, 402 bp, Pseudomonas aeruginosa
acaggctcgaaccgagtagccagatcggcacctgggtaccctcgcccggcaccgccagcaggctctgctgggaacggcgcgggccgagcagcatttccagctcggcgacctgctcggggaagtcgtcgccgttgcccaggcggtcgcgacgcaaggcgcgcatggtcgcctggtcggcgccgggggcgcggccaaggccgaggtcgatgcggcccgggtagagcgtctccagggtgccgaagttttccgccaccaccagcggcgcatggttcggcagcatcaccccacccgagccgacgcggatccgcgaggtgccgccggcgatatggccgatcagcagcgcggtggcggagctggcgatgccatccatgttgtggtgctcggccagccagaaacggttga

SEQ ID NO: 15773 - DNA, 267 bp, Pseudomonas aeruginosa
cccctactcgcccggttcaggccagcgcgcccgcatcgaccagcgagaagaaatgagcccaaggaggcatccatgctctcagcccgctcccgcaaggccccgacctatggcgtcacctatgtgagcctcgaggattgcaccctgcacttcgagaccgagtacatcatcgagcgccgcgacggcagcctcgcgcacatgccgatgcgcacgccggtcagtgagcgcgaagccctgcaacgcctgatcgaaagctgcatcgacgactga

SEQ ID NO: 15774 - DNA, 885 bp, Pseudomonas aeruginosa
cctgaaccttccgcgccacgagcctttccccatgagccacgccaatacgccccgcgactgggttcgacgcgccccgcaacacggtgcggtggaacgcatcgaggcttacttcgccggccacggctacgatccgcatcgccacgacacctatgccatcggccagaccctggccggggtgcagagcttccgctatcgccgcagccagcgccacagcctgccgggcggctgcctggtgctgcatcccgacgagctgcacgacggcgaggccggcagccaggaagggttccgctaccggatgctctacgtcgagccggcgctgatccagcaggccctcggcggccggccgctgccgttcgtgcgcgggggcttgtccgacgacccgcgcctgatcgccgccagccggaccctgctacaggccatggataccccgctggagccgctggaagaacaggacgccctgttcgaactggcccacgccctcgacgccgtggccggcaaccgggcgcgcggcaggcgccacttcgacttcgtcgccgccgagcgcgcccggcagtacatccacgcgcacctggagcgcccgctgggcctcgacgaactggcgcaggtcgcccagcgcgaacgctggagcctgtcgcgcgatttccgcgcgctgttcggcaccagcccctaccgctacctgatccagcgccggctggacatcgcccgccggctgatgctcggcggccagacgctggccgaagccgcgcttgccgccggtttcacagaccagagccacatgacccgccatttcggccagagctacggcctgccaccggcacgctggctgcgtatgctcggccgcgcctagccaggttgcacgatcatccaagaccgcccgctccgtag

SEQ ID NO: 15775 - DNA, 525 bp, Pseudomonas aeruginosa
aaaactaacgccacaccaccccaaccagcagggaatataaaattgtcagaacacaattttagcaaactcaagatagataaaatcaggagaagtcctacactcataatttccggctacggagcgggaatcgccatactcttctcaatcttcaatgaccaactaggaatggagaaaaaatggctagcaaccattgacgcaacattatcaatctgcgccataatattttacacaggaatcattcatcttatttcaacaacaaaagcgcttaaagagctaaacaaagaaaaatctaaccaactagagccacgaaaacgcattcaaacacttagcgggcttctaatcatgatctccacaggcttattcggcctctatctgattggcaatagcgatatatcaccaggagcaaaactgtcatcatctacaaccggcctaatactacttagctcttgcattatcgctttactaataacttttgaaaaaatctcaaaggagttatcaggtgcgcgaactaaatcgccgccatga

SEQ ID NO: 15776 - DNA, 1152 bp, Pseudomonas aeruginosa
gcctctacgccctcggccgctggatctggtaccggccgttgcgcaacgccaccgaggagcagatcgtcgaagctgttccagcgccaggacgagcgccgctcggtatggctcggcctgctggtggaacagatcaacgccggcctgcgtacgcagaagctgcaactgttctaccagcagctcaacggcctgctgttcggcgtggagaacctgctggtgatctggctcggcgcgaccatggtgatggacggccagttcagcgtcggcatcctgatggccttcaacgcctacaagtcgcagttcgacagccgcgtcggcagcctgatcgacaagttcttcgagctgcgcatgctccagttgcagggcgagcgcctggccgacatcgtgctccaggccccggaggtcagccacggcgacatcctcccggagaacctccgcgagcgcgaggcgagcatcgagatccagggcctgcgctaccgctacgcggaacaggagccctgggtcctcgacggcctcgacctgcgcatcgccggcggcgagtcggtggccatcgtcggcccctcgggctgcggcaagagcaccctgctcaacgtcctgctgggcatcctcccgccagtggagggacagatccgcatggccggcctggaccttgcgcaactgggcctggacggcctgcgcgaactggtcggcacggtgctgcaggacgacgtgctgttcgccggttcgctcagcgacaacatcagtttcttcgacccgcaaccggacatgccctggctgctgcagtgcgcgcagatggctgccatccacgatgacatccaggccatgccgatgggctacaacaccctggtcggcgacatgggcacggtgctctccggcggccagaagcagcgggtgatgctggcccgggcgctgtacaagaagccgcgcatcctgttcctcgacgaagccaccagccacctcgacgtacactgcgaacagcgggtcaacgccgccattcgagcgctgcgcatcacccgcatcatggtcgcccatcggcccgagaccatcgcctcggcggaccgcgtgatagtcctcggccagggcaaggtaagcctcgacgaaagcaccgcgcgcctggccgaacgccaggccgtcgcggcgcgggagcaggcctga

SEQ ID NO: 15777 - DNA, 1116 bp, Pseudomonas aeruginosa
ccgcctacgccagcgccgaggaccagcacatccgcgccctcggcaactggcagacctcgcgcctgcgactggcggcgagcctcggtcgcctgggtttctggagcctgcgctgaaaagcccgggaagcgccgccgctctctacctctcgcgcttgtccggctggccgccatcgcgcaggatgcacccagcccccgcgacgagagaccgcatgatcgacgacatccgctacctgatcgtattcgccaagatcgccgagaccggctccgtctccggcggcgccgaggcgctgggcctgagcgccgcgaccgccagcctgcacctgtccaggctggaacggaacctgggccgtgcgctgctctaccgcaacagccgcaagctgtcgctgacccaggacggcacgcagttgctggacaccgcccgctccatgctggaactctacgagaagggcttcatcgagttccgccagcgcgccgtctcgacccgcaacagcctgcgcatctcgatgcccgcggtgtttgtctacggcgacttcacccgtcacctggcagccttcatcgaggagcatcccgacctcgacctcggcatcgcatgcgacgacagccgccacgacatcatcggcgacggcatcgacatcgccttccgcatcggcgacctgccggacagctcgctgaaggcccgtcacctgttcctgctgccgcgccaggtagtggcggcaccggcattcctggcccggcacgcgccgctggaacacccgcgcgacctgcagcggctggaatggatcgggctcggcatgcgccccgacagccggctattccgtcatgcgcgggacgacgaggaggtacgcgtcgactacaccccgcgggtgcgcgtcgacagcgtcgaagcctcctgccgcctggcccgcctcggcgtcggcctggccgcgccgccgacctacctgagcgacgagccgatccgccgcggcgagttgcgcgcggtgctgccggaatggcgcctggagccgttgaaggtgtatgcggtgtggccgcccaacgtacccgccagcagcatcgcctataccctcatcaatcgcctctacgaggccttcaatccgggctagcggcgagctgcaggtag

SEQ ID NO: 15778 - DNA, 1521 bp, Pseudomonas aeruginosa
agatcctcgcggaagccgccggccgccaccagcgccgccaggtcgcggtgggtggcgcagatcacctggatatccacagcctgccggcgcgcagcccccagcggcgccacctcgccctcggccagcacgcgcagcaggcgggtctgcaggcccagcggcatctcaccgatcctcgtcgaggaacagggtaccgccatcggcctgctgcagcaggccgcgcatccctttcgccgccgcgccggtaaaggctccgccaacgtagccgaacagctcgctctcgatcaggctttcgggaatcgccgcgcagttgagcgcgacgaagggtttgtcgcgacgggcgctggcctggtgcatctggcgggcgaaaacctccttgccggcgccggtctcgccctggatcagcaccggcaggttgcggtccttgacccgcaccgccaggcgcaggctttcggcgatgcgcgggtcgagcgcagcgtcgtcgggcacctcgcgctccagccgccgcgccttggcccgcggcgcgctgagacgcacgtgcagctcgccggcctggccgcgcagcaggcacggcgcctggtcggcggcggcgtgcagggcgtcgaggtcgaacacctcgccgatgtggctcggcacctgccccaggcgctgccgcaggtagtgccgcgccgccgggttcaacgccagcaggcgcccatcggcgtcccaggcgaacaggtagtccggctggctgtcgacgtagcccggcgcacggtgcgcgcgcagcacccaatggccctgggcgctgtgcatgaagaaggcgttctcgatctcccgcgcgctctgcgccaccatctgccggatcagatgctggctacggcggtcgtccggcgattgcacggcggaaacgtcgagcacaccgagcaactcgccctgcggatcgaagaccggcgccgcggaacaggtcaggtcgatgaaggcggcgcggaagtgatcgcgcttgtgcaccgtcaccgcagtcctgtcggtgagtacggcggccaccccgcaggtgccctcctcgccttccgaccagcaggtgccgaggtacagcccggccttgcggcagtcgttgcggatggtcgactcgacacggtagtcgatggtccgcccctgggcatcggtgagcagtacgcagtagtcggcatcgcgcacccgtccatgcagtcgcgccacctcttcgctggcgatgcgcaggaacagttcggaacgctcgcgacattcgtcgaggagggtctgcgagagaatccgcggcccttgcagggaccccgggtcgagacggtgctgctccatggagcggcgccaggagtcgaggatcggcgtcggcaccggcgcctgcggcaggcgcgcggcgttcctcaggacacggctgacacagtccacatggtccttcgagtgtgcggaaagcatggggcctccgttgctcggcatcttgttgttgtgccgcccattaagcgcccatcggcgaccctcgacaagcgccgggccgccacagccgacgactga

SEQ ID NO: 15779 - DNA, 2073 bp, Pseudomonas aeruginosa
gacggagcgtctcagcgtctcgccgggaacccgtgcgcgatgacatgggttgtctcgccggacgtcgccccggcggtcgccggccttcccatgccggcgctctacgacgggccttccggccgccacgccgcaacctggcatcggccttgctccagccacggcgacggcagggcggactgtccgctcctcccaacgccctgccgcatacacctacaagaacaatcagaggtgaagcatgcacgctacgtcgtccgacgatttctccctgtcttcccgggtcgcgctggtgaccggcgccggacgcggcatcggccggggcatcgccctcgccctggcgcgcgccggcgccgacgtggcggtggccgacctcgatccgcaggtcgccgaggaaaccgccgccgcgatccgcagcctcggtcgccgcagcctggcccttggggtcgacgtcagcgacggcgacagcgtccgggcgatggtcgagcgggtcgccacggagttcggccggctcgacgtggcggtgaacaatgccggggtgatcagcatccgcaaggtcgccgaactcagcctcgccgactgggaccgggtgatgaacgtcaacgcccgcggcgtgttcctctgctgccaggccgaactgccgctgatgcaggcgcagcgctgggggcggatcgtcaacctgtcatcgatcgccggcaaggtcggtctccccgacctcgcccactactgtgcctcgaagtttgccgtgatcggtttcagcaatgccctggccaaggaggtcgcgcgcgacggggtgacggtcaacgcgctctgcccgggaatcgtcggcaccggaatgtggcgcggcgaggacggcttgtcgggccgctggcggcaggccggcgaaagcgaggcgcagtcctgggaacgccaccaggccagcctgctgccccagggcgaggcgcagaccgtcgaagacatgggccagctcgtcgtctacctggcctgcgcgccgcacgtcaccggccaggccatcgccgtcgacggcggattctcgctatgaccccgccctcgccgatcgtcggcatcatcgccaacccggcctccggtcgcgacctgcgtcgcctcaccgcccatgccgggctgcactccagcaccgacaaggcatcggtggtgcaacgcctgctcgccgccttcggcgccaccggcatccgccatgcgttgctgccgccggacatgaccggcatcgccgccgccgtgctccgggccagccagacccgccaggcccgcgacggccactggccgttcctggagttcctcgacatgccgctgcgccagagcgtcgaggatacccgcctggcggcgcggcgcatggtcgagcgcggcgtggcgctgatcgccgtgctcggcggcgacggcacgcacaaggcagtggccgccgaggtcggcgacgtccccctgctggcgctgtccaccgggaccaacaacgccttcccggagctgcgcgaagccaccggcgcggggctcgccggcggcctctgcgccagcaaccgggtgccgccggagatcggcctgcgacgcaacaagcgcctgctggtgcgcgagccgcgccgcgggctctgcgagtgggcgctggtggacgtcgcggtgtcgccgcagccgttcatcggcgcccgcgccatcagtcgcgccgaagacctcgccgaagtcttcgtcagcttcgccgaaccccacgccatcggcctttcggcgctttgcggactgtggtcgccggtgagccgcgaggagccccacggcgcctggatgcgcctgcatccggacgcccgcgagagcctgctggtgccgctggcgccgggcctgctggtgggctgcggggtctctgccgccggctacctgcaacccggcgtggcccacgcaccgagcctgtccagcgggaccctggcgctggacggagagcgcgagatcgagttcagcgccaccgaccgcccgagcatcaccctcgacccttccggcccgttcagcgtcgatgtgccggccaccctcgcctacgccgcccgccatcgcctgctggccggccagcgaaccccgatgaccccgtga

SEQ ID NO: 15780 - DNA, 723 bp, Pseudomonas aeruginosa
agacaacctggagaacaacaagatgtccactctgagcaccgaccaactgctccatgcctaccgcgtgatgcgcaccatccgcgccttcgaggaacgcctgcacgtcgagttcgccacgggcgagatacccggcttcgtccacctctacgccggcgaggaagcctccgccgccggcgtgatggcgcacctgcgcgacgacgactgcatcgcctccacccatcgcggccacggccactgcatcgccaagggcgtagacgtgcacggcatgatggcggaaatctatggcaagaagaccggggtctgccagggcaagggcggctccatgcatatcgccgacctggagaaaggcatgctcggcgccaacggaatcgtcggcgccggcgcgccgctggccgccggcgccgcgctggcggccaagctgaaaggcagcgatgcggtggcggtggccttcttcggcgatggcggctccaacgaaggcgcggtgttcgaggcgatgaacctggccgcggtgtggaacctgccgtgcctgttcgtcgccgagaacaacggctatgccgaggccaccgcggcctactggtcggtggcctgcgaccacatcgccgaccgcgccgccggtttcggcatgcccggggtgaccgtcgacggcttcgcacttcttcgccgtccacgaggctgccggcgccgccatcgagcgcgcccgcgccggcgaggggccgtcgctga

SEQ ID NO: 15781 - DNA, 2361 bp, Pseudomonas aeruginosa
agcactaccgggaaacccgcgactgcctcaagcagttccgcgaacgcacctgccacgccggcctgctctccgccagcgacctggacgccatcgacgccgaggtcgaggcgcgcatcgaggatgccgtgcagcgcgcgaagaacgatcccaagccggagccggacgacctgctgcgcgacgtctacgtgtcctatccctgagccgcccgaaaacaagaacgaggagaaccatcatggcgagaaagatcagctaccagcaggccatcaacgaggcgctggcccaggaaatgcgccgcgacccgagcgtcttcatcatgggcgaagacaatgccggcggcgccggcgcgcccggcgaggacgacgcctggggcggcgtgctgggggtcaccaagggcctctaccaccagttccccggccgtgtgctggataccccgttgtcagagatcggctatgtcggcgccgcggtcggcgccgccacccgcggcatgcgcccggtgtgcgaactgatgttcgtcgacttcgccggttgctgcctggaccagatcctcaaccaggccgccaagttccgctacatgttcggcggcaaggcggtcaccccgctggtgatccgtaccatggtcggcgccggcctgcgcgccgccgcccagcattcgcagatgctcacttcgctatggacccacatccccggcctcaaggtagtctgcccgtcgtcgccctacgacgccaagggcctgctggtccaggcgatccgcgacaacgacccggtgatcttctgcgagcacaagctgctctattcgatgcagggcgaggtacccgaggagctgtacagcgtacccttcggcgaggcgaacttcctccgcgacggcgacgacgtcaccctggtgacctacggccgcatggtccacctggcgctggacgccgccgccagcctggcgcgccagggcatctcctgcgaagtactggacctgcgcagcaccagcccgctggacgaggacagcattctcgaaagcgtggaaaagaccggccgcctggtggtggtcgacgaagccaacccacgctgctcgatggccaccgacatcgccgcgctggtcgccgaacgggccttctccgcgctgcgcgcgccgatccgccgggtcaccgcgccccatacgccggtgcctttctccgacgccctggaagacctctacatccccgacgcggcgaatatcgaggcagccgtgcgccaggccctggaagggagggacgcggcatgagccggatccatacactgaccatgcccaagtggggcctgtcgatgaccgagggtcgggtggacgcctggctcaaggaagagggcgcgcatatcgagaaaggcgacgaggtgctcgacgtggagaccgacaagatctccagcagcgtcgaggcgcccttctcgggcgtgctgcggcgcaaggtggcgcgcgaggacgagaccctggcggtcggcgcgctgctcggcgtggtggtcgagggcgaggcgagcgacgaggagatcgacgcactggtgcaacgcttccaggccgaattcgtacccgccgacgaggacgctggggatagcggaccggcaccgcggaaagtcgagctggacgggcgcctcctgcgctatttcgaccgcggcgagggcgatccggcgctactgctgatccacggtttcggtggcgacctgaacaactggttgttcaaccacgaggcgctggccgccgagcggcgggtgatcgctctagacctgccgggccacggcgagtccggcaaggccctggtgcgcggcgacctcgatgaactcagcggcagcgtgctggccctgctcgaccacctcgacctggaacaggtacacctggccggtcactccatggggggagcggtggcgctgaactgcgcgcgcctggcgccgcagcgggtgctgtcgctgagcctgatcggcagcgccggcctcggcgaggagatcaacggcgactacctgcgcggtttcgtcgaggcggccaaccgcaacgcgttgaagccgcaactggtgcagttgttctccgaccccgcgctggtcacccggcagatgctcgaggacatgctccgctacaagcgcctggaaggcgtcgatgcggccctgcgccagttgctggacaacctgttcgccgacggtcgccagcgcaacgacctgcgtgccgtggcgagcgagggccgccagccggtcctggcgatctggggcagcgatgacgcgatcatcccggcgcggcatgccgagggcctgccagcccaggtggagatcattcccggacaggcgcacatggtgcagatggaagccgccgagcaggtcaaccgcctgctgctcgacttcctccgccagcattga

SEQ ID NO: 15782 - DNA, 879 bp, Pseudomonas aeruginosa
ggagacgaccgacatgaacagttccccgcaagccaacgcggcgatgcgcgccgccgtctggcacggccgccacgatatccgcgtggaagacgtgccgctcccggccgagccgccgcccggctgggtgcagatccgcgtgcactggtgcggcatctgcggctccgacctgcacgaatacctggccggcccggtattcatccccgtggaggcgccgcacccgctcaccggcctcaaggatcaatgcatcctcggccacgagttcagcggcgaaatcgtccgcctcggcaacggcgtgaccggcttcgccgtcggccaggcggtcgccgcagacgcctgccagcattgcggcacctgctactactgccggcatgggctgtacaacatctgcgagaacctggccttcaccgggctgatgaacaacggcgccttcgccgaatacgtcaacgtaccggccaacctgctctacgccctgccggccggatttcccagcgaggccggcgcgctgatcgagccgctggcggtgggcatgcacgcggtgaagaaggccggcagcctgctcgggcagaacgtggtggtggtcggcgccggcaccatcggcctgagcaccatcatgtgcgcgcgcgccgccggcgcggcacaggtgatcgccctggagatgtcctcggcgcgcaaggccaaggccctggaggtcggcgccagccaggtgctcgacccctcgcggtgcgacgccctaggcgaaatccgcgccctcaccggcgggcttggcgccgacgtcagcttcgaatgcatcggcaacaagcacaccgccaagctggccatcgatgccatccgcaaggccggcaaatgcgtgcttgtgggaatcttcgaggagcccagtga

SEQ ID NO: 15783 - DNA, 612 bp, Pseudomonas aeruginosa
gatcagcccggcgaacaggccggcgccggcgatgctgccgccgtagaccatgtagcgcatcagcacctgcttgttctcgtcgcccagttgcgcctgcaccgcacgcaggtcggagcgggccttgccgagctcggcgtccaggttgctgcgcgccgcctgcaattcgtcgatcaacttcttgcgcgtgtcgagggtttcctgcatgccctgcacgcgggtcttccaggtgtcgttgatgccgtccagctcggcggtcagggcggctaccttctgttccagttgcggcaggcgctcggcctggccgggaacctcctgcaagtcgcggctgggaatccacacggtgctgccgttctcgccgcgcacctggctgtagttgccctgggtgccaagcagctcgaccttctgcccggaggtgagggtgccgacgatgcgatagccatcggtggggccgctgcgcacgaaagtggtcaggctgtcgctcacccagcgcgcgttgccggtcgcctcctcggcctgcgccggggcgccggccgccagcaggccgccgagcaggcaggctccgatgacgcggttctggaacggggaaagagcggcggggatgcgacgggatag

SEQ ID NO: 15784 - DNA, 432 bp, Pseudomonas aeruginosa
accacctcagccccgcgcgtcggcggcgatcccgcgcggcaccagcagcggcgtgccgctgaccgggtcggcgatgatcaacgagcgcaagccgaacacctcctccaccagacgctcggtgaagatatgcgccggcgcgccctcggcgaggatcgcgccgtcacgcatggcgatcaggtgcgaggcatagcggcaggcctggttgaggtcgtgcagcacggcgacgatggtgcgcccctggcgattcagctcggcgagcagttcgagcaattcgatctggtggacgatatccaggtaggtggtcggctcgtcgagcagcagcaacggggtttcctgcgccagcaccatggcgatccacacgcgttgccgctggccgccggagagcgcatcgagcggtcgctcggccaggccgtcgacccgcgtggcgcgtaa

SEQ ID NO: 15785 - DNA, 432 bp, Pseudomonas aeruginosa
cgccgccgctaccgcgcgctcatccgccggcgaccactggcgcaggaacgactggtgcggatagcgcccgcgcgccaccagctcggccaccgtgatgccatccggcgccagcgcgctctgcggcagcaggccgagacgccgcgccacttcccgtcccggcaggctgtggatatccctgccgtccagcaccacccggccctcggccggcgccaacaggcgcgacaatgccgccagcagggtcgacttgccgcaggcgttgggcccgacgatcacactgaacgaaccctcggggatggccagcgagagattccgcgaaacggtccgcgcgtcgcggcgcaaggtcacggcgtccgcgtgcaggcgatgggtcatgggaggttcctggataagaatggctcgaatatgtggaatcgattatacattatggaatag

SEQ ID NO: 15786 - DNA, 957 bp, Pseudomonas aeruginosa
gaagcattatcatatgaatccgtccgcccggcttcccctacagcgaaaacagccttcatgccgacccgccgccgctccgccctgccgttactcgccctgagcctgttcgccaccctcgccgcggccggggagccgaagccggcgcggatcgtctccaccaccccgagcgtcaccggcatcctgctggcgatggacgcaccgctggtggccagcgccgccaccacgccaagtcgcctgaccgacgccaagggcttcttctcgcaatgggcgaaggtcgccgaccaacgtggcgtcgaggtgctctaccgcaacctgcgcttcgacatcgaagcggtgatcgcccaggatccggacctgctggtcgcctccgccaccggcgccgacagcgccgcgccataccgtgcggagctggaggcgcagggcgtaccgacgctggtggtcgactactcgaaacacagctggcaggaactggctaccgagctgggccggcacaccggcctggaacgccaggcgcaggccgccatccagcgcttcgacgcctacaccgccgaagtcgccgcggccatcgcgccgccgcagggcccggtcagcgtggtcggctacaacatcgccggcagctattccatcggccgccaggccagcccccaggcacgcctgctcgaggccctcggcttccaggtggcggaactgccggaggcgctggcgggcaaggtgacgcgcgcctcggacttccagttcatctcgcgggaaaacctgcccgccgccatcgccggcgacagcgtgttcttgctcggcgccagcgacgacgacgtgcaggcgttcctcgccgacccggtgctggccaacctgtcggcggtccgcgaaaagcgcgtgtacgccctgggccccagttccttccgcatcgactattactcgggacggcagatgatcgacaacgtcgcccgccatttccgctga

SEQ ID NO: 15787 - DNA, 1053 bp, Pseudomonas aeruginosa
gccatgcgcccgttcgccggaagtccgctcatgcaggcgtccccgatgcgccgccggcgcctgcgcgcctggggcctgctcgccggcgcgctgctgctcgcgctggcggccctggccagcctggcgctgggctcgcggccggtgcccctggcggtcaccctggacgccctgcaagccgtcgatccgcacgatgatcgccacctggtggtacgcgaactgcgcctgccacgcaccctggtggcgctgctggccggcgcggcgctgggagtggccggcgcgctgatgcaggcgctgacgcgcaatccgctggccgaacccggcctgctggggatcaacgccggcgcggcgctggcggtgatcgtcggggtcgcgctgttcgacctggcgagcatgggccagtacctcggttgcgccttcctcggcgccggcctggccggcatcgccgtattccttctcggccaggcccgcgagaccggcaccaacccggtgcgcctggtgctggcgggtgccggcttgtcagtgatgctcgcctcgctgaccgggatcatcgtgctgaacgccccgccggaagtcttcgaccgcttccgccactgggccgccggctcgctttccggcagcggcttcgccctgctcggatggccgggcctggccatcggcgccgggctggccgccgccttcgccctcgccgccaggctcaatgccctggccctgggccaggagatcggccgggcgctcggcgtcgacctgcgcctgacctggctgctcgcctgcctggcggtgatgctgctggccggcgcggcgaccgccctggccgggccgatcgccttcgtcggcctggtcgccccgcacctcgcgcgactgctggccggaccggaccagcgctggatcctgcctttctcggcgctgatcgccgccggcctgctgctcggcgccgacatcctcgggcggctgctggcggcgccggcggagatcgccgccggaatcgtcgctttgctgctcggcggaccggccttcatcgtcctggtcaggcgcttccgcctgagccgcctgtga

SEQ ID NO: 15788 - DNA, 522 bp, Pseudomonas aeruginosa
acggtctccacgccctgcgcctgggctccctgtcgctgcgttggcggccacgggcggcgctggcctgcctggtcctcgcgggggtcggactggcgctggcggcggcgctgctggggaccggcagcctggcgctgggcccggcagaggtgttcgccagcctgctcggccagggccaggaccccaccgcccagcgcatcgtccagcgcgtacgcctgccacgggtgctcaccgcctgcctggtcggcgccgcgctgggcatggccggggcgatcttccagtcgatctcgcgcaatccgctgggctcgcccgacgtcatcggtttcaccaccggcgccgccagcggcgccatcgtgcagatcatcctgttcgatgccggcccgctggccacctcgctggcggcgctggccgccggcctctgcacggcgctggcggtggtgctgctggcgcgccggggcgccaccgccggcggctaccgcctggtgctggtgggcatcggtgtcggcgccagcctgtcgggcctga

SEQ ID NO: 15789 - DNA, 330 bp, Pseudomonas aeruginosa
tgcgcagccgccggatttgagccccggcctcaacgaccgcccaggctgccgccgccgtcgacaccgatcacctggccggtgacgaacgaagcgccctcgctgagcaggaactcgatcagcgcggccacttcgtccggccgcccgagccgctgcatggggatggtcgagagaatccgccgttcctcctcgccgccgaccgggcgggtctggcggaacagctcggtctcgatcggcccgggcgccaccgcgttgaccgtgatgcccagcggcgccagctccagcgcccaggtgcgagtcaccccgaccagcgcgctcttcgccgcggcgtag

SEQ ID NO: 15790 - DNA, 1746 bp, Pseudomonas aeruginosa
cggtctccccgtctccattcgccaggcggtgacagcatgatcgaggtcaccgaggtttccatcgccgagctgcgtgacgcgctcgagtccggtcgtaccacggcggtcgaactggtccaggcctacctggcgcggatcgacgcctacgatgcacccggcacgcccaccgcgctgaacgcggtggtggtgcgcaatcccgatgcgctggccgaagcgcaggcctccgacgcccgccgggcgcgtggcgagcccctcggtccgctggacggcattccctacaccgccaaggacagctacctggtcaagggcctcaccgcggcttccggcagcccggcgttcaaggacctggtggcccagcgcgatgccttcaccgtcgagcgcctgcgcgccgccggggcgatctgcctgggcaagaccaacatgccgcccatggccaacggcggcatgcagcgcggcgtctacggccgcgcggagagcccgtacaatgccgcctacctcaccgcgcccttcgcctcggggtcctccaatggcgccggcaccgccaccgcggccagcttcgccgccttcggcctggccgaggaaacctggtcgagcgggcgcggcccggcgtcgaacaacggcctgtgcgcctacaccccttcgcgcggggtgatctcggtgcgcggcaactggccgctgacgccgaccatggacgtggtggtgccctatgcgcggagcatggccgacctgctggaaatcctcgacgtagtggtcgccgacgatcccgatactcgcggcgacctctggcgcatgcagccctgggtgccgatccccaaggcctccgaggtacgcccggcgagctacccggccctggccgcaggcgccgaggccctggccggcaagcgcttcggcgtgccgcgcatgttcatcaacgccgaccccgatgcgggcaccagcgagtcccccgggatcggcggcccgaccggccagcgcatccatacccggccctcggtcatcgccctctgggaacaggcgcgcaaggccctggaagccgccggcgccgaagtgatcgaggtggacttcccgctggtgtcgaactgcgaaggcgaccgacccggcgcgcccaccgtgttcaaccgcggcctggtgtcgaaggaattcctccacgacgagctgtgggaactctcggcctggggcttcgacgacttcctgcgcgccaatggcgatccgaagctgaaccgcctggcggatgtcgacggcccgcagatcttcccccacgaccccggcaccctgcccaaccgcgagggcgacctggccgccggcatggacgaatacgtgcggatggccgagcgcggcataaagccctgggaccggatcgcgaccctccccgatggcctgcgcggcctcgaggaaacccggcggatcgaccttgaggagtggatgcgacgcctgcgcctcgacgccgtgctcttccccaccgtcgccgacgtcggcccggcggacgccgacgtcaacccggcctcggccgacatcgcctggagcaacggtgtctgggtcgccaacggcaacctcgccatccgccacctcggcgtgccgacggtcaccgtaccgatgggggtgatggccgacatcggcatgccggtgggcctgaccttcgccggccgcgcctacgacgactcggcgctgctgcgcttcgccgcggccttcgagtcgaccggctcgcggcgtatcgtgccgccgcgtactccaccgctggcaagcaagtga

SEQ ID NO: 15791 - DNA, 567 bp, Pseudomonas aeruginosa
ttggtgggatatggcaagccattaggcggctataaaaacagccgggtcaagaccctcggtcccggcctccgccggatcgccccatcaagccaaagaaggaagcactggatgcaatccctgcacacactggtatcggtacgccccgtggcacacgaggacttcgagcagtggctcgaatactggaaggcctaccaggcgttctatgaagtcgaactctcggcacaggccaccgaggccacctggcggcgcttcttcgacgagggcgaaccgatgcactgcgccgtggccagcgacggtagccgcctgcatggcatcgtcaacttcctctaccaccgctcgacctgggcggcacaggacgtctgctacctggaagacctctatgtctcgcccgacgtgcgcggccagcagatcggcaagcagttgatcgagtacgtccgccggcaggccgaggaacgtcgctgcgcgcggctctactggcatacccaggaaagcaaccacagggcacagcgcctgtacgactgggtagcggacaagccgggtgtgatcgaataccgcatcgagctctga

SEQ ID NO: 15792 - DNA, 480 bp, Pseudomonas aeruginosa
accggccgcgcgaccggagcctcggccgccccgctcatgcaccgcggcggaccttcgacgcggttctcagtcccaggccggcgccaggccctgcggactgacctcgcggccgttacgctcgaggccggcgatgcgcgccatgtcctcggcgtccaggcgcaggtcgcgcgccagcaggttgctggcgaggttctcgcggcgggtcgaggacggaatcaccgcgtagcccagttgcatcgcccaggccagcgccacctgggcgaccgtggcccggtgcctggcggctatcccggccagcgtcgggtccttcagtaccttgccgtaggccagggtcatgtacgaggtgaccgcgatgccctgctcctcgaggtacgcggtcagcgcgcggttctgcaagtaagggctgagttcgatctggttggtggatatctcgcccgcaccgaccgcggcgatggcctggcgggtccagttcgatgttga

SEQ ID NO: 15793 - DNA, 1056 bp, Pseudomonas aeruginosa
ttgttcagggcgccctggctggtcactgccaatgcccctgcgctggatagcgtaccgccctggttgtcgagccaggctgacttcaccgtcaggaagccccggctgtccaggctgccggcctggttatcgaacgcaccggccagggagacgtcgatacccttctggctggacagcaggccccccgcgccgttgaacaactccgtagcactcaggcgcagcccatcgcggctggcgagtacccccttgtcctggttgagcatgcgtggcgttgtgatgtccaggccactgtcaccgacgatcttgccaccgcggttgtccaactgttcgcgagcgctcgccaccaccctcgacgtgctggagatatcgcccgctcggttgtcgatcaaccgagagctcaagtcgagatcctggccggcgacaatgcgaccgctgcgattatcgagccgatccgccttcaggagcgtacggcgctcgctgaccagcttgccgcccgcactgttgtccagacgagcgacctcgatgtccatgtctcccttgctggaaaggagaccggcactgcgattgtccagtgcggcagcctggacctgcagttcgttcagaccgacgacctggccgccacggttgtcgagatcgccacgagtcttgaccacggcgcggtcccggctctgcaacaggccgtcctggcggttgtccaggctgctcgcctcgacccgcagttcgccctcggcgagcagcttgccgccacggttgtccaggtgtccgccgtcgacccggacggtcgcccccttcaggctgccgccctggttgtccagtgccaggctcgccttcgcttccagcgcgcggctggccaccaggctgccggcgttgcgcagggtgccgctgcgcagctcgaggtcgccgcgcgcgttgcgccgctcgtctggctcgacgccggcttcgatcaccccggcgttgtcgatatgcgccgcctccagcgcgatgcgttcgcgcgccgccaggctctgccggttgaccagttcctccgcgctgcggatctcggcgctgccaccggcgtag

SEQ ID NO: 15794 - DNA, 408 bp, Pseudomonas aeruginosa
gggcccggcgaggttaagcaaggttttccaagggaaagggcctcgatgcaggtaggcgctttcctaaagcgttcaggaggtcgccgcgtcttcagaagaacgcgtcgacccggaaatagatcgggtgctcgcgccgctcgatggcgctgggccgctccagcgagcgggcgaagccgacgctggcggcgaaatagcggccgcgggcatccagttcgatggcgttgccgctcatgcgcccgctggcgccgtcgttgtagcggtcgtggcggatcacgccgacgtcgtaggcgaaggccacgccgtattcctgcagccagggccgcagcggcgcccattccaccgcacgccgccagcgcaactggttgcgccagtagccgccgctgtcgccggtcagggtctggtccttga

SEQ ID NO: 15795 - DNA, 738 bp, Pseudomonas aeruginosa
atcgcattgtcgagaagccgcggcctttttgcaatagcacccgccggccggcgccctactcggccgccgcgccttcgcgcaggcaggccagcaggtcttcgctggcacggtcgcggtgcggttcgtcgcgccagcacatgcccaccgcgccctcgccgggaatctccagcgccagcctggccaccaggccgagcccggcaaggtgctcgaccacccgcgccgagccgatggacagcatgtcgctgccacgcaacaattcgatgttggccagcatcgacgatgactccaggcggtaggccggcggctgccggccgccctgggtcagggccatgtcgagcttgctgcggatcggcgagccgggcggccagagaatccagtcgtatcgccgcacgtcttcccagtccagcgcggcggtctgggccatggggttaccggggcgcgccatcaccacgatcgcctcgctgtagagcacgtcgcagcgcaggctggcgcgcggcgcatagttgtccaggcgccccaccaccacatcgagctggcgtttctccagccgctcgagaaggccgttcatggtgccttcgagcagttccacctgggccccggggtagcgtccgaggaacgcccgcaatgcgcgcggcaccaggctcggcgcggaggccggcgacgtgccgaggagcacccggctgccgctgccgctgcgcatcgcctcgaggttctgccgcgcccgctccatctcggtga

SEQ ID NO: 15796 - DNA, 4257 bp, Pseudomonas aeruginosa
accggtacagccgttgcgacgtggcgaaggcgacagcctcgcccgctacggcagcaacatgctgccgctgcgccatcagccgacgacgccgacttcgccgctgttcagctacccgtacgcgcgcagccgcgaggccctcgagcgcctggcgcgcctcgaacggcccgatccctgggaaggccacaagctgcgctacgtcaacccggccaccggcggctgggccatgccgaccatcgccacctgcctgcaactgctgccggccggcttcctcgggcagcccgcgcgcagcaccgacgccagcgtctattcggtggtggaaggcagcggcgtggcgcagatcggcggccggcgcttcgccttcgaggccaaggatctgttcgtcgtgccctcctgggccgagctgcgcctggaagccggcgccaccgactgcgtgctgttcagtttctccgaccgccctgtgcagcaggcgctcggcatcctccgcgaatcccgcgaaaccctcgcccactgaaggacccgtcccatgaaccatctcttcgcgcccgaagcacccgtcagcctcaccatccatggcagcgaccagaccttcccggtgcggcgggtctactgcgtcggccgcaactacgccgcccacgcccgggaaatgggcttcgatcccgagcgcgagccgccgttcttcttctgcaagccggccgacgcggtggtcccggtcgccgccggcagcaccctggagctggcctacccgagccagaccggcaactaccactacgagatcgaactggtggcggcgatcggcaagggcggctgcgacatccccctggagcaggccgaggaacacgtctggggctacgcggtgggcctggacatgacccgccgcgacctgcagatgcgcatgcgcgagatgggccggccctgggagatcggcaaggccttcgaccgctcggcgccgatcggcccgctctaccctgccagccaggtcggccatccgcgccacgccgccatcagcctccaggtcgacggcgaggatcgccagcgcagcgacatcgaccagttgatctggtcggtggcggaaaccgtcagctacctgtcgcgcttcttcgagctgcgccccggcgacctggtcttcaccggcaccccgggaaggcgtcggcgcggtcgagcgcggcgagcggatgctcggcgccatcgacggcctcggcgaactcagcgtccgcgtggtctgacccaccgcccgcgcacggcgcgggcccaccctgcccttcatccgggctgtcgccacggcgacggccgaggaacgctcatgcctacgcccgacaagaacaacaagatcgacgtccaggctttcatcgatgcgcaggcggtttccgccttccagttgcgagtcctgtcgctgtgcttcctgatcgtcgccatggacggattcgacaccgccgccatcggcttcatcgccccggccctggcccacgactggcaactgagcccggcgcaactcagcccgatcctcggcgccgcgctggccggcctggccctcggcgccttcgccgccggcccgctggccgaccgtttcggacgcaagagcgtgctcctgctctcggtactgttcttcggcggctggagcctcgcctcggcctacgccggttcggtggaaaccctggccctgctgcgctttttcaccggcctcggcctgggcggggcgatgcccaacgcgatcaccctgacctccgaatactgcccgcgccggcaccgcgcgctgatggtcaccgcgatgttctgcggcttcaccctcggctcggcgctgggcggcctgctcgccgcgcggatggtcccggcgctgggctgggaaagcgtgctgctgctcggcggcggcctgcccctggcgagcctgccgctgctctgggcatgcctgccggagtcggtgcgcttcctcgcccgccgcgcaccggacgcggcgcgcctgcggcgcatcctcgaacgcctggggcgcctgcccgacggctgggccggacgcctcgaactgcccgccgacgagtccgacggcacctcgctcctgcggcagatcctcggcgccgagctgcgcggcggcaccctgctgctctgggccacctttttcatgggcctgctgatcatctacctgctgaccaactggctgccgacgctgatcggcggcaccggcttcagtctcggcgaggcggcgacgatcagcgccatgttccagctcggcggcaccctcggcgcactcctcctgggcagcgccatggatcgcttcgacgcgcaccgggtgctgagcctggcctacgtcggcggcgccctgttcatcctcggcatcgccagcctctaccacagcttcgccctgctggcgctgtgcgtcgccggcgtcggtttctgcatcagcggctcgcaggtcggcgccaacgccctggccgccgatttctatccgacccgcagccgcgccaccggggtcagctgggccctcggcctgggccgcatcggctcgatcgtcggctccctcagcggcggcgccctgctcggcctgggcctgggcttcagcggcatcctcgccctgctggtaatcccggcgctgctcgccgccgtggccgtgcatcgcctgggccggcgccgggccaggccttcttccgtcactctctgaacaggacttcccatgcagctctacagcttcttcaacagctccacgtcctatcgggtgcgtatcgcattggccctgaaaggcctggattaccaggtagtgccggtcaacctgcggcagggcgagcaactgcgcccggccgaccgccagcgcaacccgatgggcgcgctgccgaccctggtcgacgccgacggtcgccggttcagccagtcgctggcgatcatcgactacctcgacgccgtgcagcccgaaccgcgcttgatccctctcgacccactgcatcgcgcccaggcgctggaactggccctgctggtggcctgcgacatccatccgctgaacaacgtgcgggtgctcaagtacctgacccaggtcctcggcatagacgccgaggaccgccagcgctggtacgcgcactgggtcgccgagggcctggcggcggcggagaccctgctgaaccgacaccgtcgcggcgccttcttcgccggcgccgcagcgggcatcgtcgagtgctgcctggtaccgcaactggccaacgcccggcgcatgggctgtgtcctggcgccctacccggcgttgctcgaactggaggggcgctgcctggcgctcgaagccttccagcgcgccagccccgagcgccagcccgactacctcccggactgacgcgctgccccgtggaaaacaacaacaagaaggacacgcccatgaccacccgcatccggaccagcctgctggccctgcccctgctgctgccctcgttccaggctatcgccgcgctgccggggatgaacctcggccagacctccttcctcgacggcaaggccctgcccggcacgctgttccagcagttcgtgaatatctacgaggccgacgacttcatggacgccaacggtcaccggcgcccgctcgacaaccgcctgcgcaccctgctcgccaccagccacttcgcccacatcagccagcaccagctgttcggcgcctactacggcgcggaaatcctcgtcccggtgttgctcgccgatcccgacttcgaaccccacgccggcagcgccaacggcctcggcaacctgatcgtcagtccgttcatcctgcaatggccgcagaccgagctgttcggccggccctactggcagcgcctgaacctcgccttccagttacccaccgggcgctacgacaggcatcgggcgatcaatcccggcagcaaccactggagcttcaacccgcactacgcgctgacctgggaattcgccgaaggctgggaagccagcgctcgcctgcagtacctgttgccgggcaagaatcgcgacccggcgccgccgttggccgacgactacctgcaaccgggccaggcgttccacgccaactactcggtatcgctggcgctggatgcgcattggcgagtcgggttgtccggctacagcctgcgacagatcaccgacgagcgggtcgacgggcacgaccgcccggactcccgcgagcgggtcgatgccatcggcccggcgctgatgttcggctggggcaagtcgcggctgttcctcaacgcctatcacgaatacggcgcacgcaaccgcagcgagggcagccggctgatcctgcgctactcgcaggtcttctga

SEQ ID NO: 15797 - DNA, 447 bp, Pseudomonas aeruginosa
cgccggtcgccgccaggcccagaacagcgcgccgagcacggcggcgagcaggcctggccaggcgaggaaaccgccatcgcggatatccagcatctgtgcgaagtcgccgcggtactgcggccagtagcgcaccacgaaagccaggcgcgccaccagcaggccgagcaacaacaggttgaacagcaccggctcggcgttgcgcccgccaccgcgcgccgccagccaaccgccgagcagcgcggcgccgagggcgaggaacagcagcaggtgttgcagcgagaccaccagcggccccagggaaaaactcagcatcagccgcgctcccgggtcgcctgccaatgggcgaggaagccgccggcgtcgacttcgccggtcaaccggcgcgcgcggcgctcctcgccttccgggccgatccagatcaggctcggcgggccgggtacctggtag

SEQ ID NO: 15798 - DNA, 960 bp, Pseudomonas aeruginosa
agcaaggcccccggccagcggcgcggtcatgcacggccccaccagcagcccggacaacgcgccgagcgcggccgcgccggccaggctgccgcccttgcggccgcgactgagaccgtcgaggcggtcgcgcagggcagccggcagttgcagttcgaagaagccgaacatcggcagcgcgaggaacacgaacagcgcggcgaagctgcccagcagccacggctgttgcagccaggcctgcaggttgccgccaagcagcgccgcgaccaccccgagtccggcgtagaccagcgccatgctcagcacgtagctaccggccagcagcaggccgcgacgagggccggcgccgctgccgaccaccagcccggcgaggatcggcagcatcggcagcgaacagggagcgaacgccagcagcaggccgaggccgaagaacagcaacaggctccaggccaggttgccggcctgcaggctgccggccaggccctggtcctcggcgacttcgccgctcgtcccggcggcggcagggccggtaccgcccaggtcgagcgcctggctctgcggcggatagcacaggccggcatcggcgcagccctgccagcccaggcgcagttgtccggcggcggccgccggcagggtcagttccaggctctggcgatagacctgcgactcgccgaagaactcgtcgctgtggctttcgccgggcggcagctgcggctgcaaggccgggtcgagtccgtcgaagcgcaggcgcttctggtacaggtagtagcccggcgcgatctgccagcgcagttgcacctggccgtcgtcgaggcgctcccaggtgaagcggaaggctttctccaccggcaggaaatccgtctgcatcgcgccgcgcggcgcgaacaggtcgtcgcccggttgcgcctgggacaggcccggcagcaggagcatcaggagcaggatcaacacacgcatggataa

SEQ ID NO: 15799 - DNA, 780 bp, Pseudomonas aeruginosa
cgcggccacgggaaaaccccggcgacgcgccgggcggggcataatcctggcttaattcgcccgcttcagactcctatccctttaaccagcgataccgccatgcatgtactgctcaccgaagacgacgacctgatcgccagcggcatcgtcgccggcctcaacgcccagggcctgaccgtggaccgggtggccagcgccgccgatacccaggcgctgctccaggtggcgcgcttcgacgtgctggtcctcgatctcggcctgcccgacgaggacggcctgcgcctgctgcaacgcctgcgccagcagggcgtcgacctgccggtgctggtgctgaccgcgcgcgacgcggtgaccgaccgggtcgccgggctgcaggccggcgccgacgactacctgctcaagcccttcgacctgcgcgaactcggcgcccgcctgcataccttgcagcggcgctccgccgggcgttgcgtcaacgtcatcgaacacggccgcctcagctacgatccgagcacccgcgaaacctggctcgacggccgccccgtggaactgtcgcgacgcgaacaggcgctgttgcaggcattgctcaacaaccgcgggcggatcctcagcggcgagcagctcaaggacagcgtctatggcttcggcgacgaggtcgagagcaacgccctcaacgtccacatccatcacctgcggcgcaagctcggcaacgccatcgtgcagaccgtgcgcggcctcggctaccgcctcgggccggcgcgcggcgacggagacgacgcatga

SEQ ID NO: 15800 - DNA, 1701 bp, Pseudomonas aeruginosa
cgctggaaatgccgctgcgcgagtgatgcgcgggcccacccgccaaccggcccccgtagggcgaatagccgcccgcggctatccgccggaccgaggcccaggcatcggcggataacgccgttggcgttatccgccctacccccgcgccgacctgcttccgccggaccgggtctccgtcctgcggacgccaggccacgagggtcagattccctgtcccagcagcacgccgttgaccttctgtccgtacaggttgacgccgtcgttggcatggaacttctgccgcgtcttctccaccgaaccgtccaccaggcgcgggtcctgcgggcgctcgtggctgttcatgaaggcggcgacgtcccaggcgtcgcggtcgctgagggtaccgggcttgcccagcggcatgttgtacttgatgaaggaggccgcggtgttgatgcggtgcatgcccgcgccccagttgaacgactgcgcgccccacagcggtgggaacaccgtctgccccagagccatctggccctggccgtcggcgccgtggcagatcgcgcactgcgcggcatagaccttggcgccgcgctcgatgctgtagccgccttccggcggggccacgtccggatagccgcgtccgggcaggctgaccccggtcggcgcctggctcgccagccaataggcgtagacggtcagggccttgatctccgggctgtcagccgccggcaccttgccgttcatgctgaactggaagcagccctgcaggcgctcggcgaacgtattgaccttgttgttcttggcacggaacgccggatagaccgggtaggccgcccactgcggcgcggagttggcccggcggccctggtcgagatggcagttgacgcagttgagctggttaccgaccagatgcggtgcgttcttccgggtttccacgaacaacgcctggccctggcggaccatttcgccgaaggcgttgtccgggaggctgctttccgccggcggctggaacggctccgagggcgccgttgccgcgtggacgggagcgaccagcaggccggcgacggccagggaaaggatcgacggccatgttcatggctggcctcctgcctgaccgagggtggcgaagaactggctgacgctgcggatctcctcttcgctgagggatttggcgatatgtcccatcagatcgttcgggtcgttgcggcgagtgccaagctgccaggcgcgcaactggttgctcaggtacatctcgccctgcccctgcaacggcgggaaggcctcccccacgccgctgccggccggaccgtgacaggtcacgcactcgggaatgttgcgctcccaggcgccacgcaccgccagggtctcgccggggctgcgcggggtggccacgcgcgacagctccaccagcttgggcgccggcattgccgcgagggtagtggcgagcgcctggatctcgtcgtcgccgagagcatcggctatgcccttcatcaccgggtgctcgcgactgccgccctgcttgaggtcgtgcagctgcttgctcaggtaggcggcgggaaggcccgccaggcgcggaaagccggcggcggccaggcccatgccatcggcgccgtggcaggtgacgcaggccgcggcggccgggttggcgccgccctgtgtgtagagtttctggccgtcgacgacggcctgggccgtcgccgccagcaaggcggtcaatga

SEQ ID NO: 15801 - DNA, 636 bp, Pseudomonas aeruginosa
aaacagcagtcggtgtgcaaccggcatggcagggttcctctctggcttattgtttttagttctaagtttagaaccaaaaaacctatcgccgaaagaccctaccgcacgcaggtctacatcattttccctacaggccccggatcacgcccctttcagctccgcgacgatttcgcaagagcgcagccgatgggcgtgctcgtagaagtcgctggtgaagataagctcgtcggcgccggtctgctccaggaggatctccagacgcgcacgaaccttctccggaccgccgatcaccgccaggccgaagaagctgccgaccgcatcctgctcgtggggcagccacaacggcgccatactttccaccggcggcttctgtttcaggctctcgccgcggatcagcgccagcacgcgctggaaggcggtagtggcgaggaactcggcctcttcgtcggtaggtgcggcgatcagcggcacgccgatcatcgcgtaaggtttgtcgagtaccgccgagggctggaagttgctgcggtagatgcgcagcgcctcgtgcaggtaacgcggtgcgaaatgcgaagcgaaggcatagggcaagcctttctgcgccgccaggtgagcgctgaacaggctcgaaccgagtag

SEQ ID NO: 15802 - DNA, 1284 bp, Pseudomonas aeruginosa
ccagatcggcacctgggtaccctcgcccggcaccgccagcaggctctgctgggaacggcgcgggccgagcagcatttccagctcggcgacctgctcggggaagtcgtcgccgttgcccaggcggtcgcgacgcaaggcgcgcatggtcgcctggtcggcgccgggggcgcggccaaggccgaggtcgatgcggcccgggtagagcgtctccagggtgccgaagttttccgccaccaccagcggcgcatggttcggcagcatcaccccacccgagccgacgcggatccgcgaggtgccgccggcgatatggccgatcagcagcgcggtggcggagctggcgatgccatccatgttgtggtgctcggccagccagaaacggttgaagcccaggcgctccacatggcgcgccaggtccagggagttgtgcagggcttcggccacgctgccgccggtgcgcaccggcaccaggtcgagcatggacaggggaatatcagcaagcgttgtcatgaaagctccaatcggcagcgggcgatggccggggcgcgagacacgcgcggaaggacctcgcccggggtttggatcaattctatatcacgcgttatagtttttgcccacggagaatccatgggctttttccagccaaggcgcgctgtggcgtcaggcggcctcgaccgccagcagggaatcccaggccgccatcgcgcagcggccgatggccagcaactgctggcggctggcgccgtcgcgggcctggatcgacaggccctgaagcacgctgctgtagaaactggtgagcgcgtcgagatcggctccggccggcacgtcgccgtcggccacgcctcgtgcgaaacgctcgcgcagcaggcgcgcggcgcgccgccggtgatcgcgcaggtagtcttcgacgcctttgttggccggcgagaaattggtcgtgctgaggtcgaccaggcaaccgcgcggcttgccttcggtggtgtagctgacggcggcgctttccagcagcgcggcgatcgactcgcgcgccgtcggcagggcgaaggcgcccttggaaagctggcactcctggctcaggtagagttccaccgccgaacggaacagcgcctccttggaaccataggcggcatacatgctcggcgcgcagatgccacccatggcctccttcagcgcggccatggtcgcgccttcgtagccggcctcccagaacacgtcgagcgcccggcgcaatgcctgttcacgatcgaagccgcaggggcgtccacgcttggccatgggaattcctga

SEQ ID NO: 15803 - DNA, 957 bp, Pseudomonas aeruginosa
tcgaaagctgcatcgacgactgatacctccagtgcccgtgtgccgctctcaggagcggccagcggcgttttcccaatccgccaccagcgtccgcagtcgcgcgtcgcgcagttcgaagagttccagcagccccagtgcccggatcgccggcagcagggcgcgcaggtcttcttcagcctgccgccgttgcgccgcgggcagttcctcctcaagcagcagccgggcgttggcgatgaacgcgccgacgctgcccttgcgtatctccacgccgcccaggcggatgcggtcctgtcggtcggaaaggatgtcttcggctttcatggcgtgctccaagcaagaatgatgagccgccaggctacatccgcagtcgaatggcctattatccatcccgagccaatcatcgtcgcttttccgccaaatgtttccgaaacccctgcccgtcccgctcttcgccctgcgcatcgaccgcgcagccagccgcacggcctcccaccgccatgcctgcggccagctctactgcctggagcgcggccttctggtggtcgaggacgagcatggccgccaggccctgcctccgcgccagatcgcctggatcccaccgggtcacccacactcggcgcactcccacggcagcctggcgggctggagcgcctacctcgccgccgaacactgccgcgacctgccccggcaccccggcgtgctcgcctgctcggctttcgtggcgctgatcgtcgaacgcgccacccgctggccgaccggctccgcctggagcaccgaacgcgagaacctgctgcgcgtgctgctggacgaactgcgccacgccgtgccccagcggacccgcctgccctatccgggggattcgcgcctgcgcaggatcgccgaggcattgatggccaaccccggcgatccgcggccggcggccgaatgggcacgctgggcgggcctcagcagccgtag

SEQ ID NO: 15804 - DNA, 1068 bp, Pseudomonas aeruginosa
cctgagccggctgttcggcgccgagaccggcatgagcttcgcgcaatggcggcaactggcgcgactgcacgcggccgtcgaacggctggcagcgggccaggcggtcggcgagatcgcctggtcgctcggctacgaaagcccgagcagcttcgccagtgccttccgcgcagtattcggcgagacgccgtccggctattccagtcgcgccaacgaagcgctagcctgaaccttccgcgccacgagcctttccccatgagccacgccaatacgccccgcgactgggttcgacgcgccccgcaacacggtgcggtggaacgcatcgaggcttacttcgccggccacggctacgatccgcatcgccacgacacctatgccatcggccagaccctggccggggtgcagagcttccgctatcgccgcagccagcgccacagcctgccgggcggctgcctggtgctgcatcccgacgagctgcacgacggcgaggccggcagccaggaagggttccgctaccggatgctctacgtcgagccggcgctgatccagcaggccctcggcggccggccgctgccgttcgtgcgcgggggcttgtccgacgacccgcgcctgatcgccgccagccggaccctgctacaggccatggataccccgctggagccgctggaagaacaggacgccctgttcgaactggcccacgccctcgacgccgtggccggcaaccgggcgcgcggcaggcgccacttcgacttcgtcgccgccgagcgcgcccggcagtacatccacgcgcacctggagcgcccgctgggcctcgacgaactggcgcaggtcgcccagcgcgaacgctggagcctgtcgcgcgatttccgcgcgctgttcggcaccagcccctaccgctacctgatccagcgccggctggacatcgcccgccggctgatgctcggcggccagacgctggccgaagccgcgcttgccgccggtttcacagaccagagccacatgacccgccatttcggccagagctacggcctgccaccggcacgctggctgcgtatgctcggccgcgcctag

SEQ ID NO: 15805 - DNA, 570 bp, Pseudomonas aeruginosa
tcgacaagttcttcgagctgcgcatgctccagttgcagggcgagcgcctggccgacatcgtgctccaggccccggaggtcagccacggcgacatcctcccggagaacctccgcgagcgcgaggcgagcatcgagatccagggcctgcgctaccgctacgcggaacaggagccctgggtcctcgacggcctcgacctgcgcatcgccggcggcgagtcggtggccatcgtcggcccctcgggctgcggcaagagcaccctgctcaacgtcctgctgggcatcctcccgccagtggagggacagatccgcatggccggcctggaccttgcgcaactgggcctggacggcctgcgcgaactggtcggcacggtgctgcaggacgacgtgctgttcgccggttcgctcagcgacaacatcagtttcttcgacccgcaaccggacatgccctggctgctgcagtgcgcgcagatggctgccatccacgatgacatccaggccatgccgatgggctacaacaccctggtcggcgacatgggcacggtgctctccggcggccagaagcagcgggtga

SEQ ID NO: 15806 - DNA, 1038 bp, Pseudomonas aeruginosa
gcctcgacgaaagcaccgcgcgcctggccgaacgccaggccgtcgcggcgcgggagcaggcctgatgcgtgccttcgccggcctgttgtgcggcctgctcggcctggttcccggcgccgccgcctacgagccggacgtgttcggcaccgccggccaggtcgccggccaggcggtctacgacctcggcggcagcggtttgccctgccgcggcgggccgccaccgaccgagctgagcctggaggaagccatcgagcggatcctctgccacgacccgcagacccgcctcgcctgggccaatgccaaggcccaggcggcccaggtcgggatcggcaagtccgcctacctgccgcgcctggacggccgtctcgacgccagtcgcggctacagcgacatggattatcgcgatgccccctacctctccggcgacggccatcgccaccggcgtggcgccagcctccaattgagctgggtgctgttcgacttcggccgccgcagcgccgccctgcgcaacgcccagcagttgctgctggcggccaacgccagccaggacgcgaccctgcagaacaccttcgccctcgccgcccaggcctactacgacgccctcgccgcccagcgcagcctggccgcctcgcgtcaggtcgcggagctggcggcgcagaacctggaagccgccgacgccaagtaccgggccggcgccgccgccctttccgatcgcctgcaggcgcagaccgcgctgtcccaggcgagcctcgcccaggtccgcgacgaaggcgccctgagcaacgccctcggcgtcatcgccctgcgcatgggcctggcgccggataccccgctgcgcctctccggcgagctggaggcgcaacccgacaccggcttcgtcaaggccatcgacgagatgctcgccgaagcccgccgcgagcatccggcgctgctcgccgcccaggcgcggctgaaagccgccgccgcctcggtggaggaaagccgcgccgccggccggccgagcctggcgctgagcgccaacctggcacgcagccatag

SEQ ID NO: 15807 - DNA, 1428 bp, Pseudomonas aeruginosa
cgaccaggcgatggcgttcaacggcgatacccgcgaacgcgaccgcagcatcggcctgcaactgaacatcccgttgttcgaaggcttcgaacgcacctaccaggtccgcaacgccctggcccgccgcgaagccagcgaagcggagctggccgacaccgagcagcaggtttcgctggaggtgtggaacaactaccagtcgctcagcgtcgagacccgcagcctggcgcgcacccgcgaactggtcgaacagtcgcggcaaagcctggaggtggtgcagggccgctaccgctcaggggtcggcagcatgatcgagctgctcaacgccctgaccgcctacgccagcgccgaggaccagcacatccgcgccctcggcaactggcagacctcgcgcctgcgactggcggcgagcctcggtcgcctgggtttctggagcctgcgctgaaaagcccgggaagcgccgccgctctctacctctcgcgcttgtccggctggccgccatcgcgcaggatgcacccagcccccgcgacgagagaccgcatgatcgacgacatccgctacctgatcgtattcgccaagatcgccgagaccggctccgtctccggcggcgccgaggcgctgggcctgagcgccgcgaccgccagcctgcacctgtccaggctggaacggaacctgggccgtgcgctgctctaccgcaacagccgcaagctgtcgctgacccaggacggcacgcagttgctggacaccgcccgctccatgctggaactctacgagaagggcttcatcgagttccgccagcgcgccgtctcgacccgcaacagcctgcgcatctcgatgcccgcggtgtttgtctacggcgacttcacccgtcacctggcagccttcatcgaggagcatcccgacctcgacctcggcatcgcatgcgacgacagccgccacgacatcatcggcgacggcatcgacatcgccttccgcatcggcgacctgccggacagctcgctgaaggcccgtcacctgttcctgctgccgcgccaggtagtggcggcaccggcattcctggcccggcacgcgccgctggaacacccgcgcgacctgcagcggctggaatggatcgggctcggcatgcgccccgacagccggctattccgtcatgcgcgggacgacgaggaggtacgcgtcgactacaccccgcgggtgcgcgtcgacagcgtcgaagcctcctgccgcctggcccgcctcggcgtcggcctggccgcgccgccgacctacctgagcgacgagccgatccgccgcggcgagttgcgcgcggtgctgccggaatggcgcctggagccgttgaaggtgtatgcggtgtggccgcccaacgtacccgccagcagcatcgcctataccctcatcaatcgcctctacgaggccttcaatccgggctag

SEQ ID NO: 15808 - DNA, 486 bp, Pseudomonas aeruginosa
cgccgccgcacagcgcgcaggcgtagcgcaacacatgccgcaactggcggacattgcccggccagcgatagccgagcaggcattccagggctgcctcgccgagttcgatgcgtacgccgcagtgcgcggtttcctcgtcgaggatgcgccggatcagcgccagccggtcgctgcgttcgcgtagcggcggcagttcgaagcgggcgccgccgaggcggaagtagagatcctcgcggaagccgccggccgccaccagcgccgccaggtcgcggtgggtggcgcagatcacctggatatccacagcctgccggcgcgcagcccccagcggcgccacctcgccctcggccagcacgcgcagcaggcgggtctgcaggcccagcggcatctcaccgatcctcgtcgaggaacagggtaccgccatcggcctgctgcagcaggccgcgcatccctttcgccgccgcgccggtaaaggctccgccaacgtag

SEQ ID NO: 15809 - DNA, 804 bp, Pseudomonas aeruginosa
agcatgcacgctacgtcgtccgacgatttctccctgtcttcccgggtcgcgctggtgaccggcgccggacgcggcatcggccggggcatcgccctcgccctggcgcgcgccggcgccgacgtggcggtggccgacctcgatccgcaggtcgccgaggaaaccgccgccgcgatccgcagcctcggtcgccgcagcctggcccttggggtcgacgtcagcgacggcgacagcgtccgggcgatggtcgagcgggtcgccacggagttcggccggctcgacgtggcggtgaacaatgccggggtgatcagcatccgcaaggtcgccgaactcagcctcgccgactgggaccgggtgatgaacgtcaacgcccgcggcgtgttcctctgctgccaggccgaactgccgctgatgcaggcgcagcgctgggggcggatcgtcaacctgtcatcgatcgccggcaaggtcggtctccccgacctcgcccactactgtgcctcgaagtttgccgtgatcggtttcagcaatgccctggccaaggaggtcgcgcgcgacggggtgacggtcaacgcgctctgcccgggaatcgtcggcaccggaatgtggcgcggcgaggacggcttgtcgggccgctggcggcaggccggcgaaagcgaggcgcagtcctgggaacgccaccaggccagcctgctgccccagggcgaggcgcagaccgtcgaagacatgggccagctcgtcgtctacctggcctgcgcgccgcacgtcaccggccaggccatcgccgtcgacggcggattctcgctatga

SEQ ID NO: 15810 - DNA, 381 bp, Pseudomonas aeruginosa
tcgccgtgctcggcggcgacggcacgcacaaggcagtggccgccgaggtcggcgacgtccccctgctggcgctgtccaccgggaccaacaacgccttcccggagctgcgcgaagccaccggcgcggggctcgccggcggcctctgcgccagcaaccgggtgccgccggagatcggcctgcgacgcaacaagcgcctgctggtgcgcgagccgcgccgcgggctctgcgagtgggcgctggtggacgtcgcggtgtcgccgcagccgttcatcggcgcccgcgccatcagtcgcgccgaagacctcgccgaagtcttcgtcagcttcgccgaaccccacgccatcggcctttcggcgctttgcggactgtggtcgccggtga

SEQ ID NO: 15811 - DNA, 2058 bp, Pseudomonas aeruginosa
ccccgtgaagacaacctggagaacaacaagatgtccactctgagcaccgaccaactgctccatgcctaccgcgtgatgcgcaccatccgcgccttcgaggaacgcctgcacgtcgagttcgccacgggcgagatacccggcttcgtccacctctacgccggcgaggaagcctccgccgccggcgtgatggcgcacctgcgcgacgacgactgcatcgcctccacccatcgcggccacggccactgcatcgccaagggcgtagacgtgcacggcatgatggcggaaatctatggcaagaagaccggggtctgccagggcaagggcggctccatgcatatcgccgacctggagaaaggcatgctcggcgccaacggaatcgtcggcgccggcgcgccgctggccgccggcgccgcgctggcggccaagctgaaaggcagcgatgcggtggcggtggccttcttcggcgatggcggctccaacgaaggcgcggtgttcgaggcgatgaacctggccgcggtgtggaacctgccgtgcctgttcgtcgccgagaacaacggctatgccgaggccaccgcggcctactggtcggtggcctgcgaccacatcgccgaccgcgccgccggtttcggcatgcccggggtgaccgtcgacggcttcgcacttcttcgccgtccacgaggctgccggcgccgccatcgagcgcgcccgcgccggcgaggggccgtcgctgatcgaagtcaagctgacccgctactacggacacttcgagggcgacgcacagacctaccgcgatcccgacgaagtaaagcactaccgggaaacccgcgactgcctcaagcagttccgcgaacgcacctgccacgccggcctgctctccgccagcgacctggacgccatcgacgccgaggtcgaggcgcgcatcgaggatgccgtgcagcgcgcgaagaacgatcccaagccggagccggacgacctgctgcgcgacgtctacgtgtcctatccctgagccgcccgaaaacaagaacgaggagaaccatcatggcgagaaagatcagctaccagcaggccatcaacgaggcgctggcccaggaaatgcgccgcgacccgagcgtcttcatcatgggcgaagacaatgccggcggcgccggcgcgcccggcgaggacgacgcctggggcggcgtgctgggggtcaccaagggcctctaccaccagttccccggccgtgtgctggataccccgttgtcagagatcggctatgtcggcgccgcggtcggcgccgccacccgcggcatgcgcccggtgtgcgaactgatgttcgtcgacttcgccggttgctgcctggaccagatcctcaaccaggccgccaagttccgctacatgttcggcggcaaggcggtcaccccgctggtgatccgtaccatggtcggcgccggcctgcgcgccgccgcccagcattcgcagatgctcacttcgctatggacccacatccccggcctcaaggtagtctgcccgtcgtcgccctacgacgccaagggcctgctggtccaggcgatccgcgacaacgacccggtgatcttctgcgagcacaagctgctctattcgatgcagggcgaggtacccgaggagctgtacagcgtacccttcggcgaggcgaacttcctccgcgacggcgacgacgtcaccctggtgacctacggccgcatggtccacctggcgctggacgccgccgccagcctggcgcgccagggcatctcctgcgaagtactggacctgcgcagcaccagcccgctggacgaggacagcattctcgaaagcgtggaaaagaccggccgcctggtggtggtcgacgaagccaacccacgctgctcgatggccaccgacatcgccgcgctggtcgccgaacgggccttctccgcgctgcgcgcgccgatccgccgggtcaccgcgccccatacgccggtgcctttctccgacgccctggaagacctctacatccccgacgcggcgaatatcgaggcagccgtgcgccaggccctggaagggagggacgcggcatga

SEQ ID NO: 15812 - DNA, 1452 bp, Pseudomonas aeruginosa
agccgcaactggtgcagttgttctccgaccccgcgctggtcacccggcagatgctcgaggacatgctccgctacaagcgcctggaaggcgtcgatgcggccctgcgccagttgctggacaacctgttcgccgacggtcgccagcgcaacgacctgcgtgccgtggcgagcgagggccgccagccggtcctggcgatctggggcagcgatgacgcgatcatcccggcgcggcatgccgagggcctgccagcccaggtggagatcattcccggacaggcgcacatggtgcagatggaagccgccgagcaggtcaaccgcctgctgctcgacttcctccgccagcattgaggagacgaccgacatgaacagttccccgcaagccaacgcggcgatgcgcgccgccgtctggcacggccgccacgatatccgcgtggaagacgtgccgctcccggccgagccgccgcccggctgggtgcagatccgcgtgcactggtgcggcatctgcggctccgacctgcacgaatacctggccggcccggtattcatccccgtggaggcgccgcacccgctcaccggcctcaaggatcaatgcatcctcggccacgagttcagcggcgaaatcgtccgcctcggcaacggcgtgaccggcttcgccgtcggccaggcggtcgccgcagacgcctgccagcattgcggcacctgctactactgccggcatgggctgtacaacatctgcgagaacctggccttcaccgggctgatgaacaacggcgccttcgccgaatacgtcaacgtaccggccaacctgctctacgccctgccggccggatttcccagcgaggccggcgcgctgatcgagccgctggcggtgggcatgcacgcggtgaagaaggccggcagcctgctcgggcagaacgtggtggtggtcggcgccggcaccatcggcctgagcaccatcatgtgcgcgcgcgccgccggcgcggcacaggtgatcgccctggagatgtcctcggcgcgcaaggccaaggccctggaggtcggcgccagccaggtgctcgacccctcgcggtgcgacgccctaggcgaaatccgcgccctcaccggcgggcttggcgccgacgtcagcttcgaatgcatcggcaacaagcacaccgccaagctggccatcgatgccatccgcaaggccggcaaatgcgtgcttgtgggaatcttcgaggagcccagtgaattcaatttcttcgagctggtttccaccgagaagcagttgctcggggccctcgcctacaacggcgagttcgccgacgtgatcgccttcatagccgacggccgcctcgacatcgcaccgctggtgaccggtcgcatcggcctggaggaaatcgtcgagcgcggtttcgaagagttggtgaacaacaaggagcacaacgtgaagatcatcgtctcgccgggcggctga

SEQ ID NO: 15813 - DNA, 477 bp, Pseudomonas aeruginosa
cgcccgcgcgccaccagctcggccaccgtgatgccatccggcgccagcgcgctctgcggcagcaggccgagacgccgcgccacttcccgtcccggcaggctgtggatatccctgccgtccagcaccacccggccctcggccggcgccaacaggcgcgacaatgccgccagcagggtcgacttgccgcaggcgttgggcccgacgatcacactgaacgaaccctcggggatggccagcgagagattccgcgaaacggtccgcgcgtcgcggcgcaaggtcacggcgtccgcgtgcaggcgatgggtcatgggaggttcctggataagaatggctcgaatatgtggaatcgattatacattatggaatagactgcatgagaagcattatcatatgaatccgtccgcccggcttcccctacagcgaaaacagccttcatgccgacccgccgccgctccgccctgccgttactcgccctga

SEQ ID NO: 15814 - DNA, 1101 bp, Pseudomonas aeruginosa
gccgcctgtgaacggtctccacgccctgcgcctgggctccctgtcgctgcgttggcggccacgggcggcgctggcctgcctggtcctcgcgggggtcggactggcgctggcggcggcgctgctggggaccggcagcctggcgctgggcccggcagaggtgttcgccagcctgctcggccagggccaggaccccaccgcccagcgcatcgtccagcgcgtacgcctgccacgggtgctcaccgcctgcctggtcggcgccgcgctgggcatggccggggcgatcttccagtcgatctcgcgcaatccgctgggctcgcccgacgtcatcggtttcaccaccggcgccgccagcggcgccatcgtgcagatcatcctgttcgatgccggcccgctggccacctcgctggcggcgctggccgccggcctctgcacggcgctggcggtggtgctgctggcgcgccggggcgccaccgccggcggctaccgcctggtgctggtgggcatcggtgtcggcgccagcctgtcgggcctgaacagcctgctgctggtcaccggcaacctcgaccaggcgatgtatgcccagctctggctggccggctcgctgaacacccggacctggtcgcacgtcgtcccggcagcgctgggcctgctcgccaacgtgccgctggcgctgtaccacggtcgtcgcctggaattgctggagctgggcgatgccagcgccgcccagctcggcgtggcggtggagcgcgtgcgcttgcagatggtcctggtcgccgtcggcatgaccgccatcgccaccgccgcggccggccccatcgccttcatcgccctggccggcccgcaactggcccggcgcctgacccgctcggccggggtgccgttgctgtccggcgcattgatgggcgcggtcctgctgctggccgccgacctgctcggccagcgcctggcatacgtcgccaacctgccgatcggcctgatgaccggcctgctcggcggtttctacctgctctggctactgatgcgcagccgccggatttgagccccggcctcaacgaccgcccaggctgccgccgccgtcgacaccgatcacctggccggtga

SEQ ID NO: 15815 - DNA, 477 bp, Pseudomonas aeruginosa
acgcggtggtggtgcgcaatcccgatgcgctggccgaagcgcaggcctccgacgcccgccgggcgcgtggcgagcccctcggtccgctggacggcattccctacaccgccaaggacagctacctggtcaagggcctcaccgcggcttccggcagcccggcgttcaaggacctggtggcccagcgcgatgccttcaccgtcgagcgcctgcgcgccgccggggcgatctgcctgggcaagaccaacatgccgcccatggccaacggcggcatgcagcgcggcgtctacggccgcgcggagagcccgtacaatgccgcctacctcaccgcgcccttcgcctcggggtcctccaatggcgccggcaccgccaccgcggccagcttcgccgccttcggcctggccgaggaaacctggtcgagcgggcgcggcccggcgtcgaacaacggcctgtgcgcctacaccccttcgcgcggggtga

SEQ ID NO: 15816 - DNA, 504 bp, Pseudomonas aeruginosa
ccttcgccggccgcgcctacgacgactcggcgctgctgcgcttcgccgcggccttcgagtcgaccggctcgcggcgtatcgtgccgccgcgtactccaccgctggcaagcaagtgaaaggcgcgggcggaaggcttcgcgtcttgcgcccacgctcttccgttcaagggagttatcgatgcagcgactcttcgtctacggcagcctcggccccggccgtcccaacgaacacctgatgcagaagatcggcgggcaatggcaggcggccagcctccgcggtcgcctgctggaaaagggctggggtgccgggatgggctttccgggcctggcgatcgacgccgacggcgaggaaatccacggccatgtgttcgtctccgaccgcctcgccgagcactggcccgcgctggatgaattcgaaggcaccgaataccggcgcgtggcgacccgggtaacgctggccgacggcgcccaggtcgatgcctacgtctacgccctgcgcgactga

SEQ ID NO: 15817 - DNA, 1257 bp, Pseudomonas aeruginosa
cccgccggccggcacgcgcggctcgaccaggccgcccagacgcttgcccacccgctccgcgaggaatcccaggcgctcgccgtagagattgcgcatgccgcgcacataggcgccgaaatggccgccggcgatgaagcgcgccagggtcagttgcgccagcgaggcgttgtgcccgtcctgcagggagcgggcgacggtcatcggcgccaccagcgccggcggcaggaccatgtagccgatgcgcaggccgggaaacagcgacttggtgaacgtgccgatgtagagcgtccgctcgtgggcgtccaggccttgcacgcaggcggtgggccggccggcgtagtggaactcgctgtcgtagtcgtcctcgatgatccatgcctgctgccgctgcgcccattcgatcagcgccaggcggcgctccagcgacagggtcacgccggtcgggtaatggtgcgacggggtcaggcacagcgcccgcgctgcctgcggctgggcgaggatcggctcgggccgcaggccctgttcgtcgaccgggaccggcaggcactccaggcctgcggcctcgaaggccttgcgcgcgccgtagtaggccgggtcctcgacgaatatccgctcgccggcgtcgagcagcacgctggcgcaaagacccagcgcctgttgcgaactggtcagcaccagtacccggtcggccgtggcgcgtgcgccacgctccaggttgacgtagtcggcgatcgcctggcgcagcggttcggcaccctgcgggtcgccatgggtcagggcgcgcgcgccgtattccttgaggacctggcgctgcaggcgctcccaggtcgccaggggaaaggtgcgggtctccggcacgccgggagcgaaggggcgcgggacgagctgctcgcgaaccccgccgccagcctgcatcgcctcgccacgccggctcagtcgcggcgcgccgccgccccgtcgtggagcgcccgcgccgcgccggccgggggacagccgggtagccgcggcgaccacgctgccgctgccgacccgacgctcgatgaagccctcggcatgcaggtgcgaataggccgcttcgacggtgtcgcgggatacccccaacgactgcgccagcgcccgcgaggccggcaacggattgcccggcgccagcgcaccgtcgaggatcagttggcggatcgcgcgctggattcgcgcatgcagcggcagggcctggagctgtggatggaggaggcgcgccttgaccgactcgagcagtga

SEQ ID NO: 15818 - DNA, 1170 bp, Pseudomonas aeruginosa
ccttcccgcccagcccctggccgcatccctcgagcaattgcagggcgccagcggcctgcgcatccgtttcgaccgcgcggccgtggccgaccggcgcgcaccggccctacgcggcacgctggagccaagcgaggcactgcagcgtctgctcgcaggttccggactgagcggggaggtacggggcggcgacgcctgggtcgaggccgcggcgacaggtgccggcatctcccccggcgacagcgtcgacctcggcgcgctcagcgtggtcgccacccaggacccggccaccgccgccatcaccgaagacagcgggtcctacaccacgcgggcgatgcgcacctcgaccaagctggcgatgtcgatccgcgagacccctcagtcggtcagcgtggtcacccgccagcgcatggacgaccagggcatgcgcgacctcaacgacgcggtgaaggggttcaccggcctcaccgttgcaaaagtacgggccggccccgggtgaaatacgcggcgcgcggctttggacgtcgaccacatcatgtacgacggcctggccgacgagcatttccacctaatacccaggacgtcatttccgccgccgacctggccatgttcgaccgcgtcgaagtggtgcgcggcgccaccggactgatgcagggcgcaggcaacccggcggcggcgatcaacatggtgcgcaagcgtccgacccaggacttccgcgcctccctgcaaggcagcgtcggcacctgggaccgctatcgcagcgaggccgacgtttccggcccgctgaacagcgaaggaaccctgcgcggccgcgcggtggtcgcctaccagaaaggcaacagcttccaggaccacgtcagcagcgaacgcggcgtgttttacgggatcgccgaagccgacctgagcccggacaccaccttcgccatcggcgcctcgaaccagaacgacaaccgcaacgacaactgggtaggcctgcccagcccgctgggcggccgccacctggacctcaagcgctcgtcctattacggcgccgactggtcctactgggataccgacaccacccacctgttcagcgacctgacccaccgcttcgccaacggttggcagatgaagctggccgccgacaagctgtgggcgcgaatcaacatgctcgggctgtacaacgactgctag

SEQ ID NO: 15819 - DNA, 348 bp, Pseudomonas aeruginosa
tactcgaccaccgggtgcgccagcatgacccagaaccccggcgactacaggtacaccgacgaccacgacagctatgacgcctatgccaacggtcccttccagttgctcggccgcgagcacgagctggtggtcggcgccagctatcgccaggaacgcttcgacggccacggcgggtggggcagcctgttcaacaaggacggcacccccaccgggccgatggacccgacccagtgggacccgaggtcgactctcaagccgaggctgaacaccagcctgtggggcatgaagctcgaccaggaacagaaaggcgcctacctcaccacccggttgaacctcgccgacccgctg

SEQ ID NO: 15820 - DNA, 1158 bp, Pseudomonas aeruginosa
tttcaggttggcgtcgagcaggcccttggcgctgacccgtccctgttggccgttgtccagctgggcggccaccagggtgatgccggcgttgctgccgatgccgccgttgcggctgttgtccagcacgccggtgcggatatccaccgcacccttggcgctgatcacgccggtacggctgttgtcgaggctggcgccctgcagcgtcacgccggcatcgctgagcagcctgccgccctggttgtccagcgcggcctggttggtcagcgccagcgcaccggcgctggagaaggtcccgccacggttgtccaggcgcgcggcgcgcgccgtcaggctgccttcgctgaccagcgcgccgccctggttgtccagcacgccgccgaggctcacgctcaggctgttctggctgtcgagccgaccgccgtcgccgttgaacagttcgccgccgtccaggctcaagccgtcgcgcccggccaacacccccttggcctggttcagcaggcgctgcacggtgaggcgcaagccgctgtcgccgatgaccttgccgccgcggttgtccagttgctcgcgggcgttcacggcgaccttcgaggtgctggaaatctcgccggcgcggttgtcgacctgccgcgcctcgatagcgatgccgccattcgcggcgatcagcccggactggctgttgtcgagcacgtcggcgcgaaggtccaggctcccctggctgaccagctcgccgccttgctggagcagcgtaccgaccgccgcctccagcacgcctctggcggcgatacggccttggttgccgttgctcacctggtcggctacaagctccaggcggccttcactcaccaggctgccttgttcggcgttgtccaggctggtcacgctgatacgggcatcgcccttgctgccgatggttcccgcacggttgtccaggacctgagactcgatggccagtccgtcggtcgccaggacctgccccttgagactgttgtccagtgtcttggcgatgcgcagggtcaaagcttcgctgctgatcagccgcccgccctgattgttcagtgtgttggcggcgagggtgaaagcacggtcgctggatatctctccgccgacgctgttgtccaccatgccgagttggcgcagcaggagcgcgccaggcgttga

SEQ ID NO: 15821 - DNA, 801 bp, Pseudomonas aeruginosa
ttgcccaatacgccgtccagaatgacgtcgatgctttgctggctgctgagcaggccgccgttgccattgaacagttcggcgccattcaggcgcagcccatcacgactggcgagtaccccgccgtcctggttgagtacccgtggcgcggcgaggcgaagtccgctatcgccgatggccttgccgcctcggttgtccaactgctcggcgacgtccagtgtcacctggcccgggctggcgatttcgcccgcacggttgtcgatcctccgggcggaaacggtcaggttgccatcagcactgaccagaccgccgctgcggttgtcgaggctatcggcctcgagcatcagcgcaccctcgctgctcaattcgccacccgcctggttaaaggctgtcacgctggcgtgcaggtcacccctggccgcgatccgtcccctgacactgttcgctcgctcggcagtcagtttcagacgaccttcgctaagcaggtcgccgtcatcgttttccaaacgggacacgtcgatatcgacggcgcccttgctgccgatggagccactgcggttgtccagggcaagcgcccggatatccaggcctccggtgccggagagaacaccttcgaggctgttgtccagagcctgggcgatgcgcaacgtcagtacaccgccgctgcgcaggcggccaccctggttggtcagcgcggtggtggtgagtgtgaaggctcggtcgctggaaatttccccgccgctgttgtccaccatgccgagttggcgcaggagcaaggttccaggcgtggcgatcaggccctga

SEQ ID NO: 15822 - DNA, 1227 bp, Pseudomonas aeruginosa
ctggaacggctgcaggtagctgagggtcaggctgtacttgtcgtagcgcgcattcgggtcgcccgcctgcgggtggccgcgaccctgcgcgccaagggcgccgatgccctgctgccagccgaggtcgaggttgacgaaaccgctgccgatccgccggccatggttgaagccgagctgggtctcggtgatccgcgtgctctggtcttccaggcgggtgtcttcgacatagttgttggtgcgctggtggctgagccccaggctcatggcggtcttgctcacaccgtcgcggtgcagcacgcgttcggcgcggaactggtggctgcggctgtcgccatcgagcttgaaggggaagccgctggcctcgttgcgcgtgcggtagtcgctctggctgtagccgtaggtgaaggtccaccagccccagggcaggctgtagaacaggctctggctgtcggaatggcgccagcggtcggtcaccgcgtcgcggttggcgcgcaggttgagctggtcggccaggcccagcgggctgtcccagtccaggcccaggcccatctgctgctcgccggtactgacgtcgccgtcgttgttgcgcgtggcggagacccgccagggcttgtcgcgctcgcccttgagacgcacccggctgccgccgacctcgctgccgggcaccagctccaattgcgcctggcgcgacggcaggcggctcaactggtcgaccagttgctccagctcgcgcaggtcgagcagctcgccggtcctgcccggaaagctcatcgtcagttcgcgcgggctggccagcgcggagctgtccaggccctccaggcggccttcgacgacgatgatgcgcagggtcccggaggccaggtcctgctgtggcaggtaggcgcgggtggtgacgtagccgcgatccaggtaatggtcggtgacggccttgagcagcgcattgagctggccgacgcccaggcagcgcccctggtagggcgccagcagttggcgacgcgcgctttcgccgaggtgcccggcgccttccagctcgatgcggcggatctcgaagcagcgctcgtcgtcgccggaggcatccgcagcggcgggcgctcccttgccgggcagttgctggagttcctccaggcgcttgcgctgttcgtccagcaggcgctgctggcggtcgcggatcaggtcgcggtcgccgggggaggtgaagggggcggcgctggcaagcagcggcagtaa

SEQ ID NO: 15823 - DNA, 318 bp, Pseudomonas aeruginosa
agtagcggttcagcttgttcggctcgctggcgctccagccgtaggcgtagacctgcgacaggtcgacgtcggagtccaggtagcggaagttctgccgcgccgaccagacgtcgtcgatgcggtgctccaactggtagccgaacatccgctgggtgcggtcgaagtcgtccttgctcggctcgccatcgaagaactcgcgggagatgtgccggccgttgtggtgcgacagggtgccgtcggccggtacgccgccgtggtagcccccgttgggatcgtgttgcaggtagccttgcagggtcagggtggtgtcgtcgctga

SEQ ID NO: 15824 - DNA, 819 bp, Pseudomonas aeruginosa
ctccaggcggtaggccggcggctgccggccgccctgggtcagggccatgtcgagcttgctgcggatcggcgagccgggcggccagagaatccagtcgtatcgccgcacgtcttcccagtccagcgcggcggtctgggccatggggttaccggggcgcgccatcaccacgatcgcctcgctgtagagcacgtcgcagcgcaggctggcgcgcggcgcatagttgtccaggcgccccaccaccacatcgagctggcgtttctccagccgctcgagaaggccgttcatggtgccttcgagcagttccacctgggccccggggtagcgtccgaggaacgcccgcaatgcgcgcggcaccaggctcggcgcggaggccggcgacgtgccgaggagcacccggctgccgctgccgctgcgcatcgcctcgaggttctgccgcgcccgctccatctcggtgagtacgcgctgggcgtggttgaacagggtcatgccatagggcgtcgggcgcaggccacgggcgtgacgctcgaacagcggcgcgccgacgtcctcctccagttccttgagccacttcgacaggcccggttgggtggtgtgtgcggcccgggcggtgccgctgaggttgccggtctccatcaggctgaccagcagttgcaggtgttgcaggcgcaggcggcgggtccagtccatcgcaagccatcctcaaatacgtataggtcgatgtctaaatatcattattcggttatgccttcacctcgaataatgactatcagaccgaggcggccccgcctcctcccgccggagattcatcggtatgcataa

SEQ ID NO: 15825 - DNA, 1056 bp, Pseudomonas aeruginosa
cgacaattccaccgagaagcgcgccgacttctatcgacgcatccgccagcagcacctcaccccgctctgggaagccctgcacagcctggtcccggcgcaacccgccggcggctgccaggcggcgctgtggcgctatcgcgaactgcgcccgttcctgctcgaggcaggcgacctgatcagcgccgaggaagcggtgcgccgcgtgctggtgctggagaacccggaccttcccggccagtcggcgatcaccccgagcctctacgccggcctgcaactgatcctgccgggcgagatcgcccccagccaccggcacacccagtcggccctgcgcttcgtcgtcgagggctacggcgcctacacctcggtggacggcgaacgcaccccgcatggagccgggcgacttcatcatcaccccgtcctggacatggcacgaccacggcaacccgcgccgccgcggaaggcggcgagccggtggtctggctggacggcctggacatcccgatgctgcgtttcttcggcgccaccttcgccgaaaaccatgatgaaccggtacagccgttgcgacgtggcgaaggcgacagcctcgcccgctacggcagcaacatgctgccgctgcgccatcagccgacgacgccgacttcgccgctgttcagctacccgtacgcgcgcagccgcgaggccctcgagcgcctggcgcgcctcgaacggcccgatccctgggaaggccacaagctgcgctacgtcaacccggccaccggcggctgggccatgccgaccatcgccacctgcctgcaactgctgccggccggcttcctcgggcagcccgcgcgcagcaccgacgccagcgtctattcggtggtggaaggcagcggcgtggcgcagatcggcggccggcgcttcgccttcgaggccaaggatctgttcgtcgtgccctcctgggccgagctgcgcctggaagccggcgccaccgactgcgtgctgttcagtttctccgaccgccctgtgcagcaggcgctcggcatcctccgcgaatcccgcgaaaccctcgcccactga

SEQ ID NO: 15826 - DNA, 2136 bp, Pseudomonas aeruginosa
aggacccgtcccatgaaccatctcttcgcgcccgaagcacccgtcagcctcaccatccatggcagcgaccagaccttcccggtgcggcgggtctactgcgtcggccgcaactacgccgcccacgcccgggaaatgggcttcgatcccgagcgcgagccgccgttcttcttctgcaagccggccgacgcggtggtcccggtcgccgccggcagcaccctggagctggcctacccgagccagaccggcaactaccactacgagatcgaactggtggcggcgatcggcaagggcggctgcgacatccccctggagcaggccgaggaacacgtctggggctacgcggtgggcctggacatgacccgccgcgacctgcagatgcgcatgcgcgagatgggccggccctgggagatcggcaaggccttcgaccgctcggcgccgatcggcccgctctaccctgccagccaggtcggccatccgcgccacgccgccatcagcctccaggtcgacggcgaggatcgccagcgcagcgacatcgaccagttgatctggtcggtggcggaaaccgtcagctacctgtcgcgcttcttcgagctgcgccccggcgacctggtcttcaccggcaccccgggaaggcgtcggcgcggtcgagcgcggcgagcggatgctcggcgccatcgacggcctcggcgaactcagcgtccgcgtggtctgacccaccgcccgcgcacggcgcgggcccaccctgcccttcatccgggctgtcgccacggcgacggccgaggaacgctcatgcctacgcccgacaagaacaacaagatcgacgtccaggctttcatcgatgcgcaggcggtttccgccttccagttgcgagtcctgtcgctgtgcttcctgatcgtcgccatggacggattcgacaccgccgccatcggcttcatcgccccggccctggcccacgactggcaactgagcccggcgcaactcagcccgatcctcggcgccgcgctggccggcctggccctcggcgccttcgccgccggcccgctggccgaccgtttcggacgcaagagcgtgctcctgctctcggtactgttcttcggcggctggagcctcgcctcggcctacgccggttcggtggaaaccctggccctgctgcgctttttcaccggcctcggcctgggcggggcgatgcccaacgcgatcaccctgacctccgaatactgcccgcgccggcaccgcgcgctgatggtcaccgcgatgttctgcggcttcaccctcggctcggcgctgggcggcctgctcgccgcgcggatggtcccggcgctgggctgggaaagcgtgctgctgctcggcggcggcctgcccctggcgagcctgccgctgctctgggcatgcctgccggagtcggtgcgcttcctcgcccgccgcgcaccggacgcggcgcgcctgcggcgcatcctcgaacgcctggggcgcctgcccgacggctgggccggacgcctcgaactgcccgccgacgagtccgacggcacctcgctcctgcggcagatcctcggcgccgagctgcgcggcggcaccctgctgctctgggccacctttttcatgggcctgctgatcatctacctgctgaccaactggctgccgacgctgatcggcggcaccggcttcagtctcggcgaggcggcgacgatcagcgccatgttccagctcggcggcaccctcggcgcactcctcctgggcagcgccatggatcgcttcgacgcgcaccgggtgctgagcctggcctacgtcggcggcgccctgttcatcctcggcatcgccagcctctaccacagcttcgccctgctggcgctgtgcgtcgccggcgtcggtttctgcatcagcggctcgcaggtcggcgccaacgccctggccgccgatttctatccgacccgcagccgcgccaccggggtcagctgggccctcggcctgggccgcatcggctcgatcgtcggctccctcagcggcggcgccctgctcggcctgggcctgggcttcagcggcatcctcgccctgctggtaatcccggcgctgctcgccgccgtggccgtgcatcgcctgggccggcgccgggccaggccttcttccgtcactctctga

SEQ ID NO: 15827 - DNA, 657 bp, Pseudomonas aeruginosa
acaggacttcccatgcagctctacagcttcttcaacagctccacgtcctatcgggtgcgtatcgcattggccctgaaaggcctggattaccaggtagtgccggtcaacctgcggcagggcgagcaactgcgcccggccgaccgccagcgcaacccgatgggcgcgctgccgaccctggtcgacgccgacggtcgccggttcagccagtcgctggcgatcatcgactacctcgacgccgtgcagcccgaaccgcgcttgatccctctcgacccactgcatcgcgcccaggcgctggaactggccctgctggtggcctgcgacatccatccgctgaacaacgtgcgggtgctcaagtacctgacccaggtcctcggcatagacgccgaggaccgccagcgctggtacgcgcactgggtcgccgagggcctggcggcggcggagaccctgctgaaccgacaccgtcgcggcgccttcttcgccggcgccgcagcgggcatcgtcgagtgctgcctggtaccgcaactggccaacgcccggcgcatgggctgtgtcctggcgccctacccggcgttgctcgaactggaggggcgctgcctggcgctcgaagccttccagcgcgccagccccgagcgccagcccgactacctcccggactga

SEQ ID NO: 15828 - DNA, 468 bp, Pseudomonas aeruginosa
tcctgcgctactcgcaggtcttctgagcgtcgccttccgggacgatcggcaagcgctccagggtgcggaacaccgagctgcgccgccagcgcaggtccgtcggttccgaggccagggcgaaacggcgacgcaccaggccgcgcaatgcgcattgcaattcgagccgggccaggtacgcgcccaggcagtagtgcggaccatgggcgaacgccacgtgctgcttggcgttcgctcgctgcaattgcaggcggtcgggggcggcgaacatctccgggtcgcggttcgccgcgaggaagctcagccagaccttctctccaggcggaatccgctggccgccgatctccacctcctccagggtgcaacgcacgccgccgcgcaccgcgccatcgaagcgcagcagttcctccaccgcgttcgccgccagctccgggcaccgccgcagcaggtcgagctggtcgggatgggtga

SEQ ID NO: 15829 - DNA, 744 bp, Pseudomonas aeruginosa
gatagaagatcgccggggtcgccgcggcgcccatcgacgccatcagttccatgttgccggcgagctgcttgcgcaccgccgccgggatcttcgccagcggcttcagggtgctggccttgcccgcctgctcatggtcgtgcagggccttctgcgggtccttgctggccagcagcgcagcggactggcttcgctgtcctcgcggatgatgccgaccatgatatgccgcaactgcaccttgccggcatccacccagggtcgcgcctgctcccagaacatggtgcagtacgggcagttcgggtcgctgcacaggtagaccacgcgcggcgcgtcggcacggccatcggcgatccaggcgatatgctccatcttctgccacatttccttggccagcggcgcatacaccaggcgctccagcggttcgcggctgaggtcattgccctgggcgtcgaacaggtggccggtgagtacgtgcttgccgtcgggcgtcaggtacagcgccatgccctggttctggtattcggcggcgtagccgcgcaggccatccggggcgtcgaagctgccgaggatgcgggcgcccttctcctggaccatgcggatcggcgccggcagctcctccgccgccgtggccaggccggcgttgaggagggtcaggcccaggccaagggtgatcaggttgcgcggcagtctcattcggaactcctggttgcgggggcggcagcggccggctcgaaggcttcgaggtag

SEQ ID NO: 15830 - DNA, 435 bp, Pseudomonas aeruginosa
cgcaccacgaaagccaggcgcgccaccagcaggccgagcaacaacaggttgaacagcaccggctcggcgttgcgcccgccaccgcgcgccgccagccaaccgccgagcagcgcggcgccgagggcgaggaacagcagcaggtgttgcagcgagaccaccagcggccccagggaaaaactcagcatcagccgcgctcccgggtcgcctgccaatgggcgaggaagccgccggcgtcgacttcgccggtcaaccggcgcgcgcggcgctcctcgccttccgggccgatccagatcaggctcggcgggccgggtacctggtagcggtgcagcagctcgcggctggcggcgttgtccgcggtcacgtcgagccgcagcaggcgcacgccctgcagggcggcgagcacatcgggcttggcgaacacctgtttctccatga

SEQ ID NO: 15831 - DNA, 1836 bp, Pseudomonas aeruginosa
ccgaccgggtcgccgggctgcaggccggcgccgacgactacctgctcaagcccttcgacctgcgcgaactcggcgcccgcctgcataccttgcagcggcgctccgccgggcgttgcgtcaacgtcatcgaacacggccgcctcagctacgatccgagcacccgcgaaacctggctcgacggccgccccgtggaactgtcgcgacgcgaacaggcgctgttgcaggcattgctcaacaaccgcgggcggatcctcagcggcgagcagctcaaggacagcgtctatggcttcggcgacgaggtcgagagcaacgccctcaacgtccacatccatcacctgcggcgcaagctcggcaacgccatcgtgcagaccgtgcgcggcctcggctaccgcctcgggccggcgcgcggcgacggagacgacgcatgagcctgcgcctgcgccttaccctgatcctcggctcggccttcatcctgctctggtcgctggccgcggcctggatgctctgcgacctgcgcgggcagatgatgcgctccttcgaccaacgcctggcggcctcggcgcggatggttgccggcctgctccagcagttgccgcagccgcagccggcggacggccagaccacgcgcctcagcgcggagcaactgggaattcccaacggcatggcctgccaggtcagctcactgcgcggcgaagtcctggcgcagagccatgccaccccggagcgggcgctggacagcaccgccagcggcttccgcgaccaggaaatcaacggcgtgctgtggcgcagcttcaccgtgcaggccggcgatctgcgggtcagcaccgccgaccgcctggaagagcgcgacgtgctgcaacgctcggtggtggtggccgccgcggtgccggtgacggtcgccctgctcggcagcctggccctgctctggctcggcgccggccagggcctggcgccgctcaagcggattcgcgacgccctcacccgacgtggcgccgactcgctggagccactggagctggcggccctgccgagcgaactgaagccgctggtggaaacccagaaccagttgttccagcgcatcgcccaggccatcgaacgcgagcgacgcctgaccggcgatgccgcccacgagctgcgcagcccgctgaccgcgatcaagacccacctgcaggtcgcgcgcatgaccgagggcgccgccgccgagcaggccctggcccacgccgaggaaggcgccgaccgtctgcaccggacgctggaccagctgttgctgctggcgcgggtggaaggcagcctgtcgttcgacgacggcgtgcaatgcagcgccgaggacgccgcccgggtagccatgcacgacgccggccacggcgacgtgcggatgttcgagctgaagctggccgacggcttgtccgaggcgccgctggaagtcccctcggtgctggccatcgccgcgctgcgcaacctgctggacaacgccgtgcgccacaccgccgccggcacccgggtggagctggcggtggaaaccgcgcaaggctgcgcgcgcttccacgtccgcgaccacggtccgggcatcgccgaaaccgacctgccgcacctcacccggcgtttctggcgccacggcaagagcggcggcagcgggctcggcctggccatcgtccaggctatcgtgcaacgctgccaatgccggctggacttcgacagccgcgcggacggcctgcgggtgacgctggaaatgccgctgcgcgagtgatgcgcgggcccacccgccaaccggcccccgtagggcgaatagccgcccgcggctatccgccggaccgaggcccaggcatcggcggataa

SEQ ID NO: 15832 - DNA, 837 bp, Pseudomonas aeruginosa
gccgccaggctacatccgcagtcgaatggcctattatccatcccgagccaatcatcgtcgcttttccgccaaatgtttccgaaacccctgcccgtcccgctcttcgccctgcgcatcgaccgcgcagccagccgcacggcctcccaccgccatgcctgcggccagctctactgcctggagcgcggccttctggtggtcgaggacgagcatggccgccaggccctgcctccgcgccagatcgcctggatcccaccgggtcacccacactcggcgcactcccacggcagcctggcgggctggagcgcctacctcgccgccgaacactgccgcgacctgccccggcaccccggcgtgctcgcctgctcggctttcgtggcgctgatcgtcgaacgcgccacccgctggccgaccggctccgcctggagcaccgaacgcgagaacctgctgcgcgtgctgctggacgaactgcgccacgccgtgccccagcggacccgcctgccctatccgggggattcgcgcctgcgcaggatcgccgaggcattgatggccaaccccggcgatccgcggccggcggccgaatgggcacgctgggcgggcctcagcagccgtagcctgagccggctgttcggcgccgagaccggcatgagcttcgcgcaatggcggcaactggcgcgactgcacgcggccgtcgaacggctggcagcgggccaggcggtcggcgagatcgcctggtcgctcggctacgaaagcccgagcagcttcgccagtgccttccgcgcagtattcggcgagacgccgtccggctattccagtcgcgccaacgaagcgctagcctga

SEQ ID NO: 15833 - DNA, 261 bp, Pseudomonas aeruginosa
agatcgaagggcgacttcgtctggcacagccacgccgacaccgacgagaccttcatcgtcctcgccggtcgcctgcgcatcgatttccgcgacggcgcgatgcacctgggccccggcgagatgtatgtggtgccgcgcggcgtggagcacaagccgttcgccgagggcgaggtgcgcatgctcctggtggagccctgcggcgtgcgcaataccggcgaccagggcggcgagcggacggcggtcaacgatctgtggatctga

SEQ ID NO: 15834 - DNA, 822 bp, Pseudomonas aeruginosa
atcgccgccatgagcctctacgccctcggccgctggatctggtaccggccgttgcgcaacgccaccgaggagcagatcgtcgaagctgttccagcgccaggacgagcgccgctcggtatggctcggcctgctggtggaacagatcaacgccggcctgcgtacgcagaagctgcaactgttctaccagcagctcaacggcctgctgttcggcgtggagaacctgctggtgatctggctcggcgcgaccatggtgatggacggccagttcagcgtcggcatcctgatggccttcaacgcctacaagtcgcagttcgacagccgcgtcggcagcctgatcgacaagttcttcgagctgcgcatgctccagttgcagggcgagcgcctggccgacatcgtgctccaggccccggaggtcagccacggcgacatcctcccggagaacctccgcgagcgcgaggcgagcatcgagatccagggcctgcgctaccgctacgcggaacaggagccctgggtcctcgacggcctcgacctgcgcatcgccggcggcgagtcggtggccatcgtcggcccctcgggctgcggcaagagcaccctgctcaacgtcctgctgggcatcctcccgccagtggagggacagatccgcatggccggcctggaccttgcgcaactgggcctggacggcctgcgcgaactggtcggcacggtgctgcaggacgacgtgctgttcgccggttcgctcagcgacaacatcagtttcttcgacccgcaaccggacatgccctggctgctgcagtgcgcgcagatggctgccatccacgatga

SEQ ID NO: 15835 - DNA, 1758 bp, Pseudomonas aeruginosa
catccaggccatgccgatgggctacaacaccctggtcggcgacatgggcacggtgctctccggcggccagaagcagcgggtgatgctggcccgggcgctgtacaagaagccgcgcatcctgttcctcgacgaagccaccagccacctcgacgtacactgcgaacagcgggtcaacgccgccattcgagcgctgcgcatcacccgcatcatggtcgcccatcggcccgagaccatcgcctcggcggaccgcgtgatagtcctcggccagggcaaggtaagcctcgacgaaagcaccgcgcgcctggccgaacgccaggccgtcgcggcgcgggagcaggcctgatgcgtgccttcgccggcctgttgtgcggcctgctcggcctggttcccggcgccgccgcctacgagccggacgtgttcggcaccgccggccaggtcgccggccaggcggtctacgacctcggcggcagcggtttgccctgccgcggcgggccgccaccgaccgagctgagcctggaggaagccatcgagcggatcctctgccacgacccgcagacccgcctcgcctgggccaatgccaaggcccaggcggcccaggtcgggatcggcaagtccgcctacctgccgcgcctggacggccgtctcgacgccagtcgcggctacagcgacatggattatcgcgatgccccctacctctccggcgacggccatcgccaccggcgtggcgccagcctccaattgagctgggtgctgttcgacttcggccgccgcagcgccgccctgcgcaacgcccagcagttgctgctggcggccaacgccagccaggacgcgaccctgcagaacaccttcgccctcgccgcccaggcctactacgacgccctcgccgcccagcgcagcctggccgcctcgcgtcaggtcgcggagctggcggcgcagaacctggaagccgccgacgccaagtaccgggccggcgccgccgccctttccgatcgcctgcaggcgcagaccgcgctgtcccaggcgagcctcgcccaggtccgcgacgaaggcgccctgagcaacgccctcggcgtcatcgccctgcgcatgggcctggcgccggataccccgctgcgcctctccggcgagctggaggcgcaacccgacaccggcttcgtcaaggccatcgacgagatgctcgccgaagcccgccgcgagcatccggcgctgctcgccgcccaggcgcggctgaaagccgccgccgcctcggtggaggaaagccgcgccgccggccggccgagcctggcgctgagcgccaacctggcacgcagccatagcgaccaggcgatggcgttcaacggcgatacccgcgaacgcgaccgcagcatcggcctgcaactgaacatcccgttgttcgaaggcttcgaacgcacctaccaggtccgcaacgccctggcccgccgcgaagccagcgaagcggagctggccgacaccgagcagcaggtttcgctggaggtgtggaacaactaccagtcgctcagcgtcgagacccgcagcctggcgcgcacccgcgaactggtcgaacagtcgcggcaaagcctggaggtggtgcagggccgctaccgctcaggggtcggcagcatgatcgagctgctcaacgccctgaccgcctacgccagcgccgaggaccagcacatccgcgccctcggcaactggcagacctcgcgcctgcgactggcggcgagcctcggtcgcctgggtttctggagcctgcgctga

SEQ ID NO: 15836 - DNA, 1317 bp, Pseudomonas aeruginosa
cggtcaacgcgctctgcccgggaatcgtcggcaccggaatgtggcgcggcgaggacggcttgtcgggccgctggcggcaggccggcgaaagcgaggcgcagtcctgggaacgccaccaggccagcctgctgccccagggcgaggcgcagaccgtcgaagacatgggccagctcgtcgtctacctggcctgcgcgccgcacgtcaccggccaggccatcgccgtcgacggcggattctcgctatgaccccgccctcgccgatcgtcggcatcatcgccaacccggcctccggtcgcgacctgcgtcgcctcaccgcccatgccgggctgcactccagcaccgacaaggcatcggtggtgcaacgcctgctcgccgccttcggcgccaccggcatccgccatgcgttgctgccgccggacatgaccggcatcgccgccgccgtgctccgggccagccagacccgccaggcccgcgacggccactggccgttcctggagttcctcgacatgccgctgcgccagagcgtcgaggatacccgcctggcggcgcggcgcatggtcgagcgcggcgtggcgctgatcgccgtgctcggcggcgacggcacgcacaaggcagtggccgccgaggtcggcgacgtccccctgctggcgctgtccaccgggaccaacaacgccttcccggagctgcgcgaagccaccggcgcggggctcgccggcggcctctgcgccagcaaccgggtgccgccggagatcggcctgcgacgcaacaagcgcctgctggtgcgcgagccgcgccgcgggctctgcgagtgggcgctggtggacgtcgcggtgtcgccgcagccgttcatcggcgcccgcgccatcagtcgcgccgaagacctcgccgaagtcttcgtcagcttcgccgaaccccacgccatcggcctttcggcgctttgcggactgtggtcgccggtgagccgcgaggagccccacggcgcctggatgcgcctgcatccggacgcccgcgagagcctgctggtgccgctggcgccgggcctgctggtgggctgcggggtctctgccgccggctacctgcaacccggcgtggcccacgcaccgagcctgtccagcgggaccctggcgctggacggagagcgcgagatcgagttcagcgccaccgaccgcccgagcatcaccctcgacccttccggcccgttcagcgtcgatgtgccggccaccctcgcctacgccgcccgccatcgcctgctggccggccagcgaaccccgatgaccccgtgaagacaacctggagaacaacaagatgtccactctga

SEQ ID NO: 15837 - DNA, 363 bp, Pseudomonas aeruginosa
ccgtcgacggcttcgcacttcttcgccgtccacgaggctgccggcgccgccatcgagcgcgcccgcgccggcgaggggccgtcgctgatcgaagtcaagctgacccgctactacggacacttcgagggcgacgcacagacctaccgcgatcccgacgaagtaaagcactaccgggaaacccgcgactgcctcaagcagttccgcgaacgcacctgccacgccggcctgctctccgccagcgacctggacgccatcgacgccgaggtcgaggcgcgcatcgaggatgccgtgcagcgcgcgaagaacgatcccaagccggagccggacgacctgctgcgcgacgtctacgtgtcctatccctga

SEQ ID NO: 15838 - DNA, 306 bp, Pseudomonas aeruginosa
gccgcccgaaaacaagaacgaggagaaccatcatggcgagaaagatcagctaccagcaggccatcaacgaggcgctggcccaggaaatgcgccgcgacccgagcgtcttcatcatgggcgaagacaatgccggcggcgccggcgcgcccggcgaggacgacgcctggggcggcgtgctgggggtcaccaagggcctctaccaccagttccccggccgtgtgctggataccccgttgtcagagatcggctatgtcggcgccgcggtcggcgccgccacccgcggcatgcgcccggtgtgcgaactga

SEQ ID NO: 15839 - DNA, 690 bp, Pseudomonas aeruginosa
cctacggccgcatggtccacctggcgctggacgccgccgccagcctggcgcgccagggcatctcctgcgaagtactggacctgcgcagcaccagcccgctggacgaggacagcattctcgaaagcgtggaaaagaccggccgcctggtggtggtcgacgaagccaacccacgctgctcgatggccaccgacatcgccgcgctggtcgccgaacgggccttctccgcgctgcgcgcgccgatccgccgggtcaccgcgccccatacgccggtgcctttctccgacgccctggaagacctctacatccccgacgcggcgaatatcgaggcagccgtgcgccaggccctggaagggagggacgcggcatgagccggatccatacactgaccatgcccaagtggggcctgtcgatgaccgagggtcgggtggacgcctggctcaaggaagagggcgcgcatatcgagaaaggcgacgaggtgctcgacgtggagaccgacaagatctccagcagcgtcgaggcgcccttctcgggcgtgctgcggcgcaaggtggcgcgcgaggacgagaccctggcggtcggcgcgctgctcggcgtggtggtcgagggcgaggcgagcgacgaggagatcgacgcactggtgcaacgcttccaggccgaattcgtacccgccgacgaggacgctggggatag

SEQ ID NO: 15840 - DNA, 1782 bp, Pseudomonas aeruginosa
cacgccggcgctggccttcagccgcaggtcgtcgcgcaggcgatagtcgaggtccagctccatgccgtaggcgtgggccttctcggcgttgatggtgtacgactgcgccacccccggcgaaaccaccaccgggatgttgtactgggcgtccttgaaatccatgaagaacaggttgccgttcagcagcaggcggccgtcgagcaggctggcgcgggtgaacagttcgtagttccagatggtttcttccttgaagtaggcccagttgcgggtggtcaggttgagcgacacgcccccggggttgtagccgcggctgaccaggccgccgacggtccagtccggggtcgcggcgaaggccagggagactttcggcaggaaggccgagaaggtcttctggtaatccagcggacgcggcgccagcaccgagttgccgctgcgctcgatgcgatcctcctggtagcgcaggccggtggtcagggtccagcggtcgctcaggcggtagttcagctcgccgaacacaccgaggttcttcttcgtgtcgtcgaaggccgacagcccgcgcaggtgcagtgtctcgtcggtgcgggtgcgggcgtagtagaccccgcccatgccactgatccggtcctcctgctcgccgaagctgacccgcgattcgttggaggcgttcttctggcggatgtcggcgtcgccctcgccgcccgcgccggtggtgcggtgcaccgaggacagcgagtactgcgcctggttgaacaggcggatgccgttgtcgaggtcataggcgacgtcgaggatgctggtgttggtgtcctgctcccagctgggcatggtggtcgagcgatggtcgagcttgtcgaacgggcgggtcgccgcttcctgggtcgggcgattgctgtcgttgtgggagaaggtgaacttgctctccaggcccggaattccgctgggcagccagagcagcttggcgcgcgcgttgagggcgcggaagtcctggtcggtgccgctgtcctggaacttcgggttgtcgtagtcgatgaaggtgtcgcgacccgcgtagtccaccgccaggcgcccggcgaagtcctgcgccagcgggccggacactgcgatcgagctgcgccgcgaatggtagctgccgatctccgcctggtaggcagcctcggggctgaaggtcgggtccttggtgttgacgatgatcgccccggcgatggcgttggcgccctgggaggtggtctgcgggccgcggaacacctcgatgctgtcgacgtcccagaccgaggtcgcgccgaagaacatctcgttgtagttcaggtagtggccatcgaggttgatcgtcgcccgcggcactgtgccgccccagaacacgttctgcccgttgttcgggccctgggtgtcctggccgcggatgatcggcgcgcccaccgagtcggtgtagaccacgttgggactgccattgatcacctcggcgaccgaggcgttgccggtctgcttgcggtcgatgtcgcgggcgctggtgagcgataccgaggacgccgtgtccttcagcgagcgttcacgtttctcgccggtcacgaccagcgcctcgagggcggcgggttcgtcctcggcgggcgggttttcccgggccagtgccgatggcgaggcgagcagggtggacagcgtgacgacgccgattccccggttgagcgtgcggtgcgtgcgggcgttcaaggatcttctccaaatgggaatgactctcttttccattcaggctatcacgccaccagatcattcctcaatggggaatag

SEQ ID NO: 15841 - DNA, 1029 bp, Pseudomonas aeruginosa
attcctcattgcgaaatattaaatctcctacgcccgtcccttccgcggcgccccaccgccccggggaatcggtatcatgggcgccgcccgcgccaccgcagcgcggaccgaagcctatggatcaaccgtggtgaggagaccgagccgttgaatacttcgcagcccccggcggacgagatgccggacgccccgggcgaaaagcgctccggcaccatccagtcggtgtccatcgccgcgcgcttcctgaagaccctggccaacgccgaaggcgaactggccctcggcgaagtggcccggcgcaccggcaccggcggctccaccgcgcaccgctacctgcagagcctggtgaaggaaggcctggcccgccaggacccgctcagcggtctctacgacctcgggccggcggcgctgagcatcggcataggcgcgctgaagcggatcgacgcggtggatatcgccgcccgccacatgaaggccctggcccaacggcatgccgccagcggcggggtggcgatctggaccgagcgcggcccgaccctggtgcgctggtaccgcagcgcctatttctcgatcaacccgctggccctgggcgatatcctgcccatcgacaataccgcttgcggcctggtgttccaggccttcctgccgaaggccgtggtcgacgccgcgcgcaagcagcaaccggcgcacttccgcggcagcccgccgagccgcgcgctgctcgacgaggtgcgtgagcgctgctgggccgaactgaccagccacctgctgtcgaatgtcaccggccaggcggcgccggtgttcgacgcccagcaggagatcgtctgcgccatgaccacggtgaccgatctcggccagttgcagtcggcggaagaccgcgacgcgctgttccacgagggccctgcaggtcaaccagtccaccggtggcctggtactccaccccggcatgcggccgccgccgcgctgaaccacctcagccccgcgcgtcggcggcgatcccgcgcggcaccagcagcggcgtgccgctga

SEQ ID NO: 15842 - DNA, 1134 bp, Pseudomonas aeruginosa
atccgtccgcccggcttcccctacagcgaaaacagccttcatgccgacccgccgccgctccgccctgccgttactcgccctgagcctgttcgccaccctcgccgcggccggggagccgaagccggcgcggatcgtctccaccaccccgagcgtcaccggcatcctgctggcgatggacgcaccgctggtggccagcgccgccaccacgccaagtcgcctgaccgacgccaagggcttcttctcgcaatgggcgaaggtcgccgaccaacgtggcgtcgaggtgctctaccgcaacctgcgcttcgacatcgaagcggtgatcgcccaggatccggacctgctggtcgcctccgccaccggcgccgacagcgccgcgccataccgtgcggagctggaggcgcagggcgtaccgacgctggtggtcgactactcgaaacacagctggcaggaactggctaccgagctgggccggcacaccggcctggaacgccaggcgcaggccgccatccagcgcttcgacgcctacaccgccgaagtcgccgcggccatcgcgccgccgcagggcccggtcagcgtggtcggctacaacatcgccggcagctattccatcggccgccaggccagcccccaggcacgcctgctcgaggccctcggcttccaggtggcggaactgccggaggcgctggcgggcaaggtgacgcgcgcctcggacttccagttcatctcgcgggaaaacctgcccgccgccatcgccggcgacagcgtgttcttgctcggcgccagcgacgacgacgtgcaggcgttcctcgccgacccggtgctggccaacctgtcggcggtccgcgaaaagcgcgtgtacgccctgggccccagttccttccgcatcgactattactcgggacggcagatgatcgacaacgtcgcccgccatttccgctgagccatgcgcccgttcgccggaagtccgctcatgcaggcgtccccgatgcgccgccggcgcctgcgcgcctggggcctgctcgccggcgcgctgctgctcgcgctggcggccctggccagcctggcgctgggctcgcggccggtgcccctggcggtcaccctggacgccctgcaagccgtcgatccgcacgatga

SEQ ID NO: 15843 - DNA, 1887 bp, Pseudomonas aeruginosa
tcgccacctggtggtacgcgaactgcgcctgccacgcaccctggtggcgctgctggccggcgcggcgctgggagtggccggcgcgctgatgcaggcgctgacgcgcaatccgctggccgaacccggcctgctggggatcaacgccggcgcggcgctggcggtgatcgtcggggtcgcgctgttcgacctggcgagcatgggccagtacctcggttgcgccttcctcggcgccggcctggccggcatcgccgtattccttctcggccaggcccgcgagaccggcaccaacccggtgcgcctggtgctggcgggtgccggcttgtcagtgatgctcgcctcgctgaccgggatcatcgtgctgaacgccccgccggaagtcttcgaccgcttccgccactgggccgccggctcgctttccggcagcggcttcgccctgctcggatggccgggcctggccatcggcgccgggctggccgccgccttcgccctcgccgccaggctcaatgccctggccctgggccaggagatcggccgggcgctcggcgtcgacctgcgcctgacctggctgctcgcctgcctggcggtgatgctgctggccggcgcggcgaccgccctggccgggccgatcgccttcgtcggcctggtcgccccgcacctcgcgcgactgctggccggaccggaccagcgctggatcctgcctttctcggcgctgatcgccgccggcctgctgctcggcgccgacatcctcgggcggctgctggcggcgccggcggagatcgccgccggaatcgtcgctttgctgctcggcggaccggccttcatcgtcctggtcaggcgcttccgcctgagccgcctgtgaacggtctccacgccctgcgcctgggctccctgtcgctgcgttggcggccacgggcggcgctggcctgcctggtcctcgcgggggtcggactggcgctggcggcggcgctgctggggaccggcagcctggcgctgggcccggcagaggtgttcgccagcctgctcggccagggccaggaccccaccgcccagcgcatcgtccagcgcgtacgcctgccacgggtgctcaccgcctgcctggtcggcgccgcgctgggcatggccggggcgatcttccagtcgatctcgcgcaatccgctgggctcgcccgacgtcatcggtttcaccaccggcgccgccagcggcgccatcgtgcagatcatcctgttcgatgccggcccgctggccacctcgctggcggcgctggccgccggcctctgcacggcgctggcggtggtgctgctggcgcgccggggcgccaccgccggcggctaccgcctggtgctggtgggcatcggtgtcggcgccagcctgtcgggcctgaacagcctgctgctggtcaccggcaacctcgaccaggcgatgtatgcccagctctggctggccggctcgctgaacacccggacctggtcgcacgtcgtcccggcagcgctgggcctgctcgccaacgtgccgctggcgctgtaccacggtcgtcgcctggaattgctggagctgggcgatgccagcgccgcccagctcggcgtggcggtggagcgcgtgcgcttgcagatggtcctggtcgccgtcggcatgaccgccatcgccaccgccgcggccggccccatcgccttcatcgccctggccggcccgcaactggcccggcgcctgacccgctcggccggggtgccgttgctgtccggcgcattgatgggcgcggtcctgctgctggccgccgacctgctcggccagcgcctggcatacgtcgccaacctgccgatcggcctgatgaccggcctgctcggcggtttctacctgctctggctactgatgcgcagccgccggatttga

SEQ ID NO: 15844 - DNA, 1335 bp, Pseudomonas aeruginosa
cgcgctcgagtccggtcgtaccacggcggtcgaactggtccaggcctacctggcgcggatcgacgcctacgatgcacccggcacgcccaccgcgctgaacgcggtggtggtgcgcaatcccgatgcgctggccgaagcgcaggcctccgacgcccgccgggcgcgtggcgagcccctcggtccgctggacggcattccctacaccgccaaggacagctacctggtcaagggcctcaccgcggcttccggcagcccggcgttcaaggacctggtggcccagcgcgatgccttcaccgtcgagcgcctgcgcgccgccggggcgatctgcctgggcaagaccaacatgccgcccatggccaacggcggcatgcagcgcggcgtctacggccgcgcggagagcccgtacaatgccgcctacctcaccgcgcccttcgcctcggggtcctccaatggcgccggcaccgccaccgcggccagcttcgccgccttcggcctggccgaggaaacctggtcgagcgggcgcggcccggcgtcgaacaacggcctgtgcgcctacaccccttcgcgcggggtgatctcggtgcgcggcaactggccgctgacgccgaccatggacgtggtggtgccctatgcgcggagcatggccgacctgctggaaatcctcgacgtagtggtcgccgacgatcccgatactcgcggcgacctctggcgcatgcagccctgggtgccgatccccaaggcctccgaggtacgcccggcgagctacccggccctggccgcaggcgccgaggccctggccggcaagcgcttcggcgtgccgcgcatgttcatcaacgccgaccccgatgcgggcaccagcgagtcccccgggatcggcggcccgaccggccagcgcatccatacccggccctcggtcatcgccctctgggaacaggcgcgcaaggccctggaagccgccggcgccgaagtgatcgaggtggacttcccgctggtgtcgaactgcgaaggcgaccgacccggcgcgcccaccgtgttcaaccgcggcctggtgtcgaaggaattcctccacgacgagctgtgggaactctcggcctggggcttcgacgacttcctgcgcgccaatggcgatccgaagctgaaccgcctggcggatgtcgacggcccgcagatcttcccccacgaccccggcaccctgcccaaccgcgagggcgacctggccgccggcatggacgaatacgtgcggatggccgagcgcggcataaagccctgggaccggatcgcgaccctccccgatggcctgcgcggcctcgaggaaacccggcggatcgaccttga

SEQ ID NO: 15845 - DNA, 513 bp, Pseudomonas aeruginosa
gttcgatctggttggtggatatctcgcccgcaccgaccgcggcgatggcctggcgggtccagttcgatgttgaagttggagacgccgatccgccgggtcaggcccaagggacttggcttccgccagcgccgccatgtactccgccagctcgacgccgttgccgggtgccggccaatggatcaggaccaggtccaaccggtcggtgcgcagtttctccagactctcgcgcaggctggcgagcagcttttcgcgggcgtagttgtcgacccagaccttggtggtgaggaacagctcggaacgcggtacgccgctctcggcgatcgcgcggccgatatccacctcgttgccgtagatctgcgcggtatcgatggcgcgatagcccagttcgagggcgctgcgcaccgagtcgacgacgacctggccggtaaggcggaaggtgccgagaccgaaggacgggagggggtggatggtggacgacatggctgcgctccgtgggcgggatggctcgaatga

SEQ ID NO: 15846 - DNA, 639 bp, Pseudomonas aeruginosa
acaagaaacgcagccggtcgcgccaacggcctgcctgcgccgccatccaggacactgcagatgaaacacgtcgtttccagtgcgttattgctcggtctctcctcgctttccctggccgcccaggccgctcccatcgcccttgaccttcccgcccagcccctggccgcatccctcgagcaattgcagggcgccagcggcctgcgcatccgtttcgaccgcgcggccgtggccgaccggcgcgcaccggccctacgcggcacgctggagccaagcgaggcactgcagcgtctgctcgcaggttccggactgagcggggaggtacggggcggcgacgcctgggtcgaggccgcggcgacaggtgccggcatctcccccggcgacagcgtcgacctcggcgcgctcagcgtggtcgccacccaggacccggccaccgccgccatcaccgaagacagcgggtcctacaccacgcgggcgatgcgcacctcgaccaagctggcgatgtcgatccgcgagacccctcagtcggtcagcgtggtcacccgccagcgcatggacgaccagggcatgcgcgacctcaacgacgcggtgaaggggttcaccggcctcaccgttgcaaaagtacgggccggccccgggtga

SEQ ID NO: 15847 - DNA, 438 bp, Pseudomonas aeruginosa
cccggcggatcggcgtctccaacttcaacatcgaactggacccgccaggccatcgccgcggtcggtgcgggcgagatatccaccaaccagatcgaactcagcccttacttgcagaaccgcgcgctgaccgcgtacctcgaggagcagggcatcgcggtcacctcgtacatgaccctggcctacggcaaggtactgaaggacccgacgctggccgggatagccgccaggcaccgggccacggtcgcccaggtggcgctggcctgggcgatgcaactgggctacgcggtgattccgtcctcgacccgccgcgagaacctcgccagcaacctgctggcgcgcgacctgcgcctggacgccgaggacatggcgcgcatcgccggcctcgagcgtaacggccgcgaggtcagtccgcagggcctggcgccggcctgggactga

SEQ ID NO: 15848 - DNA, 3036 bp, Pseudomonas aeruginosa
acgaagagtcgctgcatcgataactcccttgaacggaagagcgtgggcgcaagacgcgaagccttccgcccgcgcctttcacttgcttgccagcggtggagtacgcggcggcacgatacgccgcgagccggtcgactcgaaggccgcggcgaagcgcagcagcgccgagtcgtcgtaggcgcggccggcgaaggtcaggcccaccggcatgccgatgtcggccatcacccccatcggtacggtgaccgtcggcacgccgaggtggcggatggcgaggttgccgttggcgacccagacaccgttgctccaggcgatgtcggccgaggccgggttgacgtcggcgtccgccgggccgacgtcggcgacggtggggaagagcacggcgtcgaggcgcaggcgtcgcatccactcctcaaggtcgatccgccgggtttcctcgaggccgcgcaggccatcggggagggtcgcgatccggtcccagggctttatgccgcgctcggccatccgcacgtattcgtccatgccggcggccaggtcgccctcgcggttgggcagggtgccggggtcgtgggggaagatctgcgggccgtcgacatccgccaggcggttcagcttcggatcgccattggcgcgcaggaagtcgtcgaagccccaggccgagagttcccacagctcgtcgtggaggaattccttcgacaccaggccgcggttgaacacggtgggcgcgccgggtcggtcgccttcgcagttcgacaccagcgggaagtccacctcgatcacttcggcgccggcggcttccagggccttgcgcgcctgttcccagagggcgatgaccgagggccgggtatggatgcgctggccggtcgggccgccgatcccgggggactcgctggtgcccgcatcggggtcggcgttgatgaacatgcgcggcacgccgaagcgcttgccggccagggcctcggcgcctgcggccagggccgggtagctcgccgggcgtacctcggaggccttggggatcggcacccagggctgcatgcgccagaggtcgccgcgagtatcgggatcgtcggcgaccactacgtcgaggatttccagcaggtcggccatgctccgcgcatagggcaccaccacgtccatggtcggcgtcagcggccagttgccgcgcaccgagatcaccccgcgcgaaggggtgtaggcgcacaggccgttgttcgacgccgggccgcgcccgctcgaccaggtttcctcggccaggccgaaggcggcgaagctggccgcggtggcggtgccggcgccattggaggaccccgaggcgaagggcgcggtgaggtaggcggcattgtacgggctctccgcgcggccgtagacgccgcgctgcatgccgccgttggccatgggcggcatgttggtcttgcccaggcagatcgccccggcggcgcgcaggcgctcgacggtgaaggcatcgcgctgggccaccaggtccttgaacgccgggctgccggaagccgcggtgaggcccttgaccaggtagctgtccttggcggtgtagggaatgccgtccagcggaccgaggggctcgccacgcgcccggcgggcgtcggaggcctgcgcttcggccagcgcatcgggattgcgcaccaccaccgcgttcagcgcggtgggcgtgccgggtgcatcgtaggcgtcgatccgcgccaggtaggcctggaccagttcgaccgccgtggtacgaccggactcgagcgcgtcacgcagctcggcgatggaaacctcggtgacctcgatcatgctgtcaccgcctggcgaatggagacggggagaccgttagcgacgctcatcatcgttcctcttgttctctgcttgctgcgacgggggccgcgaggcggccgggtcgatacaggggatgcagtgtacatcctggccggcgctcgcggcttccctggcggggcgcggcaacggcctcgcaggtcctggccagtgtctggggttgccgccgaagcgcggcgtcggagaaagtccgcgggctgtcgccggccgccggcgaggcgtaaggtgcggcgtcggggggaccatttcacacaggggaatcgtcatgacgaatcatcgtaccgcgctggtcaccggcgccacccgtggcatcggcctggccctggccaggcgcttggcggcctccggctggagtgtaatgggcatcgcccgccatgcgagcgacaactttcctggacgtctgctgtgctgcgacctggccgatcctgcgcaaaccgccgagacgctgcgcggattgctctcggaaagcgccgtggatgccttggtcaacaacgccgggatcgccttgccgcaaagcctggagaacctcgacctggccgctctgcaacaggtcttcgacctcaacgtgcgggtcgccgtgcagcttgcccaggcctgcctgccggggctcaagcgttcgccggcgggccgcatcgtcaacctgtgcagccgggcgatccacggcgcccgcgaacgcaccgcctacgccgcggcgaagagcgcgctggtcggggtgactcgcacctgggcgctggagctggcgccgctgggcatcacggtcaacgcggtggcgcccgggccgatcgagaccgagctgttccgccagacccgcccggtcggcggcgaggaggaacggcggattctctcgaccatccccatgcagcggctcgggcggccggacgaagtggccgcgctgatcgagttcctgctcagcgagggcgcttcgttcgtcaccggccaggtgatcggtgtcgacggcggcggcagcctgggcggtcgttgaggccggggctcaaatccggcggctgcgcatcagtagccagagcaggtagaaaccgccgagcaggccggtcatcaggccgatcggcaggttggcgacgtatgccaggcgctggccgagcaggtcggcggccagcagcaggaccgcgcccatcaatgcgccggacagcaacggcaccccggccgagcgggtcaggcgccgggccagttgcgggccggccagggcgatga

SEQ ID NO: 15849 - DNA, 762 bp, Pseudomonas aeruginosa
gcacccgtggcaggcgtacgcgctggacgatgcgctgggcggtggggtcctggccctggccgagcaggctggcgaacacctctgccgggcccagcgccaggctgccggtccccagcagcgccgccgccagcgccagtccgacccccgcgaggaccaggcaggccagcgccgcccgtggccgccaacgcagcgacagggagcccaggcgcagggcgtggagaccgttcacaggcggctcaggcggaagcgcctgaccaggacgatgaaggccggtccgccgagcagcaaagcgacgattccggcggcgatctccgccggcgccgccagcagccgcccgaggatgtcggcgccgagcagcaggccggcggcgatcagcgccgagaaaggcaggatccagcgctggtccggtccggccagcagtcgcgcgaggtgcggggcgaccaggccgacgaaggcgatcggcccggccagggcggtcgccgcgccggccagcagcatcaccgccaggcaggcgagcagccaggtcaggcgcaggtcgacgccgagcgcccggccgatctcctggcccagggccagggcattgagcctggcggcgagggcgaaggcggcggccagcccggcgccgatggccaggcccggccatccgagcagggcgaagccgctgccggaaagcgagccggcggcccagtggcggaagcggtcgaagacttccggcggggcgttcagcacgatgatcccggtcagcgaggcgagcatcactga

SEQ ID NO: 15850 - DNA, 1386 bp, Pseudomonas aeruginosa
caagccggcacccgccagcaccaggcgcaccgggttggtgccggtctcgcgggcctggccgagaaggaatacggcgatgccggccaggccggcgccgaggaaggcgcaaccgaggtactggcccatgctcgccaggtcgaacagcgcgaccccgacgatcaccgccagcgccgcgccggcgttgatccccagcaggccgggttcggccagcggattgcgcgtcagcgcctgcatcagcgcgccggccactcccagcgccgcgccggccagcagcgccaccagggtgcgtggcaggcgcagttcgcgtaccaccaggtggcgatcatcgtgcggatcgacggcttgcagggcgtccagggtgaccgccaggggcaccggccgcgagcccagcgccaggctggccagggccgccagcgcgagcagcagcgcgccggcgagcaggccccaggcgcgcaggcgccggcggcgcatcggggacgcctgcatgagcggacttccggcgaacgggcgcatggctcagcggaaatggcgggcgacgttgtcgatcatctgccgtcccgagtaatagtcgatgcggaaggaactggggcccagggcgtacacgcgcttttcgcggaccgccgacaggttggccagcaccgggtcggcgaggaacgcctgcacgtcgtcgtcgctggcgccgagcaagaacacgctgtcgccggcgatggcggcgggcaggttttcccgcgagatgaactggaagtccgaggcgcgcgtcaccttgcccgccagcgcctccggcagttccgccacctggaagccgagggcctcgagcaggcgtgcctgggggctggcctggcggccgatggaatagctgccggcgatgttgtagccgaccacgctgaccgggccctgcggcggcgcgatggccgcggcgacttcggcggtgtaggcgtcgaagcgctggatggcggcctgcgcctggcgttccaggccggtgtgccggcccagctcggtagccagttcctgccagctgtgtttcgagtagtcgaccaccagcgtcggtacgccctgcgcctccagctccgcacggtatggcgcggcgctgtcggcgccggtggcggaggcgaccagcaggtccggatcctgggcgatcaccgcttcgatgtcgaagcgcaggttgcggtagagcacctcgacgccacgttggtcggcgaccttcgcccattgcgagaagaagcccttggcgtcggtcaggcgacttggcgtggtggcggcgctggccaccagcggtgcgtccatcgccagcaggatgccggtgacgctcggggtggtggagacgatccgcgccggcttcggctccccggccgcggcgagggtggcgaacaggctcagggcgagtaa

SEQ ID NO: 15851 - DNA, 840 bp, Pseudomonas aeruginosa
tcgattccacatattcgagccattcttatccaggaacctcccatgacccatcgcctgcacgcggacgccgtgaccttgcgccgcgacgcgcggaccgtttcgcggaatctctcgctggccatccccgagggttcgttcagtgtgatcgtcgggcccaacgcctgcggcaagtcgaccctgctggcggcattgtcgcgcctgttggcgccggccgagggccgggtggtgctggacggcagggatatccacagcctgccgggacgggaagtggcgcggcgtctcggcctgctgccgcagagcgcgctggcgccggatggcatcacggtggccgagctggtggcgcgcgggcgctatccgcaccagtcgttcctgcgccagtggtcgccggcggatgagcgcgcggtagcggcggcgttacgcgccacgcgggtcgacggcctggccgagcgaccgctcgatgcgctctccggcggccagcggcaacgcgtgtggatcgccatggtgctggcgcaggaaaccccgttgctgctgctcgacgagccgaccacctacctggatatcgtccaccagatcgaattgctcgaactgctcgccgagctgaatcgccaggggcgcaccatcgtcgccgtgctgcacgacctcaaccaggcctgccgctatgcctcgcacctgatcgccatgcgtgacggcgcgatcctcgccgagggcgcgccggcgcatatcttcaccgagcgtctggtggaggaggtgttcggcttgcgctcgttgatcatcgccgacccggtcagcggcacgccgctgctggtgccgcgcgggatcgccgccgacgcgcggggctga

SEQ ID NO: 15852 - DNA, 1224 bp, Pseudomonas aeruginosa
cctcgacaacggcatccgcctgttcaaccaggcgcagtactcgctgtcctcggtgcaccgcaccaccggcgcgggcggcgagggcgacgccgacatccgccagaagaacgcctccaacgaatcgcgggtcagcttcggcgagcaggaggaccggatcagtggcatgggcggggtctactacgcccgcacccgcaccgacgagacactgcacctgcgcgggctgtcggccttcgacgacacgaagaagaacctcggtgtgttcggcgagctgaactaccgcctgagcgaccgctggaccctgaccaccggcctgcgctaccaggaggatcgcatcgagcgcagcggcaactcggtgctggcgccgcgtccgctggattaccagaagaccttctcggccttcctgccgaaagtctccctggccttcgccgcgaccccggactggaccgtcggcggcctggtcagccgcggctacaaccccgggggcgtgtcgctcaacctgaccacccgcaactgggcctacttcaaggaagaaaccatctggaactacgaactgttcacccgcgccagcctgctcgacggccgcctgctgctgaacggcaacctgttcttcatggatttcaaggacgcccagtacaacatcccggtggtggtttcgccgggggtggcgcagtcgtacaccatcaacgccgagaaggcccacgcctacggcatggagctggacctcgactatcgcctgcgcgacgacctgcggctgaaggccagcgccggcgtgctacgcacccggatcgacgagatgtccggcaataccggctacgagcacaacgagttcgcccgctcgccgggctataccctcagcttcggaccgagctgggacgtcaccgagcgcctcaacctgaacgcccaggtgcgctacctggacggctactactcggacaccgccaacaccaaggcctactcgatcaaggcctacaccctcaccgacgcccgcgccagctaccgcttcaacgaccaggtgcagctctatggctacgtgaagaacgtgttcgacgaccgctcgcccacctacatgcaggaaaaccgggggatcggcggcatcgaggcgagcatgacgcagccgcggaccctcggcatcggcatcaagggcaccttctaggcgccccgagaagccggccccgcgcagggccggcccagccccagagcccatacaggagattggcacgatga

SEQ ID NO: 15853 - DNA, 1026 bp, Pseudomonas aeruginosa
gtaccccgaaacgcttgcacatcggcatgtcgctggcccccacctggctcagcggcgatgcctggcggcgccccgacagcaatatcgaaggcatcttcggcagcgatttcgccgtcgacatcgccaggcgctccgaagccgcccacctcgacttcgtgtttcgcccggacgtcagcagcctgccactggacgtgctggagaccggctccggcttcgccagcctggatcccaccgtactgcttgccgcggtcgcccgcgaaacctcgcggatcggcctggtgtcgacggtctccaccacgttctatccgccctacgtggtggcccggcagctgcaatcgctgcactggatcagcaacggtcgcgccggctggaacatcgtcaccgcgctgcagggccacgagaacttcggcctggacgcgatgcccgatgcggagcagcgctacgcgcgcgccgccgagttcacccggctggtgcacgacctgtgggacagcttcccccgcgaggcactcctggtcgaccgcgagagcggccgctacgccgacgtttcccgggtgcacccggtcgaccacgacggcgaattcctcaaggtcaagggaccgctcaacctgccggccttcggcgaggcgcggattcccctggtgcaggccggcgcctccgagagcgggcgcgacttcgccgcctcggtggccgacctggtgttcgcgccgaccccggacaaggaggctgccctggaactgcgccgcgacctttcccgccgcgccgaacgccacggtcgctcgccgcgcgacgtgcgcctgctgccgggcttcagcctgtacctggcggagagccgcgaggaggcgcgggaaatcttcatgcagacccacgcgcgcctggaccgcgcgcgcaagttcgccacgatcaggcagatgctcggcctcgacctcagcgactggccgctggaccggccgatttccgcggccgacctgccgccgccggtggccaaccccggcagccgcacccacaccgacctgctgcggcgcctga

SEQ ID NO: 15854 - DNA, 765 bp, Pseudomonas aeruginosa
ccccgccccggtcgcgcgcttgtccataacaattcgactggccggctttttcgctcccctttgcgggtttcgttctctcgccatgtgaagattgccatgtccctatcccgtcgcatccccgccgctctttccccgttccagaaccgcgtcatcggagcctgcctgctcggcggcctgctggcggccggcgccccggcgcaggccgaggaggcgaccggcaacgcgcgctgggtgagcgacagcctgaccactttcgtgcgcagcggccccaccgatggctatcgcatcgtcggcaccctcacctccgggcagaaggtcgagctgcttggcacccagggcaactacagccaggtgcgcggcgagaacggcagcaccgtgtggattcccagccgcgacttgcaggaggttcccggccaggccgagcgcctgccgcaactggaacagaaggtagccgccctgaccgccgagctggacggcatcaacgacacctggaagacccgcgtgcagggcatgcaggaaaccctcgacacgcgcaagaagttgatcgacgaattgcaggcggcgcgcagcaacctggacgccgagctcggcaaggcccgctccgacctgcgtgcggtgcaggcgcaactgggcgacgagaacaagcaggtgctgatgcgctacatggtctacggcggcagcatcgccggcgccggcctgttcgccgggctgatcctaccgtcgctgctgagggtgcggcgcaagcgcaacgacaagtggttctga

SEQ ID NO: 15855 - DNA, 471 bp, Pseudomonas aeruginosa
gcgagggccccgagcaactgcttctcggtggaaaccagctcgaagaaattgaattcactgggctcctcgaagattcccacaagcacgcatttgccggccttgcggatggcatcgatggccagcttggcggtgtgcttgttgccgatgcattcgaagctgacgtcggcgccaagcccgccggtgagggcgcggatttcgcctagggcgtcgcaccgcgaggggtcgagcacctggctggcgccgacctccagggccttggccttgcgcgccgaggacatctccagggcgatcacctgtgccgcgccggcggcgcgcgcgcacatgatggtgctcaggccgatggtgccggcgccgaccaccaccacgttctgcccgagcaggctgccggccttcttcaccgcgtgcatgcccaccgccagcggctcgatcagcgcgccggcctcgctgggaaatccggccggcagggcgtag

SEQ ID NO: 15856 - DNA, 495 bp, Pseudomonas aeruginosa
tgggcgaggtcggggagaccgaccttgccggcgatcgatgacaggttgacgatccgcccccagcgctgcgcctgcatcagcggcagttcggcctggcagcagaggaacacgccgcgggcgttgacgttcatcacccggtcccagtcggcgaggctgagttcggcgaccttgcggatgctgatcaccccggcattgttcaccgccacgtcgagccggccgaactccgtggcgacccgctcgaccatcgcccggacgctgtcgccgtcgctgacgtcgaccccaagggccaggctgcggcgaccgaggctgcggatcgcggcggcggtttcctcggcgacctgcggatcgaggtcggccaccgccacgtcggcgccggcgcgcgccagggcgagggcgatgccccggccgatgccgcgtccggcgccggtcaccagcgcgacccgggaagacagggagaaatcgtcggacgacgtagcgtgcatgcttcacctctga

SEQ ID NO: 15857 - DNA, 1569 bp, Pseudomonas aeruginosa
gtgtatgcggcagggcgttgggaggagcggacagtccgccctgccgtcgccgtggctggagcaaggccgatgccaggttgcggcgtggcggccggaaggcccgtcgtagagcgccggcatgggaaggccggcgaccgccggggcgacgtccggcgagacaacccatgtcatcgcgcacgggttcccggcgagacgctgagacgctccgtctcagtcgtcggctgtggcggcccggcgcttgtcgagggtcgccgatgggcgcttaatgggcggcacaacaacaagatgccgagcaacggaggccccatgctttccgcacactcgaaggaccatgtggactgtgtcagccgtgtcctgaggaacgccgcgcgcctgccgcaggcgccggtgccgacgccgatcctcgactcctggcgccgctccatggagcagcaccgtctcgacccggggtccctgcaagggccgcggattctctcgcagaccctcctcgacgaatgtcgcgagcgttccgaactgttcctgcgcatcgccagcgaagaggtggcgcgactgcatggacgggtgcgcgatgccgactactgcgtactgctcaccgatgcccaggggcggaccatcgactaccgtgtcgagtcgaccatccgcaacgactgccgcaaggccgggctgtacctcggcacctgctggtcggaaggcgaggagggcacctgcggggtggccgccgtactcaccgacaggactgcggtgacggtgcacaagcgcgatcacttccgcgccgccttcatcgacctgacctgttccgcggcgccggtcttcgatccgcagggcgagttgctcggtgtgctcgacgtttccgccgtgcaatcgccggacgaccgccgtagccagcatctgatccggcagatggtggcgcagagcgcgcgggagatcgagaacgccttcttcatgcacagcgcccagggccattgggtgctgcgcgcgcaccgtgcgccgggctacgtcgacagccagccggactacctgttcgcctgggacgccgatgggcgcctgctggcgttgaacccggcggcgcggcactacctgcggcagcgcctggggcaggtgccgagccacatcggcgaggtgttcgacctcgacgccctgcacgccgccgccgaccaggcgccgtgcctgctgcgcggccaggccggcgagctgcacgtgcgtctcagcgcgccgcgggccaaggcgcggcggctggagcgcgaggtgcccgacgacgctgcgctcgacccgcgcatcgccgaaagcctgcgcctggcggtgcgggtcaaggaccgcaacctgccggtgctgatccagggcgagaccggcgccggcaaggaggttttcgcccgccagatgcaccaggccagcgcccgtcgcgacaaacccttcgtcgcgctcaactgcgcggcgattcccgaaagcctgatcgagagcgagctgttcggctacgttggcggagcctttaccggcgcggcggcgaaagggatgcgcggcctgctgcagcaggccgatggcggtaccctgttcctcgacgaggatcggtga

SEQ ID NO: 15858 - DNA, 1911 bp, Pseudomonas aeruginosa
cgccgagggcgttgctcagggcgccttcgtcgcggacctgggcgaggctcgcctgggacagcgcggtctgcgcctgcaggcgatcggaaagggcggcggcgccggcccggtacttggcgtcggcggcttccaggttctgcgccgccagctccgcgacctgacgcgaggcggccaggctgcgctgggcggcgagggcgtcgtagtaggcctgggcggcgagggcgaaggtgttctgcagggtcgcgtcctggctggcgttggccgccagcagcaactgctgggcgttgcgcagggcggcgctgcggcggccgaagtcgaacagcacccagctcaattggaggctggcgccacgccggtggcgatggccgtcgccggagaggtagggggcatcgcgataatccatgtcgctgtagccgcgactggcgtcgagacggccgtccaggcgcggcaggtaggcggacttgccgatcccgacctgggccgcctgggccttggcattggcccaggcgaggcgggtctgcgggtcgtggcagaggatccgctcgatggcttcctccaggctcagctcggtcggtggcggcccgccgcggcagggcaaaccgctgccgccgaggtcgtagaccgcctggccggcgacctggccggcggtgccgaacacgtccggctcgtaggcggcggcgccgggaaccaggccgagcaggccgcacaacaggccggcgaaggcacgcatcaggcctgctcccgcgccgcgacggcctggcgttcggccaggcgcgcggtgctttcgtcgaggcttaccttgccctggccgaggactatcacgcggtccgccgaggcgatggtctcgggccgatgggcgaccatgatgcgggtgatgcgcagcgctcgaatggcggcgttgacccgctgttcgcagtgtacgtcgaggtggctggtggcttcgtcgaggaacaggatgcgcggcttcttgtacagcgcccgggccagcatcacccgctgcttctggccgccggagagcaccgtgcccatgtcgccgaccagggtgttgtagcccatcggcatggcctggatgtcatcgtggatggcagccatctgcgcgcactgcagcagccagggcatgtccggttgcgggtcgaagaaactgatgttgtcgctgagcgaaccggcgaacagcacgtcgtcctgcagcaccgtgccgaccagttcgcgcaggccgtccaggcccagttgcgcaaggtccaggccggccatgcggatctgtccctccactggcgggaggatgcccagcaggacgttgagcagggtgctcttgccgcagcccgaggggccgacgatggccaccgactcgccgccggcgatgcgcaggtcgaggccgtcgaggacccagggctcctgttccgcgtagcggtagcgcaggccctggatctcgatgctcgcctcgcgctcgcggaggttctccgggaggatgtcgccgtggctgacctccggggcctggagcacgatgtcggccaggcgctcgccctgcaactggagcatgcgcagctcgaagaacttgtcgatcaggctgccgacgcggctgtcgaactgcgacttgtaggcgttgaaggccatcaggatgccgacgctgaactggccgtccatcaccatggtcgcgccgagccagatcaccagcaggttctccacgccgaacagcaggccgttgagctgctggtagaacagttgcagcttctgcgtacgcaggccggcgttgatctgttccaccagcaggccgagccataccgagcggcgctcgtcctggcgctggaacagcttcgacgatctgctcctcggtggcgttgcgcaacggccggtaccagatccagcggccgagggcgtagaggctcatggcggcgatttagttcgcgcacctga

SEQ ID NO: 15859 - DNA, 627 bp, Pseudomonas aeruginosa
ggcccgcccagcgtgcccattcggccgccggccgcggatcgccggggttggccatcaatgcctcggcgatcctgcgcaggcgcgaatcccccggatagggcaggcgggtccgctggggcacggcgtggcgcagttcgtccagcagcacgcgcagcaggttctcgcgttcggtgctccaggcggagccggtcggccagcgggtggcgcgttcgacgatcagcgccacgaaagccgagcaggcgagcacgccggggtgccggggcaggtcgcggcagtgttcggcggcgaggtaggcgctccagcccgccaggctgccgtgggagtgcgccgagtgtgggtgacccggtgggatccaggcgatctggcgcggaggcagggcctggcggccatgctcgtcctcgaccaccagaaggccgcgctccaggcagtagagctggccgcaggcatggcggtgggaggccgtgcggctggctgcgcggtcgatgcgcagggcgaagagcgggacgggcaggggtttcggaaacatttggcggaaaagcgacgatgattggctcgggatggataataggccattcgactgcggatgtagcctggcggctcatcattcttgcttggagcacgccatga

SEQ ID NO: 15860 - DNA, 567 bp, Pseudomonas aeruginosa
gccaggagtgccagctttccaagggcgccttcgccctgccgacggcgcgcgagtcgatcgccgcgctgctggaaagcgccgccgtcagctacaccaccgaaggcaagccgcgcggttgcctggtcgacctcagcacgaccaatttctcgccggccaacaaaggcgtcgaagactacctgcgcgatcaccggcggcgcgccgcgcgcctgctgcgcgagcgtttcgcacgaggcgtggccgacggcgacgtgccggccggagccgatctcgacgcgctcaccagtttctacagcagcgtgcttcagggcctgtcgatccaggcccgcgacggcgccagccgccagcagttgctggccatcggccgctgcgcgatggcggcctgggattccctgctggcggtcgaggccgcctgacgccacagcgcgccttggctggaaaaagcccatggattctccgtgggcaaaaactataacgcgtgatatagaattgatccaaaccccgggcgaggtccttccgcgcgtgtctcgcgccccggccatcgcccgctgccgattggagctttcatga

SEQ ID NO: 15861 - DNA, 444 bp, Pseudomonas aeruginosa
tgggacatatcgccaaatccctcagcgaagaggagatccgcagcgtcagccagttcttcgccaccctcggtcaggcaggaggccagccatgaacatggccgtcgatcctttccctggccgtcgccggcctgctggtcgctcccgtccacgcggcaacggcgccctcggagccgttccagccgccggcggaaagcagcctcccggacaacgccttcggcgaaatggtccgccagggccaggcgttgttcgtggaaacccggaagaacgcaccgcatctggtcggtaaccagctcaactgcgtcaactgccatctcgaccagggccgccgggccaactccgcgccgcagtgggcggcctacccggtctatccggcgttccgtgccaagaacaacaaggtcaatacgttcgccgagcgcctgcagggctgcttccagttcagcatga

SEQ ID NO: 15862 - DNA, 1380 bp, Pseudomonas aeruginosa
acagccacgagcgcccgcaggacccgcgcctggtggacggttcggtggagaagacgcggcagaagttccatgccaacgacggcgtcaacctgtacggacagaaggtcaacggcgtgctgctgggacagggaatctgaccctcgtggcctggcgtccgcaggacggagacccggtccggcggaagcaggtcggcgcgggggtagggcggataacgccaacggcgttatccgccgatgcctgggcctcggtccggcggatagccgcgggcggctattcgccctacgggggccggttggcgggtgggcccgcgcatcactcgcgcagcggcatttccagcgtcacccgcaggccgtccgcgcggctgtcgaagtccagccggcattggcagcgttgcacgatagcctggacgatggccaggccgagcccgctgccgccgctcttgccgtggcgccagaaacgccgggtgaggtgcggcaggtcggtttcggcgatgcccggaccgtggtcgcggacgtggaagcgcgcgcagccttgcgcggtttccaccgccagctccacccgggtgccggcggcggtgtggcgcacggcgttgtccagcaggttgcgcagcgcggcgatggccagcaccgaggggacttccagcggcgcctcggacaagccgtcggccagcttcagctcgaacatccgcacgtcgccgtggccggcgtcgtgcatggctacccgggcggcgtcctcggcgctgcattgcacgccgtcgtcgaacgacaggctgccttccacccgcgccagcagcaacagctggtccagcgtccggtgcagacggtcggcgccttcctcggcgtgggccagggcctgctcggcggcggcgccctcggtcatgcgcgcgacctgcaggtgggtcttgatcgcggtcagcgggctgcgcagctcgtgggcggcatcgccggtcaggcgtcgctcgcgttcgatggcctgggcgatgcgctggaacaactggttctgggtttccaccagcggcttcagttcgctcggcagggccgccagctccagtggctccagcgagtcggcgccacgtcgggtgagggcgtcgcgaatccgcttgagcggcgccaggccctggccggcgccgagccagagcagggccaggctgccgagcagggcgaccgtcaccggcaccgcggcggccaccaccaccgagcgttgcagcacgtcgcgctcttccaggcggtcggcggtgctgacccgcagatcgccggcctgcacggtgaagctgcgccacagcacgccgttgatttcctggtcgcggaagccgctggcggtgctgtccagcgcccgctccggggtggcatggctctgcgccaggacttcgccgcgcagtga

SEQ ID NO: 15863 - DNA, 837 bp, Pseudomonas aeruginosa
ccgcgccgctggccgggggccttgctctatatcgcgcagaccggcaatgccctgcatggcggcctggtgctgttcagcctgggcctcggcatcggcatgccgctgttgctgctggtgacggtcggcagccgcttcctgcccaagcccggtccctggatgaacctggtcaagggcgtgttcggcttccttttcctcggcaccgcctggatactcctgcgtccgctgctcggcgaggcgctgtggatcggccttggcggcgcgttgctgctggtcctggcctacgccgcgctgcacacggcgcgaggcctggcgcggcacgcggtgctgttcggcgcggcgggctgcatcttcggtctctggggcgcggcgatgttgctgggcgccgcggccggggccgacgacccctggcgtccgctacaggtgtatgcggcggcgaaccggggcgctacgccgacggccagcgcccacgaggcgttcctcacggtgagccagccggccgagctggaccgtcagttggctgcggccaaggccgagggacaatgggtgctgctcgactactacgctgactggtgcgtgtcctgccggatcatggagaaacaggtgttcgccaagcccgatgtgctcgccgccctgcagggcgtgcgcctgctgcggctcgacgtgaccgcggacaacgccgccagccgcgagctgctgcaccgctaccaggtacccggcccgccgagcctgatctggatcggcccggaaggcgaggagcgccgcgcgcgccggttgaccggcgaagtcgacgccggcggcttcctcgcccattggcaggcgacccgggagcgcggctga

SEQ ID NO: 15864 - DNA, 528 bp, Pseudomonas aeruginosa
tgttcctcttcgccaaccagggcgagagcgccgagaccgtgcgccatttcctccagggcgagaacctgcgcctggacaacctgctgttcgacaacggcgggcagcttggccagcaggtcggctcggtcgccttgcccaccaccgttttctacaccgccgagggccgcctgctgggcagccatctcggcgaactgtcccgcggcagcctggcgcgctacctcgaagccttcgagccggccgctgccgcccccgcaaccaggagttccgaatgagactgccgcgcaacctgatcacccttggcctgggcctgaccctcctcaacgccggcctggccacggcggcggaggagctgccggcgccgatccgcatggtccaggagaagggcgcccgcatcctcggcagcttcgacgccccggatggcctgcgcggctacgccgccgaataccagaaccagggcatggcgctgtacctgacgcccgacggcaagcacgtactcaccggccacctgttcgacgcccagggcaatga

SEQ ID NO: 15865 - DNA, 510 bp, Pseudomonas aeruginosa
cctcagccgcgaaccgctggagcgcctggtgtatgcgccgctggccaaggaaatgtggcagaagatggagcatatcgcctggatcgccgatggccgtgccgacgcgccgcgcgtggtctacctgtgcagcgacccgaactgcccgtactgcaccatgttctgggagcaggcgcgaccctgggtggatgccggcaaggtgcagttgcggcatatcatggtcggcatcatccgcgaggacagcgaagccagtccgctgcgctgctggccagcaaggacccgcagaaggccctgcacgaccatgagcaggcgggcaaggccagcaccctgaagccgctggcgaagatcccggcggcggtgcgcaagcagctcgccggcaacatggaactgatggcgtcgatgggcgccgcggcgaccccggcgatcttctatctcaatgccgaggggcgcatgcagcagcaacagggcgcgccgcagccggaccagttggcggagatcctcggtccgcgctga

SEQ ID NO: 15866 - DNA, 1407 bp, Pseudomonas aeruginosa
tcctccgggccggcgccgagccgccggccatctatactccctgcgttacgccaacccagcggagcaagggccatggacgacgcattcagcgaggaaggcagcgcgcagccgcgccatgacgctcagcgtccggcgctggccccgcggagcgacggtttcgacatccacacctaccatcccgacttcgtcgccgatccctatccgctgttgcggctgatccgctcccgtgcgccggtctgccgcgaccaggcctcgatctggtggatcagtcgctatgccgatgtttcggcgtgcctgcgcgaccgccgtttctccgccgaccccgctcgccttggcgccgccggcgtccgccagggcggcgccagctggttcggccaccagcaattgcaaccgctggcgcgcttctacgacaacttcatgctgttcaacgacgcgccgcggcacacccgcctgcgcaggctgttcgctccggccttcggccccgacgccgtgcgccgctgggaagcgcgcatcgaggtgctggtggaggaactcctcgacagcttgctggagcgccgcgagcccgatctgctcagggatttcgccgaaccgctgacgatccgggtggccgccgagctgttcggctttccccgcgaagataccgggcaactgctgccctggggccgcgatctggccgccgggctcgatctcgccgccagccacggcgatgccgggcagatcaaccgcagcgcggccgccttcagcgactacctgcaacgccaggcgcgcggctggagcgatggctcttcgcgcccgccgtccggcgcggcgccgagcatcttcgacggcgccgcgatgctggaggccggactgggcctcgaggacctggtagcggcctatgccatggtgttcatggccgccttcgaaaccaccatcagcatggtcggcaacgctacgctggcgctgctcacccatcccgaccagctcgacctgctgcggcggtgcccggagctggcggcgaacgcggtggaggaactgctgcgcttcgatggcgcggtgcgcggcggcgtgcgttgcaccctggaggaggtggagatcggcggccagcggattccgcctggagagaaggtctggctgagcttcctcgcggcgaaccgcgacccggagatgttcgccgcccccgaccgcctgcaattgcagcgagcgaacgccaagcagcacgtggcgttcgcccatggtccgcactactgcctgggcgcgtacctggcccggctcgaattgcaatgcgcattgcgcggcctggtgcgtcgccgtttcgccctggcctcggaaccgacggacctgcgctggcggcgcagctcggtgttccgcaccctggagcgcttgccgatcgtcccggaaggcgacgctcagaagacctgcgagtag

SEQ ID NO: 15867 - DNA, 441 bp, Pseudomonas aeruginosa
tggcggcgtggcgcggatggccgacctggctggcagggtagagcgggccgatcggcgccgagcggtcgaaggccttgccgatctcccagggccggcccatctcgcgcatgcgcatctgcaggtcgcggcgggtcatgtccaggcccaccgcgtagccccagacgtgttcctcggcctgctccagggggatgtcgcagccgcccttgccgatcgccgccaccagttcgatctcgtagtggtagttgccggtctggctcgggtaggccagctccagggtgctgccggcggcgaccgggaccaccgcgtcggccggcttgcagaagaagaacggcggctcgcgctcgggatcgaagcccatttcccgggcgtgggcggcgtagttgcggccgacgcagtagacccgccgcaccgggaaggtctggtcgctgccatggatggtga

SEQ ID NO: 15868 - DNA, 3357 bp, Pseudomonas aeruginosa
cgcgcagcgcctgcagcggcgccaggcgctgaaactgctgtcgttgctggtggccggcggcgccgtggcctgggtcggtcgcgacagcctgccctggcagcgcctgagcgccgactacagcaccgccaccggcgagcggcgcagtatcgagctggtcgacggcacccgcctgcaactgaacaccgacagcgcggtcgacgtgcgctacgacgccggccagcgcctgattctcctcgcccgcggcgagatcttcctcgccagcggcgccgatacgcaatcgcccacgcacaggccgctgcgggtacgtaccgcgcaagggctgttcgaggccctcggcacccgtttcaacgtacgcctgcaagatgccgccacctgtctcagcgtcagcgagggttcggtgcgcatcgatgccttcggcgcgcgtccgctgcaggctccggtggccgaggcggggcagagctatcggatcgccgccgacggcgtgcggcgcctcgaacggccgcagatggacgccgtggcctgggccgatggcctcatcgtcacccgcgacatgcgcctggccgacttcctcgccgaggtcgcccgctaccgcaacggctacctcggctgcgccgcggaggtcgccgacctgcgcctgtccggggtctatcgcctggacgacaccgacaagctgctgcaggtgctcgcgcggaccctgccggtgcgcctgcagcgacatacccgctggtgggtgagggtggtcgccgcctgagtcgcgccggcggccgcgtggacgcttgctttcgtccggagcgaaacgcactgaaaattattttcattatttttgtcggctttccgcgactggtccggctttaccgattgaacacccttcaacgactccaacggatcccgttcatgaccgccaccgccgtcgtcctccgcaatgccccgtcgtccctcgatttcccccgcgcctcgcgcctgagccgttcggtgcgcgcggccctgctgtcgttggccatggcggccggcgcggcgccgctctgcgcctcggccgccgaagcggcggcggaacacgcgcggccctatgcgatccccgccggacagttgggcgacgtgctcaaccgcttcgcccgcgaagccggcatcaccctctcggccactccggcgcagaccggtggctacagctcccaggggttgcgcggcagtttcaccgtgcagcagggcctggcccggctgctcgccgacaccccgctggaagcggaagaccagggcgacggcagcttcgtcttgcgcgaggcgccggcaaaggacggcgatgtgctgaacatgcaggcggtggaggtcttcgccctcggcaacaacctgggcagcaccgatggctacctggccacccatagccagatcgccaccaagaccagcaagccgctgctggaaaccagccagaccgtctcggtgatcacccgcgagcagatcgacgacaccgcctccaagaccgtgcagcaggcgatgcgctatacccccggcatcttcaccggccaggtcggcgcctccaaccgctacgactacgtggtgatgcgcggcttcgccgacaacagcgtggacaacatctacctcgacggcctcaaggccatgggcgacagcggtaccttcagctcgatgcaggtcgacccgtacttcctcgaacgcatcgatgtgctcaaggggccgtcctcggtgctctacggccgtagcctgccgggcggcctggtggcgctgaccagcaagaagccgttgtacgaggactaccgccagatcaccggcagcatcggcaacatgggccagaaggagatgggcttcgatttcagcgggccgctcgacgaggagaagcgcatcgcctaccgcctgatcggtctcggcaagggctcggacacccagttcgatcacgtcaaggaggagcgctacgccatcgccccgaccctggccatcgacttcagcgacgacaccaccctgaccctgcaaggctacctgcaacacgatcccaacgggggctaccacggcggcgtaccggccgacggcaccctgtcgcaccacaacggccggcacatctcccgcgagttcttcgatggcgagccgagcaaggacgacttcgaccgcacccagcggatgttcggctaccagttggagcaccgcatcgacgacgtctggtcggcgcggcagaacttccgctacctggactccgacgtcgacctgtcgcaggtctacgcctacggctggagcgccagcgagccgaacaagctgaaccgctacttcagcggcgcccgcgagcacctgcaggcgtatatcgtcgacaacatgctgcaggccgaattcgccaccggcgcggcgcgccacaccctgctcaccggcctcgactaccagcgccggcgcaccgtggtcgactggcgttccggctcggcctcggcgctggacgcgttcaacccggtctacggcgacgacgccatcagctatttcccggacgacaaccacacccgccgcctggagcagaccggcgtctacctccaggacctgatcgacatcgaccagtggcgcttctcgctcggcctgcgccaggactgggtcagcgtcaccgacaagaaccgcagcaccggcagcaaggccgacgatgactgggagaaattcaccgggcggatcggcgcgctgtacctgttcgacaacggcctggcgccctacgtcagctactccgagtcgttcaacccgaacgcctattccgacgcctccggcacgcccctggcgcccaccgagggcaagcagtgggaactcggcctgaagttccaggcgccgggcagcaacagcttctacaccgcctcgctgttccatatcacccaggaaaacgtcgcctccaaggaaccccaggacaacttctacacctcggtcggcgaagtgcgctcccaggggctcgaactggaggcccatacccagctcagcgacaacctgaaactgctcggcagctacacctacaccgacatcacctacaccaagtcgctggacggcaaccagggccatacgccgaaccaggcgcccaagcacatggcttcgctgtgggccgactatgccttcgacgccggcccgctcagcggtctgagcatcggcggcggcgctcgctacgtcggcgagacctgggcggacaaggaaaacaccttgcgggtgccggactacaccctggtcgacgcgcggatcggctacgacctcggcaagctcggcctgaaaggcctggacgtcagcctcaatgccaacaacctgctggacaaggactacgtggcgtcctgctacagcctggacttctgctacttcggcgagaagcgcaacgtcaccgcgacggtgaactaccagttctga

SEQ ID NO: 15869 - DNA, 1266 bp, Pseudomonas aeruginosa
ccgtccacccgggccccggcgccagcgccgcggtaccggccaagcagcccggcgcgcgacgtacgcgccgggcattcgccggcgtcgccggccgtaccctggttacctggagcccccatgcgccccgtcctggtcctgctgcaccgctatgtcggtctggctaccgcgctgttccttttcctcgccggtctcaccggcagcctgctggccttccatcatgaaatcgacgaatggctgaaccccggcttctacgccgtgggcgagggcggcgagcgcctttccccgggcagcctggtgcaacgcgtcgagtcacgctatccgcgacaactggtgtggtacatggagtatcccgaggcgggcgggcatccggcgttgctcgccaccgtgccgcgcgaggccggcgccaaggtcgagcacgacgtgttctacctcgacccggtcagcggcgaggaagtcggcaagcgcctctgggcggcctgttgcttccagccggcgaacctggttccctgggtcctggagttccaccacaacctgaccctgccggggaactggggcctgtacctgatgggcggggtggcgatgttctggttcctcgactgcttcgtcggcgcctggctgaccctgccgcgcggccggccgttctggagcaagtgggcgaccgcctggaagatcaagcgcggcaacgcctaccgcttcaacttcgacctgcatcgcgccggcggcctctggctctggctgctgctggcgccggtggcgctgagcagcgtcgccctgaacctgcctagccaggtgttcaagccgctggtatcgctgttctcgccgatcgaaccgagcgtctacgaggcgcgcgggcggctgcccagggagcaactgggggagacccgcctggactacgaccgcaccttccagttggccagcgtcgaagcggcgcggctgggcatcgtcgagccgatcggcgagctgtactacagcttcgaatacaacttcttcggcgccggcttcggcgaccacgacgaccccatgggcaagtcctggctgttcttccacggcagcgacggccgcctgctaggccaggaagtcgccgggcagggcagttggggagagcgtttctaccgcttgcagtacccgatccacggcgggcgcatcgccggcctgccgggacgcatcgccatcgccgccctcggcctggccatcgccgggctgtcgctgaccggtgtctacatctggtggcgcaagcgccgggcgcgccactggaacggccgctag

SEQ ID NO: 15870 - DNA, 1353 bp, Pseudomonas aeruginosa
ctatcgagcggttgtcgctggcttggttttactgccgctgcttgccagcgccgcccccttcacctcccccggcgaccgcgacctgatccgcgaccgccagcagcgcctgctggacgaacagcgcaagcgcctggaggaactccagcaactgcccggcaagggagcgcccgccgctgcggatgcctccggcgacgacgagcgctgcttcgagatccgccgcatcgagctggaaggcgccgggcacctcggcgaaagcgcgcgtcgccaactgctggcgccctaccaggggcgctgcctgggcgtcggccagctcaatgcgctgctcaaggccgtcaccgaccattacctggatcgcggctacgtcaccacccgcgcctacctgccacagcaggacctggcctccgggaccctgcgcatcatcgtcgtcgaaggccgcctggagggcctggacagctccgcgctggccagcccgcgcgaactgacgatgagctttccgggcaggaccggcgagctgctcgacctgcgcgagctggagcaactggtcgaccagttgagccgcctgccgtcgcgccaggcgcaattggagctggtgcccggcagcgaggtcggcggcagccgggtgcgtctcaagggcgagcgcgacaagccctggcgggtctccgccacgcgcaacaacgacggcgacgtcagtaccggcgagcagcagatgggcctgggcctggactgggacagcccgctgggcctggccgaccagctcaacctgcgcgccaaccgcgacgcggtgaccgaccgctggcgccattccgacagccagagcctgttctacagcctgccctggggctggtggaccttcacctacggctacagccagagcgactaccgcacgcgcaacgaggccagcggcttccccttcaagctcgatggcgacagccgcagccaccagttccgcgccgaacgcgtgctgcaccgcgacggtgtgagcaagaccgccatgagcctggggctcagccaccagcgcaccaacaactatgtcgaagacacccgcctggaagaccagagcacgcggatcaccgagacccagctcggcttcaaccatggccggcggatcggcagcggtttcgtcaacctcgacctcggctggcagcagggcatcggcgcccttggcgcgcagggtcgcggccacccgcaggcgggcgacccgaatgcgcgctacgacaagtacagcctgaccctcagctacctgcagccgttccagctatggggcgagcgcttcagcttcgacagcctggccaccgggcaaaggagcgaggacgtgctgttcagcccgcagcgcatcagcctcggcggcaatag

SEQ ID NO: 15871 - DNA, 3351 bp, Pseudomonas aeruginosa
ctcggtgcgcggcttcaaggaccagaccctgaccggcgacagcggcggctactggcgcaaccagttgcgctggcggcgtgcggtggaatgggcgccgctgcggccctggctgcaggaatacggcgtggccttcgcctacgacgtcggcgtgatccgccacgaccgctacaacgacggcgccagcgggcgcatgagcggcaacgccatcgaactggatgcccgcggccgctatttcgccgccagcgtcggcttcgcccgctcgctggagcggcccagcgccatcgagcggcgcgagcacccgatctatttccgggtcgacgcgttcttctgaagacgcggcgacctcctgaacgctttaggaaagcgcctacctgcatcgaggccctttcccttggaaaaccttgcttaacctcgccgggcccctacccgccaaggagtaacgatatggacatccgcagcccgctgaaccagtgcatcgccctgtccctggccggcatcctgttcctcaacccgatcgtcgccgcggcggcggggctggcgctggacaaggccgccggcggcaacaccggcctgggccaggcgggcaacggcgtgcccatcgtcaatatcgccacgcccaacggcgccgggctgtcgaacaaccatttccgcgactacaacgtcggcgccaacgggctgatcctcaacaacgccaccggcaagacccagggtacccagctcggcgggatcatcctcggcaaccccaacctcaagggccaggcggcgcaggtgatcctcaaccaggtcaccggcggcaaccgcagcaccctggccggctacaccgaggtggccgggcagtcggcgcgggtgatcgtcgccaacccgcacggcatcacctgccagggctgcggcttcatcaacacgccgcgcgcgaccctcaccaccggcaagccgatcatggacggccagcgcctggagcgcttccaggtggacggcggcgacatcgtcgtcgaaggcgccgaactgaacgtcggcaacctcgaacagttcgacctgatcacccgcagcgccaagctcaacgccaagctctacgcgaagaacctcaacatcgtcaccggccgcaacgacgtccaggccgacagcctgcaggccacgccgcgcgccgccgatggcagcgagaagccacagctggcgatcgacagctcggcgctgggcgggatgtacgccggggcgatccgcctggtcggcaccgaacagggcgtgggggtgcggctggccggcgacatggccgccagcggcggcgacatccgcatcgacgccagcggcaagctgagcctggcccaggcctccagccagggcgacctgaagatcgcggcccaggccgtggagctgaacggcaagacctacgccggtggcagcgccgagatccgcagcgcggaggaactggtcaaccggcagagcctggcggcgcgcgaacgcatcgcgctggaggcggcgcatatcgacaacgccggggtgatcgaagccggcgtcgagccagacgagcggcgcaacgcgcgcggcgacctcgagctgcgcagcggcaccctgcgcaacgccggcagcctggtggccagccgcgcgctggaagcgaaggcgagcctggcactggacaaccagggcggcagcctgaagggggcgaccgtccgggtcgacggcggacacctggacaaccgtggcggcaagctgctcgccgagggcgaactgcgggtcgaggcgagcagcctggacaaccgccaggacggcctgttgcagagccgggaccgcgccgtggtcaagactcgtggcgatctcgacaaccgtggcggccaggtcgtcggtctgaacgaactgcaggtccaggctgccgcactggacaatcgcagtgccggtctcctttccagcaagggagacatggacatcgaggtcgctcgtctggacaacagtgcgggcggcaagctggtcagcgagcgccgtacgctcctgaaggcggatcggctcgataatcgcagcggtcgcattgtcgccggccaggatctcgacttgagctctcggttgatcgacaaccgagcgggcgatatctccagcacgtcgagggtggtggcgagcgctcgcgaacagttggacaaccgcggtggcaagatcgtcggtgacagtggcctggacatcacaacgccacgcatgctcaaccaggacaagggggtactcgccagccgcgatgggctgcgcctgagtgctacggagttgttcaacggcgcggggggcctgctgtccagccagaagggtatcgacgtctccctggccggtgcgttcgataaccaggccggcagcctggacagccggggcttcctgacggtgaagtcagcctggctcgacaaccagggcggtacgctatccagcgcaggggcattggcagtgaccagccagggcgccctgaacaatcagggcggcagactggcgagcgacgccggaattagcttgagcagcgccagcctcgacaacagccagaccggtgcgatcagtggcaagggggccgtggagattcgtaccggcaacctgaacaacagccggaaagccagtatcggcagcgatgcgggactcaccctggtcgccgctcgggtagacaacagccaggcgggccggatcgctgccaagggtgcgatcgatgcggatctccaagggctggaccagcatgacaggggcaacctggtcagcgataccggcatcacgctcgatctgaacaagggaagcctggtcaatcgcgctcaaggcctgatcgccacgcctggcactttgctcctgcgccaactcggcgtggtggacaacagcggtggggaaatctccagcgaccgcgcgttcactcttgccacctccgcgttgaacaaccaggggggacgcctgctcagcggcggagccctgaccttgcgtatcgcgcaggccctggacaacagcctcgaggggcttgtctccggtgccggaggtctggatatccaggcattcgtcctggacaaccgtagtggctccatcggcagcaagggcgccatcgatatcggtgtgacccgcctggaaaacgacgctggcacgctgatcgccgaacgcggcctgaagctggtagccgatgaggcgaacaattccaaggggagtatcgtcgccaaggatgatctgcgtgccaaactcggtgcgctggtgcagaacgggggagagctgacgactcagggcgcgctggccctcgacgccgacaaagtcgacaacggcgctggtcggcatcgcccggcaaccgaggtgtggtcatcgatgcccggcaggtggacaaccgtgccggcgagattgccagccagggcgtggcgacgctga

SEQ ID NO: 15872 - DNA, 837 bp, Pseudomonas aeruginosa
aggccgcctggagcttgtagccgaccaggtgagcaacggcaaccaaggccgtatcgccgccagaggcgtgctggaggcggcggtcggtacgctgctccagcaaggcggcgagctggtcagccaggggagcctggaccttcgcgccgacgtgctcgacaacagccagtccgggctgatcgccgcgaatggcggcatcgctatcgaggcgcggcaggtcgacaaccgcgccggcgagatttccagcacctcgaaggtcgccgtgaacgcccgcgagcaactggacaaccgcggcggcaaggtcatcggcgacagcggcttgcgcctcaccgtgcagcgcctgctgaaccaggccaagggggtgttggccgggcgcgacggcttgagcctggacggcggcgaactgttcaacggcgacggcggtcggctcgacagccagaacagcctgagcgtgagcctcggcggcgtgctggacaaccagggcggcgcgctggtcagcgaaggcagcctgacggcgcgcgccgcgcgcctggacaaccgtggcgggaccttctccagcgccggtgcgctggcgctgaccaaccaggccgcgctggacaaccagggcggcaggctgctcagcgatgccggcgtgacgctgcagggcgccagcctcgacaacagccgtaccggcgtgatcagcgccaagggtgcggtggatatccgcaccggcgtgctggacaacagccgcaacggcggcatcggcagcaacgccggcatcaccctggtggccgcccagctggacaacggccaacagggacgggtcagcgccaagggcctgctcgacgccaacctgaaagg

SEQ ID NO: 15873 - DNA, 573 bp, Pseudomonas aeruginosa
tcgaagagatgtaagccgccacactgcgcttcattcgagccatcccgcccacggagcgcagccatgtcgtccaccatccaccccctcccgtccttcggtctcggcaccttccgccttaccggccaggtcgtcgtcgactcggtgcgcagcgccctcgaactgggctatcgcgccatcgataccgcgcagatctacggcaacgaggtggatatcggccgcgcgatcgccgagagcggcgtaccgcgttccgagctgttcctcaccaccaaggtctgggtcgacaactacgcccgcgaaaagctgctcgccagcctgcgcgagagtctggagaaactgcgcaccgaccggttggacctggtcctgatccattggccggcacccggcaacggcgtcgagctggcggagtacatggcggcgctggcggaagccaagtcccttgggcctgacccggcggatcggcgtctccaacttcaacatcgaactggacccgccaggccatcgccgcggtcggtgcgggcgagatatccaccaaccagatcgaactcagcccttacttgcagaaccgcgcgctga

SEQ ID NO: 15874 - DNA, 2013 bp, Pseudomonas aeruginosa
ataatcgagggcagaccatttgttcaggcagtcactgctcgagtcggtcaaggcgcgcctcctccatccacagctccaggccctgccgctgcatgcgcgaatccagcgcgcgatccgccaactgatcctcgacggtgcgctggcgccgggcaatccgttgccggcctcgcgggcgctggcgcagtcgttgggggtatcccgcgacaccgtcgaagcggcctattcgcacctgcatgccgagggcttcatcgagcgtcgggtcggcagcggcagcgtggtcgccgcggctacccggctgtcccccggccggcgcggcgcgggcgctccacgacggggcggcggcgcgccgcgactgagccggcgtggcgaggcgatgcaggctggcggcggggttcgcgagcagctcgtcccgcgccccttcgctcccggcgtgccggagacccgcacctttcccctggcgacctgggagcgcctgcagcgccaggtcctcaaggaatacggcgcgcgcgccctgacccatggcgacccgcagggtgccgaaccgctgcgccaggcgatcgccgactacgtcaacctggagcgtggcgcacgcgccacggccgaccgggtactggtgctgaccagttcgcaacaggcgctgggtctttgcgccagcgtgctgctcgacgccggcgagcggatattcgtcgaggacccggcctactacggcgcgcgcaaggccttcgaggccgcaggcctggagtgcctgccggtcccggtcgacgaacagggcctgcggcccgagccgatcctcgcccagccgcaggcagcgcgggcgctgtgcctgaccccgtcgcaccattacccgaccggcgtgaccctgtcgctggagcgccgcctggcgctgatcgaatgggcgcagcggcagcaggcatggatcatcgaggacgactacgacagcgagttccactacgccggccggcccaccgcctgcgtgcaaggcctggacgcccacgagcggacgctctacatcggcacgttcaccaagtcgctgtttcccggcctgcgcatcggctacatggtcctgccgccggcgctggtggcgccgatgaccgtcgcccgctccctgcaggacgggcacaacgcctcgctggcgcaactgaccctggcgcgcttcatcgccggcggccatttcggcgcctatgtgcgcggcatgcgcaatctctacggcgagcgcctgggattcctcgcggagcgggtgggcaagcgtctgggcggcctggtcgagccgcgcgtgccggccggcgggctacagatgcccgggctgctttgcgcgggaatcgacgaaacgcgcgccatcgcggcggcataccgcgccggtgtcgagctggtcgggctcagcgccctgcatctcgccgcgccaccgcgagcgggtttcctgatgggcttcgccgcctacaccacggacgagctggaggcggcggtcggggtcctcgcgaagaccctgcgcggtttgcgtgcgaatccctaggccgccggcaagcgctcagtcgcgcagggcgtagacgtaggcatcgacctgggcgccgtcggccagcgttacccgggtcgccacgcgccggtattcggtgccttcgaattcatccagcgcgggccagtgctcggcgaggcggtcggagacgaacacatggccgtggatttcctcgccgtcggcgtcgatcgccaggcccggaaagcccatcccggcaccccagcccttttccagcaggcgaccgcggaggctggccgcctgccattgcccgccgatcttctgcatcaggtgttcgttgggacggccggggccgaggctgccgtagacgaagagtcgctgcatcgataactcccttgaacggaagagcgtgggcgcaagacgcgaagccttccgcccgcgcctttcacttgcttgccagcggtggagtacgcggcggcacgatacgccgcgagccggtcgactcgaaggccgcggcgaagcgcagcagcgccgagtcgtcgtag

SEQ ID NO: 15875 - DNA, 981 bp, Pseudomonas aeruginosa
cgacgctcatcatcgttcctcttgttctctgcttgctgcgacgggggccgcgaggcggccgggtcgatacaggggatgcagtgtacatcctggccggcgctcgcggcttccctggcggggcgcggcaacggcctcgcaggtcctggccagtgtctggggttgccgccgaagcgcggcgtcggagaaagtccgcgggctgtcgccggccgccggcgaggcgtaaggtgcggcgtcggggggaccatttcacacaggggaatcgtcatgacgaatcatcgtaccgcgctggtcaccggcgccacccgtggcatcggcctggccctggccaggcgcttggcggcctccggctggagtgtaatgggcatcgcccgccatgcgagcgacaactttcctggacgtctgctgtgctgcgacctggccgatcctgcgcaaaccgccgagacgctgcgcggattgctctcggaaagcgccgtggatgccttggtcaacaacgccgggatcgccttgccgcaaagcctggagaacctcgacctggccgctctgcaacaggtcttcgacctcaacgtgcgggtcgccgtgcagcttgcccaggcctgcctgccggggctcaagcgttcgccggcgggccgcatcgtcaacctgtgcagccgggcgatccacggcgcccgcgaacgcaccgcctacgccgcggcgaagagcgcgctggtcggggtgactcgcacctgggcgctggagctggcgccgctgggcatcacggtcaacgcggtggcgcccgggccgatcgagaccgagctgttccgccagacccgcccggtcggcggcgaggaggaacggcggattctctcgaccatccccatgcagcggctcgggcggccggacgaagtggccgcgctgatcgagttcctgctcagcgagggcgcttcgttcgtcaccggccaggtgatcggtgtcgacggcggcggcagcctgggcggtcgttga

SEQ ID NO: 15876 - DNA, 2103 bp, Pseudomonas aeruginosa
ccagagcaggtagaaaccgccgagcaggccggtcatcaggccgatcggcaggttggcgacgtatgccaggcgctggccgagcaggtcggcggccagcagcaggaccgcgcccatcaatgcgccggacagcaacggcaccccggccgagcgggtcaggcgccgggccagttgcgggccggccagggcgatgaaggcgatggggccggccgcggcggtggcgatggcggtcatgccgacggcgaccaggaccatctgcaagcgcacgcgctccaccgccacgccgagctgggcggcgctggcatcgcccagctccagcaattccaggcgacgaccgtggtacagcgccagcggcacgttggcgagcaggcccagcgctgccgggacgacgtgcgaccaggtccgggtgttcagcgagccggccagccagagctgggcatacatcgcctggtcgaggttgccggtgaccagcagcaggctgttcaggcccgacaggctggcgccgacaccgatgcccaccagcaccaggcggtagccgccggcggtggcgccccggcgcgccagcagcaccaccgccagcgccgtgcagaggccggcggccagcgccgccagcgaggtggccagcgggccggcatcgaacaggatgatctgcacgatggcgccgctggcggcgccggtggtgaaaccgatgacgtcgggcgagcccagcggattgcgcgagatcgactggaagatcgccccggccatgcccagcgcggcgccgaccaggcaggcggtgagcacccgtggcaggcgtacgcgctggacgatgcgctgggcggtggggtcctggccctggccgagcaggctggcgaacacctctgccgggcccagcgccaggctgccggtccccagcagcgccgccgccagcgccagtccgacccccgcgaggaccaggcaggccagcgccgcccgtggccgccaacgcagcgacagggagcccaggcgcagggcgtggagaccgttcacaggcggctcaggcggaagcgcctgaccaggacgatgaaggccggtccgccgagcagcaaagcgacgattccggcggcgatctccgccggcgccgccagcagccgcccgaggatgtcggcgccgagcagcaggccggcggcgatcagcgccgagaaaggcaggatccagcgctggtccggtccggccagcagtcgcgcgaggtgcggggcgaccaggccgacgaaggcgatcggcccggccagggcggtcgccgcgccggccagcagcatcaccgccaggcaggcgagcagccaggtcaggcgcaggtcgacgccgagcgcccggccgatctcctggcccagggccagggcattgagcctggcggcgagggcgaaggcggcggccagcccggcgccgatggccaggcccggccatccgagcagggcgaagccgctgccggaaagcgagccggcggcccagtggcggaagcggtcgaagacttccggcggggcgttcagcacgatgatcccggtcagcgaggcgagcatcactgacaagccggcacccgccagcaccaggcgcaccgggttggtgccggtctcgcgggcctggccgagaaggaatacggcgatgccggccaggccggcgccgaggaaggcgcaaccgaggtactggcccatgctcgccaggtcgaacagcgcgaccccgacgatcaccgccagcgccgcgccggcgttgatccccagcaggccgggttcggccagcggattgcgcgtcagcgcctgcatcagcgcgccggccactcccagcgccgcgccggccagcagcgccaccagggtgcgtggcaggcgcagttcgcgtaccaccaggtggcgatcatcgtgcggatcgacggcttgcagggcgtccagggtgaccgccaggggcaccggccgcgagcccagcgccaggctggccagggccgccagcgcgagcagcagcgcgccggcgagcaggccccaggcgcgcaggcgccggcggcgcatcggggacgcctgcatgagcggacttccggcgaacgggcgcatggctcagcggaaatggcgggcgacgttgtcgatcatctgccgtcccgagtaa

SEQ ID NO: 15877 - DNA, 2121 bp, Pseudomonas aeruginosa
atggaaaagagagtcattcccatttggagaagatccttgaacgcccgcacgcaccgcacgctcaaccggggaatcggcgtcgtcacgctgtccaccctgctcgcctcgccatcggcactggcccgggaaaacccgcccgccgaggacgaacccgccgccctcgaggcgctggtcgtgaccggcgagaaacgtgaacgctcgctgaaggacacggcgtcctcggtatcgctcaccagcgcccgcgacatcgaccgcaagcagaccggcaacgcctcggtcgccgaggtgatcaatggcagtcccaacgtggtctacaccgactcggtgggcgcgccgatcatccgcggccaggacacccagggcccgaacaacgggcagaacgtgttctggggcggcacagtgccgcgggcgacgatcaacctcgatggccactacctgaactacaacgagatgttcttcggcgcgacctcggtctgggacgtcgacagcatcgaggtgttccgcggcccgcagaccacctcccagggcgccaacgccatcgccggggcgatcatcgtcaacaccaaggacccgaccttcagccccgaggctgcctaccaggcggagatcggcagctaccattcgcggcgcagctcgatcgcagtgtccggcccgctggcgcaggacttcgccgggcgcctggcggtggactacgcgggtcgcgacaccttcatcgactacgacaacccgaagttccaggacagcggcaccgaccaggacttccgcgccctcaacgcgcgcgccaagctgctctggctgcccagcggaattccgggcctggagagcaagttcaccttctcccacaacgacagcaatcgcccgacccaggaagcggcgacccgcccgttcgacaagctcgaccatcgctcgaccaccatgcccagctgggagcaggacaccaacaccagcatcctcgacgtcgcctatgacctcgacaacggcatccgcctgttcaaccaggcgcagtactcgctgtcctcggtgcaccgcaccaccggcgcgggcggcgagggcgacgccgacatccgccagaagaacgcctccaacgaatcgcgggtcagcttcggcgagcaggaggaccggatcagtggcatgggcggggtctactacgcccgcacccgcaccgacgagacactgcacctgcgcgggctgtcggccttcgacgacacgaagaagaacctcggtgtgttcggcgagctgaactaccgcctgagcgaccgctggaccctgaccaccggcctgcgctaccaggaggatcgcatcgagcgcagcggcaactcggtgctggcgccgcgtccgctggattaccagaagaccttctcggccttcctgccgaaagtctccctggccttcgccgcgaccccggactggaccgtcggcggcctggtcagccgcggctacaaccccgggggcgtgtcgctcaacctgaccacccgcaactgggcctacttcaaggaagaaaccatctggaactacgaactgttcacccgcgccagcctgctcgacggccgcctgctgctgaacggcaacctgttcttcatggatttcaaggacgcccagtacaacatcccggtggtggtttcgccgggggtggcgcagtcgtacaccatcaacgccgagaaggcccacgcctacggcatggagctggacctcgactatcgcctgcgcgacgacctgcggctgaaggccagcgccggcgtgctacgcacccggatcgacgagatgtccggcaataccggctacgagcacaacgagttcgcccgctcgccgggctataccctcagcttcggaccgagctgggacgtcaccgagcgcctcaacctgaacgcccaggtgcgctacctggacggctactactcggacaccgccaacaccaaggcctactcgatcaaggcctacaccctcaccgacgcccgcgccagctaccgcttcaacgaccaggtgcagctctatggctacgtgaagaacgtgttcgacgaccgctcgcccacctacatgcaggaaaaccgggggatcggcggcatcgaggcgagcatgacgcagccgcggaccctcggcatcggcatcaagggcaccttctag

SEQ ID NO: 15878 - DNA, 1425 bp, Pseudomonas aeruginosa
gcgccccgagaagccggccccgcgcagggccggcccagccccagagcccatacaggagattggcacgatgagtaccccgaaacgcttgcacatcggcatgtcgctggcccccacctggctcagcggcgatgcctggcggcgccccgacagcaatatcgaaggcatcttcggcagcgatttcgccgtcgacatcgccaggcgctccgaagccgcccacctcgacttcgtgtttcgcccggacgtcagcagcctgccactggacgtgctggagaccggctccggcttcgccagcctggatcccaccgtactgcttgccgcggtcgcccgcgaaacctcgcggatcggcctggtgtcgacggtctccaccacgttctatccgccctacgtggtggcccggcagctgcaatcgctgcactggatcagcaacggtcgcgccggctggaacatcgtcaccgcgctgcagggccacgagaacttcggcctggacgcgatgcccgatgcggagcagcgctacgcgcgcgccgccgagttcacccggctggtgcacgacctgtgggacagcttcccccgcgaggcactcctggtcgaccgcgagagcggccgctacgccgacgtttcccgggtgcacccggtcgaccacgacggcgaattcctcaaggtcaagggaccgctcaacctgccggccttcggcgaggcgcggattcccctggtgcaggccggcgcctccgagagcgggcgcgacttcgccgcctcggtggccgacctggtgttcgcgccgaccccggacaaggaggctgccctggaactgcgccgcgacctttcccgccgcgccgaacgccacggtcgctcgccgcgcgacgtgcgcctgctgccgggcttcagcctgtacctggcggagagccgcgaggaggcgcgggaaatcttcatgcagacccacgcgcgcctggaccgcgcgcgcaagttcgccacgatcaggcagatgctcggcctcgacctcagcgactggccgctggaccggccgatttccgcggccgacctgccgccgccggtggccaaccccggcagccgcacccacaccgacctgctgcggcgcctgatcgagcgcgagacgttacgcctggaccagttgctgctgcgccccgaggtggtttccgcggcgcactggcaggtcatcggtacggtggacgatgccgtcgagcagatcgtcgactgggccgccgccggcgccatggacggtttcatcgccgcgccgggaggctcggtcggctcgctgcggctgttcctcgaacaggtggtgccgcgcctggtggagaaggggctgttccgcgagcgctacagcgccactaccttcgccgggcacctggcagaggaatgatggaaagggccggcgacggccgcgtcctggcggcgatggtgagcgagtga

SEQ ID NO: 15879 - DNA, 471 bp, Pseudomonas aeruginosa
ataccgggccggccaggtattcgtgcaggtcggagccgcagatgccgcaccagtgcacgcggatctgcacccagccgggcggcggctcggccgggagcggcacgtcttccacgcggatatcgtggcggccgtgccagacggcggcgcgcatcgccgcgttggcttgcggggaactgttcatgtcggtcgtctcctcaatgctggcggaggaagtcgagcagcaggcggttgacctgctcggcggcttccatctgcaccatgtgcgcctgtccgggaatgatctccacctgggctggcaggccctcggcatgccgcgccgggatgatcgcgtcatcgctgccccagatcgccaggaccggctggcggccctcgctcgccacggcacgcaggtcgttgcgctggcgaccgtcggcgaacaggttgtccagcaactggcgcagggccgcatcgacgccttccaggcgcttgtag

SEQ ID NO: 15880 - DNA, 486 bp, Pseudomonas aeruginosa
cgcaggaggcgcccgtccagctcgactttccgcggtgccggtccgctatccccagcgtcctcgtcggcgggtacgaattcggcctggaagcgttgcaccagtgcgtcgatctcctcgtcgctcgcctcgccctcgaccaccacgccgagcagcgcgccgaccgccagggtctcgtcctcgcgcgccaccttgcgccgcagcacgcccgagaagggcgcctcgacgctgctggagatcttgtcggtctccacgtcgagcacctcgtcgcctttctcgatatgcgcgccctcttccttgagccaggcgtccacccgaccctcggtcatcgacaggccccacttgggcatggtcagtgtatggatccggctcatgccgcgtccctcccttccagggcctggcgcacggctgcctcgatattcgccgcgtcggggatgtagaggtcttccagggcgtcggagaaaggcaccggcgtatggggcgcggtga

SEQ ID NO: 15881 - DNA, 1083 bp, Pseudomonas aeruginosa
tggttctcctcgttcttgttttcgggcggctcagggataggacacgtagacgtcgcgcagcaggtcgtccggctccggcttgggatcgttcttcgcgcgctgcacggcatcctcgatgcgcgcctcgacctcggcgtcgatggcgtccaggtcgctggcggagagcaggccggcgtggcaggtgcgttcgcggaactgcttgaggcagtcgcgggtttcccggtagtgctttacttcgtcgggatcgcggtaggtctgtgcgtcgccctcgaagtgtccgtagtagcgggtcagcttgacttcgatcagcgacggcccctcgccggcgcgggcgcgctcgatggcggcgccggcagcctcgtggacggcgaagaagtgcgaagccgtcgacggtcaccccgggcatgccgaaaccggcggcgcggtcggcgatgtggtcgcaggccaccgaccagtaggccgcggtggcctcggcatagccgttgttctcggcgacgaacaggcacggcaggttccacaccgcggccaggttcatcgcctcgaacaccgcgccttcgttggagccgccatcgccgaagaaggccaccgccaccgcatcgctgcctttcagcttggccgccagcgcggcgccggcggccagcggcgcgccggcgccgacgattccgttggcgccgagcatgcctttctccaggtcggcgatatgcatggagccgcccttgccctggcagaccccggtcttcttgccatagatttccgccatcatgccgtgcacgtctacgcccttggcgatgcagtggccgtggccgcgatgggtggaggcgatgcagtcgtcgtcgcgcaggtgcgccatcacgccggcggcggaggcttcctcgccggcgtagaggtggacgaagccgggtatctcgcccgtggcgaactcgacgtgcaggcgttcctcgaaggcgcggatggtgcgcatcacgcggtaggcatggagcagttggtcggtgctcagagtggacatcttgttgttctccaggttgtcttcacggggtcatcggggttcgctggccggccagcaggcgatggcgggcggcgtag

SEQ ID NO: 15882 - DNA, 870 bp, Pseudomonas aeruginosa
ccggcggcagagaccccgcagcccaccagcaggcccggcgccagcggcaccagcaggctctcgcgggcgtccggatgcaggcgcatccaggcgccgtggggctcctcgcggctcaccggcgaccacagtccgcaaagcgccgaaaggccgatggcgtggggttcggcgaagctgacgaagacttcggcgaggtcttcggcgcgactgatggcgcgggcgccgatgaacggctgcggcgacaccgcgacgtccaccagcgcccactcgcagagcccgcggcgcggctcgcgcaccagcaggcgcttgttgcgtcgcaggccgatctccggcggcacccggttgctggcgcagaggccgccggcgagccccgcgccggtggcttcgcgcagctccgggaaggcgttgttggtcccggtggacagcgccagcagggggacgtcgccgacctcggcggccactgccttgtgcgtgccgtcgccgccgagcacggcgatcagcgccacgccgcgctcgaccatgcgccgcgccgccaggcgggtatcctcgacgctctggcgcagcggcatgtcgaggaactccaggaacggccagtggccgtcgcgggcctggcgggtctggctggcccggagcacggcggcggcgatgccggtcatgtccggcggcagcaacgcatggcggatgccggtggcgccgaaggcggcgagcaggcgttgcaccaccgatgccttgtcggtgctggagtgcagcccggcatgggcggtgaggcgacgcaggtcgcgaccggaggccgggttggcgatgatgccgacgatcggcgagggcggggtcatagcgagaatccgccgtcgacggcgatggcctggccggtga

SEQ ID NO: 15883 - DNA, 735 bp, Pseudomonas aeruginosa
tcgagagcgagctgttcggctacgttggcggagcctttaccggcgcggcggcgaaagggatgcgcggcctgctgcagcaggccgatggcggtaccctgttcctcgacgaggatcggtgagatgccgctgggcctgcagacccgcctgctgcgcgtgctggccgagggcgaggtggcgccgctgggggctgcgcgccggcaggctgtggatatccaggtgatctgcgccacccaccgcgacctggcggcgctggtggcggccggcggcttccgcgaggatctctacttccgcctcggcggcgcccgcttcgaactgccgccgctacgcgaacgcagcgaccggctggcgctgatccggcgcatcctcgacgaggaaaccgcgcactgcggcgtacgcatcgaactcggcgaggcagccctggaatgcctgctcggctatcgctggccgggcaatgtccgccagttgcggcatgtgttgcgctacgcctgcgcgctgtgcggcggcgtcaccctgcaactcgccgaccttccggcagagctgcgtggcgaaggccggacaccggccagtgcgtgcgagagcggcggcggtccggagcgcgacgccctgctcgacgccctcgtgcggcatcgctggaaacccatggccgcggcgcgggaactgggtatctcgcgagcgaccctgtatcggcgggtgcgccggcatggcatccgcatgccgggccaggcggacgactga

SEQ ID NO: 15884 - DNA, 816 bp, Pseudomonas aeruginosa
ggtgcgccggcggccggcgcaatcgtcaagcgcggaaaatcaaaaccagccttgagccttgccccgttaatgccggtgggctttccctgtagcgttccgggcagcggcgcaacccgttcggtcgcgccccgccaggagcctacggaggaaacccatgcccgccccgcaccagccagcccgcaacccgaccggggagttcgacccatgccgctagccctgctgctcgccatgggcgcgttctccctgagcctgtcgatttcccccggtccggtgaacctgaccatcgtcgcttccggcgccaaccatggtttccgccggaccctgccgttcgtcaccggcgccaccctcggcttcgtcctgctgctggccttcgtcggcttctggttcgtccgcgcgatcgaggcctacccgcgcttcttcgactacctggggatggccggcgcggcgttcatcgctcatgtgggctaccgcatcgccaccgcggatccacgcctggccctggaggaaaacggggtccccgggttcttccagggcgtgctcctgcaatggctcaatcccaaggcctggatcgcctgcgcttccggcgtggccttgttcgccagcccgagcacgcacgcgccgctgctggtcttcatggccatctacctggtggtctgctacctctcgctggccgcctgggcactgctcggtgaccgcgtggcgctgctgctcgacagcccccggcgggtgcgcctgttcaatcgggcgatgggcggcaccctggtgctgaccgctggctacatgctctacctgcagctcgccgctagcccggattga

SEQ ID NO: 15885 - DNA, 450 bp, Pseudomonas aeruginosa
gggtataggcgatgctgctggcgggtacgttgggcggccacaccgcatacaccttcaacggctccaggcgccattccggcagcaccgcgcgcaactcgccgcggcggatcggctcgtcgctcaggtaggtcggcggcgcggccaggccgacgccgaggcgggccaggcggcaggaggcttcgacgctgtcgacgcgcacccgcggggtgtagtcgacgcgtacctcctcgtcgtcccgcgcatgacggaatagccggctgtcggggcgcatgccgagcccgatccattccagccgctgcaggtcgcgcgggtgttccagcggcgcgtgccgggccaggaatgccggtgccgccactacctggcgcggcagcaggaacaggtgacgggccttcagcgagctgtccggcaggtcgccgatgcggaaggcgatgtcgatgccgtcgccgatga

SEQ ID NO: 15886 - DNA, 1584 bp, Pseudomonas aeruginosa
gcggtagcggccctgcaccacctccaggctttgccgcgactgttcgaccagttcgcgggtgcgcgccaggctgcgggtctcgacgctgagcgactggtagttgttccacacctccagcgaaacctgctgctcggtgtcggccagctccgcttcgctggcttcgcggcgggccagggcgttgcggacctggtaggtgcgttcgaagccttcgaacaacgggatgttcagttgcaggccgatgctgcggtcgcgttcgcgggtatcgccgttgaacgccatcgcctggtcgctatggctgcgtgccaggttggcgctcagcgccaggctcggccggccggcggcgcggctttcctccaccgaggcggcggcggctttcagccgcgcctgggcggcgagcagcgccggatgctcgcggcgggcttcggcgagcatctcgtcgatggccttgacgaagccggtgtcgggttgcgcctccagctcgccggagaggcgcagcggggtatccggcgccaggcccatgcgcagggcgatgacgccgagggcgttgctcagggcgccttcgtcgcggacctgggcgaggctcgcctgggacagcgcggtctgcgcctgcaggcgatcggaaagggcggcggcgccggcccggtacttggcgtcggcggcttccaggttctgcgccgccagctccgcgacctgacgcgaggcggccaggctgcgctgggcggcgagggcgtcgtagtaggcctgggcggcgagggcgaaggtgttctgcagggtcgcgtcctggctggcgttggccgccagcagcaactgctgggcgttgcgcagggcggcgctgcggcggccgaagtcgaacagcacccagctcaattggaggctggcgccacgccggtggcgatggccgtcgccggagaggtagggggcatcgcgataatccatgtcgctgtagccgcgactggcgtcgagacggccgtccaggcgcggcaggtaggcggacttgccgatcccgacctgggccgcctgggccttggcattggcccaggcgaggcgggtctgcgggtcgtggcagaggatccgctcgatggcttcctccaggctcagctcggtcggtggcggcccgccgcggcagggcaaaccgctgccgccgaggtcgtagaccgcctggccggcgacctggccggcggtgccgaacacgtccggctcgtaggcggcggcgccgggaaccaggccgagcaggccgcacaacaggccggcgaaggcacgcatcaggcctgctcccgcgccgcgacggcctggcgttcggccaggcgcgcggtgctttcgtcgaggcttaccttgccctggccgaggactatcacgcggtccgccgaggcgatggtctcgggccgatgggcgaccatgatgcgggtgatgcgcagcgctcgaatggcggcgttgacccgctgttcgcagtgtacgtcgaggtggctggtggcttcgtcgaggaacaggatgcgcggcttcttgtacagcgcccgggccagcatcacccgctgcttctggccgccggagagcaccgtgcccatgtcgccgaccagggtgttgtag

SEQ ID NO: 15887 - DNA, 324 bp, Pseudomonas aeruginosa
aacagttgcagcttctgcgtacgcaggccggcgttgatctgttccaccagcaggccgagccataccgagcggcgctcgtcctggcgctggaacagcttcgacgatctgctcctcggtggcgttgcgcaacggccggtaccagatccagcggccgagggcgtagaggctcatggcggcgatttagttcgcgcacctgataactcctttgagattttttcaaaagttattagtaaagcgataatgcaagagctaagtagtattaggccggttgtagatgatgacagttttgctcctggtgatatatcgctattgccaatcagatag

SEQ ID NO: 15888 - DNA, 762 bp, Pseudomonas aeruginosa
aaccggcggcaagcgcggcttcggccagcgtctggccgccgagcatcagccggcgggcgatgtccagccggcgctggatcaggtagcggtaggggctggtgccgaacagcgcgcggaaatcgcgcgacaggctccagcgttcgcgctgggcgacctgcgccagttcgtcgaggcccagcgggcgctccaggtgcgcgtggatgtactgccgggcgcgctcggcggcgacgaagtcgaagtggcgcctgccgcgcgcccggttgccggccacggcgtcgagggcgtgggccagttcgaacagggcgtcctgttcttccagcggctccagcggggtatccatggcctgtagcagggtccggctggcggcgatcaggcgcgggtcgtcggacaagcccccgcgcacgaacggcagcggccggccgccgagggcctgctggatcagcgccggctcgacgtagagcatccggtagcggaacccttcctggctgccggcctcgccgtcgtgcagctcgtcgggatgcagcaccaggcagccgcccggcaggctgtggcgctggctgcggcgatagcggaagctctgcaccccggccagggtctggccgatggcataggtgtcgtggcgatgcggatcgtagccgtggccggcgaagtaagcctcgatgcgttccaccgcaccgtgttgcggggcgcgtcgaacccagtcgcggggcgtattggcgtggctcatggggaaaggctcgtggcgcggaaggttcaggctag

SEQ ID NO: 15889 - DNA, 636 bp, Pseudomonas aeruginosa
acaggcattgcgccgggcgctcgacgtgttctgggaggccggctacgaaggcgcgaccatggccgcgctgaaggaggccatgggtggcatctgcgcgccgagcatgtatgccgcctatggttccaaggaggcgctgttccgttcggcggtggaactctacctgagccaggagtgccagctttccaagggcgccttcgccctgccgacggcgcgcgagtcgatcgccgcgctgctggaaagcgccgccgtcagctacaccaccgaaggcaagccgcgcggttgcctggtcgacctcagcacgaccaatttctcgccggccaacaaaggcgtcgaagactacctgcgcgatcaccggcggcgcgccgcgcgcctgctgcgcgagcgtttcgcacgaggcgtggccgacggcgacgtgccggccggagccgatctcgacgcgctcaccagtttctacagcagcgtgcttcagggcctgtcgatccaggcccgcgacggcgccagccgccagcagttgctggccatcggccgctgcgcgatggcggcctgggattccctgctggcggtcgaggccgcctgacgccacagcgcgccttggctggaaaaagcccatggattctccgtgggcaaaaactataa

SEQ ID NO: 15890 - DNA, 999 bp, Pseudomonas aeruginosa
tattcccctgtccatgctcgacctggtgccggtgcgcaccggcggcagcgtggccgaagccctgcacaactccctggacctggcgcgccatgtggagcgcctgggcttcaaccgtttctggctggccgagcaccacaacatggatggcatcgccagctccgccaccgcgctgctgatcggccatatcgccggcggcacctcgcggatccgcgtcggctcgggtggggtgatgctgccgaaccatgcgccgctggtggtggcggaaaacttcggcaccctggagacgctctacccgggccgcatcgacctcggccttggccgcgcccccggcgccgaccaggcgaccatgcgcgccttgcgtcgcgaccgcctgggcaacggcgacgacttccccgagcaggtcgccgagctggaaatgctgctcggcccgcgccgttcccagcagagcctgctggcggtgccgggcgagggtacccaggtgccgatctggctactcggttcgagcctgttcagcgctcacctggcggcgcagaaaggcttgccctatgccttcgcttcgcatttcgcaccgcgttacctgcacgaggcgctgcgcatctaccgcagcaacttccagccctcggcggtactcgacaaaccttacgcgatgatcggcgtgccgctgatcgccgcacctaccgacgaagaggccgagttcctcgccactaccgccttccagcgcgtgctggcgctgatccgcggcgagagcctgaaacagaagccgccggtggaaagtatggcgccgttgtggctgccccacgagcaggatgcggtcggcagcttcttcggcctggcggtgatcggcggtccggagaaggttcgtgcgcgtctggagatcctcctggagcagaccggcgccgacgagcttatcttcaccagcgacttctacgagcacgcccatcggctgcgctcttgcgaaatcgtcgcggagctgaaaggggcgtgatccggggcctgtag

SEQ ID NO: 15891 - DNA, 2106 bp, Pseudomonas aeruginosa
cagcccggagatcaaggccctgaccgtctacgcctattggctggcgagccaggcgccgaccggggtcagcctgcccggacgcggctatccggacgtggccccgccggaaggcggctacagcatcgagcgcggcgccaaggtctatgccgcgcagtgcgcgatctgccacggcgccgacggccagggccagatggctctggggcagacggtgttcccaccgctgtggggcgcgcagtcgttcaactggggcgcgggcatgcaccgcatcaacaccgcggcctccttcatcaagtacaacatgccgctgggcaagcccggtaccctcagcgaccgcgacgcctgggacgtcgccgccttcatgaacagccacgagcgcccgcaggacccgcgcctggtggacggttcggtggagaagacgcggcagaagttccatgccaacgacggcgtcaacctgtacggacagaaggtcaacggcgtgctgctgggacagggaatctgaccctcgtggcctggcgtccgcaggacggagacccggtccggcggaagcaggtcggcgcgggggtagggcggataacgccaacggcgttatccgccgatgcctgggcctcggtccggcggatagccgcgggcggctattcgccctacgggggccggttggcgggtgggcccgcgcatcactcgcgcagcggcatttccagcgtcacccgcaggccgtccgcgcggctgtcgaagtccagccggcattggcagcgttgcacgatagcctggacgatggccaggccgagcccgctgccgccgctcttgccgtggcgccagaaacgccgggtgaggtgcggcaggtcggtttcggcgatgcccggaccgtggtcgcggacgtggaagcgcgcgcagccttgcgcggtttccaccgccagctccacccgggtgccggcggcggtgtggcgcacggcgttgtccagcaggttgcgcagcgcggcgatggccagcaccgaggggacttccagcggcgcctcggacaagccgtcggccagcttcagctcgaacatccgcacgtcgccgtggccggcgtcgtgcatggctacccgggcggcgtcctcggcgctgcattgcacgccgtcgtcgaacgacaggctgccttccacccgcgccagcagcaacagctggtccagcgtccggtgcagacggtcggcgccttcctcggcgtgggccagggcctgctcggcggcggcgccctcggtcatgcgcgcgacctgcaggtgggtcttgatcgcggtcagcgggctgcgcagctcgtgggcggcatcgccggtcaggcgtcgctcgcgttcgatggcctgggcgatgcgctggaacaactggttctgggtttccaccagcggcttcagttcgctcggcagggccgccagctccagtggctccagcgagtcggcgccacgtcgggtgagggcgtcgcgaatccgcttgagcggcgccaggccctggccggcgccgagccagagcagggccaggctgccgagcagggcgaccgtcaccggcaccgcggcggccaccaccaccgagcgttgcagcacgtcgcgctcttccaggcggtcggcggtgctgacccgcagatcgccggcctgcacggtgaagctgcgccacagcacgccgttgatttcctggtcgcggaagccgctggcggtgctgtccagcgcccgctccggggtggcatggctctgcgccaggacttcgccgcgcagtgagctgacctggcaggccatgccgttgggaattcccagttgctccgcgctgaggcgcgtggtctggccgtccgccggctgcggctgcggcaactgctggagcaggccggcaaccatccgcgccgaggccgccaggcgttggtcgaaggagcgcatcatctgcccgcgcaggtcgcagagcatccaggccgcggccagcgaccagagcaggatgaaggccgagccgaggatcagggtaaggcgcaggcgcaggctcatgcgtcgtctccgtcgccgcgcgccggcccgaggcggtagccgaggccgcgcacggtctgcacgatggcgttgccgagcttgcgccgcaggtgatggatgtggacgttga

SEQ ID NO: 15892 - DNA, 1482 bp, Pseudomonas aeruginosa
ccggcgaagtcgacgccggcggcttcctcgcccattggcaggcgacccgggagcgcggctgatgctgagtttttccctggggccgctggtggtctcgctgcaacacctgctgctgttcctcgccctcggcgccgcgctgctcggcggttggctggcggcgcgcggtggcgggcgcaacgccgagccggtgctgttcaacctgttgttgctcggcctgctggtggcgcgcctggctttcgtggtgcgctactggccgcagtaccgcggcgacttcgcacagatgctggatatccgcgatggcggtttcctcgcctggccaggcctgctcgccgccgtgctcggcgcgctgttctgggcctggcggcgaccggcgctacgtcgctcgctgggtgtcggcgccagcctcggactggcgttctggctgcttggcagcctgggcctgggcgtctacgagcgcggtacgcgcctgcccgagctgagcctgcgcaacgccgccggcgagtcggtgcaactggccgatttccggggccgcccgctggtgatcaacctctgggccagctggtgcccgccgtgtcggcgcgagatgccggtgctgcaacaggcgcaggcggagaatcccgacgtagtgttcctcttcgccaaccagggcgagagcgccgagaccgtgcgccatttcctccagggcgagaacctgcgcctggacaacctgctgttcgacaacggcgggcagcttggccagcaggtcggctcggtcgccttgcccaccaccgttttctacaccgccgagggccgcctgctgggcagccatctcggcgaactgtcccgcggcagcctggcgcgctacctcgaagccttcgagccggccgctgccgcccccgcaaccaggagttccgaatgagactgccgcgcaacctgatcacccttggcctgggcctgaccctcctcaacgccggcctggccacggcggcggaggagctgccggcgccgatccgcatggtccaggagaagggcgcccgcatcctcggcagcttcgacgccccggatggcctgcgcggctacgccgccgaataccagaaccagggcatggcgctgtacctgacgcccgacggcaagcacgtactcaccggccacctgttcgacgcccagggcaatgacctcagccgcgaaccgctggagcgcctggtgtatgcgccgctggccaaggaaatgtggcagaagatggagcatatcgcctggatcgccgatggccgtgccgacgcgccgcgcgtggtctacctgtgcagcgacccgaactgcccgtactgcaccatgttctgggagcaggcgcgaccctgggtggatgccggcaaggtgcagttgcggcatatcatggtcggcatcatccgcgaggacagcgaagccagtccgctgcgctgctggccagcaaggacccgcagaaggccctgcacgaccatgagcaggcgggcaaggccagcaccctga

SEQ ID NO: 15893 - DNA, 3543 bp, Pseudomonas aeruginosa
cctggaacgagggcagcagcaggggcagggccagcaggctggtccggatgcgggtggtcatgggcgtgtccttcttgttgttgttttccacggggcagcgcgtcagtccgggaggtagtcgggctggcgctcggggctggcgcgctggaaggcttcgagcgccaggcagcgcccctccagttcgagcaacgccgggtagggcgccaggacacagcccatgcgccgggcgttggccagttgcggtaccaggcagcactcgacgatgcccgctgcggcgccggcgaagaaggcgccgcgacggtgtcggttcagcagggtctccgccgccgccaggccctcggcgacccagtgcgcgtaccagcgctggcggtcctcggcgtctatgccgaggacctgggtcaggtacttgagcacccgcacgttgttcagcggatggatgtcgcaggccaccagcagggccagttccagcgcctgggcgcgatgcagtgggtcgagagggatcaagcgcggttcgggctgcacggcgtcgaggtagtcgatgatcgccagcgactggctgaaccggcgaccgtcggcgtcgaccagggtcggcagcgcgcccatcgggttgcgctggcggtcggccgggcgcagttgctcgccctgccgcaggttgaccggcactacctggtaatccaggcctttcagggccaatgcgatacgcacccgataggacgtggagctgttgaagaagctgtagagctgcatgggaagtcctgttcagagagtgacggaagaaggcctggcccggcgccggcccaggcgatgcacggccacggcggcgagcagcgccgggattaccagcagggcgaggatgccgctgaagcccaggcccaggccgagcagggcgccgccgctgagggagccgacgatcgagccgatgcggcccaggccgagggcccagctgaccccggtggcgcggctgcgggtcggatagaaatcggcggccagggcgttggcgccgacctgcgagccgctgatgcagaaaccgacgccggcgacgcacagcgccagcagggcgaagctgtggtagaggctggcgatgccgaggatgaacagggcgccgccgacgtaggccaggctcagcacccggtgcgcgtcgaagcgatccatggcgctgcccaggaggagtgcgccgagggtgccgccgagctggaacatggcgctgatcgtcgccgcctcgccgagactgaagccggtgccgccgatcagcgtcggcagccagttggtcagcaggtagatgatcagcaggcccatgaaaaaggtggcccagagcagcagggtgccgccgcgcagctcggcgccgaggatctgccgcaggagcgaggtgccgtcggactcgtcggcgggcagttcgaggcgtccggcccagccgtcgggcaggcgccccaggcgttcgaggatgcgccgcaggcgcgccgcgtccggtgcgcggcgggcgaggaagcgcaccgactccggcaggcatgcccagagcagcggcaggctcgccaggggcaggccgccgccgagcagcagcacgctttcccagcccagcgccgggaccatccgcgcggcgagcaggccgcccagcgccgagccgagggtgaagccgcagaacatcgcggtgaccatcagcgcgcggtgccggcgcgggcagtattcggaggtcagggtgatcgcgttgggcatcgccccgcccaggccgaggccggtgaaaaagcgcagcagggccagggtttccaccgaaccggcgtaggccgaggcgaggctccagccgccgaagaacagtaccgagagcaggagcacgctcttgcgtccgaaacggtcggccagcgggccggcggcgaaggcgccgagggccaggccggccagcgcggcgccgaggatcgggctgagttgcgccgggctcagttgccagtcgtgggccagggccggggcgatgaagccgatggcggcggtgtcgaatccgtccatggcgacgatcaggaagcacagcgacaggactcgcaactggaaggcggaaaccgcctgcgcatcgatgaaagcctggacgtcgatcttgttgttcttgtcgggcgtaggcatgagcgttcctcggccgtcgccgtggcgacagcccggatgaagggcagggtgggcccgcgccgtgcgcgggcggtgggtcagaccacgcggacgctgagttcgccgaggccgtcgatggcgccgagcatccgctcgccgcgctcgaccgcgccgacgccttcccggggtgccggtgaagaccaggtcgccggggcgcagctcgaagaagcgcgacaggtagctgacggtttccgccaccgaccagatcaactggtcgatgtcgctgcgctggcgatcctcgccgtcgacctggaggctgatggcggcgtggcgcggatggccgacctggctggcagggtagagcgggccgatcggcgccgagcggtcgaaggccttgccgatctcccagggccggcccatctcgcgcatgcgcatctgcaggtcgcggcgggtcatgtccaggcccaccgcgtagccccagacgtgttcctcggcctgctccagggggatgtcgcagccgcccttgccgatcgccgccaccagttcgatctcgtagtggtagttgccggtctggctcgggtaggccagctccagggtgctgccggcggcgaccgggaccaccgcgtcggccggcttgcagaagaagaacggcggctcgcgctcgggatcgaagcccatttcccgggcgtgggcggcgtagttgcggccgacgcagtagacccgccgcaccgggaaggtctggtcgctgccatggatggtgaggctgacgggtgcttcgggcgcgaagagatggttcatgggacgggtccttcagtgggcgagggtttcgcgggattcgcggaggatgccgagcgcctgctgcacagggcggtcggagaaactgaacagcacgcagtcggtggcgccggcttccaggcgcagctcggcccaggagggcacgacgaacagatccttggcctcgaaggcgaagcgccggccgccgatctgcgccacgccgctgccttccaccaccgaatagacgctggcgtcggtgctgcgcgcgggctgcccgaggaagccggccggcagcagttgcaggcaggtggcgatggtcggcatggcccagccgccggtggccgggttgacgtagcgcagcttgtggccttcccagggatcgggccgttcgaggcgcgccaggcgctcgagggcctcgcggctgcgcgcgtacgggtagctgaacagcggcgaagtcggcgtcgtcggctgatggcgcagcggcagcatgttgctgccgtagcgggcgaggctgtcgccttcgccacgtcgcaacggctgtaccggttcatcatggttttcggcgaaggtggcgccgaagaaacgcagcatcgggatgtccaggccgtccagccagaccaccggctcgccgccttccgcggcggcgcgggttgccgtggtcgtgccatgtccaggacggggtga

SEQ ID NO: 15894 - DNA, 927 bp, Pseudomonas aeruginosa
ggatggcttgcgatggactggacccgccgcctgcgcctgcaacacctgcaactgctggtcagcctgatggagaccggcaacctcagcggcaccgcccgggccgcacacaccacccaaccgggcctgtcgaagtggctcaaggaactggaggaggacgtcggcgcgccgctgttcgagcgtcacgcccgtggcctgcgcccgacgccctatggcatgaccctgttcaaccacgcccagcgcgtactcaccgagatggagcgggcgcggcagaacctcgaggcgatgcgcagcggcagcggcagccgggtgctcctcggcacgtcgccggcctccgcgccgagcctggtgccgcgcgcattgcgggcgttcctcggacgctaccccggggcccaggtggaactgctcgaaggcaccatgaacggccttctcgagcggctggagaaacgccagctcgatgtggtggtggggcgcctggacaactatgcgccgcgcgccagcctgcgctgcgacgtgctctacagcgaggcgatcgtggtgatggcgcgccccggtaaccccatggcccagaccgccgcgctggactgggaagacgtgcggcgatacgactggattctctggccgcccggctcgccgatccgcagcaagctcgacatggccctgacccagggcggccggcagccgccggcctaccgcctggagtcatcgtcgatgctggccaacatcgaattgttgcgtggcagcgacatgctgtccatcggctcggcgcgggtggtcgagcaccttgccgggctcggcctggtggccaggctggcgctggagattcccggcgagggcgcggtgggcatgtgctggcgcgacgaaccgcaccgcgaccgtgccagcgaagacctgctggcctgcctgcgcgaaggcgcggcggccgagtag

SEQ ID NO: 15895 - DNA, 1056 bp, Pseudomonas aeruginosa
cgtcgagcgctacgtggccgaggcgctgtaccactgctacctgctgcgctacggcgaatgagcggagccgtggacgggacgcgcggtagggtcgacgaagcggtggtcaggcaggccatccactggctggtccgcctgcgctcgcagccggccgacgatcgcctgcagcgcgcctgcgcggcctggcgcgcggagcacggcgagcacgagcgggcctggcagcaggtcagcgcgctcaacgaagaactgcaaggacgcttcaaggcgctgcccggcggggtcgcctacggcaccctggacagtagcgcgcagcgcctgcagcggcgccaggcgctgaaactgctgtcgttgctggtggccggcggcgccgtggcctgggtcggtcgcgacagcctgccctggcagcgcctgagcgccgactacagcaccgccaccggcgagcggcgcagtatcgagctggtcgacggcacccgcctgcaactgaacaccgacagcgcggtcgacgtgcgctacgacgccggccagcgcctgattctcctcgcccgcggcgagatcttcctcgccagcggcgccgatacgcaatcgcccacgcacaggccgctgcgggtacgtaccgcgcaagggctgttcgaggccctcggcacccgtttcaacgtacgcctgcaagatgccgccacctgtctcagcgtcagcgagggttcggtgcgcatcgatgccttcggcgcgcgtccgctgcaggctccggtggccgaggcggggcagagctatcggatcgccgccgacggcgtgcggcgcctcgaacggccgcagatggacgccgtggcctgggccgatggcctcatcgtcacccgcgacatgcgcctggccgacttcctcgccgaggtcgcccgctaccgcaacggctacctcggctgcgccgcggaggtcgccgacctgcgcctgtccggggtctatcgcctggacgacaccgacaagctgctgcaggtgctcgcgcggaccctgccggtgcgcctgcagcgacatacccgctggtgggtgagggtggtcgccgcctga

SEQ ID NO: 15896 - DNA, 627 bp, Pseudomonas aeruginosa
ccggtgtctacatctggtggcgcaagcgccgggcgcgccactggaacggccgctagacggctgttagtctggctgcctcccacaccaccagaggatggacgaatgaacgcaaggatcgccgcattgggactgctcctgcccctggccgccggcagcgccgtggccgcggaggagggcagctcggtcaaggatgcggccaaggccgcggtgtcctcggccatcgagaccggcaagaacctcctcggcggggtcagcgagggcatcaccagcggccgccagtcggcccagggcgccgatggcgccaaggtggtctccgacaacgccggcttcgccgagatcggccaggtcgaagtgctcaagaccgagccgcgcgaccagcaactggccgtcaccctcggcttcaagaacgacagcgacgccaccgtgcgcctgatcaacctgacccagaccggcgcgctgctggtgatcgacaacgacggctactccaacgccctggtcgccctcgccaaccccgacgatgtcaccgtcccggccaaggccggcatccgccagaccttcgtcttcgaaggcggcgcggaagggatcaaggcggtgcgcctgtggggcaaggacctgccggtgaagtga

SEQ ID NO: 15897 - DNA, 1719 bp, Pseudomonas aeruginosa
agggaactcgcaggacatcggatgttgcgttctagctatcgagcggttgtcgctggcttggttttactgccgctgcttgccagcgccgcccccttcacctcccccggcgaccgcgacctgatccgcgaccgccagcagcgcctgctggacgaacagcgcaagcgcctggaggaactccagcaactgcccggcaagggagcgcccgccgctgcggatgcctccggcgacgacgagcgctgcttcgagatccgccgcatcgagctggaaggcgccgggcacctcggcgaaagcgcgcgtcgccaactgctggcgccctaccaggggcgctgcctgggcgtcggccagctcaatgcgctgctcaaggccgtcaccgaccattacctggatcgcggctacgtcaccacccgcgcctacctgccacagcaggacctggcctccgggaccctgcgcatcatcgtcgtcgaaggccgcctggagggcctggacagctccgcgctggccagcccgcgcgaactgacgatgagctttccgggcaggaccggcgagctgctcgacctgcgcgagctggagcaactggtcgaccagttgagccgcctgccgtcgcgccaggcgcaattggagctggtgcccggcagcgaggtcggcggcagccgggtgcgtctcaagggcgagcgcgacaagccctggcgggtctccgccacgcgcaacaacgacggcgacgtcagtaccggcgagcagcagatgggcctgggcctggactgggacagcccgctgggcctggccgaccagctcaacctgcgcgccaaccgcgacgcggtgaccgaccgctggcgccattccgacagccagagcctgttctacagcctgccctggggctggtggaccttcacctacggctacagccagagcgactaccgcacgcgcaacgaggccagcggcttccccttcaagctcgatggcgacagccgcagccaccagttccgcgccgaacgcgtgctgcaccgcgacggtgtgagcaagaccgccatgagcctggggctcagccaccagcgcaccaacaactatgtcgaagacacccgcctggaagaccagagcacgcggatcaccgagacccagctcggcttcaaccatggccggcggatcggcagcggtttcgtcaacctcgacctcggctggcagcagggcatcggcgcccttggcgcgcagggtcgcggccacccgcaggcgggcgacccgaatgcgcgctacgacaagtacagcctgaccctcagctacctgcagccgttccagctatggggcgagcgcttcagcttcgacagcctggccaccgggcaaaggagcgaggacgtgctgttcagcccgcagcgcatcagcctcggcggcaatagctcggtgcgcggcttcaaggaccagaccctgaccggcgacagcggcggctactggcgcaaccagttgcgctggcggcgtgcggtggaatgggcgccgctgcggccctggctgcaggaatacggcgtggccttcgcctacgacgtcggcgtgatccgccacgaccgctacaacgacggcgccagcgggcgcatgagcggcaacgccatcgaactggatgcccgcggccgctatttcgccgccagcgtcggcttcgcccgctcgctggagcggcccagcgccatcgagcggcgcgagcacccgatctatttccgggtcgacgcgttcttctga

SEQ ID NO: 15898 - DNA, 2970 bp, Pseudomonas aeruginosa
tgggctgcgcctgaatggcgccgaactgttcaatggcaacggcggcctgctcagcagccagcaaagcatcgacgtcattctggacggcgtattgggcaatcaggcgggcagcttgagcagccagggacgcctgagcgtgaagagcggtcggctggacaaccagggcggtgcagtctccagcgccgggaccttgtcgctttccagccagggtgcgttgaacaaccagggggcagggtggtcaccgacgccggtgccgtcctgcgcagcgccagcctcgacaacagccagggcggcatcgtcagcgccaagggggccgcggagatccgtactggcagcctcaacaatagccagaagggcggcataggcagcggtgccgggctcgcgctggtcgcggacctggtggacaacagccagaacggccggatcactgccaagggtgcgatcgatgccaacctgaaggggctggatcagcagggcagcggcaggctggtcagcgatacggccatcgcgctcgatctgcgcgggggagaactggtcaaccgtgctcagggcctgatcgccacgcctggagccttgctgctgcggcaactgggtgtcgtggacaacagtggcggtggcgagatctccagcgatcgaagctttaccctcgccgcgaccgcgctgagcaaccggggtggccgcgtgatcagcggcgactccctgaccctgcgcatcgcccaggcactggacaacagcctccaaggcgttctttccgcaagcggagggctggatgtcgctgcactcgtcttcgacaaccatagcggcatcgttgctagcaagggcgatacacgcatcggggtgaaccgcctggagaacgaggcaggccgcgtggtcagcgaaagcgccctggatctgaccgccaagcaggtgagcagcgccaaggggcgcattgccgcgaagggcgatctgcaggtcacggttggcaccctcgagcagcagggtggagaactggccagtcaggggacgctgactctcgacgccgatagcctggataaccgcaatggcggcctggtgagcgccgatggcggggtcaccgccgaggcacgccagatcgataaccgcggtggggaaatatccagcgtggccaaggtggctctggctgtccgggaacaactggacaaccgggggggcaaggtgatcggcgacagtgagctgagcctaaccgtgcagcgcctgctgaaccaggccaagggtgtgctcgccagtcgcgatggattgcacctggacggcgctgaactgctcaatggcgatggcggcctgctcagcagccaacgcctggtggatgtaacgctcagtggtgcattggacaaccaggggagcggtgcactggtcagcgaagggtcgctgacagtgaaggccgaccaggtcaataaccaggcggggactttctccagtgcgggtagcctgctcgttaccagccggggcgagttgaacaaccagggtggcaggttggtgaccgatgctggagccaccctgaacagcactggcttcgacaacagccgtgcgggcctggtcagtgcgaaaggggctgtggccattcgtaccggagccctgaacaacagtcagaagggatccattggcggcaatacgggcgtcaccctggtcgccgggttggtcgacaacggccgggaaggacggatcagcacccagggtacgctcgacgccaacctgaaagggttgcttcatcacgggggaagctcgctggtcggcgagcgcggtgtcaccctcgacctcaacggtggcaccctggacaaccacgacctcggtctggtttcaacgcctggcgcgctcctgctgcgccaactcggcatggtggacaacagcgtcggcggagagatatccagcgaccgtgctttcaccctcgccgccaacacactgaacaatcagggcgggcggctgatcagcagcgaagctttgaccctgcgcatcgccaagacactggacaacagtctcaaggggcaggtcctggcgaccgacggactggccatcgagtctcaggtcctggacaaccgtgcgggaaccatcggcagcaagggcgatgcccgtatcagcgtgaccagcctggacaacgccgaacaaggcagcctggtgagtgaaggccgcctggagcttgtagccgaccaggtgagcaacggcaaccaaggccgtatcgccgccagaggcgtgctggaggcggcggtcggtacgctgctccagcaaggcggcgagctggtcagccaggggagcctggaccttcgcgccgacgtgctcgacaacagccagtccgggctgatcgccgcgaatggcggcatcgctatcgaggcgcggcaggtcgacaaccgcgccggcgagatttccagcacctcgaaggtcgccgtgaacgcccgcgagcaactggacaaccgcggcggcaaggtcatcggcgacagcggcttgcgcctcaccgtgcagcgcctgctgaaccaggccaagggggtgttggccgggcgcgacggcttgagcctggacggcggcgaactgttcaacggcgacggcggtcggctcgacagccagaacagcctgagcgtgagcctcggcggcgtgctggacaaccagggcggcgcgctggtcagcgaaggcagcctgacggcgcgcgccgcgcgcctggacaaccgtggcgggaccttctccagcgccggtgcgctggcgctgaccaaccaggccgcgctggacaaccagggcggcaggctgctcagcgatgccggcgtgacgctgcagggcgccagcctcgacaacagccgtaccggcgtgatcagcgccaagggtgcggtggatatccgcaccggcgtgctggacaacagccgcaacggcggcatcggcagcaacgccggcatcaccctggtggccgcccagctggacaacggccaacagggacgggtcagcgccaagggcctgctcgacgccaacctgaaa

SEQ ID NO: 15899 - DNA, 1143 bp, Pseudomonas aeruginosa
cagcgggtcggcgaggttcaaccgggtggtgaggtaggcgcctttctgttcctggtcgagcttcatgccccacaggctggtgttcagcctcggcttgagagtcgacctcgggtcccactgggtcgggtccatcggcccggtgggggtgccgtccttgttgaacaggctgccccacccgccgtggccgtcgaagcgttcctggcgatagctggcgccgaccaccagctcgtgctcgcggccgagcaactggaagggaccgttggcataggcgtcatagctgtcgtggtcgtcggtgtacctgtagtcgccggggttctgggtcatgctggcgcacccggtggtcgagtactagcagtcgttgtacagcccgagcatgttgattcgcgcccacagcttgtcggcggccagcttcatctgccaaccgttggcgaagcggtgggtcaggtcgctgaacaggtgggtggtgtcggtatcccagtaggaccagtcggcgccgtaataggacgagcgcttgaggtccaggtggcggccgcccagcgggctgggcaggcctacccagttgtcgttgcggttgtcgttctggttcgaggcgccgatggcgaaggtggtgtccgggctcaggtcggcttcggcgatcccgtaaaacacgccgcgttcgctgctgacgtggtcctggaagctgttgcctttctggtaggcgaccaccgcgcggccgcgcagggttccttcgctgttcagcgggccggaaacgtcggcctcgctgcgatagcggtcccaggtgccgacgctgccttgcagggaggcgcggaagtcctgggtcggacgcttgcgcaccatgttgatcgccgccgccgggttgcctgcgccctgcatcagtccggtggcgccgcgcaccacttcgacgcggtcgaacatggccaggtcggcggcggaaatgacgtcctgggtattaggtggaaatgctcgtcggccaggccgtcgtacatgatgtggtcgacgtccaaagccgcgcgccgcgtatttcacccggggccggcccgtacttttgcaacggtgaggccggtgaaccccttcaccgcgtcgttgaggtcgcgcatgccctggtcgtccatgcgctggcgggtgaccacgctgaccgactga

SEQ ID NO: 15900 - DNA, 507 bp, Pseudomonas aeruginosa
gacccgctgtcttcggtgatggcggcggtggccgggtcctgggtggcgaccacgctgagcgcgccgaggtcgacgctgtcgccgggggagatgccggcacctgtcgccgcggcctcgacccaggcgtcgccgccccgtacctccccgctcagtccggaacctgcgagcagacgctgcagtgcctcgcttggctccagcgtgccgcgtagggccggtgcgcgccggtcggccacggccgcgcggtcgaaacggatgcgcaggccgctggcgccctgcaattgctcgagggatgcggccaggggctgggcgggaaggtcaagggcgatgggagcggcctgggcggccagggaaagcgaggagagaccgagcaataacgcactggaaacgacgtgtttcatctgcagtgtcctggatggcggcgcaggcaggccgttggcgcgaccggctgcgtttcttgtttatgtgggaaaccggcgtaggaattcgcggcggggcaagtgtatgtaa

SEQ ID NO: 15901 - DNA, 420 bp, Pseudomonas aeruginosa
aggccgtctggattcgtgactccagcgcaaatgaatttgctcgattcgggtcttaatcgaagagatgtaagccgccacactgcgcttcattcgagccatcccgcccacggagcgcagccatgtcgtccaccatccaccccctcccgtccttcggtctcggcaccttccgccttaccggccaggtcgtcgtcgactcggtgcgcagcgccctcgaactgggctatcgcgccatcgataccgcgcagatctacggcaacgaggtggatatcggccgcgcgatcgccgagagcggcgtaccgcgttccgagctgttcctcaccaccaaggtctgggtcgacaactacgcccgcgaaaagctgctcgccagcctgcgcgagagtctggagaaactgcgcaccgaccggttggacctggtcctga

SEQ ID NO: 15902 - DNA, 1506 bp, Pseudomonas aeruginosa
tcgagggcagaccatttgttcaggcagtcactgctcgagtcggtcaaggcgcgcctcctccatccacagctccaggccctgccgctgcatgcgcgaatccagcgcgcgatccgccaactgatcctcgacggtgcgctggcgccgggcaatccgttgccggcctcgcgggcgctggcgcagtcgttgggggtatcccgcgacaccgtcgaagcggcctattcgcacctgcatgccgagggcttcatcgagcgtcgggtcggcagcggcagcgtggtcgccgcggctacccggctgtcccccggccggcgcggcgcgggcgctccacgacggggcggcggcgcgccgcgactgagccggcgtggcgaggcgatgcaggctggcggcggggttcgcgagcagctcgtcccgcgccccttcgctcccggcgtgccggagacccgcacctttcccctggcgacctgggagcgcctgcagcgccaggtcctcaaggaatacggcgcgcgcgccctgacccatggcgacccgcagggtgccgaaccgctgcgccaggcgatcgccgactacgtcaacctggagcgtggcgcacgcgccacggccgaccgggtactggtgctgaccagttcgcaacaggcgctgggtctttgcgccagcgtgctgctcgacgccggcgagcggatattcgtcgaggacccggcctactacggcgcgcgcaaggccttcgaggccgcaggcctggagtgcctgccggtcccggtcgacgaacagggcctgcggcccgagccgatcctcgcccagccgcaggcagcgcgggcgctgtgcctgaccccgtcgcaccattacccgaccggcgtgaccctgtcgctggagcgccgcctggcgctgatcgaatgggcgcagcggcagcaggcatggatcatcgaggacgactacgacagcgagttccactacgccggccggcccaccgcctgcgtgcaaggcctggacgcccacgagcggacgctctacatcggcacgttcaccaagtcgctgtttcccggcctgcgcatcggctacatggtcctgccgccggcgctggtggcgccgatgaccgtcgcccgctccctgcaggacgggcacaacgcctcgctggcgcaactgaccctggcgcgcttcatcgccggcggccatttcggcgcctatgtgcgcggcatgcgcaatctctacggcgagcgcctgggattcctcgcggagcgggtgggcaagcgtctgggcggcctggtcgagccgcgcgtgccggccggcgggctacagatgcccgggctgctttgcgcgggaatcgacgaaacgcgcgccatcgcggcggcataccgcgccggtgtcgagctggtcgggctcagcgccctgcatctcgccgcgccaccgcgagcgggtttcctgatgggcttcgccgcctacaccacggacgagctggaggcggcggtcggggtcctcgcgaagaccctgcgcggtttgcgtgcgaatccctag

SEQ ID NO: 15903 - DNA, 357 bp, Pseudomonas aeruginosa
tgggcatcgcccgccatgcgagcgacaactttcctggacgtctgctgtgctgcgacctggccgatcctgcgcaaaccgccgagacgctgcgcggattgctctcggaaagcgccgtggatgccttggtcaacaacgccgggatcgccttgccgcaaagcctggagaacctcgacctggccgctctgcaacaggtcttcgacctcaacgtgcgggtcgccgtgcagcttgcccaggcctgcctgccggggctcaagcgttcgccggcgggccgcatcgtcaacctgtgcagccgggcgatccacggcgcccgcgaacgcaccgcctacgccgcggcgaagagcgcgctggtcggggtga

SEQ ID NO: 15904 - DNA, 519 bp, Pseudomonas aeruginosa
aaaccgccgagcaggccggtcatcaggccgatcggcaggttggcgacgtatgccaggcgctggccgagcaggtcggcggccagcagcaggaccgcgcccatcaatgcgccggacagcaacggcaccccggccgagcgggtcaggcgccgggccagttgcgggccggccagggcgatgaaggcgatggggccggccgcggcggtggcgatggcggtcatgccgacggcgaccaggaccatctgcaagcgcacgcgctccaccgccacgccgagctgggcggcgctggcatcgcccagctccagcaattccaggcgacgaccgtggtacagcgccagcggcacgttggcgagcaggcccagcgctgccgggacgacgtgcgaccaggtccgggtgttcagcgagccggccagccagagctgggcatacatcgcctggtcgaggttgccggtgaccagcagcaggctgttcaggcccgacaggctggcgccgacaccgatgcccaccagcaccaggcggtag

SEQ ID NO: 15905 - DNA, 498 bp, Pseudomonas aeruginosa
ccgccggcggtggcgccccggcgcgccagcagcaccaccgccagcgccgtgcagaggccggcggccagcgccgccagcgaggtggccagcgggccggcatcgaacaggatgatctgcacgatggcgccgctggcggcgccggtggtgaaaccgatgacgtcgggcgagcccagcggattgcgcgagatcgactggaagatcgccccggccatgcccagcgcggcgccgaccaggcaggcggtgagcacccgtggcaggcgtacgcgctggacgatgcgctgggcggtggggtcctggccctggccgagcaggctggcgaacacctctgccgggcccagcgccaggctgccggtccccagcagcgccgccgccagcgccagtccgacccccgcgaggaccaggcaggccagcgccgcccgtggccgccaacgcagcgacagggagcccaggcgcagggcgtggagaccgttcacaggcggctcaggcggaagcgcctga

SEQ ID NO: 15906 - DNA, 402 bp, Pseudomonas aeruginosa
tgtataatcgattccacatattcgagccattcttatccaggaacctcccatgacccatcgcctgcacgcggacgccgtgaccttgcgccgcgacgcgcggaccgtttcgcggaatctctcgctggccatccccgagggttcgttcagtgtgatcgtcgggcccaacgcctgcggcaagtcgaccctgctggcggcattgtcgcgcctgttggcgccggccgagggccgggtggtgctggacggcagggatatccacagcctgccgggacgggaagtggcgcggcgtctcggcctgctgccgcagagcgcgctggcgccggatggcatcacggtggccgagctggtggcgcgcgggcgctatccgcaccagtcgttcctgcgccagtggtcgccggcggatga

SEQ ID NO: 15907 - DNA, 801 bp, Pseudomonas aeruginosa
actacaacgagatgttcttcggcgcgacctcggtctgggacgtcgacagcatcgaggtgttccgcggcccgcagaccacctcccagggcgccaacgccatcgccggggcgatcatcgtcaacaccaaggacccgaccttcagccccgaggctgcctaccaggcggagatcggcagctaccattcgcggcgcagctcgatcgcagtgtccggcccgctggcgcaggacttcgccgggcgcctggcggtggactacgcgggtcgcgacaccttcatcgactacgacaacccgaagttccaggacagcggcaccgaccaggacttccgcgccctcaacgcgcgcgccaagctgctctggctgcccagcggaattccgggcctggagagcaagttcaccttctcccacaacgacagcaatcgcccgacccaggaagcggcgacccgcccgttcgacaagctcgaccatcgctcgaccaccatgcccagctgggagcaggacaccaacaccagcatcctcgacgtcgcctatgacctcgacaacggcatccgcctgttcaaccaggcgcagtactcgctgtcctcggtgcaccgcaccaccggcgcgggcggcgagggcgacgccgacatccgccagaagaacgcctccaacgaatcgcgggtcagcttcggcgagcaggaggaccggatcagtggcatgggcggggtctactacgcccgcacccgcaccgacgagacactgcacctgcgcgggctgtcggccttcgacgacacgaagaagaacctcggtgtgttcggcgagctga

SEQ ID NO: 15908 - DNA, 1419 bp, Pseudomonas aeruginosa
cgcagccgcggaccctcggcatcggcatcaagggcaccttctaggcgccccgagaagccggccccgcgcagggccggcccagccccagagcccatacaggagattggcacgatgagtaccccgaaacgcttgcacatcggcatgtcgctggcccccacctggctcagcggcgatgcctggcggcgccccgacagcaatatcgaaggcatcttcggcagcgatttcgccgtcgacatcgccaggcgctccgaagccgcccacctcgacttcgtgtttcgcccggacgtcagcagcctgccactggacgtgctggagaccggctccggcttcgccagcctggatcccaccgtactgcttgccgcggtcgcccgcgaaacctcgcggatcggcctggtgtcgacggtctccaccacgttctatccgccctacgtggtggcccggcagctgcaatcgctgcactggatcagcaacggtcgcgccggctggaacatcgtcaccgcgctgcagggccacgagaacttcggcctggacgcgatgcccgatgcggagcagcgctacgcgcgcgccgccgagttcacccggctggtgcacgacctgtgggacagcttcccccgcgaggcactcctggtcgaccgcgagagcggccgctacgccgacgtttcccgggtgcacccggtcgaccacgacggcgaattcctcaaggtcaagggaccgctcaacctgccggccttcggcgaggcgcggattcccctggtgcaggccggcgcctccgagagcgggcgcgacttcgccgcctcggtggccgacctggtgttcgcgccgaccccggacaaggaggctgccctggaactgcgccgcgacctttcccgccgcgccgaacgccacggtcgctcgccgcgcgacgtgcgcctgctgccgggcttcagcctgtacctggcggagagccgcgaggaggcgcgggaaatcttcatgcagacccacgcgcgcctggaccgcgcgcgcaagttcgccacgatcaggcagatgctcggcctcgacctcagcgactggccgctggaccggccgatttccgcggccgacctgccgccgccggtggccaaccccggcagccgcacccacaccgacctgctgcggcgcctgatcgagcgcgagacgttacgcctggaccagttgctgctgcgccccgaggtggtttccgcggcgcactggcaggtcatcggtacggtggacgatgccgtcgagcagatcgtcgactgggccgccgccggcgccatggacggtttcatcgccgcgccgggaggctcggtcggctcgctgcggctgttcctcgaacaggtggtgccgcgcctggtggagaaggggctgttccgcgagcgctacagcgccactaccttcgccgggcacctggcagaggaatga

SEQ ID NO: 15909 - DNA, 654 bp, Pseudomonas aeruginosa
gccaggcgtccacccgaccctcggtcatcgacaggccccacttgggcatggtcagtgtatggatccggctcatgccgcgtccctcccttccagggcctggcgcacggctgcctcgatattcgccgcgtcggggatgtagaggtcttccagggcgtcggagaaaggcaccggcgtatggggcgcggtgacccggcggatcggcgcgcgcagcgcggagaaggcccgttcggcgaccagcgcggcgatgtcggtggccatcgagcagcgtgggttggcttcgtcgaccaccaccaggcggccggtcttttccacgctttcgagaatgctgtcctcgtccagcgggctggtgctgcgcaggtccagtacttcgcaggagatgccctggcgcgccaggctggcggcggcgtccagcgccaggtggaccatgcggccgtaggtcaccagggtgacgtcgtcgccgtcgcggaggaagttcgcctcgccgaagggtacgctgtacagctcctcgggtacctcgccctgcatcgaatagagcagcttgtgctcgcagaagatcaccgggtcgttgtcgcggatcgcctggaccagcaggcccttggcgtcgtagggcgacgacgggcagactaccttgaggccggggatgtgggtccatag

SEQ ID NO: 15910 - DNA, 825 bp, Pseudomonas aeruginosa
cgggtcagcttgacttcgatcagcgacggcccctcgccggcgcgggcgcgctcgatggcggcgccggcagcctcgtggacggcgaagaagtgcgaagccgtcgacggtcaccccgggcatgccgaaaccggcggcgcggtcggcgatgtggtcgcaggccaccgaccagtaggccgcggtggcctcggcatagccgttgttctcggcgacgaacaggcacggcaggttccacaccgcggccaggttcatcgcctcgaacaccgcgccttcgttggagccgccatcgccgaagaaggccaccgccaccgcatcgctgcctttcagcttggccgccagcgcggcgccggcggccagcggcgcgccggcgccgacgattccgttggcgccgagcatgcctttctccaggtcggcgatatgcatggagccgcccttgccctggcagaccccggtcttcttgccatagatttccgccatcatgccgtgcacgtctacgcccttggcgatgcagtggccgtggccgcgatgggtggaggcgatgcagtcgtcgtcgcgcaggtgcgccatcacgccggcggcggaggcttcctcgccggcgtagaggtggacgaagccgggtatctcgcccgtggcgaactcgacgtgcaggcgttcctcgaaggcgcggatggtgcgcatcacgcggtaggcatggagcagttggtcggtgctcagagtggacatcttgttgttctccaggttgtcttcacggggtcatcggggttcgctggccggccagcaggcgatggcgggcggcgtaggcgagggtggccggcacatcgacgctga

SEQ ID NO: 15911 - DNA, 537 bp, Pseudomonas aeruginosa
acggctgcggcgacaccgcgacgtccaccagcgcccactcgcagagcccgcggcgcggctcgcgcaccagcaggcgcttgttgcgtcgcaggccgatctccggcggcacccggttgctggcgcagaggccgccggcgagccccgcgccggtggcttcgcgcagctccgggaaggcgttgttggtcccggtggacagcgccagcagggggacgtcgccgacctcggcggccactgccttgtgcgtgccgtcgccgccgagcacggcgatcagcgccacgccgcgctcgaccatgcgccgcgccgccaggcgggtatcctcgacgctctggcgcagcggcatgtcgaggaactccaggaacggccagtggccgtcgcgggcctggcgggtctggctggcccggagcacggcggcggcgatgccggtcatgtccggcggcagcaacgcatggcggatgccggtggcgccgaaggcggcgagcaggcgttgcaccaccgatgccttgtcggtgctggagtgcagcccggcatgggcggtga

SEQ ID NO: 15912 - DNA, 732 bp, Pseudomonas aeruginosa
caggttgacgatccgcccccagcgctgcgcctgcatcagcggcagttcggcctggcagcagaggaacacgccgcgggcgttgacgttcatcacccggtcccagtcggcgaggctgagttcggcgaccttgcggatgctgatcaccccggcattgttcaccgccacgtcgagccggccgaactccgtggcgacccgctcgaccatcgcccggacgctgtcgccgtcgctgacgtcgaccccaagggccaggctgcggcgaccgaggctgcggatcgcggcggcggtttcctcggcgacctgcggatcgaggtcggccaccgccacgtcggcgccggcgcgcgccagggcgagggcgatgccccggccgatgccgcgtccggcgccggtcaccagcgcgacccgggaagacagggagaaatcgtcggacgacgtagcgtgcatgcttcacctctgattgttcttgtaggtgtatgcggcagggcgttgggaggagcggacagtccgccctgccgtcgccgtggctggagcaaggccgatgccaggttgcggcgtggcggccggaaggcccgtcgtagagcgccggcatgggaaggccggcgaccgccggggcgacgtccggcgagacaacccatgtcatcgcgcacgggttcccggcgagacgctgagacgctccgtctcagtcgtcggctgtggcggcccggcgcttgtcgagggtcgccgatgggcgcttaa

SEQ ID NO: 15913 - DNA, 789 bp, Pseudomonas aeruginosa
ccagcatctgatccggcagatggtggcgcagagcgcgcgggagatcgagaacgccttcttcatgcacagcgcccagggccattgggtgctgcgcgcgcaccgtgcgccgggctacgtcgacagccagccggactacctgttcgcctgggacgccgatgggcgcctgctggcgttgaacccggcggcgcggcactacctgcggcagcgcctggggcaggtgccgagccacatcggcgaggtgttcgacctcgacgccctgcacgccgccgccgaccaggcgccgtgcctgctgcgcggccaggccggcgagctgcacgtgcgtctcagcgcgccgcgggccaaggcgcggcggctggagcgcgaggtgcccgacgacgctgcgctcgacccgcgcatcgccgaaagcctgcgcctggcggtgcgggtcaaggaccgcaacctgccggtgctgatccagggcgagaccggcgccggcaaggaggttttcgcccgccagatgcaccaggccagcgcccgtcgcgacaaacccttcgtcgcgctcaactgcgcggcgattcccgaaagcctgatcgagagcgagctgttcggctacgttggcggagcctttaccggcgcggcggcgaaagggatgcgcggcctgctgcagcaggccgatggcggtaccctgttcctcgacgaggatcggtgagatgccgctgggcctgcagacccgcctgctgcgcgtgctggccgagggcgaggtggcgccgctgggggctgcgcgccggcaggctgtggatatccaggtga

SEQ ID NO: 15914 - DNA, 489 bp, Pseudomonas aeruginosa
ccatcgtcgcttccggcgccaaccatggtttccgccggaccctgccgttcgtcaccggcgccaccctcggcttcgtcctgctgctggccttcgtcggcttctggttcgtccgcgcgatcgaggcctacccgcgcttcttcgactacctggggatggccggcgcggcgttcatcgctcatgtgggctaccgcatcgccaccgcggatccacgcctggccctggaggaaaacggggtccccgggttcttccagggcgtgctcctgcaatggctcaatcccaaggcctggatcgcctgcgcttccggcgtggccttgttcgccagcccgagcacgcacgcgccgctgctggtcttcatggccatctacctggtggtctgctacctctcgctggccgcctgggcactgctcggtgaccgcgtggcgctgctgctcgacagcccccggcgggtgcgcctgttcaatcgggcgatgggcggcaccctggtgctga

SEQ ID NO: 15915 - DNA, 804 bp, Pseudomonas aeruginosa
ccggctgtcggggcgcatgccgagcccgatccattccagccgctgcaggtcgcgcgggtgttccagcggcgcgtgccgggccaggaatgccggtgccgccactacctggcgcggcagcaggaacaggtgacgggccttcagcgagctgtccggcaggtcgccgatgcggaaggcgatgtcgatgccgtcgccgatgatgtcgtggcggctgtcgtcgcatgcgatgccgaggtcgaggtcgggatgctcctcgatgaaggctgccaggtgacgggtgaagtcgccgtagacaaacaccgcgggcatcgagatgcgcaggctgttgcgggtcgagacggcgcgctggcggaactcgatgaagcccttctcgtagagttccagcatggagcgggcggtgtccagcaactgcgtgccgtcctgggtcagcgacagcttgcggctgttgcggtagagcagcgcacggcccaggttccgttccagcctggacaggtgcaggctggcggtcgcggcgctcaggcccagcgcctcggcgccgccggagacggagccggtctcggcgatcttggcgaatacgatcaggtagcggatgtcgtcgatcatgcggtctctcgtcgcgggggctgggtgcatcctgcgcgatggcggccagccggacaagcgcgagaggtagagagcggcggcgcttcccgggcttttcagcgcaggctccagaaacccaggcgaccgaggctcgccgccagtcgcaggcgcgaggtctgccagttgccgagggcgcggatgtgctggtcctcggcgctggcgtag

SEQ ID NO: 15916 - DNA, 501 bp, Pseudomonas aeruginosa
gtgcgttcgaagccttcgaacaacgggatgttcagttgcaggccgatgctgcggtcgcgttcgcgggtatcgccgttgaacgccatcgcctggtcgctatggctgcgtgccaggttggcgctcagcgccaggctcggccggccggcggcgcggctttcctccaccgaggcggcggcggctttcagccgcgcctgggcggcgagcagcgccggatgctcgcggcgggcttcggcgagcatctcgtcgatggccttgacgaagccggtgtcgggttgcgcctccagctcgccggagaggcgcagcggggtatccggcgccaggcccatgcgcagggcgatgacgccgagggcgttgctcagggcgccttcgtcgcggacctgggcgaggctcgcctgggacagcgcggtctgcgcctgcaggcgatcggaaagggcggcggcgccggcccggtacttggcgtcggcggcttccaggttctgcgccgccagctccgcgacctga

SEQ ID NO: 15917 - DNA, 480 bp, Pseudomonas aeruginosa
gcggctacggagcgggcggtcttggatgatcgtgcaacctggctaggcgcggccgagcatacgcagccagcgtgccggtggcaggccgtagctctggccgaaatggcgggtcatgtggctctggtctgtgaaaccggcggcaagcgcggcttcggccagcgtctggccgccgagcatcagccggcgggcgatgtccagccggcgctggatcaggtagcggtaggggctggtgccgaacagcgcgcggaaatcgcgcgacaggctccagcgttcgcgctgggcgacctgcgccagttcgtcgaggcccagcgggcgctccaggtgcgcgtggatgtactgccgggcgcgctcggcggcgacgaagtcgaagtggcgcctgccgcgcgcccggttgccggccacggcgtcgagggcgtgggccagttcgaacagggcgtcctgttcttccagcggctccagcggggtatccatggcctgtag

SEQ ID NO: 15918 - DNA, 438 bp, Pseudomonas aeruginosa
cagggtccggctggcggcgatcaggcgcgggtcgtcggacaagcccccgcgcacgaacggcagcggccggccgccgagggcctgctggatcagcgccggctcgacgtagagcatccggtagcggaacccttcctggctgccggcctcgccgtcgtgcagctcgtcgggatgcagcaccaggcagccgcccggcaggctgtggcgctggctgcggcgatagcggaagctctgcaccccggccagggtctggccgatggcataggtgtcgtggcgatgcggatcgtagccgtggccggcgaagtaagcctcgatgcgttccaccgcaccgtgttgcggggcgcgtcgaacccagtcgcggggcgtattggcgtggctcatggggaaaggctcgtggcgcggaaggttcaggctagcgcttcgttggcgcgactggaatag

SEQ ID NO: 15919 - DNA, 465 bp, Pseudomonas aeruginosa
agctggccgcaggcatggcggtgggaggccgtgcggctggctgcgcggtcgatgcgcagggcgaagagcgggacgggcaggggtttcggaaacatttggcggaaaagcgacgatgattggctcgggatggataataggccattcgactgcggatgtagcctggcggctcatcattcttgcttggagcacgccatgaaagccgaagacatcctttccgaccgacaggaccgcatccgcctgggcggcgtggagatacgcaagggcagcgtcggcgcgttcatcgccaacgcccggctgctgcttgaggaggaactgcccgcggcgcaacggcggcaggctgaagaagacctgcgcgccctgctgccggcgatccgggcactggggctgctggaactcttcgaactgcgcgacgcgcgactgcggacgctggtggcggattgggaaaacgccgctggccgctcctga

SEQ ID NO: 15920 - DNA, 639 bp, Pseudomonas aeruginosa
cgtgtttttttctcaggaattcccatggccaagcgtggacgcccctgcggcttcgatcgtgaacaggcattgcgccgggcgctcgacgtgttctgggaggccggctacgaaggcgcgaccatggccgcgctgaaggaggccatgggtggcatctgcgcgccgagcatgtatgccgcctatggttccaaggaggcgctgttccgttcggcggtggaactctacctgagccaggagtgccagctttccaagggcgccttcgccctgccgacggcgcgcgagtcgatcgccgcgctgctggaaagcgccgccgtcagctacaccaccgaaggcaagccgcgcggttgcctggtcgacctcagcacgaccaatttctcgccggccaacaaaggcgtcgaagactacctgcgcgatcaccggcggcgcgccgcgcgcctgctgcgcgagcgtttcgcacgaggcgtggccgacggcgacgtgccggccggagccgatctcgacgcgctcaccagtttctacagcagcgtgcttcagggcctgtcgatccaggcccgcgacggcgccagccgccagcagttgctggccatcggccgctgcgcgatggcggcctgggattccctgctggcggtcgaggccgcctga

SEQ ID NO: 15921 - DNA, 1086 bp, Pseudomonas aeruginosa
tatagaattgatccaaaccccgggcgaggtccttccgcgcgtgtctcgcgccccggccatcgcccgctgccgattggagctttcatgacaacgcttgctgatattcccctgtccatgctcgacctggtgccggtgcgcaccggcggcagcgtggccgaagccctgcacaactccctggacctggcgcgccatgtggagcgcctgggcttcaaccgtttctggctggccgagcaccacaacatggatggcatcgccagctccgccaccgcgctgctgatcggccatatcgccggcggcacctcgcggatccgcgtcggctcgggtggggtgatgctgccgaaccatgcgccgctggtggtggcggaaaacttcggcaccctggagacgctctacccgggccgcatcgacctcggccttggccgcgcccccggcgccgaccaggcgaccatgcgcgccttgcgtcgcgaccgcctgggcaacggcgacgacttccccgagcaggtcgccgagctggaaatgctgctcggcccgcgccgttcccagcagagcctgctggcggtgccgggcgagggtacccaggtgccgatctggctactcggttcgagcctgttcagcgctcacctggcggcgcagaaaggcttgccctatgccttcgcttcgcatttcgcaccgcgttacctgcacgaggcgctgcgcatctaccgcagcaacttccagccctcggcggtactcgacaaaccttacgcgatgatcggcgtgccgctgatcgccgcacctaccgacgaagaggccgagttcctcgccactaccgccttccagcgcgtgctggcgctgatccgcggcgagagcctgaaacagaagccgccggtggaaagtatggcgccgttgtggctgccccacgagcaggatgcggtcggcagcttcttcggcctggcggtgatcggcggtccggagaaggttcgtgcgcgtctggagatcctcctggagcagaccggcgccgacgagcttatcttcaccagcgacttctacgagcacgcccatcggctgcgctcttgcgaaatcgtcgcggagctgaaaggggcgtga

SEQ ID NO: 15922 - DNA, 768 bp, Pseudomonas aeruginosa
tccggggcctgtagggaaaatgatgtagacctgcgtgcggtagggtctttcggcgataggttttttggttctaaacttagaactaaaaacaataagccagagaggaaccctgccatgccggttgcacaccgactgctgttttcattgaccgccttgctggcggcgacggcccaggccgtcgtcgacggccagaaactctacacacagggcggcgccaacccggccgccgcggcctgcgtcacctgccacggcgccgatggcatgggcctggccgccgccggctttccgcgcctggcgggccttcccgccgcctacctgagcaagcagctgcacgacctcaagcagggcggcagtcgcgagcacccggtgatgaagggcatagccgatgctctcggcgacgacgagatccaggcgctcgccactaccctcgcggcaatgccggcgcccaagctggtggagctgtcgcgcgtggccaccccgcgcagccccggcgagaccctggcggtgcgtggcgcctgggagcgcaacattcccgagtgcgtgacctgtcacggtccggccggcagcggcgtgggggaggccttcccgccgttgcaggggcagggcgagatgtacctgagcaaccagttgcgcgcctggcagcttggcactcgccgcaacgacccgaacgatctgatgggacatatcgccaaatccctcagcgaagaggagatccgcagcgtcagccagttcttcgccaccctcggtcaggcaggaggccagccatga

SEQ ID NO: 15923 - DNA, 873 bp, Pseudomonas aeruginosa
acatggccgtcgatcctttccctggccgtcgccggcctgctggtcgctcccgtccacgcggcaacggcgccctcggagccgttccagccgccggcggaaagcagcctcccggacaacgccttcggcgaaatggtccgccagggccaggcgttgttcgtggaaacccggaagaacgcaccgcatctggtcggtaaccagctcaactgcgtcaactgccatctcgaccagggccgccgggccaactccgcgccgcagtgggcggcctacccggtctatccggcgttccgtgccaagaacaacaaggtcaatacgttcgccgagcgcctgcagggctgcttccagttcagcatgaacggcaaggtgccggcggctgacagcccggagatcaaggccctgaccgtctacgcctattggctggcgagccaggcgccgaccggggtcagcctgcccggacgcggctatccggacgtggccccgccggaaggcggctacagcatcgagcgcggcgccaaggtctatgccgcgcagtgcgcgatctgccacggcgccgacggccagggccagatggctctggggcagacggtgttcccaccgctgtggggcgcgcagtcgttcaactggggcgcgggcatgcaccgcatcaacaccgcggcctccttcatcaagtacaacatgccgctgggcaagcccggtaccctcagcgaccgcgacgcctgggacgtcgccgccttcatgaacagccacgagcgcccgcaggacccgcgcctggtggacggttcggtggagaagacgcggcagaagttccatgccaacgacggcgtcaacctgtacggacagaaggtcaacggcgtgctgctgggacagggaatctga

SEQ ID NO: 15924 - DNA, 438 bp, Pseudomonas aeruginosa
ggtgcggcaggtcggtttcggcgatgcccggaccgtggtcgcggacgtggaagcgcgcgcagccttgcgcggtttccaccgccagctccacccgggtgccggcggcggtgtggcgcacggcgttgtccagcaggttgcgcagcgcggcgatggccagcaccgaggggacttccagcggcgcctcggacaagccgtcggccagcttcagctcgaacatccgcacgtcgccgtggccggcgtcgtgcatggctacccgggcggcgtcctcggcgctgcattgcacgccgtcgtcgaacgacaggctgccttccacccgcgccagcagcaacagctggtccagcgtccggtgcagacggtcggcgccttcctcggcgtgggccagggcctgctcggcggcggcgccctcggtcatgcgcgcgacctgcaggtgggtcttga

SEQ ID NO: 15925 - DNA, 714 bp, Pseudomonas aeruginosa
ggcgcaggcgcaggctcatgcgtcgtctccgtcgccgcgcgccggcccgaggcggtagccgaggccgcgcacggtctgcacgatggcgttgccgagcttgcgccgcaggtgatggatgtggacgttgagggcgttgctctcgacctcgtcgccgaagccatagacgctgtccttgagctgctcgccgctgaggatccgcccgcggttgttgagcaatgcctgcaacagcgcctgttcgcgtcgcgacagttccacggggcggccgtcgagccaggtttcgcgggtgctcggatcgtagctgaggcggccgtgttcgatgacgttgacgcaacgcccggcggagcgccgctgcaaggtatgcaggcgggcgccgagttcgcgcaggtcgaagggcttgagcaggtagtcgtcggcgccggcctgcagcccggcgacccggtcggtcaccgcgtcgcgcgcggtcagcaccagcaccggcaggtcgacgccctgctggcgcaggcgttgcagcaggcgcaggccgtcctcgtcgggcaggccgagatcgaggaccagcacgtcgaagcgcgccacctggagcagcgcctgggtatcggcggcgctggccacccggtccacggtcaggccctgggcgttgaggccggcgacgatgccgctggcgatcaggtcgtcgtcttcggtgagcagtacatgcatggcggtatcgctggttaa

SEQ ID NO: 15926 - DNA, 1506 bp, Pseudomonas aeruginosa
aaggcgttatccatgcgtgtgttgatcctgctcctgatgctcctgctgccgggcctgtcccaggcgcaaccgggcgacgacctgttcgcgccgcgcggcgcgatgcagacggatttcctgccggtggagaaagccttccgcttcacctgggagcgcctcgacgacggccaggtgcaactgcgctggcagatcgcgccgggctactacctgtaccagaagcgcctgcgcttcgacggactcgacccggccttgcagccgcagctgccgcccggcgaaagccacagcgacgagttcttcggcgagtcgcaggtctatcgccagagcctggaactgaccctgccggcggccgccgccggacaactgcgcctgggctggcagggctgcgccgatgccggcctgtgctatccgccgcagagccaggcgctcgacctgggcggtaccggccctgccgccgccgggacgagcggcgaagtcgccgaggaccagggcctggccggcagcctgcaggccggcaacctggcctggagcctgttgctgttcttcggcctcggcctgctgctggcgttcgctccctgttcgctgccgatgctgccgatcctcgccgggctggtggtcggcagcggcgccggccctcgtcgcggcctgctgctggccggtagctacgtgctgagcatggcgctggtctacgccggactcggggtggtcgcggcgctgcttggcggcaacctgcaggcctggctgcaacagccgtggctgctgggcagcttcgccgcgctgttcgtgttcctcgcgctgccgatgttcggcttcttcgaactgcaactgccggctgccctgcgcgaccgcctcgacggtctcagtcgcggccgcaagggcggcagcctggccggcgcggccgcgctcggcgcgttgtccgggctgctggtggggccgtgcatgaccgcgccgctggccgggggccttgctctatatcgcgcagaccggcaatgccctgcatggcggcctggtgctgttcagcctgggcctcggcatcggcatgccgctgttgctgctggtgacggtcggcagccgcttcctgcccaagcccggtccctggatgaacctggtcaagggcgtgttcggcttccttttcctcggcaccgcctggatactcctgcgtccgctgctcggcgaggcgctgtggatcggccttggcggcgcgttgctgctggtcctggcctacgccgcgctgcacacggcgcgaggcctggcgcggcacgcggtgctgttcggcgcggcgggctgcatcttcggtctctggggcgcggcgatgttgctgggcgccgcggccggggccgacgacccctggcgtccgctacaggtgtatgcggcggcgaaccggggcgctacgccgacggccagcgcccacgaggcgttcctcacggtgagccagccggccgagctggaccgtcagttggctgcggccaaggccgagggacaatgggtgctgctcgactactacgctga

SEQ ID NO: 15927 - DNA, 1107 bp, Pseudomonas aeruginosa
ctggtgcgtgtcctgccggatcatggagaaacaggtgttcgccaagcccgatgtgctcgccgccctgcagggcgtgcgcctgctgcggctcgacgtgaccgcggacaacgccgccagccgcgagctgctgcaccgctaccaggtacccggcccgccgagcctgatctggatcggcccggaaggcgaggagcgccgcgcgcgccggttgaccggcgaagtcgacgccggcggcttcctcgcccattggcaggcgacccgggagcgcggctgatgctgagtttttccctggggccgctggtggtctcgctgcaacacctgctgctgttcctcgccctcggcgccgcgctgctcggcggttggctggcggcgcgcggtggcgggcgcaacgccgagccggtgctgttcaacctgttgttgctcggcctgctggtggcgcgcctggctttcgtggtgcgctactggccgcagtaccgcggcgacttcgcacagatgctggatatccgcgatggcggtttcctcgcctggccaggcctgctcgccgccgtgctcggcgcgctgttctgggcctggcggcgaccggcgctacgtcgctcgctgggtgtcggcgccagcctcggactggcgttctggctgcttggcagcctgggcctgggcgtctacgagcgcggtacgcgcctgcccgagctgagcctgcgcaacgccgccggcgagtcggtgcaactggccgatttccggggccgcccgctggtgatcaacctctgggccagctggtgcccgccgtgtcggcgcgagatgccggtgctgcaacaggcgcaggcggagaatcccgacgtagtgttcctcttcgccaaccagggcgagagcgccgagaccgtgcgccatttcctccagggcgagaacctgcgcctggacaacctgctgttcgacaacggcgggcagcttggccagcaggtcggctcggtcgccttgcccaccaccgttttctacaccgccgagggccgcctgctgggcagccatctcggcgaactgtcccgcggcagcctggcgcgctacctcgaagccttcgagccggccgctgccgcccccgcaaccaggagttccgaatga

SEQ ID NO: 15928 - DNA, 1731 bp, Pseudomonas aeruginosa
cgctcagcgtccggcgctggccccgcggagcgacggtttcgacatccacacctaccatcccgacttcgtcgccgatccctatccgctgttgcggctgatccgctcccgtgcgccggtctgccgcgaccaggcctcgatctggtggatcagtcgctatgccgatgtttcggcgtgcctgcgcgaccgccgtttctccgccgaccccgctcgccttggcgccgccggcgtccgccagggcggcgccagctggttcggccaccagcaattgcaaccgctggcgcgcttctacgacaacttcatgctgttcaacgacgcgccgcggcacacccgcctgcgcaggctgttcgctccggccttcggccccgacgccgtgcgccgctgggaagcgcgcatcgaggtgctggtggaggaactcctcgacagcttgctggagcgccgcgagcccgatctgctcagggatttcgccgaaccgctgacgatccgggtggccgccgagctgttcggctttccccgcgaagataccgggcaactgctgccctggggccgcgatctggccgccgggctcgatctcgccgccagccacggcgatgccgggcagatcaaccgcagcgcggccgccttcagcgactacctgcaacgccaggcgcgcggctggagcgatggctcttcgcgcccgccgtccggcgcggcgccgagcatcttcgacggcgccgcgatgctggaggccggactgggcctcgaggacctggtagcggcctatgccatggtgttcatggccgccttcgaaaccaccatcagcatggtcggcaacgctacgctggcgctgctcacccatcccgaccagctcgacctgctgcggcggtgcccggagctggcggcgaacgcggtggaggaactgctgcgcttcgatggcgcggtgcgcggcggcgtgcgttgcaccctggaggaggtggagatcggcggccagcggattccgcctggagagaaggtctggctgagcttcctcgcggcgaaccgcgacccggagatgttcgccgcccccgaccgcctgcaattgcagcgagcgaacgccaagcagcacgtggcgttcgcccatggtccgcactactgcctgggcgcgtacctggcccggctcgaattgcaatgcgcattgcgcggcctggtgcgtcgccgtttcgccctggcctcggaaccgacggacctgcgctggcggcgcagctcggtgttccgcaccctggagcgcttgccgatcgtcccggaaggcgacgctcagaagacctgcgagtagcgcaggatcagccggctgccctcgctgcggttgcgtgcgccgtattcgtgataggcgttgaggaacagccgcgacttgccccagccgaacatcagcgccgggccgatggcatcgacccgctcgcgggagtccgggcggtcgtgcccgtcgacccgctcgtcggtgatctgtcgcaggctgtagccggacaacccgactcgccaatgcgcatccagcgccagcgataccgagtagttggcgtggaacgcctggcccggttgcaggtagtcgtcggccaacggcggcgccgggtcgcgattcttgcccggcaacaggtactgcaggcgagcgctggcttcccagccttcggcgaattcccaggtcagcgcgtagtgcgggttgaagctccagtggttgctgccgggattgatcgcccgatgcctgtcgtagcgcccggtgggtaa

SEQ ID NO: 15929 - DNA, 498 bp, Pseudomonas aeruginosa
atgatcagcaggcccatgaaaaaggtggcccagagcagcagggtgccgccgcgcagctcggcgccgaggatctgccgcaggagcgaggtgccgtcggactcgtcggcgggcagttcgaggcgtccggcccagccgtcgggcaggcgccccaggcgttcgaggatgcgccgcaggcgcgccgcgtccggtgcgcggcgggcgaggaagcgcaccgactccggcaggcatgcccagagcagcggcaggctcgccaggggcaggccgccgccgagcagcagcacgctttcccagcccagcgccgggaccatccgcgcggcgagcaggccgcccagcgccgagccgagggtgaagccgcagaacatcgcggtgaccatcagcgcgcggtgccggcgcgggcagtattcggaggtcagggtgatcgcgttgggcatcgccccgcccaggccgaggccggtgaaaaagcgcagcagggccagggtttccaccgaaccggcgtag

SEQ ID NO: 15930 - DNA, 873 bp, Pseudomonas aeruginosa
cccagggcggccggcagccgccggcctaccgcctggagtcatcgtcgatgctggccaacatcgaattgttgcgtggcagcgacatgctgtccatcggctcggcgcgggtggtcgagcaccttgccgggctcggcctggtggccaggctggcgctggagattcccggcgagggcgcggtgggcatgtgctggcgcgacgaaccgcaccgcgaccgtgccagcgaagacctgctggcctgcctgcgcgaaggcgcggcggccgagtagggcgccggccggcgggtgctattgcaaaaaggccgcggcttctcgacaatgcgattcattatcattcatgtgtcgccccgactttcccatgtccgccccgatccttctcagcgcccaccatcgcgccatgcatgcgctgtacagcgagcaccatggctggttgcagaactggctgcgcggcaagctgggctgcgcggcggacgcggcggacctggcccaggacaccttcctgcgcatcctgctcaagcgcgaactgcgcgagatcggcatgccgcgcgcgttcctgcggaccatcgcccgcggcctggtgatcgaccactggcgtcgcgaggaactgcagcgcgcctacctcgaaagcatcgcccacctgcccgaggcacaggcgccgtcgcccgaggcgcgggaactggtgctggaactgctggaggaaatctcgcggatgctcgaagggctcaagccgaaggtccgcaccgccttcctcctggcccagtgcgaagacctcagccaccggcagatcgccgaacgcatgggggtttcccagcgtagcgtcgagcgctacgtggccgaggcgctgtaccactgctacctgctgcgctacggcgaatga

SEQ ID NO: 15931 - DNA, 507 bp, Pseudomonas aeruginosa
ttctcctcgcccgcggcgagatcttcctcgccagcggcgccgatacgcaatcgcccacgcacaggccgctgcgggtacgtaccgcgcaagggctgttcgaggccctcggcacccgtttcaacgtacgcctgcaagatgccgccacctgtctcagcgtcagcgagggttcggtgcgcatcgatgccttcggcgcgcgtccgctgcaggctccggtggccgaggcggggcagagctatcggatcgccgccgacggcgtgcggcgcctcgaacggccgcagatggacgccgtggcctgggccgatggcctcatcgtcacccgcgacatgcgcctggccgacttcctcgccgaggtcgcccgctaccgcaacggctacctcggctgcgccgcggaggtcgccgacctgcgcctgtccggggtctatcgcctggacgacaccgacaagctgctgcaggtgctcgcgcggaccctgccggtgcgcctgcagcgacatacccgctggtgggtga

SEQ ID NO: 15932 - DNA, 915 bp, Pseudomonas aeruginosa
cctgccgggcggcctggtggcgctgaccagcaagaagccgttgtacgaggactaccgccagatcaccggcagcatcggcaacatgggccagaaggagatgggcttcgatttcagcgggccgctcgacgaggagaagcgcatcgcctaccgcctgatcggtctcggcaagggctcggacacccagttcgatcacgtcaaggaggagcgctacgccatcgccccgaccctggccatcgacttcagcgacgacaccaccctgaccctgcaaggctacctgcaacacgatcccaacgggggctaccacggcggcgtaccggccgacggcaccctgtcgcaccacaacggccggcacatctcccgcgagttcttcgatggcgagccgagcaaggacgacttcgaccgcacccagcggatgttcggctaccagttggagcaccgcatcgacgacgtctggtcggcgcggcagaacttccgctacctggactccgacgtcgacctgtcgcaggtctacgcctacggctggagcgccagcgagccgaacaagctgaaccgctacttcagcggcgcccgcgagcacctgcaggcgtatatcgtcgacaacatgctgcaggccgaattcgccaccggcgcggcgcgccacaccctgctcaccggcctcgactaccagcgccggcgcaccgtggtcgactggcgttccggctcggcctcggcgctggacgcgttcaacccggtctacggcgacgacgccatcagctatttcccggacgacaaccacacccgccgcctggagcagaccggcgtctacctccaggacctgatcgacatcgaccagtggcgcttctcgctcggcctgcgccaggactgggtcagcgtcaccgacaagaaccgcagcaccggcagcaaggccgacgatga

SEQ ID NO: 15933 - DNA, 249 bp, Pseudomonas aeruginosa
agtgaattcgagtctgcgtcaaagcagccccgccttggcggggcttctttctgccgggccacgagcgcaaataatcagctcaccagaacccggccgagcgctgcctggagaccgataggtccttcccattacgaaaatgacgacatcgcatcgatcctgaaacgtccgtacagccaggacgacgcaatgaaggcaaagtgccattccctcctgtccctgtttggattagcattcctacttttggactaa

SEQ ID NO: 15934 - DNA, 1563 bp, Pseudomonas aeruginosa
cgatatggacatccgcagcccgctgaaccagtgcatcgccctgtccctggccggcatcctgttcctcaacccgatcgtcgccgcggcggcggggctggcgctggacaaggccgccggcggcaacaccggcctgggccaggcgggcaacggcgtgcccatcgtcaatatcgccacgcccaacggcgccgggctgtcgaacaaccatttccgcgactacaacgtcggcgccaacgggctgatcctcaacaacgccaccggcaagacccagggtacccagctcggcgggatcatcctcggcaaccccaacctcaagggccaggcggcgcaggtgatcctcaaccaggtcaccggcggcaaccgcagcaccctggccggctacaccgaggtggccgggcagtcggcgcgggtgatcgtcgccaacccgcacggcatcacctgccagggctgcggcttcatcaacacgccgcgcgcgaccctcaccaccggcaagccgatcatggacggccagcgcctggagcgcttccaggtggacggcggcgacatcgtcgtcgaaggcgccgaactgaacgtcggcaacctcgaacagttcgacctgatcacccgcagcgccaagctcaacgccaagctctacgcgaagaacctcaacatcgtcaccggccgcaacgacgtccaggccgacagcctgcaggccacgccgcgcgccgccgatggcagcgagaagccacagctggcgatcgacagctcggcgctgggcgggatgtacgccggggcgatccgcctggtcggcaccgaacagggcgtgggggtgcggctggccggcgacatggccgccagcggcggcgacatccgcatcgacgccagcggcaagctgagcctggcccaggcctccagccagggcgacctgaagatcgcggcccaggccgtggagctgaacggcaagacctacgccggtggcagcgccgagatccgcagcgcggaggaactggtcaaccggcagagcctggcggcgcgcgaacgcatcgcgctggaggcggcgcatatcgacaacgccggggtgatcgaagccggcgtcgagccagacgagcggcgcaacgcgcgcggcgacctcgagctgcgcagcggcaccctgcgcaacgccggcagcctggtggccagccgcgcgctggaagcgaaggcgagcctggcactggacaaccagggcggcagcctgaagggggcgaccgtccgggtcgacggcggacacctggacaaccgtggcggcaagctgctcgccgagggcgaactgcgggtcgaggcgagcagcctggacaaccgccaggacggcctgttgcagagccgggaccgcgccgtggtcaagactcgtggcgatctcgacaaccgtggcggccaggtcgtcggtctgaacgaactgcaggtccaggctgccgcactggacaatcgcagtgccggtctcctttccagcaagggagacatggacatcgaggtcgctcgtctggacaacagtgcgggcggcaagctggtcagcgagcgccgtacgctcctgaaggcggatcggctcgataa

SEQ ID NO: 15935 - DNA, 1920 bp, Pseudomonas aeruginosa
tctgcgtgccaaactcggtgcgctggtgcagaacgggggagagctgacgactcagggcgcgctggccctcgacgccgacaaagtcgacaacggcgctggtcggcatcgcccggcaaccgaggtgtggtcatcgatgcccggcaggtggacaaccgtgccggcgagattgccagccagggcgtggcgacgctgaacctcactgagcaactggacaaccgtggcggcaagatcgtcggtgacagtggtctgggcatcaccgcgccacgcgtgctcaaccaggacaagggagtactcgccagccgcgatgggctgcgcctgagtggtaccgaattgttcaatggcaatgccggactgctcagcagtcagagacatatagaggtcactctggacggcgtgctggacaatcagggcaagggcgcgctgctcagcgacggtaccctgacggtgagcgccgggcgcatacacaaccaggacgccactctgtccagcgccggtgcgctgagactgagcagccaggaggcggtggacaaccgtggcggcaagttggtgacggactccagcctgcgcctgaccagcgccagcctggacaacagccgatcagggatcatcagtgccaacgctgcggcggagatccataccggggttctgaacaacagccagaaaggcaatcttggcagtaatgacgggctcggcctgattgctactgaggtggataacagccaggaaggtcggatcactgccaaaggcatgatcgacgcaaatatcaagggactcgatcagcagggcaaagggcggctggtcagtaatgccggcatcatactcgacctgaacgagggaaccctggccaatggcgctcagggcctgatcgccacgcctggaaccttgctcctgcgccaactcggcatggtggacaacagcggcggggaaatttccagcgaccgagccttcacactcaccaccaccgcgctgaccaaccagggtggccgcctgcgcagcggcggtgtactgacgttgcgcatcgcccaggctctggacaacagcctcgaaggtgttctctccggcaccggaggcctggatatccgggcgcttgccctggacaaccgcagtggctccatcggcagcaagggcgccgtcgatatcgacgtgtcccgtttggaaaacgatgacggcgacctgcttagcgaaggtcgtctgaaactgactgccgagcgagcgaacagtgtcaggggacggatcgcggccaggggtgacctgcacgccagcgtgacagcctttaaccaggcgggtggcgaattgagcagcgagggtgcgctgatgctcgaggccgatagcctcgacaaccgcagcggcggtctggtcagtgctgatggcaacctgaccgtttccgcccggaggatcgacaaccgtgcgggcgaaatcgccagcccgggccaggtgacactggacgtcgccgagcagttggacaaccgaggcggcaaggccatcggcgatagcggacttcgcctcgccgcgccacgggtactcaaccaggacggcggggtactcgccagtcgtgatgggctgcgcctgaatggcgccgaactgttcaatggcaacggcggcctgctcagcagccagcaaagcatcgacgtcattctggacggcgtattgggcaatcaggcgggcagcttgagcagccagggacgcctgagcgtgaagagcggtcggctggacaaccagggcggtgcagtctccagcgccgggaccttgtcgctttccagccagggtgcgttgaacaaccagggggcagggtggtcaccgacgccggtgccgtcctgcgcagcgccagcctcgacaacagccagggcggcatcgtcagcgccaagggggccgcggagatccgtactggcagcctcaacaatagccagaagggcggcatag

SEQ ID NO: 15936 - DNA, 867 bp, Pseudomonas aeruginosa
gacaggcgctcggcgacctcggcgttgctgaaaaagcgcaggctgtgcataagtcgagtttcctccgtcgctgcaggacagcgcccgccccggcggccagagcgccgaggcggggcgcgctcaatgtccgccgagataggcgttgcgcacctcctggttgccgagcagttcttcgccgctgccgctcatgcggatttccccggtgaccatcacgtaggcgcggtcggagagcttcagcgcatggttggcgttctgctcgacgaggaagatggtcatgccgctcctggccagctcgcgcagggtctggaagatctgcttgaccacgatcggcgccaggcccagggagggctcgtcgagcaacagcagcttcggccggctcatcagcgcgcgggcgatggcgagcatctgctgctcgccgccggacatggtcatggcgcgctggttgcgccgctccttcaggcgcgggaacagctcgaacatgcgctgcatgtcctcctcggcgtggtccatgccgatgggaatggtacccatcagcaggttttcctcgacgctcatgtcggggaacacccggcgtccttccggcgactgcgcgatgccgttggacgccacgtagtgcgccgacttctggcggatgtcctggccgcgatagaggatctgcccggccgccgcgcgcggctggccgaagatcgacatcaacagcgtcgacttgcccgcgccattggcaccgatcaggctcaccgtctcgccctcgttgacctgcagcgagacctttttcagcgcctggatcggcccgtagaacacgtccacctcacggaattccagcaacgccgcgctcatgacagctccttttcgtcggcaccgagatag

SEQ ID NO: 15937 - DNA, 1080 bp, Pseudomonas aeruginosa
gccagcgaatgctctatcgcgagacttgccggcagtaataagcgtcgcccggcactccggcaagcgagctttcctccctacgtcattccgtttattcatataacgcgttccgcccgctccacccgcgccaggaaacccgccatgctgaacaaacgccgcctgccgtcgatgaccgccctgcaatgcttcgaagcggtagcccggcacctgagcttcacccgcgccgccgaagagttgagcctgacccagagcgccatgagcaagcaggtcgcgcaactcgaggagcaactgcagcacgccctgttccgccgggtgcgcaagcgcttgcaactgaccccggccggcgagctgtacctggccgaggtacgacgcatcctgcaacaggtagagctgtccacccgcttcctgctttcctacggcggcgagaccgaagtgctgcgagtggcgaccccgccgaccttcggcgcgcgctggctgatcccgcaactgaacggctggcgccaccgccacccgaacatccacctcgacctgcgccaggaactggaaccggacgacctgcgccagggccattgcgacctggcgttcttcttcggccccggcaccctgccgggcgccgagtgcatccgcctgttcggcgaacaactggtggcggtctgcgcgccatccctgttgccggccggcggactggacgaaccgacccaactggcggagctggtgctgctgcagaacgccagccgcgcggaggcctggcacgactggttcgccagcctggagcgaaattgccagggttgctaccacggtccacgcttcgacaccttctacatgtgcatccgcgccgcccaggccggttgcggggtagccctgctaccgcgcttcctggtcgaggaggaactcgccgaaggcaagctggcgatcgcctggccgcacgccctgcccagccaggaggcctactacctggcctatcccgagcatgccgcggaagtccccaaggtgcgccatttcatcgagtggatggtagagcgcctggagcaggagcaaccctcagcgggcccccgccagacgcgccacgacccggtttga

SEQ ID NO: 15938 - DNA, 783 bp, Pseudomonas aeruginosa
aggctgtggtcggcgctgcggccgttgaccagcacgccgggcaaggcccactggccggcgaaaggcgcctgggcgcggcggatcagcaacagctccagtccgtgcccggggttcaggcgcaacgccacgatatccacgctggccaatacttccgctgaactcatcgtcactcctctcttcagcccgcctggcgttcgccgccatagcagtgcagttcgtccttcacttccggcaggcaccaggcctccggtaccgccagcccttcacgcaggcgctggcggatcatcgagctgtgcagcggcagccgctcctccgccaccagccggccgaagcgccagcacaattcggcggcgcgttcgaagcgcggcagctccgcctcgttgtcggcgccgatcagcagggcgatccgcggtgacgccaggccgctacgcgcggccagcgcttccagcaggtcgatgctgtagaccgccggacaatcaggcatcaatcctgcttcgatcggttcgcaatacacccgccgcggatcgatccgccgggccagccgcgccagccagcggcagcgcagctcgaaatcgcccatgcgcttgccgaaggcgtggcggtggctcggcaccagggcgacccgttcggcgcaaagcagcgcccggcggatcaccgactcatggccggggtgcggcgggtcgaacgccccaccgtagaccgcgagggcgaagtcgggggcgcgtccgccgctcatcccggcaggcagtcggcgaatccggtaacttatttcatcacgcatag

SEQ ID NO: 15939 - DNA, 705 bp, Pseudomonas aeruginosa
attatgtgcccacattcagccccaacccgtcaagcggaggcttccatgaatcgtcccagcaagatcgccagcttcgatgtcgacgcccagaaaggcttcaccccgctgtgcccggacgaactgccggtgcccggcggcgacgccatcggcgccgccctcaaccaactggccagccgcgccgcgctgcgcctgggcagcaaggacgcgcacagcccgaaggctgcctgggtagtggaaagcgccgagcagatgctgcggccgctggcctatccggatgccgacctgacctgggtgagccactgcgtaccgggtacgccgggtttcgagctgctcgacgaactgccgcggccgatcgactacgacttcttcgtctggaagggcgtggagccggacctgcatccctacggcgcctgctaccacgatctggcggaacgccgcagcaccggggtcatcgaatacctgaggcagaatggcgtgagccatgtgctggtgggtggcctggcgctggactactgcgtgaagaacaccgccctgcaactgcgccgcgccggtttcgaggtgctgctctacctgcccgcctgccgggccatcgccgaggacaccgcgcagcgggcctgcgacgagatgcgcgacgccggggtgatcctctgcgccgacctggaacgactggatagcgccctcgccggcgccgacaaggagaagtga

SEQ ID NO: 15940 - DNA, 969 bp, Pseudomonas aeruginosa
cggcctgcaacggccatccggtggcgaagatatccgacgccccgggcaagacccaatgccgcgacgagaacttcgtcgcctacctccgccacgtcttcaacgtgccggcctaatcctttcgcacctaacgggagcccgaacatgcaacagatccaacgcgacatcgcccaagccctgcaggtccagccgccgttccagtcggaggccgacgtgcaggcgcagatcgcccggcgcatcgccttcatccagcagtgcctgaaggattccgggctgaagaccctggtgctggggatcagcggcggcgtcgactcgctcaccgccggcctgctggcccagcgcgccgtcgagcaactgcgcgagcagaccggcgaccaggcctaccgcttcatcgccgtgcgcctgccctaccaggtgcagcaggacgaggccgatgcccaggcctcgctggcgaccatccgcgccgacgaagagcagaccgtcaacatcggtccgtcggtgaaagccctggcggaacagctggaagccctggaaggactcgagccggcgaagagcgacttcgtcatcggcaatatcaaggcgcgcatccgcatggtcgcccagtacgccatcgccggcgcccgcggcggcctggtgatcggcaccgaccatgccgccgaggcggtcatggggttcttcaccaagttcggcgacggcgcctgcgacctggctccgctcagcggcctggccaagcatcaggtgcgcgccctcgcccgcgccctcggcgctccggagaacctggtggagaagatccccaccgccgacctcgaggacctgcgccccggccatccggacgaggcttcccacggcgtcacctatgccgagatcgacgccttcctgcacggccagccgctgcgcgaggaagctgcgcgggtgatcgtcgacacctaccacaagacccagcacaagcgcgaactgccgaaggcgccctga

SEQ ID NO: 15941 - DNA, 801 bp, Pseudomonas aeruginosa
ggaagtccagcgcttcgccgaggtcggtgcgtgccggatcgagcgcctgcatgtcgcgttgcagctccagcaaggccagccagttctccccggacaagcgcccgcgcacctgcgccgccgcccagtgcaggcgccgcaggttggcgcacaggctcgccggccagtgctcgtcgagcaacgcccgcaacaggcacctttccaacggctcgccatccccgggcagcaggccgatgccgccggccagggccagggcgctgcgcagcgcctcttcgtcgccatcggcatccacgtagcgcgacagcaccacccgcagcaggcgcgcgtggtcgtcgcaacgctcggcatagcggccgtaccagaacaggttttccaccacccgcgacggcaggtagggatcctcgcggaccaggtcgcgcacgccgagccggcgcggccgccacggctcgccgccgaccgcacgctcggccagtacccaggtgtccttgctcgcgccgccgcgttgcatcgacaccacctcggcatccgccgccgaggctacgcgggtcagaccgccgggcatcacccagtagcggccgtcggcggcggcgacggcgaacacgcgcatgccgatggcccgcgactgcaggccgacgccggcctcgccgtcgcgccagaccggcgcctgggacaactgcgccaggcgttgcgccacgtaggcctgcgggcgctcgcgcaagcgctcgccgagggacgccaggccggcaccgtcgagggcgtggccgaacagaggttcgcagcgctggccgggaaaggccggcttga

SEQ ID NO: 15942 - DNA, 510 bp, Pseudomonas aeruginosa
agaccgggatgccccggaagcgcaagacttgtgccagcgccgtcaggcccgggcggccaggaggtcgtgccgcggcaatgcactgcgacggtgcgcgaccgcaggcaaggttgcagccgcgcacgctttgcgggcggcagggccgccccggcgatcagcgcgggatgttcggctggcgcgacttcttcttgcccttggcgaaggccgtcgccttgttctgctgacccttgctccacggcttaccaccgtcgctggcgcgtggcggcaggccggtatgctgggtcagcagcttgccggccttcttgctgccggccggcgtcgagttcttccgccgagcgctctggtattcgccggtatccggctggtaggtcgggaccaggtggtgcttgccattgccgatcaggtcggcgcgccccatccgctccagcgcctcgcgcagcagcggccagcctttcgggtcgtggtagcgcaggaaggccttgtgcaggcgccgctgctggtcgctcttga

SEQ ID NO: 15943 - DNA, 648 bp, Pseudomonas aeruginosa
gcaggaagggcgccggaccgaaacactcggcccagtacttgggatagtcgaacagcggcttggcggcttgcatcacgggcaccagggggtatctctaggaatggggggtcgcgaaaacgcggggcgcggaatatagcacaaaaaatgagcaattccgacgttttcactgggtattgcctgtcgtcggccggcttcgaaaaaatgccatcatttagccatcttgtttctatactccattcatcgtcatctcacccggcctctaaggcaggcccccgggagagtcatcgtgcgccatcctcttgctctgctcgcggtcatcttcctgctactggccagcgccgtttcgcgcgccgcgccggagtttccggcgcctccggccagcggcgcctggttgaacggctcgctggacctgctcgaagaccccgatggcaacctggcggtggaggacctcgaacaagcggagcaggccggccgcttcgtcgccgccgccggccgcaccagcgtcggcctcagccgcagcgcctggtggctgcgcctcgacctgccgagacgcgaggcggtatccggcggctggtggctggaagtcgccagcgccagcctgcacgacctgcgcctgtacctccccgacgagcgcggcgggttccgtga

SEQ ID NO: 15944 - DNA, 690 bp, Pseudomonas aeruginosa
ccgcctggcgctgctggcgatctggggcatctgcgtgatccgcttcagccagaacctgctgcaaagccggcagcacgcacgctgggcccatcacctgctgaacgcctgttgcctgctgttccttgcctgcctggcgttcaacgccgccggctggcgctggcaggcggccggcgtgctggcgctgaccctgctggccaacctgccgatcgccatcggcctggcagtgcagcgctggcgccagggttcggccacggcgcgcctgtacctggtcggcttcggcctggtgctcggcagcgtcagccttggcgtgatgcgcgccaccgcgctggtccagccgacctcggccaacgccatggtcttcccgctggcgctgaccctggaggccctgctgttctccctggcgctcgcctcgcgcatccaggatctgaagcaggaaagggccctggccctggaccaggccgaccaggaaaagaacgcgcgcctggccctgctgcacagcgcccagcgcgacctggcacgcgccgtggaagtccgtaccaacgagttgagcgaggccaatcgccagttgcagatgcgcgaagcgcaactgcagtacgccgcccatcacgacccgctgaccgggcttggcaaccgcaggcacctgatggagttcgccgaaagcgccctggacgacgcgcgccgccacggtaa

SEQ ID NO: 15945 - DNA, 927 bp, Pseudomonas aeruginosa
ccttcaccgttcgtggaaccctggcgccgggccaggcgtccacgaaaatcaaacagactgtcgacaaccgccaaaagacagatcaggttccccagcagcaatacagccaggtacaggcccaccagccaaccacccgcgaggcgcttcagggcgatcaggccatgcccgagcgccacgccggcgatgatcagcggcacgctgcacaacggaccgagcaccgcggcctgcacttccagcgccgggaccacgacggcccccagtagcaggatcacggcaaccgccggcgccagccgcaaactccggaattcgcggccgaagccgcccgggttgtacagcgaagcctgccagtaccgcgcgagcatcaggcagagcaggcaggtcacctgcagcgaggaagccatgaccccggtcagggtcggcaccagcgccacctgcaacttgtccagctcttcgcccgacagctgggactccccgcgaagctgggtcaggaccttggtgacttccgtcgccagggcgccgatcagctcgctggaggtatgccccagcaccagcgcgaataccacgccaactgcaacactgcccagcagcacatggctccaggacgtgctggcgcgcagaatctgcgccagcgtcagggtaccgagcaggaccagaaggatgctcggatcgcccaggtaccaccagaacatcgccggtagcaccgcccaggccaggacgccgaaggcgtcgccgaatccgcgccgcagcagcaccaggctaccggcggcggcactcagccagaacaacagtggaacaaccgcggagcctgccacggcgagcgtggcctgcatgcggccgcgcatggtgaactcagccagtgcgcgcatgcgatctatcccttaccagcgttcgactgcccgatctcaacggccgtggctgtcggtgtaa

SEQ ID NO: 15946 - DNA, 495 bp, Pseudomonas aeruginosa
agggtcttgtccgcctcgccagcggtgccgaccacccacaggccgcgctgctggagcttttccagggtgcgcgcgaggttggtcaccgccaccagcgggatcacctcggcggcgccgcaagcgaccttgcgcacggtggcgttgagggtcgcggacttgtccttgggcacgatcaccgcctgcacccccgccgcatcggcggtacgcaggcaggcgccgaggttgtgcggatcggtgacgccatccagggccagcagcagcggcacgccctcgctccgctcgagcagttcctcgagcatgttttcgccccagacctggctggggctgacttccgcgaccacgccctggtggacgccttccgcccactcgtcgagttcgcgccgatcgcgctgccctaccggaatacggaacccggcggccagctcggtgagcacctggacccgcggatcatgccgcccctcggccagccacaactgcttgacccgcttcgggtga

SEQ ID NO: 15947 - DNA, 594 bp, Pseudomonas aeruginosa
ctcatgacttggccttacgtttgcgcgccccggtggcggccggagcgttgtcggccttcggcttggaaggccccttgcgatgcttggtcggcttgcccggcttggcggcagcggcgggcttgccgtccttggccttgcccttcgcgctcttgcccgcaggaacgaccttgcccttcttcccgcccttgtccttgccgccgacacgcgcctcggcgagcagcgcctgcttcacctcgcgactcttgcgcacgtcggtgttgccgagcatctccgcggcctgcgccagcagctccggcgcgaccggcggcagcgcctgcaccttgccggccttgcgccgcggcaccaccgcggcgtcgggactggccagcgccggctccaggtcgacctcgggcacggatgcgcccttgcgccccttcggcgccttgccggcgttcgccgacttgtcgccgttgcgcttcttgcgtccgatcggcgcgctcagcacgtttccggccagctcgaaatcgatcttccgctcgtccaggtcgacccgcgccactaccacttccgtggtgtcgccgagacggaagctgcgcccggtgcgttcgccgctga

SEQ ID NO: 15948 - DNA, 351 bp, Pseudomonas aeruginosa
ccttggtgtaggtcaggcgggcatgggagtggatcaccgcttcgtagaactggtagccggtcagcttgccagccttggacagggtcatctcgcagaccatggccagccggtcgaccagcggattcagcgagcagagaccattggacagcacctccggcagcatcgggatcacccgctcggggaaatacaccgagttgccgcgcctggccgcctcttcgtccagcgccgaaccgaccttcacgtagtgcgagacatcggcgatcgccacgaacaggcgccagccgccgccgcgcttggcctcggcgtacaccgcgtcgtcgaagtcgcgggcatcctcgccgtcgatggtga

SEQ ID NO: 15949 - DNA, 414 bp, Pseudomonas aeruginosa
gcttggccgcttccttctccaccgcggccggccagacgtgggggatatcgtagctgcgcagggcgacttcgatctccatccccggcgccatgtagtcaccgagcacctcgacgatctcgccctgggcctggcggtggatgctcggccattgctcgatgcgcacctggacgaactggttgtgcctggccttgccggccttgcccggcgggatcaggacttcctgctggatcttcgggttgtccgcgaccaccacgccgatgccgctttcctcgaagtagcggccgaccacgatctcgtgggcccgctcgatcacctcgaccagctggccttcgcggcgtccgcgccggtcatggccggacacccgggccagggcgcggtcgccgtcgaacaccaggcgcatctgggtgggactga

SEQ ID NO: 15950 - DNA, 1923 bp, Pseudomonas aeruginosa
aaacgggccgcatgcgcagcccgttccgtcatcgccccgctatccgcctcaggcgaatggatggcgcaggatgatggtctcgttgcggtccggaccggtggagatgatatcgatcggcgcacccaccagctcttccacgcgcttgatgtatgcgcgggcgttggccggcaactcttccagggtcttcgcacccacggtcgactcgctccagccgggcatttcctcgtagaccggctgcaggccgatgtatctgtcggcatcggtcggcgcttccagcacatcgccatcggcattcttgtagccgacgcacaggcgcaccacatccaggccatcgagcacgtcgagcttggtcaggcacaggccggagatgctgttgatctcgatggcgcggcgcaggatcacggcatcgaaccagccgcagcgacgagcgcgaccggtggtggcgccgaactcgtggccgcgcttggccaggtaggcgccgacgtcgtcgaacagctcggtcgggaacggaccggagccgacgcgagtggtataggccttggtgatacccagtacgtagtccaggtacagcgggccgaagccggaaccggtggcggtaccgccagcggtggtgttggaactggtcacgtaggggtaggtgccatggtcgatgtccagcagcgatccctgggcgccttcgaacatgatgtccttgccgtgcttgcgcaggtcgtgcagggtcgcagcgacatcggccatcatcggcttgagcagctcggcatactccatcgcctcgtccagggtcttctggaagtcgatggccggctccttgtagtagtgctgcaggacgaagttatggtagtccagcagctcgcccagcttggcggcgaagcgctcgcggtggaacaggtcgccgacgcgcaggccgcgacgtgccaccttgtcctcgtatgccgggccgatgccacgaccggtggtgccgatcttggcttcgccgcgggccttctcgcgcgcctggtcgagggcgacgtgataggacaggatcagcggacaggaaggactgatgcgcaggcgctcgcgcaccggcacgcccttctcttccagcttggtgatttcgcgcagcagcgcatccggcgccagcaccacgccattgccgatcaggcactgcacgccttcgcgcaggatgcccgatggaatcaggtgcaggacggttttctcgccatcgatcaccagggtgtggccagcgttgtgaccaccctggtagcgaactacggcagccgcctgctcggtgagcaggtcgacgatcttgcccttgccctcatcaccccattgggtgcccaggactacgacattcttacccataacacttgtccccatcgtggaagttcgatgccggccgcggccggcggaatctcaggacgccagcggcgccacctgccaattgccatcgcgcagcgccagctgccggtcgcagcccgcctcgcgcgcagaagccgcatcctgcccgggcagagcctggacgacacgctgcccgtcgcggcgcagtcgttgcaccgcctgccagagcccggccccttcggccggcgcccagatacccgatacagcctggtccaaccgggcctggccgagagtgaccaggcttttcagatcggtggagaaaccggtggccgggcgggcgcgcccgaaatcggcaccgatatcatcatagcgaccgccctgggcgatggactggccaacgccgggcacgaaggccgcaaacaccacgccggtgtgatagtgatagccacgcagctcgccgaggtcgaaatacagcggcaagccggggaagcgcccggccagcgaatcggcgatctcgatcagctcgttcagcgccacctggacatcggccggcgccgccgccagacgggcacggccctgctccagcgcatcgcggccgccacatag

SEQ ID NO: 15951 - DNA, 1074 bp, Pseudomonas aeruginosa
cacgatttctccggcgggcgctgccgcccgccggagaaccgagtattacttgttggccttgttcagatagcggaagaactcgctgctcggatcgagcaccagtacgtcgcgcttctcggcgaagctttcgcgatacgccttcaggctacggtagaaggaatagaactccggatcctggttgtaggccttggcgtagatcgcggcagccttggagtcgccgtcaccgcgggtctcttccgactcgcggtaggcttcggcaacgattacccggcgctggcgatcggcgtcggcacgaatgccttcggccagttcgcgacccttggcgcggtgctcgcgggcctcgcgctcacgctcggtgctcatccgctcgaagacgctgcggttgacttccttcggcaggtcgatggccttgacccgcacgtcgatcacctcgatacccagctccttctgcgccatgcggttcagcgaagcggtgatgtcgcccatcagcgcgtcgcgctcgcccgataccacttcatgcagggtacgcttgccgaactggtcgcgcagacccgcttcgagacgccgcgacaggcgttcgtcggcgatctgcttgaggcccgaggtagcggtgtagaagcgctcggcatccgccacccgccacttggcataggcatccaccatcaccgctttcttttccagggtcaggaagcgctgggtcggggcatccagggtcagcaggcgagcgtcgaacttgcgcacctggttgacgtacgggatcttgaagtgcaggcccggcttgacgtcggactcgaccacccggccgaagcgcaacatgaccgcgcgctcggtctgctggactacgtagacgctgttccacaggacgatggcggcgacgacaccgacgatcagagcgatcaaagacttgttgcccatcagcggctctccctcgtacgcgcgtcttgctggcgcagatcgttgacgatccgcgaccccaggtcggaagcgctggcgctgccaccaccggcggaagcaccggcccccgtagcgggcgcggcgttacgaccatcgatcatcttgtccagcggcaggtag

SEQ ID NO: 15952 - DNA, 1209 bp, Pseudomonas aeruginosa
caggtcaaccttgttatagacctcgagcatcggcaattcgttggcgccgatctcgccgagcaccgccagcacctgctcgacctgcgcatcccgttcgggctcgtaggcgtcgatcacgtgcagcaggaggtcggcgttgctcgactcttccagcgtagcgcggaaggcctccaccagcttgtgcggcaggtggcggatgaagcccaccgtgtcggccagcaccaccggcccgagatcgtccagttgcaggcgacgcagggtggggtcgagggtggcgaacaactggttggcggcatacacctcggaggcggtgagcgaattgaacagggtcgatttgccggcgttggtatagccgaccagggagaccgccgggatatccgcgcgcttgcgcccgcgtcgagcctgctcgcgctggctgcggaccttctccaggcgctgcttgatctggcggatgcgcacgcgcagcaggcgtcggtcggtttccagctgggtctcgcccggaccgcgcagaccgataccgcctttctgccgttcgaggtgggtccagccgcgtaccagccgcgtgctcatgtgctccagttgcgccagttccacctgcaacttgccttcgtgggtacgtgcgcgctgggcgaagatgtcgaggatcagcccggtccggtcgagtacgcggcactcgaacgcacgctcgaggttgcgctcctggctgggcgtcaaggtgtggttgaaaatcaccagctcgacgttttcggccttgaccaggtcgtgcaactcctcgaccttgccactgccgataagatatttggcgctcggctggtggcgggagacgctgacgaatgccaccgtttccgcgccggccgaacgcaccagctcctggaactcctgcgggtcttcacgcgcctcggggttctgcccttccagatgcaccagaacagcctgttccccaccacctgggcgctcaaagaacaaagcggactcccgtcaagcgttgcccggctcggccggctggtcaccgctcggcagacgcaccggacggctcggtaccacggtggagatcgcgtgcttgtaaaccatctggctgacggtgttcttcagcaggatgacaaactggtcgaaggactcgatctggccttgcagcttgatgccgttgaccagatagatggaaaccgggacgcgttctttccgcagggtattgaggtaagggtcttgtag

SEQ ID NO: 15953 - DNA, 438 bp, Pseudomonas aeruginosa
gctgcgccagggcgtaacccagcggcgggatgtcctgggcgctctcgggcaacgcggctggcgcctcgcccgcgggtaacggcgcgaagtaggccttgtaggcgccaccggcctcggccagagagggcggcgcctccggccgggtataggcggaatagccggaggagccgccggaggccgatgagccgccactccagcccacccgtgccgccggactctccagcacgctctcggccaggcgcatctcgccctgcgggccgaactcgccggcggcagcgccggtcggacgcggctcggtcaggctggtcgccccgggcggcgcgagctggtcgtcgggacggacctcgcccagcgcacgatgcagggtgccatagaggaagtcatggaccatccggctgtcacggaagcgaacttcgtgcttggtcgggtgcacgttga

SEQ ID NO: 15954 - DNA, 2091 bp, Pseudomonas aeruginosa
tgccgccctgctcgacctccacatcaatgcgccgggaaccggcgtcaaggctgttttccaggagttccttggccaccgaggcgggacgctcgaccacctcaccggcggcgatctggttcgccagccgcggactcagcagctggatacgcggtgcttcactcatcactgggccgccagggcggtgctcgggatggacagggcctggccgactttcaggttgtcgctggacaggctgttgctgctacgcagcgcggccatgctcacttcatagcgctgggcgatcatcgccagggtctctccgggccgcaccacgtgctcgcgcggccccatggagagcttgccctgggcgcgcaaagaggcgatgtaggtaccgggcggcgggctctgctggaaatactggcggatgccgctggtgatcgaacgcgccaaggcctgctgatggctggcgctggccagcttgcgcgactcgttgacgttcgagatgaagccggtttccaccaggatcgacgggatgtcgggcgacttcagcaccatgaacccggcctgctcgacacgacgcttgtgcagcgaagtgatgcggccgacattggtcagtaccttgtggccgacatccaggctcgacgagagggtggcggtcatcgacaggtcgagcagcacgccggcgagcatctggtccttgtcgccgaggctgacgctgccatcgccgccgatcaggtcggaacggttctcgctgtcggccagccagcgcgcggtttccgaagtggcgccgcggtcggacagggcgaacaccgaggcaccgaaggcgctgcggctcggcgcggcgtcggcatggatcgagacgaacaggtcggcgcccttcttgcgggcgatctcggtgcgcttgcgcagcgggatgaaatagtcgccggtacgggtcagctcggcccggtaaccgcgcacctggttgatctggcgttgcagctcgcgagcgatcgacagggtgatgttcttctcgtgcaacccgcccgggccaagggcgccagggtcttcaccgccgtggccggcgtcgatggcgatgacgatatcgcgggtgccgcccttggttggcagcggcagcttggccaccggctgggtcggcgtcaccggggtgaccggcacgctcggggtcggcgtcgcgggtacgtccggggtcaggtcggcgccctggtcgtagagatcgaccaccaagcggttgccgtattgctggttgggcggcaggacgaagcttttcggggtgacctgcgccgacaggtcgaggaccatgcgcaggtcgttgggcgtgcgctgggcggagcgcaccgcggtgatcggggtgttgccgagcttgagaccgttgagctgggtcgccagctgggcgccgctgacgtcgatgacgatacggttgggcgcggccagggtgaacaggctgtgctgcaccggaccggagagatcgaagaccagacgggtgttgtccggagcgcgccagatccgcacgctcttgatttgcgcggcggccagaacctcgccgacctggcaggccagcagaatcatcaccccagtcaacaacgtccgcagacgcaagccccaacccatcgtttttctcatgctcccatggtcagggtggcacaccaggcttcgcccccgcgcaccgtgcggtaccaggcgcagtgtccgtccacccgcttgggcagtaatggtaatgtccagatcggcggttggcaaaacgcccgcaccgcgctcgggccactcgatcagacagagtgcgctgccgtcgaaatagtcgcggatgccgaagaactccaattcctccgcatcggcgagccggtacaggtcgaaatggtaggcgcgcagctcgccgatttcgtaaggctcgaccagggtaaaggtcgggcttttcaccgagccggcatggccgaggccgcgcaggatgccgcgcgagagggtggtcttgccggcgccgaggtcgccatgcaggtagatcaccccctgccccccgctggcccgggcgatgcgcccgcccagttcgagcatcgcgtcttccccttcggcggacaggatcacttcagacacggactgcactcctcgagcaactga

SEQ ID NO: 15955 - DNA, 999 bp, Pseudomonas aeruginosa
cgacacgccagttccagcgccgccgccgggcgatccgcctgcacctcggcggtcgagcgacccaacaggcgcgcggcctcgccgggatgcggcgtcagaatccatgtccgcggccctgctccgaccggttccagggccagcaggttcaacgcgtcggcatcccagacctgcggcaacggtcgcgaccggacagcgctcagcagggctacgcccccagggcgcgctggccaagaccgggaccgagcaacagcacgctggcgcgttcggcaagggcccagcagttggttcgccgacgccacgccatgggccatgacctcgggacaacggctcaacaacgcccggcacatgttcgaccgcgggtcgccgccgagaccagcccgggcgccgcagcgcaggggcgctttccggcggccagtagcacggccccgcccatgccggtgtcgccgccgaccaccagcaggtggccgaacagccccttgtgtgcggtccgcggccgcgctgccagcctcggcaggggcatttcgcgccaggcggcgagcccggggctggagcgcttgcagcacgacggcgtcgctaccgagttcgtcgaacaccagctcgccgacccgtgccggcgcatcgccagtgaacagcccgatcttcaggccgatgaaagtcacggtcagatccgccctgatcgcttcccccaataccgcgccggtgtcggcgctcaagccggaaggaatatccaccgccagcaccggcaggtcggcggcgttggccaggcggatggcctgcgcaaagggctcgcgcacggcacctgccaggccggtgccgagcaatgcatccactactacgccctcgagcacggcgcactcgctccagggctccaccacgaccccggtcgccagcgcggcggcatgcgcctgcgccgcgtcgccggcaagccgctgcggcgccgcgaccgccagcacccgcactcgccaacccgcacgttgcgccagcgccgcgatcaggtag

SEQ ID NO: 15956 - DNA, 333 bp, Pseudomonas aeruginosa
tccgcaagcgtctgcaacaactggccgagcgcatccaggccgaagtcggcccgttcggtttccgcgccttcgtcgacagcgcgccggtgctggaaaaggccatcgccgaacaggccggcctcggctggatcggcaagaacacgctggtgctcaaccgcaaggccggcagctacttcttcctcggcgagctgttcgtcgacatgccgctacccgtcgacccggcgatggacagcgagcattgcggacgctgctcggcctgcctggacatctgcccgaccgcggccttcgtcggcccctaccggctggacgcgcgacgctgcatctcctacctga

SEQ ID NO: 15957 - DNA, 909 bp, Pseudomonas aeruginosa
cgcttgacgcgcttgacgatgatcggctggttattgtccatctatcgacagtgcctccactcagcggccgcgcacggcctgctcgagctcggcgaaggtcggccgatgggcgggcagcagcaccttgcggccgaactcgacggccagcgaaggcggcatgccggaagcggaagcgaccaggcaggccttgatcgcctcgaacaggttcaactcttccttggcatcgtgctccagggcgcccgccagcgggccgacgaagccgtaggcggcgagaatcccgaggaaggtgcccaccagggcggcggcgacgtggtggccgatctccgcctggctgccttcgccaagcaacgccatggtgatgacgatgccgagtaccgcggcgacgataccgaagcccggcagggcgtcggcgaccttggtcaccgcgtgggacggatgctccaggtcctccttgagactggacagctccatgtcgaacaggccttccagctcgtgcggcgccatgttgccggaggacatgatgcgcaggtagtcgcagacataggcggtcatccgctcatccttcagcacaccggggtacttgctgaagatggggctggccgcggggtcttcgatgtccgcctcgatcgccatcatcccttcgcgccggctcttgttgaggatctcgtagagcatgcccagcacctcgaggtagtaggtctgggtgaagcggttgctgaacatcttcggcgctttcttcagcaccaccatgaacgtgctgcccgggttggactggaggaacgcccccagtgccgcgccaccgatgatcaggacctcgaagggctggatgatggcgccgatcttgccgccggagagcaggaagcccccgaggacactggcgaaaacgacgatgatgccgatgatttttga

SEQ ID NO: 15958 - DNA, 1206 bp, Pseudomonas aeruginosa
tgctggtcctggccgacctcggcggccagccgttcagcgacctgcatgcccaggccttcgccaagaccgcccagtgcaccgagcgcgcgatccagcagttcggccgccagcgccgcacggaatgagggacatgcccggcacactggtcgggcgcgctttccgttaaactgctgcccttcttcaacccgggggtactcgcatgtccgtcttctccgacctgccattggtgatcgagcccagcgacctcgcgccgcgcctgggcgcgcccgagctgatcctggtcgacctgaccagtgccgcccgctacgccgaagggcatatccccggcgcgcgtttcgtcgaccccaaacgcacccagtggggacaacccccggcacccggcctgctaccggcgaaggccgacctggaagccctgttcggcgagctgggccaccgcccggaggcgacctacgtggtctacgacgacgaaggcggcggctgggcgggccgcttcatctggctgctggacgtgatcggccaccaccactaccactatctcaacggcggcctgccggcctggatcgccgacgcccaggcgctcgaccgcgaggtcccggcgcctgtcggcggcccgcagccgctgacgttgcacgacgagcccagtgcgacccgcgaatacctgcaaagccgcctcggcgccgccgacctggcggtatgggatgcgcgcaaccccagcgaatacgccggtaccaaggtgctcgccgcgaaggccgggcatgtgcccggcgcgatcaatttcgaatggaccgccggcatggacccggctcgcgccctgcgcatccgcgcggatatcgccgaagtcctggaggacctcggcatcacgccggacaaggaagtgatcacccactgccagacccaccatcgctccggcttcacctacctggtggccaaggcgctgggctacccgcgggtcaaaggctacgccggctcctggtcggaatggggcaaccaccccgatacccctgtagaggtttgaggaatgtcgttcaaagatcgtctgttcatctgcagccagtacctgctgccgcaccacctgctgtcccggctgatcggcttcgccgccgactgccgggcgacctggttcaaggaccgcctgatcgcctggttcgcccggcgctaccaggtcgatatgcgcgaagcgcaggtcgaggacctgcaggcctatga

SEQ ID NO: 15959 - DNA, 978 bp, Pseudomonas aeruginosa
cggagccgtctatccccccatggaaaaccagagcccccacctctcgttgcgcgtccccactccgacgcagcagaacctgagcttctgcgacgccaccccgaaggacatcaagtactggctggcgcacctgcccaaggccaacctcggggagaccgcgcgccagctctaccagggcctgatcgaactcaaccagttggtgctgcccgtcgaggcccgcctgcaactgctcgaactgttccgtccagaggtgcatttcgtctgcgcccacctggaacggcacttcctcaaccaggccatcgtcctcgacgaacggccgcgcaagatcgccaacctctgccaggccctgcagaaccacctggccatcggctacaagctgatcgtggtccaggaagcgccgcgcaacagccgcgaccgcgcgcagctgctcgcggtcggcatccagcgggcgatccgcagcctgtgcgggccgctgatccgcgccagccagttgtactgcccggtccccgaggggctttggctggaactccaccagctctaccagttggccagccagcgcggcgtgcatcgtctcgcggtgcgcgacgaactggccaagcacacccccggcctgagcgtcgagcaggcctacctgattccgctgctgctcggctgcgcgcgctgcaaccagatgcgccagaacaacattgcacggctcgccgaggtgctcgaaccctggagccagctgctgtcgatacagagcgcgacgctgcccggctcactgttcatcgccgtgccgcagatcgacggcccgccgcgctaccgttcgctgtacccggagacccaactggccaatgccctgggcatcgacacccagccgctggtcgagctgatccgcgaatacctgctgcagcccgaggccgaacgcgcgaaagcacgcctgccgctgatcgaaggggtgaccctggacctgctgcaacatctctcctcggcctggggtga

SEQ ID NO: 15960 - DNA, 1734 bp, Pseudomonas aeruginosa
ctgcgccccggtggagtcgatgcacaccgcatactggttcgagcgtcccggcgcggcggcatgaaagcggtcgccggctttgtaggaaaggccggcggcgtcgatgtcgtggcccttggcgcaacgcacccagcctttgtccgagagcaccacggtcaccggttcggtgggcatcagctcggtttccgacagcgcgcgggcctcggcgcgggcgacgatcggcgaacggcggtcgtcgccgtaggtctcggcgtccttgatcagctcctcgcgcaccagcttcttcagcttggcctcgctgccgagcagggtctgcaggcgcttctgctccttcagcaactcttcctgctcgccgcggatcttcatctcttccaggcgcgccaactggcgcaggcgggtgtcgaggatatagtcggcctgcacctcgctgagttcgaagcgctccatcagcaccgccttgggctggtcctcggtgcggatgatgtggatcacctcgtcgaggttgaggaaggcgatcagcaagccatccagcagatgcaggcggcgctcgaccttgtccaggcggaactgcaggcgtcgacgcacggtgccgatgcggaactgcagccactccgagagcaactggcgcaggtccttgacctgcggcttgccgtcgaggccgatgatgttcaggttgacccggtagctggtttccaggtcggtggtggcgaacagatgggtcatcagctcttcgacatcgacccggttcgaacgcgggatgatgacgatgcgggtcgggttctcgtggtccgactcgtcgcgcaggtcggccaccatcggcagcttcttggcctgcatctgcccggcgatctgttccagcaccttggaaccggacacctggtgcggcagggcgtggatgacgatgtcgccgtcctcgacgcggtacaccgcgcgcatgcgcaccgaaccgcggccggtctcgtagaccttctgcaggtcggcgcgcggggtgatgatctcggcttcggtggggaagtccgggcccggcacgtgttcgcacaattcggcgaccgtcgcgcccggctggtcgagcaggcgcacgcaggccgacgcgacttcccgcaggttgtgcggcggcacgtcggtggccatgcccaccgcgatgccggtggtgccgttgagcagcaggttgggcaggcgggccggcagcacggccggctcgtccagggtgccgtcgaagttaggtacccagtccacggtaccctggcccagttcgctgagcagcacctcggaatagcgcgacaggcgcgcctcggtataacgcatggcggcgaaggacttgggatcgtccggcgccccccagttgccctggccgtccaccagcggatagcgataggagaacggctgcgccatcagcaccatggcctcgtagcaggccgagtcgccgtgcgggtggaacttgccgagcacgtcgccgacggtgcgcgccgacttcttgtgcttggaatcggcatccagccccagttcgctcatggcgtagacgatgcgtcgctgcaccggtttcaggccgtcgccgatatgcggcagggcgcggtccatgatcacgtacatggaatagttcagataggcctgctcggtgaactcggccaacgaccggcgttcgaccccttccaggctcagatcgagggattcgctcatgcgtacctcacggagaagtgttttggcgcagcaccagggtgccgtcgcgctgggtga

SEQ ID NO: 15961 - DNA, 1332 bp, Pseudomonas aeruginosa
tccgtcccagccgctgaccgggcgcccgttgcgtcacttgtcccccaaccagccgccggcgggcgcggcgaagcgcaggacgaagggccgcacgtcgccatcggcgcgcgcatggtcgccattgtcgatgcccagccaggcgcccttgtcgtccagcgacagggcttccgcgacgccataaggcagctcgtagcgacgctccggcgccaggaccgccgaggcgaacgaccagcagcgctcgaccttggcctgggccaggtcgcggcgacagatctgatgcgccaggcgctccagggtgaacagcttgccgcggtagaaggcgaggtcggagaaatccttcggcagcttgcgcgcgctgcccagttccggcggcggctcgatcttgccgccctcggcgagcagtacgcagctgccctcgcagcgccaggcactgttgtcgcggtgggccaccagcaggccgcggcgctcgcgctcggcagccagccagaggcgcttgccctcggggtcgacggcgatcccttcgaacagcgcgttgaaattcatcagcatgccgctggcccgcgcttgcgacagcaggccgggcggcaggcgcagccagttcggcgcgccgctcaccggcagttgcaggaccgccgcgtgcgcctcgctgaccaggtagcgattgccggcggcatcgcaggcgatgccttcgaagtcgaggttgccgccgcgcaccaggccactgagccagacccgcgtgctcatgccccagggcaacccgctgtccggcggggtcggagcgatgaaactctcggcctcggcctgccagggctggtcggagccttcggccgagggttgcaggcgatacaggcggtcatcgtcgcggtcggaaaccgtccacagcgcgccgccacaccaggccagcccggagaggttgccgccgcgcatgccctccaccgcatgttcggagatgaagctcaaggctgccggaaccggtggctctggcggcgcctcggccgcctggaccaggcccccgaacaggccgaggatggccagcaggcggcgcatcagaccagcacctcggccaggttgcccttgctttccagccaggacttgcggtcaccggcgcgcttcttggccagcagcatgtccatgatctccagggtaccggtggcgtcctccagggtgagctggaccagccgccgggtattcggatccatggtggtctcgcgcagttgcaacggattcatttcgccaaggcccttgaagcgggtgacctgcggcttgccgcgcttcttctctgcggccaggcgctcgaggatgccgtcgcgctcggcttcgtcgagggcgtag

SEQ ID NO: 15962 - DNA, 645 bp, Pseudomonas aeruginosa
cgcagctgggccaggtcactggcacccggatcgacgccgatggccaccgcgatgtcgtggacctcctggctggcgagcacctcgccgccgtccacttcccaggtgttcaggatctttccgcgcagcggcatgatcgcctggaattccttgtcccgcgcctgcttcgccgagccgccggcggagtcgccctcgaccaggaacagttccgcgcgcatcggttcctgtccggcgcagtcggccagtttgccgggcagcgccggcccctgggtgatcttcttgcgctcgaccttcttgcccgccttgaggcgacgcccggcgttgctgatcgccagttccgccagttgcaggccgatttcggcgtgctcgttgagccacaggctgaaggcgtccttcaccacgcccgagacgaacgccgccgcctcgcgggacgacaggcgctccttggtctgcccggagaactgcggttcctgcatcttcatcgagaggacgaaggcgatccgttcccagacgtcctcgggcgccagcttgacgccgcgcggcaacaggttgcggaactcgcagaattcgcgcatggcgtcgagcaggccctggcgcaggccgttcacatgggtgccgccctgggccgtgggaatcaggttgacgtag

SEQ ID NO: 15963 - DNA, 726 bp, Pseudomonas aeruginosa
agtcgctgctgccgggggcgaactgcacgcaggtggacggcgaggccagcaggcgcagcgggccgcgctggcggtcgaactcctggtgaatgtgcccccacagcaggcaacgcacctgcggatagggtgccagcaggtcgaacagcgcctgcgggttgcgcaggccgatggggtccatccagtcgctgccgatcggcaccgggtggtgatggaaggaaaccagcaggaagcgttcgccggcgctgtcgatggcacgccgcagcaggtcgagctggtcgtcctcgagatagcccggcaccgcgccgggaatgctcgagtcgagcaacaccacgcgccagttgccgacgtcgacgacctgctccagcaggtcgctgccctcggtcgcccgctgcatcggctcgcgttcgtcgtggttaccggcgaaccagcgcaacggcgcggccagcggcgcgctcaacctgcggaagcgtgtgtaggaatccaggctgccgtcctgggagacgtcgccggtggcgaggatcaggtcgatccgcggttgctcccgggcgacccgctcgaccaccttttccaggctatgggcggtgtccatgccgagcaggcgcgcgccgtcctcggcgaacaggtggctgtccgaaagctgcaccagcagtacggaggcgtcggtggcgggagtgttcgaatggcgtgacaaggggccgtctcctgaaggcgaggcgtccgcggtga

SEQ ID NO: 15964 - DNA, 2190 bp, Pseudomonas aeruginosa
acggcatcgtcaagccgaacctgttccccggccgcggctgacgcttccgacaccccgaagcccctcgccgcggcgaggggcccggtggcgcggcgcggcctacacctgcctgtagatcaccgatccttcgtccttgaagcgcgccgcctgctcctggaagccggcctcgatggccttgctctcgtcggacaggccgttttccttggcgtagtcgcgaacctcctgggtgatcttcatcgagcagaacttcggtccgcacatggagcagaagtgcgcgaccttggccgagtccttcggcagggtctcgtcatggaacgcccgcgcggtgtccgggtccaggccgaggttgaactgatcctcccaacggaactcgaagcgcgccttggacagcgcgttgtcgcggatctgcgcgcccgggtggcccttggcgaggtcggcggcatgggcggcgatcttgtaggtgatgatcccggtcttcacgtcatccttgttcggcagacccaggtgctccttgggcgtgacgtagcagagcatggcgcagccgaaccagccgatcatcgccgcgccgatgccggaggtgatgtggtcgtagccgggggcgatgtcggtggtcagcgggccgagggtatagaacggcgcctcgtcgcagcactccagctgcttgtccatgttttccttgatcaattgcatcggcacgtggccggggccttcgatcatcacctgcacgtcgtgcttccaggcgatcttggtcagctcgccgagggtttccagctcgccgaactgggcggcgtcgttggcgtcggccaccgagcccggacgcaggccatcgcccagcgagaagctgacgtcataggccttcatgatttcgcagatctcttcgaaatgcgtgtagaggaagttctcctggtggtgcgccaggcaccacttggccatgatcgagccgccgcgggaaacgatgccggtgacccgcttggcggtcagcggcacatagcgcagcagcacgccggcgtggatggtgaagtagtcgacgccctgctcggcctgttcgatcagggtgtcgcggaagatttcccaggtcaggtcctcggcgacgccgttgaccttctccagcgcctggtagatcggtacggtgccgatcggtaccgggctgttgcgcaggatccactcgcgggtttcatggatgtgcttgccggtggacaggtccatcaccgtgtcggcgccccagcggataccccaggtgagcttctccacttcttcctcgatcgaggagcccagcgcgctgttgccgatgttgccgttgatcttcaccaggaagttgcggccgatgatcatcggctcaagctcggtgtggttgatgttcgccggaatgatcgcgcggccgcgggcgacttcctcgcggacgaactcgggggtgatttccttcgggatgttggcaccgaagctgtgccccgggtgctgctggtcgagcaggccggcggcccgggcttcctgcagcttcatgttctcgcggatggcaatgtattccatctccggggtgatgatgcctttcttcgcgtagtgcatctgcgagacgttggcgcccggcttggcccggcgcggcgtgcgcacgtgggcgaagcgcagggcgtcgaggctggcgtcggccaggcgggcctggccgaactcggaggtcaggccggggaggatctcggtgtcgccgcgctcgtcgatccagcgcgaacgcacgtcaggcaggcccttgcgcaggtcgatgcggacctcagggtcggtatacgggccggaggtgtcgtagacgaacaccggcgggtttttttcgccgccgaaggcggtgggggtgtcggcgagggagatttcccgcaccgggacgcggatgtccgggcgcgagccggtcaggtagaccttgcgcgagttcgggaaaggctgcgtcgactggcggtcgagctgctcaaggcgggtgatgttgttcttctgcgttgcgctcatcgatggctctcctgggtgattgtcgggagaacctggcacgcggggccaccgggactggtggcgagaaggacgcgccggcaaggcaggcatggcgcggacatcttgttccctacgcgggttgctgcggtccgcgcgaggcggaaccggacgctagcccgatcaggttcaacgggatccggaactatccgatctcagcccctcgtatag

SEQ ID NO: 15965 - DNA, 312 bp, Pseudomonas aeruginosa
tcagcgtctacaaggaagccgtcgacaacaacgccgacctcgccgccgcccaggccgactacctggcgcgcaaggaagtggtgccccaggcccgcgccggcctgctgccgcaactcggcgccggcgcccgcgtcggagacacccggatcgcattcgacgagcgtccggcgaccgtcaagcgcaacagccaggtcgtccaggccaccctcagccagccgttgttccgcgccgaccgctggttccagtggcaggccgccaaggaaaccagcgaccaggcccggctggaattctccgcgacccagcaggacctga

SEQ ID NO: 15966 - DNA, 477 bp, Pseudomonas aeruginosa
aagtcgttgaacttgcgcgggtcgatatcgacgcggatcagttcgcccgacagcggcaggcgttcgcgccagaagtcggtgtcggccatctcggtgcccaccgccagcaccaggtcggcctcggcgatcatctcccagcccggcgctacgcacaggctggccccggcgttgagcggcgcgtccggcggctgcaggcccttgccggcgacgctggtgaacagcggcgcggccaggcgctcgctcagcgcggcaagcgcatcgccggccgccagcgcgccgccgccggcgatgagcattggtcgccgggccgcagccaggcgctccgccgccgcccgcaatgcctcggtgcacggcacgccacgaccagggcggcgcgccacggcagcgctccagtcatgggccaccggcgcggcgagcacgtcgagcgggatcgagatatgcaccgggcgcggacgctcgctgtcgaacaccgcgtag

SEQ ID NO: 15967 - DNA, 618 bp, Pseudomonas aeruginosa
gcgcgagggccgcgccgatctccgacaccccggtcttcagggcgatcaccggcacgcctttctgcaacgccttgtaggctgcgcgggcgaaccccgggacgttcttcagcccttccagatgcaggccgatggcagtcacccgcggctcgtcgagcagcacgtccatcagctcggcgatgcccagctgcgcctggttgcccaccgatgccatataggccaccggcagcgaacggtcgctcatcgacaggttgtaggcgaagttgccactctgcgtcagcaccgcgacgccccgctccacctgccgaccgccatgtgccaccggccatagcgcggcgccgtgcaggtagtcgagcaagccgtagcagttcgggccgagcagcgccatttcgccggcggcggccagcagccggcgttgcacggccaggccctgttcgccggtttcggcgaagccggaggcatagcagatcgccccgccggcgcctttggcggcgagcgcggcgaccgcgtcgagggtcagttcgcggttggtggcgacgaacgccgcgtccgggccgcacggcaggtcggcgacgctggccacgcagggtacgccttcgagttcggcgtgctgcggattga

SEQ ID NO: 15968 - DNA, 1185 bp, Pseudomonas aeruginosa
cggccctgcggcaggcgcaaagccacacgccatgcgatccgccgaaaagcggcgaaggcccgcgcgagccggctgttacaacttcgaacaaaccaaccaggcgaaaacgaaaacgcccgccggatgcggcgggcgtcgggtcctgcgaatggccgttcagccggcccgtcccagggcggggtcgcccagtccctgcggctgccggcgacgaaccacgtaataggccaggtagcaggcggcgatgaagccgaagccccagtacaaggacggccgctgggtgggatcgagggcgaggaagacgaacagcgagcagcacacggcgatgcaggccagcggcaccagcgggaacagcggcgcggcatatttcagtccggcgaccgtgccgccgctggccatgtgctcgcggcggaagcggtattgggcgtaggcgatgacgatccaggtgacggtgccggacatcccgctcaccgccatcagcaccatgaacagggtgtcggcggcgaccacgctggtcagcaacgagagcagggcgaagcacagggtgatcagcaacgcgtagagcggtacgccgcgcgcgctgagcttcgacaggccgcgcggggccatgccggtcctggacatcgcccagaggatccgcgtcgaggcgtacaggcccgagttgcctaccgagaggatggcggtgaggatgacgaagttcatcaggtccgccgcgtagggaatcccgaccatgtcgaacacctgcacgaacgggctttccatcagcccggcctgttgccagggaatgatggcggaaagcacgacgatggccagcacgtagaagatcagtacgcggaacaccacgttgcgcaccgcccgcgggatgctcttctccggtcgctcggtctcgccggcggcgacgcccatgatctcgcaaccctggaaggcatagaccaccgtcatcatcaccgcgaacaccgccgacaggccgttggggaacagccgctcgccgaccaggttggagaacatcggcgccggcgcaccgctcttcagttcgataccgccgaagatcaccagccccccgaccacgatgaacaccaggatcgccgccaccttgatcccggcgaaccagtactcggcctcgccgaaggcgcgggtcgccagggcattgagagagaacagcacgaccacgaagaaacccgaccatag

SEQ ID NO: 15969 - DNA, 480 bp, Pseudomonas aeruginosa
ccacacgggcacctccgggaaccagcgggtcatgagcatcccggccgcggtgaattccaggcctaccgtggaggcccagctcatccagtagacccagccgatcatgaagccagtcgccgggccgatgaaacgcgtcgcgtgggcctggaacgaaccggagaccggcatctgcaccgacagctcgccgaggcagaccatcaccaggtacatcagcaccccggccaccaggtaggccagcaccgcgccggccgggccgccctggttgatggtcacgccggagcccatgaacaggccggtgccgatcaccccgccgagggacagcatgaagatgtggcggctcgccagggcccgggtgagttgcagcctttccttgccgtcagccatggcgcacctccggatgagggtacgcacaggggtcttcgagatggctcattattcttgtctccactctgtcagaggccgtgtcttgcgcacggatga

SEQ ID NO: 15970 - DNA, 2274 bp, Pseudomonas aeruginosa
gtcggcttcgccgaggaagccggcgcggcgcagggcttcggcgccgtcgcggcgcaggctacccaggcgtgcgccccaggctcgcgggtcgaccccggccgcgcccagggcctcgcgctccagctcgcccaggccggcgccgagcgccaccaggcccatggagtggcagcttccggacaggcgatgggcgatgttcgccgcctcggccaggtccgcctggtccagggcttcggccagcagcggcaactgctcgtccaggcttcccagcaggttgcccagcagtccggcgagcttgtgccgccccagcaggcggcggtgggtctcgagcatttgccggtccagcgcggcctccaccgcaagcgcaggcacgctggtgccgacctcgcccagcgcgcggcgcagctcgtccatccgcaggggcttgccgagcacgccctgcatgcccgcggcgaagtaccgacgcaccatgtccggctggatgctggcggtgaaggcgaagatcggcgtggagcggttcaggccgtcgagctgccggcgaatcccggcgcaaagctcgaggccagccatccccggcaggtgcatgtccagcaggatcaggtcgaagcgccgctgccggcacaacgccagggccggccccgcgtcctcggccagcatcacccggtggccgtcccgctcaagcaggccctgggccacctcgcggttgagcgccacgtcctccaccagcagcacctccagcgcagacaccgatgccgccggcggcgtcgcgccggacaagctcgccagcgccagctcgatctcgaaccagaacgtgctgccctggccgacccggctttccacgccgatccgtccccccagcgcttccaccagccgcttgctgatcgccaggcccaggccggttccgccgtaacggcgggtcacggcgtcgccgccctgggtgaagcgttcgaagatgcgttcgcgcatttcctcgggaatgccgattccatcgtccgcgacgctcagccgcaggcgctcgcttcctgcgctgcgcgccagccgctcgacgcgaacgcgcacctcgccggcctcggtgaacttcaccgcgttgcccagcaggttggtcaacacctggcgcaggaactgctcggcgccgcgatggccgtcatgaacctgtgggtccagccacaggtccagccgcgtggcgttctcccgcgcccgcggttcgagcagggtgaggacgtcctcgagcaggcttcgcaaggaaaagtccaccgcttccggcacatccggcgcttcctccagccgggcgaagtggaggacctcgttgaggatcgccagcagtccctcccccgctgtcgccagtgcccgcaggcgctggcggtcacgctcgccgagcgatgcctcgcgcagcagctcggccatgcccaggatgccgttcagcggggtacggatctcatggctcatggtcgcgaggaaacggctcttcgcccggtcggcggcttccgcctggtccttcgcccgacgcaggctggcggtgcgtcgctcgacctgtcggcgcaactcgtcgcgatcggcatcgcgccggcggcggtcggtgcgcagagcctggcgcatgtcttccagggcggcggcgacggcgtcgatctcatcgcgctcgcggtccaccttgtccagtcgcagcggctgttgcaggtcgccttcggcgatatgcccggcgaactcggacatgcgccacagatggcgagtgaccaggctgtggaacagccaactgagggccaccgccaggccgcaaaggaaactgcccatccacaagaggctggccaggccgccggaaaccagccggcgatagaccgccgccaggtcgatggcgatctccagctcgcccagttgccgacgctcgccccccggcggctggtagctcaagggaaagcgctcgacccgcagcatgccgcgtggacgctggtcgccctgcaacaggttgaagtcggcgctttgcaggctgacacgggcgatgtcggggaaatccccgaggccgcgcaactgcacgttcaactgctcctggttgagatcccacaggctgcgctcgaagctggccaggtagccgctgcggatcagttccaggcgcgcctcgatctcgcgcatttcgcggcggtattcgaagaacagctgcacggcgccggcgaggacggtgaaacacaggctgaacagcagcacccgccacagcaggcgccgcgccaacactccgccgtggccgctcaccaggcgtccgcgcggttgccggcgaggcgccgatag

SEQ ID NO: 15971 - DNA, 2001 bp, Pseudomonas aeruginosa
attcatatcctgtttctgaagcgcgccgcgagaacaacaagaaggacgccaaccgtgaatttcccgcacctgttcagccccctggaaatccggggcaaacgcctgaaaaaccgcatcatgtcgagcggccacgacacgtcgatgcctaccgacaacctggtcaacgagccactcgtcgcctatcaccgcgcccgggcccgcggcggcgccggactgatcgtcatgcaggtggcgggggtccacgacagcgcgcgctacacctcgcacgtgctgatggccaccgacgatgcctgcatccccggctaccggcgggtcgccgaggcctgccacgccgaaggctgcgtggtgctgtcgcaaatcttccatcccgggcgcgagatcatggagtccgccgacggcctgctggcggtggcctattccgcctcggcctcgcccaacgaacggttccgggtgatgccgcgcgaactcgaccagccgctgatcgacgagatcgtcgccggctacgccgccgccgcgcgccgcctgcacgaggcaggactggacggggtggaggtggtcgccagccacggctacctgccggcgcaattcctcaacccgcgggtgaaccgccgcaaggatggctacaacggcgacctcgatgcccgcctgcgtttcctccgcgaagtgctggcggcggtgcgcgcggccacctccgaggacttcatcgtcggcctgcgcctgtccgccgacgagcgcgaccccgagggtctcagcgaaagcgagtcgctgcaggcggccgaggcggtccagggcgagctggactacctgcacatcgtcgccggcacttcggcctccctcggcggcgccattcatatcgtcccgccgatggccatcgagccggcctacctggcccgcgaagccagtaccttcaaggcgcgcctggcgatcccgctgttcgtcaccgggcgcatcaaccagccccaggaggccgaggccatcctcgcccgaggccaggccgacgtctgcggcatgacccgcgcgctgatctgcgacccgcagatgccgaacaaggccgaggccgggcgcagcgacgacgtgcgcgcctgcatcgcctgcaaccaggcctgcatcggacatttccaccgaggctatccgatctcctgcatccagcacccggaaaccggccgcgagctgacctacgcaacgcccaatccgccctcgcggcgcaagcgcgtgctggtcgccggcggcggcccggcggggatgaaggcggcggcggtggcggcacagcgcggccacgaggtagtgctctgcgaggccggcgcccagctcggcggccaggtcaacctggcgcaactgctgccgcgccgcgcggaattcggcggcgcctccaccaacctgcaacgggagatgcaactggccggcgtcgaggtacgccgcaacacgccggtcgaccgcgcgctggtggagcgcgaacggccggacctggtgatcgtcgccaccggcgccgaaccctattggccgcctttcgagcgcggcggcgagctgcaggtggtggatgcctggcaggtgctgcgcggcgaggtgcgggtcggtcgctcggtgctggtcaccgactggcggggcgactggatcggccccggtatcgcggaaaagcttgtacgcgagggccaccaggtacgcctggcggtgaacggcacccactgcggcgagagcctgccgctgtacgtgcgcgaccagttggccggcgaactgcaccgcctgggtatcccggtcacgccctacgcccgcctgtacggctgcgacgataccacggtgtacatgcagcacagcgccagcggcgaggcgatgctgttcgaggaggtcgataccctggtgctatgccagggccaccagccggtggaccgcctggctgacagcctgcacggcctggcggaggtgttgcggatcggcgactgcctggccccccgcaccgccgaggaggcgatctacgaagggctcaaggccgcctggagcatctga

SEQ ID NO: 15972 - DNA, 462 bp, Pseudomonas aeruginosa
aggaacagcagctcgcccatggtatcgccgagcagcacctgggtcgcgcgtgccaccggctcgccgccggagcgccggaccgtggcgaagccttcgcggcggcatagctcgtggacgccggcgaagcgttccggatggcgcggcaccaggatcagcaacgcgtcgggacgcgtttccagcaggcgccggtgggctgccaggacgatctcgtcctcgccggcatgggtgctggcggcgatccacagcggtcgcgccgtcgcgtcccattcctcgcgcagggcggcagcggccagcggcagctgcgggtcgatgcgcaggtcgaacttgatcgagccggtcacgctgacgcactcaggacgcgcgccgagacgacggaagcgctcggcctcggcctcggtctgcacggcgatccaggacagctcggcgagcatcggccgggtcagcccggcgaagcgcgcgtag

SEQ ID NO: 15973 - DNA, 783 bp, Pseudomonas aeruginosa
ccacccatccgacccgcgacggccagtcggtctggtacctcggcggcgacatcgccgaagccgatggcgtggcccgcgacgaagccgcgcagatcgccgaagcgcgtcgcgaactggcaaagctgctgccctggatcgacctcggccaggcgcagtgggccaccttgcgggtggatcgcgccgagccggcacagtccaacctgttgcgcccggacaacgccttcctcgccgaacagggacgcctgctggtcggctggccgaccaagctggcgctggcccctgacttcgccgaccgggtctgcgcccgcctggaagaagacggcatccgccccagcgaacatgccgcgctgccgcaactgccgcgtccgccgctcgccgaaccggcctgggaggtggccttcgcatgatcagggataccctccacgacctgcaccgcccgctgggcgacaccggcctggccgtttcgccgctgggcctgggcaccgtcaagttcggccgcgaccagggagtgaagtacccttccggcttcaccatccccgacgaccgcgaagccgccgacctgctggccctggcccgcgacctcggcatcaacctgatcgacaccgccccggcctacggccgcagcgaggaacgcctcggcccgctgctgcgcggccagcgcgaacattgggtgatcgtcagcaaggtcggcgaagagttcgtcgacggccagtcagtcttcgacttctccgccgcgcatacccggcgctccgtcgagcgcagcctgaagcgcctggagactga

SEQ ID NO: 15974 - DNA, 966 bp, Pseudomonas aeruginosa
cacccgcggtgcattccgctgccatgttcctcccgaacgagccgtatcctgcctgccgccctcgcctccggtggccggtgcatcgaacgtgagcctccgtcccgccccggcgcgatgacccgacaaggagccccgtatgccccgtatgctcgcccgcaaggatccgtccgccttcaagaccctgccgctgctggtggaggcctccccggacgggctggtctaccaggccctcggcctgccgctgaacttccagcagatgctcgtacgccgccgccgcatggaggtagccgacccgcagcgcttcgtcgccgagctggccaacctgggggtctcggtgcgcttgaccctgaactggcagggccgcgactactgggtgctggtccgtcagcgccggctggaccgcggcgataccgtgctcaagctgatctccggctacgtaccggcccacgaactgaacctgccgctgctcacggcgatccaggaagtcgccgaggaatgcctggtggagaccgccggcggctggctcggcgggcgcttcggcgacacctggctgccgacgccctaccagggttcgctgcgctaccgggagaacagccacttcgtcctcaccccgctgtccggcgccgcccgtccggtgcaagccggcagcctgcgcttgctggagcgcccacgcgcctacgtacacctgcccacggcctcgctgcaactggtctacgacatgcgcctggagctgccgcgcgatgcgcgcgagccgagcctctaccatgtcgacgagcggctcgagagcggtccgctggtggcgcgtctggaccgtcggcgccccgatctctacctgctgccgctggaccaggggcgccccaccggcgacctgttcaccctgcgcaagggccagttgcgccctgcggccacccgcggcctgtggttggccgagagctttgccgtacaggacggctggctggtgcatga

SEQ ID NO: 15975 - DNA, 501 bp, Pseudomonas aeruginosa
aggatgtcgaagcagccattggtgaagacgatcttctcgccgtgggcgcgggcgtcttcgattgccagcagcaattgctccaggcccagcacgccacgctcggaaccctgctcgcgctgcaccgcgcgacgcagttcgggcgcgctgatcgccgcggtacccagcttgccgaccacgatgccggcggccaggttggccaggcccaccgcggacggcagctcctcgccggcggcaagcgccgcggccagggtggagatgaccgtatcgccggcaccggtgacgtcgaacacttcccgcgcccgcgccggcaggtgcagggccggctggccatcgcggagcagggtcatgccatgctcgccgcgggtcaccagcaaggcaccgaggtcgagttcgctcatcagcgcctggcccttggcgaccagttcggcttcgtcggcgcaacggccgacgatggtctcgaattcggacaggttcggggtgatcaggctggcgccgcgatag

SEQ ID NO: 15976 - DNA, 1830 bp, Pseudomonas aeruginosa
cggtcgagcatcacatcaccgaccaccaacaccggggcctggtcgaaacggggcatggacaacttcatgggaactccaaacaacctctcggggcagacgcccagtttatcagccgacaggcgccggcgcctgctcatccagtcccatcgcgtgcagccgcgcataatggccgttctgcgccagcagctcggcgtggctgccgcgctcgacgatctgcccctggtccatcaccaggatcaggtcggccttctcgatggtcgacaggcggtgggcgatcaccagggtggtgcgccccttcatcacttcgtccagcgccgcctggatatgccgctccgactcggtgtccagcgccgaggtcgcctcgtcgaggatcagcaggggcgcgtccttgagcagcgcccgggcgatcgccagacgctggcgctggccgccggaaagcagcacgccattctcgccgacctcggtgtcgaagccttgcggcaggttgtcgatgaattccttggcgttggcagccttcgccgcccgctcgatttcctcgcgcggcgcgccagccaggtcgccgtaggcgatgttgttggcgacgctgtcgttgaacagcgtgacctgctgggtcaccagggcgatgtggcggcgcaggttacgcaggcgataatcctcgacctcaacgccatcaagcatgatcttgccgtcattgtgctgataaaagcgcggaaccaggttggccagggtcgacttgccgctaccggaacggccgaccagggcgatcatctgcccgggctcggcgatgaaactgatgtcatccagcacctgcttgtcggttccgggataacggaagctcaggttgcgcacttccaggcgcccgctgacccgctccttctcgacggtaccctggtctttctccgccgcttcgtcgagctgctcgaagatgctctcggcgccggcgacgccgcgctggaccgtggaactgacctcggaaagctggcggatcggcttgggcaacaggcccgccgcggtgatataggccaccaggtcgccggccgaggcgtccccgcgcagccacagcacgaggaacatcagtatcgccatggcgacgtagatcaccaattgcagcatcggcgtgtagaccgcgccggtcttggtcatccgcaactgcttgtcggtattgctctggctggcgtcgaggaagcgcttctcttcataggcttcgccgccgaagctgcgcactacccggtagccctggatggtttccgaggcgacgtgggtgacgtcgcccatggccacctggatcttcttgctctgcttgcggaacttgcggctggcggtagtcaccatcaccgcgatgaccggcaggatcgccagcatcaccagggtcagcttccagttcatccacagcaggtagaggaacaggaagaccacggtcaggccctcacggatcaccaccttgatggcatccgtggccgctccggtgaccatggtcacgttgaaggtgatgcgcgagatcaggtggccggagctgtgcgtgtcgaaatagcggttcggcagcaccagcagcttgttgaacagggcgacccgcaggtcatgcaccagccccagggaaaccttggcgaggaagaagttgccgaggaacgagcccagcccctgccaggcagcgatcaggatgatcagcaacggcaccgcgtagaccaggtgcaagtcgcgcaaccagggccactgcacattcggaaacaatgccgcgtcaggattggagaggccgtcgacgaaatacttgaggatgcccgccagcatcggctgggtcgaggcgaagatcaggaaaccgacgatgctgagtag

SEQ ID NO: 15977 - DNA, 204 bp, Pseudomonas aeruginosa
tcgacatcgccgaccctgcgggtccagcgctcggcgctcagcgccgcccagcgcattcgcaatttcaagcacctgctgcgctacgaacaggatcgaacctggttcctcgacgacagcgagcacctggtgctcaaggcctatctccgcagcagccaggtccactggacactcgagcagctcctcaagcaactgcaactggattga

SEQ ID NO: 15978 - DNA, 1806 bp, Pseudomonas aeruginosa
ggcatgcggttcttcgcgtgcttgtcgcgcacgaagcgctcttcctcgacggccgcgaccagcttgccgtcgatgtacagggcggcggacgggtcatggcttacggcgccagacaggcctaggacggtcaatgccacggtagaacctcttcaaagcagctcgcggttgcggagtgggaccgacaaccgcggctttcgtttaactcgtcgaccgccgcaggcggtggtcgtcgcttgtcgttcaagccccggcggcgtcgccgaggcggggaatccgttgctccagcagccggtagaggccgctgtcctgcggccagttgcgcaggaagcgcgcacggtcgcgggcgtaggcgcgggcaaaggacgcctggctgtgatgcttgcgcatcgcgtccaggtcgatcagcgcccattcgccgccttgttcatgggcctgccagaacaggttgtgtcccttcaggtcgccgtggctgatgcgttcgcggatcaacgtcgaaaacagccgatccagtgccgccaactcggcttccggtggcgaaacggcgccatcgggcatgtccaggcaaggcttaaaacgagcgattatatcctgaccgccgagataatcggtaatcaggtaggcgcgcccgcgcagccagcaccagcgccgctccagcatcgccagcggacgggcggtggcgatgccgaggaattccaggcggttgccttcgcgccaggaggcccaggcccggctcggccgccagaagcgcttcagccaatggacccagcccttgatgttgtagcgcttgatgatcagcgtgcggccgttcgcttcgacccgggcgacggtggccgcgccgccgtccttgtagacgtggccggcggcgatcaggcggtccgcgtccgccagcaggggcgccatcgtctcggcctcgctgcggcgagcggcgaacaggcggaacggaccgcgcacgacgctgaacaggctacagtcgcgaccgaccttcctcagcaggtcgcgcacccgccagcggcgaaccttggcgatttccttctgcaaggcttccagcggcagcgcatgctcgccgttggccagcaggtaatgcaccagcaactcctccaggaaaggatcgaggagcgccggcaactgggcgaagaacaccccgaggttttccagcactttctgtcgcgacagcggctggccgggagtttccgcacgcacgccgccaccgtcgatgagatacaggcggccggcgtggcgcaacaggttgtccacgtgcaggtcgtcctgccagaggccctttgcatgcagctcgccaatggctgccagggcttcgccgagcaccgcttgctgggcatcgcccagcggcgcctgggcctccaccgcacgccaggcgtcaccgaggctctgcgccgcgtcgaggtagtcgaacagcagccagccgccctcgccctgctgcagcccgtcggccagcagcgccggggtggtcagcccctgggccgcgagcagacgcgccccttccagttcgcgctggaaatgccgtgcggccttgccgcccaccagcagcttggccagcaccttgcgcccacgccattcgccggcaccgacgtagcgctgcccgggcagcacccgcagcagactgtccaggcgcagttcggcagcgccagcgccatccgccagggtcacccgcaatggcagttgcgggtggcgcccggcggcttgcagttcggccagtctcatcggcgcgactccttgcgccgacggcgctggtcgagaaggcgataccactgctcgacctcggccgagtcgaggggttcgtcgacatag

SEQ ID NO: 15979 - DNA, 1173 bp, Pseudomonas aeruginosa
ccagcagtaccctcatccggcgacctcggcagggtcgccgaccagccgctccagggcttgcaataccaggccaggcggcagctcgcggaggcaattgtagtggccgaagcgacaggtgcgctcgaagcacgggctgcactcgagactgaggcggacgatctccacccggtccgccagcggcggggtgaactgcggcgaggtggagccatagacgcccaccagcgggcgatccagcgcggccgccacgtgcatcaggccggaatcgttggacaccaccgcgccagcgcaggacatcaggtcgatggcctcggccagcgaagtctccccggcaagattgaaggactcctcgcgcaaccccggaatcaggcgctggcgaatctcctctccaccgggatggtcgttcttcgagccgaacagccagacctgccagccggcacggatcttcgcctcggcgaccgcggcgtagtgttccgccggccagcgcttggcctcgccgaactcggcgccgggacagagcgccagcaccgggcggtccaggctcagggcgaacttgtcgagcgccgcctggcggctaccgtcgtcgatccgcaggcgcggctgcggatagggcttcggcaactccacgcccggctcgaaggccagggccatgaagcgttcgatcatcagcggatagcgctgcttgtcgagcttgcggatgtcattgagcagcccgtagcgcatctcgccgcgccagccggtgcgcttcggtattccggcgaaccagggcaccagcgccgacttcagcgagttgggcagcaggatcgcctgctcgtactgaccgcacaggccgcgtccgatccggcgccgtgtggcgacgtccatcaccccgtggccgagcgggaagctcagggcctggcgcacctcgggcatgcgctcgaggatcggtcggctccactcgggcgccagcacgtcgatcacgcactcgggatgccgctggcgcagacactggaacagggtctgcgccatcaccatgtcccccacccaggagggacctacgatcagaattctcattcaggctccggaaatgatcagggaggctttcgcctccctgtcacacccttcttcggtgcttacttgaccagggtacgccactcggcgtgggcctcggtcttgccgctgaccaggtcgaaatag

SEQ ID NO: 15980 - DNA, 2781 bp, Pseudomonas aeruginosa
aaccgcatattgcaccataaattcgatatcgacgataccaccggcatcgtgcttgagatcgaaggctgccgtggcctcgaaggcattcgaggcggtaccggcggcggtcgcgcgggttcccaggttgtcgcgcatcttggcgcgcatttcgctgacttcggtgcgcaacgcgtcgagatcgcgcggcctcgccagcacctcggcacgtaccgcctcgaagctcgcctgcacccgccggcaaccggccagcacccgggcgcggaccaacgcctggtgctcccaggtccaggcctcctgctcctggtagcgctggaaggcgcccagcgaactcaccagcaggccggccgcgccgctcggacgcaggcgcatgtcgacctcgtagagggtgccggatggcgtctgcgcggtgaggaaatggatgatcttctgccccaggcgggtaaagaactgcgcgccatcgatggatttgccgccatcggtctcgcactgggggtcgccgtcatggatgaacaccaggtcgaggtccgagccatggccgaactccagcccgccgaccttgccgtagccgacgatgacgaagtccggatcgcacggcgtgccgtcggcgcgcaacggccggccgtgacgctgcaccaactgccgccaggccagttcgaggacctcgacgaggatcgcctcggccagccaggtcaggtagtcgctgaccttcatcaacggcagcgtgccggcgatctccgaggccgccacccgcagcccgtgggccagcttgaagtgacgaagggtctccatctgctgctcgaggtcgtcctcgggaatccgcatcagccgttcgcgcagctcggcggccagctcggcggcctgtggaggacggaacaggcgcccctcgttgagcagctcgtcgagcagaatcgggaaccgcgcgatctgctcggcaaccatcgggctggccgcgcagagggtcagcaggcgctccagcgcgccggggttctcggtcagcaacaccaggtaggcggaacgccgcgccaccgcttccaccagcggcaggacccgctccagcaccaggtccggctgggggttttccacggtcatcgccagcaggcgcggaacgaaggcatccaggcgctcccggccgagacgctgcatcgctcgtacctgggggccgtggcgcagatcgctgagacgcttccaggccgcctcggcatcgacgaagccggcgtcggccagttgccggctggccgactcctcgtccagcgcctcctcccacagcgggatccactcggcgccgacgctgccgcaggccgcctcgccgctttcgtcctcgtccgggtcggcgatcacctggcggaagtgccagtcgatgcgcgcccgccagtggctcaggcgctcgtggaatgcggcccaactggcgaagcccatgatgaaggccacgcggatgcggtcgtattcgtcgctgggcagcatttgcgtctgccggtcggccagcgcctggatggcatgctcggcgtagcgcaggaactcgtagccgccgcgcagctcctcgaccaccgccggcggcaggtagccctgcccctccagggtcgccagcaccttcagcagcggccgttgctgcaagctcaggtcgcgcccgccatggatcaactggaaggcctgggcgatgaactccacctcgcggataccgccttcgcccagcttgatgttttccgacatccccttgcgccggacctcctgctggatcagctgcttcatggtgcgcagcgcctcgatggcggaaaagtccaggtagcgccgatagacgaacggccgcagcatgccgagcagttgctcgcctgcctgctggtcgccgccgaccacccgcgccttgatcatcgcgtagcgctcccagtcacgcccctggtcctggtagtactgctccagcgcggcgaagctgtagaccagcggtccgctggagccgtagggacgcaggcgcatgtcgacgcggaagacgaagccgtcgacggtgatcgcatccagcgccttgatcagcttctgccccaggcgggtgaagaactcctggttgtccagcgaacgcttcgccccctcggtctcgccgccctccgggtaaccgaagatcaggtcgatgtccgacgacaggttgagctccaccgcgcccagcttgcccatgccgaggaccaccatccgctgcggttcgccggagcgccggccgatcggcgtgccgaactgctcgcactggcgccgatggagccactcgcaagccaggtcgatgcaggcgtcggccagggccgacaggtcgcgacaggtttccgccagcgcggcgcggcgggtcaggtcgcgccagatgatgcgcagttgctggcgtgtgcggaaacgtcgcaggcgccgaccgagttcgtcctcgtcggcgcaatcctccagccgcgcctgcaactggctgcgcaattcgccgggcgcgtgggggttctccagctcgccgcgttcggccagatccagcagcatcgccgggtcgcgcactgcctgctcggcgacgaaatcgctggccgcggcgacccgtcggaaatcctccaggcgctcctcgggccaggcctccaggcgggccagggcggcggcatcgagggcggcgacagcggagcggagggcagtcccggcgcgttcggcggcgggcagcagggtggccggcagattcgccagcgaaggcaggctcatggtctatcctgtttgggcttccgaccgaagaccacaggctcgacgcacaacgtcgaaaaggctctacatcgggccttatag

SEQ ID NO: 15981 - DNA, 267 bp, Pseudomonas aeruginosa
tgcgggcgaacaagcacgacccggacctgggcggccacatctccaccttcgcctcctcggcgaccctctacgacatcggcttcaactatttcttccaggctcccaccgacgaacacggcggcgacctggtgttcttccagggccacgcgtcccccggcgtctacgcccgggccttcctcgaaggccgcatcagcgaggaacaactggagaacttccgccaggaagtggacggcaacggcctgtcctcctatccgcacccctggctga

SEQ ID NO: 15982 - DNA, 465 bp, Pseudomonas aeruginosa
tcttcgtcatcaactgcaacctgcagcgcctcgacggcccggtccgcggcaacgccaagatcatccaggaactggaaggcgtgttccgcggcgccgagtggaacgtcaacaaggtcatctggggtcgcttctgggacccgctgttcgccaaggacaccgccggcctgctgcagcagcgcatggacgaggtcatcgacggcgaataccagaactacaaggcgaaagacggcgcctacgtgcgcgagcacttcttcggcgcgcgtccggaactgctggaaatggtcaaggacctttccgacgaggaaatctggaagctcaaccgcggcggccacgacccctacaaggtctatgcggcctaccaccaggcggtcaaccacaagggccagccgaccgtcatcctggccaagaccatcaagggctacggcaccggcagcggcgaagcgaagaacatcgcgcacaacgtga

SEQ ID NO: 15983 - DNA, 2019 bp, Pseudomonas aeruginosa
ccgtctaccgccgcgacctcgaccagtacgagaagccccagagcatcgacgccagccgctaccccgcctacctcgaggcggtacacagcgggcgcgccatcgacgcccacaacggcccagcgcgacccacgcacccaggaactctacaaggactacctgaagccgctgggcgtcaacgccctgctcgacgccaccatccgcatcggcggcgaggtggtcggcgtgctgtgcctggaacacgccggcgagaaccgcatgtggcagagcgacgagatcgccttcgccggggaactcgccgaccagtacgcgcaggtcctgatgaaccacgagcgacgcaatgtctccagcgccctgcacttgttccagcgcgcggtggaacagagcgccagcgccttcctgctgatcgaccgcgacggcgtggtggaatacgtcaatccgagcttcacctcgatcacccagtacagcgccgacgaagtgcgtaaccgacgcctgtccgagcttccggcgctggagaacctcagcgagctgctgttcgacgcgcgttccgcgctgacccagcagaacagctggcagggcgagttccgcagccgccgcaagaaccacgagccttactggggccagttgtcgctgtcgaaggtctacgacgatctcggcgagctgacccactacatcggcatctacgaagacatcacgcagaacaagctggcccagcagcacatcgagaaactcgcctaccgcgacaacctcaccggcctggccaaccggcactatttcatcggcgccctcgaggaacgcctggaaagcagcggcgaccgcccgctcagcctgctgctggtggacatcgacaacttcaagcggatcaatgacagcctcggccaccagaccggcgacaagctgctggtcagcctggcccggcgcttgcgcagttgcctcggcgacggcgccaccctggcgcgcttcgccagcaacgagttcgccgtgctgctcgacgacaccgcggtggaaaagggcgaaagcattgccgcgcaggtcctgcacatgctcgacaagccgctgttcgtcgacaaccagttgatcaacatcaccggctccatcggcctggccagcgccccgcagcacggctgcgacccgcagaccctgatgaagtacgccggcctggcgctgcacaaggccaaggccaacggcaagcaccaggtccaggtgttcaccgaggcgctgaccgccgaggccagctacaagctgttcgtcgagagcaacctgcgccgcgccctggcgcagaacgaactggcggtgcactaccagcccaagctgtgcctgcgcagcggccagttgctcggcctggaagccctgctgcgctggcagcatccggaaaaaggcatgatccgcccggaccgcttcatcagcgtggccgaggaaaccgggctgatcgtgccgatcggcaagtgggtgatccgcgaagcctgtcgccaggcccgcgagctggccgaggccgggctgggcgagctgcagatcgccatcaacctgtcgcccaagcagttcaccgacccggacctggtcggctcgatcgcggcgatcctccacgaagagaacatcccggccagccagctggaactggagctcaccgaaagcctgctgctggacgccaccgacgatacccgccagcaactcgaacgcctgaagagcctcggcctgaccctggcgatggacgacttcggcaccggctactcgtcactgagctacctgaagaaattccccatcgacgtgatcaagatcgaccgcagcttcatcaaggacattccggacagccaggacgacatggaaatcacctcggcggtgatcgccatggcccacaacctcaagctcaaggtagtcgccgaaggcgtggagagcgccgagcaactggccttcctccggcgcaaccgctgcgacatcggccagggctacctgttcgaccggccgatccccagcgacctgctcaataccagtctgctgcgctatccctgccgcaccctgcactga

SEQ ID NO: 15984 - DNA, 741 bp, Pseudomonas aeruginosa
tcgcccaggcctcccccgccggcgcggaaaggctgtactctctgtgctcatccgcgagtcattcgcctaccccctgagcaggagacgagagccatggttctgcgttctgaaatcctcaccaagaaaagcgagctgcccacgccggaccaggccctgccgggtcgcgaaagcgccatgccggtgcccgaagcgcacttcgtcaacggccgcccgctgaccgcgccgttccccgccggcctgcaacaggtgctgttcggcatgggctgcttctggggcgccgagcgtcgcctctggcagcaaccgggtgtctgggtgaccgcggtgggttatgccggcggctacacgccgaacccgacctacgacgaagtctgctccggcctgaccggccacagcgaggtcgtgctggtggtctacaacccgcaggagaccagcttcgaacagctgctcaaggtattctgggaagcccacgacccgacccagggcatgcgccagggcggcgacatcggcacccagtaccgctcggtgatctacaccttcgacgcggcccagaaggccgcggccttggccagccgggagagcttccaagccgaactggcgaaagccggctacgaccgcatcaccaccgagatcgccgacgtcccgcccttctactacgccgaggcctaccaccagcagtacctggcgaagaaccccaacggctactgcggcctgggcggcaccggggtgtgcctgccggcctga

SEQ ID NO: 15985 - DNA, 762 bp, Pseudomonas aeruginosa
cgactattccgccaccagccagtcgagacgccagccgccctggctctgggccatgacctcggccagccagggcagcaggtcgcgcagttcgtcttccagcggccacggcggattgacgatggccagcccggagccgttgaaacgctcggcgtcgtcgatcggatgcacgtgcagctcggcacgcagcagcttcggcgcgacgctacgttccagggcctggtagaaacgcttgagctggcgctcgtccttgatcggataccagatcaccaccaccgtctggcgcatccgcccgatcgcctcgtcgagcgcagcgacacaacgctgcaattcgtcggcctgctcgaacggcggatcgatcagcagcaccgcgcgcttttccggcgccggcaggaacgcccgcggcagcagccaaccgtcgccctggtgcacggcgacccgccgttcgccagccatgttggccttgagcaggcggccgtcctcgggatgcaattcgttgagcagcacgcggtcctgggcgcgggtcaggcgccgcgccagttccggcgagcccgggtagtagcgcagggagccgtccggattcaggtgacggatcacgtccaggtaatcgtccagttgctcgggcaggccttcgcgctcccacaggcgggcgatgccctgctcccactcgccggtgcggctggcctcgtcaccctgcaggtcgtagaggccgaccccggaatggctgtccaggtaggcgtacggcgtgtccttgcgccccagtag

SEQ ID NO: 15986 - DNA, 1437 bp, Pseudomonas aeruginosa
ctcggcctatccgttcctgaccatgggtgccgccaacctgatcgagagcttcggcagcgaggagcagaagcagcgcttcctgcaaccgatgatcgagggccgcttcttcggcaccatggccctcaccgaaccgcacgccggctcctccctctccgacatccgcacccgcgccgaaccggccgccgacggcagctatcggatcaagggcaacaagatcttcatctccggcggcgaccacccgctctccgagaacatcgtgcatatggtcctggccaagctgccggatgcaccgccgggggtgaaaggcatctcgctgttcatcgtgccgaagttcctggtcaacgccgacggcagcctcgggccgcgcaacgacgtgatcctcgccggcctgttccacaagatgggttatcgcggcaccacctccaccgcgctgaacttcggcgacaacggcgcctgcgtcggctacctggtgggcaagccgcaccacggcctggcctacatgttccagatgatgaacgaggcgcgcatcggcgtcggcatgggcgcggtgatgcttggctatgccggttacctctaatcactgagagtacgccccgcgaacgcccgcagggccgcctgccggacggcaaggacctgagcgcgccacaggtggcgatcatccgccacgccgacgtgcggcgcatgctgctgacccagaaggcctatgtcgaaggcgccttcgacctgggcctgtacgccgcgcgcctgttcgacgacagccagaccctggaagacgacgaacagcgccgccaggcccacgacctgctcgacctgctgaccccgatcgtcaagtcctggccctcggagttctgcctgaaggccaacgagctggcgatccagatcctcggcggccacggctacacccgcgaatacccggtggaacagtactaccgcgacaatcgcctgaacccgatccacgaaggcacccacggcatccagtccctcgacctgctgggacgcaaggtcgggcagaacaatggcgccggcctgcgccagctgacccgcctgatccaggacgcctgccggcgcgccgaagcccacccatccctggtcgccctgcgccagccgctggaacggctggtggcgcggctgtccgaggtgaccctggcactgctcggcgacctgatgcagggccaggtcaaccagggcctggccaactcggcgctgtacctgaaagtgttcggccatgcggtgatcggctggcgctggctggagcaggcgatccgcgccgaggaagggctggctcgcggcgactgcgccgacgccgacttctatcgcggcaagttgcaggccgcacgctacttcctgacctgggaagtgcctggctgccaccacgaactggcgctgctggaggcccgcgacgacgtgtgttcgagcatgcaggaagaatggttctga

SEQ ID NO: 15987 - DNA, 1776 bp, Pseudomonas aeruginosa
tttcttcctgatcggggcggtgctggtcggcatgagcatcctcgtcagctcgctgtcctcccgcctgggcatcccgatcctggtgatcttcctcgccgtcggcatgatcgccggcaacgacggggtcggcggcatcgtcttcgacaactatccgatggcctacctggtgggcaacctggcgctcgccgtgatcctcctcgacggcggcctgcgcacccgcgtctccagcttccgcgtggcgctctggccggcattgtcgctggccaccctgggcgtgctggtgaccaccggcctgaccggcatcgcggcagcctggctgttcgacctgcactggatggaaggcctgctgatcggcgccatcgtcggctccaccgatgccgccgcggtgttctccctgctcggcggcaaaggtctcaacgagcgggtcaccgcgaccctggaaatcgaatcgggcagcaacgacccaatggcggtgttcctcaccgtgaccctgatcgagatgctcgccagcggccagaccggcctcagctggggcttcgccctgcacctggtgcagcagttcggtctcggcgccctgctcggtcttggcggcggctggttgctgctgcaactgatcaaccgcatgcacctggccggcggcctctacccgttgctggtgatcagcggcggcctgctggtgttcgccctggccaacgccgtcggcggcagcggcatcctcgccatctacctgtgcggcctgctcctcggcaaccgcccgatccgcagccgccacggcatcctgcacatgctcgacggcatggcctggctggcgcagatcggcatgttcctggtcctcggcctgctggtcaccccccacgacctgtggccgatcgccctgccggcactggccctggcgctgtggatgatcctggtggcacgaccgctgtcggtactgatcggactgatcccgttccgcgccttccacgaccgcgagaaagccttcatcgcctgggtcggcctgcgcggcgcggtgccgatcatcctcgcggtgttcccgctgatggccggcctgccgaacgcccagctgttcttcaacgtggccttcttcatcgtcctggtctcgctgctggtgcagggcaccagcctgccctgggcggccaggctgctgcgggtggtggtgccgccggatccggcaccgatatcccgcgccggcctggagatccacccgaccagcgagtgggagctgttcgtctaccacctgaacaaggaaaagtggtgcatcggcgccgccctgcgcgagctgaagatgcccggcgggacccggatcgccgcgctgttccgcggcaccgaactgctccacccgtcgggcagcaccatcctcgaggccgacgacattctctgcgtgatcggccacgaacacgacctgccggccctcggcaagctgttcagccaggcgcccgaccggggcctcggcgcgcgcttcttcggcgacttcgtgctggaaggcgatgcccagctgtcggcggtggcctcgctctacggcctgaagctcgacggcatcgacggcgagcaagcgctgggccgcttcatcgcccacgagatcggcggcgaagcggtgatcggcgaccaggtggagtggaacggcctgacctggaccgtggccgccctggaaggcaaccgtatccgcaaggtcggcgtgaagtttccggaaggccgcccagggcccggacttttcctctgatttcctgtcgaattcccgttccgaggcgccttgcggcgcctcggagccaccactaa

SEQ ID NO: 15988 - DNA, 294 bp, Pseudomonas aeruginosa
agaagaccaaagaacgtccggtcagcgaacgctacagcggcgagagcgcggcccgcctggaaatgctgctcaacgaccgcaccacccagcaggccgagtggcagaaagccctgggcgaggccaacagcctgtcgatcaccgccgagacccgtccggaacgagcccaggccggcatcagcagcatgcaggcacggatcctggaaatcggctcgctgctcaaggccggcaaggaaagcggcaagacgatcaacgccgaccgtcgcggcgagctgctcgccgagcaggccgcattga

SEQ ID NO: 15989 - DNA, 870 bp, Pseudomonas aeruginosa
cgagctgcggcgcgacagtggggaagccagcgtagccatcccacggagtccgccatgatccgccacctcctggtcgcccacgacctcaccccggaagccgacgtcgccctcgcccgcgccgcccagttggcccgccagcacgatgcgcgggtcagcctgctgcacgtgtacgacccggggctatcggcgtcggcggtgaagaccgtcagcgccatgctgcagctcaagcgcaaggaggccggcctcgacgaggacagcgccatccacctgttcaggggccaaccgatcgacggcatcctgcagcagacccgggcgctcgaaccggacctgctgctgatgggcgcgcaccaccagaagaccttcgaacgcttcggcaacaccaccctcgaccaggtggtgcggcgcagccgggtgccagtgctgctcgccgtgcgcgaggcggacgaaccctaccgccaggcgctcagcgccctggacttttcccagtgcgcctgtaccgcgctgcgccaggcctaccgcctgctgccggtggaagccgacctgcacgccctgcacgtgttcgagtcccccgacgacggcgtgctcggcctgcccaggcagaatgccgcgcacctggccacccaggccgggctgatcgaacaattgctgagcgacgagcaggagcgcctgccgggcgtcgggccgcagctgagccacgaagtggttcccggcgtgctgccgtacagcctggacgccgcgttgaagcagcgccagccggagctgctcgccctcggccggcacagccgcaacgcgctgatgcaggcgctgctcggcaacctggcgcaacgttacctgcgccagccgagctgcgacgtcctggttacctcgtag

SEQ ID NO: 15990 - DNA, 978 bp, Pseudomonas aeruginosa
agcggttcagcgccggcgcaggctggccgcctcgcgggtcaccaggtcgatgaaggacagcgccagcggcgagccctcgttctgccgacggaccagccataccgcagtcgtcgcctcgggatcgctcagggtgcggtagaccacgccgtcgacccgggtgcggcggaacgacgccggcaggatcgacacccccagtccggccgagaccaggccgatgatggtcatcgcctcgctggcctcctgggcgatgcgcgggctgaagccggcctgtcgggtcagggcgatgacctggtcgtagagcccggtgccgtagctgcgcgggaagaacacgaagggctcctcggccagggcggcgatggccaggccatcctcgctgccggccgccagcggatggtcggcccgcagcaccgccaccagcggttcgcggaacaactccacccaatgcaccgcatccggcagcgccagcgggcggatcacgcccacctgcaggctttcctcgagcagcgccttgagtacctggcggctgctcatttcctgcaggtcgaggtgtacgtccggataggccttgcggaaggcatggatgctgctgggtatggtcgaggtgaagggtgccgaggaagtgaaaccgatcttcagctcgcccagttcccccaggtgggcccgacgcgccagcaacaccgccttgtctacctgggccagcacctggcgggactcgtcgaggaacagccggccggcgtcggtgagttcgacgcggcggttggtgcgctcgaacaggcgcgcaccgatttcctcctccagcgcctggatctgctggctcaacggcggctgggagatccccaggcgctcggcggcgcggccgaagtgcagctcctcggcgacggcgatgaaatagcgcaggtgcctgagttccacgcggcccctccaattaggtctttttacatatcaatcgtgtcgatcaatatattggaaatcatataa

SEQ ID NO: 15991 - DNA, 2400 bp, Pseudomonas aeruginosa
acctatctatatcctttgccacataacctccaacaacgaccccttgtccctgaaatccaggtggcgcggcctcgttgtgcctgctcgccaccgaccccagaggtgccccgtgagcaatccgcaagtccggccacaggccgaagaagaacccgcgttaatcgaggcggcccgcgaagcagccaacgaggtgctggaagccgccaccgaagtcgaacgctatatcgaaaaaggcaccccgcagttcatgcgcacctccctagcgctgttctccggcggtttcgccacctttgccctgctctactgcatccagccgatgatgccggtgctgtccaaggcgttttccatcagcgccgcggaaagcagcctggcattgtccgtcgccaccgccatgctcgcccttggcctgctggtcaccggcccgatctccgacgcgatcggtcgcaagccggtgatggtcgtctcgctgctggccgccgcgctgttcaccctcggcagcgcggtgatgcccacctggcatggcgtgctgctgatgcgcgcgctggtcgggctgtccttgagcggcctggccgcggtggcgatgacctatctcagcgaagagatccatccgcagcacatcggcttgtcgatgggcctgtacatcggcggcaacgccatcggcgggatgagcggacgcctgatcagcggcgtcctggtcgatttcatctcctggcatgccgcactggcggtcctcggcggcctggccctggtcgccgcgctggtgttctggcgcgtgctgcccgaatcgaaacacttccggccggcaccgctgaagccggcgaccctgctcaacggctaccgcctgcacttccgcgacgccggactgccctggctgttcctgatcggcttcctgctgatgggcagcttcgtcaccctgttcaactacatcggctaccgcctgctggccgagccctaccacatgagccaggcggtggtcggcgtgctctcggtggtttacctctcgggcatctacagctcggcctgggtcggttcgctggccgacaagctggggcgacgcaaggtgctctgggcggtcatcctgctgatgctcggcggcctgctgctgaccctgttcgagccgatcccgctgatgctcgccggcctgctgctattcaccttcggcttcttcggcgcgcactcggtggcgagcagctggatcgggcgccgcgccctgcgcgccaagggccaggcctcgtcgctctacctgttcagctactacgtcggctcgagcctggccggcaccctcggcggggtgttctggcattactacggctggaacggcatcgggctgttcatcggctcgctgctggtggtcgcggtattggtctcgctgcacctggcgcgcctgccggccctgcctggcaacaccctggcgcaggccgcccactgagttcgagcgccggtctcccggcgccttcactccgaccagaagcgtactccggtcagttcctccgatcgcgcccacagccgcgcggccagccccaggtcgcgcgcattccgcggaatccgcgccgccgccggataaccgcgggtttccaaccagcgatccgggccgacataggcgccgccataccagcgctgttcggtcagcgcggaaagtgccggcaacgcccccatctccgccgattgcgcgaacgctccgttggccaccttcatcgcccagcgtcccaggcgcgaaccggccatcgccggcgccgcgtactgcaggttggtcgccgcgtagcccggatgcgccgccaggctctgcagaagcacgccccgctggccggcgcggcgctgcaactccaggctgaacagcagattggcctgcttgctgtggcaataggcgagatagcggttgtagccgcgctcggcgttgaggtcgtcgagcggcagccggccgaactggttgaaaccgctggtcatgcccaccaccctgggccgtggagcggccagcaacgactccagcagcagtcccgtaagggcgaagtggccgaggtgattggtgcccatctgcatctcgaaaccgtcgcgggtacgccgcaggggcaggaacatcactccggcgttgttgaacaagagatcgaggcgttcgtggcgctgacggaaaccggcggcgcaggcgcggatcgaggcgaggtcggccaggtcgagatcggccagctccaggcgtgcctggggatactcgtcgaggatcgcccgccgcgcccgctccgcctgttcgcgattgcggcaggccatcaccacggtcgcccctttgccggccagcgtgcgcgccgcctgccaacccaggccgctgttggcgccggtgaccagcgccaggcgcccggccagttgtggaatgttgcgtcgtgcccagggatgcatcgctcgttctccgcttga

SEQ ID NO: 15992 - DNA, 1167 bp, Pseudomonas aeruginosa
ctgcgttgccgggcagtatcgcggcaccagccaatgcagcggcagacgcgctcgcgccagactgccgatcatttcgggccaggacacgccagcatgagccgccgcacggactccgacgcaccgaccatcaccgctgcctacccgcgcctgctgctcggcctgctggaggagcgcggcctggacggacgcgcgctgctacgggaaatcggtctgtcgacgctgcgactggaagagccggaagcacgcgtcacatcgcagcagtaccaggcgatcgccgccgcggcgctcgcgctgagcggcgaccccggcctcggcgcacagctcgccttgcgcacgcctcccaccgcccatggcagcctgggctacgcgatgatggcctcggcgacgctcggcgatgccttgtgcctggcgctgcgctacatgccgctgctgcagggcaacgtcgaaatcagcctgctgcgcgaggacgagcaggtgatcctgcgcatgctgccaggccccgcgctcccgccggcactgcaccggtacttcagcgaagccctgctgatcggcctgtatcgctccggcgcctggctgctcggcgaaccggccctggtcggcaggctcgacttcgactatcccgaacctgccgtgcctgtgccgctgccgcagtgccgctacgaccaggcccacgtccagctggtgttccccgccatcctgctcgcccgctcgctaccgatggccgatccggctgcgttgcgccgcgcccgcgaacactgcgagcgcgaactggcgctgctcgatgccggccgccgggacatctgcgcccgcgtgcggctggagctggaacgccaggaacagcgcttccccaacctggaggaagtagccgcgcgcctgcacctgtccagccgcagcctcaagcggcatctgcatgacgccggcaccagctttcgccagttgctcggtcaggctcgccagcgccaggccttgcgattgctgcggcgtcccgaggtgtcgttgcagcgtatcgccctgtacctgggttacagcgatccaaccaacttcacccgcgccttcaagcgctggaccggcgagccgccgagcgacacccgcgcccgcctgctgggcgggcaaccagtttcacgaacaaatgccaagcgctcgacaaatccctcgcgtttcccttga

SEQ ID NO: 15993 - DNA, 1074 bp, Pseudomonas aeruginosa
aagggactttatgaaaccagcgatcaagcgcgcctgcctgctcggcacggcactgttctccctctgcgccagcgcagcccaggcggccggcgttctggtaggaacctgggacctgcggggcaacggccagctcgccgcggtctaccgcgacggcgccaacctgcaggtggtggaaggcggcagcacccgcaactacagcttcggcaacgtggtctggtcggtcttcggcgccaccgataccgacggccagcccggcgcggaaatcctggtcaaggccggtcccgacctggtgatcgtttcccacgccagcaccacccagcgcaagtacccggtaggcaacgtctcctgggcgatcatgcgcgccaccgacgtcgacaacgtcgccggcgacgaagtcatcctcagcatcggcaacggcgtgcgcaccgtattcgatcgcacccgtacgcaacgcgacgccaccttcagctacaacggcacctggggcctgttcgacgtcgccgacgtggacggcgcgccgggcaaggaactggtgctgaacatgggcaacggcgtcaaggtcatcgacccgcgcaccggtggcgccaaggacttcaccttcagcggctaccacgcgctcgcacagatcgccgacctcgacggccagcccggcgcggagatcatcggccgcaccagcaccggcatctacgtgatcagcaacgccagttcccgcaaggaatacaacatcggcgccagcgcctgggcactctatggcggcaccgcggacaccgacggcaagccgggcaacgagctgatcgtggtgatgcagggcaaggtgcgggtcatccaccacgccagcggcgccagcagcgactaccgcatcggcgacgtcaactacagcatcgattcggtggccgacatggatggccagccgggcgcggaaatcctcgtgcgcgacgccaacggcaagctgttcgtgatcaacgaccgcaccggcaaggtaagcagttgagccgggcgggttgcgtagggcgggtacgccaccggcgcgaccccgccagccaacgcgccggagggccgtcggcccgcgcatga

SEQ ID NO: 15994 - DNA, 444 bp, Pseudomonas aeruginosa
ggtagctggtcaccgattgcgccagcttgtccagcagagcgtgcatggcctgagggttgtcgtagagcatcgccttggacttgcggaagtccttgctcgagccgccctcgaccatgtaggtggcgagggtccaggggctgccggagaagccgatcagcggtacgcggccgttcagctcgcggcggatggtgcgcacggcatccatcacatagcccaggtcctgttccggatcgggaaccggcagcgcctcgatgtcggccagcgacgagaccaccttgcggaagcgcgggccttcgccggtctcgaagtacaggccctggcccatggcatcgggaatggtcaggatatcggagaagaggatcgcggcgtccagctgcgggtaacggtccagcggctgcagggtcacttcgcaggccagctccgggttcatgcacaggctcatga

SEQ ID NO: 15995 - DNA, 1833 bp, Pseudomonas aeruginosa
cggcatccgatcaaaggctgctggcttcacgcgggcgcgtgcggaagggggttatccacaggccggcgggcgaaaagggccgctattgtcgcaaagcacaaaacaaaaggcacggcgggggccgtgccttttgtctatcgcggtgatttgtcgcagcgccggtggcgccgcggatcagacgccaaggtagtcgaggatgccttcggccgcggtacgtccttcgaagatcgccgtcaccaccaggtcggaaccacggaccatgtcgccaccggcgaagatcttcgggttgctggtctggtgcttgaactgcgcctgcgccggagccaccacgcggccctggctgtcggtggcgatctcgaagcgctcgaaccacggcgccggactcggccggaagccgaaggcgatcagcacggcttccgccgggatgatctcctcggaaccggggatcggttcggggctgcggcggccgcgggcgtccggctcgccgagacgggtctcgaccaccttcacgccttccacccggtcctcgccgacgatggcgatgggctggcggttgaagaggaacttcacgccctcttccttggcgttcttcacttccttgcgcgagcccggcatgttttcttcgtcacggcgataggcacaggtcaccgacttggcgccctggcggatcgaagtgcggttgcagtccatcgcggtgtcgccgccgcccaggaccaccacgcgcttgcccttcatgtcgacgaagtcctcggccgacttctcgaagccgaggttgcggttcacgttggcgatcaggaagtccagggcgtcgtgtacgcccggcaggtcctcgccggggaaaccgcccttcatgtaggtgtaggtgcccatccccatgaacacggcatcgtactcatcgagcaactgctccatggccacgtccttgccgatctcggtgttcaggcgaaactcgatgcccatgccggtgaacacctcgcggcgacggctgaggacgtgcttctccagcttgaactcgggaatgccgaaggtcagcaggccgccgatctccgggttgcggtcgaacaccaccggggtcacgccgttgcgcaccagcacgtcggcgcagccgaggccggccgggccggcgccgatcaccgcgacgcgcctgccggtcggcttgaccttggacaggtccggacgccagcccatggcgaaggccgtatcggtgatgtacttctccaccgagccgatggtcaccgcgccaaaaccgtcgttgagggtgcaggcgccctcgcagaggcgatcctgcgggcagacccggccgcagacttccggcagggtgttggtctggtgcgacagttcggcggcggccaggatgttgccttcggaaaccagcttcagccagttagggatgaagttgtgcaccgggcatttccactcgcagtacgggttgccgcagcccaggcagcggtgggcctggtcggcggcctgctgcggcttgaacaggtcgtggatctccacgaactcgcgcttgcgctggcgcagcagcttcttcttcgggtccttgcgcccgacttcgatgaactggaagtcgttgttcaggcggtcggaattcagacgttcagacatatcgaaacctcatcacaacttcgggcgcttattgcgggttggcacgggtgctggtcagcagcgaaccgaggctggccgccttcggtttcaccagccagaaccgacgcaggtagtcatccaggttttccaggatgttcgcgccccactcgcttgccgtttcgttcacgtactcgaccaggaccttgcgcaggtggctgcgataggcctccatcgcctcgccgctga

SEQ ID NO: 15996 - DNA, 387 bp, Pseudomonas aeruginosa
aacggaacaccaccggtgccttggccatgccctggttgccgtgcaggcgggcgatctcgccggatacccgcgcgccgatggatcggtcgcagttgcagatgtccagctcgtactcgccgccgctcaggccttcgatggcggccttcgacagctcgaccatcttctcggccagcaggccctggtcgaacggcgggtttttctccacctcgcagaactgcggcttgtcggccgggatcagctcactgcccagcaacggagcgagatccagattctgctgcttggcggtctcgccggggaggatctccagcaggtcggtgcggccgatcagctcgcccaggctgcgcacgccgaggcgcgccagccactcgcgggtttccgtggcgatga

SEQ ID NO: 15997 - DNA, 2874 bp, Pseudomonas aeruginosa
ccttgccgcccggcaactggccgccctcgccggggcatgggggccctgggccaccttgatctgcaggacctcggcgttgaccaggtattccggggtcacgccgaagcggccggtagccacctgcttgatcttcgaactcttcagcgtgccgtagcgcgccgggtcctcgccgccctcgccggagttggagcgaccgcccagggtgttcatcgcctcggccagcgcctcgtgggcctccggcgacagcgcgccgagggaaatcccggcggcatcgaagcgcttgaagatggcttccagcggctccacctcgtcgagcgccagcggctgcgcggcggtcttcacctgcaacaggtcgcggatcatcgacactgggcgctggtccaccagcgcggtgtattccttgaacttctcgtagtcgccctgctgcacggcagcctgcagggtattcaccacatccgggttgtaggcgtggtattcgccgccatagacgaacttcagcaagccgccctgctggatcggcttgcggttgctccaggcctcggcggccaggagcttctgctcgttctcgatatcgacgaagcgcgcgccctggatgcggctggcgactccggtgaagcacaggtcggtgacctcgtcggacaggcccaccgcctcgaacagctgcgcgccacggtaggacgcgacggtggagatgcccatcttcgagagaatcttcatcaggcccttggagatccccttgcggtagtacttgaacacctcgtagaggtcgcccagcacttcaccggtgcggatcaggtcggccagcacctcgtaggcgaggaacggatagaccgccgaggcgccgaagccgatcagcaccgcgaaatggtgcggatcgcgggcggtggcggtctccaccaggatgttggagtcgcagcgcagcccggtctgcaccaggcggtgatgcaccgcaccgacggccagggcagcatgcaccggcagtttgccgggagcgatatggcggtcgctgaggatcagcagcaccttgccgccgcgcacggcctcctcggcctggtcggcgatgttgcgcaccgcggcctccaggcccatcgactcgtcgtagttgaggtcgatgaagtggcggtcgaagcccgggcggtccagggtcatgatggtccgccacttcgccggcgagatcaccggagtggtgaggatcgcctggttggcatggtgcggggcttcctcgaagatgttctgctcgacgcccaggcaggtttccagggacatcacgatggcttcgcgcagcgggtcgatcggcgggttggtgacctgggcgaattgctggcggaagtaatcgtacggagagcggatgcgccgggagaggatcgccatcggcgtatcgtcgcccatggagcccaccgcttcctggccctgctcgccgagcggacgcagcacctggtcacgctcctcgaaggtgacctggaacatcttcatgaattgcttgagctggtcggcgtcgtagctggccacgccatggtcgtcgtccagggtcgcctggatgcgcagggcattctgccgcagccactgcttgtagggatggcgcgacttcaggcggttgtcgatgtcgtcgctgtgcaggacctggccggtctcggtgtccaccgcgaggatctgccccgggccgacgcgccccttggcgatgacgtcctcgggcttgtagtcccagacgccgatttccgaagccagggtgatgtagccgttcttcgtggtgacccagcgcgacgggcgcaggccattgcggtcgagcaggcagacggcatagcgaccgtcggtcagcacgacgccggcggggccatcccagggctccatgtgcagcgagttgtactcgtagaacgcgcgcaggtcggcgtccatggtttcgacgttctgccaggccggcgggatgatcatgcgcaggccgcggaacaggtccatgccgccggtgaccatcagttcgagcatgttgtccatgctcgacgagtcggagccgacgcggttcaccagcgggccgagctcttccaggtcggggatcagttcgttggtgaacttggtccgccgcgcctgggcccagttgcggttgccggtgatggtgttgatctcgccgttgtgggcgaggaagcggaacggctgcgccagcggccatttcggcagggtgttggtggagaagcgctggtggaatacgcagatcgcggtctgcaggcgctcgtcgccaaggtccggatagaaggcggccaggtcggccggcatcatcaggcccttgtagatgatggttttgtgcgaaaagctgcagatgtagtggtcgctgtcggcggcgttggccaccgacgagcggcgccgtgcgctgaacagcttgatggcgaagtcctggtcgctcaggccggcgccgccgatgaacacctgttcgatctgcggcagacgctccagcgccaggcggccgagaacgctggtatcgatcggcaccttgcgccagccgaccagctccagtccggcggcgacgatctcgcgattcatgttctcgcgtgccgcctcggctttcaccgggtcctggttgaagaacaccatgcccaccgcgtattgctcgggcaggtcgacagaaaaggcttccctggcgacggcacgcaggaacaggtcgggcttctggatcagcagcccgcagccgtccccggtcttgccatcggcattgatcccaccgcggtgggtcatgcaggtcagtgcttcgattgcggtttgcagaagttgatggctcggctcgccctgcatatgggcgatcaggccaaatccgcagttatccttgaacgtttcaggatggtacagacctgctttcataaggaactctcaccggcaaaacttttttag

SEQ ID NO: 15998 - DNA, 477 bp, Pseudomonas aeruginosa
atgttctcgaccttggcgcccatgctcaccagcagcttcatgcaggagatggcggcagcgccggcgccgaggcagacgatcttcgcttcttccagcttcttgccggccagttccagcgcgttgagcatgcccgccgcggtcacgatggcggtgccgtgctggtcatcgtggaacaccgggatgtcgcactgttcgatcagcgcgcgctcgatctcgaaacactcgggagccttgatgtcctcgaggttgataccgccgaaggtgatggaaatacgcttgacggtatcgatgaaagcctgcgggctctcggcgtcgacctcgatgtcgaacacgtcgatgccggcgaagcgcttgaacagcacacccttgccttccatcaccggcttggaggccagcgggccgaggttacccaggccgagaatcgcggtgccgtcggaaatcactgccaccaggttgcccttgccggtgtactggtag

SEQ ID NO: 15999 - DNA, 1698 bp, Pseudomonas aeruginosa
cccctcgccgccagccgccaattgctccagcgtctgccccgccttgacctgcaccaggtgcaggcgtcgcggctgcgccagggcccgctccttgtcgcgcagcggacggaagctgcggatcacgctgaggaagcggtcgtcctgggtctccagggaaccgaccttgaccacgccgacgaacaggtaggcgcggtcgccctggtagatcacagcaacccgtcgcgccgggttgcctggcaccaccgccgtgtagccgttcagtcctgcctgcttcagcgactcttcctgggccagccgttgcccggcgttcttgcgcaggaactccgcgggcgtcaggcgggaatcatggggcaccagcttcatgccgatgaacgactgctcgtccgccggatagccaagcagggcactgggctggttgaggatcttccagcccgccggatagctcagggtgaagtccagctcggcatggtagaagttctgcccgcgacgcaccccggccgatgccgagtcgccgaacggcatgccttccagatggcgaagaaagacctcgcgccccacttcctgctgtccgttggccagttgccgggccgggccgaccacttcctgcagacgccggtcgttgtccggatgggtatcgaacaacccgtggtagccgccggcctgtaccgcctggccattgcgcgcagcctcttcgcgagcgaagtcctcctggttcttcagcacccgcaccacctggatcatcgccgtcggatcgtagccggcgcgggccaggtactgagcgccgagaccatcggcttccagttccatgtcacgcccgtagccgcggacgaaggccgtgccgagcacgttggccaggtcgccggcggcaccgaccccggtgccgatcgccaccgcctggccaaggatgttccaggcgctggcctggctctgctggcgcacgctgtggcgcgccgtgacgtggccgacctcatgaccgagcaccgcggccagttcggcctcggagccaaggtaggcgatcagtccgcgatggatatagatgtagccgcccggcagggcgaaggcgttgatgtccggcgaatcgatgacggtgaaatgatattgcagattgctgcggtggctgctgcgggcgacccgctcgcctacccgttgcacgtaggcctggagcttttcatcgttgtagcgggggaactgcttgaggatttcctggttgtagcgagcgcccatgccgagttcctgctgctcgctcatcatcacgaaatcgctcttgccggtggccgggttcaccgcgcagccgcccagcgcgccgactcccagcaacagcagcaggagccaggcggtcttcatggcaaccattccagcatcgccggatcggtcaccgacatctgccagcgcgccttgccggccggcacagcgccacggcgggaacgatcgaccacccagccacgcacttccagcgaacgtcccgccatctgcatcacccgtttcgcatcgaacgccttgagcaccttcggctcgatccgcaggaccagcggaccgtccatctccagccagataccgccccggttgagttcgacctcgagcacccgcccgcggaccacggcgaagccgctctgcgccagtcgatcgagcgaaagcaccggcgaacgcttccatacacccagattagccgaacgcgctgcacgttccgccgcttgctga

SEQ ID NO: 16000 - DNA, 753 bp, Pseudomonas aeruginosa
agactctggaacgcatgtaatcgaacccgcccgaacaggagtccgggaacccccatggcaaagaagaaacccgcccccaagcgcggcgccagccgctaccaggcgcccgccgcgaagaacggcgttcccggctgggtctggctggtcgccggcctggccatcggcggcttcatcatgttcctgatgaagctcgaacccgggcgcaaggacgtccagcgcgaacgcccggacgcccagcgcccggccgccgccgtgcagggcaagcagccgcagcagaacggccaggcccagcagcccgcgcaaacgcagacgccggcccaggccaagccgaagtacgagttctacaccctgctgccggagtccgaggtcgtggtgccgccggaagcggtaccggagaaggccccgccgccgcccacccccgccgaactggccaaggccgacgaagcgcgggccaaggccgcactcgccgggcaggtgccaccgccgctgccgaaagcggtggtcgccgccagcacgcagttcttcctgcaggccggctcgttccgcaagcagtccgacgccgaccgcgtgcgcgcgcagatcatcctgctcgggcagtcggtgaacgtcgaggccggcaacgtccgcgacgagacctggtaccgggtgatggtcggcccgttcaacagccgcgaccagttgtcccaggcgcagaagacactgtcctccaacggcttcagcaacctgctgttacagcaacgcaaggcccgctga

SEQ ID NO: 16001 - DNA, 540 bp, Pseudomonas aeruginosa
tcgatgccggctacgtcaacagccacctcggcgagctggccgaggacgaggacctgtcccgctacatcctttgaccaccgccgccgccacggccaacaccgtggcggcgggccgcgcggtcccgaaccggggtatccttgtactccgcccttccgcgagtccgatgcgatgcgtatcccttccgccatccagctgcacaaagcctcgaagaccctgaccctgcgctacggcgaggatagctacgacctgcctgccgagttcctccgcgtgcattcgccctcggccgaggtccagggccacggcaacccggtattgcagtacggcaagctgaacgtcggcctggtcggcgtcgaacccgccggccagtacgcactgaagctgagcttcgacgacggccacgacagcggcctgttcacctgggactacctgtacgagctggcgacccgcaaggaccagctatgggccgactacctggcggagctggtcagcgccggcaagtcgcgcgaccccgacgagtcggtcgtcaagctgatgctctga

SEQ ID NO: 16002 - DNA, 1449 bp, Pseudomonas aeruginosa
cgaccgacgcttttccgatccggcctggagccagaatccactgtacaagcgctacatgcagacctacctggcctggcgcaaggagctgcacagctggatcagccacagcgacctgtcgccgcaggacatcagtcgtggccagttcgtcatcaacctgctgaccgaggcgatgtcgccgaccaacagcctgagcaacccggcggcggtcaagcgcttcttcgagaccggcggcaagagcctgctggacggcctcggccacctggccaaggacctggtgaacaacggcgggatgccgagccaggtggacatggacgccttcgaggtgggcaagaacctggccaccaccgagggcgccgtggtgttccgcaacgacgtgctggaactgatccagtaccggccgatcaccgagtcggtgcacgaacgcccgctgctggtggtgccgccgcagatcaacaagttctacgtcttcgacctgtcgccggacaagagcctggcgcgcttctgcctgcgcaacggcgtgcagaccttcatcgtcagctggcgcaacccgaccaagtcgcagcgcgaatggggcctgaccacctatatcgaggcgctcaaggaggccatcgaggtagtcctgtcgatcaccggcagcaaggacctcaacctcctcggcgcctgctccggcgggatcaccaccgcgaccctggtcggccactacgtggccagcggcgagaagaaggtcaacgccttcacccaactggtcagcgtgctcgacttcgaactgaatacccaggtcgcgctgttcgccgacgagaagaccctggaggccgccaagcgtcgctcctaccagtccggcgtgctggagggcaaggacatggccaaggtgttcgcctggatgcgccccaacgacctgatctggaactactgggtcaacaactacctgctcggcaaccagccgccggcgttcgacatcctctactggaacaacgacaccacgcgcctgcccgccgcgctgcacggcgagttcgtcgaactgttcaagagcaacccgctgaaccgccccggcgccctggaggtctccggcacgcccatcgacctgaagcaggtgacttgcgacttctactgtgtcgccggtctgaacgaccacatcaccccctgggagtcgtgctacaagtcggccaggctgctgggtggcaagtgcgagttcatcctctccaacagcggtcacatccagagcatcctcaacccaccgggcaaccccaaggcacgcttcatgaccaatccggaactgcccgccgagcccaaggcctggctggaacaggccggcaagcacgccgactcgtggtggttgcactggcagcaatggctggccgaacgctccggcaagacccgcaaggcgcccgccagcctgggcaacaagacctatccggccggcgaagccgcgcccggaacctacgtgcatga

SEQ ID NO: 16003 - DNA, 1017 bp, Pseudomonas aeruginosa
acgatgaaaagcgaccagcctgaagaacagccgcaggagcgatccgcggcctccgccgacgaaaccccgccagcgcctccggcgcggccccgtgccgcgcggaagccggccaggccccgtatcgccgagcccgcggctgcgccgccgaggaccccgagcatgccccagcccttcgtcttccggaccatcgacctcgacggccagaccatccgcaccgcagtgcggccgggcaaggaaggaagcactccgctgctgatcttcaacggcataggcgccaacctggaactggtgttccccttcgtccaggcgctcgacccggaactggaggtgatcgccttcgacgttcccggcgtcggcggttcctcgacgcccagcgtgccctaccgctttcccggcctggccaagctggcggcgcggatgctcgactacctggactacggccaggtcaacgcgatcggcgtgtcctggggcggcgcgctggcccagcagttcgcccacgactatccggaacgctgcaagaagctgatcctcgccgccacttcggctggcgcggtgatggtgccaggcaagccgaaggtactgatgcgcatggccagcccgcggcgctacatccagccctcctatggcgtacacatcgccccggacatctacggcggggccttccgccgcgaccccaagctggccatggcgcatgccagcaaggtgcgttcgtcgggcaagctgggctactactggcaactgttcgccgggctcggctggaccagcatccactggctgcataggatccgccagccgaccctggtgctggccggcgacgacgacccgatcatcccgctgatcaacatgcgtgtgctggcctggcgcattcccaacgccgaactgcacgtgatcgacgacggccacctgttcctggtgacccgcgccgaatcggtggcgccgatcatcatgaagttcctcgccgaggagcgccgccgcgccgtcatgcaccctcgtccgttcctgcccaagaccggctga

SEQ ID NO: 16004 - DNA, 1749 bp, Pseudomonas aeruginosa
gtattccgagccaggggacgatcgcccgtggcatccagactgtggtcctacgacggagtgtggtccatgcgagaaaagcaggaatcgggtagcgtgccggtgcccgccgagttcatgagtgcacagagcgccatcgtcggcctgcgcggcaaggacctgctgacgacggtccgcagcctggctgtccacggcctgcgccagccgctgcacagtgcgcggcacctggtcgccttcggaggccagttgggcaaggtgctgctgggcgacaccctgcaccagccgaacccacaggacgcccgcttccaggatccatcctggcgcctcaatcccttctaccggcgcaccctgcaggcctacctggcgtggcagaagcaactgctcgcctggatcgacgaaagcaacctggactgcgacgatcgcgcccgcgcccgcttcctcgtcgccttgctctccgacgccgtggcacccagcaacagcctgatcaatccactggcggtaaaggaactgttcaataccggcgggatcagcctgctcaatggcgtccgccacctgctcgaagacctggtgcacaacggcggcatgcccagccaggtgaacaagaccgccttcgagatcggtcgcaacctcgccaccacgcaaggcgcggtggtgttccgcaacgaggtgctggagctgatccagtacaagccgctgggcgagcgccagtacgccaagcccctgctgatcgtgccgccgcagatcaacaagtactacatcttcgacctgtcgccggaaaagagcttcgtccagtacgccctgaagaacaacctgcaggtcttcgtcatcagttggcgcaaccccgacgcccagcaccgcgaatggggcctgagcacctatgtcgaggccctcgaccaggccatcgaggtcagccgcgagatcaccggcagccgcagcgtgaacctggccggcgcctgcgccggcgggctcaccgtggccgccttgctcggccacctgcaggtgcgccggcaactgcgcaaggtcagtagcgtcacctacctggtcagcctgctcgacagccagatggaaagcccggcgatgctcttcgccgacgagcagaccctggagagcagcaagcgccgctcctaccagcatggcgtgctggacgggcgcgacatggccaaggtgttcgcctggatgcgccccaacgacctgatctggaactactgggtcaacaactacctgctcggcaggcagccgccggcgttcgacatcctctactggaacaacgacaacacgcggctacccgcggcgttccacggcgaactgctcgacctgttcaagcacaacccgctgacccgcccgggcgcgctggaggtcagcgggaccgcggtggacctgggcaaggtggcgatcgacagcttccacgtcgccggcatcaccgaccacatcacgccctgggacgcggtctatcgctcggccctcctgctgggcggccagcgccgcttcatcctgtccaacagcgggcacatccagagcatcctcaaccctcccggaaaccccaaggcctgctacttcgagaacgacaagctgagcagcgatccacgcgcctggtactacgacgccaagcgcgaagagggcagctggtggccggtctggctgggctggctgcaggagcgctcgggcgagctgggcaaccctgacttcaaccttggcagcgccgcgcatccgcccctcgaagcggccccgggcacctacgtgcatatacgctga

SEQ ID NO: 16005 - DNA, 1530 bp, Pseudomonas aeruginosa
aagatccggcccgggcgcctggagccgggcacctccatccccagaagaagtccggatgaagacacgcgaccgaatcctcgaatgctcgctgttgctgttcaacgaacagggcgagcccaacgtctcgacactggagatcgccaacgaactgggcatcagcccgggcaatctctactaccacttccatggcaaggaaccgctggtgatggcgctgttcgagcggttccaggccgagttggcgccgctgctcgatccgcccgaggaggtgcgcctgggcgcggaggactactggctgttcctgcacctgatcgtcgagcgcctcgcccactaccgcttcctgttccaggacctgtccaacctgaccgggcgcctgccacggctggctcgcggcatccgtacctggctcggcgcgctgaagcggaccctggccaccctgctggcccgcctcaaggccgaccggcagttgcgcagcgacgcgccggcactcgggcaactggtcgaacagatcaccctgaccctgctgttctccctggattatcagcgggtactgggcagcaagggcgaggtgcgcacggtggtctaccagatcatgatgctggtcgccccgcatctgcgcagcgaggcccaacgctcggcggaaagcctggcgcagcgctacctgggaccggaatgaaaaacgcccggcgagtgccgggcgtgtgccttgccgccaggactcagccctggctgctcggcgtcgccggagcgttcgctgccggagcgctggcagccggtgtggcggcgggggcagcgggcgcgctcgaagacgcggcgggagcggccggtttcgccgcggcgggcttggctgccggcttcttcgccgcaggctttttcgcagccggcttggcggcaggtttcgccgcgggcttggcggcggtcgcagcggccggcttggctgcggcaggtttcgcagcaggcttcgccgcggccttggctgccggcttggtcgccggtttcgctgcggccttcgcagtcggtttggcggcgggcttggctgccggcttggcggccgcggttttcgccgcgggttttttcgccgcgggtttcgccgcaggcttggcggcggccttggctgccggtttagctgccggcttggccgctgcggttttcgccgcgggcttggcagccggtttcgccgcaggcttggccgctgccttcgccgccggcttgacgctgacgccggtgagtttctcgatctgcttggtcagcgtatcgaccttgctgtgcagctccttcacctcgttgcggctcggcacgccgagacgcgagatggcgctgttcaggcgcttgtcgaaagcttcctcgagctcgctccacttgccgagcgcacggtcccgaacctcgtcgaccttgctcttcgcagagcgggcggaagccttcgccgcaccgacctgcgcgtccacatcggacttcgcttctttttcagccttctcgccgtctttcaccaaggtctcgaacagcttgctgccgtccttgctgaccttcgagtag

SEQ ID NO: 16006 - DNA, 630 bp, Pseudomonas aeruginosa
tgtccggtggcatccatcgcctgtggaagcgcttcaccatcgagctgtccggcgtgcgcagcgggaaccgcgtgctcgacatcgccggcgggcaccggcgacctgacccggcagttctcgcgcctggtcggcccgaccggcgaggtggtgctggccgacatcaacgcctcgatgctcaaggtcggccgcgacaagctgctcgacaagggcgtctccggcaacgtcagcttcgtccaggcggacgccgagaagctgcccttcccggacaaccacttcgactgcgtgaccatcgccttcggcctgcgcaacgtcacccacaaggacgaagcgatccgctccatgctgcgcgtgctcaagcccggtggccgcctgctggtgctggagttctccaagccgagcagcaacctgctgtccaaggcctacgacgcctattcgttcagcctgctgccgctgatgggcaagctggtcaccaacgactccgagagctatcgctacctggccgagtcgatccgcatgcaccccgaccaggaaaccctgaaggcgatgatggtggaagccggcttcgaccgcgtgacctaccacaacatgaccggcggcatcgtcgccctgcaccgcggtatcaagccttaa

SEQ ID NO: 16007 - DNA, 1785 bp, Pseudomonas aeruginosa
agctggccctcgatcgtctcgacgcgcgcgtcggacgcctcagccaaaagaccaagcccgacgcatgaagctcctcgctgtccgccgcctcctgcgcatccagcgcgtcgtcatccgctaccgcctggacgacctgatcctcgaactgccgatgctgccctggtggctgcgcctgctcggtgccaccctgccctggcgctggctgccgcggcgcaagctggaactgacccgcggcgcgcgcctgcgcctggcactgcaggacctcggaccgatcttcatcaagttcggccagattctctccacccgccgcgacctgctgcccgacgacatcgccaacgaactggcctggctgcaggacaaggtgccgcccttcccgccggagctggcggtcaagcgcatcgaggaacagctgggcgcgaagatcgaacaggtcttcgcccgcttcgaacgcgaaccgctggcctccgcctcggtggcccaggtccacgccgcgcgcctgaagagcggcgaggaagtggtggtgaaggtgatccggccgaacctggaaccggtgatccgctccgacatcgcctggctgttcatcctcgcccgcctcgccgagcgggtctccagcgaggcgcggcgcctgcacccggtggaagtggtcagcgactacgagaagaccatcgtcgacgaactcgacctgctccgcgaggcggccaacgcctcgcagctgcgacgcaacttcgaaggctcgccgctgctctacgtgccacaggtctactgggactggtgccggcccaaggtgctggtgatggagcgcatctacggcatcccggtgaccgacctggaaaccctgcgcgaccagcgcaccgacttcaaggcactggccgagcgcggcgtggagatcttcttcacccaggtgttccgcgacagctttttccatgccgacatgcaccccggcaacatcttcgtcagcacccgcgcgccctggagcccgcaatacatcgcggtggactgcggcatcgtcggcagcctgaccgacgaggaccaggactacctggcgcgcaacctgatcgccttcttcaagcgcgactaccgcaaggtcgcccaactgcatatcgactccggctgggtaccggcggaaaccaaggtcaacgacttcgaggcggcgatccgcaccgtctgcgaaccgatcttcgagaagccgctgaaggacatctccttcggccaggtcctgctgcgcctgttccagaccgcgcgtcgtttcaacatggagatccagccgcaactggtgctgctgcagaagaccctgctgaacatcgaaggcctcggccgccagctctacccggaactcgacctgtgggccaccgcccagccgttcctggagcgctggatgcgcgaacgggtcagcccgaagcagttgctgcgcaatttccagcaacaggtcgagcaggtgccgcacctgtcgcaaatggcccgcgacaccctcgaacgcctgtcacaaccgcacgcccacaatgcgccgccgccggagtggaaaggttcccgccacgactggctcgggcgcctggtgggcgcggtgctgctggtcggcgccgccgaggtcggcctgggtcagcagctggaagcctggccggcgtgggtgatgctggccggcggggtgttcctgatcctgcgccgctagcgccgcgcacggccactaggcccgcgccgatagccagtcgcgctcccggctggcacactactcccatttccgccggaaacgcgcgcaacgtaccggcaacgaacgtggaaagaccatga

SEQ ID NO: 16008 - DNA, 441 bp, Pseudomonas aeruginosa
aggacccggacgctatctacgaacacgcaggacaccaccatgagtgacaccctgacccgcctggcggcggtgctcgaggagcgcaagaacgccgcgcccgacagctcctacgtggccagtctgtaccacaagggcctgaacaagatcctggagaaggtcggcgaggagtcggtggaaaccatcatcgccgccaaggatgccgcagccagcggcgactgccaggacctgatttacgaaaccgccgacctctggttccactcgctggtgatgctctcggccctcggccagcatccgcaagccgtgctggacgaactggagcgccgcttcggcctttcccggccacgccgagaaagccgcccgccaaccatcggcctgaacctacacattgcgaggaatacgacatgggcatttttgactggaaacactggatcgtcatcctga

SEQ ID NO: 16009 - DNA, 432 bp, Pseudomonas aeruginosa
ccatcgatgttcggaatcagcttcagcgaactgttgctggtcgggctggtcgccctgctggtgctcggccccgagcgcctgccgggcgccgcacgtaccgccggcctgtggatcggccgcctgaagcgcagtttcaataccatcaagcaggaagtggaacgggaaatcggcgcggacgagatccgccggcaactgcacaacgagcacatcctctcgatggagcgcgaagcgcagaagctgctggccccgctgaccggtcagaatcccccgcaggaaaccccgccgccggcggccgagagcccggcgccgagcgtacccacgccgccgccgaccagcacgcctgcggttccgcccgcggacgccgcggcaccgccggcagtcgctgcctccactcccccttcgccaccgtccgagacgccgcgtaatccatga

SEQ ID NO: 16010 - DNA, 426 bp, Pseudomonas aeruginosa
tggacgccagcctcgcgcagcaggccggcgacccgcaggcgttgcaacgtagccgtgcggtggccgacctgcaccaacagttgctcatggtgcgttaccaggtgcgcggctacgtcttcgaacgcagcgacaaggccgagcaggccgcgttcgccgcgttcgacgccctccgccaggccgccacgacgctgcgtggccagttgcccggcgaggccgatgcggcgctggaacaggccatgggtagcctccagggctatcgtggcgggatcgagcagttccgtgccggcgtcatccgcacgcgccaggcgcagcaagcgatgcaaagcagcacccaggatatggcccgggccggccggaccctcaccgaagccggtcgccaattgcgcgagagcaccgccagccgcgaccgcgccagcctctggctga

SEQ ID NO: 16011 - DNA, 759 bp, Pseudomonas aeruginosa
acctgcagatcgccactgccgcggagcaacagagcacggtggccgaggagatcaaccgcagcgtcctcagcgtacgcgacgtcgccgagcagtcggccgccgccagcgagcagaccgccgcctccagcggcgagctggcgcgcctgggcacgcagttgcaggcacaggtgggacgcttccgcctgtaacatcccgagaggatcctccttgcatcggcagcccctcccgtccatcgaaagcggacaggaggggcacctttgcgtaggatcaggctttcgccttttgggagatgacgccatgcgcccgatgaccatcgatatcgacgaactggccttcgccctggataccccgggaatcgaccactacctcgacctgtacagcggcaaggtgctgctgatctccgccgaggcgcccgatcccgaactggacgcattgctggaaaacgagccggaacgcctgctgctgatcgacccgctgagcaccacccagtcgctgggactgatgcaggatttcctccgcgaggtggaagagccgcacgcctatgcgacgctcgccaacgcgctgcagagccgcaagccgttcaaggccttcaagcactctctgatggagtacccggaactgttgcaggactggtaccgctaccagaacgagcgcctgcgcgaatgggcgctggactggctggaggacaacgatatccagccggccgcgcggcagagtccgacgtcgctcctgccgccgccgggcaagccgttcgcctag

SEQ ID NO: 16012 - DNA, 201 bp, Pseudomonas aeruginosa
gcgcatgccagcggttctcgtaggtgtactcgtcggtggcgcgcagctcgcgcggcgtgtcgtactcctccgggatcaggaacagcttttcgtcgcgggcgcgcaggcccagcttcacccggctggagatcaccgataccgggatcgacaggatcagcgaaccgacgatcggcgacagccaccacaggaagcgcgggttga

SEQ ID NO: 16013 - DNA, 459 bp, Pseudomonas aeruginosa
agcggtccaccaccatggggttggggcgcagcgtggcggtgcggccctcccaggtcgaccaggccttggcggcgtgcatctgggcgatctggtcgctaccggtcaggcgcttgtggaaggccgccagcaggtcgccgcgctcttccggcgggatcggcgcgacatagtcttcccaatagtcggggaacaggcggctggcgccttcctggtagaaccagtggatgtcctgcggacggcaaaggaagatgccgcgcaggatcagcgcatggacccgctcgggatgggtctgcgcgtaggccagcgacagggtcgagccccaggaaccgccgaacagcacccacttctcgatacccaggtgctcgcgcaggcgctccatgtccgccaccagctcccaggtgctgttcttctccaggctggcgtggggcgtggaacggccgcaaccgcgctggtcgaaggtga

SEQ ID NO: 16014 - DNA, 1593 bp, Pseudomonas aeruginosa
agggcctgggcggcgacgagttcgatatccgcgaagtcggctggatcgcccgcgacgaactgcctggcctgccgtcgttctatccggccgaactggccgacgacgtctggtcgcgcctggacgcgccgacgccgtcgatccgccacctcggcctgcagcgctagacgctcactgcaccggatcgctggtggggttctcgaggatcgccttcagctccgcggtcatgggaaactccaggttcaaccccttgggcgggatcggctgctggaaccagcgctggtagatgccctgtatctcgcccgagcgatacagcccggccagggtctcgttgaccagggcaaggaactgcgggtcgtccttgcgcaccatgcagctgtagatctcccgcgattgcggctcgccgaccaccacccagtcgtgcggctggcgcgccttggcgcgttcgccgtagagcagcgcatcgtccatgtagaaggccaccgcgcgacccgattgcagcatctggaaggcttcgccgtggtccttggcgctgaccacgttcatccccagcttgtgttcggcgttgtagttcttcaggtagcgctcgttggtggtgccggcggtggtcaccacgttcttgcccttgaggtcgtcgaagtgggcgatgccgctgtccttgcgggtcagcaactggcccttgacgtagatgaagccgtaggagaacgccacctgtttctgccgctcggcggtgaccccggtggagccgcactccaggtcgacggtgccattctgcaccagagggatacgggtctgcgaagtgaccaggttgtacttcaccttgagttccggcttgccgagggtgcttttgagccgctccaccaccttgtcggccagttccaccgaatagcccatgggctggccgctgttatcgccaaggtaggagaaaggcaccgaggcatcgcgataacccagggttatcgtgccgttgtcggcaaccttcttcagggtgccgctgagttcctcggcctgcgcggcgccgatggcgagcgacagggagagtgcgagagtgctggatacaaggattttcatcggaggttctgcctcttttttcttatggctatggaaagtaagtcagcccctggccgccaccacggtgatctccaccagcaccgacggacgcgccagctccgcctggacggtggtccggctgggcgcctggccggtcggcaaccactgggtccagacctcgttcagggcggcgaaatcgcgggcgatgtccttcaggtagatggtcgcgctgaggatacgctccttgcgcgacccggcctcggccagcagcgcgtcgatcttcgccagcacctcgcgggtctggccatggatatcctcggcctggcccggcacctggccggaaagaaataccagggcgtcgaagcagaccgcggcggacaggcggtcattggtggcgatacgggtcggttccatgggagtgctccaggtcgaggggaattcagccagccagcgcgccgcgcggaagcaggccagaggtatcgatgctcggcgggcggcggccgatctgctcggccagcaggcgcccgctgccgcaggccagggtga

SEQ ID NO: 16015 - DNA, 855 bp, Pseudomonas aeruginosa
gttcgccacccgccgctggacgaagcggtcaacgtagtcgtcggccggctggtggaggatttcccgtggcgtgccgacctggatcagttggccgtccttgaggatcgcgatgcggttgccgatgcgtaccgcctcgtcgaggtcgtgggtgatgaagacgatggtcttgtgcagggttttctgcagttccagcaactggtcctgcatgtccgcgcggatcaacgggtcgagggcgctgaaggcctcgtccatgagaatgatctcggtgtcggcggccagcgcgcgggccaggccgacacgctggcgcatgccgccggaaagctggtgcggataggacttctcgtagcccttcaggcccaccgtggcgatccagtgcagggcccgctcgtggcactgcgcccggctttcgccgcgaaccttcaggccgtaggcgacattgtcgagcacgctcttgtgcggcagcaggccgaaactctggaacaccatgctgatcttgcgccggcggaattgccggagggcttccatgtcgtagcgcaggatgtcctcgccatccaccaggatctcgccgctggtggggtcgatcaggcggttgaaatggcgcaccagggtcgacttgccggaacccgacaggcccatgatcacgaagatctcgccagcaccgatggtcagcgacaggtcgttgacgccgaccacgcagccggtctgcgccagcacttcgcccttgctgcgtccctggcggataagggccagcgcggcatcggcgcgcgggccgaagatcttgaacacgttcttcacttcgatcttgttcatctgcgcaccgctcatttgctcgtctcgtgccgggaacggccatag

SEQ ID NO: 16016 - DNA, 225 bp, Pseudomonas aeruginosa
aacagccggatgcgcagcggcaccgcattgatcgcccgcgggatcacccgctgcgggtcctgcgcctcgccggcggtgatgccgaagatctcgatgccgccgaaggcgaataccaccagcgacagggaggcgaccagcccgggcccagccgttgggcaggaacccgccgtgctgccaaaggttgtgcacgccggtggcgggagtcgccgccgccgcccaagctga

SEQ ID NO: 16017 - DNA, 2004 bp, Pseudomonas aeruginosa
actggctgtagaggcggccgtggcgctcgttcgccgggatgtagtcgatcgagcgccgttcgatcagtggcttgctgtcgctgccctgggtcatgctgctgtactccgctgcggctcgcgcgccgccattcttgttgtggcctggtcgggacagtgggcggccgcccccacgccccgccggcgtggaggcggttttcgaggtcagcgctgggcggtgatcatcggcaggttcaggccctgctccttcgcgcaatcgatggcgacctggtagccggcgtcggcgtgccgcatcaccccggtacccgggtcgttggtcagcacgcgggcgatgcgttcggcggcctcgtcgctaccgtcgcagacgatcaccatcccggagtgctgggagaagcccatgcctacgccgccgccgtggtgcagcgagacccaggtggcgccgctggcggtattcagcagggcattcagcagcggccagtcggacaccgcgtcggagccgtcctgcatggcctcggtctcgcggttggggctggccaccgagccggagtcgaggtggtcgcggccgatgacgatcggcgcggacagctcgccgctgcgcaccatctcgttgaaggccaggccgagcttggcgcgcagccccaggccaacccagcagatgcgcgccggcaggccctggaagctaatgcgctcgcgggccatgtccagccaacggtgcaggtgggcatcgtcggggatcagttgcttgaccttggcgtcggtcttgtagatgtcctgcgggtcgcccgacagcgcggcccagcggaacggaccgatgccgcgacagaacagcgggcggatgtaggccgggacgaagccggggaaatcgaaggcattggccaccccctcttccttggccatctggcggatgttgttgccatagtcgaaggtcggcacgccctgctgctggaacgccagcatggcccgcacgtgtaccgccatggactgcttggcggccttgaccacggcggccgggtcggtctgcgcgcggtcgcggtactcttcccagctccagccggccggcaggtagccgttgagtggatcgtgggcgctggtctggtcggtgaccatgtccgggcgtacgccgcggcgaaccagttccggaaggatctcggcggcattgcccagcagggcgatggagatggccttgccttcggcggtgtagcgctggatccgcgccagggcgtcgtccaggtccttggcctgctcgtcgacgtagcgactgcgcaggcggaagtcgatgcggctctgctggcactcgatgttcagcgaacaggcgccggccagggtcgccgccagcggctgggcgccgcccatgccgccaaggccggcggtaagcacccagcggcccttgagattgccgtcgtaatgctggcggccagcctcgacgaaggtttcgtaggtgccctggacgatgccctggctgccgatgtagatccacgaaccggcggtcatctggccgtacatcgccaggcccttggcgtccagttcgttgaagtgttcccaggtcgcccagtgcggcaccaggttggagttggcgatcagcacccgcggcgcgttggcgtgggtcttgaacacgccgaccggcttgccggactgtaccagcagggtctcgtcgtcgttcagttgcttgagggtctcgacgatcctgtcgtagcactcccagttgcgcgcggcacggccgatgccgccgtaaaccaccagttccctggggttctccgcgacctccgggtcgaggttgttcatcagcatgcgcagcggcgcttcggtcagccagctcttggcggtcagcgtagtgccgcgcggggcgcggatttcaatatcgcggaatttgctcggggtggtcacggcaggctcctgggcgtggcgttcaacgggcggcgaccggcgagggtgcgcctgaattcggggacgaagcagaggtcgggctgggtctaccgaacacatctatgcttgtacatacaagtataa

SEQ ID NO: 16018 - DNA, 1296 bp, Pseudomonas aeruginosa
atcatccgcggcaactggtcgagcaacaggatcagcgccagccagccatcggcctcggccgtccactcctgcaagccgccgtccagcgcctggttcaccaggtcgccgaaacggccgccggcatcggcgtcctggcagacgttcttgccgaaccacaggccgttgcgctgggcaaccacctcggcggcgtcgctggaggtgccgaaccaccagtcgagcaaggtctcccagggcgcgctcatcggcctactccgcgtggtagccggtgatgcgctcgacttcctgcttcgagccgaggaacaccgcgacacgctggtgcaggttctccggcttgatgtcgaggatgcgctgggtgccgttggtggcggcgccgccggcctgctcgatgatgaacgacatcgggttggcttcgtacatcaggcgcagcttgccgggcttctccggctcgcgggcgtcgcgcgggtacatgaagacgccgccacgggtcaggatgcggtggacgtcggcgaccatcgaggcgatccagcgcatgttgtagttcttgcccagcgggccttccttgccggccagcagttcttccacgtagcgtttcaccggcgcttcccagtggcgctggttggacatgttgatggcgaactcggcggtgctttccggcacgctgatgttgtcgtgggtgaggacgaagctgcccagctcgcgatccagggtgaagcccttgacgccattgccgagggtcagcatcagcatggtctgcgggccgtagatggcgtagccggcggcgacctgggtggtgcccggctggaggaaggcttcctcgcgcagggtatcgttctggttcaggtactcgttggggcagcgcagcaccgagaagatggtgccgaccgagacgttgacgtcgatgttgctggagccgtccagcgggtcgaagaccaacaggtaggcgcctttcggatagcgccccggaatctggtaggggtggtccatctcctcggaggccatgccggccaggttgccggcccattcgttggcttccagcaggatctcgttggacatcacgtccagcttcttctgcacctcgccctgcacgttctcggtgcccatgctgccgagcacgccgcccagcgcgcccttggacaccgcatggctgatttccttgcaggcacgcgccacgacctcgatgaggaagcgcaggtcggccggggtgttgtggctgcgggtctgctcgatcagatagcggctcagggtaacgcgggacatggatggctccggagagaggaaaaaacccgcgcagtttaa

SEQ ID NO: 16019 - DNA, 894 bp, Pseudomonas aeruginosa
tcattctcttactccgtgatttgtttttattgtcgggccgccgcgtcgtcggcatgcgccccggggcccgtcgtaaagcctcctcagccgaacagcatagcgcggaaccggctcatggcttgttcggcgaggaacgcagcaggctcattgccattattaccagcagagcgacccccagcagaagtaccgcccacaggccgatcttcttccagtcgctacccggtgccggcgccgcgaccgccatggccacctccagcggttcgcccaggctggcgctacccagggtggcgcgcttgctctcggtatagccgggaatcagtacgccgagcggcagcgccgccgactgcgcgccaggcttgccgaacgccagccggtacggcgggctgccacgcaccaggaacaccagttcgctggccggcaggccgacactcagggacgggacctccgggcccaggccggtacctcgttggtccacctgcagacgcagctcgcgcaccgcccagcccggcagttccagctcgttctgctgtacgttgcggccgtcgatcggcagccggtagagaaccccgcgtgccaggctgctccaggcggcctcccggcgcggcgaagcgttctccgtacgatcacggccggacagttccaccgggacgatggtgtgggtcagcgcctgctgcagggacacccgcacccgctgcaacggcaacgccagcggcaactgccagcggtactcgccgtcccccgcctggcgcccggccagcggctcggaccagatcatcggcgccggctcggtgctccgcgtgctgccttgcaggcgggcgccttggaggtctgccgcggttgccccagccggccaggccagacgcaggtagcgggcctggcggccgggaagcttga

SEQ ID NO: 16020 - DNA, 489 bp, Pseudomonas aeruginosa
aggtcaagcgggcgatctgtccgtccccccaggcctgccaatgctcgaggtcgtcgctggcttccacggagaagcgctggaagccctcctccgggctgctccagtccagccgcaggcgctccaggggaaacgtcaccgcgctcgcgtcgatcagccagccgcgcaaagtctcggcagccggcccggcgttttccggcagcacctcgactatggtgccgctggtgttgcgctgcacccgcaggttcggttgcgtcgcgtcggcggcggacgtgcctcgcaacgggaacagccgcacctcggcctcatgcggcgtgctggcctggcgctcgctgccggccaccagggtgtagggcaaggcctcgccttcggcatcgaagacccgcaggtcgcgcaggtcggcatgggcagccgacaactgcacgctcatcgggatgctcaggcgataccagggaccttcgccctgcagcgacagcgccacctggcggctga

SEQ ID NO: 16021 - DNA, 714 bp, Pseudomonas aeruginosa
gaagtagccgacgaccagcaacaggacgccgaccccgatgaaggagatgattcgctccaggctgccactgttgcccagctcgacgaagaacagcttgaccaccacgacgccgaccagcgccgcgccgaccatccacaggtcgcgccggccgagacgggtaccggcgatggtcaggcccagcgcacagagcgtccagaccagcgacagccccgcctgcaccagcatcgacgcggccagcgcctcggcctggaacggtacgccggccaggtggtgcgcggcgcggcacaccgccagggtcagcagggcgaacagcgaggcgccggccaacgcctggcgccccaggcgcgcgctggcattgccatcgacgagcgaggccaggctggcgtcgctccagcggtagagggcgaacagcacgatcagcagccccagttccagcgggttggccagcggcaggtaaggcagcggctcggcagcgccgtcgctgagcaggttggcgctccagaaccagccgagcagcaacagcgccaccggcgcagcggcgagcagccgatactcccgcgggaagtcgcgcagcggccagggcaggctccgcccgccagccaccagcagcaggtaggcgctcgggaccaacgcccagcccagccaacgccaggcgttgtactgttcggcgagcagggcgaacaggtagcgcagctccagcgccagcacccctag

SEQ ID NO: 16022 - DNA, 882 bp, Pseudomonas aeruginosa
caacgcatgctcgcgcaggccataaggcacgaagcggacggtttcgcacagcgcggtcagcgcccaccagccggctccccagagcagcagcaagtgcgacagctcggccaggccgagggtaccgatacccagcgcccgctcgcgctcgccggcgcggcgcagccgccaggcgccgaccagcgccgccagggccagcactgccggcgtccagaacccggaatgggccaggggccgcaggccttcgccgctcagcgagccgaacagcgacggcccggcgaggaggaacgccaggccgcccactacctgcaaggcgaggccgaagtagaagctcaggcgctggcgcagcaccaggctcagccagatgatcagcagcccgctaccggcccataccgcgctggcgctgcgccaaggcaggacgaacagcactgccaggttgacgaacgccagaccggccagcagcaccaggctcaagcccatgagcagccgactgtcgtccttcaccagcgggtcgcgcgccgccagcagcatgccgccgatcagcgccaggccaatcagcgaggcggtcatcaagccacgccagcccgagtcgaataccccaccctggccatcgccgccctgcaaatgcaggaggaacagcgcaccgcccagcagttgcacggcgaaggcgcagaacaggaaggtacgcgagcccaggcgcaagccggcgaacaagctcgccaggccgggccacggcccaggcgatggcggtgccgtcgacggccaggcagagcggtgcgaccaggtagaggaaggccaggccggcggccgccagcaacggccggcaggccggctcccagtcggccagcgctttcgccggcgcgcgacgcagctgccagaagctga

SEQ ID NO: 16023 - DNA, 378 bp, Pseudomonas aeruginosa
acagcgctacatggttgccgctgccggtggaggtcaggatcggcgcggcgaagccgccgagcgccgccaccaccgccaggcccatggcgttctgcagcacggcgaggatcgccgagcagatcatcaccaccaccagcagggccagcgccgcgccgggagagatcagcggatgcaggcgcatggcggcgaagatggtcaggtacagcaccgcgataccggtgccttgcaggatcaggccgtaggcggcgcgccgctcgcgcagccaccagccgacgccgagcagcgccatcgctgccagcgccaccccggcgtagcggtactccaccggcaccgccacccgttccgaggcatagcgcaggaggaaggccaggccgatga

SEQ ID NO: 16024 - DNA, 459 bp, Pseudomonas aeruginosa
tcttccacttcaagtcgacttgaggtcaagggcatgcggcaactggacataggcgaggtcgcgcgacgatccggggtaccggcctcgaccctgcgctactacgaggaaaagggactgatcgcctccagcggccggcacggcctgcgccggctgttcgatgcaggcgtgctggagcggctggcgctgatcgggctgggccgcgccgccgggttgtcgctggacgagattgccggcatgggcgcagccgacggcgcgctgcggatcgaccgcgcggcgctggcggccaaggccgacgaactggaccggacgatccgccgcctcgccgccatgcgcgacggcctgcggcatgccgcggcctgtccggcgcgcgagcacatggactgcccgacgttccgccgcttgctgcgggccgctgccgcgggggccatcaagccacgccggaaagcgcccggcgcatag

SEQ ID NO: 16025 - DNA, 558 bp, Pseudomonas aeruginosa
ggctcctgcttctcgccgtccttctcgatgatcaccacttccgggcggcccacggccagctcgaagccttcgcggcgcatggtctcgatcagtaccgacaggtgcagttcgccacggccggaaaccttgaacttctccgggctgtcgcccggctcgacgcgcagcgccacgttatgcagcagttccttctccaggcgctccttgatgttgcggctggtgacgaacttgccttcgcggccggcgaacggcgaatcgttgacctggaaggtcatgctcacggtcggctggtcgacggtcagcggcggcagcgcctcgacgttctgcgggtcgcacagggtatcggagatgaacagctcctccatgccgctgacgcagacgatgtcgccggcttccgcctcggccacctcgacgcgctgcaggccgtggtggcccatgatcttcaggatgcggccgttgcgcttgctgccgtcgtcgctgatggccaccaccggggtgttggacttgaccttgccgcgggtgatgcggccgataccgatcacgccgaggaagctgttgtag

SEQ ID NO: 16026 - DNA, 258 bp, Pseudomonas aeruginosa
acgatcgggaagtcgagttgctcgtcggtggcgccgaggttgtcgaacaggtcgaagatctggtcgatgacccagtccggacgcgcgcccgggcggtcgatcttgttcaccaccacgatcggacgcaggccggccttgaaggccttctgggtcacgaagcgggtctgcggcatggggccgtcctgggcgtcgaccaccagcagcacggagtcgaccatcgacatcacgcgctccacctcgccgccgaagtcggcgtga

SEQ ID NO: 16027 - DNA, 420 bp, Pseudomonas aeruginosa
ccgttccacttgatcgcggtgttcttcgccaggatggtgatgccacgctctttttcctggtcgttggagtccatcacccgctcgctttccgcttctttgcggtcgagggtgccggacagcttcagcagcttgtccaccagggtggtcttgccatggtcgacgtgggcgatgatggcgatgttgcgcagattttcgatcacaagtcttgtctcgtttaacgcccgaagcgcggcttcgcggcggtggtggggtcggacagggcggcgcccgacacgacaggcttcttcaattaaggggcgggcagcaggcggacgctgccccggtccggccggcacgccgaagggcgggcatcggcctaggcggcggacgtgtcgggaggacggtggcggatgctgccgccgaacaagcccggctgcttaa

SEQ ID NO: 16028 - DNA, 414 bp, Pseudomonas aeruginosa
ggaccgtccatgcgtcactctctctggctcctgcttgccgccatcctcagcctgcccgcccaggccggcaccgaatgccgcgatatccacgaccgcgacctgcggcgcatgtgcaacgcactggaacgcggcgacagcggggattgcggcgacatcgacagccgcgacctgcggcgttactgcggcgcactgctggcgccgggacagcgctacgactgcgacgacatccgcgacggcgacacgcgccgccagtgccgcgccatcgtccgcggcgaccgcaagcgctgcgacgacatcgacagccgcgacatgcgccgccagtgccgggccgtggtatcgcgtgcgccgtggcagtgcgacggcatcgacgaccgcgacatgcgccgcatctgccgggtcatcctgtcgcgctag

SEQ ID NO: 16029 - DNA, 333 bp, Pseudomonas aeruginosa
  unsure (314): Identity of nucleotide at the above locations are unknown.
tcgtcgatcgacagcgagtcctcgatgatgatgaacaggccggtgatcaggtccgccaccagcgactgcgcgccgaagccgatggccaggccgatcacgccggcaccggccagcaacggggtgacgttcatgcccatgttggccagggcgacgatcagggcgagaaacgcgacttcgccgaatggcaggcggtgttcgccgccctggatgcctgcgtggagccgctgctgccgctctccgaggcgctggaacacccgcagttgcaggcgcgcgggctggtcgcccgggtgccgctggcggacggcggcagccangcgcagatggcctgtccga

SEQ ID NO: 16030 - DNA, 555 bp, Pseudomonas aeruginosa
cgcagtcggccgcctccaccgccgcgcgcaacccgtcggccgctcgcgccgggtagccctcctcgcgcagccgggcggccagcgcggcggccttggccggatcgcggccccagatgtcgatgtggcgatagtcgcgcacgcaggcgtgggcccgcaccatgtgcgcagccagggttccgcagccgaccaccagcaggcgccgcgcatcgtcccgcgccaggtagtcggcggccagcgccgagctgcaggcggtacgccgggcggtcagctccgaagcctccagcaacgccagcgggcgaccgtcttcgccgtcgaacagagcgaacaccgcggccaccgccggcaggccacgcgccccattgccagggaacaccgtcaccagtttcacgccgatcccctcaccggcctgccacaccggcatctgtagcagcgaggcctgcgccggcaaggcatggcagctgcgcagcggcgcactgcaaggcttggccaggccgatgcgcaacgcctcgatcagttgtggataagacaggcgctcggcgacctcggcgttgctga

SEQ ID NO: 16031 - DNA, 1404 bp, Pseudomonas aeruginosa
ggatcttgtcgctcatggcgccacccccttgcgcggggcgaagcccacccggctgatgcggatcagcccgcgcgcccgccagatcatcatcaccaccatgagtatcccgagcagcagcacgcggatgtcggcgaagctgcgcagcagctccggcgccacggtgaggacgaaggcggcgttcaccaccccgaccgtagagcccatgccgccgagcacgacgatggcgaggatcagcgccgactcgaagaagttgaacgaggacgggttgacgaagccctggtagctggcgaagaacaccccggccagtcccgcggtggaggcgccgagcatgaacgccgagagtttcaccagcacatggttgaggcccatcgcgcgacaggcgatctcgtcctcgcgcagcgcctcccaggcgcgcccgaccggcatccgggtcagccggtgcttgatgtagagcaccagcagcacgaccaggaacagcaccacgtagatgaacaggaacttcatgttggggttgtaggcgatgccgaggaactcgtggatcggcaccccgccatccttggcccggcggccgaactccaggccgaggaaggtcggcgccggcgccggcatgccgttcggcccgccggtgaaggacagccagttgttcagtaccaggcggatgatctcgccgaagcccagggtgacgatcgccaggtagtcgccatgcatgcgcaacaccgggaagccgaggatcgccccggccaccgcggcggtcagcgcggccagcggcaggacggtccagaagcccaggccgaggtactggtagcccagcgccaggccataggcgccaatggcgtagaaggccacgtagccgaggtcgagcagcccggcgaggccgaccacgatgttcaggcccaggcccagcagcacgtagatcaggccgaggatgaccaccgccagcaggtacttgctggcgaagaacgggaagatcaccgcggccaccaggatcagcggcacgatccagcgcaagcgggtcttgtagcccggcggcaggacgtggacgccgctgccagccccctcgaagcgctccagcacggcgcgcccgccgcgggtctgcaggtagaggatgagcaggaagcgcccggccatcacgatcgcgatgatccagccgacccgctcgtaatgcaggttgaagccgtagccgtcgaggaccacgccgacgatggggccgaacaccaccagggcgatcaacccggagagcacggcatcgaggacgcactgcttgagatcgatggaagtctcgttgctcatcgtcgtccccttacaccttggcgatctgcgggcggccgagcaggccctggggacggaagatcaggatcagtaccagcaacgagaaggcgaacacgtccttgtagtcggtgttga

SEQ ID NO: 16032 - DNA, 720 bp, Pseudomonas aeruginosa
aggcgccaagctcaacgagcagatggagaaacgctacgactccatgcgcaccaccttcctgctcatcggcgccgcagccctggtcctcatcgtcgccgcggcctggttcatcagcctgtcgatcatgcgcccgctttccgatctgcgcggggtgatccgccgcgtgcaggactcctcgaatctcacgctccgcgccgatgcgcgcgggcgcgacgaagtgtccgatacggcgcgcgccttcaatatgatgctggaaagccagcaggcgctgcttcggcatctcgccgagacagccaggaagctcaccatcacctcggacgagatgagtgccatcagcaaccaggtcagccatgtcgccacgtcccagggcgaccagaccgacatggtcgccacggcggtacaccagatgagcatggcggtccaggacgtggcgcggaacgcccaggccgccgcagccagcgcggaatcggcgaacagcgaggcgcacaccggaaccggactcgtgcatgcgaacctcgacgccatccagggcctgtcggtcatggtcggagaggcgggagccgtcatcgacacgctacgcaacaagaccgaggaaatcagcaccgttctggaagtcatccagaacatcgcccagcaaaccaacctgctcgccctcaatgccgcgatagaagccgcacgggcgggcgaggccggacgcgggttcgcggtggtcgccgatga

SEQ ID NO: 16033 - DNA, 1410 bp, Pseudomonas aeruginosa
tcctctgcgccgacctggaacgactggatagcgccctcgccggcgccgacaaggagaagtgaacatggccgaaagcgtctttgccgagcgcatcgtgcagaacctgctcgataccgatttctacaagctgaccatgatgcaggcggtgctgcacaactaccccaacgccgaagtggagtgggaattccgctgccgcaacgccgaggacctgcgtccgtacctggcggagatccgctaccagatcgagcgcctcgccgaagtcgaggtaaccgccgaccagctcgccttcctcgaacgcatcccgttcatgaagccggacttcatccgcttcctcagcctgttccgcttcaacctgcgctacgtgcacaccggcatcgaggatggccaactggcaatccgcctgcgcggcccatggctgcacgtgatcctcttcgaggtgccgctgctggccatcgtcagcgaggtgcgcaaccgttatcgctaccgcgaggtggtcctggaacaggtcggcgagcagctctatcgcaagctcgactggctctccgcccaggccagcagcgaggaactcgcggaattccaggtcgccgacttcggcacccgccggcgcttctcctaccgcacccaggaggaagtggtgcatatcctcaagcgcgacttccccgggcgcttcgtcggcaccagcaacgtgcacctggcccgcgagtacgacctcaagccgatcggcaccatggcccacgaatggctgatggcccaccagcaactcggcccgcggctggtcgacagccagcaagcggcgctggactgctgggtccgcgagtaccgcggacagctcggcatagccctgaccgactgcattaccatggatgccttcctcgacgacttcgacctgtacttcgccaagctcttcgacggcctgcgccacgattcgggcgacccgctggcctgggcggagaaagccatcgcccactaccgccgcctgggtatcgacccgctgagcaagaccctggtgttctccgacgggctggacatgcccaaggcgttgcagctgttccgcgcgctacgtggcaagatcaacgtcagcttcggcatcggcaccaacctgacctgcgacatcccgggggtcgagccgatgaacatcgtcctgaagatgacggcctgcaacggccatccggtggcgaagatatccgacgccccgggcaagacccaatgccgcgacgagaacttcgtcgcctacctccgccacgtcttcaacgtgccggcctaatcctttcgcacctaacgggagcccgaacatgcaacagatccaacgcgacatcgcccaagccctgcaggtccagccgccgttccagtcggaggccgacgtgcaggcgcagatcgcccggcgcatcgccttcatccagcagtgcctga

SEQ ID NO: 16034 - DNA, 954 bp, Pseudomonas aeruginosa
aaggaagctgtatccctgcgaaggccagccatgcgcacccgtctccccgccctgctcctcggtgtcctgctggccggccaggcctgcggacacacatccccgctgctcgcgccggtacggcagttccacgccttcggcgacagctattcggacaacggcgaaagccagcgactgacccgcgagatgctcgccaagggcatcgccggcgcccaggcattgcccggcgaagtctactggcagggccgctggagcaacggcccgaccgccgtcgaggtgctcgcccgccagcttggtgcgcaactggccgaccatgcggtgggcggcgccaagagcggagcggacaactactacggctggatgagcgcctaccgccataccggcctcgccggccaggtcgacgcctacctcgccacgctggacggcaagccggtcgatggccaggcgctgcacttcatcttcgtctccgccaacgatttcttcgagcacgaggatttcgccggcgagcagcccctggaacaactggccggcagcagcgtggcgaacatccgcgccgcggtgcagcgtctcggagaggccggcgcacgacgcttcctggtggtcagttcgaccgacctgagcgtggtcccggcggtggtcgccggtaaccgggtcgagcgggcgcagcgctacctgcaggcagtcaacgccagcctgccgatccagctcgccgccctgcgcaagacccgcggcctggagctgagctggttcgaccatctcaccttcagccgccacttgcggcgcaacccggcgcgctatggcctggtggagctggacgcgccctgccagccgacccagcccagcgtccgcccggcctgcgccaacccggaccagtactacttctgggacgagtggcatccgacccggcgcgtgcaccaactggccggcgaggcgatggcggcacgctacgcgcgctga

SEQ ID NO: 16035 - DNA, 840 bp, Pseudomonas aeruginosa
cacagatgtgccgcttcgcgcctgcgacgcaacgtccggcaatgcttcgcacggcttggtcgaagcgctcccagccgctaccctgtgcgcctttttccacccccgacaggagtcgatcatgaccttgcgttccgtatgcgtattctgtggcgccagccccggcgcttccccggtctaccaggaagccgccgtggcactcggccggcacctggccgagcgcggcctgaccctggtctacggtggcggcgcggtcggtctgatgggcaccgtggcggacgccgcattggccgccggcggcgaagtgatcgggatcatcccgcagagcctgcaggaggccgagatcggccacaagggcctgacccgcctggaagtggtagacggcatgcacgcgcgcaaggcgcgcatggccgagctggccgacgccttcatcgccctgcccggcgggctcggcaccctggaagagctgttcgaggtctggacctggggccaactgggctaccacgccaagccgctgggcctgctcgaagtgaacggtttctacgatccgctgctgaccttcctcgaccacctggtcgacgaacgcttcgtccgcgccgaacaccgcggcatgctgcagcgcggtgccagcccggaggcactgctcgattccctcgccgcctggacgccaagcgtggcgccgaagtgggtcgaccgcaccccgcagtgatccgctcctctctcaggacggcggcagcaggctcagcgggtcgagcggccggccgttctggcggatctcgaagtacagttgcacccggtcggcatccgaggaaccggcctcggcgatcttctggcccttgctga

SEQ ID NO: 16036 - DNA, 1269 bp, Pseudomonas aeruginosa
  unsure (290): Identity of nucleotide at the above locations are unknown.
cgatcgtcgtgtcatccatatcgctcaccgtgcgcaaggaaggagtctggctccgtacgagaaccgcccctggcaccggaaaggcaggctccggcccttggcccgacaacgtccgtagcggattctggaaaagctagcacggcgccgcgaatttgccggagcaccgcttcgttgtccccaaacggcgtgggcgaggctgtggacaacctgagtaaaaaggtccgggagtcccgggcggcagggcctccgcggaaccgatcactttttgatcagccggcagtttcccgtancggcagcaccgtcacccgcacctccgggtcatggctaccgccgccgaggatcaccccgcgcagcggcgacacatcgcgaaaaatcccgcccccaggccagggtgatgtgctccaggtcgggcaacaggtcgttggtcgggtcgaaatccacccagccgttctccgggcaatacagcgagacccaggcatgcgaggcgtcggcgccgatcagtcgcgcctgcccgggcggcgggcgggtcaacaggtagccgctgacgtagcgcgccgccagtccgcgcgcgcgcaggcaggcgagcatcaggtgggcgaagtcctggcagaccccgcgacggcgctccagcacttcgtccagcggcgtcgccacctgggtggcctgcgcatcgaaggcgaactcgcggaagatcttctccatcagtgccgccgccgccaccagcaacggccgtccgggcgggaagcagtcggcggcgaactcggcgaatcgccgctggatgcgcacatagggcgactcgacgcgatagcggcaggcttccagctcggcggcggacagcgcccgcccggaaaatgccagcccggcggcgacggtttcccatgccggcgacgcggtcagttgcgccggcgcatgggcgaacacttcgacctgcagtcgcgcgctgacccgcagcgcctcgtggggacgctcgaaggccacccggctcagcggattgccgaatgcgtcgtgggcatcctcgcggccgggctcggcccccggctcgatcagcaattgcccgctcatgacaggcctgccaggcgcattcgcgtggccagagatgcgccagttgccgcgacagcgagaccggcgtcgcatagcggtaatgggtgtcgtgcagcacctggtagcgggcgccctggagcggaacggagcgaagcgcgggtgcggacatcaggtggataccgttctctggctgacatcgtcgacatgggcgaaatagcgcaagcctag

SEQ ID NO: 16037 - DNA, 1962 bp, Pseudomonas aeruginosa
ccggttgaggaagtccagcgcttcgccgaggtcggtgcgtgccggatcgagcgcctgcatgtcgcgttgcagctccagcaaggccagccagttctccccggacaagcgcccgcgcacctgcgccgccgcccagtgcaggcgccgcaggttggcgcacaggctcgccggccagtgctcgtcgagcaacgcccgcaacaggcacctttccaacggctcgccatccccgggcagcaggccgatgccgccggccagggccagggcgctgcgcagcgcctcttcgtcgccatcggcatccacgtagcgcgacagcaccacccgcagcaggcgcgcgtggtcgtcgcaacgctcggcatagcggccgtaccagaacaggttttccaccacccgcgacggcaggtagggatcctcgcggaccaggtcgcgcacgccgagccggcgcggccgccacggctcgccgccgaccgcacgctcggccagtacccaggtgtccttgctcgcgccgccgcgttgcatcgacaccacctcggcatccgccgccgaggctacgcgggtcagaccgccgggcatcacccagtagcggccgtcggcggcggcgacggcgaacacgcgcatgccgatggcccgcgactgcaggccgacgccggcctcgccgtcgcgccagaccggcgcctgggacaactgcgccaggcgttgcgccacgtaggcctgcgggcgctcgcgcaagcgctcgccgagggacgccaggccggcaccgtcgagggcgtggccgaacagaggttcgcagcgctggccgggaaaggccggcttgatcaccaggtcgggcagtgccgcgagtatcgcctcgagtgcctgcggctcgccgcaccagcgggtgtcgagcgagggcagcgccaactcctcgccgagcaggcggcgacaggcctgcggcaggaagccgagcaggccgggcgattccagcaccccgttgcccaacgcgttggccaccagtacgcgcccctggcgtaccgcctcgagcaggccgggaatgcccagcgccgagtcggtacgcaattccagcgggtcgcagaagtcgtcatcgagacgccgcaataccgcgtgcacccgtttcaggccgccgagggtcttgagatagagggtggcgtcgcgcaccgtcaggtcgtgcccctcgaccagcgggaaaccgagctggcgcgccaggtagagatgctcgaagtaggtttcgttgaaacgtccgggagtcagcagcaccaccagcggcgtctcgccgtcgccggcggcctggctggcgagggtctcctgcagggtgcggaaatacccggcgagatgctgcacgcgcaggtcgcgatagagttccggcaaggcccgcgagacgatctgccggttctccagcgcatagcccgcgccggacggagcctgggtgcggtcggcaaggacctgccagcgtccgtcggcatcgcgcgccaggtccacggcatagctgtgcaggaaaatcccgccgggcggccggatgccgagcgccggccagaggaagttcggatggccgaagaccagttcgctgggcagcagcccttcggcgagcagacgctggtcgccgtacaggtcggccagcagcgcattgagcagccgagcacgctgcgccacaccagcggcgatcggctgccactcggcggcggacagcaggttcggcagaaggtccagcgcccaggggcggtcggtgcccttgggatcggcgtaaacgttgtaggtgacgccgttctcctggatctgccgttccaccagggcctggcgctggcgcaattgctcagggctgctgcgctccagttggcggaacagccgctgccaatggggacgcacgccgccctggcgatcgagcaactcgtggtaggccgtatcggtgaacggatagtgggcaagcagctcgggcatcgaaggctcgcggggctggggttgcggtcactgtag

SEQ ID NO: 16038 - DNA, 2532 bp, Pseudomonas aeruginosa
cggagtcggcggcgcgacgccggagcgaagcgacgaggcgttgccgggtccgccacgacggttcttcgtgaagaccgggatgccccggaagcgcaagacttgtgccagcgccgtcaggcccgggcggccaggaggtcgtgccgcggcaatgcactgcgacggtgcgcgaccgcaggcaaggttgcagccgcgcacgctttgcgggcggcagggccgccccggcgatcagcgcgggatgttcggctggcgcgacttcttcttgcccttggcgaaggccgtcgccttgttctgctgacccttgctccacggcttaccaccgtcgctggcgcgtggcggcaggccggtatgctgggtcagcagcttgccggccttcttgctgccggccggcgtcgagttcttccgccgagcgctctggtattcgccggtatccggctggtaggtcgggaccaggtggtgcttgccattgccgatcaggtcggcgcgccccatccgctccagcgcctcgcgcagcagcggccagcctttcgggtcgtggtagcgcaggaaggccttgtgcaggcgccgctgctggtcgctcttgacgatggtcacgccatcgctcttgtaggtgaccttgcgcagcgggttcttgcccgagtgatacatagcggtggcagtggccatcggcgaaggatagaacgcctggacctggtcggcgcggaagccgttgcgcttgagccacagggccaggttcatcatgtcttcgtcggtggtcccgggatgggcggcgatgaagtacgggatcaggtactgctccttgccggcttccttcgagaacttctcgaacatctgcttgaagcggtcgtaggtgccgatccccggcttcatcatcttgtccagcggaccgcgctcggtgtgctccggggcgatcttcaggtagccgccgacgtggtgggtcaccagttccttgacgtactcgggcgactcgacggcgaggtcgtagcgcaggccggaggcgatcaggatcttcttcacccccggcagcgcccgggccttgcggtacagctcgatcagcgagctgtggtcggtatcgaggttctcgcagatgccggggaacacgcaggatggcttgcggcagtgccgctcgatgtccgggctcttgcaggcgatgcggtacatgttcgccgtcggtccgccaaggtcggagaccacgccggtgaagccgggcaccttgtcgcgcatctcctcgatctcgcggatgatcgagtcgtgcgagcggttctggatgatccgtccctcatgctcggtgatcgagcagaaggtgcagccgccgaagcagccacgcatgatgttcaccgagaagcggatcatctcgtaggcgggaatcttcgccttgccgtaggccgggtgcggcacgcgggcatagggcatgccgaacacgtagtccatttcctcggtgctcatcggaatgggcggcgggttgaaccagacatccacttcgccgtgcttctgcaccagggcacgggcgttgcccgggttggtctccaggtgcagcacgcggttggcgtgggcatagagcaccgggtcgttgcgcaccttctcgaaagacggcaggcggatcacggtcttctcccgggtcagcctggggttcgccagcaactgcacgaccttggcttcctgcgggtcctcctgcgcgcccttttcctgctcgatggcgcaggcggcggtgtcctgggtgttcacgtagggattgatgatcttgtcgatcttgcccggccggtcgatccgcgtggaatcgatctcgaaccagccctccggggtgtcgcgacggacgaaggcggtgccgcgcacgtcggtgatcgcgctcaccagttcgccctgggccaggcgctgggcgatttccaccaccgcacgctcggcgttgccgtaaaacaggatgtcggccgtggcgtccatcaggatcgagcggcggaccttgtcctgccagtagtcgtaatgggcgatgcgccgcaacgaggcctcgatcccgccgaggatcaccggcacatggctgtaggcctccttgcagcgctggctatagaccaggctggcgcggtccgggcgcttgccggccaggccgccgggggtgtaggcgtcgtcggaacggaccttcttgtccgcggtgtagcggttgatcatcgagtccatgttgccggccgccacgccgaagaacaggttcggctcgccgagcttcatgaagtcgtccttcgactgccagtccggctgggcgatgatgccgacgcggaacccctgggcctccagcaggcggccgatgatggccatgccgaaggacgggtggtcgacgtaggcatcgccggtgacgatgatgatgtcgcaggagtcccagccgagctgatccatctcttccctactcataggcaggaagggcgccggaccgaaacactcggcccagtacttgggatagtcgaacagcggcttggcggcttgcatcacgggcaccagggggtatctctaggaatggggggtcgcgaaaacgcggggcgcggaatatag

SEQ ID NO: 16039 - DNA, 2040 bp, Pseudomonas aeruginosa
gcaattccgacgttttcactgggtattgcctgtcgtcggccggcttcgaaaaaatgccatcatttagccatcttgtttctatactccattcatcgtcatctcacccggcctctaaggcaggcccccgggagagtcatcgtgcgccatcctcttgctctgctcgcggtcatcttcctgctactggccagcgccgtttcgcgcgccgcgccggagtttccggcgcctccggccagcggcgcctggttgaacggctcgctggacctgctcgaagaccccgatggcaacctggcggtggaggacctcgaacaagcggagcaggccggccgcttcgtcgccgccgccggccgcaccagcgtcggcctcagccgcagcgcctggtggctgcgcctcgacctgccgagacgcgaggcggtatccggcggctggtggctggaagtcgccagcgccagcctgcacgacctgcgcctgtacctccccgacgagcgcggcgggttccgtgaacatcgcagcggcgaagcggtgcccttcgccgagggccgcgaccacgcctaccgtcatccgctgttccggatccctcccggcgatgggccgttgcgcgtctacctgcgcagctacgatcccggcggcaacgcctttccgctgaggctctggagccacgacgaactgctggaataccgcagccagggcaacctgctgttcggcatggcctacgggctgatcctcgccctgctgctgtacaacctgttcctcttcaccagcctgcgcgatcgcgcctatttctggtacgtgctgaccgctgccagcgcgctggtgctgaccctgagcatcagcggccatggtttcgagtatttctggcccgagcgggcggtgccctggtggcttgaccgcctggcgctgctggcgatctggggcatctgcgtgatccgcttcagccagaacctgctgcaaagccggcagcacgcacgctgggcccatcacctgctgaacgcctgttgcctgctgttccttgcctgcctggcgttcaacgccgccggctggcgctggcaggcggccggcgtgctggcgctgaccctgctggccaacctgccgatcgccatcggcctggcagtgcagcgctggcgccagggttcggccacggcgcgcctgtacctggtcggcttcggcctggtgctcggcagcgtcagccttggcgtgatgcgcgccaccgcgctggtccagccgacctcggccaacgccatggtcttcccgctggcgctgaccctggaggccctgctgttctccctggcgctcgcctcgcgcatccaggatctgaagcaggaaagggccctggccctggaccaggccgaccaggaaaagaacgcgcgcctggccctgctgcacagcgcccagcgcgacctggcacgcgccgtggaagtccgtaccaacgagttgagcgaggccaatcgccagttgcagatgcgcgaagcgcaactgcagtacgccgcccatcacgacccgctgaccgggcttggcaaccgcaggcacctgatggagttcgccgaaagcgccctggacgacgcgcgccgccacggtaacagcatggcgctgctgctgatcgacctggatcacttcaagccgatcaacgatacccatggccacgatgccggcgacttcgtcctgcagaacgtggcccagcggctgcgccattgcgtgcgcaccgaggattgcgtggcgcgcctcggcggcgacgaattcgccgtgctggtcggcgggtcgaatgccgagcagcatgcccgcgacatcgccgaacgcctgctgcgagaactggcgaaaccggtggagttcgccaagcagtggctggtgatcacaccgagcatcggcgtcgccctgtttcccggcgacgccctgcagttcggcaaactctacaaggccgccgaccaggcgctgtaccgggtcaagggcgccgggcgcgccggctatgcgatggctgccgacgatgaacgcgagaccgcgccggcgctcccctggccgaccgccctggcaccggagcgtatctcctga

SEQ ID NO: 16040 - DNA, 1368 bp, Pseudomonas aeruginosa
ccaccgcgaacgcctggcgctgcggcgcgcagcgcttggccagggcatagttgtggcgaatggcggaaaggtcgacggtggcaacgaggggacgcatggcatcgggtcctgcaactgaaacgggtgcctatggtaaggcgcccgccgggcaagacccaagccgggtcattcgtcctcgaagttgtacatgccggcggcaagattctcgaagcgcgtgtatttgccgatgaaggccaggcgcaccgtaccgatcggaccgttacgctgcttgccgatgatgatttcggcgacgcccttgaactcggtctccgggtggtacacctcgtcgcggtagacgaacatgatcacgtcggcgtcctgctcgatcgccccggattcgcgcaagtcggagttcaccgggcgcttgttgggtcgctgctccagggagcggttgagctgcgacagggcaatcaccgggcagttgaattccttcgccagggccttcagcgagcgggaaatctcggaaatctcgttggtccggttgtcgccgctggagccgggtatctgcatcagttgcaggtagtcgatcatgatcagcgccaggtcgccgtgctcgcgcaccaggcgacgggtccgcgcgcgcatttccgagggactgatgccagcggtatcgtcgatgaacagcttcttgtcgttgagcaggttgatcgccgaagtcaggcgcggccagtcctcgtcgtcgagcttgccggaacgcaccttggtctggtcgatacgcccgagcgacgagagcatacgcatcacgatcgagtcggagggcatctccagggagtacaccaacacggccttgtcggtgcgcatcaccgcgttctcgaccaggttcatggcgaaggtggtcttacccatcgacggacgcccggcgacgatgatcaggtcggccggctgcaggccgctggtcttctcgtcgaggtcggtgaaaccggtggacaccccggtcagcgcctcggtggtgttgaacaggtagtcgatgcggtcgatggtcttgaccaggatatcgctgatccctaccggcccgccagtcttcggtcgcgcttcggcgatctcgaagatcttccgctcggcctcgtcgaggatctcgttggcgccgcgcccttccgggtggaaggcgctgtcggcgatctcgttgctgatgccgatcagttggcgcagggtggcgcgctcgcggatgatctgcgcgtaggccttgatgttggcgaccgagggaatgttcttcgccagttcgccgagataggccaggcccgccgacctgggccagttgtccttccttctccaactgctccggagagggtcaccacgtcgatcggctggttggcctcggccagcttgtag

SEQ ID NO: 16041 - DNA, 777 bp, Pseudomonas aeruginosa
agcggcagaacttacgacgacggaagaaacgtgccatgtgattggctcctcaatactggtccggaattactcgtcagcgttatcgctatcgctgttgtcgtcgccatcggcgccttcagcgttatcgttcggacgctcacgacgctcgcgacgctcgttgcggctttcttcagccttgagcatctcggactgctcggtgacagcttcgtcgcgacgcatgaccaggttacggatcacggcatcgttgtaacggaagttgtcttccagctcagccagggccttggcgctgcactcgacgttcatcagaacgtagtgggccttgtgcacgttgttgatggcgtaggccagctgacgacggccccagtcttccagacggtggatcttgccgccgtcttcttcgatggccttggtgtaacgctcgaccatgccaccgacttgttcgctctggtccgggtgaaccaggaacacgatttcgtaatgacgcataaatgctccttacgggttgcagcctgccgcagaacggtcaggcaaggagtgaatgttttcttggcttgcctggtggagaggcgaacgaacgcctgcccgcgcggcaaggggcgacattctagagaagggcaaccggcgaagcaaggaagattggcgaatatttgtacagcggatggaatggcgcggggccgcgccgcggcggccccgcacgcgctcactccagcggggtgcgctggcggaggatctcgaacaggcagacgccggtggcgaccgagacgttcaggctgctga

SEQ ID NO: 16042 - DNA, 2616 bp, Pseudomonas aeruginosa
cttggccttacgtttgcgcgccccggtggcggccggagcgttgtcggccttcggcttggaaggccccttgcgatgcttggtcggcttgcccggcttggcggcagcggcgggcttgccgtccttggccttgcccttcgcgctcttgcccgcaggaacgaccttgcccttcttcccgcccttgtccttgccgccgacacgcgcctcggcgagcagcgcctgcttcacctcgcgactcttgcgcacgtcggtgttgccgagcatctccgcggcctgcgccagcagctccggcgcgaccggcggcagcgcctgcaccttgccggccttgcgccgcggcaccaccgcggcgtcgggactggccagcgccggctccaggtcgacctcgggcacggatgcgcccttgcgccccttcggcgccttgccggcgttcgccgacttgtcgccgttgcgcttcttgcgtccgatcggcgcgctcagcacgtttccggccagctcgaaatcgatcttccgctcgtccaggtcgacccgcgccactaccacttccgtggtgtcgccgagacggaagctgcgcccggtgcgttcgccgctgaggcgatggtgcacggcgtcgaaatgatagtagtcgccgggcagcgcggtcacatggaccaggccttcgacgaagatgtcggtcagctcgacgaacagaccgaaaccggtgaccgcagtgattacgccagggaaggtctcgccgacccgctcgcgcatgtattcgcacttcagccagttggtcacgtcgcgggtggcctcgtcggcacgccgctcggtcatcgagcactgctcgcccaactggtccaggcgcaattcgtcgtacggatagatacgcgccttgggcatgctcgccgcgccggcccgctgcacgtgcggagtctccgccttggagcggatcacactgcggatcgcacgatgcaccagcaggtccgggtagcgccggatcggcgaggtgaagtgggtgtaggcgtcgtagttgaggccgaagtggccattgttgtccgggctgtacaccgcctggctgagcgaacgcagcatgaccgtctggatcaggcggaagtcggcgcggtcgtggatcttctccagcaactcctggtagtcgcccggggtcggcgcggccttgccgcggccgaggctcaaccccagctcgccgaggaactggcgcaggttgttgagtttctcctgcggcgggccgtcatgcacccggtacaacgccgggatggcgtgcttctgcaggaagcgtgcggtcgccacgttggcgcagagcatgcactcttcgatcaggcggtgcgcatcgttgcgctgggtcgggcggatttccgagatcttccggtcggcgccgaagacgatgcgggtttcctgggtctcgaaatcgatcgcgccgcggacatggcggccggccagcagcgctttatacaacgcatacagctgctgcaggtgcggcaccacgccgggcaactgctggcgcaggttctcggcctcgacgctgtcgggatgctcgagcaactggctgaccttggtgtaggtcaggcgggcatgggagtggatcaccgcttcgtagaactggtagccggtcagcttgccagccttggacagggtcatctcgcagaccatggccagccggtcgaccagcggattcagcgagcagagaccattggacagcacctccggcagcatcgggatcacccgctcggggaaatacaccgagttgccgcgcctggccgcctcttcgtccagcgccgaaccgaccttcacgtagtgcgagacatcggcgatcgccacgaacaggcgccagccgccgccgcgcttggcctcggcgtacaccgcgtcgtcgaagtcgcgggcatcctcgccgtcgatggtgacgaagggcacctggcgcaggtcgacacgcttttccttgtccttctccgccacttccggcttgagcttggccgcttccttctccaccgcggccggccagacgtgggggatatcgtagctgcgcagggcgacttcgatctccatccccggcgccatgtagtcaccgagcacctcgacgatctcgccctgggcctggcggtggatgctcggccattgctcgatgcgcacctggacgaactggttgtgcctggccttgccggccttgcccggcgggatcaggacttcctgctggatcttcgggttgtccgcgaccaccacgccgatgccgctttcctcgaagtagcggccgaccacgatctcgtgggcccgctcgatcacctcgaccagctggccttcgcggcgtccgcgccggtcatggccggacacccgggccagggcgcggtcgccgtcgaacaccaggcgcatctgggtgggactgaggaacaggtcgtcgctgccatcgtcggggatcaggaagccgaagccgtcgcggtgcccgctgatgcggccgcggatcaggtccagcttgtccaccggcgcataggcgccacgacgcgtatagataagctgcccgtcgcgctccatggcgcgcaggcgacgacgcaaggcctcttccggctcctcgccggcgagcccgaactcgtcgagcaactgggagcgagtcgccggagcgccccgctcggatag

SEQ ID NO: 16043 - DNA, 444 bp, Pseudomonas aeruginosa
cgaactacggcagccgcctgctcggtgagcaggtcgacgatcttgcccttgccctcatcaccccattgggtgcccaggactacgacattcttacccataacacttgtccccatcgtggaagttcgatgccggccgcggccggcggaatctcaggacgccagcggcgccacctgccaattgccatcgcgcagcgccagctgccggtcgcagcccgcctcgcgcgcagaagccgcatcctgcccgggcagagcctggacgacacgctgcccgtcgcggcgcagtcgttgcaccgcctgccagagcccggccccttcggccggcgcccagatacccgatacagcctggtccaaccgggcctggccgagagtgaccaggcttttcagatcggtggagaaaccggtggccgggcgggcgcgcccgaaatcggcaccgatatcatcatag

SEQ ID NO: 16044 - DNA, 618 bp, Pseudomonas aeruginosa
ttcctgcctgacgcgtcaaaatccgccttttcagcgctttgccggcgacgcaggtcgctcatcgacaccccgccgaggcgatacacctcgagcgcccgcatcagtcgctgcgggtcgttggggtggatgcgcgcagccgactccgggtcgacctcggcgagttgccggtgcagcgcgtcccaacctttggacagggcctcggcctcgatcgccgcgcgcacctcgggatcggcgccgggcatgtcggccaggccctcgagccaacgccttgtaatagagcatggtgccccccaccagcaggggaatcctgccgcgcgcggtggcctcggccatcgccgccagggcgtcggcgcggaattccgcggccgaatagctctccgccggatcgcggatatcgatcaggcggtgcggatagcgcgccagcagctcccgggaaggcttggccgtaccgatatccatgccgcggtagatcagcgccgagtcgacgctgatcagctcgcagggcagcgcatcggccagcgccatcgccaggtcggtcttgccggcggcggtcggccccatgagaaagatggcgggaggcagggaagacatcggaacgctcttggacaaagcgcatag

SEQ ID NO: 16045 - DNA, 1272 bp, Pseudomonas aeruginosa
gccgccactccagcccacccgtgccgccggactctccagcacgctctcggccaggcgcatctcgccctgcgggccgaactcgccggcggcagcgccggtcggacgcggctcggtcaggctggtcgccccgggcggcgcgagctggtcgtcgggacggacctcgcccagcgcacgatgcagggtgccatagaggaagtcatggaccatccggctgtcacggaagcgaacttcgtgcttggtcgggtgcacgttgacgtccaccaccgccggatcgacttcgaagaacagcacgaaggtcggatgccggccgttgtacagcacgtcgcgataagcctggcgcaccgcgtgggcgaccagcttgtcgcgcaccatgcgcccgttcacatagaagtactgcaggtccggctggctgcgggagaaggtcggcaagccgacccagccccacaggtgcaggccgttgcgctcgacctcgatcggcagcgcctgctcgaggaatgcctggccgcacaccgcgccgacccggcgcgcgcgggccagctcgtctcgcgcctcgtgcagggcgaagatggtcttgccgttgtggcgcaggtggaaagccacgtcgaagcgggccagcgccaggcgcttgatgacctcctgcagatggtcgaactcggtcttctcggcacgcaggaacttgcgccgcgccggggtgttgaagaacaggtcgcgaacctcgacgctggtccccaccgggtgcgccgccggctgtacccgcggctgcatgtcgcggccctcggtttccacctgccaggcttcgccggcgtcggcggtacgcgaggtcatggtcaggcgcgctaccgagctgatcgaggccagcgcctcgccacggaagccgaggctcatcacccgctccaggtcttccagctcgcggatcttgctggtggcgtggcgagccagggccagcggcaggtcgtcggcggggatgccgcgaccgtcgtcgcgcactcgcagcaacttgatgccgccctgctcgacctccacatcaatgcgccgggaaccggcgtcaaggctgttttccaggagttccttggccaccgaggcgggacgctcgaccacctcaccggcggcgatctggttcgccagccgcggactcagcagctggatacgcggtgcttcactcatcactgggccgccagggcggtgctcgggatggacagggcctggccgactttcaggttgtcgctggacaggctgttgctgctacgcagcgcggccatgctcacttcatag

SEQ ID NO: 16046 - DNA, 462 bp, Pseudomonas aeruginosa
tggctggcgctggccagcttgcgcgactcgttgacgttcgagatgaagccggtttccaccaggatcgacgggatgtcgggcgacttcagcaccatgaacccggcctgctcgacacgacgcttgtgcagcgaagtgatgcggccgacattggtcagtaccttgtggccgacatccaggctcgacgagagggtggcggtcatcgacaggtcgagcagcacgccggcgagcatctggtccttgtcgccgaggctgacgctgccatcgccgccgatcaggtcggaacggttctcgctgtcggccagccagcgcgcggtttccgaagtggcgccgcggtcggacagggcgaacaccgaggcaccgaaggcgctgcggctcggcgcggcgtcggcatggatcgagacgaacaggtcggcgcccttcttgcgggcgatctcggtgcgcttgcgcagcgggatgaaatag

SEQ ID NO: 16047 - DNA, 441 bp, Pseudomonas aeruginosa
tgcccgacagcacgtcacccaggccggcaccagccatcgccggatgcccctgggaacagacggcaagtcgtccgtccggcgcggcgaccaggctgccggcgcccttcagcaccaccaccgcctggtagcgacacgccagttccagcgccgccgccgggcgatccgcctgcacctcggcggtcgagcgacccaacaggcgcgcggcctcgccgggatgcggcgtcagaatccatgtccgcggccctgctccgaccggttccagggccagcaggttcaacgcgtcggcatcccagacctgcggcaacggtcgcgaccggacagcgctcagcagggctacgcccccagggcgcgctggccaagaccgggaccgagcaacagcacgctggcgcgttcggcaagggcccagcagttggttcgccgacgccacgccatgggccatga

SEQ ID NO: 16048 - DNA, 429 bp, Pseudomonas aeruginosa
tcgcttcccccaataccgcgccggtgtcggcgctcaagccggaaggaatatccaccgccagcaccggcaggtcggcggcgttggccaggcggatggcctgcgcaaagggctcgcgcacggcacctgccaggccggtgccgagcaatgcatccactactacgccctcgagcacggcgcactcgctccagggctccaccacgaccccggtcgccagcgcggcggcatgcgcctgcgccgcgtcgccggcaagccgctgcggcgccgcgaccgccagcacccgcactcgccaacccgcacgttgcgccagcgccgcgatcaggtagccgtcgccagcattgttgccgtccccggcgagcaccgtcagcgccgcggcctccggccaacggcggcgcaaggcacgccaggcggcgtgggcggcgcgctgcatga

SEQ ID NO: 16049 - DNA, 1320 bp, Pseudomonas aeruginosa
gttcgaagcccggcgtgccggcagcgatcaggcgcgcatccaggtcgcgcacctgggcggcggaatagagggcgagtggcaggtcgtcgtgctggaaggtcatggtcatcggatcgattcggcgtcaggcgcgcagtctggcagaattatacctatcccatgtcgctttccctcgtcttcgttgcctcccatgactccccaacctctggccgacaacctttccccgccggaccccgcccgcctcgcccagtccatcaaggactggggccgcgagctggggttccagcaggtcggtatcagcgacgtcgagctgggcgagcacgaagcgcacctgcagcgctggctggaggccggctaccacggcgagatggactacatggcggcgcacggcagcaagcgctcgcgacctgccgagctggttcccggcacgctgcgggtgatctccctgcgcatggattacctgcccggcgacacgcgcatggcgcaggtcctcgcgacaccggaaaaagcctacgtctcgcgctacgccctcggccgcgactaccacaagctgatccgcaagcgtctgcaacaactggccgagcgcatccaggccgaagtcggcccgttcggtttccgcgccttcgtcgacagcgcgccggtgctggaaaaggccatcgccgaacaggccggcctcggctggatcggcaagaacacgctggtgctcaaccgcaaggccggcagctacttcttcctcggcgagctgttcgtcgacatgccgctacccgtcgacccggcgatggacagcgagcattgcggacgctgctcggcctgcctggacatctgcccgaccgcggccttcgtcggcccctaccggctggacgcgcgacgctgcatctcctacctgaccatcgagtacaagggcgcgattccgctggagctgcggccactgatcggcaaccgggtattcggctgcgacgactgccagatcgtctgcccatggaatcgcttcgcccgccccaccgggcagggcgactttcagccgcgccacagcctggacaacgccgaactcgccgaactgttcctctggagcgaggaggagttcctcggccgcaccgagggttcgccgctgcgccgcgccggctacgagcgctggttgcgcaacctggcggtggggctgggcaacgcgccctcgaccatcccggtgctggaggcgctgaaggcgcgccgcgggttcccttcggagctggtccgcgagcacgtggaatgggccctgcggcgccacggggaaacctagcccagccggcgcctaccgcccggcccggacggatcagagcttga

SEQ ID NO: 16050 - DNA, 1662 bp, Pseudomonas aeruginosa
ggagggggactgctaggctccctcttgttatcggttgctagccgcaagactatagtccgaatactcgaaaagccagttcgccgcctcgccgacaccgagcccgacacccatgacagaccgcctcgccgcctggctcgaagagctcgaccggcaacccctgccgatccccgccagccactatgccggcctgcacgccgcgctgagcgacagccgccgctcgctgcgcgagatcgccgaccagttgcagggcagcccgacgctggcgttgtccatcctgcgcgaggccaatcgcgccgagagcgcccgcgacaaccccgcggaaagcctggaggtggccctcagccgcctcggcctggcgcgcgcgagccaacttctgaagaccctgccgagcatccaggatgcggagatgcccagggtcctcgggcagatgctgctgatcagccagcacgccatgcagcaggccagcggcctgttcggcgcgcgcctggccaggctctggcaggaaatccactggggcagcctgctgaccatggctccggtctgggcgctggccaacgcccgcccgcagttgctggagcaatggcagcaacgcgtgctggtacagggcgaaccgaccctgcgagtggagcgcgaactgctcggcatgcgcctgctgccgatctgcctggcgctggccgaacgctggcggctaccgcagtgggtcatccagggctatcgcctgctcgcctgcgaccgtcgcctgctggttcgagccctgcgtatcgcccgcgaccatcagtcgcccctgctccagcaacagcaactcgatgcccagcccgatctcgcccgctggctgacccagccggccaactgcactctcctcgccaatggcctggccatcgccgcgcaccagagctgggacgggccgcacatgctgcgctggcagcgcctgaccggtctgtacctgggccagccgctgaccgaagtccagcagcaggtgcacatgctcgccgcgcaaagcgcgcgcctgcacgcccggccgccgctgtggcatccggcggtggccttgatctggccctggcaggccagccgctggcgtgccgaagcggcgcccccgccgccgccctcggcggaagccctggccgagtggcggcagcattgcgccgagttgctccgcgagcccagcccgttcagcaacgtggtgcagctcaccgcctgtgcccgcgatgcgctgcgcgcctgcggcctgcaaaggatgctgctgctggtggccgatcgcacacaggtacacgtgctggcgcagcagagcgccggactcgaaccgggccaggagaaattgcaactggagattgccagcagcccgctgctgaagaaactgttccagcagcctgccctgctgcgcatcggcccgaacaaccaggaccagttgctgccggccctcggcgaacccttgcgccaactgttccccggacctcacctgctgctgcgctcgctgggcaacggctcgcgggtggtgatgctggtcctggccgacctcggcggccagccgttcagcgacctgcatgcccaggccttcgccaagaccgcccagtgcaccgagcgcgcgatccagcagttcggccgccagcgccgcacggaatgagggacatgcccggcacactggtcgggcgcgctttccgttaa

SEQ ID NO: 16051 - DNA, 849 bp, Pseudomonas aeruginosa
actgctgcccttcttcaacccgggggtactcgcatgtccgtcttctccgacctgccattggtgatcgagcccagcgacctcgcgccgcgcctgggcgcgcccgagctgatcctggtcgacctgaccagtgccgcccgctacgccgaagggcatatccccggcgcgcgtttcgtcgaccccaaacgcacccagtggggacaacccccggcacccggcctgctaccggcgaaggccgacctggaagccctgttcggcgagctgggccaccgcccggaggcgacctacgtggtctacgacgacgaaggcggcggctgggcgggccgcttcatctggctgctggacgtgatcggccaccaccactaccactatctcaacggcggcctgccggcctggatcgccgacgcccaggcgctcgaccgcgaggtcccggcgcctgtcggcggcccgcagccgctgacgttgcacgacgagcccagtgcgacccgcgaatacctgcaaagccgcctcggcgccgccgacctggcggtatgggatgcgcgcaaccccagcgaatacgccggtaccaaggtgctcgccgcgaaggccgggcatgtgcccggcgcgatcaatttcgaatggaccgccggcatggacccggctcgcgccctgcgcatccgcgcggatatcgccgaagtcctggaggacctcggcatcacgccggacaaggaagtgatcacccactgccagacccaccatcgctccggcttcacctacctggtggccaaggcgctgggctacccgcgggtcaaaggctacgccggctcctggtcggaatggggcaaccaccccgatacccctgtagaggtttga

SEQ ID NO: 16052 - DNA, 873 bp, Pseudomonas aeruginosa
ggaatgtcgttcaaagatcgtctgttcatctgcagccagtacctgctgccgcaccacctgctgtcccggctgatcggcttcgccgccgactgccgggcgacctggttcaaggaccgcctgatcgcctggttcgcccggcgctaccaggtcgatatgcgcgaagcgcaggtcgaggacctgcaggcctatgaacatttcaatgccttcttcacccgcgccctgaaggatggcgcccgcccgctggcccaggagcccggcgcggtgctctgcccggccgatggcgcgatcagccagctcggcccgatcgagcacgggcggatcttccaggccaaaggccacagctacagcctggccgaactgctcggcggcgacgccgaactggccgcgcccttcatgggcggcgacttcgccaccgtctacctgtccccccgggactaccaccgcgtgcacatgccgctggccggcaccctgcgcgagatggtctacgttcccggccggctgttctcggtgaaccagaccaccgcggaaaacgttcccgagctgttcgcccgcaacgagcgggtggtctgcctgttcgacaccgagcgcggtccgatggccgtggtgctggtaggcgcgatgatcgtagcctccatcgaaaccgtctgggccggcctcgttacgccgccgaagcgcgaactgaagaccttccgctacgacgaagccgcccgtgcgccgatccgcctggaaaaaggcgccgagctcggtcgcttcaagctgggctccaccgccatcgtcctgttcggcccgcagcaggtcgcgttcaacgacggcctcggggcagcgagcccggtgcgcatgggcgaatgcctggccctgccgaaacagtcctga

SEQ ID NO: 16053 - DNA, 2142 bp, Pseudomonas aeruginosa
cctcgccggggcggagcgccccgagcgcctccgtcccgtctctccccgccgccggaacctcccggcgggatcgtggcgtccgaaggctgcgggtccatttcgatgctgctagagttcggaaaggtcctatcgagcctgtgccgacccctcggtcaggaaagcggactgccgcacagttcctgttctggccacgacgatgaacccgcctcccgtgttaagaaagaggaggcgcagccgcggcgatcggaagtccggcacctctccggggcttcatccccccgtaggagccttttcagtagcggagccgtctatccccccatggaaaaccagagcccccacctctcgttgcgcgtccccactccgacgcagcagaacctgagcttctgcgacgccaccccgaaggacatcaagtactggctggcgcacctgcccaaggccaacctcggggagaccgcgcgccagctctaccagggcctgatcgaactcaaccagttggtgctgcccgtcgaggcccgcctgcaactgctcgaactgttccgtccagaggtgcatttcgtctgcgcccacctggaacggcacttcctcaaccaggccatcgtcctcgacgaacggccgcgcaagatcgccaacctctgccaggccctgcagaaccacctggccatcggctacaagctgatcgtggtccaggaagcgccgcgcaacagccgcgaccgcgcgcagctgctcgcggtcggcatccagcgggcgatccgcagcctgtgcgggccgctgatccgcgccagccagttgtactgcccggtccccgaggggctttggctggaactccaccagctctaccagttggccagccagcgcggcgtgcatcgtctcgcggtgcgcgacgaactggccaagcacacccccggcctgagcgtcgagcaggcctacctgattccgctgctgctcggctgcgcgcgctgcaaccagatgcgccagaacaacattgcacggctcgccgaggtgctcgaaccctggagccagctgctgtcgatacagagcgcgacgctgcccggctcactgttcatcgccgtgccgcagatcgacggcccgccgcgctaccgttcgctgtacccggagacccaactggccaatgccctgggcatcgacacccagccgctggtcgagctgatccgcgaatacctgctgcagcccgaggccgaacgcgcgaaagcacgcctgccgctgatcgaaggggtgaccctggacctgctgcaacatctctcctcggcctggggtgacatcgccgaacgtaccttccagcgcacccagggccagggccagttgaccctgtgcatcggcatgagcgccctgcactacttcctcgccgggcgccgcccgttcaacgaggtcctgcagatccaggaagcgcccgaggcgcctcgcttcaaggccgacgtccaggacgcctgggccggcgccttcgatgcacagaaggtcaccgactggcagcccggcatgccgctggaggaaatcgagtaccgcccgcaccagtcgccccgcagtgtgcaacccgggcacccgcaggcccacgcacaggctgacgccaccgaggactacccgacctacgccctgcccatcgtcaaccacagccccggcggctattgcctgagctggccgaaggaggtgcccgcccaactgcaggcgggcgaactggtcggcctgcaggaccttccaggccaggcgtggagcatcgcggtggtgcgctggatccgccaggtacgcaatggcggcacgcagatgggcatcgagatgatcgccccggcggcacagccctgcggcctgcaactgctgcgcaagaccgagcagagcagccactacctgcgcgccctgctgctgccggcgatcgccgcgatctcgcggccggcgacggtgatcaccccgcgcctgccgttccaggagggcagccgggtgcagatcaacctgcacggcgaggagcggcgcgcggtgctgaatcgccggcaggcctcgaccggcagcttcagccagttcgaataccgctcggcggaaccggtgaacaccccgagcgataagccggtcacagcgccagtggcccggccgcctgcgggggaggaagattttgactcgctctggaagtctctgtag

SEQ ID NO: 16054 - DNA, 1689 bp, Pseudomonas aeruginosa
cgccaccagctatctgaagcaggccaagcaactgacccagggcctggccaccctgcattgccaggcggcgatcagccagttcggctgctcgctgaacccgttcaacgcgctgaagcacctgaccgtgcaattcatcaagatcgatggttccttcgtccaggacctcaaccaggtggaaaaccaggagatcctcaagggcctgatcgccgaactgcacgaacagcagaagctcagcatcgtccccttcgtcgagagcgccagcgtcctcgccaccctgtggcaagccggcgccacctacatccagggctactacctgcaggggccgagccaggcgatggactacgacttctcctcgggagacgaatgaagaacgggcgccctgggcgcccgttgcttttccgctctaccgacctggttcgtggctgccgggccggcaagagacgcccgccggcctcaggctcgtccttcgcggtcgcggtagccgagcaggtagaggatgccgtccaggcccagggtcgagatcgcctgcttggccgactgcttgaccagcggcttggcgcggaacgccacgcccaggccggccaggccgagcatcggcaggtcgttggcgccgtcgccgacggcgatggtctgctccaggctcaggccttccttcgccgccagttcgcgcagcaggtcggccttgcgctgggcatcgacgatcggctcgaccgccaccccggtgaccttgccgtcgacgatctgcaactcgttggcgaacacgtagtcgatccccagcttcgcctgcaattgacgggcgaaataggtgaagccgccggacaggatggcggtcttgtaacccaggcgcttgagttcggcgaacagggtttccgcaccctcggtcagacgcagcgaggcgccgatctcctccagcacgtcttccgacagcccctgcagcagcgccaggcgctccttgaagctggcgcggaagtccagttcaccgcgcatcgcccgctcggtgatcgcggcgaccttctcgccgacgccggcggccttggccagttcgtcgatgacttccgcctcgatcagcgtcgaatccatgtcgaacaccgccagccggcggttgcggcggaacacgctgtcctgctggaaagcgatgtcgacgttcaattcctgggcgacgctgaggaattccgcacgcagcgccgccggatcggccggttcgccgcgtaccgagaactcgatgcagcccttgccctggtcggcgggcatgtccagcggcatgcgcccggagagacggtcgatgtggtcgatgttcagcgcgtacttggcggtgatcgagctgaccctctgcagttgctcggcagtcacccggcgggtgagcagggtcacgatgtgccgcgccttgccctggccgtcgacccattgccggtagtcctcttccgagaccggggtgaagcgcacctgctggtccagcttgtaggcggtgaacagcacgtccttgaggaccgaggaaccggcctcggtatccgggatttccaccaggatgccgaacgacagggtgtcgtggatcaccgcctggccgatgtccaggatgttcaccccgccctgggccagtacgccggtgatggcagcggtgagaccggggcggtcttccccggtgatgttgatcaggacaatttcgcgcaaggcgtaagctccgccaggtaa

SEQ ID NO: 16055 - DNA, 585 bp, Pseudomonas aeruginosa
tccggacaatccggcccccggcgccgaactgcagaacgagctgggcgacctggcgcgcgacctggaagagcgcctggtgccggaaaagccgccggcgccggagccggaagaagcaccgctgccgcagaacttcgacgacatcctgctggaagacgacgaagccgacctgcgcagccgcaaggtcgaggcctcggccttcgaggaagacgacattccgctgggcgacgccctgctggacgagaccaagccggtggaattcacctccatcgacgaagacccgctggaccaggacgccttcgacgagaacggagccgaagccggggaacagcccgcagcgcccgccgctgcgcgcgaaccgcaacacagtgcggtgctggcgatccagctcggcgcccaggaacagttgcgccggttgccgcgcagccgcctggtggatctcctgcaacgctatcgcgactgcctggaacaggccgcccgccagtacaagggcagcctgcacacgctcagcgacggcggcagcctgattctcttccacagccgcgacaaccgcgccgactacctgaccaacgcgctctgctgcggtga

SEQ ID NO: 16056 - DNA, 879 bp, Pseudomonas aeruginosa
actgatgcgtgcgctcggccatgccctgcagatcgaggtcgccgacagcggcatcaccttgcaactgcaactgggcctgagcctcggcgaagacctcagcgaacagacccaggccgacctgctgctcaacgaaaccgtgcagaacgccctcgccctcaaccagcacagccgcaacctgctgctggtcgaacgcagcatcgccgacgacgcggtggtccgcgagcgcgcccgtatccgcgccatcgccagtccggaaggagcctgctgcgtcgagcgtctgctggagccgtatccgtcgatgctcgagcgccaactggcgcgcatgcacgaccgcgcccgcccgtgaccaccctgatcacccacccgctgccggtcctggcggtgggactggcccttggcagccgggtgatcccgccacgcctgctgctggcaggcatgctcgccgcctgcctgccggacttcgacgtagtcgccttcaagctcggcatcgcctatcacgatgccttcggccatcgcggcttcagccattcgctattgttcgccgcgatactcggcgcgctcgccgccctcgcctgccggccgctgcatagcggaccgctgaaagccgggctgtgggtggcgctggccaccgcctcgcacagcctgctggacgcgatgaccaatggcgggctgggcgtcgcctggttctggccctggagcgacgcccgctacttcatgccgttccatccgatcgccgtgtcgccgatcggtctgtcgcgcttcctcagcgaacgcggattgctggtgctgcaatcggaggcgcgctgggtctggctgccctgcctgctgctggcgctcgccggcatggccctgcgcttcctgttgcgccgctcacgctga

SEQ ID NO: 16057 - DNA, 1443 bp, Pseudomonas aeruginosa
cgcgcaggctcggtagaaggcctgcgcggcgcgataatcgagggtttcgtcggcggtctgcagccatacctggtagcgttcgggacgttgcaggcgcgtgacttccagttcggccagcgccgccacgtggtcctcggtgagttcccaggtctcgccgctgtagtggttggtctgcgcgcccaggtagccgtcgaaggagcgatgcggggcgaccgccggattgaccaggatcgccgccaggccatggcgctccgccaaatgggtcgcatagtagccacccagggagctgccgaccagcaccggtcgcccgagctcggcgatggcccgctccaactgggcgatggcctgccgtgggtgatggtgcagggccgggacgcgcaggccttcggccaggcccaagtggccgaaggccgcctgcagctggcgcgccttgtgcgattcgggcgaactgttgaagccgtggatatacagcagggatgggctggtcgcagtcatcgggaacgggctaatgggcttcaactcggtagggaaagccgaacggtaccagcttccaggcttcatcttccagcctgcgcgccgatcggcaacgacgcacgcggccgcggcatcccgcggccggggggcatgtcagtatccggcggtgtcgtagtccacttcgaagacgacgtcgtcgacccgcgagatccccgtttccaggcgcccgtcgtcgtgcaggcgcaaccagcggtagcccggcgccaggcggtcgagggtgaagtcgctgctgccgggggcgaactgcacgcaggtggacggcgaggccagcaggcgcagcgggccgcgctggcggtcgaactcctggtgaatgtgcccccacagcaggcaacgcacctgcggatagggtgccagcaggtcgaacagcgcctgcgggttgcgcaggccgatggggtccatccagtcgctgccgatcggcaccgggtggtgatggaaggaaaccagcaggaagcgttcgccggcgctgtcgatggcacgccgcagcaggtcgagctggtcgtcctcgagatagcccggcaccgcgccgggaatgctcgagtcgagcaacaccacgcgccagttgccgacgtcgacgacctgctccagcaggtcgctgccctcggtcgcccgctgcatcggctcgcgttcgtcgtggttaccggcgaaccagcgcaacggcgcggccagcggcgcgctcaacctgcggaagcgtgtgtaggaatccaggctgccgtcctgggagacgtcgccggtggcgaggatcaggtcgatccgcggttgctcccgggcgacccgctcgaccaccttttccaggctatgggcggtgtccatgccgagcaggcgcgcgccgtcctcggcgaacaggtggctgtccgaaagctgcaccagcagtacggaggcgtcggtggcgggagtgttcgaatggcgtga

SEQ ID NO: 16058 - DNA, 1026 bp, Pseudomonas aeruginosa
aggcgaggcgtccgcggtgaatggggtgattatggtgaccgacgaaagtggcggcaaacccggaaagcggaacagatcacagttgcgaggactacttttggcttgatgccattcaactggccttttgcctgcaaccgctcagcgctgggccaccggcaccatctcgtggccgcaggccaggcagtgggcgagccactcgccgaggaacaggttgagctggttcttctcgtcgggctggtgcatcgcctggttcgggtagggatagatcgccatcagccgccgcgcctgttcggcgccgatcacctcggccatccgtgcatcgtggtagacccgcacttccagccgcggcgccggcaaccagggcaggcccagttcctggcgcacctgcagggtggtggtgtacgggcaggcctcggtcacttccagcgccaggacgccgagcagccgctccccttcgctcagcgcgacccggcgcgaggcctgtgcctcgcgcatgtccgggagcaggcgcatgagccgcgcgtagttcgcttcgcaggtcgcctgcaggctggccaggtcgacccggtagcgctcgcgcagcaggttcaggcccatagcccacgcacctcggcccggttcagggccagccactgcagggcgatgatgctcgccgcgttgttgatccgcccgtcgcgcacggcctgcagcgcatcttccaacggccagacgtggacgcggatgtcctcgccctcctccggcaagccatgcacgccgccgacgccttcgctgtcgcaacggccgacgaacaggtgcaccacctcgtcggtgccgcccggcgacggcaggtactgggttatcggccagagcgcaccgagggtcagcccggcctcctccatcgcctcgcgatgggccacttcctccggttgctcgtccttgtcgatcaggccggcgaccagctccagcagccaggggttggcgagcttctgcatcgccccgacgcggaattgctcgatgagcaccacgcaatcgcgctgcgggtcgtag

SEQ ID NO: 16059 - DNA, 1548 bp, Pseudomonas aeruginosa
ccgccaccggtagcgaccttagccttgccccacctcgcatcttttccaggacgaacgaatgctgcgcagactctccctggcggccgccgtggccgctgctaccggtgtcgcctgggccgcccagccgaccccgctgccgaccaagaccgacctgatcagcgtctacaaggaagccgtcgacaacaacgccgacctcgccgccgcccaggccgactacctggcgcgcaaggaagtggtgccccaggcccgcgccggcctgctgccgcaactcggcgccggcgcccgcgtcggagacacccggatcgcattcgacgagcgtccggcgaccgtcaagcgcaacagccaggtcgtccaggccaccctcagccagccgttgttccgcgccgaccgctggttccagtggcaggccgccaaggaaaccagcgaccaggcccggctggaattctccgcgacccagcaggacctgatcctgcgcagcgccgagacctacttcacggtgctccgcgcccaggacaacctggccaccagcaaggccgaggaagccgccttcaagcgccagctggaccaggccaacgagcgcttcgacgtgggcctttccgacaagaccgacgtgctcgaggcccaggccagctacgacaccgcccgcgccaaccggttgatcgccgaacagcgcgtggacgatgccttccaggccctggtgaccctgaccaaccgcgactacagcgccatcgagggcatgcgccacaccctgccggtggtgccgccggcgccgaacgacgccaaggcctgggtcgacaccgcggtgcagcagaacctgcgcctgctggccagcaactacgcggtcaacgccgccgaggaaaccctccgccagcgcaaggccgggcacctgccgaccctcgatgccgtggcccagtaccagaagggcgacaacgacgccctcggcttcgccaacagcgccgccaatccgctggtgcactatggcaagtatgtcgacgagcgcagcattggcctggaactgaacatcccgatctacagcggcggcctgacctcctcccaggtccgcgagtcctaccagcgcctcaaccagagcgagcaatcccgcgaaggccagcgccgccaggtggtgcaggatacccgcaacctgcaccgcgcggtgaataccgacgtcgagcaggtccaggcgcggcgccaggcgatcatctccaaccagagttcgctggaagccaccgagatcggctaccaggtcggcacccgcaacatcgtcgacgtgctcaacgcccagcgccagctgtacgccgccgtgcgcgactacaacaacagccgctacgactacatcctcgataccctgcgcctgaagcaggcggccggcaccctcagcccggccgacctggaggcgctcagcgcctacctgaagcaggactacgatccggacaaggacttcctcccgccggacctggccaaggccgccgccgagcagttacagagcaagccgcgccagcagtactagcacgagccaagacgcccccggtcgggggcgtcttggcttga

SEQ ID NO: 16060 - DNA, 1770 bp, Pseudomonas aeruginosa
aggattgcggttcgttgtgggcgtggacgatcagtacgttcatcgtggtttccgaatcgtggtgaccggccgcatcgctcgcggccgaggggttcaggcctggccgagcaactcggcggcgcacagcgcaatgcgccgacaggcttcgcgcagcggttcggcgcccaacaccaggccgaggcggatgtgaccggcggcgctcgggccgaaggcttcgccggcgagcaccgatacgccatggcggtccagcaggcggtcggcgaaggcctgggcggaaagtccggtgggacggatgtcgaccatcacgaacatgccgccgtccgggcgcagtggacgcaggccggggctgtcggccaggcactcgattaccaggtcgcggcggcggcggtaggcctcgcgcatcgcctccaactccggcagcggcgcttccagcgcggtgcaggcggcatcctggatgaattccggcgagccatagagcatgcacagggcgaggttctccaggtgcgcgcagagtgctgcgggaccgaccacccagccgacccgccagccggtcatggcgtgggatttcgacaggctgttgagggtcgcggtacggtcggccatccccggcaggctggccgggctgacatgctcgccgtcgaacagcagttcgctgtagacctcgtcggagatcatccacaggtcatgggccatgcacagctcggccagggcttcccaggtggcccgcggcaggctggcgccggacgggttgtgcgggctgttcagcgccatcgcgcgcgtgcgcggggtgatcagtgcggcgacctcctcggcctgcacgcggaagccattctcggagcgcaccggcaccggcaccacccgcgcgccacaggcgccgaacaccgcttcgtaggtgacgtacatcggctcggcgactatcacctcgtcgcccggattcagcaggcactgcaccaccgcgtacagcgcgcattgggcacctgccagcaccaccacctgctccgcgtccaccgcctggccgctgcgccgccggtggcgctcggcgatgcgctggcgcagggcgcgcttgccgcgcacgtcggcgtagtgggtgttgccggccagcaggctgtcgatggccgcctggacgatgggcgccggggtatcgaagtcggggtcgccgaccgacagcaggaggatttcctcgccctgctcgacccgcgccagcgcgcgatagtggatgtcccaggcagcggcgccgtcgccggcgatacgttgagtgaagtcggaatagcgcatggatgctctccttgtccggcggtcagcgcgcacaggcgtgccgcagttcgatcagggtcacgccgggctgcccgaagccggcgcgcaggtcgcgctccagttcgttcaggtcctgcggctggcgcaccgcgcaaccgtaggcgcggcccagcagggcgaagtcggggttgcgcggcagcacgccgaccggctcgatgtccaggccgagcatgtcgtcgcggatctggccgagcgcgtcgttgttccacagtagcaccaccagcggactgtccagttcctcgctggcggtggccagttcctgcgcggtgtagaggaagccgccatcgccgaccagcaccaggcccgggcgctgcggggcgccgagcttggcgccgatgccggccggcaggccgtagccgagggtgccgtagccggtgggatgcagccagctgcgcggcgctcggctggcgaacgcgtagttgccggtataggccagttgggtcatgtcggtgctga

SEQ ID NO: 16061 - DNA, 1665 bp, Pseudomonas aeruginosa
cgcggcgccgtgcaggtagtcgagcaagccgtagcagttcgggccgagcagcgccatttcgccggcggcggccagcagccggcgttgcacggccaggccctgttcgccggtttcggcgaagccggaggcatagcagatcgccccgccggcgcctttggcggcgagcgcggcgaccgcgtcgagggtcagttcgcggttggtggcgacgaacgccgcgtccgggccgcacggcaggtcggcgacgctggccacgcagggtacgccttcgagttcggcgtgctgcggattgaccagccacaactggccggcgaaaccgccttcggcacagcgtttcagggcacgcgccatgccacggccgccaatgaaggcgagatgcctgggtgccagcaggcgcttgaggttttcacgattcatgtcggttctcgattcggaacatggcagccttcccctctcccctggaggaagaggggagccaggacttcaacgcagcaacggccgcagcagttcgcgggaaacgatgtgccgctggatttccgaagtgccctcccagatccgttcgatccgcgcgttgcgccagatgcgctcgaccggtccttcatccatcaggcccatgccgccgaagatctgcaccgcttcgtcggcgaccttgccgagggtctcgctggcgaacagcttggccatgccggcctcgccgtcggtcatggtgccctggtccatcttccaggcggtgtgcagggtcatcagctcggcggcacggatctgcgtggccatgtcggcgagcttgaaggaaacgccctggtagctgccgatcggctggccgaactgcttgcgatcggccgcccagcgcagcgacaggtcgagggcgcgctgggcctggccgacacagttggcggcgaccatcacccgtccggcggtgagccaggcgttggccacttcccagcccttgccgacctcgccgagcaccttggaggccggcacccggcaatcgtcgaagaagatctcgtaggtgtggtagccacggttgctcacgcatttcggcccgcggcgcacggtcatcccgggcgtgcccttgtccaccaggaaggcggtcaccgcgttgcgcttgcggccgttgtgctcgtagctgtcggtgacggcgaagacgatggcgaagtcggcgtgcccggcgtggctgatgaagtgcttgctaccgttgatcacgaaggcgtcgccgtcgcgcaccgcgcgggtcttgatcgaattggcgtcggagccggcgcccggctcggtgagggcgaagcaatcggtcttttcgccctgcacgcagggcaacaggtagtcgccgagctgttctccggtgcaggccatgaggatcttcgagggccgcgcgacgaatacgtggagggcccaggagaccttcgacagctcgcgttcgaccagcgcctgggacaggtagtcgaggccgccgccacccacttcctcgggcatgttgaaggcatagaaaccggcggcgagggccttgccgcgaatctgtgcggccagctccggcgacaccgcgtcggcgcggtcgacatcgtcctcgtggggcagcagttccttctcgacgaagctgcgcaccgcctcgaccagcatgtcctgttcctgggtcagcctgaaatccatgggaatcacctgctcggcgcctag

SEQ ID NO: 16062 - DNA, 1257 bp, Pseudomonas aeruginosa
gccagcaccgcgccggccgggccgccctggttgatggtcacgccggagcccatgaacaggccggtgccgatcaccccgccgagggacagcatgaagatgtggcggctcgccagggcccgggtgagttgcagcctttccttgccgtcagccatggcgcacctccggatgagggtacgcacaggggtcttcgagatggctcattattcttgtctccactctgtcagaggccgtgtcttgcgcacggatgagcggattattggcggcggatgtaagacgccgttgaacgcgcggatcgaagatgtaaaaagctgtaaggaagttgttcgccgcgccgctcaaccggccgctgagtcggcttcgccgaggaagccggcgcggcgcagggcttcggcgccgtcgcggcgcaggctacccaggcgtgcgccccaggctcgcgggtcgaccccggccgcgcccagggcctcgcgctccagctcgcccaggccggcgccgagcgccaccaggcccatggagtggcagcttccggacaggcgatgggcgatgttcgccgcctcggccaggtccgcctggtccagggcttcggccagcagcggcaactgctcgtccaggcttcccagcaggttgcccagcagtccggcgagcttgtgccgccccagcaggcggcggtgggtctcgagcatttgccggtccagcgcggcctccaccgcaagcgcaggcacgctggtgccgacctcgcccagcgcgcggcgcagctcgtccatccgcaggggcttgccgagcacgccctgcatgcccgcggcgaagtaccgacgcaccatgtccggctggatgctggcggtgaaggcgaagatcggcgtggagcggttcaggccgtcgagctgccggcgaatcccggcgcaaagctcgaggccagccatccccggcaggtgcatgtccagcaggatcaggtcgaagcgccgctgccggcacaacgccagggccggccccgcgtcctcggccagcatcacccggtggccgtcccgctcaagcaggccctgggccacctcgcggttgagcgccacgtcctccaccagcagcacctccagcgcagacaccgatgccgccggcggcgtcgcgccggacaagctcgccagcgccagctcgatctcgaaccagaacgtgctgccctggccgacccggctttccacgccgatccgtccccccagcgcttccaccagccgcttgctgatcgccaggcccaggccggttccgccgtaa

SEQ ID NO: 16063 - DNA, 681 bp, Pseudomonas aeruginosa
acctgtgggtccagccacaggtccagccgcgtggcgttctcccgcgcccgcggttcgagcagggtgaggacgtcctcgagcaggcttcgcaaggaaaagtccaccgcttccggcacatccggcgcttcctccagccgggcgaagtggaggacctcgttgaggatcgccagcagtccctcccccgctgtcgccagtgcccgcaggcgctggcggtcacgctcgccgagcgatgcctcgcgcagcagctcggccatgcccaggatgccgttcagcggggtacggatctcatggctcatggtcgcgaggaaacggctcttcgcccggtcggcggcttccgcctggtccttcgcccgacgcaggctggcggtgcgtcgctcgacctgtcggcgcaactcgtcgcgatcggcatcgcgccggcggcggtcggtgcgcagagcctggcgcatgtcttccagggcggcggcgacggcgtcgatctcatcgcgctcgcggtccaccttgtccagtcgcagcggctgttgcaggtcgccttcggcgatatgcccggcgaactcggacatgcgccacagatggcgagtgaccaggctgtggaacagccaactgagggccaccgccaggccgcaaaggaaactgcccatccacaagaggctggccaggccgccggaaaccagccggcgatag

SEQ ID NO: 16064 - DNA, 960 bp, Pseudomonas aeruginosa
ccgctgcggatcagttccaggcgcgcctcgatctcgcgcatttcgcggcggtattcgaagaacagctgcacggcgccggcgaggacggtgaaacacaggctgaacagcagcacccgccacagcaggcgccgcgccaacactccgccgtggccgctcaccaggcgtccgcgcggttgccggcgaggcgccgatagtcgcgcacgctgtcgtccagccaacgctggatgctgccgtcgtcgcgatagccacgcagggcccggtcgatctcgtccatcttcgccgccagcggcgagtgccgcgagaccgccacccgcaggtagtccaccgtcagcggttcgggcagcgcacggatgttctcgccgccggccaggcgctcggcgaacagcgtgccggtgcgccgttcgtgggcgatgtagtcgatgcgctggcgcaccagcttgccgaagttctgtcggctgtcggaaacccattcgacgttgccgtggcggccgacgaagcggtcgaagtccgccccgtagctttcgccgaacaacagcccgccgcgatagccggcgaggtcgccgagggattggatgcgcaccggccgctggcggttgtagaagatcgccacgtcctcgcgcagcaccggctcggcggaaaacgccaggtcgcgatcgcgcgcgggcgtgcggtaggccagtatcaggtcgacccgtccggcggcggcgtcgagcaggcagcgccgccagttgcccagcaccaccacctcgacccggtagcccagcgcgccgaacagccgcttcaccagctccggcgccagcccccggacctgctggccgtcgctccaggagatcggcgggtataccggatagtcgcaatagcggatggtctccgcagcctgtgccaggccgcccagcagccatccgcagagcgccagccagcaggcctgcatggctcaggcgtcgctggccgcggcggtga

SEQ ID NO: 16065 - DNA, 408 bp, Pseudomonas aeruginosa
accgccgcaaggatggctacaacggcgacctcgatgcccgcctgcgtttcctccgcgaagtgctggcggcggtgcgcgcggccacctccgaggacttcatcgtcggcctgcgcctgtccgccgacgagcgcgaccccgagggtctcagcgaaagcgagtcgctgcaggcggccgaggcggtccagggcgagctggactacctgcacatcgtcgccggcacttcggcctccctcggcggcgccattcatatcgtcccgccgatggccatcgagccggcctacctggcccgcgaagccagtaccttcaaggcgcgcctggcgatcccgctgttcgtcaccgggcgcatcaaccagccccaggaggccgaggccatcctcgcccgaggccaggccgacgtctgcggcatga

SEQ ID NO: 16066 - DNA, 1125 bp, Pseudomonas aeruginosa
ccaggcccagccgaggttgcgcatcagcagctcggccatggaatagaagctgtccagccgccagacctgcgggctgatctgctcgccgcccggatagccgctctgctggggcacgatcaaaagttgccggtgctgtgccagctcgcggcgactgacccgttgcagcccggccagcgggtggccggcaccgcacaccgtgaccatctcgacgctgccgaggcgccgccgctccagcgactcaggcatgcgctcatggtggaacagcaggccgaggtcagcctgctcctcgagcaaacgacgggtgacgtcaccctggccgccgctggacacctgcacctccagactgggaaagcgctgcgccagcgcttccaggctgtccagcaccggctggtagggcatcgcctcgtcctgggccaggcgcagccgcggctcctcgccgcgcgccagccccagcgcgcgcccctgcaggcgctcgcactggcgcagcacctcgcgcgcctccgccagcagcacccggccctcgtcggtcaggcgcggctggcgtccgctgctgcgttcgaacagggtgacgccgaggtccgcctccagcagcgcgatgccgttgctcaccgccgattgcacccgcttcagttcgcgggcggcggcagagaacgactggcgctcggcgacgctgacgaacaggcggatctgctccaggttccactgcataacctatctccaataaagataggtaacgactttatcccatccgccggctccctagaatggccgcagtttccggaggaccccgccatgaccaactatctctacctctccatcgccatcgccgccgaagtggtcgccaccacctcgctgaaagccgtcgccggattcagcaagccactgccgctgctgctggtggtgggcggctacgtgctcgccttcagcatgctcgtgctggtcatgcgcaccctgccggtcggcgtggtctacgccatctggtccggactgggcatcgtcctggtcagcctggtggcgatgttcgtctacggccagcgcctggaccccgccgccctcctcggcatcggcctgatcatcgccggcgtgctggtgatccagttgttctcccgcgcttcggggcactga

SEQ ID NO: 16067 - DNA, 1062 bp, Pseudomonas aeruginosa
  unsure (606),(620): Identity of nucleotide at the above locations are unknown.
ggcagccccatgccccaagccctttccaccgacatcctcatcgttggcggcggtatcgccggcctctggctgaacgcccgcttgcgccgggccggctacgccaccgtgctggtggaaagcgccagcctcggtggcggacagagcgtgaagtcgcaggggatcatccacggcggcgccaagtacgccctgcatggtgccctgaccggcgcctccgaagccatcgccgacatgccgcggcgctggcgcgcctgtctcggcagcgacggcgaactcgacctgcggggcgtgcgcctgctttccgaggcgcactacctgtggtcgccgggcggcctggccggcagccttaccagcttcttcgccagcaaggctgtgcgcagtcgggtcgagcaggccaagggcgaagatttgcctccggcgctgcgcgacaaggggttcaagggcaaggcctaccgcctcacggaaatcgtcttcgacgtccccgacctgattcgccgcctggcggaactggccggcgacagcctgctcgccggcgaacgcatcgaaccgctgcgcgaatgccgggaactggccggcctgtgcgtctacggccgggagaatcgtgcccancgcgtggtgctcantgccggtggcgggcaacgaagcgctgctccgcgaactgggcctggaacaaccggccatgcagcggcggccgctgcacatggtgatggtcaaggcggcgaccctgaaaccgctgtacgcccactgcctgggggcagggccgaagccacggatcaccgtgaccacccatccgacccgcgacggccagtcggtctggtacctcggcggcgacatcgccgaagccgatggcgtggcccgcgacgaagccgcgcagatcgccgaagcgcgtcgcgaactggcaaagctgctgccctggatcgacctcggccaggcgcagtgggccaccttgcgggtggatcgcgccgagccggcacagtccaacctgttgcgcccggacaacgccttcctcgccgaacagggacgcctgctggtcggctggccgaccaagctggcgctggcccctga

SEQ ID NO: 16068 - DNA, 933 bp, Pseudomonas aeruginosa
cttcgccgaccgggtctgcgcccgcctggaagaagacggcatccgccccagcgaacatgccgcgctgccgcaactgccgcgtccgccgctcgccgaaccggcctgggaggtggccttcgcatgatcagggataccctccacgacctgcaccgcccgctgggcgacaccggcctggccgtttcgccgctgggcctgggcaccgtcaagttcggccgcgaccagggagtgaagtacccttccggcttcaccatccccgacgaccgcgaagccgccgacctgctggccctggcccgcgacctcggcatcaacctgatcgacaccgccccggcctacggccgcagcgaggaacgcctcggcccgctgctgcgcggccagcgcgaacattgggtgatcgtcagcaaggtcggcgaagagttcgtcgacggccagtcagtcttcgacttctccgccgcgcatacccggcgctccgtcgagcgcagcctgaagcgcctggagactgaccggatcgagctggtgctggtgcattccgatggcaacgacctggatatcctcgagaacagcgaggtctacccgactctcgccgcgctcaagcgcgagggcctgatcggcgcctacggactctccggcaagaccgtcgaaggtggcctgcgcgccctgcgcgagggcgattgcgcgatggtcacctacaacctgaacgagcgcgccgagcgcccggtcatcgagtacgccgcggcccatgccaagggcatcctggtgaagaaggcgctggccagcgggcatgcctgcctgggcgccggacaggacccggtgcgtgccagcttcgaactggtcttcgaccagccgggcgtcgccgccgccatcgtcggcaccatcaatccgctgcacctggcccataatgtcgcgatggccgcgcaagccctgaaaaaggcctga

SEQ ID NO: 16069 - DNA, 939 bp, Pseudomonas aeruginosa
cccgacaaggagccccgtatgccccgtatgctcgcccgcaaggatccgtccgccttcaagaccctgccgctgctggtggaggcctccccggacgggctggtctaccaggccctcggcctgccgctgaacttccagcagatgctcgtacgccgccgccgcatggaggtagccgacccgcagcgcttcgtcgccgagctggccaacctgggggtctcggtgcgcttgaccctgaactggcagggccgcgactactgggtgctggtccgtcagcgccggctggaccgcggcgataccgtgctcaagctgatctccggctacgtaccggcccacgaactgaacctgccgctgctcacggcgatccaggaagtcgccgaggaatgcctggtggagaccgccggcggctggctcggcgggcgcttcggcgacacctggctgccgacgccctaccagggttcgctgcgctaccgggagaacagccacttcgtcctcaccccgctgtccggcgccgcccgtccggtgcaagccggcagcctgcgcttgctggagcgcccacgcgcctacgtacacctgcccacggcctcgctgcaactggtctacgacatgcgcctggagctgccgcgcgatgcgcgcgagccgagcctctaccatgtcgacgagcggctcgagagcggtccgctggtggcgcgtctggaccgtcggcgccccgatctctacctgctgccgctggaccaggggcgccccaccggcgacctgttcaccctgcgcaagggccagttgcgccctgcggccacccgcggcctgtggttggccgagagctttgccgtacaggacggctggctggtgcatgaggaacgcatccgtttccgcgactggctggcactgtggccatccagcaacggcgaccaggccggcggtgggcgcgaccgcgccagcgcctga

SEQ ID NO: 16070 - DNA, 2631 bp, Pseudomonas aeruginosa
accgggcgggctttgccgccctttctacttcaactggctggaagacttgccgagcaggcggcgagcgacgatgagcagctggatctgctgggtgccctcgaagatgtcgaggatcttcgagtcccgcgcccacttctccaacagctcatcctcggcgtagccgagggcgccagccagctccacgcacttcagggtgatctcgttggccacccgtccagccttggccttggcgatggacgcttccttcgagttgggcagcttgttgtcggccatccatgccgccttcaaggtcaacaggcgcgctgcctcccactccgcctccaggcgatagagagtggcctcggcgtggctgacggtcagcagcggtttcctgtagtcgaacttgcagccagccttcttcagcaattcgcgggtccggtccagcgccgccttggccaccccgacggccatgccggccaccagcgggcgggtattgtcgaaggtctccatgaccccggcgaaccccttctgcacgtcgacctcggcgttgcccagcaggttcgcggccggcacccggcaatcattgaaactgatcgaagcggtatccgaagccttgatcccgagcttcttctccagacgcgtcacggtcatccccggcgtgcccttctcgaccacgaaggacttgatcgccgcccgccccaggttgcggttcagggtggcccagaccaccacggcatcggcccgctcgccggaagtgacgaaaatcttctcgccgttcagtacatagtggtcgccatcctgggtcgcggtggtgcgaatcgccgccgagtccgagccgcagcccggctcggtgatcgccatcgccgcccaggtgccgccgaagcgctgcaactgctcctcgttggccaccgcggcgatcgccgcgttgcccagcccctggcgcggcatggccaggagcaggccgacgtcgccccagcacagttccatcacgccgagcaatgccgacaggttgccgccgttcttgatgccctcctctacctgcttgccggcgcgcttgctcgccgaggtcgcgccgacagcctcgggcgagccgctgttcatgccgtccagcaaggccgcgagcaggtccagctccttcggataggcgtgttcggccttgtcgtacttgcgcgagatcggccggaaatagttttccgcgacctgatgcgcctggttggccaggctgcggaatttcttcggggtttccaggtacatgtcgattcctcgttcactcgtcgcggcggaccgcgcactcgctcgggttcacaggtgcaggccgccggccatcagcgctaccgcgcgcaggtcgcggtaccagcgctcggccggatgctccttggtgaagccgtggccgccgagcagttgcacggcgtcggtgccgatcttcatcgccttctcggcgcacagcagacgcgccaggtaagcctcgcgctggaacggctggccgcgctcggccagggcgcaggcgcgccagaccatcaggcgcatggcgtccagttcgatggcgatgtcggcgaccatgaaggcgaccccctggcgatggctgatcggctcgccgaaggcctcgcgctcgttgcagtaggcgatcacgtagtccagcgccgcctgcccggtgcccagcgccagggcacaccaggccagggccgcgtgatcgaggaaggcccggtagtcgaaatgctcggcggccaggcggttgtccgccggcaccttgacgctcttcaggcgcaaccgggcggtgccgccggccttcagtcccatcgccggctcggcacgtcgctcgacgcccttggcggaggcttccaccaggaacagcgcaggcccctcgtcggtcttcgccgcgacgatcaggcggctggcctccaggccgcgcaggaccaggcatttctctccggaaagcaggtagtgactgcccttgcgccgggcgcgggtcgccagtttctgcgggtcgaacagcagactcggctcgttgaccgcgatggcggtgagcggcgccccctcttcgctgacgaacgccggcagccactgcgcctgctgcgaggggctgccccagcggcggatgcagttggccgccgacaacggcaccagcagggccgccgccagcgtcaggtcgcccttggccagggcctcggcgataagggccgtggtcaccgtggtgcgctcaccggccatgccgccgtgcacctcgccgaccccatagtgggtcaggcccagctccagcgcctggttgagcagttccgccggcaggctggcctcggcatccgcgtcatgagccagcggacgcaacacctccagggcgaagccttcgagcatgtccaccagcatctgctggtcgtcggagaacgacaggtcgaacaacccgtccggatcggccttgcgcggtcccttcgcctgcttcgccgaacgctcgctggccaggcggaagccggtacggctgccgctgtagagcagtttttcgaagggtttgcgaagattgaagcgatccggccagtcggcctgggcgacacggttcagtacagccagggcacggccctgtacatcggtgctcatgggcatcttgctccacgcaggatgggatgcccggatcatgcgccgccgcatgggcagcgcctatga

SEQ ID NO: 16071 - DNA, 312 bp, Pseudomonas aeruginosa
cgccgaccagcaaggcctgcgcgcccagcgcggcgatgttcagcgcgacgttggcggcgccgccggggcggtcctcgtgctgttcgacgcggaccaccggcaccggggcctccggcgaaatgcgcgaagtcgcgccatgccaatagcggtcgagcatcacatcaccgaccaccaacaccggggcctggtcgaaacggggcatggacaacttcatgggaactccaaacaacctctcggggcagacgcccagtttatcagccgacaggcgccggcgcctgctcatccagtcccatcgcgtgcagccgcgcataa

SEQ ID NO: 16072 - DNA, 1824 bp, Pseudomonas aeruginosa
caacgcagaagtgctggaagccgatggtcatggggacaaggtactgcgtctgcgcgacgggtccttcctcaagctgtttcgccgcaagcgcctgatttcctccgcagccctgttcccctatgcggagcgcttcgcccgcaatgccagcgaactggcgcggcgcggcatcgtctgcccgaaggtgctggacgtactgcggatcccacatatccagcgcgacgcggtgcactacgagccgctaccggggcagaccctccgccaactcgaccgcaacgacccggagtgcggcgatacagtccggacgcaactgggcgagctgatcgccgcgctgcacgccaagggggtgtacttccgctcgctgcacctgggcaacgtggtgcgcacgccggaaggccggatgggcctgatcgacatcgccgaccctgcgggtccagcgctcggcgctcagcgccgcccagcgcattcgcaatttcaagcacctgctgcgctacgaacaggatcgaacctggttcctcgacgacagcgagcacctggtgctcaaggcctatctccgcagcagccaggtccactggacactcgagcagctcctcaagcaactgcaactggattgagcaaggaatgttcgcagctacccgactgacccgtcttcgtcacgataccagccgcatcctcagccactggatcctgccgctgggctggctggccctgctcaccggaatgttctgggtcggcgaccgttccgactatcaccggcttttctatatcttgctggctgcaccgacgctgctgtacgtgatactgcaaccgcgtctgcttcgcccgctaacgggctcgccgctgttcatcgccttcctcgccttcagcagctacatgatgctgagcctgtcctggtcgacccccgagaactccaccggctcgctgctcaagcgccccctgtacatcgccctcctgttcttctgcgccgccatcctggcgctcgaagctcccctccgcctcaagaccgcgacctggctggcagcccttggcgcggtgatctccgcggcagccaccttgctgcaatactactgggacgccaacccgctgcgccttaccggttatggcgctctctataacccattactgagcgcccatgtctatggcgccttcacggcactctggctggcctattggatgcaatcccgccccatcctggcccccttgccactgatatctctggcgctgctcggtggccttcttatcgcgaccggttcacgtactcccctggtagggctcacagcggcccttatgtggctggtcctggccggagacaggaaaaaagccctcatcgccctggcactcgccctggctggagcgctactgggctacatcctgtacccggaagtgatcacccagagaggggcatcgttccgcccggaaatctgggccgacgccctacgccagatcagcgagcatccatggttcggacacggctacgatcatccgatgcgaatcgtcctgagcaacggcatgctgctcgccgacccgcacaacatcgaactgggtgtgcttttcgctggagggatcatcgggctcctgctgtgggtggcgatctacgcactggccttcggcttctcctggaaaaaccggaagtctccagcggttctgctagcctcgacctggctggtgttcggcctggcagccggactcacggagggcaacgccttcctgccccgtcccaaggaacactggttcctgatctggattcccatggcgctgctgtatgcgctgtggatccagcaaaggttcgccgccagcaggcgcggtgaggatatcgccgcgccttga

SEQ ID NO: 16073 - DNA, 450 bp, Pseudomonas aeruginosa
ccatcacccgccgatcacggtagtcgggatggcgcgcacgccacagggtcggttcgccgaccagccggcaatgccggccgcgcaggcgaatccggccctcgcccagcggcccggccagtcccgtcaggttcaggtagcgcaagccgttcaccccacgttcgaaagcctgggcatcggcctccgcgccaccttccagcagcaccgagggttcgaggaagcgccccagccagccagcgcgcacgccgatgccaagcaccagcgtatcgccttcgcgcagctcaccgtcgactcgcagacggccatccgccaggcgtaccggcagcgactcgaccccttccgcgaaacggtagcggtagtcctcgcccggcgaatagaacaggtgatcggcgaaccaggcttcgtgggcgacccacagggccacgaggaggatcggcaacaaccaggggctga

SEQ ID NO: 16074 - DNA, 1407 bp, Pseudomonas aeruginosa
gcacgtccttggacaacgccaggtggcggccccaggtcgggatcgccgcaaccagttcgccagcgctctcccaacccaggtaacgcaccgggattccagccatttcggcgagctgctcgaccaccagcgggtgggtcgcgacgctgccgccgaaacgctgccaggcctgggcgtaggtcggcgcgtccacttcgcgccaaccgcgttcgcggaaggcgcgcaacctgttcagcatgcagactccgaagcgaagccggcaatcgtcggcaggcgccagaattcgcggcgcaccgcagcgtcggagaagcgtgtctccaggcgctcgagcatgagccgcgcacaggcctcgcgctggcggcggtcaagcgccgccaggtgggtcaggccctcggccagggccgtctcgtcgcccagcgggaagaggatgccgaccccttccaccacttcgcgggcgccgccacaggcggtggcgatcagcggtacaccggcaaccatggcctccagcaggaccatgccgaacggctcgtggtcggaactcagggcgaaggcgtcgaacgccttgaagtagcgccgtgcctcttcgacctggccgaggaacagcacgcgctcgccgatacccagttcgcaggccaggtccttgagctgctcttccaggcggccgctgccgaggatcgccagcaggctgttctgcggcaggcgcggcagcgcggcggcaaagccgcgcagcagggtagcctggtccttgtccggatgcaggcggccgacgttgccgaccacccaggcctcgtcgggcaggcgcagttgccggcgcgcactcaggcgctcgacctgctcggcctgcagcgcagcgacgtcgatgcggttgtagagcgtctcgatccgctccgccggccacttcggcaggcaacggcggatatcgtcgcgcaccgcgtcggacaccgccagcaggctcaggcgcttgctcatcaggccggcgaagaccttgcgcgacaaccgctggtaatcgccgaaggcgtggtgcacgccaacgatcggcagacgagtggccaggctggcgatccagatcggcttgaagcggtgcgcgatgcagaagcggaagtcgcgcgaacgggcgatctcgcgcaagtcgcggatcgccttcagcttgaggccacggatgtccctggagccgtactcgaggaacagtacctcgtcggaggcgcaacgcgccgccacctcaggatcggaacgcccggtgaggaacaccgtggtgaccttgtacggggttccggcgaacaggctggcgtactgacgggcacagtcgaggaaaggcccgtcgtagccgtgacagaactgcaggacgcgaggttcagccgaccgagtcataccagtccacgccctccttcacgaccaggatgtcctccatga

SEQ ID NO: 16075 - DNA, 585 bp, Pseudomonas aeruginosa
cctggtcgcggcggccgaaccagatcgggcgggtcttctccaggtcgatcaggcaggcctcgaagacaccatcggccccctcgcggaggaatacatgcttgggatagaagcaaccatgcatctgtccggcggcgtgcagctggcgcgccagcctgccaaccgcccggagaatcgcccggcgccgctcttcggccaggtcgtgccaggacgccagccaggtgtccaggtcctgccaaccgtccagggcacgggtcaggaggatcgcctggcgctctccgccgaccgcctgctgggcgaagaacgccgcctgcagggcgggaatgcccagcgcccggtagcgctcgatgttgcggaactcgcgggcgaaggtcggctcgcccagcggatggcgcaggctgcgggtcaggtggttgctctggcgcttcaggtagtaggcggagtcgcccaggtcgaggcggtagacgctgctccagccaccccgctcggtattcggttcgtccacggcgtccagctgcaaggcccacagggcgtcgaagctgtccagacggttgcgctggagcaggtcgtggtcctgcgcggcgatga

SEQ ID NO: 16076 - DNA, 804 bp, Pseudomonas aeruginosa
tctggggagtaccgcggcattttccaaccccgccgccaggcgcccggcccgctcccgctcggcggcgctgccccagggcaggcgcaccgaccagccgcgctcgcacatgcgctcggccagttcgcgccagtaggcttccggccaatgcttggtgtcccaggtagtaccgtgcaggaacaccaggtacggcgcgccagggtcggcgtcggccaactgctcgcggtccaggccatagtcaccgaccgactcgggcaacgggtagtccagcgcctgggcgaacaactggcgcgtgcgctccaccgcatgctgtccccaggcgaccggataggcacggcgatagaagcggctggcgagcggctcgcgcgccgagtcgcgatcgagaccggcgaccggcgtcttgcccacgtagcgggtcagccaggcactcttcagcagcccctgggcgtcgatcaccaggtcatagtcgacttccttcaggcgctgcttgaagcgccgccattcgccgttgcgcagggtctgccagaggttcttgcgccagcgccggatcgccaccgggatcacccgcgccaccgccggatgccaggcgggaatctcggcgaaaccttcctccaccacccagtcgaactggatgccgggaatcgcccgggcggcgtcggtaagcgccggcagggtgtggatcacgtcgccgagggacgaggtcttgaccagcagtaccctcatccggcgacctcggcagggtcgccgaccagccgctccagggcttgcaataccaggccaggcggcagctcgcggaggcaattgtag

SEQ ID NO: 16077 - DNA, 426 bp, Pseudomonas aeruginosa
gcctcctgcaggagacggacgtcctcgctggcgatcaggccagcccgttccagtccttccagaatgcggatgttatcggtgaattcgagcagcgccgggtgttctccggaccaagctagaaccgcatattgcaccataaattcgatatcgacgataccaccggcatcgtgcttgagatcgaaggctgccgtggcctcgaaggcattcgaggcggtaccggcggcggtcgcgcgggttcccaggttgtcgcgcatcttggcgcgcatttcgctgacttcggtgcgcaacgcgtcgagatcgcgcggcctcgccagcacctcggcacgtaccgcctcgaagctcgcctgcacccgccggcaaccggccagcacccgggcgcggaccaacgcctggtgctcccaggtccaggcctcctgctcctggtag

SEQ ID NO: 16078 - DNA, 705 bp, Pseudomonas aeruginosa
ccgaagatcaggtcgatgtccgacgacaggttgagctccaccgcgcccagcttgcccatgccgaggaccaccatccgctgcggttcgccggagcgccggccgatcggcgtgccgaactgctcgcactggcgccgatggagccactcgcaagccaggtcgatgcaggcgtcggccagggccgacaggtcgcgacaggtttccgccagcgcggcgcggcgggtcaggtcgcgccagatgatgcgcagttgctggcgtgtgcggaaacgtcgcaggcgccgaccgagttcgtcctcgtcggcgcaatcctccagccgcgcctgcaactggctgcgcaattcgccgggcgcgtgggggttctccagctcgccgcgttcggccagatccagcagcatcgccgggtcgcgcactgcctgctcggcgacgaaatcgctggccgcggcgacccgtcggaaatcctccaggcgctcctcgggccaggcctccaggcgggccagggcggcggcatcgagggcggcgacagcggagcggagggcagtcccggcgcgttcggcggcgggcagcagggtggccggcagattcgccagcgaaggcaggctcatggtctatcctgtttgggcttccgaccgaagaccacaggctcgacgcacaacgtcgaaaaggctctacatcgggccttatagcctgacagcgacaatcgaaatgtag

SEQ ID NO: 16079 - DNA, 1182 bp, Pseudomonas aeruginosa
cggcacccaactgccctacgcgatcaccacgccctatcgcaacaccattccggtaacccacgaagcacgcatgcccggcgacctgttcatggaacgccggatccgctccctggtgcgctggaacgccctggcgatggtgatgcgggcgaacaagcacgacccggacctgggcggccacatctccaccttcgcctcctcggcgaccctctacgacatcggcttcaactatttcttccaggctcccaccgacgaacacggcggcgacctggtgttcttccagggccacgcgtcccccggcgtctacgcccgggccttcctcgaaggccgcatcagcgaggaacaactggagaacttccgccaggaagtggacggcaacggcctgtcctcctatccgcacccctggctgatgccagacttctggcagttccccaccgtatccatgggccttggcccgatccaggcgatctaccaggcacgcttcatgaagtacctggaaagccgcggcttcatccccgccggcaagcagaaggtctggtgcttcatgggcgacggcgagtgcgacgagccggaatccctcggcgcgatctccctggccggccgcgagaaactcgacaacctgatcttcgtcatcaactgcaacctgcagcgcctcgacggcccggtccgcggcaacgccaagatcatccaggaactggaaggcgtgttccgcggcgccgagtggaacgtcaacaaggtcatctggggtcgcttctgggacccgctgttcgccaaggacaccgccggcctgctgcagcagcgcatggacgaggtcatcgacggcgaataccagaactacaaggcgaaagacggcgcctacgtgcgcgagcacttcttcggcgcgcgtccggaactgctggaaatggtcaaggacctttccgacgaggaaatctggaagctcaaccgcggcggccacgacccctacaaggtctatgcggcctaccaccaggcggtcaaccacaagggccagccgaccgtcatcctggccaagaccatcaagggctacggcaccggcagcggcgaagcgaagaacatcgcgcacaacgtgaagaaggtcgacgtcgacagcctgcgcgcgttccgcgacaagttcgacatcccggtcaaggacgccgacctggagaagctgccgttctacaagcctga

SEQ ID NO: 16080 - DNA, 1527 bp, Pseudomonas aeruginosa
agaaggcagcgccgaggccaagtacctggccgagcgccgcgccgcgctgggcggcttcatgccggtgcgccggcagaagagcatgagcgtgccggttccgccgctggaaaccctgaaggccatgctcgacggctccggcgatcgcgagatctccaccaccatggccttcgtgcggatcatctcgcagctggtcaaggacaaggaactcggcccgcgcatcgtcccgatcgtcccggacgaggcccgtaccttcggcatggaaggcatgttccgccagctcggcatctactcctcggtcggccagctctacgagccggtggacaaggaccaggtgatgttctaccgcgaggacaagaagggccagatcctcgaggaaggcatcaacgaggccggcgccatgtccagctggattgccgccggtacctcctacagcacccacaaccagccgatgctgccgttctacatcttctattcgatgttcggcttccagcgcatcggcgacctggcctgggccgccggcgacagccgcgcgcacggcttcctgatcggcggcaccgccggtcgcaccacgctgaacggcgaaggcctgcagcacgaggacggccacagccacctgctggcctcgaccatcccgaactgccgcacctacgatccgacctacgcctacgaactggcggtgatcatccgcgaaggctcgcggcagatgatcgaagagcagcaggacatcttctactacatcaccgtgatgaacgagaactacgtccagccggccatgccgaagggcgcagaggaaggcatcatcaagggcatgtacctcctcgaggaggacaagaaggaagccgctcaccacgtgcaactgctgggctccggcaccatcctgcgcgaagtcgaggaagcggccaagctgctgcgcaacgacttcggcatcggcgccgacgtctggagcgtgccgagcttcaacgagctgcgtcgcgacggccttgccgtcgagcgctggaaccgcctgcatccgggccagaagccgaagcagagctacgtcgaggagtgcctgggcggccgtcgcggcccggtgatcgcctccaccgactacatgaagctctacgccgagcagatccgccagtgggttccctccaaggagtacaaggtgctcggcaccgacggcttcggccgcagcgacagccgcaagaagctgcgcaacttcttcgaagtggatcgtcactgggtggtgctggccgcgctcgaagcgctggccgatcgcggcgatatcgagccgaaagtggtggccgaggccatcgccaagtacgggatcgatccggagaagcgcaacccgctggattgctaattcgctccatactcctctcggcagcgaggggtttcgagcacgccggcgccgccaacgggcggcgccggctcacaacgaaccaaggaccaaaagtctttgttttgcgcgccgcacagcggtggtggcacgtaaaaggagaggaatgtgagcgaactcattcgcgtacccgacatcggcaacggtga

SEQ ID NO: 16081 - DNA, 1446 bp, Pseudomonas aeruginosa
cgaagtcggcaccggcgacctgatcctcaagctgaaggtggaaggcgccgctccggcagccgaagagcaaccggcagccgctccggcccaggccgcggcgcccgccgccgagcagaagcccgccgcggcggcccctgcgccagccaaggccgataccccggctccggtcggcgcacccagccgcgacggcgccaaggtccacgccggcccggcggtgcgcatgctggcgcgcgagttcggcgtcgagctgagcgaagtgaaagccagcggtcccaagggtcgcatcctcaaggaagacgtccaggtcttcgtcaaggagcaactgcagcgcgccaagtccggcggtgccggcgccaccggcggagccggcatcccgccgatcccggaagtcgacttcagcaagttcggcgaagtggaagaagtggcgatgacccgcctgatgcaggtcggcgccgccaacctgcatcgcagctggctgaacgtgccgcacgtgacccagttcgaccagtcggacatcaccgacatggaagccttccgcgttgcccagaaggccgcggcggagaaggccggggtcaagctgaccgtactgccgatcctgctcaaggcctgcgcccacctgctcaaggaactgccggacttcaacagttcgctggcccccagcggcaaggcgctgatccgcaagaagtacgtacacatcggcttcgccgtggacactccggacggcctgctggtcccggtgatccgcgatgtcgaccggaagagcctcctgcaactggccgccgaggccgccgagctggccgacaaggcccgcaacaagaagctctcggccgatgccatgcagggcgcctgcttcaccatctccagtctcggccacatcggcggcaccggcttcacgccgatcgtcaacgcgccggaagtggcgatcctcggtgtgtccaaggcgaccatgcagccggtatgggacggcaaggccttccagccgcgcctgatgctgccgctgtcgctgtcctacgaccatcgcgtgatcaacggcgccgccgcggcgcgcttcaccaagcgcctgggcgagctgctggcggacatccgcaccctgctcctgtaatacctgcgccgctccccacggagcggccagcccctctcgcgagcatgccacgctcgtctctcggccccaccggatggtggggctttttttgcccgcctgacggctcggcgaaactgcgtcccgtcgtaccgccagcgaatgccacaggacccgcaggcgcgagttcggcgcgcacgatgacaggcgctcgacgccaaccctcccggcgaagccaaccctacgaaaaacagggcttttccagcggcaccgcagacctccgaccgtccagcggttttttcccggatacgcttaacttgggccctgccgggccgatacagagttacttgtcagaccaatcggcataa

SEQ ID NO: 16082 - DNA, 915 bp, Pseudomonas aeruginosa
tgcaccctttgcctgcaccccatcgaaacgggtcgaggcctccccctcgctcagtacctggaatcagcctcgcatgaaaagtcatcccgatgccgccagccgttcggcggccgaggttgtcacgcagctacccgtgccgtcgcggctcgggctgctgcgtttcgagcggctgaacgagccgagctgggcactgctgttcctcgatcctgcctgcgagcgccagctcgggctgccggcgactaccctctgcgcactgctcgatgcgccttacgccagcctgatggaacccgaggcccgccaccgcctgcacgagcagatccagcagcaactggtgaagcgcccgcactaccaggtgagctacaagctgcacacacccaacggcgtgctgaccatgctggagttcggcgaagccttccagcagcatggccgccagttgctgcacggctacctgatggtcgaggagcgagcggagagcgccgagcgcagcgaacagttgctcgacctggaatcgcagaacctgcgcctgaaggcgtccctggacctctaccagcgctcccaggacgaccacctgcaacacctgctgcgctcgcgcacccagcagaacctgatcgtccgcctggcccgccatcgctacctgtccagcgacccgctgctggaagccgcgcaactgatcacccaggccgcctgcgaagcctacggcaccgcgcgcgccggcatctggcgcctgctcgacgaccagcgcctggaagcggtgaccgtctaccgccgcgacctcgaccagtacgagaagccccagagcatcgacgccagccgctaccccgcctacctcgaggcggtacacagcgggcgcgccatcgacgcccacaacggcccagcgcgacccacgcacccaggaactctacaaggactacctga

SEQ ID NO: 16083 - DNA, 414 bp, Pseudomonas aeruginosa
cccactacatcggcatctacgaagacatcacgcagaacaagctggcccagcagcacatcgagaaactcgcctaccgcgacaacctcaccggcctggccaaccggcactatttcatcggcgccctcgaggaacgcctggaaagcagcggcgaccgcccgctcagcctgctgctggtggacatcgacaacttcaagcggatcaatgacagcctcggccaccagaccggcgacaagctgctggtcagcctggcccggcgcttgcgcagttgcctcggcgacggcgccaccctggcgcgcttcgccagcaacgagttcgccgtgctgctcgacgacaccgcggtggaaaagggcgaaagcattgccgcgcaggtcctgcacatgctcgacaagccgctgttcgtcgacaaccagttga

SEQ ID NO: 16084 - DNA, 438 bp, Pseudomonas aeruginosa
tctacaccttcgacgcggcccagaaggccgcggccttggccagccgggagagcttccaagccgaactggcgaaagccggctacgaccgcatcaccaccgagatcgccgacgtcccgcccttctactacgccgaggcctaccaccagcagtacctggcgaagaaccccaacggctactgcggcctgggcggcaccggggtgtgcctgccggcctgacgactattccgccaccagccagtcgagacgccagccgccctggctctgggccatgacctcggccagccagggcagcaggtcgcgcagttcgtcttccagcggccacggcggattgacgatggccagcccggagccgttgaaacgctcggcgtcgtcgatcggatgcacgtgcagctcggcacgcagcagcttcggcgcgacgctacgttccagggcctggtag

SEQ ID NO: 16085 - DNA, 1026 bp, Pseudomonas aeruginosa
actcgctggcaccctggcaccgcctgcgacggtcgatgccttcgccgcgccgccccacgatcccctttcgccgaggtcgtcatgtccgaaaccctgctcagttcccgcaacctagcgttcgagctgtacgaagtcctcgatgccgaagccctgacccagcgcccgcgcttcgccgaacatagccgcgaaaccttcgatgccgccctcggcaccgcgcggagcctggcggaaaagctgttcgccccgcacaaccgcaagggcgacgaacacgagccgctctatgagaatggctcagccacgctgattccggaagtgaagccggcagtggatgccttcctcgacgccggcttcctcaacgccacccgcagcttcgagcaaggcggcatgcagttgccgaccctgctgtcgcaggcctgcttcgcccacttccaggcggccaacgtcggtagctcggcctatccgttcctgaccatgggtgccgccaacctgatcgagagcttcggcagcgaggagcagaagcagcgcttcctgcaaccgatgatcgagggccgcttcttcggcaccatggccctcaccgaaccgcacgccggctcctccctctccgacatccgcacccgcgccgaaccggccgccgacggcagctatcggatcaagggcaacaagatcttcatctccggcggcgaccacccgctctccgagaacatcgtgcatatggtcctggccaagctgccggatgcaccgccgggggtgaaaggcatctcgctgttcatcgtgccgaagttcctggtcaacgccgacggcagcctcgggccgcgcaacgacgtgatcctcgccggcctgttccacaagatgggttatcgcggcaccacctccaccgcgctgaacttcggcgacaacggcgcctgcgtcggctacctggtgggcaagccgcaccacggcctggcctacatgttccagatgatgaacgaggcgcgcatcggcgtcggcatgggcgcggtgatgcttggctatgccggttacctctaa

SEQ ID NO: 16086 - DNA, 1794 bp, Pseudomonas aeruginosa
aaccgacccgtagcgtcgccttccccctgtcccgccgcgaggaggccgaccttggacgccgtcaccgtcaataatttcttcctgatcggggcggtgctggtcggcatgagcatcctcgtcagctcgctgtcctcccgcctgggcatcccgatcctggtgatcttcctcgccgtcggcatgatcgccggcaacgacggggtcggcggcatcgtcttcgacaactatccgatggcctacctggtgggcaacctggcgctcgccgtgatcctcctcgacggcggcctgcgcacccgcgtctccagcttccgcgtggcgctctggccggcattgtcgctggccaccctgggcgtgctggtgaccaccggcctgaccggcatcgcggcagcctggctgttcgacctgcactggatggaaggcctgctgatcggcgccatcgtcggctccaccgatgccgccgcggtgttctccctgctcggcggcaaaggtctcaacgagcgggtcaccgcgaccctggaaatcgaatcgggcagcaacgacccaatggcggtgttcctcaccgtgaccctgatcgagatgctcgccagcggccagaccggcctcagctggggcttcgccctgcacctggtgcagcagttcggtctcggcgccctgctcggtcttggcggcggctggttgctgctgcaactgatcaaccgcatgcacctggccggcggcctctacccgttgctggtgatcagcggcggcctgctggtgttcgccctggccaacgccgtcggcggcagcggcatcctcgccatctacctgtgcggcctgctcctcggcaaccgcccgatccgcagccgccacggcatcctgcacatgctcgacggcatggcctggctggcgcagatcggcatgttcctggtcctcggcctgctggtcaccccccacgacctgtggccgatcgccctgccggcactggccctggcgctgtggatgatcctggtggcacgaccgctgtcggtactgatcggactgatcccgttccgcgccttccacgaccgcgagaaagccttcatcgcctgggtcggcctgcgcggcgcggtgccgatcatcctcgcggtgttcccgctgatggccggcctgccgaacgcccagctgttcttcaacgtggccttcttcatcgtcctggtctcgctgctggtgcagggcaccagcctgccctgggcggccaggctgctgcgggtggtggtgccgccggatccggcaccgatatcccgcgccggcctggagatccacccgaccagcgagtgggagctgttcgtctaccacctgaacaaggaaaagtggtgcatcggcgccgccctgcgcgagctgaagatgcccggcgggacccggatcgccgcgctgttccgcggcaccgaactgctccacccgtcgggcagcaccatcctcgaggccgacgacattctctgcgtgatcggccacgaacacgacctgccggccctcggcaagctgttcagccaggcgcccgaccggggcctcggcgcgcgcttcttcggcgacttcgtgctggaaggcgatgcccagctgtcggcggtggcctcgctctacggcctgaagctcgacggcatcgacggcgagcaagcgctgggccgcttcatcgcccacgagatcggcggcgaagcggtgatcggcgaccaggtggagtggaacggcctgacctggaccgtggccgccctggaaggcaaccgtatccgcaaggtcggcgtgaagtttccggaaggccgcccagggcccggacttttcctctga

SEQ ID NO: 16087 - DNA, 1542 bp, Pseudomonas aeruginosa
tttcctgtcgaattcccgttccgaggcgccttgcggcgcctcggagccaccactaacctgcattcacccttcttcgagtctcttctcgaccatgcctgcccttcgctccctgatcgctattcttttcctcggcctctgccttgccagtccgccgctcctcgcccagtccgagccgccctcggccgaggccgtccagcaaagcctcgacaagctggccgagcgcaagctcgccgaagccgaccagaaggtcgccaaggccagcctcgaacagaccctcaagttcctcgccgcgcgcgacgaagcgctgcagagcctggaggacctgaaaaagcgcctgagcgacgcgccccggcagatcgaggaaaaccagcgcgaactggagcgcctgaagaagaccaaagaacgtccggtcagcgaacgctacagcggcgagagcgcggcccgcctggaaatgctgctcaacgaccgcaccacccagcaggccgagtggcagaaagccctgggcgaggccaacagcctgtcgatcaccgccgagacccgtccggaacgagcccaggccggcatcagcagcatgcaggcacggatcctggaaatcggctcgctgctcaaggccggcaaggaaagcggcaagacgatcaacgccgaccgtcgcggcgagctgctcgccgagcaggccgcattgaccgtgcagagccagctgttgcgccaggagctggccggcaacaacctgctgcaggacctcggcaagagccagcacgatctgctcaccgagaagatctcgcgcctggaaaaggaaaccctcgacctgcaggcgctgatcagcgagaagcgccgcgagcagtcggaaaagaccgtcgccgagctgtccaaggaaggcgcccagggagccggcaccgacagcctgctgagccaggagaacgccaagaacctgcgtctctccgactacctcctgcgtgccaccgaccgcctcaacgtgctcacccggcgcaacctcgagaccaagcagcaactggacaacctgacccagtccaaccaggccctcgaggaacagatcaacgtcctgcgcggcagcctgctgctgtcgcgcatcctctacaagcagaaacaggcgctgcccaagatcaaggccgaccagagcctggccgacgagatcgccgacctgcgcctcggccagttcgaactgaaccaggaacgcgacaagctggcgaccccgcagcaatacctggacgacctgctcgcccagcagcccagcgagcaggtcacgccggaactgcgcaaggatctcgacaccctgttggcaacccgttccgagttgctcgaacggctcaaccacgaactcaacgcgctgctcaacgaagcgatcaccttgcagttgaaccagaaacagttgctttccaccagcgagagcctgcgcaccaccctcgacgagcagatgttctggattcccagcaaccagccgctcgacctgtcctggttcaagatgaccccgaccctgctgaagaaccagctcaccgagatcccctggggctccggggtgcgtga

SEQ ID NO: 16088 - DNA, 2229 bp, Pseudomonas aeruginosa
actgggcgaaggcctggtcgatcggccgctgctgttcctgccgctgttcctgctgatcgccgcgctgctgtggaaacgccgctacctgtacgacaagctggcggagctgaacgacgacatcggccacttcaagcgcgacagccagctgcataccccgctggcgatcctgatcaccatcctcctcgccctgcccggcaccctgacctttgccgtcgccgggctggccctgctgctggacgcccgcggccagaacgccaccctcggcagcgccctactggaaatggcccaggtctggctgctgttctacaccgcccatcgcatcctcaccccgggcggcatcgccgagcggcatttccactggagccgcgaacaggtcggcttcctcgaccggcacctggtccgcctcggcgttgtggtcctggcgctggtcggcgtggtgacggtggccgagcaccagccggcgagtctggccgacgacgtgatcggcatcgccgtggtcctgctcggctacgcggccatggcctggctgctcagccgcctgctgttcagcagccccggcgacgaacgtccgtcgctgatcaagatgatcgtcggcatcctcttcaccgcgctgccgctggtgctcttcgtcgcggtctgcttcggctactactacacctcgctgaagctcaccgaccgtctcatcgataccctttacctgctgctgctctggttcgtcatcgaagccgccttcgtccgcggcctgggcgtggcggcccggcgcctggcctacgcccgggccctggcgaaacggcagaacgcggcgaaggaaggcgtcgacggcgagaccaacgtcgaggagccgaccctcggcatcgagcagatcaaccagcaatcgctgcggctgatccgactggccctgctgatcggcttcatcgtctgcctgtactgggtctgggccgacctgatcagcgtgatctcctacctcgacaacgtcaccctgtaccagtacaccgccggcaccggcgaagcggccaccagcgtgccgatcagcctgcgcgacttcctcgcggcgctggccatcgcggtggtcaccgtggccctggcgcgcaacctgcccggcctgctggaagtcctggtactgcagcgcctgaccctggcccagggcagcgcctacgccaccaccaccctgctttcctacgccatcagcggcatcggcatcgtcagcgccctgtccaccctcggggtcagctgggacaagctgcaatggctggtggcggcgctctcggtaggcctcggtttcggcctgcaggcgatcttctccaacttcgtctccggcctgatcatcctcttcgagcgtccggtacgaatcggcgacgtggtgaccatcggcaacctgtccggcacggtcagccggatccgcatccgcgccaccaccatcaccgatttcgaccgcaaggagatcatcgtcccgaaccagaccttcatcaccgggcaactggtgaactggtcgctgagcgataccgtgacccgggtcaccatcaagatcggcctggcctacgagaccgacctgccgctggcgcgcaagctgatgatgcaggcggtcaaggaaaacccgcgggtactgcgcgacccggagccgctgctgtacttcctgaccatcagcgccagtaccttcgactacgagctgcgcttccacgtccgcgaactgggcgaccgcaacccctctaccgacgagatcctgacgaagatcgccaccagcttccgcgaacacaagatcgacatggctttcaaccaggtcgatgtgttcgtcaagaacctccagggccagcaggtccagctgttcgtcggcgagccgcagcacagcggcgtcggcaatccgcccgcgctcaagggccaggacggtcccgccgaaccgacccgctgaacctcagggcctggacgccctccggcaattcccagcacaatgctcgggaattgccggaggcctctcttgaaatcactcgacgacctcgacttcgacaaccgcttcgcccgcctgggcgacgccttctccaccgaagtcctgcccgaccccatcgccgagccgcgcctggtggtagccagccccgccgccctggcgctgctcgacctgccagcggaaaccagcgacgaagcgctgttcgccgaactgttcggcgggcacaagctgtggtcggaggccgagccgcgggcgatggtgtattccggccaccagttcggctcctataa

SEQ ID NO: 16089 - DNA, 1251 bp, Pseudomonas aeruginosa
cccgcgcctgggcgacggccgcggcctgctgctcggcgaggtgatcaaccaggccggcgagcactgggacctgcacctcaagggcgccggccagaccccctactcgcggatgggcgacgggcgcgccgtgctgcgctcgtcgatccgcgagttcctcgcctccgaagcccttccggcactgggcattcccagcagccgggcgctctgcgtgatcggttcgagcacgccggtctggcgcgagaagaaggaaagcgcggcgacgctgctgcgcctggcgcccagccacgtgcgcttcggtcacttcgaatacttctactacacccgccagcacgaccagttgaaacagttggcggcgttcgttctggaacaccacttcgccgactgcaacgcagccgagcggccatacgcggcgatgttccgccaggtcgtcgagcgcaacgccgaactcatcgcccgctggcaggcctatggcttctgccacggggtgatgaacaccgacaacatgtcgatcctcggcattaccttcgactacgggccctacgccttcctcgacgatttcgacgccaatcacatctgcaaccactccgacgacgccggccgctactccttcagcaaccaggtaccgatcgcccattggaacctggccgccctggcccaggcgctgacgccactggtggaagtggacgaactgcgcgccagcctcgacctgttcctgcccctctaccaggcccactacctcgacctgatgcgccggcgcctgggcctgggcgtcgccgcggagaacgaccaggccctggtccaggaactgttgcagcgcatgcagggcagcgcggtggattactcgctgttcttccgccgactcggcgaagaaactccggagcgggcgctggccagcctgcgcgacgacttcgtcgaccgcgaggccttcgaccgctgggccgaggcctaccgccggcgcgtcgaggaagaaggcggagaccaggagtcgcggcgccggcgcatgcacgcggtcaatccgctctatgtgctgcgcaactacctggcacagcaggccatcgaagcggccgagcagggcgactacacggaagtccgcttgctgcaccaggtgctgagtcgcccgttcgaggaacagccgggcatggagcgcttcactcggcgcccgccggactgggggcggcacctggaaatcagttgctcctcctgacgggatgccctgacagaacggcggccgataatgccgcaatggaataa

SEQ ID NO: 16090 - DNA, 1293 bp, Pseudomonas aeruginosa
cccgtccacccgcgcggtggcggtgccgatctaccagaccacctcctacgctttcgacgacacccagcatggcgccgacctgttcgacctgaaggtaccgggcaacatctacacacggatcatgaaccccaccaacgatgtactggaacagcgcgtcgcggcgctggaaggcggggtcggggcgctggcggtggcctcggggatggcggccatcacctacgcgatccagaccgtcgccgaagccggcgacaacatcgtctcggtggccaagctctacggcggcacctacaacctgctggcccacaccctgccacgcatcggcatccaggcgcgcttcgccgcccacgacgacatcgccgccctggaagcgctgatcgacgagcggaccaaggccgtgttctgcgaaaccatcggcaacccggcgggcaacatcatcgacctgcaggcactggccgacgccgctcaccgccacggcgtaccgctgatcgtcgacaacacggtagccaccccggtgctctgccggccgttcgagcacggtgccgacatcatcgtgcactcgctgaccaagtacatgggcggccacggcaccagcatcggcgggatcgtggtcgactccggcaaattcgactgggcggcgaacaagtcgcgcttcccgctgctgaacacgcccgatccgtcctaccacggcgtcacctacaccgaggccttcggacccgccgccttcatcggccgctgccgggtggtaccgctgcgcaacatgggggcggcgctctcgccgttcaacgccttcctcatcctccaaggcctggagaccctggcgctgcgcatggagcgccactgcgacaacgccctcgccgtagcccgctacctgcaacaacatccgcaggtggcctgggtgaaatacgccggcctcgccgacaaccccgagcacgccctggcccggcgctacctggggggccgcccggcggcgatcctgtccttcggcatccagggcggcagcgccgccggcgcgcgcttcatcgacgccttgaagctggtggtgcggctggtcaacatcggcgacgccaagtccctggcctgccacccggcgagcaccacccaccgccagttgaacgcggaggaactggcccgcgccggagtctccgacgacatggtgcggctgtcgatcggcatcgagcacatcgacgacatcctcgccgacctcgaccaggccctggccgccgccgcacgctgagcggatcggtcagtccgggcgagcgtttcggtccttgcccggcctggccggccggctag

SEQ ID NO: 16091 - DNA, 330 bp, Pseudomonas aeruginosa
gccttgcggaaggcatggatgctgctgggtatggtcgaggtgaagggtgccgaggaagtgaaaccgatcttcagctcgcccagttcccccaggtgggcccgacgcgccagcaacaccgccttgtctacctgggccagcacctggcgggactcgtcgaggaacagccggccggcgtcggtgagttcgacgcggcggttggtgcgctcgaacaggcgcgcaccgatttcctcctccagcgcctggatctgctggctcaacggcggctgggagatccccaggcgctcggcggcgcggccgaagtgcagctcctcggcgacggcgatgaaatag

SEQ ID NO: 16092 - DNA, 1512 bp, Pseudomonas aeruginosa
cgcaggtgcctgagttccacgcggcccctccaattaggtctttttacatatcaatcgtgtcgatcaatatattggaaatcatataaacctatctatatcctttgccacataacctccaacaacgaccccttgtccctgaaatccaggtggcgcggcctcgttgtgcctgctcgccaccgaccccagaggtgccccgtgagcaatccgcaagtccggccacaggccgaagaagaacccgcgttaatcgaggcggcccgcgaagcagccaacgaggtgctggaagccgccaccgaagtcgaacgctatatcgaaaaaggcaccccgcagttcatgcgcacctccctagcgctgttctccggcggtttcgccacctttgccctgctctactgcatccagccgatgatgccggtgctgtccaaggcgttttccatcagcgccgcggaaagcagcctggcattgtccgtcgccaccgccatgctcgcccttggcctgctggtcaccggcccgatctccgacgcgatcggtcgcaagccggtgatggtcgtctcgctgctggccgccgcgctgttcaccctcggcagcgcggtgatgcccacctggcatggcgtgctgctgatgcgcgcgctggtcgggctgtccttgagcggcctggccgcggtggcgatgacctatctcagcgaagagatccatccgcagcacatcggcttgtcgatgggcctgtacatcggcggcaacgccatcggcgggatgagcggacgcctgatcagcggcgtcctggtcgatttcatctcctggcatgccgcactggcggtcctcggcggcctggccctggtcgccgcgctggtgttctggcgcgtgctgcccgaatcgaaacacttccggccggcaccgctgaagccggcgaccctgctcaacggctaccgcctgcacttccgcgacgccggactgccctggctgttcctgatcggcttcctgctgatgggcagcttcgtcaccctgttcaactacatcggctaccgcctgctggccgagccctaccacatgagccaggcggtggtcggcgtgctctcggtggtttacctctcgggcatctacagctcggcctgggtcggttcgctggccgacaagctggggcgacgcaaggtgctctgggcggtcatcctgctgatgctcggcggcctgctgctgaccctgttcgagccgatcccgctgatgctcgccggcctgctgctattcaccttcggcttcttcggcgcgcactcggtggcgagcagctggatcgggcgccgcgccctgcgcgccaagggccaggcctcgtcgctctacctgttcagctactacgtcggctcgagcctggccggcaccctcggcggggtgttctggcattactacggctggaacggcatcgggctgttcatcggctcgctgctggtggtcgcggtattggtctcgctgcacctggcgcgcctgccggccctgcctggcaacaccctggcgcaggccgcccactga

SEQ ID NO: 16093 - DNA, 1356 bp, Pseudomonas aeruginosa
ccgcgcgcctgcacctgtccagccgcagcctcaagcggcatctgcatgacgccggcaccagctttcgccagttgctcggtcaggctcgccagcgccaggccttgcgattgctgcggcgtcccgaggtgtcgttgcagcgtatcgccctgtacctgggttacagcgatccaaccaacttcacccgcgccttcaagcgctggaccggcgagccgccgagcgacacccgcgcccgcctgctgggcgggcaaccagtttcacgaacaaatgccaagcgctcgacaaatccctcgcgtttcccttgagcgcggcaagcgctgtcctatgctgctgcggccggcatccggccggcctcgacagcgatatgaaagggactttatgaaaccagcgatcaagcgcgcctgcctgctcggcacggcactgttctccctctgcgccagcgcagcccaggcggccggcgttctggtaggaacctgggacctgcggggcaacggccagctcgccgcggtctaccgcgacggcgccaacctgcaggtggtggaaggcggcagcacccgcaactacagcttcggcaacgtggtctggtcggtcttcggcgccaccgataccgacggccagcccggcgcggaaatcctggtcaaggccggtcccgacctggtgatcgtttcccacgccagcaccacccagcgcaagtacccggtaggcaacgtctcctgggcgatcatgcgcgccaccgacgtcgacaacgtcgccggcgacgaagtcatcctcagcatcggcaacggcgtgcgcaccgtattcgatcgcacccgtacgcaacgcgacgccaccttcagctacaacggcacctggggcctgttcgacgtcgccgacgtggacggcgcgccgggcaaggaactggtgctgaacatgggcaacggcgtcaaggtcatcgacccgcgcaccggtggcgccaaggacttcaccttcagcggctaccacgcgctcgcacagatcgccgacctcgacggccagcccggcgcggagatcatcggccgcaccagcaccggcatctacgtgatcagcaacgccagttcccgcaaggaatacaacatcggcgccagcgcctgggcactctatggcggcaccgcggacaccgacggcaagccgggcaacgagctgatcgtggtgatgcagggcaaggtgcgggtcatccaccacgccagcggcgccagcagcgactaccgcatcggcgacgtcaactacagcatcgattcggtggccgacatggatggccagccgggcgcggaaatcctcgtgcgcgacgccaacggcaagctgttcgtgatcaacgaccgcaccggcaaggtaagcagttga

SEQ ID NO: 16094 - DNA, 543 bp, Pseudomonas aeruginosa
ggcgggtacgccaccggcgcgaccccgccagccaacgcgccggagggccgtcggcccgcgcatgaaaaaggggagcctcggctccccttctttcgttccggctcagccgtggtactgcgccgacagctcgtgcaccgcctcgaagaaggcgccggcatgggccgggtcgacttccggggtgatgccgtggccaagattgaacacatgccccgtacccttgccgtaggccgccaggatccgcgcgacttcggcgcggatcgccgccggattggcgtagagcaccgagggatccatgttgccttgcagggctacgcgctcaccgacacgggcccgggcgctgccgatgtcgcaggtccagtccaggcccagcgcctcggcgccgacctcggccatcgactccagccacaggccgcctcccttggtgaagaggatcaccggcacccggcgtccgtcgtgctcgcggatcaatccatcgacgatcttgcgcatgtaggtcagggagaactcctggtaggccgccgccgacaggctgccgccccatga

SEQ ID NO: 16095 - DNA, 819 bp, Pseudomonas aeruginosa
gtcgaagatctgcaccgcctgggcgccggcgtggatctgcccgttgaggtagctggtcaccgattgcgccagcttgtccagcagagcgtgcatggcctgagggttgtcgtagagcatcgccttggacttgcggaagtccttgctcgagccgccctcgaccatgtaggtggcgagggtccaggggctgccggagaagccgatcagcggtacgcggccgttcagctcgcggcggatggtgcgcacggcatccatcacatagcccaggtcctgttccggatcgggaaccggcagcgcctcgatgtcggccagcgacgagaccaccttgcggaagcgcgggccttcgccggtctcgaagtacaggccctggcccatggcatcgggaatggtcaggatatcggagaagaggatcgcggcgtccagctgcgggtaacggtccagcggctgcagggtcacttcgcaggccagctccgggttcatgcacaggctcatgaaatcgccggccttggcacgggtggcacggtattccggcaggtaacgaccggcctggcgcatcatccagacgggggtgacatcgacgggctgcttgagcagggcgcggaggaagcggtcgttcttcagggcagtcataacggcatccgatcaaaggctgctggcttcacgcgggcgcgtgcggaagggggttatccacaggccggcgggcgaaaagggccgctattgtcgcaaagcacaaaacaaaaggcacggcgggggccgtgccttttgtctatcgcggtgatttgtcgcagcgccggtggcgccgcggatcagacgccaaggtag

SEQ ID NO: 16096 - DNA, 447 bp, Pseudomonas aeruginosa
tcgaggatgccttcggccgcggtacgtccttcgaagatcgccgtcaccaccaggtcggaaccacggaccatgtcgccaccggcgaagatcttcgggttgctggtctggtgcttgaactgcgcctgcgccggagccaccacgcggccctggctgtcggtggcgatctcgaagcgctcgaaccacggcgccggactcggccggaagccgaaggcgatcagcacggcttccgccgggatgatctcctcggaaccggggatcggttcggggctgcggcggccgcgggcgtccggctcgccgagacgggtctcgaccaccttcacgccttccacccggtcctcgccgacgatggcgatgggctggcggttgaagaggaacttcacgccctcttccttggcgttcttcacttccttgcgcgagcccggcatgttttcttcgtcacggcgatag

SEQ ID NO: 16097 - DNA, 2532 bp, Pseudomonas aeruginosa
gtgcccatccccatgaacacggcatcgtactcatcgagcaactgctccatggccacgtccttgccgatctcggtgttcaggcgaaactcgatgcccatgccggtgaacacctcgcggcgacggctgaggacgtgcttctccagcttgaactcgggaatgccgaaggtcagcaggccgccgatctccgggttgcggtcgaacaccaccggggtcacgccgttgcgcaccagcacgtcggcgcagccgaggccggccgggccggcgccgatcaccgcgacgcgcctgccggtcggcttgaccttggacaggtccggacgccagcccatggcgaaggccgtatcggtgatgtacttctccaccgagccgatggtcaccgcgccaaaaccgtcgttgagggtgcaggcgccctcgcagaggcgatcctgcgggcagacccggccgcagacttccggcagggtgttggtctggtgcgacagttcggcggcggccaggatgttgccttcggaaaccagcttcagccagttagggatgaagttgtgcaccgggcatttccactcgcagtacgggttgccgcagcccaggcagcggtgggcctggtcggcggcctgctgcggcttgaacaggtcgtggatctccacgaactcgcgcttgcgctggcgcagcagcttcttcttcgggtccttgcgcccgacttcgatgaactggaagtcgttgttcaggcggtcggaattcagacgttcagacatatcgaaacctcatcacaacttcgggcgcttattgcgggttggcacgggtgctggtcagcagcgaaccgaggctggccgccttcggtttcaccagccagaaccgacgcaggtagtcatccaggttttccaggatgttcgcgccccactcgcttgccgtttcgttcacgtactcgaccaggaccttgcgcaggtggctgcgataggcctccatcgcctcgccgctgatccgctggatttccaccagctcgtggttcacgcggtcgacgaaagtgttgtccatgtcgaggacgtaggcgaagcccccggtcatgccggagccgaagttgtagccggtcttgcccagcacgcagacgaaaccgccggtcatgtattcgcagcagtggtcgccggtaccttccaccaccgcatgggaaccggagttgcgcacggcgaagcgctcgccggcggttccggcggcgaacagcttgccgccggtggcgccgtacaggcaggtgttgccgacgatggcagattcctgggtcttgaacggactgcccttgggcggggtgatcaccagcttgccgccggtcatgcccttgcctacgtagtcgttggcgtcgccttccaggtacaggtgcaggccaccggcgttccacacgccgaagctctgtcccgcggtgcccttgaaacggaacaccaccggtgccttggccatgccctggttgccgtgcaggcgggcgatctcgccggatacccgcgcgccgatggatcggtcgcagttgcagatgtccagctcgtactcgccgccgctcaggccttcgatggcggccttcgacagctcgaccatcttctcggccagcaggccctggtcgaacggcgggtttttctccacctcgcagaactgcggcttgtcggccgggatcagctcactgcccagcaacggagcgagatccagattctgctgcttggcggtctcgccggggaggatctccagcaggtcggtgcggccgatcagctcgcccaggctgcgcacgccgaggcgcgccagccactcgcgggtttccgtggcgatgaaggtgaagaagttgatcaccatcgcggtggtgccgatgaagtggtccttgcgcaacttgtcgttctgcgtcgccacgccggtggcgcagttgttcaggtggcagatgcgcaggtacttgcagcccagggcgatcatcggcgcggtgccgaagccgaagctctcggcgccgagaatggccgccttgatcacgtccaggccggtcttcaggccgccatcggtctgcacccggaccttgccgcgcaggtcgttgccgcgcagggtctggtgggtttccgccaggcccagttcccagggcgagccggcgtacttgatcgaggtgatcggcgaggcgccggtaccgccgtcgtagccggagatggtgatcaggtccgcataggccttggccacgccggcggcgatggtgccgacgcccggctcggataccagcttcaccgataccagcgcctgcgggttgacctgcttgaggtcgaagatcagctgcgccaggtcttcgatggagtagatgtcgtggtgcggcggcggcgagatcagggtcacgccgggcaccgcatagcgcaggcgggcgatcaggccgttgaccttgccgcccggcaactggccgccctcgccggggcatgggggccctgggccaccttgatctgcaggacctcggcgttgaccaggtattccggggtcacgccgaagcggccggtagccacctgcttgatcttcgaactcttcagcgtgccgtag

SEQ ID NO: 16098 - DNA, 2070 bp, Pseudomonas aeruginosa
cggcaacggctggctggagccgttgaactccacggccgggccgctgcccggctgctgggcctgggccggcgtaccaccattcatggacaattcggtagaggcggtctgcggcgcctccggcttgctcttgccttgcatgaaccaggcggcgatcacgccgatggccacgaccgcaagaatcaccagatgcttcttgggcaagttgaaagaccctccggttgccttgcgcgctgcgccacgattggccagcatcgcttcgatcagggcatcgcgggcgacctggttgatcgctcccggccagccttccgactgctcgtggatgtccaccagcaggtcgttggaaatcagctcgatgccctgcccggcgccctcgagacgctgggccaggtagtcgcgggtttcctcttcgctgtatggctgcaattcgatggcatggaagcgctcctcaccctcggaaaacacctccaggcgcggcagcaacgacggctcaccgaacaggaatacatgcaggcgtccctcgttggtgccggaagccagcagcaacagcacttccagcgcgctgtcctggagctgttcggcatcgtccaccatcaggtagacgtcctgcccggtgatcgccagctgcgccaccttggtcaggatcgcctccaggctcgcctggttgatgctcaggccctgcgccacctggcgcagcaacgaagtctcgtcggcggcggtgcgcgccgagatcaccacgctgaggaccgcatccttgttggtgctggccaccagcgcctggcgcagcagggtcttgccgctgcccaggggcccggtgaccagcagcaggagctggctgtagcgggccagatggtgcaactggccgagcaccggcttgcgctgcgccgggaagaacttgaaacccggaacgcgcggcgcgaacgggtcgtgactgaattggtagtggcccaggaaggcctcatcggcatgcaagctggtcatgggacctcattcatctccaagctggtcggccaaggcccgatagtcggtgcgcagggtcgcgtccaagatctcacggggaaaatcgccggtgaccacggcattccccagtccttgcagcaaaaccagacgcaggcggccatcgagcactttcttgtcgacggccatgtgttccataaaatcttccgccgtcatctcggccggcggtaccacgggcaggccagcccggcgcagcagacggataccgcgatcgcgctcggcggcgctcagccaacccaaccgatgcgacatctcgagtgccatcacggttcccgcccctaccgcttcgccgtgcaaccagacgccgtaaccctgctgggtctcgatcgcgtgaccgaaggtatggccgaggttcagcgtggcacgcacgcccgactcgcgctcgtcggcgcccaccacgcgggccttcgccgcgcaagagcgctcgatggcctcggtgacaacggtcggctccagtgccagcaaggcatccatgtgctcttccagccaggtgatgaacggttcgtcgcaaatgaaaccgtacttgatcacctccgccagcccggcggacagctcgcgggacggcagcgtcttcagcgacgcggtgtcgatgaccaccgcctggggctggtagaacgcaccgatcatgttcttgcccaacggatggttgatcccggtcttgccgcccaccgaggagtcgacctgggacaacagggtggtcggcacctggatgaagttgaccccacgctggtagcaggccgcggcgaaaccggccatgtcaccgatgacgccgccgcccagggcgatcagggtagtcttgcggtcatgccgctccttcagcagggcatcgaagatcagttgcagggtttcccactgcttgtaggcctcgccgtcgggcagcaccacaggggtgacctcatggccttgcagtgccttgagcagggtttccagatagagaggagcgaccgtttcgttgctgatcaccgcgacccggcgaccgacgatatgtggcgcgaaccagcgggcgtcgcccagcaggttttcaccgatgtaaatgggatagctacgctcgcctag

SEQ ID NO: 16099 - DNA, 2040 bp, Pseudomonas aeruginosa
ccacgttgttcgatatcagcgaccgattgcgatggcctgattattcatgatccgcggtgtcaggaaaaccagaagttcgtttttccggtcggtgacggtatcacgccggaacagccgccccaggtaaggcagttcgccgaggaacggcaccttctccaccgacttgctctgctcgttactgaacacgccgccgatgacgatggtctcgccatcgttgaccaggatcttggcgttgacctcgttcttgttgataggaggtacgccgttcaacatattctggtaatccggcgcgtccttggtcaccttgacttcgacgatgatccggttgtccggggtgatctgcggggtcacctcgagggacagcgcggcttccttgaacgaggtgctggtagcgccgctggaactggcctcctggtaggggacttccgagcccttgaggatcttcgcggtttccttgtccgaggtcacgaccttgggttgggagacgatctcgccgttgccggtcttttccatcgccgacagttgcaggtcgaggatgatgttgtcggtgatgaagccgatgccgatcccggaggtagcatccttggcaccgaggtcgacgaacggcgacggcgacttgctggttcccgtggtggggaaagtacagttgccggcgatcgggccgcagttcatgccgtcctcgtccttgatcccgatattgccgtccttgccgtagccgttccagttgcccttgtgataagcgccgccccagcgcacaccgaggctcttgtcgtaaccgacgttggcctcgacgatgcgtgcctcgatcatcacctggcgcaccggaatatccagctgcgaaacgatccgccgcagttcgtccagtcgctcctggggctgataggcgatgatgctgttggtgcggtcgtcgacggtgatcgagccgcgcccgccttccttgccttcctggccaccatcgctggtcaccgactggaacagcttggcgatgtccgcggccttggcgtagttcacctggatcagttcccgacgcagtggcgccaactcggcgatctgcttctgcgcttccagctcctggcgctcacgggcggcgatctcgtcggccggggccaccagcagcacgttgccgagcttgcgcttgtccaggcccttggtcttcagcaccaggtccagcgcctggtcccacggcacgttctgcaggcgcagggtgatattgccctgcacggtatccgaggccaccaggttcaggtcggtgaagtcggcgatcagctgcagtaccgaacgcacgtcgatgtcctggaagttcagcgacagtttctcaccggtataggcgaaattgtccttcttgcgccgctcggcgtcttccgtggtcatcggcttgatgctgacggtcaggcgattgtcggtctggtagaccagatagtcgtagagcccgctcggttcgatggtgatgctggtacggtcggattgcgcgctggcgttgacaaactgcaccggcgtggcgaagtccttgacgtccaggcgaacccgcagcgcatccggcaactgggtcttggcgaagtccaggcggatcttgccaccctgctcctggatatccgggctcaaggtcgggtcggacaggtcgatgaccacgttgccctcgcccttttcgccacgctggaaatcgatgttgcgaatggcacgacccgccggcacgtacggcttgggcttgatcggctgggcatagctggccggagccgggctagccttgaccggagcggtggaagcgacgctggcgccggccggcgaattgccgaccaccacgaagaggttgttgccttccacccgggtggtgtaggacgacaacgtggtcaggttgatgatcaaccgtgtgcgatccttcgcctcgaccaccgtgacgctgcgcgtattgcccacgctcagctcgcggttcttggtgccgagcttgttctgtacccccggcagatcgagggcgattcgcgccggctgctcgatggtatagccacgcggcgcggcgacgggctcgtcgaactgcagctttag

SEQ ID NO: 16100 - DNA, 2505 bp, Pseudomonas aeruginosa
ctctttctttttcctggaaatccgaatctacccatgcgcctgctgaagttcctgtggtggacttgcgtcaccctgatttgtggagtgctgctcagtttcagcggcgcctatctctatctgagtcccagcctgccctcggtggaagctctgcgtaacgtccagctgcagatccccctcaaggtctacagcgaggacggcaagctgatctccgagttcggcgagatgcgccggacgccgatccgcttcgccgacatcccgcaggacttcatccatgccctgctgtccgccgaggacgacaatttcgccaaccattatggcgtcgatgtgaaaagcctaatgcgcgccgccgcgcaattattgaaaagcggtcacatccagactggcggcagcaccatcaccatgcaggtagcgaagaactacttccttaccaatgaaagaagcttctcgcgaaagatcaatgaaatcctcctggccctgcagatcgagcgacagctgaccaaggacgagatcctcgagctctacgtcaacaagatctacctgggcaaccgtgcctatggcatcgaggctgccgcacaggtctattacggcaagccgatcaaagacttgagcctggccgagatggcgatgatcgccggcctgccgaaagcgccctcgcgctacaacccgctggtcaacccgacccgcagtacggagcggcgcaactggatcctcgagcgcatgctcaagctcggcttcatcgaccagcaacgctaccaggccgccgtcgaggagccgatcaacgcctcctaccacgtgcagacccccgaactgaatgcgccctacatcgccgagatggcccgtgccgagatggtcggccgctacggcagcgaggcctataccgagggctacaaggtcatcaccacggtccgcagcgacctgcagaacgccgccagccaatcggtccgcgacggcctcatcgactatgaccagcgccacggctaccgcggcccggagacccgcctgccgggccagacccgcgacgcctggctcaagcacctgggccagcagcgcagcatcggcggcctggagccggcgatcgtcacccaggtggaaaagagcgggatcatggtgatgacccgcgacggcaaggaagaagccgtgacctgggacagcatgaaatgggcacgccccttcctcagcaacaacagcatgggcccgatgccgcgccagcccgccgacgtggcccaggccggcgaccagatccgcgtgcagcgccaggaagacggcaccctgcgcttcgtacagattcccgccgcacagagcgcgctgatctcccttgacccgaaggacggggcgatccgctcgctggtcggcggcttctccttcgagcagagcaactacaaccgcgcgatccaggccaagcgccagccgggctccagtttcaagccgttcatctacagcgcggccctggacaacggcttcaccgccgccagcctggtcaacgatgcgccgatcgtgttcgtcgacgagtacctggacaaggtctggcgaccgaagaacgacaccaacaccttcctcggcccgatcccgctgcgcgaagccctgtacaagtcccgcaacatggtctcgatccgcgtcctgcagggcctgggcatcgagcgggcgatcagctacatcaccaagttcggcttccagcgcgacgaactgccgcgcaacttctccctggccctgggtaccgcgacagtcacaccgatggaaatcgccggcgcctggagcgtattcgccaacggcggctacaaggtcaatccgtacgtcatcgaacgcatcgagagccgcgacggacaggtgctgtaccaggccaatccgccccgcgtgccggtggaagaacaggtcgctgcgccggatgcggaagacgccgggaatcctggtgaccccgagcatccggagagcgccgaaggcgaaggttcgatcgaagcccagcaaatcgccgccaaggcccagaccaccttcgagccgaccccggccgagcggatcatcgatgcccgtaccgcctatatcatgaccagcatgctgcaggacgtgatcaagcgcggtaccgggcgtcgcgccctggcgctgaagcgcaccgacctggccggcaagaccggcaccaccaacgattccaaggatggctggttctccggctacaactccgactacgtgacctgcgtctgggtcggcttcgaccagccggagaccctgggtcgccgcgagtacggcggtaccgtcgcgctgccgatctggatcaggtacatgggcttcgccctcaaggacaagccgatgcacaccatggccgaaccgccaggcatcgtcagcctgcgcatcgacccggtgaccggccgttcggccgcgccgggcactcccggcgcctatttcgagatgttcaagaacgaggacaccccgccctcggtcaacgaactgccgccaggcagcttccctggcagcccgctgccggatgacgaaggcgcgccgatcgacctgttctga

SEQ ID NO: 16101 - DNA, 612 bp, Pseudomonas aeruginosa
acagcaggacggcctgcgctaccacgcccgcgacctggcactggtacgcgcgcgcctggagaatgtgccgatcctgctcggttcggccacgcccgccctggaaagcctgcacaacgcccaggccggccgctacggcctgctgcgcctgacccagcgcgccggtggcgcgcacccgccgaagttcatccgcctcgacgtgaagagcatgccgctcgacgccggcctttcccgtccgctgcaacaggccatcggcgataccctggcggccggccagcaggtcctggtgttcctcaaccgccgcggcttcgctccgaccctgctttgccacgactgcggctggatcagccaatgcccgcgctgcgacgcgcggatgaccgtgcaccagggcagcggcgagttgcgctgccaccactgcgaccaccgccagcggccgccgatgaactgcccgcaatgcggcaagctcgacctgcgcccggtaggcgccggcaccgagcgcgccgaggaacgcctgcggattctcttcccgaaccatccggtgctgcgcatcgaccgcgacagcacctcgcgcaagcacgccatgcgcgacctcttcgccaccatcaacagcggtga

SEQ ID NO: 16102 - DNA, 741 bp, Pseudomonas aeruginosa
gccatgcatcctggtcggcacccagatgctcgccaaggggcaccacttcccacgggtcaccctggtggcgatcctcgatgccgatggcggcctgttttccgccgacttccgcgccagcgaacgcatggcccagcagatcgtccaggtcgccggccgcgcaggacgcgccgaggagcccgggcgggtactgatccagacccacctggccgatcacccgctgctggtccagctcaccgaggacggctacttcgcctttgccgaacaggccctcagcgaacgccgcgccgccggcctgccgcccttcgcccacctcgccctgctgcgcgccgaagcgcacaagccgggccaggcggaagccttcctcgacagcgcctgcagtgccgccgagcaattgctcgagcagatgggcggaccggaggtggaactgctcgggccggtgcccgcgcccatggagcggcgtgccggcaagcaccgcgcgcaactgctgctgcagtgcatgagccgagcgccgctgcatcgcctgctgacgccctggctgcagagcctcgaacagttgcccggcgggcgccaggtgcgctggtcgctcgatatcgatccgatcgacctgttctgagcgccttccaggaagacgccccgcttgactggggtcagccggaatccgcgatgtccggcgcaaactgtcggctaatcgccgcaacggttggcaacgcctgtccgcccacggataatgcgcggttctga

SEQ ID NO: 16103 - DNA, 1812 bp, Pseudomonas aeruginosa
ccacggcgatttcgccagcaacatcgccatgatgctggccaagccggccgggatgaagccgcgcgacctggccgccaggctggtcgaggcaatccccgcccacgagcaactggccaaggtggagatcgccggccccggcttcctcaacttcttccaggatcacgtctggctcgccgccagcctcgaccgcgccctcgccgacgaacgtctcggcgtgcgcaaggcaggcccggcgcagcgcgtggtgatcgacctgtcctcgccgaacctggccaaggaaatgcacgtcggccacctgcgctcgaccatcatcggcgacgccgtcgcgcgcgtcctcgagttcctcggcgacacggtgatccggcagaaccatgtcggcgactggggcacccagttcggcatgctgctcgcctacctggaagagcaaccggtcgacgccgaggccgagctgcacgacctggaggtcttctaccgcgcggcgaagaaacgcttcgacgagtctcccgaattcgccgaccgcgcccgcgaactggtagtcaagctgcaggccggcgaccccgactgcctgcgcctgtggacccgcttcaacgagatttccctgtcgcactgccagaaggtctacgaccgtctcggcgtgaagctgagcatggccgacgtcatgggcgagagcgcctacaacgacgacctcgcccaggtggtcgccgacctgaccgccaagggcctgctcaccgaagacaacggcgcgttgtgcgtcttcctcgaagagttcaagaacgccgagggcaatccgctcccggtgatcgtgcagaaggccggcggcggctacctctacgccaccaccgacctcgccgccatgcgttatcggcacaacgtgctgcacgccgaccgcgtgctgtacttcgtcgaccagcgccaggccctgcacttccagcaggtcttcgaagtggcgcggcgcgccggtttcgttccggccggcatggagctggagcacatgggcttcggcaccatgaacggcgccgacggccgtccgttcaagacccgcgacggcggtacggtgaagctgatcgacctgctggaagaggccgagagccgcgcctatgcgctggtcaaggaacgcaacgagcagcgcgccgagcgtggcgaggagccgttcgacgaggtccagctgcgcgagatcggccgggtggtggggatcgactcggtgaagtacgccgacctgtccaagcaccgcaccagcgactacagcttcaacttcgaactgatgctgagcttcgaaggcaacaccgcaccctacctgctctacgcctgcacccgcgtggccagcgtcttccgcaagctcggccagggccgcgagcaactgggcgggaagatcgtcctcgagcagccccaggagctggccctggccgcacagctggcgcagttcggcgacctgatcaacaacgtcgcgctcaagggcgtgccgcacctgctctgcgcctacctatacgagttggccgggctgttctccagcttctacgagcattgcccgatcctcaccgccgaggacccggcgcagaaggacagccgcctgcgtctcgccgcgctgaccggccgtaccctggaacagggcctggagctgctcggtctgaagactctggaacgcatgtaatcgaacccgcccgaacaggagtccgggaacccccatggcaaagaagaaacccgcccccaagcgcggcgccagccgctaccaggcgcccgccgcgaagaacggcgttcccggctgggtctggctggtcgccggcctggccatcggcggcttcatcatgttcctga

SEQ ID NO: 16104 - DNA, 417 bp, Pseudomonas aeruginosa
agctcgaacccgggcgcaaggacgtccagcgcgaacgcccggacgcccagcgcccggccgccgccgtgcagggcaagcagccgcagcagaacggccaggcccagcagcccgcgcaaacgcagacgccggcccaggccaagccgaagtacgagttctacaccctgctgccggagtccgaggtcgtggtgccgccggaagcggtaccggagaaggccccgccgccgcccacccccgccgaactggccaaggccgacgaagcgcgggccaaggccgcactcgccgggcaggtgccaccgccgctgccgaaagcggtggtcgccgccagcacgcagttcttcctgcaggccggctcgttccgcaagcagtccgacgccgaccgcgtgcgcgcgcagatcatcctgctcgggcagtcggtga

SEQ ID NO: 16105 - DNA, 756 bp, Pseudomonas aeruginosa
tggtcggcccgttcaacagccgcgaccagttgtcccaggcgcagaagacactgtcctccaacggcttcagcaacctgctgttacagcaacgcaaggcccgctgaacgcgggccacgccgtgcgttccgacgcacggcggtgcgtgcggttgaaaagccgcggatcgcccctatatctcccagcattccgggcattcggccccgcagtgtggagatttcccccttgaccaccatcgtatctgtccgccgcaacggcaaagtcgtcatgggcggcgacggccaggtttccctgggcaacaccgtgatgaaaggcaacgccaagaaggtccggcgcctgtatcacggtcaggtactggccggtttcgccggcgccaccgccgatgccttcaccctgttcgagcgcttcgagcagcaactggagaaacaccaggggcacctggtccgcgccgccgtcgaactggccaaggactggcgcaccgaccgctccctgagccgcctcgaagccatgctcgcggtcgccaacaaggatgcctcgctgatcatcaccggcaacggcgacgtggtcgaacccgaacacggcctgatcgccatgggctccggcggcggcttcgcccaggccgcggccctggccctgctgcagcacaacgccgagctgagcgctcgggaagtcgccgagaccgcgctgaacatcgccggctcgatctgcgtcttcaccaaccagaacctgaccatcgaggagctggacagcgccgtctga

SEQ ID NO: 16106 - DNA, 1257 bp, Pseudomonas aeruginosa
acgaatgtccatgacgccccgcgagatcgtccacgaactcaaccgccacatcatcggccaggacgacgccaagcgcgccgtcgccatcgccctgcgcaaccgctggcgacgcatgcaactgccggccgagctgcgcgccgaggtaacaccaaagaacatcctcatgatcggccccaccggcgtcggcaagaccgagatcgcccgccgcctggcgcgcctggcgaacgcgccgttcatcaaggtcgaggcgaccaagttcaccgaggtcggctatgtcggacgcgacgtcgagtcgatcatccgcgatctcgccgacgccgcggtgaagatgctccgcgaacaggagatccagaaggtcaagtatcgcgccgaggacgccgccgaagagcgcatcctcgatgccctgctgccggccgcgcgtcccgccatgggcttcggcgacgagccggcacgcgaggacagcaacacccgccagctgttccgcaagcgcctgcgcgaaggccagctggacgacaaggaaatcgacatcgaggtggccgacaacccggccggcgtggagatcatggccccgcccggcatggaggagatgaccaaccagttgcagaacctgttctccggcatgagcaagggcaagaagaagacccgcaagctgaaggtcgccgaggccctgaagctgatccgcgacgaagaggcggtgcgcctggtcaacgaggaagagctcaaggcacgcgccctggaggcggtcgagcagcacggcatcgtcttcatcgacgagatcgacaagatcgccaagcgcgccaacgccggcggcgccgacgtctcccgcgagggcgtacagcgcgacctgctgccgctgatcgagggctgcacggtgaacaccaagctgggcatggtcaagaccgaccacatcctgttcatcgcctccggcgccttccacctgagcaagccgagcgacctggttcccgagctgcagggccgcctgccgatccgcgtggagctcaaggccctcagtccgaacgatttcgagcgcatcctcaccgagccgcatgcctcgctcaccgagcagtaccgcgagttgctgaagaccgaggggctggccatcgagttcgccgaggacggcatcaagcgccttgccgagatcgcctggcaggtcaacgagaagaccgagaacatcggtgcccgccgcctgcatacgctgctcgagcggctgctggaagaggtctcgttcagcgccgccgacctggccagcgagcatag

SEQ ID NO: 16107 - DNA, 1749 bp, Pseudomonas aeruginosa
ccggccggacacctggtccccggtttcgttgcggtcccctgtttcgcctcgaacaatggagcgttgccgatgagtcagaagaacaataacgagcttcccaagcaagccgcggaaaacacgctgaacctgaatccggtgatcggcatccggggcaaggacctgctcacctccgcgcgcatggtcctgctccaggcggtgcgccagccgctgcacagcgccaggcacgtggcgcatttcagcctggagctgaagaacgtcctgctcggccagtcggagctacgcccaggcgatgacgaccgacgcttttccgatccggcctggagccagaatccactgtacaagcgctacatgcagacctacctggcctggcgcaaggagctgcacagctggatcagccacagcgacctgtcgccgcaggacatcagtcgtggccagttcgtcatcaacctgctgaccgaggcgatgtcgccgaccaacagcctgagcaacccggcggcggtcaagcgcttcttcgagaccggcggcaagagcctgctggacggcctcggccacctggccaaggacctggtgaacaacggcgggatgccgagccaggtggacatggacgccttcgaggtgggcaagaacctggccaccaccgagggcgccgtggtgttccgcaacgacgtgctggaactgatccagtaccggccgatcaccgagtcggtgcacgaacgcccgctgctggtggtgccgccgcagatcaacaagttctacgtcttcgacctgtcgccggacaagagcctggcgcgcttctgcctgcgcaacggcgtgcagaccttcatcgtcagctggcgcaacccgaccaagtcgcagcgcgaatggggcctgaccacctatatcgaggcgctcaaggaggccatcgaggtagtcctgtcgatcaccggcagcaaggacctcaacctcctcggcgcctgctccggcgggatcaccaccgcgaccctggtcggccactacgtggccagcggcgagaagaaggtcaacgccttcacccaactggtcagcgtgctcgacttcgaactgaatacccaggtcgcgctgttcgccgacgagaagaccctggaggccgccaagcgtcgctcctaccagtccggcgtgctggagggcaaggacatggccaaggtgttcgcctggatgcgccccaacgacctgatctggaactactgggtcaacaactacctgctcggcaaccagccgccggcgttcgacatcctctactggaacaacgacaccacgcgcctgcccgccgcgctgcacggcgagttcgtcgaactgttcaagagcaacccgctgaaccgccccggcgccctggaggtctccggcacgcccatcgacctgaagcaggtgacttgcgacttctactgtgtcgccggtctgaacgaccacatcaccccctgggagtcgtgctacaagtcggccaggctgctgggtggcaagtgcgagttcatcctctccaacagcggtcacatccagagcatcctcaacccaccgggcaaccccaaggcacgcttcatgaccaatccggaactgcccgccgagcccaaggcctggctggaacaggccggcaagcacgccgactcgtggtggttgcactggcagcaatggctggccgaacgctccggcaagacccgcaaggcgcccgccagcctgggcaacaagacctatccggccggcgaagccgcgcccggaacctacgtgcatgaacgatga

SEQ ID NO: 16108 - DNA, 852 bp, Pseudomonas aeruginosa
gcagcgatccacgcgcctggtactacgacgccaagcgcgaagagggcagctggtggccggtctggctgggctggctgcaggagcgctcgggcgagctgggcaaccctgacttcaaccttggcagcgccgcgcatccgcccctcgaagcggccccgggcacctacgtgcatatacgctgaaagatccggcccgggcgcctggagccgggcacctccatccccagaagaagtccggatgaagacacgcgaccgaatcctcgaatgctcgctgttgctgttcaacgaacagggcgagcccaacgtctcgacactggagatcgccaacgaactgggcatcagcccgggcaatctctactaccacttccatggcaaggaaccgctggtgatggcgctgttcgagcggttccaggccgagttggcgccgctgctcgatccgcccgaggaggtgcgcctgggcgcggaggactactggctgttcctgcacctgatcgtcgagcgcctcgcccactaccgcttcctgttccaggacctgtccaacctgaccgggcgcctgccacggctggctcgcggcatccgtacctggctcggcgcgctgaagcggaccctggccaccctgctggcccgcctcaaggccgaccggcagttgcgcagcgacgcgccggcactcgggcaactggtcgaacagatcaccctgaccctgctgttctccctggattatcagcgggtactgggcagcaagggcgaggtgcgcacggtggtctaccagatcatgatgctggtcgccccgcatctgcgcagcgaggcccaacgctcggcggaaagcctggcgcagcgctacctgggaccggaatga

SEQ ID NO: 16109 - DNA, 294 bp, Pseudomonas aeruginosa
gtttctcgatctgcttggtcagcgtatcgaccttgctgtgcagctccttcacctcgttgcggctcggcacgccgagacgcgagatggcgctgttcaggcgcttgtcgaaagcttcctcgagctcgctccacttgccgagcgcacggtcccgaacctcgtcgaccttgctcttcgcagagcgggcggaagccttcgccgcaccgacctgcgcgtccacatcggacttcgcttctttttcagccttctcgccgtctttcaccaaggtctcgaacagcttgctgccgtccttgctga

SEQ ID NO: 16110 - DNA, 2028 bp, Pseudomonas aeruginosa
ggcggaggtcgactgcaccctgcgtgcgccggccggcaacctcctgcacctggccctggcgcgcgacaagacccgcgtcctgcacagcccggaagtcagcatggacggcgacagcgcggccctgctggaactggccggcatcctgcagagcctggagctggactgggagtacgaactgtcgcgctggctcggcccgctcgccacccaggtgctcggcagcggcctgcgcgacgcttcgcgctggagcgcgcagagcctgcacagcctgcgcctgaacctggccgactaccttgccgaggaaagccgtacgctggtcggccagcacgaagccgaagcacgcttcgccgaactggaccagctgaagctggccctcgatcgtctcgacgcgcgcgtcggacgcctcagccaaaagaccaagcccgacgcatgaagctcctcgctgtccgccgcctcctgcgcatccagcgcgtcgtcatccgctaccgcctggacgacctgatcctcgaactgccgatgctgccctggtggctgcgcctgctcggtgccaccctgccctggcgctggctgccgcggcgcaagctggaactgacccgcggcgcgcgcctgcgcctggcactgcaggacctcggaccgatcttcatcaagttcggccagattctctccacccgccgcgacctgctgcccgacgacatcgccaacgaactggcctggctgcaggacaaggtgccgcccttcccgccggagctggcggtcaagcgcatcgaggaacagctgggcgcgaagatcgaacaggtcttcgcccgcttcgaacgcgaaccgctggcctccgcctcggtggcccaggtccacgccgcgcgcctgaagagcggcgaggaagtggtggtgaaggtgatccggccgaacctggaaccggtgatccgctccgacatcgcctggctgttcatcctcgcccgcctcgccgagcgggtctccagcgaggcgcggcgcctgcacccggtggaagtggtcagcgactacgagaagaccatcgtcgacgaactcgacctgctccgcgaggcggccaacgcctcgcagctgcgacgcaacttcgaaggctcgccgctgctctacgtgccacaggtctactgggactggtgccggcccaaggtgctggtgatggagcgcatctacggcatcccggtgaccgacctggaaaccctgcgcgaccagcgcaccgacttcaaggcactggccgagcgcggcgtggagatcttcttcacccaggtgttccgcgacagctttttccatgccgacatgcaccccggcaacatcttcgtcagcacccgcgcgccctggagcccgcaatacatcgcggtggactgcggcatcgtcggcagcctgaccgacgaggaccaggactacctggcgcgcaacctgatcgccttcttcaagcgcgactaccgcaaggtcgcccaactgcatatcgactccggctgggtaccggcggaaaccaaggtcaacgacttcgaggcggcgatccgcaccgtctgcgaaccgatcttcgagaagccgctgaaggacatctccttcggccaggtcctgctgcgcctgttccagaccgcgcgtcgtttcaacatggagatccagccgcaactggtgctgctgcagaagaccctgctgaacatcgaaggcctcggccgccagctctacccggaactcgacctgtgggccaccgcccagccgttcctggagcgctggatgcgcgaacgggtcagcccgaagcagttgctgcgcaatttccagcaacaggtcgagcaggtgccgcacctgtcgcaaatggcccgcgacaccctcgaacgcctgtcacaaccgcacgcccacaatgcgccgccgccggagtggaaaggttcccgccacgactggctcgggcgcctggtgggcgcggtgctgctggtcggcgccgccgaggtcggcctgggtcagcagctggaagcctggccggcgtgggtgatgctggccggcggggtgttcctgatcctgcgccgctag

SEQ ID NO: 16111 - DNA, 1494 bp, Pseudomonas aeruginosa
acccgagcagcccgagcacgaccaggaaatgcccctggtctcgcacctgaccgaactgcgtacgcgcctgctgcgcagcgtggcggcgatcttcctgatcttcgccggcctgttctacttctcgcagaagatctacaccctggtctccgagccgttgcgccgcttccttccggaaggcaccagcatgatcgccaccgacgtcgcctcgccgttcctcgcgccgttcaagctgaccatggtggtggcgctgttcctcgccatgccggtgatcctcgcgcaggtctggggcttcatcgcgcccggcctgtacaagcacgagaaacgcgtggcgctgccgctgctggtgtccagcatcatcctgttctacgccgggatggccttcgcctacttcctggtgttcccgatgatcttccacttcttcgccagcgtgacgcccgagggcgtggcgatgatgacggacatcaacagctacctggacttcgtcctgactctgttcttcgccttcggcgtcgccttcgagatcccggtggccacggtgctgctgatctggatcggagtggtcgacgtcgagtacctgaagtagatccgcccgtacgtgatcatcggctgtttcgtggtcggcatggtcctgaccccgccggacatcttctcccagaccatgctcgcggtgccgatgtggctgctgttcgagatcggcctgctgttcggccgcctggtacgcaagcgcggcgagcatccggacgaccaaccggccagcgacggcgaccagcctccggccacccgccagtgaacctgctgctcctcgacgacgccgacttcgtgtcggcggatcgtgcggtcctgcacgatcgccgcctcaagcacctgcacgaagtgcaccgcgccgagaacggcgacaccctgcgggtcggccgcctcggcggctggatgggcgaaggtcgcctgctgaagctcgacgccagcgaggcgaccctggaagtgcgctttgaccagccgccgccggccaagctgccgatcaccctgctgctggccttgccgcgaccgaagatgctccgccgggtgttgcagaccatcgccgcgatgggcgtaccgaagctggtgctgctgaacagctaccgcgtggaaaagagcttctggcagaccccgttcctcgacccggcggcgatccgcgagaacctggtcctcggcctggagcaggcccgcgatacggtgctgccggaaatcatcgtcgagaagcgcttcaaacccttcgtcgaagaccgcctgccggccctggccgccggcagcctcggcctggtcggccatcccggtccctggccggcctgtccgcgcgcggtggagaagccggtgaccctggcgatcggcccggaaggcggctggattccctacgaggtcgacaagctgcgcgaagccggactgcatccggtgcagctcggcgaacgcatcctgcgcgtggaaaccgcggtcagcgccctgcttgcgcggttgttctga

SEQ ID NO: 16112 - DNA, 645 bp, Pseudomonas aeruginosa
gacctcgcccgccggccacgtaccggccctccgcgcccgcacgccggacgcgacgacgctgagccattacctgttccgccacgccatggggctgccaacccagggtgtcgcactgcctggagtaatgacgatgtacgattggtgggttctccaactggccaagctgagcgtcagccgcaagctgatggtcggtttcggtgtcctcctcgcgctgcttctgctggtggtgatcagcagcaaccgcaccctcacgcaccagaccgccctcagcgagcagctcgccgaagtcgccagcctgatggaacagacccagcaagccgaacaaggccgcctggcattcgaagccggcagcgacccgcgccaggccgagcaggtccgccagaccctggccgggatgctccagcgcctgcaggcgctgcgcgacagcgagctcgacccggccgccctggcccaccagaccgaagccatcgaagcctaccgcaaggctttcgacgacctcgccgcagccgatcagcaacgcagcgccgcccgtggtgtgctggtgggcactgcacagcaggcgctggacagcttcgcccgcctcgaggaactgatggacgccagcctcgcgcagcaggccggcgacccgcaggcgttgcaacgtag

SEQ ID NO: 16113 - DNA, 666 bp, Pseudomonas aeruginosa
cctccagggctatcgtggcgggatcgagcagttccgtgccggcgtcatccgcacgcgccaggcgcagcaagcgatgcaaagcagcacccaggatatggcccgggccggccggaccctcaccgaagccggtcgccaattgcgcgagagcaccgccagccgcgaccgcgccagcctctggctgatcgccgcgctggccctggccttcggctgcgtcgccggctgggcgatcaaccggcagatcgtccggccgctggacgaagccctcgcgcaggccgaggccatcgccgccggcgacctcggcaagcgtccgcagaatcccctgaccctccagcgccgcgacgaactgggccaattgcagcgagtcatgcagcgcatgggcgacagcctgcgcgagctggtcgggcggatcggcgacggcgtcagccagttggccagctccgccgaggaactctcggcggtcaccgagcagacccgcgccggggtcaacagccagaaagtggagaccgaccaggtcgccaccgccatgcacgagatggccgccaccgtgcaggacgtcgcgcgcaacgccgaactggcttcccaggccgctcgccaggccgacgaagaggcgcgccagggcgacgcggtggtcgaccaggcggtgacccgcatcgagcgcctggctag

SEQ ID NO: 16114 - DNA, 648 bp, Pseudomonas aeruginosa
cgaaatggacgtttccagcgaagccatggcgcgcctgaagaacgagagcgagcagatcggcagcgtcctcgacgtgatcaagtcggtggccgagcaaaccaacctgctggcgctcaacgcagccatcgaagcggcacgcgccggcgacgccggacgcggcttcgcggtggtcgccgacgaggtccgcggcctggcccagcgcacccagcagtccaccgccgagatcgagggcctgatccagcgtctccagcagggcgccggcgaagccgccgaacgcctggagaacagccgctcgctgaccgccagcacggtggaactggcgcgccgcgcgggcgccgcgctggacagcatcacccgcaccgtctccgacatccagaacatgaacctgcagatcgccactgccgcggagcaacagagcacggtggccgaggagatcaaccgcagcgtcctcagcgtacgcgacgtcgccgagcagtcggccgccgccagcgagcagaccgccgcctccagcggcgagctggcgcgcctgggcacgcagttgcaggcacaggtgggacgcttccgcctgtaacatcccgagaggatcctccttgcatcggcagcccctcccgtccatcgaaagcggacaggaggggcacctttgcgtag

SEQ ID NO: 16115 - DNA, 1011 bp, Pseudomonas aeruginosa
tggagtacccggaactgttgcaggactggtaccgctaccagaacgagcgcctgcgcgaatgggcgctggactggctggaggacaacgatatccagccggccgcgcggcagagtccgacgtcgctcctgccgccgccgggcaagccgttcgcctagcgcggtactagaggacctggcggaggaaggcctgggcccgcgggtcctgcggattgtcgaagaactgcgccggcggcgcgtcctccagcagcttgccgtggtcgaagaacagcacgcggtcggccacttcgcgggcaaagcccatctcgtgggtcacgcagaccatggtcatgccttccacggccagggtcttcatgacgtcgaggacttcgccgaccatctccggatcgagcgccgaggtcggttcgtcgaacagcatcaccttggggtccatgcacaacgcgcgagcgatcgccacgcgctgctgctggccgccggacaggcgcgagggatattcgtcggccttctgcccgatgccgaccttggccagcagcgcccgcgccttggcctcgcgctcggccttgccgcgcttgcgcaccacgcgttgggccaggcagaggttctcgagcacggtcatgtgcgggaacaggttgaaatgctggaacaccatgccgacttcgcggcggtaggcattgatgtcggtcctcgggtcggccaggtcgacgccgtcgatgctcaccgagccttcgtcgaactcctccaggccgttcaggcagcgcaggaaggtcgacttgccggaaccggacggaccgatcaccaccagtacctcgcccctggccacgcgggtactcacgtcgtccaccgcgcgcactacctggccgcgggtatcgaagaccttcagcaggttgcgtacttcaatcactttgtccgagcctccgctccagtcgggatgccatgtgcgaaaggggcaggttcaacagcaggtacaacgcggcgacgcagaaccagatctcgaaggtggagaacgaggtggtga

SEQ ID NO: 16116 - DNA, 1038 bp, Pseudomonas aeruginosa
cctcgacccggccgatctcgttggcccgtaacggctcctcggcctggtaggcgaagtactgcggaacgcggttccagcgccattcataggaaatcagcgaggtggagaaccacagcgcccaggccaggaccagcaggatcagcccggtcagcaggtgccagggccagacggaacgtttcttcttggtcacggaaactctctcgaacgatggaatgcgcaggtacgacggcccccttcgcgggggccgtcagcggttcattccatttccttcagccactcggtgttcttgaaccacttgtcgtggatgcgctgataggtgccgtcttcgcggatctgatggaggaagttgttgatgaaattgatgctgtcgtagtcgcctttcttcaggccgaacgccagcggctcgtaggtgaacggctggtcgaggtagaccagcttgccggcgccgaacttgctcaccgccaccacgttgtagggcgagtcgtagatgaaggcgtcggccttgccgttgaccacgtccatcaccgcttccggctcgttgtcgaagccgtggtacttggccttgctgatcagcttgcgggcaacgatctcaccggtggtgccgatcttcgaggtgatgctgtactgcggatcgttcaggtccttgtaggacttgatcttgccttccagttccttgcgcaccagcagggtctggccgaccacgatgaagggctcggagaagttcaggcgcaggttgcgctcctgggtcagggtcatgcccgagccgatcatgtcgaacttgtcggtcagcagcgccgggatgatgccatcgtagctggtggagaccagctccagcttgacgcccatggacttggccatggccttgagcaggtcgacttcgaagccgatgatctggccacgcttgttggtcatctcgaacggcatgtaggtcgggtccatgccgacccgcagggtgccgcgcttgaccgcgtcctccaccgcgccggccgcctggaccgaagccacgcccaccagggcgcagacgcccagaaccaatga

SEQ ID NO: 16117 - DNA, 843 bp, Pseudomonas aeruginosa
agcaagatactttttcattccccaatccccagcagtcttagaaacacagtcgtcgaacggatgctctcgtcgtgtcgccgtcccgggcgggcagcaggccatgaccggctgcgcaaaaggcggccgatagtacctcagctggcgaacgatacgagactttctggattgccggcgcagggtaacagcagcgccgcacggggaaaacaggcaagaaacagaccatgcccccggcggcgttccgccgggggcatgggatcaggactgggcggcgggcagcaggccggcgtcgccgggcactacctgggccagcggtacgctggcggcgtgggggtcgtccgcctcggccttgcgccagcggccgagccagtcgtcgcggtcctcttcccagacccgcgtatgcaggcgcgaaagtgctaccgggtcactcaacagagccaggcgcgtggcgccgtcgagctgttccgggcccttatcgatggccttgccgatacgctcgccgcgcaccgtctcgatggcttgcgcacggttgtggcgagccgtgcccatggcgcaggccagggcgttgagcaacggatcgacggcggccttgaggaagccatccttgagcgcatgccagcggttctcgtaggtgtactcgtcggtggcgcgcagctcgcgcggcgtgtcgtactcctccgggatcaggaacagcttttcgtcgcgggcgcgcaggcccagcttcacccggctggagatcaccgataccgggatcgacaggatcagcgaaccgacgatcggcgacagccaccacaggaagcgcgggttgagccaggccaccagcagggtccaggcgatacccagtag

SEQ ID NO: 16118 - DNA, 2094 bp, Pseudomonas aeruginosa
agtctgcatgccgtgccggcggatcgcctcgctccagggcgtggcgtcgtcgtcgcgctgcggcgagttccactgcaccgaccagccgaggaaggcggcaagcacgaagcgggtgtggaagagcatgcgcaccggcgccagcagcaccgagaagaacatctccaggagcatgctcagggtcacccggatcaccccgccgaaacccttggcgcccttggcccagatcagcattacgctgagcagcttgggcaggaacaacagggtcagggtggtggagaacaacgcgatggccttctccggatgccactgcggccagatcgggaacagctgccgcggttccaggaagtactgcggctccatcagttggtgcaccgccagcagcgcggtggaaagcaccaggaagaagaaccacaacggcgccgacaggtaggacatgaccccggtgaggaacaccgcgcggtgcaccgggtgcatgcccttgaccaggaacaggcggaagttcatcaggttgccgtggcaccagcggcggtcgcgcttgagttcgtcgagcaggttcggcggcagttcttcgtagctgccgtcgaggtcgtaggcgatccacacgccccagccggcacggcgcatcaacgcagcctcgacgaagtcgtgggacaggatcgcgccggcgaacgagcccttgcccggcaacggcgccagggcgcagtggtcgatgaagggctgcatgcggatgatcgcgttgtggccccagtagtgcgactcgccgagttgccagaagtgcaggccggcggtgaacagcgggccgtagacgcgggtggcgaactgctgcatgcgcgcatacagggtgtccatgccggacgccttcggcgcggtctggatgatccccgcctcaggattggcctccatcaggcgtaccagcttggccaggcagtcgccgctcatcacgctgtcggcgtccatcaccaccatgtagcggtagtcgccgccccagcgccggcagaagtcgtcgatgttgccgctcttgcgcttcacccgacgccggcggcgacggtagaagatcttgccgaagcccttggtctcgcggcacagctcgagccaggcctgctgctcggcgacggcgatatccgggtcgttggtgtcgctgaggacgaagaagtcgaagcgctccatctcgccggtggcggccatcgactcgacggtcgcccgcaggccggcgaatacccgcggcacgtcttcgttgcagatcggcatgacgatcgccgtgcgggcgtcggcggcgatcggctcgctgccggcgctgctgccggagatccggtagcggtcacgcccggtgagcagctcccagaagcccatcagcgcggtccagaagccggccgagacccaacagaagaggatcgcgaagagcgccaggatgccgaactggatgacatagggcagcacctgctggacggtatccagcaggctctgctgggccagctcctccaggtcgacgaaggcccagccctggtagggcaggatgcctttcatgtagtaggtggcgaccgaggtctgcgccagcatcaacaacagcaggatgaaccggcgcagcgagccgacccgctgccagcgggcccgcggcagggcacgcttgggcttgggcgggttgctgcgtccggtcagccgacgccagccgcgcaccaggatgttggtgcgccagggctcgggaatcaccttggtacggcggatcggcggggaaatcttgaggaaggtgcgaccctgggcgtcgacgccgaacatctcggcgtcgtccagctcaggggtgcccagctgcaggcgggcgcgtaccgaggccagggcgggatcgcccccggcatcggcagcggcgccttccgctcccgccaggcgagcgtgcagctcggagaaggaagcggactcgccaagccgctcccgctcctcttccgccaggggaagatgagcgaggtagtcggccagcggtgctttcgtagtggatgggttattcatcggcaggcagctgatagctccaggtttcgctcagtggcttctgcgcctcgtcgaccagcgccgcgcgcatttccaccggtttcttcggatccttga

SEQ ID NO: 16119 - DNA, 1113 bp, Pseudomonas aeruginosa
gcagcttgtgcagcatcttcgccgcgcaacgctcgccatcctcgggctcgaccccgaccagcaccagcaggccgcgatcgatggagccgacgatttcgccgccaacctccacccgcgccgcgccgacgcgctgcagcaatgccttcattcggcctccggcggcaggtcgagcagtcgccggccgatctcgttggtggcgcgcaccagcgcatcgactatccccggctcgctggcggtatgcccggcgtcgcggatgatctgcagttcgctgttcggccaggcctggtgcagggcccaggcattgtccagcggacagatggcgtcgtagcggccatgcacgatcacgccaggcagatgggcgatgcggtgcatgtcctcgagcaactggttgggcctgaggaagccctggttgacgaagaagtggttctcgatgcgcgagatcgacagcgccctgcccggctcggtgaagcggtccaccaccatggggttggggcgcagcgtggcggtgcggccctcccaggtcgaccaggccttggcggcgtgcatctgggcgatctggtcgctaccggtcaggcgcttgtggaaggccgccagcaggtcgccgcgctcttccggcgggatcggcgcgacatagtcttcccaatagtcggggaacaggcggctggcgccttcctggtagaaccagtggatgtcctgcggacggcaaaggaagatgccgcgcaggatcagcgcatggacccgctcgggatgggtctgcgcgtaggccagcgacagggtcgagccccaggaaccgccgaacagcacccacttctcgatacccaggtgctcgcgcaggcgctccatgtccgccaccagctcccaggtgctgttcttctccaggctggcgtggggcgtggaacggccgcaaccgcgctggtcgaaggtgacgatacggtagaggttgggatcgaagaagcgacgcgacagggcatcgcaaccggagccggggccgccgtggacgaagacgaccggcagtccgtccggcgaaccgctttcgtcggcatacagcacatgcggttcgtcgacggccagctcgtggcgagcgtagggtttaatttccggatacagaactag

SEQ ID NO: 16120 - DNA, 672 bp, Pseudomonas aeruginosa
atggtcgcgctgaggatacgctccttgcgcgacccggcctcggccagcagcgcgtcgatcttcgccagcacctcgcgggtctggccatggatatcctcggcctggcccggcacctggccggaaagaaataccagggcgtcgaagcagaccgcggcggacaggcggtcattggtggcgatacgggtcggttccatgggagtgctccaggtcgaggggaattcagccagccagcgcgccgcgcggaagcaggccagaggtatcgatgctcggcgggcggcggccgatctgctcggccagcaggcgcccgctgccgcaggccagggtgaagccgagcgcgccgtggccgaggttgagccagaggttgcggtagccgccgttgcccaccagcggtaccccggtgggcgtggccgggcgcatgccggcccattcgacggcggcgtcaaaatcgccgccctgcgggaacgtgtctcgcgcctgctggcgcagcagtgccaggcgcgcgggctcgaggccggggtcgaagccgacgatgtcgaccatcgcggcgatccgcagccgctcgccgattcgcgcgtagacgatcttgcggtcgtaatcggtgatgctggtatccggcgcgcggtgctgcgcgccgaccggcagggtcaggctatagcccttgagcgggtatag

SEQ ID NO: 16121 - DNA, 888 bp, Pseudomonas aeruginosa
cctgcaggcggtgcggcgcctggcgcagaacctgcggcgccaaccgggccacagcctgcgcatcggcgccaccccggccctggcgctgtcgctgctgccgcgggcgatcggcgaatggagcgcgcgctatccgcagagcggctgcgaactggccaccttgcattcgcgcgagctggtgcagggcctgctgatgcgcgaactggacctggccctaagcctgaagcagccggaacaccccggcctgcgcggcgaagccatcgccagcggcgtattggtggccctggcgccgcgcgaacactggcccgaagcggaacgccggcagccgctgagcctggccgggctggccggcgaagcgctgatcgggctgtccaccgccgacccgctgttcgcccgcctggaggattacctcagcgccgtggagccaccgccgcaggtgaagatcgccgtgcagacctacgccctcgcccgcgccctggtggaggctggggccggcctggcgctggtcgatcccttcaccgccctcggcgccgacccgcacagcaccgcaatccgcccattgagcccggccttcccggtcaccctctacgccatcacccgcgccgacgaaaccccgccgcacaccctcgctccgctgctgcggatgctcgcccgccaggccgaggagcgtttgcgggccgtgcagatgtagcatttgccgcctggcctgccgctggaaaccttggacgtcgttctggcccacgcctcgcgtacttaccgctccggcttccagtctgggcggtccacgtcgtagccttgggtcgggtgaggaggcagaggatggtcctttatcaaattgggaaaacgcaaatcaggatcagcggcaagttgatcgtaaataccatcatatag

SEQ ID NO: 16122 - DNA, 951 bp, Pseudomonas aeruginosa
ggtcaactccatgcctgcctcgatcactaccttgtcgccggccttgaaatggatctcgtcgcccgcctcgacgaactggccggtgccgatcctcaggtgcaacgcgtcggcgacgctgaggtggtcggccgccttcagttcgaccttgcggtcggcatggaccgtgcgctgttcctcggccctgaactcgctgtagctatcgccctcgaccgtgtcgtggcgctcgtggccgacgcggatcttctggtcgtgctcgatgttctcgtcccagtcgcgctgggcgtggacgaagatctgttcctggcccttgcggtcctcgatgcgcagttcgttgaaaccgccgccgccggggtagctgtcggtcttgaaaacgctgcgggtcttgttctgcggcagctcgtagggcacccggttttcgctgtggtagaggcagccggtgaccagcggctgatccggatcgccctccaggaaacccaccaggacttccatgcccacccgcgggatggcgacgccgccatagcgtttgcccgcccagttggaggcgacgcgcaaccagcaactggtgttgtcgtcggcctggccgaggcgatcccagaagaactgcaccttgacccggccgtattggtcgcagtggatggtctcgccggcggggccggtcacgaccgctgtctggcagcccagcaggcgtggcctgggatgctccagcgggggccggaaatgcgcgctccagggagtggcgacgaaacggttgcgatagccctggcggaaatcgccccggccctgcgcgacgtcgctgtcgatcgactcttccagtacctgcggctgccgcccttcgtggagaacctcggtaagcagccagagatcgttccattcgccgcggggatgcgcggacagcgtcaggaagtgtccgctgagcagcgccggttcgtcgctttcgcccctggcctgtag

SEQ ID NO: 16123 - DNA, 1884 bp, Pseudomonas aeruginosa
gtagtcggcgcgatgccgttccagcgcgcgccggctcaggtgcttgccgcgctcgcggtgggtgaagcggccgggatagtcgtagtcctccaggtccggttgctgcgccccgggctgcgggccatgggcggcctgcatctgcaacgcgggttgctcgaagtcgtagtcgcgccgggtaacccggctggcacgggtgtcgaagcgcacgccgaagcgcttgaccaccggctggtcggcgaccagcccggcgtcctgcacgtaggcgacggggcgttgcagccgcggaaaggaggtctggtcgtcgccgaagaccagcacatggccctgggcagaaaactcatggtggtaatggatgccttcctcctcgcagagcctgctgaggaacgccaggtcggtttcgtcgtactgcgtgcagtattcgcgggccgggtacggcgtcgggcccagctggaagcggtaggcgtcggcgagaatgccgtggccctccagcacccggccgatgatttccggcacgctgaggcgctggaagatgcgttggtcgctgcacagccccaggtaggccaggcgcggctccagggtcgcgcgatagccggtcaggcgcttgccggagtccccctgggcgatgctggtgagctgtccgtggaccccttgcccgctcggcgagaggatcaggaaggccggctggtgcagcagcgcgtcgaggtccagatcggatcgctcgctgaccagctccaggtcgaagcgaaagggctggctgatggcttcgcgaccgcggaaggcgagtacctggaagtcgtgccggaggttttcgatgcgaaggctgaagtgcgtctggttggcgggggcgaacattcactgtcctcttggaaacgcagccgtgcgttcctggcgtattcggttccgggcgcgacgcgcctgagcccgcgcgatggaaatgctggccgagaggatagaggagaacagttgtgcaactctttgcgcactcggcctcccggccgcatcaacgctgacctcaataaatttgcaacagaaaatttccagaatgccgacgcggacgccccaccccatccgcggccttcacgtccgccaggacgggccaggcgtccgccgcctccgagcacctcaggcgtagcgctcgcgaccccaggcgaggaggctttccagcagttcgcggatgactgcgcgggtcgcttcggcgaggtccgcgcggtaagcgaacggggcctgctcgtccatgtaggtgcactgcgccagctccagctggacggcatggacgtgctgctccggctggccgtagtggcgggtgatgtggccgcccttgaagcgcccgttgagcacatggctgtagccttcggcggcagcgcagaccgcctccaggcgggccgccagcgctggatcgcaactggcgccggcgttggtgccgagattgaagtcgggcagtcggccgtcgaacaggtgcggcacgtgggaacggatcgagtgggcgtcccagagcagcgcgtagccgaactcggccttcagccgcgccagttcctcggcgatggtccggtggtagggcgtccacacttcagccaggtagcgcatgcgttcctcggcggacggcgccatgccttcgcggtagagcggccggccgtcgaacagggtgtccggatacaggccggtagtggcggtgctgtacagcggcttgtcgtcggaagggcggttgagatcgaccacatagcgcgaatagtgggcagccagggtgctggcgcccagttcctcggcgaaatcgtagagccggggaatgtgccagtcggtatcggtcagcgcccgcgcctcctccaccaggccggcgtccaccgccggggtcaggcgcgtgccggggtgcggcatgctgatcagtag

SEQ ID NO: 16124 - DNA, 1557 bp, Pseudomonas aeruginosa
gggtggcggcatggcaatgctgccagagtcgtttcattgcaggtctcctatgctcgcggccagccgggcgagactcttccgctcgccgaggatggccgccgcgctggcgatgtcgggagccagccagcggtcggtgtcgtacgcgggcacgcgctcgcgcaggatgccccaggccgccgcggtgccctggccgaagcgttgcggggcgaggaattcgaaggcctgggcggccagcaggtactcgatggcgaggatccgccggaggttctccagggccctgccaagcttgagcgcggcactggtgccgaggctcaggtggtcctcctggagcgccgaggtgacgaagttgtcgaccaccgccggctgcgccagctggcggttctcgccagccagggaggcggcgacgtactgggtgatcatcatccccgagttgactcccggcttgcccaccaggaacgccggcaggccgctgaccagcgggttgaccaggcgatccaggcgccgctcggcgaccccgcccagctcggccacggcgatcgccagcaggtcggcggccatcgccaccgattcgccgtggggattggcctgggataccacccggtaggcttccggcgtacccagcagcagcgggttgtcggtggccgagttgagttcggtctctatctgccgcgccgcgtgggccaactggtcacggcaggcgccatggatctgcggtatcgagcggatgctcagggcatcctgggtgcggatgccgcgggcgttctccagtacctggctgccagccagcaaggctcgcagattgacggcgacccgctgcatcccgggatgcggcttgagcgcaacgatctcggcgtcgaacgccgccagttggccgcgcagggcctcgaagctcatcgccccgatcacgtcggcccactgcgccaggcgctgcgcgtcgtccagggccaggcaggcgaggccggtcatgcacggcgtgccgttgaccaggcagagcccgtccttggctcccaggcgcaccgtcgccaggccttccgccgccaacgcggcggcggccggcacgacgctgccgcggtagctgacctcgccgatgccgagcagggcgatgccgacgtgcgccatgtgggtcaggtagcccaccgagccctgggccggcacctgcggggtaatgccgtggttgagcagcgccagcagtccttccaccagcgaacggtcgagcccggacttgccctggctgtagttggcgacggcggcacagatgatcgcccgggtctgttcgtcgcgcagcggctcgccgaccccgcaggcatggctgagcaaggtgttgcgcgacagctcggcgagctgctcgccttccagcaggacgtcgcacagcgcgccgaggccggtactgatgccgtaggcacgctcgccgttggcgacgatacggcagacgatggcgcgggcgttgtcgatccgtgcccaggccgccgccgacagttccaggcgcgcaccgtgccgggccaccgcgaccagttcctgccaacgcagcggaccgtcgccgaacacgacgctcggtag

SEQ ID NO: 16125 - DNA, 840 bp, Pseudomonas aeruginosa
tgccgaagatctcgatgccgccgaaggcgaataccaccagcgacagggaggcgaccagcccgggcccagccgttgggcaggaacccgccgtgctgccaaaggttgtgcacgccggtggcgggagtcgccgccgccgcccaagctgaagccgaagaacaagatgccgagcccggggagaatcatcgcgaagatggcaccgaccttgaccagcgacagccagaactccagctcgccgaagaccttgacatgacagaggttcagcccgccgatgaacagcacgatggacagtacccagatccagcgcggcacgtcgggaaaccagaaccccatgtagatgccgaacgcggtgacatcggcgaggcagacgatgatcatctcgaaagcgtaggtccagccggtgacgaacccggccagggggccgagatagctgctggcgtaatggccgaacgagccggacaccggctcgtgcactgccatctcgccgagcgcgcgcatcaccatgtacaccgccgcgccggcgaccaggtaggccagcagcaccgccggcccggccatctggatggccgatgcggaaccgtagaacaggccggtgccgatcgccgaccccagtgccatgaaacgaatatgacgggcgttcagtccgcgccgaagccccgtgtcgtgcgtcatccctcggctctcctcttgttgttcttgctggagcgccccggccgagcggccgggggcgggtatcaaagactcggcaacagccgggccggcagcagcgcgttcaggcaaccgctggcgagcaactggctggcggcctcgatatcaggggcgaagaagcgatcctcctggtag

SEQ ID NO: 16126 - DNA, 2295 bp, Pseudomonas aeruginosa
tacggcaccttgtcgcgcagcaggcggcgagcctgctccagcttcggcgaactcttcaggccctcgcggaagtccaggccctggcaggcgcccagccactccacggcgagaatcccgcgggacgttctcggccatcgcccagagccgtttgccggcgttcggcgccatcgacacatggtcttcctggttggccgaggtcggcaggctgtcgacgctggccggatgggccagggccttgttgtcgctggccagcgcggcggcggtgacctgggcgatcatgaagccggagttgaccccgccgttggccaccaggaacggcggcaactgcgacatgtgcatgtccatcatcagcgagatgcgccgttccgacagcgaaccgatctcggccaacgccagggccaggttgtcggcggccatcgccaccggttcggcgtggaagttgccgccggagatcacgtcgccctcggcggcgaataccagcgggttgtcggacaccgcgttggcttcgatctccagcacctcggcggcctggcgcatctgggtcaggcaggcgcccatcacctgcggctggcaacgcagcgaataggggtcctggaccttgtcgcacttctcatgggagcgcgccacctcgctgctggcggtgagcaggtcgcgataggccgcggccacgtcgatctgcccacgctggccgcgcgcggcatggatgcgcgcatcgaacggcgcccgcgaaccgagcatggcctcgacgctgagcccgccgcagacggtggcggcggcgaacaggtcctcggcctcgaacaacccgcgcagcgcgtaggcggtggacacctgggtgccattgagcagggccaggccttccttcgccgccagggtcagcggctccagcccggccaccgccagcgcttcggcggccggcagccactcaccgcgatggcgcgcccggctttcgccgatcagcaccagcgacatgtgcgccagcggcgccaggtcgccggacgcacccaccgagcctttcagcgggatgtgcggatagacctcggcgttgatcagcgcgatcagcgcgtcgatcaccttgcggcggatgccggagaacccgcgcgccaggctgttcaccttgagcagcatgaccagccgcaccatggcgtcgtccagcgcctcgccgacgccggcggcatgggacaggacgatggaacgctggagcttctccaggtcggccggggaaatccgcgtcgaggccagcaggccgaagccggtgttgatgccgtaggcggtgcggccctcggcgatgatgttctcgacacaggcgacgctggcggcgatcagcgcgtcggcgctgggatccaggctcaggcgcacgggggccaggtatgcttggcgcaggtcggccagggtcaactggccgggtttcagatgcaggctcatcgaaggctccttgttcggttcggcgggctcggcagcgccgtccgccggcggcgtttcatgggattgaaggcggccgcgccgccctggaaattcgtctcaggccccgtgcgcgggacgttcgaaggcgccgggatcggccggcaggatcattcgcgccggggcctggcgcgtggccttgcgccgcgccaccaggtagtagaggaccgccggcaccagcaagccgatgatccaggagatatccacgccgccgaggtgctcgaccatcggtccggtgtacagcgtggtcgccaggaacggcatctgcaccagcacgccgagggtatagacggcgattcccggcaggttccagcgaccgtagcggccgtcggggtcggccagcgcgggcacgtcatagcgctcgcgggtgatgaagtagtagtcgaccaggttcaccgcgctccacggggtgaagaaggtcagcaggaacaggatgaaggacttgaacgcagcgaggaacgagtgctggccgagcagcgcgatgagcgtcgaggcgccgacgatcgcgaggacgaagaacaggcgttgcacgcgggtgatctccagttggccgcgtacgctgctgatgatggtcgcgatgcacatgaagctgccgtaggagttcagcgtggaaatggtcaccttgccgaaggcgatgctgaagtagagcagcgcggcgacggtcccgctgctgcccaggccgacgatgtaggccacctcgcggccggcgaactggccgttggccagggctgcggagaacaccccgaggaccatcgaggcctgggcgccgagcaccgagccgaggccgacggcgaggaaggtcttccacgacgaggtggacgccggcaggtagcgtga

SEQ ID NO: 16127 - DNA, 843 bp, Pseudomonas aeruginosa
atagtcggccacgtaggggccgaaggcgatctgccaggacgccgccagcgacaccgcgaggaggaacgaggcccagctgaaatggcggatggcgagcaggtcgccgatgtcgctgagcagcatcaggcggctgaacaggtaggcgaaggcgatgatgccgaggacgctggcgatccgcccgatgatgtggatgacgcgatagccgagcaccgtcaccaggacgatgaaggcggcgaagatgaagatcccggtgctgtcgctgagcccggtgagctggccgatggcctggccggaaagcaccgtgccggtggcggtgaagcccaggtacatcaggcacaccagtgcgatcgggatgcaggcgccgtagacgccgaactgcacccggctggaaatcatctgcggcagccccaggcgcggcccctgcgcggcgtgcagggccatcaccgcgccgccgaggagctggccgatgagcaggccgaccagcgaccagaacacgtcgccgccgaggaccacggcgagggcgccggtgacgatggcggtgatctgcaggttggcccccagccagagggtgaactggctgtagaggcggccgtggcgctcgttcgccgggatgtagtcgatcgagcgccgttcgatcagtggcttgctgtcgctgccctgggtcatgctgctgtactccgctgcggctcgcgcgccgccattcttgttgtggcctggtcgggacagtgggcggccgcccccacgccccgccggcgtggaggcggttttcgaggtcagcgctgggcggtgatcatcggcaggttcaggccctgctccttcgcgcaatcgatggcgacctggtag

SEQ ID NO: 16128 - DNA, 492 bp, Pseudomonas aeruginosa
ccggcgtcggcgtgccgcatcaccccggtacccgggtcgttggtcagcacgcgggcgatgcgttcggcggcctcgtcgctaccgtcgcagacgatcaccatcccggagtgctgggagaagcccatgcctacgccgccgccgtggtgcagcgagacccaggtggcgccgctggcggtattcagcagggcattcagcagcggccagtcggacaccgcgtcggagccgtcctgcatggcctcggtctcgcggttggggctggccaccgagccggagtcgaggtggtcgcggccgatgacgatcggcgcggacagctcgccgctgcgcaccatctcgttgaaggccaggccgagcttggcgcgcagccccaggccaacccagcagatgcgcgccggcaggccctggaagctaatgcgctcgcgggccatgtccagccaacggtgcaggtgggcatcgtcggggatcagttgcttgaccttggcgtcggtcttgtag

SEQ ID NO: 16129 - DNA, 879 bp, Pseudomonas aeruginosa
caccgttcagcgcaattgcgggtaaccccagccctgcgcctgacgctcgtagtcgaggagaatccggtaatgctcctcgccggccgggaggaagcttttcagcgccagtgtcgcggccaggtgcgggcactcgatcagcgtcaggttcagcgcttcgaacagctcgcggcgttgcgccgcactccagtgcagcgaggtgatcagcggcaaggccgggctcggcgcgctgcgcccgagcacgcgcaggccggccaggcgctccggtgcgtggcgttgcaggtagccgaaggtcactgcatccaccgaggtcagctcgacctcacccgcggccaccatcgccaggctgcgcaggtggccgccgctgatgtgcacctcggcgaagaacgccgagtctcgccccagcggcgccagcgcatggcgcagcaggttcatgccgctgttggagtcgtggtcgttgagcgccaggcgggtattgcggaagtcgccgaggcgctggcgcgcctgtccttcggcggcgacgaacaggctgcaatgctcgccgggagcacaatcgggcaagtcgtagctgggcaccgcgagcaccgccacctggccgcgcaactgggtcatcagcggatagccgcaggtctgcgcgaacaacaggttaggctgtcgccactgcaccgccagatcggtggcggccgacgcgtaacggcgcacgcccaggcgccggcagacctcgccgatgaagattgcgccggcctgcctgacgcagtccggctcgacatacatgtccagcgccgccaccaccggggtatcgatcatgctctcgtccgcctgccttcaatgctcgggatgcaccggcgcatccaccggccgccaaccgtggcgccgccatag

SEQ ID NO: 16130 - DNA, 885 bp, Pseudomonas aeruginosa
acgaccatagccgggcaggtggaaatcgccactgcgtcgccggtaggcacggcggcttgcgctatacacgcgcggcagcaggtaccagggcaggcccggcagatcgtggtggaccagatgcaagttgttgttgaggaacagcagccgccacggccaccccgcctcgaccagcacgctgcgctgcgccggctcgtgggccggacggtgctcgtagaaagagcgcagcatgctcaggccgagggccggataggccaccgccggcaggtacagccagggcgggatgcccgcccagcgccaaagcccggccagcaacccgcccagcagcacggcatgcaggccccacaggcgccaggcggcgccctctccccggcgcaaccgcgaaccctccaggcgcgccatcgccgccagggccagcagcgggccgagggtggcgcgaccaagcagggtcttgtccaggcagagccagcgccgccgccaggagcccaggcgcggccactcggacagactgacgtagcgactctcggggtccagccccgggtaggtcagttgctcgtcgaggtggtgccgcaagtggctgtcacggtacagcggatagggataccagacggccagtggcaggtagccgagcatggcgttgaacctcggccagcgggtcgggtggccatggatcagctcatgctgcaacgacatgtagagggaggcgaacggcaccagtcccgccagtaccggccaaccccagcgctcatactggctggcgagcagtgcccaaccgccgtacaggcaggccgatcagcagccaggtcggccattcgctgcgcgcctggaaggtatcctggagccgccgcaccagggtgcgctgacgcccgctcaggtagtgcgccatga

SEQ ID NO: 16131 - DNA, 798 bp, Pseudomonas aeruginosa
gctgaaacgtccttccagacggtggcgggaacccgggtgcagcagccgcgcggcggtcaccgcgacacgcccggaccatgtgcggcggcggatcagcaggcacggctcgccgcgttcgatctgcaacagcttgcactcggccggctcggcgaggatcgcctcgaccacatgctcgccctcggtgagcggcgccacctgggtcaggtaggcatagggcgtttgccgggtgaaatcctgcttgaggtagtccggcgccaccgcggcgttcacgtagcggtcctcgatctgcaccgggatatcgttctcgtagtgcacgatcagcgagtggaacacccgctggccttcgcgcacgtccagtgccagggcgcgctcggggccggcgacctcctcgccgagggtgatcacctggcaacgatggcgatgcccgcgggccgcgatctcgtcggcgatgttgtgcacctcgaacagcgccgactggcccttgggctcggcgacgaaggttcctaccccctgcatgcgcaccagcaggccgtcgctggtcagttcgcgcagggcgcgattgatggtcatgcgactgaagccgagctggctgaccagttcgctctcggacggcacccggtggtgcggcggccaggcgcccgactggatctggctgacgatcatctgcttgacccgcgcgtagagcggcgccggtacctcgccgagttgcgaggccagcggggaacgatcggaggaagaggacgtcacggagagactccttgtcgaggcgtcgatgaagtgagtttacgcaccgcttaa

SEQ ID NO: 16132 - DNA, 831 bp, Pseudomonas aeruginosa
acgtgcgttgctgccggaaggctgggcgcgaaatgtccgtttcgagatttccgcggacggagtcctcgccgggattcgtcccgacgccaacgccgacggcgccgaacgcctcggcggcgccgtgctgccggggatgcccaacctccattcgcacgcgttccagcgcgccatggccgggctcgccgaagtcgccggcaatcccaacgacagtttctggacctggcgcgagctgatgtaccggatggtcgctcgactgtcgccggaacagatcgaggtcatcgcctgccagctctacatcgagatgctcaaggccggctacaccgcggtggcggaattccactacgtccatcacgacctcgacggccgcccctacgccgaccccgccgaactttccctgcgcatctcccgcgccgccagcgccgcaggtatcggcctgaccctgctgcccgtgctttacagtcacgcaggcttcggcggccagccggccagcgagggccagcggcgcttcatcaatggcagcgaggcctacctggaactgctccagcgcctgcgcgcgccgctggaggcggcaggccactccctgggcctgtgcttccactccctgcgcgcggtgactccgcagcagatcgccacggtcctcgccgccggccacgacgacctgccggtccacatccatatcgccgaacagcagaaggaagtcgacgactgccaggcctggagcggacgccggccgttgcaatggctgtacgagaacgtcgcggtcgaccagcgctggtgcctggtccatgcgacccacgccgaccccgccgaggtggcggcgatggcgcgtag

SEQ ID NO: 16133 - DNA, 432 bp, Pseudomonas aeruginosa
tctcgccgtgggccgtcgcgccgacctgctggtgctcgacggcaacgacccctacctggccagcgccgagggcgacgccctgctcaaccgctggctgttcgccggcggcgaccgccaggtgcgcgacgtgatggtggccggcagatgggtggtgcgcgacggccggcatgcaggggaagagcgcagcgcacgggcattcgtccaggtgctgggggaactgctcgactgaccctgcacagcggcggacaaccgcgttgcgcttatccgccccactcgttcgagccgtcgggcgctaaacgccgatacttcccacgccagccgccaggcgtgaacggcgctggaaagaaaaaacgccccggcggggcgttccttcactggctccgcttcaactggccgtcgggtacccgccagatcagctcgtccaccgcgtaa

SEQ ID NO: 16134 - DNA, 597 bp, Pseudomonas aeruginosa
ggaacgccgtctcctcctcgctggaggggcggccgagaatggcgttgcgatggggaaagcgaccgaagcgggcgactaccgcatgatgccgctcggcatagtcgtagaaatcgtcgaagggcttgcgcacgctgccaccgacctgatcgcgcaggtcgcggaagcaggctaccgcccgctcctggctgggcaggtcctcggcgtgctccaggaccaggtaggcgaacacccggcgcaccggcggcaactggcggtcgaagcctttttccaggccctcgcgcaccacccgttgcgcccgggcgtcgccggcgtaggcgcgcggcgtgtcgcggtagatcatccgcggcaactggtcgagcaacaggatcagcgccagccagccatcggcctcggccgtccactcctgcaagccgccgtccagcgcctggttcaccaggtcgccgaaacggccgccggcatcggcgtcctggcagacgttcttgccgaaccacaggccgttgcgctgggcaaccacctcggcggcgtcgctggaggtgccgaaccaccagtcgagcaaggtctcccagggcgcgctcatcggcctactccgcgtggtag

SEQ ID NO: 16135 - DNA, 2031 bp, Pseudomonas aeruginosa
tgccggcgcgcgccgttcgttccgtcggcgagaaacgcgaccggcgccgcccgggcgccggtcgccgctacctcagaagtccaggctcagcgccaggctgacgctctgctgggtatcgtcctcgcccttgcgccagttgtagccgccgcgcagcgacagctccggtgccagcttctggctgaagccgagggagacgcggttgaggtggtcctgcggggtgtagccttcgagggtaaagcgattgcccggcaggctgttgagggacatggtgaggtcctgggtgtcgtcctcgtactcgcgttcgtgggcgtactcggcgaacagctgagtatcgctgccgaacgcgtacttgccttgcaggccggcgcccaggcgcttcgagctgcgcttctggtcgtcgtagtcgagcgcggtggcgctggcgcccttctcggaatagccgtcgacctcgacccgtgcatagtcggcgctgacgaacggcgacaggtgccagggactgtcggcctgctgggcgatgtcgtagcccaggcgcgcgctgaacgcccacaggtggccgttggtgtcgcctttctcgctgcgctcgccgccgcccagggcgaacttgcgcttcaggtcgtcgtagtcgaggtagccgccggtcaacgccgcgtcggcccaccagcgggtttcctggtactgcacgaaggcgctggccatgtagctgttcattcggtagtcggaatccttggcgccggcttccagcttctgccggtagaaaccggcggcgaccccggcgcgccaggcctcgtcgatgcggtagctgccgccaagggtcaggttgtagccattgccgtcgccgctggcggcgctgtcctgggagtcgaagtccaggcgctggccgccgccgccgacgaagccgcgccactggccgacgttctgccagttctcccagtccgcctgccactggctgcgcagttcgtcctggtaggcacgcagggtgccgtgggccatttccggcagcagggtcaactcccagggcgccgacagcagcgaataggtgtagtcggcgatcaggcgctggccggtgatggtcgggtgcacgctgtcgttgaacagcagtttgctcgggtcgggcgtgctgccgttgatcccgtaggtcgggttcatggtacagccgttgccgctgaaacaggtgccgatcaggttctggtcggcggccaggccgaaggaagccgggttggccatgccttccttgagcagcagcgggatgttcaacggaatgacgttggcgccggcctggctcaactgggcggtcagctcggcgttgaacgtgccgctgagttggctggcgaaaggctgcaagggaccaccgaaggtagccggggtcaggcccaggtcgggcaacagccagaccacgatgtagcgcgcgccggcctgctgcagggcctgcacgctatccaccaggcgaccggcggcctgttgtgcctggaggtcgttgaggatgcgcccctggaggaagtcgttgccgccgccggtgatgtagtacaacgcgttcggatcggcacccaggccctggcgggcacggtccaccaggtagccatcgcggctgcgcaggagggtattgtcgcgctcgatcagcgagccgttggccgcggtgatcgagtcgtagatctggtcggtccggtagccgcccaccgcccagttgttgccgtcggccgatgccctgctgggccgttgaccggcgaagtcgaggcacccaggtcgcccgggggcgatgccgagctgattgccgagccccaggggcgcggtcggtccgaagatctcgccgctgccgttctggtaggtcgggccgacccggttggtgaaacgcgaggtgcttccggcggggccggcaggatcggggaactgcccggcatcgctgaggctgtcgccgaacaccaccagcgtcgaataaggcgaaggagcagcctgcggggcggtggacagcgaagccagcaggcaggccgctaccagtggcttgagcgccattctgatcattctcttactccgtga

SEQ ID NO: 16136 - DNA, 1464 bp, Pseudomonas aeruginosa
cgcggaaccggctcatggcttgttcggcgaggaacgcagcaggctcattgccattattaccagcagagcgacccccagcagaagtaccgcccacaggccgatcttcttccagtcgctacccggtgccggcgccgcgaccgccatggccacctccagcggttcgcccaggctggcgctacccagggtggcgcgcttgctctcggtatagccgggaatcagtacgccgagcggcagcgccgccgactgcgcgccaggcttgccgaacgccagccggtacggcgggctgccacgcaccaggaacaccagttcgctggccggcaggccgacactcagggacgggacctccgggcccaggccggtacctcgttggtccacctgcagacgcagctcgcgcaccgcccagcccggcagttccagctcgttctgctgtacgttgcggccgtcgatcggcagccggtagagaaccccgcgtgccaggctgctccaggcggcctcccggcgcggcgaagcgttctccgtacgatcacggccggacagttccaccgggacgatggtgtgggtcagcgcctgctgcagggacacccgcacccgctgcaacggcaacgccagcggcaactgccagcggtactcgccgtcccccgcctggcgcccggccagcggctcggaccagatcatcggcgccggctcggtgctccgcgtgctgccttgcaggcgggcgccttggaggtctgccgcggttgccccagccggccaggccagacgcaggtagcgggcctggcggccgggaagcttgacctcgctgacgtcgatgcgttcgccgttgaaggtcaagcgggcgatctgtccgtccccccaggcctgccaatgctcgaggtcgtcgctggcttccacggagaagcgctggaagccctcctccgggctgctccagtccagccgcaggcgctccaggggaaacgtcaccgcgctcgcgtcgatcagccagccgcgcaaagtctcggcagccggcccggcgttttccggcagcacctcgactatggtgccgctggtgttgcgctgcacccgcaggttcggttgcgtcgcgtcggcggcggacgtgcctcgcaacgggaacagccgcacctcggcctcatgcggcgtgctggcctggcgctcgctgccggccaccagggtgtagggcaaggcctcgccttcggcatcgaagacccgcaggtcgcgcaggtcggcatgggcagccgacaactgcacgctcatcgggatgctcaggcgataccagggaccttcgccctgcagcgacagcgccacctggcggctgaaaccttcggcagactccttcgccgacagcggcagggacaggcaggcgcccagcaggagcaggccggcggttctgaacgaaaaggagcgcgtcatggctgctcggcctccgatgcgacctcggcgcgacgcggaggcaagggtgagaagtag

SEQ ID NO: 16137 - DNA, 2256 bp, Pseudomonas aeruginosa
aagctcaggcgctggcgcagcaccaggctcagccagatgatcagcagcccgctaccggcccataccgcgctggcgctgcgccaaggcaggacgaacagcactgccaggttgacgaacgccagaccggccagcagcaccaggctcaagcccatgagcagccgactgtcgtccttcaccagcgggtcgcgcgccgccagcagcatgccgccgatcagcgccaggccaatcagcgaggcggtcatcaagccacgccagcccgagtcgaataccccaccctggccatcgccgccctgcaaatgcaggaggaacagcgcaccgcccagcagttgcacggcgaaggcgcagaacaggaaggtacgcgagcccaggcgcaagccggcgaacaagctcgccaggccgggccacggcccaggcgatggcggtgccgtcgacggccaggcagagcggtgcgaccaggtagaggaaggccaggccggcggccgccagcaacggccggcaggccggctcccagtcggccagcgctttcgccggcgcgcgacgcagctgccagaagctgaacagcgccgctgcaccgagcatcagcgcgcccagcggcgaaccctccagcaacgtcgtctcacccgggcgcacgccattcaggtaggccaacgccgcaccgccctgcaacagcagggcgaagagccgcgccaggcggcgttgctggtgcaggccgagccagtagatgccggcgccctcgacggcccaggcggccgaggtccagcgcgcgtccaggccgagcggaatggccagggtgccgaagaccacccccagcgccaggcagatttccaccagcaggctggtgcgtccggccgaagcatggccgcgcagcacccgcgccaggaccatgtagaagagccccagggccagggcgctgaaggccatgccgaagtcgatgtggccgatcaccgcgcattgcaggccgaaccccaccagtggcgggccgaacagcacggtggcgtcgatgtagtcggcctgtcgcgccgaccagcgcagcagttcgccgcgctcggcaggcgcctgcgcggcctccagcagcttgcggcgggcgaagagcaggccgatcccgacgtacatcaggaagaacagggccaggaacggctcggtgctggcgaacagctccggtgtataggagcgcagtccccaggcgaagccgatgccgaaggtgccgacgaagccgaccaggttgagcggccgccaggcgcggaaccaggcgatggcgaagatgccggcgttgagcagggcgaagtagctgaacagcgctacatggttgccgctgccggtggaggtcaggatcggcgcggcgaagccgccgagcgccgccaccaccgccaggcccatggcgttctgcagcacggcgaggatcgccgagcagatcatcaccaccaccagcagggccagcgccgcgccgggagagatcagcggatgcaggcgcatggcggcgaagatggtcaggtacagcaccgcgataccggtgccttgcaggatcaggccgtaggcggcgcgccgctcgcgcagccaccagccgacgccgagcagcgccatcgctgccagcgccaccccggcgtagcggtactccaccggcaccgccacccgttccgaggcatagcgcaggaggaaggccaggccgatgaacagcagcaccacgccgatgcgcaataccgtgttgccgccgaacagccagcccttggccgcggcgaagccacgctcgaccagcgagggttcgcgtggagacgctggaggggcggcacggcgcggcgctggctgggcgtcaggctggaacgccggctgacgctcgatgggctggacgggctcggggggacaaggcggaggcggcgcagcctcgacggccggcagctcgatgtcccagtccagcggcggggcaacctcggcgggaggagcgggaggcgtgtctgcgagcggctggtcgataccggcggccggctcgggaacgctttcgggaaggtcctgcgcctggcgctccacgcgcagcaagcgctggtggatgacctcggtgccgcgctcgaagcgttcggcgaattcgctcatctgcttgcgcaggcgctcgttctgttgcgccaggttctgcagcgagacggcctgtcccagggccaggccggaaaggccgccgaggagggcgccgaccagcgattccccggcgaagccgccgaggatcaggcccaccagcatgaaaatccattgcatgcgtcgaatccttga

SEQ ID NO: 16138 - DNA, 447 bp, Pseudomonas aeruginosa
gttcttcgaagccggcaagatgttcgacggctcctccatcgccggctggaaaggcatcgaagcctccgacatgatcctgatgccggacgacagcaccgccgtcctcgatccgttcaccgaagagccgaccctgatcctggtctgcgacatcatcgagccgagcaccatgcaaggctacgagcgcgacccgcgcaacatcgccaagcgcgccgaggagtacctgaagtccaccggcatcggcgacaccgtgttcgtcggcccggagccggagttcttcatcttcgacgaagtgaagttcaagtccgacatctccggctcgatgttcaagatcttctccgagcaggcttcctggaacaccgacgccgacatcgagtccggcaacaagggccatcgcccgggcgtgaagggcggctacttcccggtaccgccggtcgaccacgaccatga

SEQ ID NO: 16139 - DNA, 948 bp, Pseudomonas aeruginosa
aatccgcaccgccatgtgcaacgccctggaagaaatgggcctggtggtcgaagtccaccaccacgaagtggcaaccgccggccagaacgagatcggcgtgaagttcaacaccctggtcgccaaggccgacgaagtgcagaccctgaagtactgcgtgcacaacgtcgccgacgcctacggcaagaccgtgaccttcatgccgaagccgctgtacggcgacaacggttcgggcatgcacgtgcacatgtcgatctccaaggacggcaagaacaccttcgccggcgaaggctatgccggcctgtccgagaccgccctgtacttcatcggcggcatcatcaagcacggcaaggccctgaacggcttcaccaacccctcgaccaactcctacaagcgcctggtcccgggcttcgaagctccggtgatgctggcctactcggcgcgcaaccgttccgcctcgatccgtatcccctacgtatccagcccgaaggcccgccgtatcgaagcgcgcttcccggacccggcagccaacccctacctggccttcgccgcgctgctgatggccggcctggacggcatccagaacaagatccaccccggcgatgccgccgacaagaacctgtacgacctgccgccggaagaggcgaaggaaatcccgcaggtttgcggcagcctgaaagaggcgctggaagagctcgacaagggccgcgcgttcctgaccaagggcggcgtgttcaccgacgagttcatcgatgcctacatcgagctgaagagcgaagaagagatcaaggtgcgcaccttcgtgcaccccgctggaatacgacctgtactacagcgtctgatccaccctttcctataacaacgagtcaccctcttgaggcctccttcgggaggccttttttatgggccggcccatggagaaacgcaaagttcgccgcgccgttcggttag

SEQ ID NO: 16140 - DNA, 522 bp, Pseudomonas aeruginosa
acttgccgcgctccccgccccaaggataaggaccgtccatgcgtcactctctctggctcctgcttgccgccatcctcagcctgcccgcccaggccggcaccgaatgccgcgatatccacgaccgcgacctgcggcgcatgtgcaacgcactggaacgcggcgacagcggggattgcggcgacatcgacagccgcgacctgcggcgttactgcggcgcactgctggcgccgggacagcgctacgactgcgacgacatccgcgacggcgacacgcgccgccagtgccgcgccatcgtccgcggcgaccgcaagcgctgcgacgacatcgacagccgcgacatgcgccgccagtgccgggccgtggtatcgcgtgcgccgtggcagtgcgacggcatcgacgaccgcgacatgcgccgcatctgccgggtcatcctgtcgcgctagatgccgccgtccgccggcgtgcccggctcgtccggttccgcggatttcgccttgggcgcccggctcaactgtacgttga

SEQ ID NO: 16141 - DNA, 1134 bp, Pseudomonas aeruginosa
cagctccttttcgtcggcaccgagataggcggcgatcaccttctcgtcatggcggatctgttcggggttgccacgggcgatcacgtcgccgtggtcgagcacgatgatgtggtcggagatgttcatcaccatgcccatgtcatgctcgatcagcagtacggtgatcccgtggtggtcgcgcaggtagcggacgatgttgctcagggcgtgggtctcggccgggttgaggccggcggccggttcgtccaggcagatgagttccggccgcgtgcacatggcccgggcgatctccaggcgccgctgctggccgtaggacatctcgccggccaggcggttggcgcagtccaccaggtcgaccacctccagccagtagaacgcgtggtccagcgcctcgctctcggcgcggcgatagccgggagtgttgaggatgccggcgagcaggttgcggttgacgaacatgtgctgcgccaccagcaggttctccaccaccgacatgtccttgaacaggcggatgttctggaaggtccgcgccagcccggcgcggttcaccaggtgggtgccgccgaacatcttgtagtagaggcgactgcccagttgcggcggcttgacgaagtcgtccagctggaacggctcgccgagcacctggatgacgtccgtggtgcgcccctgggtgttgagcaggatgttgccgccggtggccttgtagaagccggtgagacagttgaacacggtggtcttgccggcgccgttggggccgatcagcgcggtgatcgaaccgcgctcgacgtcgaggttgacgtcgttgagcgccttgatgccgccgaagtgcatcatcaggtgctcgacgctgaggatcttgtcgctcatggcgccacccccttgcgcggggcgaagcccacccggctgatgcggatcagcccgcgcgcccgccagatcatcatcaccaccatgagtatcccgagcagcagcacgcggatgtcggcgaagctgcgcagcagctccggcgccacggtgaggacgaaggcggcgttcaccaccccgaccgtagagcccatgccgccgagcacgacgatggcgaggatcagcgccgactcgaagaagttgaacgaggacgggttgacgaagccctggtag

SEQ ID NO: 16142 - DNA, 1098 bp, Pseudomonas aeruginosa
ccgtcgaggaccacgccgacgatggggccgaacaccaccagggcgatcaacccggagagcacggcatcgaggacgcactgcttgagatcgatggaagtctcgttgctcatcgtcgtccccttacaccttggcgatctgcgggcggccgagcaggccctggggacggaagatcaggatcagtaccagcaacgagaaggcgaacacgtccttgtagtcggtgttgaccatccccgagaactgcgcctcggccactcccagcaccaggccgccgagcatcgccccgggcagcgagccgatgccgccgagcaccgccgcggtgaacgccttgatgccgatgatgaagccggcgtagaagtcgaaggtgccgtagttcatggtgatcagcaccccggccagggcggccatcgctgcgccgatgacgaacacgtaggagatcacccggtcggtgttgatccccaggatcgaagccatcttgcggtcctgctgggtcgcccggcacatgcgcccgagcttggtgtagcggatcacgtaggtcagcaccgccatgccgatcagcgaagcgatcaggatgaacagcttggtgtaggtgagctggacgaaaccgtcgccgacgtggaatttcagggcgccgtcgagcagggtcgggatcccctgctggcgcggtccctgcgccacctgcacgtagttctgcaggatcagcgacatgccgatcgccgagatcagcggcgccaggcgcgtggagttgcgcagcggcttgtaggcgatgcgctcgatcacccagccgtaggtgcaggtcaccagcacggtgaacagcaaggtgccgaggatcagcagcgggaagttctgcaggccgaagaaggccagcagggcaagggcgatggccgacaggtaggcggagatcatgtacacctcgccgtgggcgaagttgatcatgccgatgatgccgtagaccatggtgtagccgatggcgatgaggccgtagaccgagccgagggtcagcccgttgatcatttgctggaggaagatgccgtccatttttcagtctcttcagggcgaatcgcgacggcctttgtaaggcgcgccggcgctcgccggtga

SEQ ID NO: 16143 - DNA, 1251 bp, Pseudomonas aeruginosa
aagcggacgggtgctactgaaacggccccggatcgcgggactccagaccgaccacacgcagacgtcttcggtgaatccgcactacggcggcaagcacgggcgagcacttcagcagctcccggacttacccatgcgccgggcctgtgcccggcgcatggcggtcgagcgcgatcagggcaactggtggtacttgcccttgtcgtcccactcgtagaccacgtagtcggagactttcaggtcgcccttcttgtcccattccttcttgcccatcacggtctgcaccggatgcgacttcagccactcggcggccttggccggatcgttggcgccggcgccgttgaaggccgccgccagggactggatcgaggcgtaggagtagagggtgtagccttccggctcgaaaccgccggcacggaatttctccaccaccgccttgccgtcggggatcagccgcgggtcggcgccgaaggtcatcagcacgcccttgacgtactgcggaccgccggcggtggtcgccagttcgtcggtgaccacgccgtcgtcggacatgaacttggcggtcagtccctgttcgcgcatctgccgtaccagcggaccggcttccggatgcaggccgccgaagtagacgacctcggcaccggaggcgcggatcttggtgaccagcgcgttgaagtccttctcgccgcgagtcaggccctcgtagagaacctctttcacgccgagcttgttcagttgcgccctggtggcgtccgccaggccctggccgtaggtgtccttgtcatggatcaccgcgaccttcttggccttgagcacgttgacgatatagtcgccggcgaccacgccctgctggtcgtcgcggccgcacatgcggaacatcccggagagtccgcgctcggtgacctgcgggttggtggaaccgggggtgatggcgatgatcccggcctcgtcgtagacctcggatgcggggatggtcgaagaagagcagaaatggccgaccacggcgatggccttgtcctggtccaccaggcggttggccacggccacggcctgcttcggttcgcaggcgtcgtcggccttgaccagcttgatcttctcgccgttgatcccacccgccgcgttgatgtcttccgccgcctgggacgcgccgcgccagtattgctcgccgaaggaggcgttggcgccggtatgcggtccggccacgccgatcacgacgtcggccagcgcatgcgtggaaagacccatcacggatga

SEQ ID NO: 16144 - DNA, 2721 bp, Pseudomonas aeruginosa
gcgtcgcccggcactccggcaagcgagctttcctccctacgtcattccgtttattcatataacgcgttccgcccgctccacccgcgccaggaaacccgccatgctgaacaaacgccgcctgccgtcgatgaccgccctgcaatgcttcgaagcggtagcccggcacctgagcttcacccgcgccgccgaagagttgagcctgacccagagcgccatgagcaagcaggtcgcgcaactcgaggagcaactgcagcacgccctgttccgccgggtgcgcaagcgcttgcaactgaccccggccggcgagctgtacctggccgaggtacgacgcatcctgcaacaggtagagctgtccacccgcttcctgctttcctacggcggcgagaccgaagtgctgcgagtggcgaccccgccgaccttcggcgcgcgctggctgatcccgcaactgaacggctggcgccaccgccacccgaacatccacctcgacctgcgccaggaactggaaccggacgacctgcgccagggccattgcgacctggcgttcttcttcggccccggcaccctgccgggcgccgagtgcatccgcctgttcggcgaacaactggtggcggtctgcgcgccatccctgttgccggccggcggactggacgaaccgacccaactggcggagctggtgctgctgcagaacgccagccgcgcggaggcctggcacgactggttcgccagcctggagcgaaattgccagggttgctaccacggtccacgcttcgacaccttctacatgtgcatccgcgccgcccaggccggttgcggggtagccctgctaccgcgcttcctggtcgaggaggaactcgccgaaggcaagctggcgatcgcctggccgcacgccctgcccagccaggaggcctactacctggcctatcccgagcatgccgcggaagtccccaaggtgcgccatttcatcgagtggatggtagagcgcctggagcaggagcaaccctcagcgggcccccgccagacgcgccacgacccggtttgacgtttccgctgcgcggaaccatctttactctcactcggttcacctcggaacgtcccatgctcactggcgtcacggttcgaatccgcctgctggtcctggcgctgctaccgctgacgatgctcgtcacggtcatcgcgatggcgctggccaacgccagtcgactcgatgccagcttccaggaccttttcaacaaccggatgaagcccatcagccagctcaagatcgtcgccgacgccgttgcggtcagcgtggtcgacgccctgcacaagtaccgtgcgggggtcttcgatgaagagcgcctgcagcaggagttgagtggggcgctgtcgcgcatcgagaagtcgtgggccgactattccgcagaccaccggactgccgccgagaaggaaatcatcgagtcgctggtccccaccctggaacgggtcaagcggatgaccctggcatacggcgagcaggccagggccggaagcctgcgaaacgtcgaggccggcacgttcaatcgcgagatgtatggtgcgttcgatccgctgggaaccgcgctgtcgacgctgatcgacctgcagctcagtgaaggcgccaagctcaacgagcagatggagaaacgctacgactccatgcgcaccaccttcctgctcatcggcgccgcagccctggtcctcatcgtcgccgcggcctggttcatcagcctgtcgatcatgcgcccgctttccgatctgcgcggggtgatccgccgcgtgcaggactcctcgaatctcacgctccgcgccgatgcgcgcgggcgcgacgaagtgtccgatacggcgcgcgccttcaatatgatgctggaaagccagcaggcgctgcttcggcatctcgccgagacagccaggaagctcaccatcacctcggacgagatgagtgccatcagcaaccaggtcagccatgtcgccacgtcccagggcgaccagaccgacatggtcgccacggcggtacaccagatgagcatggcggtccaggacgtggcgcggaacgcccaggccgccgcagccagcgcggaatcggcgaacagcgaggcgcacaccggaaccggactcgtgcatgcgaacctcgacgccatccagggcctgtcggtcatggtcggagaggcgggagccgtcatcgacacgctacgcaacaagaccgaggaaatcagcaccgttctggaagtcatccagaacatcgcccagcaaaccaacctgctcgccctcaatgccgcgatagaagccgcacgggcgggcgaggccggacgcgggttcgcggtggtcgccgatgaagtgcgcagcctggccaccaatacgcacaaggccaccgaaaccatccgcgagatgatcgaagccctgcaggcaggcgccagcagcgcggtcagcgtgatgcagcagtcacgcgagcaggcccaggtcagcgtccagcgcgcccacgaggcgggaaaggcgctcggtctcatcgcccaggcggtcgaaggtatcgcccagagcaacgcgcagatatccacggcgacggaagaacagaccgccaccgcgagcgaggtcagccagaacatcgactcgctcaatgccagtatcggcgaagtcgccgagggcgcggtgaagacctccacctccagtgtcgagctggcgaaactggcaaacggactggagcagcagatccagcgcttcaccgtctag

SEQ ID NO: 16145 - DNA, 1233 bp, Pseudomonas aeruginosa
cgccctcgccggcgccgacaaggagaagtgaacatggccgaaagcgtctttgccgagcgcatcgtgcagaacctgctcgataccgatttctacaagctgaccatgatgcaggcggtgctgcacaactaccccaacgccgaagtggagtgggaattccgctgccgcaacgccgaggacctgcgtccgtacctggcggagatccgctaccagatcgagcgcctcgccgaagtcgaggtaaccgccgaccagctcgccttcctcgaacgcatcccgttcatgaagccggacttcatccgcttcctcagcctgttccgcttcaacctgcgctacgtgcacaccggcatcgaggatggccaactggcaatccgcctgcgcggcccatggctgcacgtgatcctcttcgaggtgccgctgctggccatcgtcagcgaggtgcgcaaccgttatcgctaccgcgaggtggtcctggaacaggtcggcgagcagctctatcgcaagctcgactggctctccgcccaggccagcagcgaggaactcgcggaattccaggtcgccgacttcggcacccgccggcgcttctcctaccgcacccaggaggaagtggtgcatatcctcaagcgcgacttccccgggcgcttcgtcggcaccagcaacgtgcacctggcccgcgagtacgacctcaagccgatcggcaccatggcccacgaatggctgatggcccaccagcaactcggcccgcggctggtcgacagccagcaagcggcgctggactgctgggtccgcgagtaccgcggacagctcggcatagccctgaccgactgcattaccatggatgccttcctcgacgacttcgacctgtacttcgccaagctcttcgacggcctgcgccacgattcgggcgacccgctggcctgggcggagaaagccatcgcccactaccgccgcctgggtatcgacccgctgagcaagaccctggtgttctccgacgggctggacatgcccaaggcgttgcagctgttccgcgcgctacgtggcaagatcaacgtcagcttcggcatcggcaccaacctgacctgcgacatcccgggggtcgagccgatgaacatcgtcctgaagatgacggcctgcaacggccatccggtggcgaagatatccgacgccccgggcaagacccaatgccgcgacgagaacttcgtcgcctacctccgccacgtcttcaacgtgccggcctaa

SEQ ID NO: 16146 - DNA, 1119 bp, Pseudomonas aeruginosa
cgggagcccgaacatgcaacagatccaacgcgacatcgcccaagccctgcaggtccagccgccgttccagtcggaggccgacgtgcaggcgcagatcgcccggcgcatcgccttcatccagcagtgcctgaaggattccgggctgaagaccctggtgctggggatcagcggcggcgtcgactcgctcaccgccggcctgctggcccagcgcgccgtcgagcaactgcgcgagcagaccggcgaccaggcctaccgcttcatcgccgtgcgcctgccctaccaggtgcagcaggacgaggccgatgcccaggcctcgctggcgaccatccgcgccgacgaagagcagaccgtcaacatcggtccgtcggtgaaagccctggcggaacagctggaagccctggaaggactcgagccggcgaagagcgacttcgtcatcggcaatatcaaggcgcgcatccgcatggtcgcccagtacgccatcgccggcgcccgcggcggcctggtgatcggcaccgaccatgccgccgaggcggtcatggggttcttcaccaagttcggcgacggcgcctgcgacctggctccgctcagcggcctggccaagcatcaggtgcgcgccctcgcccgcgccctcggcgctccggagaacctggtggagaagatccccaccgccgacctcgaggacctgcgccccggccatccggacgaggcttcccacggcgtcacctatgccgagatcgacgccttcctgcacggccagccgctgcgcgaggaagctgcgcgggtgatcgtcgacacctaccacaagacccagcacaagcgcgaactgccgaaggcgccctgagcctcccggtccgtgcggcaggcccgtcgtcgacgggcctttgtcgcgggcgggaatgtgcctgtcgcaaccaggtcttcaagtccgcgcggcggcgcgctagaaggaagctgtatccctgcgaaggccagccatgcgcacccgtctccccgccctgctcctcggtgtcctgctggccggccaggcctgcggacacacatccccgctgctcgcgccggtacggcagttccacgccttcggcgacagctattcggacaacggcgaaagccagcgactga

SEQ ID NO: 16147 - DNA, 825 bp, Pseudomonas aeruginosa
aagagcagactgcccgatcgggcaccgagttccactgattcaggtcaaacccgaaccggacgtggcggggcatcgagcgggatctgcccggcgtttactacggggaactcctgttttagcacagatgtgccgcttcgcgcctgcgacgcaacgtccggcaatgcttcgcacggcttggtcgaagcgctcccagccgctaccctgtgcgcctttttccacccccgacaggagtcgatcatgaccttgcgttccgtatgcgtattctgtggcgccagccccggcgcttccccggtctaccaggaagccgccgtggcactcggccggcacctggccgagcgcggcctgaccctggtctacggtggcggcgcggtcggtctgatgggcaccgtggcggacgccgcattggccgccggcggcgaagtgatcgggatcatcccgcagagcctgcaggaggccgagatcggccacaagggcctgacccgcctggaagtggtagacggcatgcacgcgcgcaaggcgcgcatggccgagctggccgacgccttcatcgccctgcccggcgggctcggcaccctggaagagctgttcgaggtctggacctggggccaactgggctaccacgccaagccgctgggcctgctcgaagtgaacggtttctacgatccgctgctgaccttcctcgaccacctggtcgacgaacgcttcgtccgcgccgaacaccgcggcatgctgcagcgcggtgccagcccggaggcactgctcgattccctcgccgcctggacgccaagcgtggcgccgaagtgggtcgaccgcaccccgcagtga

SEQ ID NO: 16148 - DNA, 1116 bp, Pseudomonas aeruginosa
aacccggccggctgcggcgacggttgcaggcccgcactataccttgttcgccggggtgcccgttggactcgccgatggcccgttttctccgcgcggcccgccacccggtccgcgcacaaacgccaacgccccgcaggacggggcgtcggtgccgagcgggaaacgtcaggcgccggcggactgctgcacgatcaccgtctgcgccggcatcggtgccgggaagtcggcgccgagggcgtccttgatcaccttgttggtatcgaaatagacctgccagtaatggtcgttgtggcaatacgggcgcaccgccagcaccggcccgaccaggttgaactcgaggatctccacgtccaccggcggctcgccgagcacgttgggaatcgccgcgacgcgctgcttgagcagggcgatggccgcctggtagtcggcggcaccggaaagctgcgccttcaactcgacccggcggaacgggttgtgggtgaagttctggatgttgtcgccgaatatcttgttgttgccgaccatggtcagcacgttgtccggagtgttgatcgccgtggtgaacaggccgatctccttgaccgtgccggtcactccgccggcgcagatgaagtcgccgaccttgaacggccgcaggacgatgatgaagccgccggccgccaggttcgccagcaatcccgaccaggccatgccgatggccaggccgaccgccgcgatcagcgccgccaggctggtggtctggatgccgaagaaaccgaggatgcccaccaccagcagcacgttcagggtcaccgtgatgaacgaacccacgtagcgcagcacggtgggatcgaccttttgccgctcgagggatttctgcaccatgccgacggcgaagccgatcagccaacgaccgatcacccagaaggcgatggccgcgagaatcttgatgccgaaggcgaaggcgtactgggacaccatcgcccagagcgcgttgatcttctcggtacctacgttgacgatcgtcgtgtcatccatatcgctcaccgtgcgcaaggaaggagtctggctccgtacgagaaccgcccctggcaccggaaaggcaggctccggcccttggcccgacaacgtccgtag

SEQ ID NO: 16149 - DNA, 504 bp, Pseudomonas aeruginosa
gtgatgccgctgttacccagttccagcagccattccagcgcgccggcgtcccaggcgctaccgccgtcgaggaaggcggcgatgctctcggcgaagaagcgcacgcgctcgatgcgccggccgatcatcaggaaacgccagccgtcgtcgcgggtcatgtcgtcgagggcgaaaccggacaaggctgccagggacatcactagccggttgaggaagtccagcgcttcgccgaggtcggtgcgtgccggatcgagcgcctgcatgtcgcgttgcagctccagcaaggccagccagttctccccggacaagcgcccgcgcacctgcgccgccgcccagtgcaggcgccgcaggttggcgcacaggctcgccggccagtgctcgtcgagcaacgcccgcaacaggcacctttccaacggctcgccatccccgggcagcaggccgatgccgccggccagggccagggcgctgcgcagcgcctcttcgtcgccatcggcatccacgtag

SEQ ID NO: 16150 - DNA, 552 bp, Pseudomonas aeruginosa
tcacaccgagcatcggcgtcgccctgtttcccggcgacgccctgcagttcggcaaactctacaaggccgccgaccaggcgctgtaccgggtcaagggcgccgggcgcgccggctatgcgatggctgccgacgatgaacgcgagaccgcgccggcgctcccctggccgaccgccctggcaccggagcgtatctcctgaatcagtggctgtagcgtcgcggaacccgagccgtgaccttgctcagaagctcgtagccaagggtgccgcaggcacgggcgacctcgtccaccgacaacccggcgccccacaactccaccgggtcgccaacgcgagcctccggcaggtcggagaggtcgaccgccagcatgtccatcgagacccgcccggccagggtcgcgcggcgtcccccgaccagtaccggagtcccggctggcgcggtacgcggatagccgtcggcgtagccgcaactgaccgtgccgatccgcgccggccgctcggcgatccaggtggcgccgtagccgacgctctcgcccacggccacctcgcgcagtga

SEQ ID NO: 16151 - DNA, 744 bp, Pseudomonas aeruginosa
aatcaactgcgcgcccaggctcatggccggcctcaggcccagttcggcggcgctcaggtcggccagcggggtcgacccgtagagcatgattcccggccgcagccagtccatgtgggcggccgggatagtcagcaccgccgccgaattggccaggctgcgctggtcgaaatccaggtcgagcaggccgaggaaactctccagctgctgctcggtgagcggatggttgcgttcgtcggcgcaggcgaaatggctgatcaggttcagctcgcgcacaccaggatggttgcgcaggcgcgcatgccaggcgcgcagcgcggcaggatcgaagcccaggcggtgcatgccggagtcgagcttgagccagacgttgagtggaatatccaggccggcggcgaggaacgcctcgccctgttccgcgccctggatcaccaggtccaggcgcaattgcccggcgagggcgtattcgctcgcctcgaagcagccttccagcaacaggatgcgcgcgctggcgtgcaaggcgcggacttccgcggcctcctccaggcaggccacggcgaagccatcggcatcgtcgtgcaacgcggtaaccacttcgcgcgcaccgtggccataggcgttcgccttgaccaccgcgaacgcctggcgctgcggcgcgcagcgcttggccagggcatagttgtggcgaatggcggaaaggtcgacggtggcaacgaggggacgcatggcatcgggtcctgcaactga

SEQ ID NO: 16152 - DNA, 441 bp, Pseudomonas aeruginosa
tcgatcatgatcagcgccaggtcgccgtgctcgcgcaccaggcgacgggtccgcgcgcgcatttccgagggactgatgccagcggtatcgtcgatgaacagcttcttgtcgttgagcaggttgatcgccgaagtcaggcgcggccagtcctcgtcgtcgagcttgccggaacgcaccttggtctggtcgatacgcccgagcgacgagagcatacgcatcacgatcgagtcggagggcatctccagggagtacaccaacacggccttgtcggtgcgcatcaccgcgttctcgaccaggttcatggcgaaggtggtcttacccatcgacggacgcccggcgacgatgatcaggtcggccggctgcaggccgctggtcttctcgtcgaggtcggtgaaaccggtggacaccccggtcagcgcctcggtggtgttgaacaggtag

SEQ ID NO: 16153 - DNA, 516 bp, Pseudomonas aeruginosa
cggactgccgcggacacgcatatgcccgcccagccctaccgatcggatcgcttactcagcgacgatgatcagcttcagagtggtttccacgtcggtgtgcaggtgcacggcgacgtcgaactcaccggtgttgcgcagcgcgccgttgggcaggcgaacttcggctttttccagcgggtaaccggcagcggaaacggcttcggcgatgtcgcgggtgccgatcgaaccgaacagcttgccttcgtcgccagcgtgggcgccgagggttaccaccagctcggagagctgggcagcacgggcttcggcagcggccttcttctcggcggcagccttttccagctcggcgcggcgtgcttcgaacgcagcgacgttctcggcggtggcgacggtggccttgccctgcggcagcaggaagttacgggcgtaaccgcccttgatgttcaccttgtcgcccaggttgcccaggttggcgactttttccagcaggatgacttccatttgagtcttacctcttaa

SEQ ID NO: 16154 - DNA, 1524 bp, Pseudomonas aeruginosa
atgttttcttggcttgcctggtggagaggcgaacgaacgcctgcccgcgcggcaaggggcgacattctagagaagggcaaccggcgaagcaaggaagattggcgaatatttgtacagcggatggaatggcgcggggccgcgccgcggcggccccgcacgcgctcactccagcggggtgcgctggcggaggatctcgaacaggcagacgccggtggcgaccgagacgttcaggctgctgacgctgccggccatcggcaacctggcgaggaagtcgcagtgctcgcgggtcagccggcgcatgcccttgccttccgcgcccatcaccagcacggtcggccccttgaggtcgagctggtagagggtcttgtccgcctcgccagcggtgccgaccacccacaggccgcgctgctggagcttttccagggtgcgcgcgaggttggtcaccgccaccagcgggatcacctcggcggcgccgcaagcgaccttgcgcacggtggcgttgagggtcgcggacttgtccttgggcacgatcaccgcctgcacccccgccgcatcggcggtacgcaggcaggcgccgaggttgtgcggatcggtgacgccatccagggccagcagcagcggcacgccctcgctccgctcgagcagttcctcgagcatgttttcgccccagacctggctggggctgacttccgcgaccacgccctggtggacgccttccgcccactcgtcgagttcgcgccgatcgcgctgccctaccggaatacggaacccggcggccagctcggtgagcacctggacccgcggatcatgccgcccctcggccagccacaactgcttgacccgcttcgggtgatgacgcaacaacgcttccacggcatgcacgccgtagaccttttcccactgactcatgacttggccttacgtttgcgcgccccggtggcggccggagcgttgtcggccttcggcttggaaggccccttgcgatgcttggtcggcttgcccggcttggcggcagcggcgggcttgccgtccttggccttgcccttcgcgctcttgcccgcaggaacgaccttgcccttcttcccgcccttgtccttgccgccgacacgcgcctcggcgagcagcgcctgcttcacctcgcgactcttgcgcacgtcggtgttgccgagcatctccgcggcctgcgccagcagctccggcgcgaccggcggcagcgcctgcaccttgccggccttgcgccgcggcaccaccgcggcgtcgggactggccagcgccggctccaggtcgacctcgggcacggatgcgcccttgcgccccttcggcgccttgccggcgttcgccgacttgtcgccgttgcgcttcttgcgtccgatcggcgcgctcagcacgtttccggccagctcgaaatcgatcttccgctcgtccaggtcgacccgcgccactaccacttccgtggtgtcgccgagacggaagctgcgcccggtgcgttcgccgctgaggcgatggtgcacggcgtcgaaatga

SEQ ID NO: 16155 - DNA, 534 bp, Pseudomonas aeruginosa
ccaggcttttcagatcggtggagaaaccggtggccgggcgggcgcgcccgaaatcggcaccgatatcatcatagcgaccgccctgggcgatggactggccaacgccgggcacgaaggccgcaaacaccacgccggtgtgatagtgatagccacgcagctcgccgaggtcgaaatacagcggcaagccggggaagcgcccggccagcgaatcggcgatctcgatcagctcgttcagcgccacctggacatcggccggcgccgccgccagacgggcacggccctgctccagcgcatcgcggccgccacatagctcggccagcgcacgcaacatgccgcgcagctcggcaggcaggtctgcagtcagcgcctcgacctcgtccaccgccttgcgctgcaaggcatcgaacaactgctgctcgacttcgccggacagccctgccgcgcgcgccaggccgcggtagataccgacatggccgaggtccatgtgcacgtccggcacttccgccatctcgagcatttccagcatcaggctga

SEQ ID NO: 16156 - DNA, 1887 bp, Pseudomonas aeruginosa
ccgcgcgctcggtctgctggactacgtagacgctgttccacaggacgatggcggcgacgacaccgacgatcagagcgatcaaagacttgttgcccatcagcggctctccctcgtacgcgcgtcttgctggcgcagatcgttgacgatccgcgaccccaggtcggaagcgctggcgctgccaccaccggcggaagcaccggcccccgtagcgggcgcggcgttacgaccatcgatcatcttgtccagcggcaggtagagcaggttgttctgcccctgctgaccggtcaccagcaccttgctggtctggctgaagacttcctgcatggtgtccaggtacagacgctcgcgcgtcacttccggagccttgcgatattccaccagcagcttggagaagcgatccgcctcgccctgggcgcgcgaaatcacctcgtcgcggtaaccgttggcttcttcgatgatgcgctgggcctggccacgtgcctccggcaccacgccgttggcataggcttcggcctggttcttctcgcgctgctcgtcctcgcgggcccggatcacatcgtcgaacgcttcctgcacctcacgcggtgcctgggcgctctggatgttcacctgggtcacggtgataccggtcctgtaggtatccaggaagcgttgcaggcgctcgcgcacctcggtcgccatctgctcgcggccttcggtgaggatccggtccatggtggtggagccggcgacatgccgcagcgcgctctcggtcgcctgctgcaggctgacctcgggctggtcgacgttgagcacgaagtcctgcaggttgctgatcttgtactgcacggtcagcggcacttcgacgatgttctcgtcctcggtgagcatctgcccctgcttgctgtacgcacgctcgcgggtgacgttctcctggaagcgcttgtcgatcggcgggaagtagaagttcaggccgggaccgaccgtctcgtaatacttgccgaagcgcaggatgaccgcctgctcctgctcgtccaccacatagatggcgttgtacagccagagcacggcgaggatcgccaggccgatgccgaacaggcccaggccaccgcccttgccgccggaaccggagccggaaccgttgccactgcgtttttttccaccgaacagcccgttcaggctgtcctgaagcttgcggaaagcctcatccaggtcgggcggccccttgcggtcaccaccgccgccaccaccaccgcggcggcctccccacgggtctcgatcgttgttgttcgagttgtcacccggctcgttccaagccatagcgctctccatctagtaacgcgaaacgcgcctgcggcgcggccacccatgctaccgaatgccctgcccgctgccaaaagcagcgatacgggctttattgcaaagtgtgttgcgcaacgaactccgccggctgccagccagcgcggctcgccaggcggttcaactcggcccgcggcaggcgcacctgcagcagggtacaaccctcctcatcgtgcgcctcggactgcaccgcgcccagttcgaacaactgggcgcgcaggcgcccgagccgctggggcaggcgcaaggttccgacgaacaggtcctcgccaagcagctcggcgatggcctggcgcaacaggtcgaggccttcgccggtctgcgccgacagccagacgcgcaccggcttgccggagtcgtcgcgctggatgtgcggctcgaccgagggtagcaggtcaaccttgttatagacctcgagcatcggcaattcgttggcgccgatctcgccgagcaccgccagcacctgctcgacctgcgcatcccgttcgggctcgtaggcgtcgatcacgtgcagcaggaggtcggcgttgctcgactcttccagcgtag

SEQ ID NO: 16157 - DNA, 1029 bp, Pseudomonas aeruginosa
aagtactgcaggtccggctggctgcgggagaaggtcggcaagccgacccagccccacaggtgcaggccgttgcgctcgacctcgatcggcagcgcctgctcgaggaatgcctggccgcacaccgcgccgacccggcgcgcgcgggccagctcgtctcgcgcctcgtgcagggcgaagatggtcttgccgttgtggcgcaggtggaaagccacgtcgaagcgggccagcgccaggcgcttgatgacctcctgcagatggtcgaactcggtcttctcggcacgcaggaacttgcgccgcgccggggtgttgaagaacaggtcgcgaacctcgacgctggtccccaccgggtgcgccgccggctgtacccgcggctgcatgtcgcggccctcggtttccacctgccaggcttcgccggcgtcggcggtacgcgaggtcatggtcaggcgcgctaccgagctgatcgaggccagcgcctcgccacggaagccgaggctcatcacccgctccaggtcttccagctcgcggatcttgctggtggcgtggcgagccagggccagcggcaggtcgtcggcggggatgccgcgaccgtcgtcgcgcactcgcagcaacttgatgccgccctgctcgacctccacatcaatgcgccgggaaccggcgtcaaggctgttttccaggagttccttggccaccgaggcgggacgctcgaccacctcaccggcggcgatctggttcgccagccgcggactcagcagctggatacgcggtgcttcactcatcactgggccgccagggcggtgctcgggatggacagggcctggccgactttcaggttgtcgctggacaggctgttgctgctacgcagcgcggccatgctcacttcatagcgctgggcgatcatcgccagggtctctccgggccgcaccacgtgctcgcgcggccccatggagagcttgccctgggcgcgcaaagaggcgatgtaggtaccgggcggcgggctctgctggaaatactggcggatgccgctggtga

SEQ ID NO: 16158 - DNA, 2859 bp, Pseudomonas aeruginosa
aggtcgggcttttcaccgagccggcatggccgaggccgcgcaggatgccgcgcgagagggtggtcttgccggcgccgaggtcgccatgcaggtagatcaccccctgccccccgctggcccgggcgatgcgcccgcccagttcgagcatcgcgtcttccccttcggcggacaggatcacttcagacacggactgcactcctcgagcaactgacgaacggtaggtatgagatcggtcgccgccagtccacgcccctgggcgccgagccgctcaccggcggcggcatgcagccagaccgccaggcaggccgcctcgaacgcctccacgtgctgggccagcaaggcaccggtgatgcccgacagcacgtcacccaggccggcaccagccatcgccggatgcccctgggaacagacggcaagtcgtccgtccggcgcggcgaccaggctgccggcgcccttcagcaccaccaccgcctggtagcgacacgccagttccagcgccgccgccgggcgatccgcctgcacctcggcggtcgagcgacccaacaggcgcgcggcctcgccgggatgcggcgtcagaatccatgtccgcggccctgctccgaccggttccagggccagcaggttcaacgcgtcggcatcccagacctgcggcaacggtcgcgaccggacagcgctcagcagggctacgcccccagggcgcgctggccaagaccgggaccgagcaacagcacgctggcgcgttcggcaagggcccagcagttggttcgccgacgccacgccatgggccatgacctcgggacaacggctcaacaacgcccggcacatgttcgaccgcgggtcgccgccgagaccagcccgggcgccgcagcgcaggggcgctttccggcggccagtagcacggccccgcccatgccggtgtcgccgccgaccaccagcaggtggccgaacagccccttgtgtgcggtccgcggccgcgctgccagcctcggcaggggcatttcgcgccaggcggcgagcccggggctggagcgcttgcagcacgacggcgtcgctaccgagttcgtcgaacaccagctcgccgacccgtgccggcgcatcgccagtgaacagcccgatcttcaggccgatgaaagtcacggtcagatccgccctgatcgcttcccccaataccgcgccggtgtcggcgctcaagccggaaggaatatccaccgccagcaccggcaggtcggcggcgttggccaggcggatggcctgcgcaaagggctcgcgcacggcacctgccaggccggtgccgagcaatgcatccactactacgccctcgagcacggcgcactcgctccagggctccaccacgaccccggtcgccagcgcggcggcatgcgcctgcgccgcgtcgccggcaagccgctgcggcgccgcgaccgccagcacccgcactcgccaacccgcacgttgcgccagcgccgcgatcaggtagccgtcgccagcattgttgccgtccccggcgagcaccgtcagcgccgcggcctccggccaacggcggcgcaaggcacgccaggcggcgtgggcggcgcgctgcatgagttcgaagcccggcgtgccggcagcgatcaggcgcgcatccaggtcgcgcacctgggcggcggaatagagggcgagtggcaggtcgtcgtgctggaaggtcatggtcatcggatcgattcggcgtcaggcgcgcagtctggcagaattatacctatcccatgtcgctttccctcgtcttcgttgcctcccatgactccccaacctctggccgacaacctttccccgccggaccccgcccgcctcgcccagtccatcaaggactggggccgcgagctggggttccagcaggtcggtatcagcgacgtcgagctgggcgagcacgaagcgcacctgcagcgctggctggaggccggctaccacggcgagatggactacatggcggcgcacggcagcaagcgctcgcgacctgccgagctggttcccggcacgctgcgggtgatctccctgcgcatggattacctgcccggcgacacgcgcatggcgcaggtcctcgcgacaccggaaaaagcctacgtctcgcgctacgccctcggccgcgactaccacaagctgatccgcaagcgtctgcaacaactggccgagcgcatccaggccgaagtcggcccgttcggtttccgcgccttcgtcgacagcgcgccggtgctggaaaaggccatcgccgaacaggccggcctcggctggatcggcaagaacacgctggtgctcaaccgcaaggccggcagctacttcttcctcggcgagctgttcgtcgacatgccgctacccgtcgacccggcgatggacagcgagcattgcggacgctgctcggcctgcctggacatctgcccgaccgcggccttcgtcggcccctaccggctggacgcgcgacgctgcatctcctacctgaccatcgagtacaagggcgcgattccgctggagctgcggccactgatcggcaaccgggtattcggctgcgacgactgccagatcgtctgcccatggaatcgcttcgcccgccccaccgggcagggcgactttcagccgcgccacagcctggacaacgccgaactcgccgaactgttcctctggagcgaggaggagttcctcggccgcaccgagggttcgccgctgcgccgcgccggctacgagcgctggttgcgcaacctggcggtggggctgggcaacgcgccctcgaccatcccggtgctggaggcgctgaaggcgcgccgcgggttcccttcggagctggtccgcgagcacgtggaatgggccctgcggcgccacggggaaacctag

SEQ ID NO: 16159 - DNA, 612 bp, Pseudomonas aeruginosa
cccagccggcgcctaccgcccggcccggacggatcagagcttgatgaagtggtcgcgatagtggcgcagctcggcgatcgactcgcggatatcgtccagcgccaggtgggtgttgcccttcttgaagctctcgcggacctgcggcgcccagcgcgcagccagctccttgagggtggagacgtcgaggttgcggtagtggaagtagccttccagcctgggcatgtgcctatagaggaagcggcggtcctggcagatgctgttgccgcagatcggcgagctgcgcttgggcacccactgctcgaggaaggccagggtctgcgcctcggcctcggccatgctcacggtgctttcccggaccctctgggtcaggccggattggccgtgctggcgggtattccactcgtccatgccggcgaggatttcctctggctggtggatggcgatcaccggtccttcggccagggtgttgaggtcactgtcggtgacgatggtggccatctcgatgatgacgtcccggtccggatcgaggccggtcatctccaggtcgatccagataaggttctgcgggttctgcatggggagtcgctccagtcgctatgccgtgcattctag

SEQ ID NO: 16160 - DNA, 1071 bp, Pseudomonas aeruginosa
tggcggcgcgcccatgttaaactcgccgccgatttttcatgcggacgcatcatggccaaacgccacttgacccgccggcagagctggcgcatcgaaaagatccaggaagaacgcgcggcccgggcggcccgtcgcgagtcgcgtgccgtggaagagctggagggcggcgacctgggaccggagcaaaccggccaggtgatcgctcatttcggggttcaggtagaggtcgagtccgccgacggccaggtttcccgctgtcacctgcgcgccaacctgccggcactggtgactggcgaccaggtggtctggcgcgccggcaaccagggcatcggcgtgatcgtcgcgcaattgccgcgccgctccgagctgtgccgcccggacatgcgcgggctgctcaagccggtggcggccaacgtcgaccgcatcgtcatcgtcttcgccccgcgtcccgaaccgcacgccaacctgatcgaccgttacctgatcgccgccgaacatgccggcatccagccgctgctgctgctgaacaaggccgatctggtcgacgagagcaatgccgaaggcatcgatgcgctgctgaatgtctaccgcaccctgggttacccgctgatcgaggtgtcggccttcaatggcctggcgatggacgaactgcgcggcgcgctggacggtcacgtgagcgtcttcgtcgggcagtccggggtgggcaagtcgtcgctggtgaatgccttgttgccaggtgtcgacacacgtgtcggcgacctctccacggtgaccggcaagggcacccataccaccaccaccgcgcgactgttccattttcccggcggcggcgacctgatcgactcgcccggcatccgtgagttcggcctggggcacgtgtcgcgagacgatgtcgaggccggtttcatcgagttccgcgacctgctcggacattgccgcttccgcgactgcaagcacgaccgtgaaccaggttgcgccctgctccaggccttggaggacgggcgcatcatgccgcaacgcatggccagctaccggcacattctggcaagcatgccggaaacggactactga

SEQ ID NO: 16161 - DNA, 1566 bp, Pseudomonas aeruginosa
tccgaatactcgaaaagccagttcgccgcctcgccgacaccgagcccgacacccatgacagaccgcctcgccgcctggctcgaagagctcgaccggcaacccctgccgatccccgccagccactatgccggcctgcacgccgcgctgagcgacagccgccgctcgctgcgcgagatcgccgaccagttgcagggcagcccgacgctggcgttgtccatcctgcgcgaggccaatcgcgccgagagcgcccgcgacaaccccgcggaaagcctggaggtggccctcagccgcctcggcctggcgcgcgcgagccaacttctgaagaccctgccgagcatccaggatgcggagatgcccagggtcctcgggcagatgctgctgatcagccagcacgccatgcagcaggccagcggcctgttcggcgcgcgcctggccaggctctggcaggaaatccactggggcagcctgctgaccatggctccggtctgggcgctggccaacgcccgcccgcagttgctggagcaatggcagcaacgcgtgctggtacagggcgaaccgaccctgcgagtggagcgcgaactgctcggcatgcgcctgctgccgatctgcctggcgctggccgaacgctggcggctaccgcagtgggtcatccagggctatcgcctgctcgcctgcgaccgtcgcctgctggttcgagccctgcgtatcgcccgcgaccatcagtcgcccctgctccagcaacagcaactcgatgcccagcccgatctcgcccgctggctgacccagccggccaactgcactctcctcgccaatggcctggccatcgccgcgcaccagagctgggacgggccgcacatgctgcgctggcagcgcctgaccggtctgtacctgggccagccgctgaccgaagtccagcagcaggtgcacatgctcgccgcgcaaagcgcgcgcctgcacgcccggccgccgctgtggcatccggcggtggccttgatctggccctggcaggccagccgctggcgtgccgaagcggcgcccccgccgccgccctcggcggaagccctggccgagtggcggcagcattgcgccgagttgctccgcgagcccagcccgttcagcaacgtggtgcagctcaccgcctgtgcccgcgatgcgctgcgcgcctgcggcctgcaaaggatgctgctgctggtggccgatcgcacacaggtacacgtgctggcgcagcagagcgccggactcgaaccgggccaggagaaattgcaactggagattgccagcagcccgctgctgaagaaactgttccagcagcctgccctgctgcgcatcggcccgaacaaccaggaccagttgctgccggccctcggcgaacccttgcgccaactgttccccggacctcacctgctgctgcgctcgctgggcaacggctcgcgggtggtgatgctggtcctggccgacctcggcggccagccgttcagcgacctgcatgcccaggccttcgccaagaccgcccagtgcaccgagcgcgcgatccagcagttcggccgccagcgccgcacggaatga

SEQ ID NO: 16162 - DNA, 2085 bp, Pseudomonas aeruginosa
gccctttccatggccatcgaaaagaaaaccatccgcctgctgattctggaagactcgcagaacgaagccgaacgcctggtcagtctgttccgcaatgccggccacgcgacccgcgtacatcgactgacctctcccgaggacctcgccgaaaccctccagcaaagctgggacctgctgatcgccgcgccgaccagcgagtgtctcgagcccggcgaggcgctcgccaccttgcgccgccagtcgcgcgacatcccgttcatccagctggtggccgacaacagctccgacgccatcaccgacgccttgatgctcggcgcccaggacgccctgccgcaaggcgaggacgagcgcctggtgctggtcgccaaccgcgagctggccggcctcgccgaacgccgcgcgcgccgcgccgccgaactcgccctgcgcgaggcggaaaaacgctgccagttgctgctcgacagctcggtcgacgccatcacctacgtccacgacggcatgcacatctacgccaaccgctcctacatggcgctgttcggctacgaggacgccgaggaactggaaggcctgccggtcatcgacctgatcgcctcctgcgaccagggcgccttcaaggatttcctcaagggctaccagaacgaccagcgccagaccgaactggtttgcaccggggtcaagctcgacggccaggaattcaaggcgcgcatcagcctctccgccgccacgtacgacggcgaaccctgcatccaggtggtgatccgcggcgaggtcgacaacgccgagctggaagaaaagctccgcgaagtcagcagccaggacccggtcaccggtctctacaaccgcagccacttcctcgacctgatggatgccgccgtgcagcaggcggtgaccgcccgcaagccgtcgaccctggcctatatccatctcaacggctacccctctctccaggccgaccacgggctttccgggatcgacctgctgctcggccagttggccggactgatgcgtgaacagttcggcgaggaagccgacctggcgcgtttcggcgattcgatcttcgccgccctgttcaagggcaagactcccgagcaggcgcaagcggcgctgcaacgactgctgaagaaagtcgagaaccaccttttcgagctgaacggccgcagcgcccaggccaccctcagcatcggcgtcgccggtctcgacgagaagaccgccaaggcccaggacgtgatgaaccgtgcgcatcgctgcgccgatgacgcggcacgcaagggcgggtcgcagatcaagcagtacaacccggcggaagagcttgccgccgccgcccagcgcggcgacgtcatcgcgatcctccagcaggcgctggagaccaacagcttccgcctgctgttccagccagtcatcagcctgcgcggcgacagccacgagaactacgaggtgctcctgcgcctgctcaatccgcagggccaggaagtgccgccggcggagttcctgcatgccgccaaggaagccgggctggcggagaagatcgaccgctgggtgatcctcaattcgattaagctgctcgccgagcatcgcgccaaggggcaccagaccaagctgttcgtccacctgtccagcgcgagcctgcaagaccccggcctgctgccctggctcggggtggcgctgaaggccgcgcgcctgccgccggagtcgctggtgttccagatcagcgaagctgacgccaccagctatctgaagcaggccaagcaactgacccagggcctggccaccctgcattgccaggcggcgatcagccagttcggctgctcgctgaacccgttcaacgcgctgaagcacctgaccgtgcaattcatcaagatcgatggttccttcgtccaggacctcaaccaggtggaaaaccaggagatcctcaagggcctgatcgccgaactgcacgaacagcagaagctcagcatcgtccccttcgtcgagagcgccagcgtcctcgccaccctgtggcaagccggcgccacctacatccagggctactacctgcaggggccgagccaggcgatggactacgacttctcctcgggagacgaatga

SEQ ID NO: 16163 - DNA, 576 bp, Pseudomonas aeruginosa
cccaggcgcttgagttcggcgaacagggtttccgcaccctcggtcagacgcagcgaggcgccgatctcctccagcacgtcttccgacagcccctgcagcagcgccaggcgctccttgaagctggcgcggaagtccagttcaccgcgcatcgcccgctcggtgatcgcggcgaccttctcgccgacgccggcggccttggccagttcgtcgatgacttccgcctcgatcagcgtcgaatccatgtcgaacaccgccagccggcggttgcggcggaacacgctgtcctgctggaaagcgatgtcgacgttcaattcctgggcgacgctgaggaattccgcacgcagcgccgccggatcggccggttcgccgcgtaccgagaactcgatgcagcccttgccctggtcggcgggcatgtccagcggcatgcgcccggagagacggtcgatgtggtcgatgttcagcgcgtacttggcggtgatcgagctgaccctctgcagttgctcggcagtcacccggcgggtgagcagggtcacgatgtgccgcgccttgccctggccgtcgacccattgccggtag

SEQ ID NO: 16164 - DNA, 1752 bp, Pseudomonas aeruginosa
gctccgccaggtaaaagacgccattctacccgctttcccgcacacccgagagacgcagagccgggcatttgccatcaccaccggtcggaaccgaccgggaaaacccgcgaaaccgccgcgcggcggcctggaaagcgcgtcaacggccctttgcccctcggggggcgctggttatactgcgcgatacctctatttcagaagaccgagccccctgtgacccggcccacgtccgtcaagcccgacaatttcttcctcctgctgtttcgtgccttgcgccagcgccgcgtcccgatcgccctgcggctcgccagccatagcctgatcctggtggccctggccctgctgatctacgcctgggtcatgggcatgcagtttcgccaggccatgcaacagcaggccgatgccctgggccagagcctgatcacccagaccgccgcgtccgccaccgagttgctggtgtccaacgacatcctcagcctcaacgtgctgctgaacaacctggtgaagaacccgctggtggcccatgcggcgatctacagcgtcgaccagcgcatcctcgccgaggccggcagccgtccgaagcagagcctgctcggcgccaccgaaggcctgtactcgacgccgatcaccttccaggaagtgatcgccgggcacctgcgcatcagcctggacatgcagcagtttcagcagccgatgatgatcagcctgcagagcatgggcctgatcagcctgatcctgctgatcctcgccctgtatttcagcctgcgcctggggcggcagatttccacacccttgttgcaattgcgtgtctggttgcgtgatccggacaatccggcccccggcgccgaactgcagaacgagctgggcgacctggcgcgcgacctggaagagcgcctggtgccggaaaagccgccggcgccggagccggaagaagcaccgctgccgcagaacttcgacgacatcctgctggaagacgacgaagccgacctgcgcagccgcaaggtcgaggcctcggccttcgaggaagacgacattccgctgggcgacgccctgctggacgagaccaagccggtggaattcacctccatcgacgaagacccgctggaccaggacgccttcgacgagaacggagccgaagccggggaacagcccgcagcgcccgccgctgcgcgcgaaccgcaacacagtgcggtgctggcgatccagctcggcgcccaggaacagttgcgccggttgccgcgcagccgcctggtggatctcctgcaacgctatcgcgactgcctggaacaggccgcccgccagtacaagggcagcctgcacacgctcagcgacggcggcagcctgattctcttccacagccgcgacaaccgcgccgactacctgaccaacgcgctctgctgcggtgaactgatgcgtgcgctcggccatgccctgcagatcgaggtcgccgacagcggcatcaccttgcaactgcaactgggcctgagcctcggcgaagacctcagcgaacagacccaggccgacctgctgctcaacgaaaccgtgcagaacgccctcgccctcaaccagcacagccgcaacctgctgctggtcgaacgcagcatcgccgacgacgcggtggtccgcgagcgcgcccgtatccgcgccatcgccagtccggaaggagcctgctgcgtcgagcgtctgctggagccgtatccgtcgatgctcgagcgccaactggcgcgcatgcacgaccgcgcccgcccgtga

SEQ ID NO: 16165 - DNA, 2043 bp, Pseudomonas aeruginosa
agctcaaggctgccggaaccggtggctctggcggcgcctcggccgcctggaccaggcccccgaacaggccgaggatggccagcaggcggcgcatcagaccagcacctcggccaggttgcccttgctttccagccaggacttgcggtcaccggcgcgcttcttggccagcagcatgtccatgatctccagggtaccggtggcgtcctccagggtgagctggaccagccgccgggtattcggatccatggtggtctcgcgcagttgcaacggattcatttcgccaaggcccttgaagcgggtgacctgcggcttgccgcgcttcttctctgcggccaggcgctcgaggatgccgtcgcgctcggcttcgtcgagggcgtagtagatgtccttgccgaggtcgatgcggtacagcggcggcatcgccacgtagacgtggccggcttccaccagcgggcggaaatggcggacgaacagcgcgcagagcagcgtggcgatgtgcagcccgtcggagtcggcatccgcgaggatacagatcttgccgtagcgcagctgggccaggtcactggcacccggatcgacgccgatggccaccgcgatgtcgtggacctcctggctggcgagcacctcgccgccgtccacttcccaggtgttcaggatctttccgcgcagcggcatgatcgcctggaattccttgtcccgcgcctgcttcgccgagccgccggcggagtcgccctcgaccaggaacagttccgcgcgcatcggttcctgtccggcgcagtcggccagtttgccgggcagcgccggcccctgggtgatcttcttgcgctcgaccttcttgcccgccttgaggcgacgcccggcgttgctgatcgccagttccgccagttgcaggccgatttcggcgtgctcgttgagccacaggctgaaggcgtccttcaccacgcccgagacgaacgccgccgcctcgcgggacgacaggcgctccttggtctgcccggagaactgcggttcctgcatcttcatcgagaggacgaaggcgatccgttcccagacgtcctcgggcgccagcttgacgccgcgcggcaacaggttgcggaactcgcagaattcgcgcatggcgtcgagcaggccctggcgcaggccgttcacatgggtgccgccctgggccgtgggaatcaggttgacgtagctttcctgcaccgactcaccgccctcgggcagccacagcagggcccagctcaccgcttccttggaaccttcgaggttgccgcagaagggttcatcgggcaggcgcggcagctcggcgaccgcgtcggtcaggtaggagcgcaggccgtcctcgaagtgccactcgacgcgctcgccggtgttcttgtcctcgaacaccacgctcaggcccgggcacagcaccgccttggccttgagcacatgcttgaggcggctgaccgaaaacttcgccgaatcgaaatacttcggatccggccagaaatgcacgctggtaccggtattgcgcttgccgaccgtgccgatgacttccaggtcgctgtccttgaagccgtcggcgaaggtcatccggtactcgttggcgtcgcgcttgacgcgtacctcgacccgggtcgagagcgcgttcaccaccgagatgccgaccccgtgcaagccgccggagaactggtagttcttgttcgagaacttgccgccggcatgcagcttggtaaggatcagctcgacgcccggcacgccctcttccgggtggatgtccaccggcatgccgcggccgtcgtcgatgacttccagcgagttgtcctggtgcaggatcacctgcacgctcttcgcgtggccggccagggcttcgtcgacgctgttgtcgatgacttcctgggccaggtggttggggcgggtggtgtcggtgtacatccccgggcgcttgcgcaccgggtcgaggccggaaaggacttcgatggcgtctgcgttgtaagtagccatggggtctctattcagtcaaaagtcgaaaaatcggtgtcgcgccacagcgccgacgggtag

SEQ ID NO: 16166 - DNA, 852 bp, Pseudomonas aeruginosa
gccatacttggggtttgcgcgggccgaactcaagcgcggcgccagggtcgaaacggactggtcgacgcttcgagcccgcccatccaccgtcgcaaaaggaatcccatgcgccttctgaaattcgccgccctcggcagcctggtcgttctgctgagcgcctgccagagcttcttcaagcccggcctcgacgacccgctgcccaccgagcgcctcgccagcgagcacctgaagcccggctgccagggcgaacagtgccccttggtaaacatcgacaccctgaagttccccgacgaaccgcagttggacccgatcgtcgagcgcgccctgctggaaatgacccgggaaaacaacgaaacgcccctgccggcatcgctggcggactacgaacggcagttcctggacagcgccgagccgggctggagcagctacctgcaagccaaggtgcgcgaacaacatgacggtctggtgatcatcgagctttccagctacctgttcaccggcggcgcccacggcatgcccggtcgcggcttcatcaactacgaccgcaggcagcacaaggtgctgagcctgcaggacatgctggttcccggccaggaagaagccttctggaaacaggccgagctggcacacaaggcctggctgctggccaacaagctcgaccaggacgccgatttccagaagacctggccgttccagcgcaccccgcacgtggcattgaccttcggcgcggtgacgctgaagtacgacgcctactccatcgcgccgtattcctatgcccaccccgaactgaagatcccgtatccgcgcctgaacggcatcgtcaagccgaacctgttccccggccgcggctga

SEQ ID NO: 16167 - DNA, 435 bp, Pseudomonas aeruginosa
tgttgttcttctgcgttgcgctcatcgatggctctcctgggtgattgtcgggagaacctggcacgcggggccaccgggactggtggcgagaaggacgcgccggcaaggcaggcatggcgcggacatcttgttccctacgcgggttgctgcggtccgcgcgaggcggaaccggacgctagcccgatcaggttcaacgggatccggaactatccgatctcagcccctcgtatagggcaccccgacaagaaccccggcagtctaatcaacaccggcgggatacgccaacgggaaaacgccccgcccgaccggcagtcatggtccagtccggcgccctctcgccagggaagacgcagatccccgcacgttcgccggcacatcgatccggactggctcttcgatcagttgccgcgcaggtgccttgaccgccaccggtag

SEQ ID NO: 16168 - DNA, 1485 bp, Pseudomonas aeruginosa
ccttgccccacctcgcatcttttccaggacgaacgaatgctgcgcagactctccctggcggccgccgtggccgctgctaccggtgtcgcctgggccgcccagccgaccccgctgccgaccaagaccgacctgatcagcgtctacaaggaagccgtcgacaacaacgccgacctcgccgccgcccaggccgactacctggcgcgcaaggaagtggtgccccaggcccgcgccggcctgctgccgcaactcggcgccggcgcccgcgtcggagacacccggatcgcattcgacgagcgtccggcgaccgtcaagcgcaacagccaggtcgtccaggccaccctcagccagccgttgttccgcgccgaccgctggttccagtggcaggccgccaaggaaaccagcgaccaggcccggctggaattctccgcgacccagcaggacctgatcctgcgcagcgccgagacctacttcacggtgctccgcgcccaggacaacctggccaccagcaaggccgaggaagccgccttcaagcgccagctggaccaggccaacgagcgcttcgacgtgggcctttccgacaagaccgacgtgctcgaggcccaggccagctacgacaccgcccgcgccaaccggttgatcgccgaacagcgcgtggacgatgccttccaggccctggtgaccctgaccaaccgcgactacagcgccatcgagggcatgcgccacaccctgccggtggtgccgccggcgccgaacgacgccaaggcctgggtcgacaccgcggtgcagcagaacctgcgcctgctggccagcaactacgcggtcaacgccgccgaggaaaccctccgccagcgcaaggccgggcacctgccgaccctcgatgccgtggcccagtaccagaagggcgacaacgacgccctcggcttcgccaacagcgccgccaatccgctggtgcactatggcaagtatgtcgacgagcgcagcattggcctggaactgaacatcccgatctacagcggcggcctgacctcctcccaggtccgcgagtcctaccagcgcctcaaccagagcgagcaatcccgcgaaggccagcgccgccaggtggtgcaggatacccgcaacctgcaccgcgcggtgaataccgacgtcgagcaggtccaggcgcggcgccaggcgatcatctccaaccagagttcgctggaagccaccgagatcggctaccaggtcggcacccgcaacatcgtcgacgtgctcaacgcccagcgccagctgtacgccgccgtgcgcgactacaacaacagccgctacgactacatcctcgataccctgcgcctgaagcaggcggccggcaccctcagcccggccgacctggaggcgctcagcgcctacctgaagcaggactacgatccggacaaggacttcctcccgccggacctggccaaggccgccgccgagcagttacagagcaagccgcgccagcagtactag

SEQ ID NO: 16169 - DNA, 2148 bp, Pseudomonas aeruginosa
caccaccagcggactgtccagttcctcgctggcggtggccagttcctgcgcggtgtagaggaagccgccatcgccgaccagcaccaggcccgggcgctgcggggcgccgagcttggcgccgatgccggccggcaggccgtagccgagggtgccgtagccggtgggatgcagccagctgcgcggcgctcggctggcgaacgcgtagttgccggtataggccagttgggtcatgtcggtgctgacgaaagcatcggccggcagcgcggcggcgatccggtcgaggatcgcctggtgcagcgcctgcagcggcgcgtgtgccgcgcggatatccgcgcgcaggcgcgccaccctcgcggcggccggcgcggcgtcgcgggcctcctgcggcaggcgcgccagcagcgcctccagggtctgccgggcatcgcccctgagcgctacggcagagggatagaagtcgttgaacttgcgcgggtcgatatcgacgcggatcagttcgcccgacagcggcaggcgttcgcgccagaagtcggtgtcggccatctcggtgcccaccgccagcaccaggtcggcctcggcgatcatctcccagcccggcgctacgcacaggctggccccggcgttgagcggcgcgtccggcggctgcaggcccttgccggcgacgctggtgaacagcggcgcggccaggcgctcgctcagcgcggcaagcgcatcgccggccgccagcgcgccgccgccggcgatgagcattggtcgccgggccgcagccaggcgctccgccgccgcccgcaatgcctcggtgcacggcacgccacgaccagggcggcgcgccacggcagcgctccagtcatgggccaccggcgcggcgagcacgtcgagcgggatcgagatatgcaccgggcgcggacgctcgctgtcgaacaccgcgtaggcccgggcgatcagttcgggcagctgttccgggctcaaggccagggcggagaaggcagtgatcggcgcggtcatggcacgctggtcctgggtctcgtgcaggcagccccagcccttgcccaggctggcgctgtggttgacgctggaaatcaccagcagcggcaccgagtcggcgtaggcctggccgatggcggtggcgacgttggtcacgcccggcccggtgatgacgaagcacactcccggcttgccgctgacccgcgcataaccgtcggccatgaagccggcgccctgctcgtggcgggtcagcacgtggcggatgccgctgcccggaagtccgcggtacagctccagggtatgcacgccggggatgccgaaaacggtatccacgccgtagttggccagcaagcggaccagggcctggccggcggtgagggtcttctgtggttgcatgggcaatatcctcatccagttcggcgaccatcggagtcgccgttcgcgccgcagcgctcttgctcccattcccacaagcgggagggggagccgtcgtgtccccccggccttcagccattggccagccggatcaacgcatccaccgccagcgctccctcggcatccgccagcaacggattgacgtccagctccagcaagcgctcggcatgttcgcaggcgaattcggcgaccgcgcggatcgccgccaccagggcctccatgcacactgccgggcgaccgcggaagccgctgagcaacggcgcgctgcgcaggctcagcagggcatcgcggatcgccgcgtcggtggttggcaggagcaggctgcgactgtcgcgcagcagctccacgagtatcccgccggcaccgatcaccaatgccaggccgaagccctcctcgcgcttgaccccgacgatcagctcggccagcggcgcgccagccatgcgctccaataaaacacgctcgaagaccagttgcggcgcgtgccgggccaggctttcgcgcatgtcgaacaatgccgcctccaacgccgcctcgttgcgtaggccgagcgccacgccaccggcctcggtcttgtgcggcagtgcggcgctgaccgccttgagcaccagcgggaagccgaggtcgagggccgcttcgcgggcctggccgggggtgctcagcaccccctggggcagtggcaggccgaagggtttcagcgcctgcttggattgccactcgtcgagcaggtag

SEQ ID NO: 16170 - DNA, 537 bp, Pseudomonas aeruginosa
aaagctgtaaggaagttgttcgccgcgccgctcaaccggccgctgagtcggcttcgccgaggaagccggcgcggcgcagggcttcggcgccgtcgcggcgcaggctacccaggcgtgcgccccaggctcgcgggtcgaccccggccgcgcccagggcctcgcgctccagctcgcccaggccggcgccgagcgccaccaggcccatggagtggcagcttccggacaggcgatgggcgatgttcgccgcctcggccaggtccgcctggtccagggcttcggccagcagcggcaactgctcgtccaggcttcccagcaggttgcccagcagtccggcgagcttgtgccgccccagcaggcggcggtgggtctcgagcatttgccggtccagcgcggcctccaccgcaagcgcaggcacgctggtgccgacctcgcccagcgcgcggcgcagctcgtccatccgcaggggcttgccgagcacgccctgcatgcccgcggcgaagtaccgacgcaccatgtccggctggatgctggcggtga

SEQ ID NO: 16171 - DNA, 2430 bp, Pseudomonas aeruginosa
acagcagcacccgccacagcaggcgccgcgccaacactccgccgtggccgctcaccaggcgtccgcgcggttgccggcgaggcgccgatagtcgcgcacgctgtcgtccagccaacgctggatgctgccgtcgtcgcgatagccacgcagggcccggtcgatctcgtccatcttcgccgccagcggcgagtgccgcgagaccgccacccgcaggtagtccaccgtcagcggttcgggcagcgcacggatgttctcgccgccggccaggcgctcggcgaacagcgtgccggtgcgccgttcgtgggcgatgtagtcgatgcgctggcgcaccagcttgccgaagttctgtcggctgtcggaaacccattcgacgttgccgtggcggccgacgaagcggtcgaagtccgccccgtagctttcgccgaacaacagcccgccgcgatagccggcgaggtcgccgagggattggatgcgcaccggccgctggcggttgtagaagatcgccacgtcctcgcgcagcaccggctcggcggaaaacgccaggtcgcgatcgcgcgcgggcgtgcggtaggccagtatcaggtcgacccgtccggcggcggcgtcgagcaggcagcgccgccagttgcccagcaccaccacctcgacccggtagcccagcgcgccgaacagccgcttcaccagctccggcgccagcccccggacctgctggccgtcgctccaggagatcggcgggtataccggatagtcgcaatagcggatggtctccgcagcctgtgccaggccgcccagcagccatccgcagagcgccagccagcaggcctgcatggctcaggcgtcgctggccgcggcggtgaacaggtagccggcgccgtggatggtgatgatcagttgcggttcggccgggtcgtcgcgcagcttgcgacgcaggcggccgaccagcacgtcgatggagcgatcgctgggcagccactcgcggttgcggatctggtccatcaactggtcgcggctcagggtatgcccgctgttgcgcaggaaagcgccgagcaattggaattcgccatgggtgagcagggtttcgttgcccgcgtggtcgatcaggcggcgccggtcggcgtccagcagccagtcgccgaactgcctgagggcctgccgggcggggccggcgctggcctgggcatggcgcacccggcggatcagattcttcgcccgcgacaccagttcgcgcgggttcagcggcttgatcacgtaatcgtcggcgccgcactccaggccgacgatgcgatcgatctcgtcgttgcgcccggtgatcaggatgatccccacctcggagcgcacccgcagctcgcgggtcagggtcaggccgtccttgccgggcaggcggatgtccagcagcaccagctcgaccggctggccgagatgggcgcactcggcaaggcaggcttccgcctgctcggcgttgccggcgcagaggacgtcatagccctcctcgccgagataggcctggagaagctcacgaatcaccgggtcgtcgtcgaccaccaatacgcgcggaaccatcgccatcaccttgcgcctccggcgggccggggcgtttcttgttctgggttgtcggacggtgggcggaaggggccggggcgccttccgctgccagcagcagcctatccactactgaacggacgatcaacaagcttccatcgcacgccggaagcggcgatgggcgcccgcctccaggccatccacccaggcctcgcaaatctgcacgccctgccgcggcgtgaaggtcgcgggattcagcccagactccagccacagcccgtcgagcagggcgctgaggctgatggccgccagttccgcgtcgaagtccgcccagccgccctcctccgccagttgccgcagcacgccgaccagcagcgcccggtactcgccataggaatggtcgtggacccgcccgatcgcttcgatgctgcccaccgcaccccagaacgccagccaggcgtcgagcaattgcggatcgagcagctcggcggagaaggatgcctcgaagaacgccgagagccgcgggcgggcgccgcccggcgcggtgtcgatggcaccgcggagcaggcgcatgacgcgtccggtgaccgccaggtaggcctcggccaccagcgcgtccttgccatcgtagtggtgattgatcaggcccaccgataccccggcctcggcgcagatcttgcgcaccgaggcgccctggaagccatgccgcttcaggcaggccagggtcgcctcgatcagcagcgccttgcgctgctctggctccagacgggaaaagcgcacttcctggttcatcctttcgcggctcctgctcgtcgcccgcgaccaccggcgggcagccccgatgatcgcaggttacgtggcgcccgtctcactggctggcccaggcgttga

SEQ ID NO: 16172 - DNA, 2157 bp, Pseudomonas aeruginosa
ccgaccaccaccaggccatcatcggcctggaccggcgcgaggccgccgaacgccagcaggacggcgccgagcaggacgcggcaaggaaaaaccgggtgcggacgggcgctggccgcgcggcgcaacggaaaggaacggttcatgtgcgtctcctcttgttcttgttgtggagtggatcgcagcgagccgccgggaagcggccacgggacagaaactatccagtcgattttaaaaaaacaagttgattttttactgatggtaaattcatatcctgtttctgaagcgcgccgcgagaacaacaagaaggacgccaaccgtgaatttcccgcacctgttcagccccctggaaatccggggcaaacgcctgaaaaaccgcatcatgtcgagcggccacgacacgtcgatgcctaccgacaacctggtcaacgagccactcgtcgcctatcaccgcgcccgggcccgcggcggcgccggactgatcgtcatgcaggtggcgggggtccacgacagcgcgcgctacacctcgcacgtgctgatggccaccgacgatgcctgcatccccggctaccggcgggtcgccgaggcctgccacgccgaaggctgcgtggtgctgtcgcaaatcttccatcccgggcgcgagatcatggagtccgccgacggcctgctggcggtggcctattccgcctcggcctcgcccaacgaacggttccgggtgatgccgcgcgaactcgaccagccgctgatcgacgagatcgtcgccggctacgccgccgccgcgcgccgcctgcacgaggcaggactggacggggtggaggtggtcgccagccacggctacctgccggcgcaattcctcaacccgcgggtgaaccgccgcaaggatggctacaacggcgacctcgatgcccgcctgcgtttcctccgcgaagtgctggcggcggtgcgcgcggccacctccgaggacttcatcgtcggcctgcgcctgtccgccgacgagcgcgaccccgagggtctcagcgaaagcgagtcgctgcaggcggccgaggcggtccagggcgagctggactacctgcacatcgtcgccggcacttcggcctccctcggcggcgccattcatatcgtcccgccgatggccatcgagccggcctacctggcccgcgaagccagtaccttcaaggcgcgcctggcgatcccgctgttcgtcaccgggcgcatcaaccagccccaggaggccgaggccatcctcgcccgaggccaggccgacgtctgcggcatgacccgcgcgctgatctgcgacccgcagatgccgaacaaggccgaggccgggcgcagcgacgacgtgcgcgcctgcatcgcctgcaaccaggcctgcatcggacatttccaccgaggctatccgatctcctgcatccagcacccggaaaccggccgcgagctgacctacgcaacgcccaatccgccctcgcggcgcaagcgcgtgctggtcgccggcggcggcccggcggggatgaaggcggcggcggtggcggcacagcgcggccacgaggtagtgctctgcgaggccggcgcccagctcggcggccaggtcaacctggcgcaactgctgccgcgccgcgcggaattcggcggcgcctccaccaacctgcaacgggagatgcaactggccggcgtcgaggtacgccgcaacacgccggtcgaccgcgcgctggtggagcgcgaacggccggacctggtgatcgtcgccaccggcgccgaaccctattggccgcctttcgagcgcggcggcgagctgcaggtggtggatgcctggcaggtgctgcgcggcgaggtgcgggtcggtcgctcggtgctggtcaccgactggcggggcgactggatcggccccggtatcgcggaaaagcttgtacgcgagggccaccaggtacgcctggcggtgaacggcacccactgcggcgagagcctgccgctgtacgtgcgcgaccagttggccggcgaactgcaccgcctgggtatcccggtcacgccctacgcccgcctgtacggctgcgacgataccacggtgtacatgcagcacagcgccagcggcgaggcgatgctgttcgaggaggtcgataccctggtgctatgccagggccaccagccggtggaccgcctggctga

SEQ ID NO: 16173 - DNA, 783 bp, Pseudomonas aeruginosa
cagcctgcacggcctggcggaggtgttgcggatcggcgactgcctggccccccgcaccgccgaggaggcgatctacgaagggctcaaggccgcctggagcatctgagcggcgcggccgcggctccctcgacgggtcccggcccagcccctagaatgccgcaaacgcagccaggaccccgccgcatgccccgcccgtcaccgccggacgccaccgacacgccgcgcagcgaaacgcacttcctcggcacccgcatccgcggcctgcgcaagcgccgcggcctgaccctggccgagctggccgcacagagcgaactcaccgccggctacatcagccagttggaacgcaacctggcgtatccgtcgattccggcgctgttcaacatcgcccgcagcctcggcgtgaccatccagtggttcttcgccagcgaggccgcggtggacccggcggacgccggctacgtggtgcggcgcaacacgcgcatgagcgtgcattacgaagacggcatcatcgacgaactgctcaccccgcagcccagccgccagttggagatcctccactcgcgtttcccgccgggcacctacagccagcagagctacagccatgagggcgaggaagccggctacatcctcagcggaatcttcgaactctgggtcggcgaccgccatttccagctccgcgagggcgacagcttcagctactccagccaggaaccgcatcgctacggcaacccgggcgacagcgataccctggtgctctgggtgatcaccccgccgacgttctga

SEQ ID NO: 16174 - DNA, 855 bp, Pseudomonas aeruginosa
ctcgtggacgccggcgaagcgttccggatggcgcggcaccaggatcagcaacgcgtcgggacgcgtttccagcaggcgccggtgggctgccaggacgatctcgtcctcgccggcatgggtgctggcggcgatccacagcggtcgcgccgtcgcgtcccattcctcgcgcagggcggcagcggccagcggcagctgcgggtcgatgcgcaggtcgaacttgatcgagccggtcacgctgacgcactcaggacgcgcgccgagacgacggaagcgctcggcctcggcctcggtctgcacggcgatccaggacagctcggcgagcatcggccgggtcagcccggcgaagcgcgcgtagccacgcgccgagcgctcggacaggcgcgcattggccagcgccaccgggatcccgcgcacggcgcaggcatggatatggttgggccacagctcggtttccatgatcaccgccaggcgcggccgcacccggtcgaggaagcgcgccgccgcccagggcaggtcgtagggcaggtagcagtgccggacctgctcgccgaacaatgcgcggatgcgctccgagccggtcggggtcatgcaggtgacggtgaccggcagctgcggatggcgctccagcagcgcccgcaccatcggcgcggcggcgatgctctcgcccaccgagacagcgtgcacccagatgccgccgggcggcacctcgggcaaggacagggaaaaacgctcgccgatgcgcttggcataggccggtgcctggcgcgcgcgccaccacaggcgcaacgccaccagcggcaagccgaggtggaacagcagggtatagagggtacggttcatgggcgcgcagcttag

SEQ ID NO: 16175 - DNA, 699 bp, Pseudomonas aeruginosa
  unsure (119),(133): Identity of nucleotide at the above locations are unknown.
ttcgccgcctggcggaactggccggcgacagcctgctcgccggcgaacgcatcgaaccgctgcgcgaatgccgggaactggccggcctgtgcgtctacggccgggagaatcgtgcccancgcgtggtgctcantgccggtggcgggcaacgaagcgctgctccgcgaactgggcctggaacaaccggccatgcagcggcggccgctgcacatggtgatggtcaaggcggcgaccctgaaaccgctgtacgcccactgcctgggggcagggccgaagccacggatcaccgtgaccacccatccgacccgcgacggccagtcggtctggtacctcggcggcgacatcgccgaagccgatggcgtggcccgcgacgaagccgcgcagatcgccgaagcgcgtcgcgaactggcaaagctgctgccctggatcgacctcggccaggcgcagtgggccaccttgcgggtggatcgcgccgagccggcacagtccaacctgttgcgcccggacaacgccttcctcgccgaacagggacgcctgctggtcggctggccgaccaagctggcgctggcccctgacttcgccgaccgggtctgcgcccgcctggaagaagacggcatccgccccagcgaacatgccgcgctgccgcaactgccgcgtccgccgctcgccgaaccggcctgggaggtggccttcgcatga

SEQ ID NO: 16176 - DNA, 762 bp, Pseudomonas aeruginosa
acctgccgctgctcacggcgatccaggaagtcgccgaggaatgcctggtggagaccgccggcggctggctcggcgggcgcttcggcgacacctggctgccgacgccctaccagggttcgctgcgctaccgggagaacagccacttcgtcctcaccccgctgtccggcgccgcccgtccggtgcaagccggcagcctgcgcttgctggagcgcccacgcgcctacgtacacctgcccacggcctcgctgcaactggtctacgacatgcgcctggagctgccgcgcgatgcgcgcgagccgagcctctaccatgtcgacgagcggctcgagagcggtccgctggtggcgcgtctggaccgtcggcgccccgatctctacctgctgccgctggaccaggggcgccccaccggcgacctgttcaccctgcgcaagggccagttgcgccctgcggccacccgcggcctgtggttggccgagagctttgccgtacaggacggctggctggtgcatgaggaacgcatccgtttccgcgactggctggcactgtggccatccagcaacggcgaccaggccggcggtgggcgcgaccgcgccagcgcctgaaccgggcgggctttgccgccctttctacttcaactggctggaagacttgccgagcaggcggcgagcgacgatgagcagctggatctgctgggtgccctcgaagatgtcgaggatcttcgagtcccgcgcccacttctccaacagctcatcctcggcgtag

SEQ ID NO: 16177 - DNA, 2067 bp, Pseudomonas aeruginosa
aagcatgaaattactgcaggcttatcctcttccctaagtaaaacctttaaatacaatcccacttcttgccatccccctcccgcgtcatccccaagccattcccgtcgacgagtaaagaaaatgtgcggtatcagtggatttatccaaagacacactgaaaagagccaaatggtacagatcattggccagatgacggacaagatcattcatcgtggccccgatgacaaaggatattggttggatcattccatcggcctggcgctcggccaccgccgcctggccatacaggacctgtcgacggccggacatcagcccatgccgtctgcatgcggacggtacgtcatagtcttcaatggggagatctacaatcatctggcactccgtgccctgctcggaccgcatccctggagggggcattccgacaccgagacgctgcttgcctgcttctccgtctggggtatggagaaaaccctatccaatatcactggcatgttttccctcgcacttttcgataaagaaacgagtaaaatcttcctcattcgtgaccggctaggagaaaaacctttatattatgggtggcagggaaactgcttcctgttttcctccgagttaaagtctctgaccgtacacccagagttccaaaaagagatcgacagagacagccttgcagcatttctacgttttggatattgccccactcccaacagcatctacaaaggtataaaaaaacttccgcccgggcattacattcaattgaacctggctaatgctacgccaggtgaactcatggatccgctcccctactggtctctgagcaaggtcatcgcacaagggatccatcagccattccagggaagtgactcagaggccgtggatgccctgcaccggcaactgtccgccagcgttacttcgcaaatgctcagtgacgtacctcttggcgccttccttagcggtggcgtcgacagcagcacaatcgtggcccttatgcaggctcggcattcccggcccgtacagacgttcaccattggcttcgacgagcccggctacaacgaagcggaacacgccaaggctgtcgcccagcatctcggcacccagcacaccgagctttacgtcagggccgaagacgcactcgcggtggtgccgtgtcttcccggcatctactgcgagcccttcgccgatagctcacagataccgacctacctgatcagtcgcctggccaagcaatccgtaacggtcgctctcaccggcgatggtggcgatgaactgtttgccggctacaatcgctatctcacggcatgccaggcatggaacaggttgcaacagcttccactggttgccaggatgacgctcgcaaaactgctgagcgctctgccaccggcgatgtgggacagcctgttctctctcgcaagccccttgctaccctcgaagtaccgtttgcgcacaccaggagacaagcttcagaagctcgccggtctcatggcgttttccagtgaagaggacttctacaaggatctggtcagccactggaagaagcctacgaacctcgtcatcggcagcgaggaatcggcttccgtcttttggaatcttgacagcctccccgagatggaaagcttcgaacaatggatgatggccatggatacccggacctacctggccgatgacatactggcgaaggtcgaccgcgccgcaatggccactagcctggaaacccgcgtcccgctcctcgatcatcgcgtggtcgaactcgcctggaaaatgccactgaacctgaagatcagaaataacgacggcaagtggttgctgcgccaggttctttaccagcacgttccccgggaactgatcgagcgtcccaagatgggattcgccatccctctggacacctggctgcggggaccgttgcgggagtgggccgaaagcctcctggctgaggaacgcttgagacgcgagggctacctgcgcccggagccgattcggcgagcctggcaggagcatctcagcggaaaaagaaactggcaaggcccgctctggaatgtattgatgttccaggcttggctggaacatcaatga

SEQ ID NO: 16178 - DNA, 963 bp, Pseudomonas aeruginosa
cgggaatcagcgctggcggatcttctcgacgatggcggtggtggagctgttctccaccaggccgagcacccgtacctcgccgccgtaggccttgacgatctgcgcgccgaccacctgctcgacgccgtaatcgccgcccttgaccagcacgtccggacgcacctgctcgagcaggcgctcgggagtgtcttcggcgaagctcaccacccagtccaccgcgccgagcccggcgagtaccgccatgcgccggtccaccgagttgatcggccggccaacgcccttcaggcgagtgaccgaggcgtcgtcgttgaccccgacgatcaggcggtcgccctgggcgcgcgcctgttcgaggtaggtcacgtggccggcgtgaaggatgtcgaagcagccattggtgaagacgatcttctcgccgtgggcgcgggcgtcttcgattgccagcagcaattgctccaggcccagcacgccacgctcggaaccctgctcgcgctgcaccgcgcgacgcagttcgggcgcgctgatcgccgcggtacccagcttgccgaccacgatgccggcggccaggttggccaggcccaccgcggacggcagctcctcgccggcggcaagcgccgcggccagggtggagatgaccgtatcgccggcaccggtgacgtcgaacacttcccgcgcccgcgccggcaggtgcagggccggctggccatcgcggagcagggtcatgccatgctcgccgcgggtcaccagcaaggcaccgaggtcgagttcgctcatcagcgcctggcccttggcgaccagttcggcttcgtcggcgcaacggccgacgatggtctcgaattcggacaggttcggggtgatcaggctggcgccgcgatagatggcgaagtccttgcccttgggatcggccagtaccggaatgttgcgcgcccgcgccgcctggatcagcacctggtggttctgtag

SEQ ID NO: 16179 - DNA, 789 bp, Pseudomonas aeruginosa
cgcgcccttgccgtagtcggacagcaccagcaccttgaccttggccagcagcgactcgacgtccacggccagggccgccgcgtcggtgcggaacggttcctcgaagtcgacccgcagcagttgctggtgacgactcatgacccgcagcttgacgatggtcggctggctatcgatgcgctggaagcgcgcgtccactccagcggccttgaggctgttggccaggctgtcggcggcctcgtcgcggccggtgacgccgaccagcaaggcctgcgcgcccagcgcggcgatgttcagcgcgacgttggcggcgccgccggggcggtcctcgtgctgttcgacgcggaccaccggcaccggggcctccggcgaaatgcgcgaagtcgcgccatgccaatagcggtcgagcatcacatcaccgaccaccaacaccggggcctggtcgaaacggggcatggacaacttcatgggaactccaaacaacctctcggggcagacgcccagtttatcagccgacaggcgccggcgcctgctcatccagtcccatcgcgtgcagccgcgcataatggccgttctgcgccagcagctcggcgtggctgccgcgctcgacgatctgcccctggtccatcaccaggatcaggtcggccttctcgatggtcgacaggcggtgggcgatcaccagggtggtgcgccccttcatcacttcgtccagcgccgcctggatatgccgctccgactcggtgtccagcgccgaggtcgcctcgtcgaggatcagcaggggcgcgtccttga

SEQ ID NO: 16180 - DNA, 753 bp, Pseudomonas aeruginosa
cacaggacctccatcactctgcctggaaggcgtgttggggtaagatggcgggccgttcgttcaggagctcgcatgcgagtcatagactacccctcctacttgcagttgcgtgacaacgcagaagtgctggaagccgatggtcatggggacaaggtactgcgtctgcgcgacgggtccttcctcaagctgtttcgccgcaagcgcctgatttcctccgcagccctgttcccctatgcggagcgcttcgcccgcaatgccagcgaactggcgcggcgcggcatcgtctgcccgaaggtgctggacgtactgcggatcccacatatccagcgcgacgcggtgcactacgagccgctaccggggcagaccctccgccaactcgaccgcaacgacccggagtgcggcgatacagtccggacgcaactgggcgagctgatcgccgcgctgcacgccaagggggtgtacttccgctcgctgcacctgggcaacgtggtgcgcacgccggaaggccggatgggcctgatcgacatcgccgaccctgcgggtccagcgctcggcgctcagcgccgcccagcgcattcgcaatttcaagcacctgctgcgctacgaacaggatcgaacctggttcctcgacgacagcgagcacctggtgctcaaggcctatctccgcagcagccaggtccactggacactcgagcagctcctcaagcaactgcaactggattgagcaaggaatgttcgcagctacccgactga

SEQ ID NO: 16181 - DNA, 2418 bp, Pseudomonas aeruginosa
agccccagctcttttcggctgctactctcaggtaaaaatacgtcgccaggtcttctccagccatccgggacgctccggctcgcgcaacgcgggccgcatggcctcgacgatactctgaccgacagcggcgaagctgaatcgttcgatggccagcgcctggccgcttcgcgcgatccgctcggcgagagccgtatcgaggcgcaggatcgcgagcttttcctggatgtccgccaccgagcgatacagcacgatattctccatgtcccggaaacccaaggcctcgttttcccgctcgccctggtcgtaggccagcagtacgcaaccgcaggccatcgcctcgaaattcttgatcatgtattcgcccatgccgacatccgcgctgacgaagaaacggatgcggttgagcgtacgcaggtactcctcgccggacttggtcttggtcaccagcaggttctccactccgcccaactcgtcgagcagcgccttgcgtccactgtaagccacgctgccggtactgccgacgaagcccagctcgatatcgcgcgcgaggcccaggtcatgcaacagggtctggtcgtagcccttgggcacgaataccgcgtcgaatccctcctggcgcaggcgttcgctgaccgtatggcccgaactgatcacccgtgcccagggcaggcgccggtaatgggcgctgaacttgccggtgtacttgcagggaatgtagttctggtaggcatcgtgctcgaggatcaccaggttgggcacgctgcggatgaagcggacctggcgcatttccttcttgaaacggaggaagaacaggatgcggtcgtagcgcgagacatccacgtgcttgcggaagtagccgcgcaggtcggcctgctcctcgctgctcagccagcgggtatcgcactcgcaatgggcggcgatgccgtcgtacaggcgatccaggatcgcgcgctgctctttctggaccagaaacagaactttcatcagaccttcatcctcgcggctgctccgaagcagcatggcggctcgaaccttgccgaacgctcgacccaagcatcacgcctccccatccagcgactccacccagaacaactcgtgccgacgcaccgccttgcgcatgaactcgtcctcgccgtaagccggccagcgacgcccggcgagccagccctgcagacggcggcgcagacggcgcttgaacggcggcctgggttgcaggtcgtgcatcatgcccaaggccatggccttgtccacctggcgcgtgcgctccagcgccagcgtccatggcagcaacggcgagcattcttcggtcagcggtggcaggctgacccccatgtgcgcatcgcccatcggccagcgatcgttgtcgtgcaggtgattggcatagtgcaacaatgcctgcggctgccagtccaggccctggagcgcctcgcgcacagcctcctgggcgcggacatggtccgggtgcggatcgaaatgcggatgaggcaggacgatgacctcgggacgtgccagcaggatcagctcgcggagatcggacagcagattgttccaggtcgacaggccgtcggcatcgctggccaggcgcaggcggttgaactggcggaacggacggatatcggcgagatcggcctcacgggacggcaccacctcgcccgggttcgcctgcatggcaggcaattgcaggcagaaataacccagttgcacgcagcgctcggccggcaccccaccccacgtcggcacggcctggctatcccaggcgcgcaggcggcccttcaggcgcgccgcagctattccgtcgaggcccatgcggcggtaatgctcggtttcgatctcgccggcggtcagggtcacgatccaggcctcgcgagcctggctgtagaggccgaaggcggccagctcggcgtcgtcggcatgcggagcgatgaccatcacccgccgatcacggtagtcgggatggcgcgcacgccacagggtcggttcgccgaccagccggcaatgccggccgcgcaggcgaatccggccctcgcccagcggcccggccagtcccgtcaggttcaggtagcgcaagccgttcaccccacgttcgaaagcctgggcatcggcctccgcgccaccttccagcagcaccgagggttcgaggaagcgccccagccagccagcgcgcacgccgatgccaagcaccagcgtatcgccttcgcgcagctcaccgtcgactcgcagacggccatccgccaggcgtaccggcagcgactcgaccccttccgcgaaacggtagcggtagtcctcgcccggcgaatagaacaggtgatcggcgaaccaggcttcgtgggcgacccacagggccacgaggaggatcggcaacaaccaggggctgaccagcagaccgacggccagcaatgccagcagcgcaaccagtag

SEQ ID NO: 16182 - DNA, 1290 bp, Pseudomonas aeruginosa
gccgatccgcttgttgcgtcgatgacgcttgagcaactgctgcttgcgtgcgctcatgcttcagacctggaagaccggagaaggatggcaccagcgatccttgtattcgcggtcggcgcgaccgaacgaatagcgcaggggtttgcccagcgctcgcgcatcctcccaggcggcctgggtgttcaggtaactgagcacgctgccagggctgaactcgcgggtctgcggatcgacgccgccgttgatgtactcgacgctgagccagcccggcgcttcggcgcgatacagtacctggaccgcgatgggctggtcgttgagcagcaggaccgagccgcgcagcaattcgcgcagccgctcgaagacctcggccatgcgctccgcgccggtggcagggaaaccccagcgacgctggaacagttcaagatagatggcagcgaactcggccggggcgaagctgtctgcctggcgcacctggccaccggcctcctccaccaggcgcacttcgcgccgctggttatagcggaacttcttggagaaatcctcgggagcacgagcgaaagccagttgctcggtctgagggcgcagcgtgacgatgttccgctcatgcagcgccgacaggtagcgtcccgcatggcggagggcgatgcgggcatcgccggccaccggcaggatcagttcggcgttgcccaggtcgtacaggcccttcttgccgcgccgcttgagcacgtccttggacaacgccaggtggcggccccaggtcgggatcgccgcaaccagttcgccagcgctctcccaacccaggtaacgcaccgggattccagccatttcggcgagctgctcgaccaccagcgggtgggtcgcgacgctgccgccgaaacgctgccaggcctgggcgtaggtcggcgcgtccacttcgcgccaaccgcgttcgcggaaggcgcgcaacctgttcagcatgcagactccgaagcgaagccggcaatcgtcggcaggcgccagaattcgcggcgcaccgcagcgtcggagaagcgtgtctccaggcgctcgagcatgagccgcgcacaggcctcgcgctggcggcggtcaagcgccgccaggtgggtcaggccctcggccagggccgtctcgtcgcccagcgggaagaggatgccgaccccttccaccacttcgcgggcgccgccacaggcggtggcgatcagcggtacaccggcaaccatggcctccagcaggaccatgccgaacggctcgtggtcggaactcagggcgaaggcgtcgaacgccttgaagtag

SEQ ID NO: 16183 - DNA, 1764 bp, Pseudomonas aeruginosa
cagaactgcaggacgcgaggttcagccgaccgagtcataccagtccacgccctccttcacgaccaggatgtcctccatgatcaggtactgcagatcggagccgaagaacatgttcagggcgtcggtcggcgagcagatcatcggttcgccacggcgattgagcgaagtgttcagggccacgccgttgccggtgaggttctccagttccttcatcaggtcgtagtagcgcgggttgtactcgcgcttcagcacctgggcgcgggaggtaccgtcttcgtgcaccacttccggcactcgctccttccactcttcgttgacttcgaaggtgaaggtcatgaacggggccgggtggtcgatcttgaacatctgcgggccgacggtatccagcatcgacgggcagaagggccgccagcgctcgcggaacttgatctgcgcattgatccggtcggccacgcccggcacgctcgggcagccgagaatggagcggccaccgagggcacgcggaccgaactccatgcgtccctggaaccaggccaccgggttgccgtcggcaaggatcctgccgatacgccggctgcggttgtcgatcttctgccactgcggcctggcctcgtgacgggcgcaggcggcgatgacgtcctcgttggaatactccgggccgaggtagacgtgctccatcttctccaccggcacgccgcgctggtgcgacacgtaggccgccgcgccgaccgcggtgccggcgtcgctggccgccggctggacgaacagctccttcacttcggggcgcgagatgatcttctggttgagcttgacgttcagcgcgcagccgccggcgaaagcgaccttgccggtctcgcggatgatatcgccgaggtagtagtccatcatctccagcgcgagcttctcgaacagcgcctggatgctcgcggcgtaatggatgtagggatcgtcggcgatgtcgccttcgcgcttgggccccagccactcgatcagcttgggcgagaagtagtagcccttgcctttctccttgtagcggcggaagccgatgacgttggcataatcggtgttgatcaccagttcgccgttctcgaacttggcgagacgggagaaatcgtacttgctggcgtcaccgtagggcgccatgcccatgaccttgaactcgccgtcgagcatgtcgaagccgaggtactcggtgatcgcgccgtacaggccgcccagcgaatccggatcgtagaactccttgatcttgtggatccgaccgttctcgccccagccgaagaaagtggtggcgtattcgcccttgccgtcgatgccgaggatcgcggtcttttccttgaaccccgagcaatggtaggcactggaggcgtgggcaaggtggtgctcgaccggctggatcttgattttcttcaggtcgaagccgagttgttgcaggcaccactcgatgcgcttgtagtaacgcttgtagcggcggttgccgagcaggatcgcatccagcgcgcgatccggcgcgtaggcgtagcgcttggcgtagtgccagcgggccttttccatgatgctgatgggagcgaagggaatcgctaccacgtcgacatcggccggctcgatccctgcctgctccaggcagaacttcgccgattcgtagggcatgcggttcttcgcgtgcttgtcgcgcacgaagcgctcttcctcgacggccgcgaccagcttgccgtcgatgtacagggcggcggacgggtcatggcttacggcgccagacaggcctag

SEQ ID NO: 16184 - DNA, 1344 bp, Pseudomonas aeruginosa
gatacaggcggccggcgtggcgcaacaggttgtccacgtgcaggtcgtcctgccagaggccctttgcatgcagctcgccaatggctgccagggcttcgccgagcaccgcttgctgggcatcgcccagcggcgcctgggcctccaccgcacgccaggcgtcaccgaggctctgcgccgcgtcgaggtagtcgaacagcagccagccgccctcgccctgctgcagcccgtcggccagcagcgccggggtggtcagcccctgggccgcgagcagacgcgccccttccagttcgcgctggaaatgccgtgcggccttgccgcccaccagcagcttggccagcaccttgcgcccacgccattcgccggcaccgacgtagcgctgcccgggcagcacccgcagcagactgtccaggcgcagttcggcagcgccagcgccatccgccagggtcacccgcaatggcagttgcgggtggcgcccggcggcttgcagttcggccagtctcatcggcgcgactccttgcgccgacggcgctggtcgagaaggcgataccactgctcgacctcggccgagtcgaggggttcgtcgacataggcggagatgaattcgtgcacgtccgcttcgctccagtccggggcacggcgcagcatcggctccaggtccttgacctggtcgcggcggccgaaccagatcgggcgggtcttctccaggtcgatcaggcaggcctcgaagacaccatcggccccctcgcggaggaatacatgcttgggatagaagcaaccatgcatctgtccggcggcgtgcagctggcgcgccagcctgccaaccgcccggagaatcgcccggcgccgctcttcggccaggtcgtgccaggacgccagccaggtgtccaggtcctgccaaccgtccagggcacgggtcaggaggatcgcctggcgctctccgccgaccgcctgctgggcgaagaacgccgcctgcagggcgggaatgcccagcgcccggtagcgctcgatgttgcggaactcgcgggcgaaggtcggctcgcccagcggatggcgcaggctgcgggtcaggtggttgctctggcgcttcaggtagtaggcggagtcgcccaggtcgaggcggtagacgctgctccagccaccccgctcggtattcggttcgtccacggcgtccagctgcaaggcccacagggcgtcgaagctgtccagacggttgcgctggagcaggtcgtggtcctgcgcggcgatgaaaacgctcattcgcgcccctcgaagaaagccaccacctggcgaatacgcttcttgtcggattcgttcaggtgccggcgacggcgatattgcaggtag

SEQ ID NO: 16185 - DNA, 921 bp, Pseudomonas aeruginosa
tcagggaggctttcgcctccctgtcacacccttcttcggtgcttacttgaccagggtacgccactcggcgtgggcctcggtcttgccgctgaccaggtcgaaataggctttctgcagcttttcggtgaccgggccacggcggccggcgccgatcttgcgaccgtccacttcgcggatcggcgtgacttccgcggcagtgccggtgaagaaggcctcgtcggcgatgtacacctcgtcgcgggtgatgcgcttctcgaccagtttaaaaccgtgttcggcggccagggtcaggatagtgttacgagtgatgccgttcaggcaggcggtgacttccggggtgtagatcacgccatccttgatgatgaagatgttctcgccggagccttcggccacgtagccttccggatcgagcatcatggcctcgtcggcgccgccggagatcgcttcctggagggccagcatcgagttgatgtaggcgccgttggacttggcgcgggtcatcgagatgttgacgtggtggcgggtgaaggaactggtgcgcaccttgatgccttgctgcagggcttcctcgcccatgtaggcgccccagctccaggcggcgatgatcacatggaccttcaggccgctggcgcgcaggcccatgccttcgcttccgtagaacaccatcgggcggatataggcgctttccaggttgttctcgcgcacggcggcgcgggtcgcctcgttgatctcgtcgcggctgtacgggatctgcatgttcatgatgtgcgcggagtcgaacagccggtcggtatgcgcctgcaggcggaagatcgccgtgccctgcggggtgtcgtaggcgcgcacgccctcgaacacgcccattccatagtgcagggtatgggtcagcacgtgcgtggtcgcgtcgcgccactgcactag

SEQ ID NO: 16186 - DNA, 255 bp, Pseudomonas aeruginosa
cttcggtgcgcaacgcgtcgagatcgcgcggcctcgccagcacctcggcacgtaccgcctcgaagctcgcctgcacccgccggcaaccggccagcacccgggcgcggaccaacgcctggtgctcccaggtccaggcctcctgctcctggtagcgctggaaggcgcccagcgaactcaccagcaggccggccgcgccgctcggacgcaggcgcatgtcgacctcgtagagggtgccggatggcgtctgcgcggtga

SEQ ID NO: 16187 - DNA, 447 bp, Pseudomonas aeruginosa
tgcgcagttgctggcgtgtgcggaaacgtcgcaggcgccgaccgagttcgtcctcgtcggcgcaatcctccagccgcgcctgcaactggctgcgcaattcgccgggcgcgtgggggttctccagctcgccgcgttcggccagatccagcagcatcgccgggtcgcgcactgcctgctcggcgacgaaatcgctggccgcggcgacccgtcggaaatcctccaggcgctcctcgggccaggcctccaggcgggccagggcggcggcatcgagggcggcgacagcggagcggagggcagtcccggcgcgttcggcggcgggcagcagggtggccggcagattcgccagcgaaggcaggctcatggtctatcctgtttgggcttccgaccgaagaccacaggctcgacgcacaacgtcgaaaaggctctacatcgggccttatagcctga

SEQ ID NO: 16188 - DNA, 2769 bp, Pseudomonas aeruginosa
aactacaagtcgccgggtacacccccggagaacatccaagaattagctgcggtcgcccacgaggccggccgctcacctatggcatccgattctggaagcctttccgccctggagcaagccatgcaagacctcgatcccgtcgaaacccaggaatggctggacgccctggagtccgtactcgaccgcgaaggtgaagaccgcgctcattacctgatgacccgcatgggcgagctggccagccgtagcggcacccaactgccctacgcgatcaccacgccctatcgcaacaccattccggtaacccacgaagcacgcatgcccggcgacctgttcatggaacgccggatccgctccctggtgcgctggaacgccctggcgatggtgatgcgggcgaacaagcacgacccggacctgggcggccacatctccaccttcgcctcctcggcgaccctctacgacatcggcttcaactatttcttccaggctcccaccgacgaacacggcggcgacctggtgttcttccagggccacgcgtcccccggcgtctacgcccgggccttcctcgaaggccgcatcagcgaggaacaactggagaacttccgccaggaagtggacggcaacggcctgtcctcctatccgcacccctggctgatgccagacttctggcagttccccaccgtatccatgggccttggcccgatccaggcgatctaccaggcacgcttcatgaagtacctggaaagccgcggcttcatccccgccggcaagcagaaggtctggtgcttcatgggcgacggcgagtgcgacgagccggaatccctcggcgcgatctccctggccggccgcgagaaactcgacaacctgatcttcgtcatcaactgcaacctgcagcgcctcgacggcccggtccgcggcaacgccaagatcatccaggaactggaaggcgtgttccgcggcgccgagtggaacgtcaacaaggtcatctggggtcgcttctgggacccgctgttcgccaaggacaccgccggcctgctgcagcagcgcatggacgaggtcatcgacggcgaataccagaactacaaggcgaaagacggcgcctacgtgcgcgagcacttcttcggcgcgcgtccggaactgctggaaatggtcaaggacctttccgacgaggaaatctggaagctcaaccgcggcggccacgacccctacaaggtctatgcggcctaccaccaggcggtcaaccacaagggccagccgaccgtcatcctggccaagaccatcaagggctacggcaccggcagcggcgaagcgaagaacatcgcgcacaacgtgaagaaggtcgacgtcgacagcctgcgcgcgttccgcgacaagttcgacatcccggtcaaggacgccgacctggagaagctgccgttctacaagcctgaagaaggcagcgccgaggccaagtacctggccgagcgccgcgccgcgctgggcggcttcatgccggtgcgccggcagaagagcatgagcgtgccggttccgccgctggaaaccctgaaggccatgctcgacggctccggcgatcgcgagatctccaccaccatggccttcgtgcggatcatctcgcagctggtcaaggacaaggaactcggcccgcgcatcgtcccgatcgtcccggacgaggcccgtaccttcggcatggaaggcatgttccgccagctcggcatctactcctcggtcggccagctctacgagccggtggacaaggaccaggtgatgttctaccgcgaggacaagaagggccagatcctcgaggaaggcatcaacgaggccggcgccatgtccagctggattgccgccggtacctcctacagcacccacaaccagccgatgctgccgttctacatcttctattcgatgttcggcttccagcgcatcggcgacctggcctgggccgccggcgacagccgcgcgcacggcttcctgatcggcggcaccgccggtcgcaccacgctgaacggcgaaggcctgcagcacgaggacggccacagccacctgctggcctcgaccatcccgaactgccgcacctacgatccgacctacgcctacgaactggcggtgatcatccgcgaaggctcgcggcagatgatcgaagagcagcaggacatcttctactacatcaccgtgatgaacgagaactacgtccagccggccatgccgaagggcgcagaggaaggcatcatcaagggcatgtacctcctcgaggaggacaagaaggaagccgctcaccacgtgcaactgctgggctccggcaccatcctgcgcgaagtcgaggaagcggccaagctgctgcgcaacgacttcggcatcggcgccgacgtctggagcgtgccgagcttcaacgagctgcgtcgcgacggccttgccgtcgagcgctggaaccgcctgcatccgggccagaagccgaagcagagctacgtcgaggagtgcctgggcggccgtcgcggcccggtgatcgcctccaccgactacatgaagctctacgccgagcagatccgccagtgggttccctccaaggagtacaaggtgctcggcaccgacggcttcggccgcagcgacagccgcaagaagctgcgcaacttcttcgaagtggatcgtcactgggtggtgctggccgcgctcgaagcgctggccgatcgcggcgatatcgagccgaaagtggtggccgaggccatcgccaagtacgggatcgatccggagaagcgcaacccgctggattgctaa

SEQ ID NO: 16189 - DNA, 1656 bp, Pseudomonas aeruginosa
aaggagaggaatgtgagcgaactcattcgcgtacccgacatcggcaacggtgagggtgaagtcatcgagctgctggtcaagcccggcgacaaggtcgaggccgatcagagcctgctgaccctggaatccgacaaggccagcatggaaatccccagtcccaaggccggggtagtgaaaagcatcaaggcgaaggtcggcgacaccttgaaagaaggtgacgaaatcctcgagctggaagtggaaggcggcgaacagcctgccgaagccaaggccgaggcagcgcccgcccaaccggaagcgccgaaagccgaagcgcctgctcccgccccgagcgagagcaagccggccgcccccgccgcggccagcgtccaggacatcaaggtcccggacatcggctcggccggcaaggccaacgtcatcgaagtgatggtcaaggccggcgacacggtcgaggccgaccagtcgctgatcaccctggaatccgacaaggccagcatggagattccctcgccggcctccggggtggtggaaagcgtctcgatcaaggtcggtgacgaagtcggcaccggcgacctgatcctcaagctgaaggtggaaggcgccgctccggcagccgaagagcaaccggcagccgctccggcccaggccgcggcgcccgccgccgagcagaagcccgccgcggcggcccctgcgccagccaaggccgataccccggctccggtcggcgcacccagccgcgacggcgccaaggtccacgccggcccggcggtgcgcatgctggcgcgcgagttcggcgtcgagctgagcgaagtgaaagccagcggtcccaagggtcgcatcctcaaggaagacgtccaggtcttcgtcaaggagcaactgcagcgcgccaagtccggcggtgccggcgccaccggcggagccggcatcccgccgatcccggaagtcgacttcagcaagttcggcgaagtggaagaagtggcgatgacccgcctgatgcaggtcggcgccgccaacctgcatcgcagctggctgaacgtgccgcacgtgacccagttcgaccagtcggacatcaccgacatggaagccttccgcgttgcccagaaggccgcggcggagaaggccggggtcaagctgaccgtactgccgatcctgctcaaggcctgcgcccacctgctcaaggaactgccggacttcaacagttcgctggcccccagcggcaaggcgctgatccgcaagaagtacgtacacatcggcttcgccgtggacactccggacggcctgctggtcccggtgatccgcgatgtcgaccggaagagcctcctgcaactggccgccgaggccgccgagctggccgacaaggcccgcaacaagaagctctcggccgatgccatgcagggcgcctgcttcaccatctccagtctcggccacatcggcggcaccggcttcacgccgatcgtcaacgcgccggaagtggcgatcctcggtgtgtccaaggcgaccatgcagccggtatgggacggcaaggccttccagccgcgcctgatgctgccgctgtcgctgtcctacgaccatcgcgtgatcaacggcgccgccgcggcgcgcttcaccaagcgcctgggcgagctgctggcggacatccgcaccctgctcctgtaa

SEQ ID NO: 16190 - DNA, 1401 bp, Pseudomonas aeruginosa
caggcgctcgacgccaaccctcccggcgaagccaaccctacgaaaaacagggcttttccagcggcaccgcagacctccgaccgtccagcggttttttcccggatacgcttaacttgggccctgccgggccgatacagagttacttgtcagaccaatcggcataatgcaccctttgcctgcaccccatcgaaacgggtcgaggcctccccctcgctcagtacctggaatcagcctcgcatgaaaagtcatcccgatgccgccagccgttcggcggccgaggttgtcacgcagctacccgtgccgtcgcggctcgggctgctgcgtttcgagcggctgaacgagccgagctgggcactgctgttcctcgatcctgcctgcgagcgccagctcgggctgccggcgactaccctctgcgcactgctcgatgcgccttacgccagcctgatggaacccgaggcccgccaccgcctgcacgagcagatccagcagcaactggtgaagcgcccgcactaccaggtgagctacaagctgcacacacccaacggcgtgctgaccatgctggagttcggcgaagccttccagcagcatggccgccagttgctgcacggctacctgatggtcgaggagcgagcggagagcgccgagcgcagcgaacagttgctcgacctggaatcgcagaacctgcgcctgaaggcgtccctggacctctaccagcgctcccaggacgaccacctgcaacacctgctgcgctcgcgcacccagcagaacctgatcgtccgcctggcccgccatcgctacctgtccagcgacccgctgctggaagccgcgcaactgatcacccaggccgcctgcgaagcctacggcaccgcgcgcgccggcatctggcgcctgctcgacgaccagcgcctggaagcggtgaccgtctaccgccgcgacctcgaccagtacgagaagccccagagcatcgacgccagccgctaccccgcctacctcgaggcggtacacagcgggcgcgccatcgacgcccacaacggcccagcgcgacccacgcacccaggaactctacaaggactacctgaagccgctgggcgtcaacgccctgctcgacgccaccatccgcatcggcggcgaggtggtcggcgtgctgtgcctggaacacgccggcgagaaccgcatgtggcagagcgacgagatcgccttcgccggggaactcgccgaccagtacgcgcaggtcctgatgaaccacgagcgacgcaatgtctccagcgccctgcacttgttccagcgcgcggtggaacagagcgccagcgccttcctgctgatcgaccgcgacggcgtggtggaatacgtcaatccgagcttcacctcgatcacccagtacagcgccgacgaagtgcgtaa

SEQ ID NO: 16191 - DNA, 1230 bp, Pseudomonas aeruginosa
cagcctcggccaccagaccggcgacaagctgctggtcagcctggcccggcgcttgcgcagttgcctcggcgacggcgccaccctggcgcgcttcgccagcaacgagttcgccgtgctgctcgacgacaccgcggtggaaaagggcgaaagcattgccgcgcaggtcctgcacatgctcgacaagccgctgttcgtcgacaaccagttgatcaacatcaccggctccatcggcctggccagcgccccgcagcacggctgcgacccgcagaccctgatgaagtacgccggcctggcgctgcacaaggccaaggccaacggcaagcaccaggtccaggtgttcaccgaggcgctgaccgccgaggccagctacaagctgttcgtcgagagcaacctgcgccgcgccctggcgcagaacgaactggcggtgcactaccagcccaagctgtgcctgcgcagcggccagttgctcggcctggaagccctgctgcgctggcagcatccggaaaaaggcatgatccgcccggaccgcttcatcagcgtggccgaggaaaccgggctgatcgtgccgatcggcaagtgggtgatccgcgaagcctgtcgccaggcccgcgagctggccgaggccgggctgggcgagctgcagatcgccatcaacctgtcgcccaagcagttcaccgacccggacctggtcggctcgatcgcggcgatcctccacgaagagaacatcccggccagccagctggaactggagctcaccgaaagcctgctgctggacgccaccgacgatacccgccagcaactcgaacgcctgaagagcctcggcctgaccctggcgatggacgacttcggcaccggctactcgtcactgagctacctgaagaaattccccatcgacgtgatcaagatcgaccgcagcttcatcaaggacattccggacagccaggacgacatggaaatcacctcggcggtgatcgccatggcccacaacctcaagctcaaggtagtcgccgaaggcgtggagagcgccgagcaactggccttcctccggcgcaaccgctgcgacatcggccagggctacctgttcgaccggccgatccccagcgacctgctcaataccagtctgctgcgctatccctgccgcaccctgcactgatcgcccaggcctcccccgccggcgcggaaaggctgtactctctgtgctcatccgcgagtcattcgcctaccccctga

SEQ ID NO: 16192 - DNA, 1044 bp, Pseudomonas aeruginosa
gagtacgccccgcgaacgcccgcagggccgcctgccggacggcaaggacctgagcgcgccacaggtggcgatcatccgccacgccgacgtgcggcgcatgctgctgacccagaaggcctatgtcgaaggcgccttcgacctgggcctgtacgccgcgcgcctgttcgacgacagccagaccctggaagacgacgaacagcgccgccaggcccacgacctgctcgacctgctgaccccgatcgtcaagtcctggccctcggagttctgcctgaaggccaacgagctggcgatccagatcctcggcggccacggctacacccgcgaatacccggtggaacagtactaccgcgacaatcgcctgaacccgatccacgaaggcacccacggcatccagtccctcgacctgctgggacgcaaggtcgggcagaacaatggcgccggcctgcgccagctgacccgcctgatccaggacgcctgccggcgcgccgaagcccacccatccctggtcgccctgcgccagccgctggaacggctggtggcgcggctgtccgaggtgaccctggcactgctcggcgacctgatgcagggccaggtcaaccagggcctggccaactcggcgctgtacctgaaagtgttcggccatgcggtgatcggctggcgctggctggagcaggcgatccgcgccgaggaagggctggctcgcggcgactgcgccgacgccgacttctatcgcggcaagttgcaggccgcacgctacttcctgacctgggaagtgcctggctgccaccacgaactggcgctgctggaggcccgcgacgacgtgtgttcgagcatgcaggaagaatggttctgatcctgcctgccctttcccgccccggtcacgtccggggcttttttatgtccgggcatggacgccgggttgccgttgcctggcggccacgccggcgagtccgcgcgcactcgcccggacaacgcgaaagccttggaattccttcgaaaaaaaccgcagccgcccctttacagtccgccaaatccgcaggttag

SEQ ID NO: 16193 - DNA, 3489 bp, Pseudomonas aeruginosa
agtttccggaaggccgcccagggcccggacttttcctctgatttcctgtcgaattcccgttccgaggcgccttgcggcgcctcggagccaccactaacctgcattcacccttcttcgagtctcttctcgaccatgcctgcccttcgctccctgatcgctattcttttcctcggcctctgccttgccagtccgccgctcctcgcccagtccgagccgccctcggccgaggccgtccagcaaagcctcgacaagctggccgagcgcaagctcgccgaagccgaccagaaggtcgccaaggccagcctcgaacagaccctcaagttcctcgccgcgcgcgacgaagcgctgcagagcctggaggacctgaaaaagcgcctgagcgacgcgccccggcagatcgaggaaaaccagcgcgaactggagcgcctgaagaagaccaaagaacgtccggtcagcgaacgctacagcggcgagagcgcggcccgcctggaaatgctgctcaacgaccgcaccacccagcaggccgagtggcagaaagccctgggcgaggccaacagcctgtcgatcaccgccgagacccgtccggaacgagcccaggccggcatcagcagcatgcaggcacggatcctggaaatcggctcgctgctcaaggccggcaaggaaagcggcaagacgatcaacgccgaccgtcgcggcgagctgctcgccgagcaggccgcattgaccgtgcagagccagctgttgcgccaggagctggccggcaacaacctgctgcaggacctcggcaagagccagcacgatctgctcaccgagaagatctcgcgcctggaaaaggaaaccctcgacctgcaggcgctgatcagcgagaagcgccgcgagcagtcggaaaagaccgtcgccgagctgtccaaggaaggcgcccagggagccggcaccgacagcctgctgagccaggagaacgccaagaacctgcgtctctccgactacctcctgcgtgccaccgaccgcctcaacgtgctcacccggcgcaacctcgagaccaagcagcaactggacaacctgacccagtccaaccaggccctcgaggaacagatcaacgtcctgcgcggcagcctgctgctgtcgcgcatcctctacaagcagaaacaggcgctgcccaagatcaaggccgaccagagcctggccgacgagatcgccgacctgcgcctcggccagttcgaactgaaccaggaacgcgacaagctggcgaccccgcagcaatacctggacgacctgctcgcccagcagcccagcgagcaggtcacgccggaactgcgcaaggatctcgacaccctgttggcaacccgttccgagttgctcgaacggctcaaccacgaactcaacgcgctgctcaacgaagcgatcaccttgcagttgaaccagaaacagttgctttccaccagcgagagcctgcgcaccaccctcgacgagcagatgttctggattcccagcaaccagccgctcgacctgtcctggttcaagatgaccccgaccctgctgaagaaccagctcaccgagatcccctggggctccggggtgcgtgaactgggcgaaggcctggtcgatcggccgctgctgttcctgccgctgttcctgctgatcgccgcgctgctgtggaaacgccgctacctgtacgacaagctggcggagctgaacgacgacatcggccacttcaagcgcgacagccagctgcataccccgctggcgatcctgatcaccatcctcctcgccctgcccggcaccctgacctttgccgtcgccgggctggccctgctgctggacgcccgcggccagaacgccaccctcggcagcgccctactggaaatggcccaggtctggctgctgttctacaccgcccatcgcatcctcaccccgggcggcatcgccgagcggcatttccactggagccgcgaacaggtcggcttcctcgaccggcacctggtccgcctcggcgttgtggtcctggcgctggtcggcgtggtgacggtggccgagcaccagccggcgagtctggccgacgacgtgatcggcatcgccgtggtcctgctcggctacgcggccatggcctggctgctcagccgcctgctgttcagcagccccggcgacgaacgtccgtcgctgatcaagatgatcgtcggcatcctcttcaccgcgctgccgctggtgctcttcgtcgcggtctgcttcggctactactacacctcgctgaagctcaccgaccgtctcatcgataccctttacctgctgctgctctggttcgtcatcgaagccgccttcgtccgcggcctgggcgtggcggcccggcgcctggcctacgcccgggccctggcgaaacggcagaacgcggcgaaggaaggcgtcgacggcgagaccaacgtcgaggagccgaccctcggcatcgagcagatcaaccagcaatcgctgcggctgatccgactggccctgctgatcggcttcatcgtctgcctgtactgggtctgggccgacctgatcagcgtgatctcctacctcgacaacgtcaccctgtaccagtacaccgccggcaccggcgaagcggccaccagcgtgccgatcagcctgcgcgacttcctcgcggcgctggccatcgcggtggtcaccgtggccctggcgcgcaacctgcccggcctgctggaagtcctggtactgcagcgcctgaccctggcccagggcagcgcctacgccaccaccaccctgctttcctacgccatcagcggcatcggcatcgtcagcgccctgtccaccctcggggtcagctgggacaagctgcaatggctggtggcggcgctctcggtaggcctcggtttcggcctgcaggcgatcttctccaacttcgtctccggcctgatcatcctcttcgagcgtccggtacgaatcggcgacgtggtgaccatcggcaacctgtccggcacggtcagccggatccgcatccgcgccaccaccatcaccgatttcgaccgcaaggagatcatcgtcccgaaccagaccttcatcaccgggcaactggtgaactggtcgctgagcgataccgtgacccgggtcaccatcaagatcggcctggcctacgagaccgacctgccgctggcgcgcaagctgatgatgcaggcggtcaaggaaaacccgcgggtactgcgcgacccggagccgctgctgtacttcctgaccatcagcgccagtaccttcgactacgagctgcgcttccacgtccgcgaactgggcgaccgcaacccctctaccgacgagatcctgacgaagatcgccaccagcttccgcgaacacaagatcgacatggctttcaaccaggtcgatgtgttcgtcaagaacctccagggccagcaggtccagctgttcgtcggcgagccgcagcacagcggcgtcggcaatccgcccgcgctcaagggccaggacggtcccgccgaaccgacccgctga

SEQ ID NO: 16194 - DNA, 1527 bp, Pseudomonas aeruginosa
acctcagggcctggacgccctccggcaattcccagcacaatgctcgggaattgccggaggcctctcttgaaatcactcgacgacctcgacttcgacaaccgcttcgcccgcctgggcgacgccttctccaccgaagtcctgcccgaccccatcgccgagccgcgcctggtggtagccagccccgccgccctggcgctgctcgacctgccagcggaaaccagcgacgaagcgctgttcgccgaactgttcggcgggcacaagctgtggtcggaggccgagccgcgggcgatggtgtattccggccaccagttcggctcctataacccgcgcctgggcgacggccgcggcctgctgctcggcgaggtgatcaaccaggccggcgagcactgggacctgcacctcaagggcgccggccagaccccctactcgcggatgggcgacgggcgcgccgtgctgcgctcgtcgatccgcgagttcctcgcctccgaagcccttccggcactgggcattcccagcagccgggcgctctgcgtgatcggttcgagcacgccggtctggcgcgagaagaaggaaagcgcggcgacgctgctgcgcctggcgcccagccacgtgcgcttcggtcacttcgaatacttctactacacccgccagcacgaccagttgaaacagttggcggcgttcgttctggaacaccacttcgccgactgcaacgcagccgagcggccatacgcggcgatgttccgccaggtcgtcgagcgcaacgccgaactcatcgcccgctggcaggcctatggcttctgccacggggtgatgaacaccgacaacatgtcgatcctcggcattaccttcgactacgggccctacgccttcctcgacgatttcgacgccaatcacatctgcaaccactccgacgacgccggccgctactccttcagcaaccaggtaccgatcgcccattggaacctggccgccctggcccaggcgctgacgccactggtggaagtggacgaactgcgcgccagcctcgacctgttcctgcccctctaccaggcccactacctcgacctgatgcgccggcgcctgggcctgggcgtcgccgcggagaacgaccaggccctggtccaggaactgttgcagcgcatgcagggcagcgcggtggattactcgctgttcttccgccgactcggcgaagaaactccggagcgggcgctggccagcctgcgcgacgacttcgtcgaccgcgaggccttcgaccgctgggccgaggcctaccgccggcgcgtcgaggaagaaggcggagaccaggagtcgcggcgccggcgcatgcacgcggtcaatccgctctatgtgctgcgcaactacctggcacagcaggccatcgaagcggccgagcagggcgactacacggaagtccgcttgctgcaccaggtgctgagtcgcccgttcgaggaacagccgggcatggagcgcttcactcggcgcccgccggactgggggcggcacctggaaatcagttgctcctcctga

SEQ ID NO: 16195 - DNA, 1047 bp, Pseudomonas aeruginosa
gaaaagccgattatcttcgccgccacacttattccagcctgttctaccacctcctgtcaggcgccttgccgcatgaagatacgcgacctcgatctcagccagagttcgatcaacaccgaacaccaggcgctaggtctgcctcctgtcgaagatttcgtcacccatccggacgaccacccggtactgcgcgccgccatgtgggcggcggtgctgatcctggtcggcctgctcgccttcctggcctggcgcctgttcttcgacaacggcggcagcagcggcttcgagatcatcgagcaggccctgaccagccgaggtttctggagcgcggtggcggtgggcttcttcgcccaggtgatcgacggtgcgctgggcatggcctacggcattactgccaccaccttcctgctcagcgctggcgccacgccggccgccgccagcgccagcgtgcacatcgccgaagtgttcaccaccggcttttccgggatttcccacgtcaagctcggcaacgtcaacaagtcactcttcctccgcctgctgctgccgggaatgatcggcgcggtgctcggcgccgtgctgatcacccgcttcgacggccaccagctcaagcccttcatctccgcctacctgctgctgatgggcctgtacatcctgagcaaggcctaccgccacgtgatcaagcgccgggcaccgcgccacgtggccaagctggcactcttcggcggcttcgtcgatgccgccggcggcggcggctggggcccggtggtcaccagcagcctgatcggctcgggtagcgacccgcgcaccaccatcggctcggtgaacttcgccgagttcttcctgaccatcgccagcgccacctccttcatcctcctcgccggccagccggacacctggaagatggtcgccggactggtcttcggcggcctgttcgccgcgccgttcgccgccctgctgtgcaagaagctttcgccgcgcaccctgctggtcatcgtcggcaccctgatcaccctgatcagcgcctacaacatctacatcggcctgcgctga

SEQ ID NO: 16196 - DNA, 1335 bp, Pseudomonas aeruginosa
cccgcccggcgcgctttcccatgctgcgtccttccaatctgcccgaaggaacgctgcatgaaactggaaaccctggccgtccacgccggctacagccctgacccgtccacccgcgcggtggcggtgccgatctaccagaccacctcctacgctttcgacgacacccagcatggcgccgacctgttcgacctgaaggtaccgggcaacatctacacacggatcatgaaccccaccaacgatgtactggaacagcgcgtcgcggcgctggaaggcggggtcggggcgctggcggtggcctcggggatggcggccatcacctacgcgatccagaccgtcgccgaagccggcgacaacatcgtctcggtggccaagctctacggcggcacctacaacctgctggcccacaccctgccacgcatcggcatccaggcgcgcttcgccgcccacgacgacatcgccgccctggaagcgctgatcgacgagcggaccaaggccgtgttctgcgaaaccatcggcaacccggcgggcaacatcatcgacctgcaggcactggccgacgccgctcaccgccacggcgtaccgctgatcgtcgacaacacggtagccaccccggtgctctgccggccgttcgagcacggtgccgacatcatcgtgcactcgctgaccaagtacatgggcggccacggcaccagcatcggcgggatcgtggtcgactccggcaaattcgactgggcggcgaacaagtcgcgcttcccgctgctgaacacgcccgatccgtcctaccacggcgtcacctacaccgaggccttcggacccgccgccttcatcggccgctgccgggtggtaccgctgcgcaacatgggggcggcgctctcgccgttcaacgccttcctcatcctccaaggcctggagaccctggcgctgcgcatggagcgccactgcgacaacgccctcgccgtagcccgctacctgcaacaacatccgcaggtggcctgggtgaaatacgccggcctcgccgacaaccccgagcacgccctggcccggcgctacctggggggccgcccggcggcgatcctgtccttcggcatccagggcggcagcgccgccggcgcgcgcttcatcgacgccttgaagctggtggtgcggctggtcaacatcggcgacgccaagtccctggcctgccacccggcgagcaccacccaccgccagttgaacgcggaggaactggcccgcgccggagtctccgacgacatggtgcggctgtcgatcggcatcgagcacatcgacgacatcctcgccgacctcgaccaggccctggccgccgccgcacgctga

SEQ ID NO: 16197 - DNA, 543 bp, Pseudomonas aeruginosa
gcggatcggtcagtccgggcgagcgtttcggtccttgcccggcctggccggccggctagtctggctgggatccccgacatggagagcgccatgccactgcccaccgaactcgccaggcacctgaccgaagaaaagatcgccttcgtccagcgcagcggactcagggcggaagtcctcgaacccggctacgtgcgcctgcgcatgccgggcgccggcaacgagaaccacatcggcagcatgtacgccggggcgctcttcaccctcgccgaaattcccggtggcgcgctgttcctgaccagcttcgacagcgcccgcttctatcccatcgtcaaggagatgaccttgcgcttccgccgcccggccaagggcgacatacgcgtcgaggcacgcctggatgccgagcgcatccgccaactggaaaccgaggctggagagcgcggcaaggccgaatacagcctcgaactgcaactcaccgacgagcagggggaggtggtggcggaaagcaccgcgttgtaccagctacgcagccacgcgcggccctga

SEQ ID NO: 16198 - DNA, 1062 bp, Pseudomonas aeruginosa
ccatcccacggagtccgccatgatccgccacctcctggtcgcccacgacctcaccccggaagccgacgtcgccctcgcccgcgccgcccagttggcccgccagcacgatgcgcgggtcagcctgctgcacgtgtacgacccggggctatcggcgtcggcggtgaagaccgtcagcgccatgctgcagctcaagcgcaaggaggccggcctcgacgaggacagcgccatccacctgttcaggggccaaccgatcgacggcatcctgcagcagacccgggcgctcgaaccggacctgctgctgatgggcgcgcaccaccagaagaccttcgaacgcttcggcaacaccaccctcgaccaggtggtgcggcgcagccgggtgccagtgctgctcgccgtgcgcgaggcggacgaaccctaccgccaggcgctcagcgccctggacttttcccagtgcgcctgtaccgcgctgcgccaggcctaccgcctgctgccggtggaagccgacctgcacgccctgcacgtgttcgagtcccccgacgacggcgtgctcggcctgcccaggcagaatgccgcgcacctggccacccaggccgggctgatcgaacaattgctgagcgacgagcaggagcgcctgccgggcgtcgggccgcagctgagccacgaagtggttcccggcgtgctgccgtacagcctggacgccgcgttgaagcagcgccagccggagctgctcgccctcggccggcacagccgcaacgcgctgatgcaggcgctgctcggcaacctggcgcaacgttacctgcgccagccgagctgcgacgtcctggttacctcgtagaagcgctgccgcagaggctgctcagctttcgagcagcccgtgcaactcgacgaactgctgggtcaacttgtgccgcggttcgaggaagatcagcggggtacaagcctggtgcgactcgcgcatcttcaccgaactcatcaggtacaccggcagcaccggcagttcctccgccaccagctcgtcgagcagttgctgcggcaggctggcgcgcggctggaactggttga

SEQ ID NO: 16199 - DNA, 702 bp, Pseudomonas aeruginosa
tgctcgccggcctgctgctattcaccttcggcttcttcggcgcgcactcggtggcgagcagctggatcgggcgccgcgccctgcgcgccaagggccaggcctcgtcgctctacctgttcagctactacgtcggctcgagcctggccggcaccctcggcggggtgttctggcattactacggctggaacggcatcgggctgttcatcggctcgctgctggtggtcgcggtattggtctcgctgcacctggcgcgcctgccggccctgcctggcaacaccctggcgcaggccgcccactgagttcgagcgccggtctcccggcgccttcactccgaccagaagcgtactccggtcagttcctccgatcgcgcccacagccgcgcggccagccccaggtcgcgcgcattccgcggaatccgcgccgccgccggataaccgcgggtttccaaccagcgatccgggccgacataggcgccgccataccagcgctgttcggtcagcgcggaaagtgccggcaacgcccccatctccgccgattgcgcgaacgctccgttggccaccttcatcgcccagcgtcccaggcgcgaaccggccatcgccggcgccgcgtactgcaggttggtcgccgcgtagcccggatgcgccgccaggctctgcagaagcacgccccgctggccggcgcggcgctgcaactccaggctga

SEQ ID NO: 16200 - DNA, 258 bp, Pseudomonas aeruginosa
ccggtcttgcccagcacgcagacgaaaccgccggtcatgtattcgcagcagtggtcgccggtaccttccaccaccgcatgggaaccggagttgcgcacggcgaagcgctcgccggcggttccggcggcgaacagcttgccgccggtggcgccgtacaggcaggtgttgccgacgatggcagattcctgggtcttgaacggactgcccttgggcggggtgatcaccagcttgccgccggtcatgcccttgcctacgtag

SEQ ID NO: 16201 - DNA, 816 bp, Pseudomonas aeruginosa
tcgttggcgtcgccttccaggtacaggtgcaggccaccggcgttccacacgccgaagctctgtcccgcggtgcccttgaaacggaacaccaccggtgccttggccatgccctggttgccgtgcaggcgggcgatctcgccggatacccgcgcgccgatggatcggtcgcagttgcagatgtccagctcgtactcgccgccgctcaggccttcgatggcggccttcgacagctcgaccatcttctcggccagcaggccctggtcgaacggcgggtttttctccacctcgcagaactgcggcttgtcggccgggatcagctcactgcccagcaacggagcgagatccagattctgctgcttggcggtctcgccggggaggatctccagcaggtcggtgcggccgatcagctcgcccaggctgcgcacgccgaggcgcgccagccactcgcgggtttccgtggcgatgaaggtgaagaagttgatcaccatcgcggtggtgccgatgaagtggtccttgcgcaacttgtcgttctgcgtcgccacgccggtggcgcagttgttcaggtggcagatgcgcaggtacttgcagcccagggcgatcatcggcgcggtgccgaagccgaagctctcggcgccgagaatggccgccttgatcacgtccaggccggtcttcaggccgccatcggtctgcacccggaccttgccgcgcaggtcgttgccgcgcagggtctggtgggtttccgccaggcccagttcccagggcgagccggcgtacttgatcgaggtgatcggcgaggcgccggtaccgccgtcgtag

SEQ ID NO: 16202 - DNA, 576 bp, Pseudomonas aeruginosa
gataacgcaattcgccgcgcctcagcggggcggcaacttgcgcaggcgttcgagaatttcctggacgaccaggcgcggcggcctttcgtcggtctccaccaccacatcggcgatttcgcggtagagcggatcgcgcagcgccatcaggtcgcggaggatctgtcccgggttgggcttctgcaacaaggggcggttgcggtcccgcgccgtgcgcgcgatctggtgctcgaccgaggcatgcaggtacacaacccggccaccggcgcgcagcacctggcggttaccgtcgcgcatcaccgccccgccgccggtggcgatcaccatgccgtcggcggcgcagagttcggtgagcatggcctgctcgcgctcgcggaaaccgacctcgccctcgacatcgaagatccatgggatattcgcgccgcaccgctgttcgatctccttgtcggagtccttgaacgcgagatgcagctccttggcgagcaggcgcccgatggtgctctttccagcacccatcgggccgacgaggatcaggttgaccacgttgttcgatatcagcgaccgattgcgatggcctga

SEQ ID NO: 16203 - DNA, 1542 bp, Pseudomonas aeruginosa
aggcctcgtacggctggaacttcggcaacggctcgatggtgcccttgggccgggcgcgaacctcgtccatgtaggactgcagatcggcgaaatcggaaccgccgccgcatccggccaggctggcgagcagcaggctgctcagaatcaggcgggctctcatttcttcagccccttgtcgttgtagcgataggtcttggccaggatgctcatgcgcagcttggacgtgctgccgggcgcgaccggcttgatctcgaagtcatgcagggtgacgatccgcggcaggctggacacgccgctgacgaaggtcgccaagtcgtggtagccgccgaccacgctgatctggatcggcagctcgatgtagaactgctgggcaacctcgggaagcagcttgatttcctcgaactccaggccgctgcccaggccggtacgagtgatgtcctcgagcagcccgggtacctcggtgtcgctgggcaactgccgcagcaaggcgccaaaggactcttccatctccttcatctgtgccttgtaggcttccaggttcgcggcctggaaggccttggtggagaactgctgcttgagcgtctcctcttccgcggcctgctgttcgagctgagcctgcatgtcactcagatggaagttgtagcccagcgccaggaccgccgcggtcagcagcacgcagacgatgaccttgaccgccgccggccaggaaccgatgttgttcaggtcgagatcgttgatatcgatcttgcgcagactttccagggaactggccagactcatttcttggctccttgcgcaaccccatgcttcgccttggcgtcttcctcgccgggctgcgtctgctgcacggtcagttggaacacgttggcctggtccaccgcgccctgggtcaccgccttgacctcgttcagggtcggggcggtcagccactcggacgcgtccatgttgcgcatgagattggaaacgcggttgttggactcggccgcgccggcgatggcgatgttcttgccggtcatcttcaggtcggtgaaatacacgccgtcgggcaaggtccgcacgagctggtcgaacacccgtccgatgatgggacggttgccctgcaggtcctggatgatcttcatccgctcgagcaattgctggcgccgcgacttcagttcgctgatttccttgatccgggcgtcgagtacgacgatttccttgcgcaggaagtcgttgcgggcgttctggttctcgatggccgcggtgaagtactggtcgccaaggaataccagcgcagccgatgccaccaggacgccgccaagaatcaccaggaactgctgcttgcgctgctcgcgcagctcttcgcgccagggtagaaggttgatccgtgccatcagtcgaaactcctcaacgccaggccgcaggcgatcatcaacgccggagcgtcgctggccagggcgccggcattcaccttgccgttcagcgccatgtcggcgaacgggttggcgaccagggtcggggtgccgatcttctgctggatcaaccgatcgagatcctggatag

SEQ ID NO: 16204 - DNA, 420 bp, Pseudomonas aeruginosa
gctggcgaccgccgaacagctgttcgcgggtatagatggtgcgtccgttgtgcaggacgctcagggtggtcatggtcgcgccgatgtccactaccgccacggtcaactggtcggtgtcggcacccagctggctgctcagcagcgcataggagcgctccagcgcgtaggcctcgacgtcgaccaccttggcggtcaggccggccagcgccagggccgcttcgcgaacctcgacgttctctttccgacaggcggccaggagtacgtccacgcgctcgggattgcgcgcggagagtccctggacctcgaagtcgatggcgacttcctccagcggataggggatgtactggtcggcctcgatcttcagctggttttccagttcatcctcggaaagcccggcctccatctcgatggtcttggtga

SEQ ID NO: 16205 - DNA, 732 bp, Pseudomonas aeruginosa
tctcccttgacccgaaggacggggcgatccgctcgctggtcggcggcttctccttcgagcagagcaactacaaccgcgcgatccaggccaagcgccagccgggctccagtttcaagccgttcatctacagcgcggccctggacaacggcttcaccgccgccagcctggtcaacgatgcgccgatcgtgttcgtcgacgagtacctggacaaggtctggcgaccgaagaacgacaccaacaccttcctcggcccgatcccgctgcgcgaagccctgtacaagtcccgcaacatggtctcgatccgcgtcctgcagggcctgggcatcgagcgggcgatcagctacatcaccaagttcggcttccagcgcgacgaactgccgcgcaacttctccctggccctgggtaccgcgacagtcacaccgatggaaatcgccggcgcctggagcgtattcgccaacggcggctacaaggtcaatccgtacgtcatcgaacgcatcgagagccgcgacggacaggtgctgtaccaggccaatccgccccgcgtgccggtggaagaacaggtcgctgcgccggatgcggaagacgccgggaatcctggtgaccccgagcatccggagagcgccgaaggcgaaggttcgatcgaagcccagcaaatcgccgccaaggcccagaccaccttcgagccgaccccggccgagcggatcatcgatgcccgtaccgcctatatcatga

SEQ ID NO: 16206 - DNA, 1512 bp, Pseudomonas aeruginosa
ccggccgttcggccgcgccgggcactcccggcgcctatttcgagatgttcaagaacgaggacaccccgccctcggtcaacgaactgccgccaggcagcttccctggcagcccgctgccggatgacgaaggcgcgccgatcgacctgttctgaaccggcgcctgcgcttcgttggcgacgacgggagcgcgaggcgcaggcaaaaagaaaccccgccaaggcggggtttctttttatccggcggatcgatcgatcagccgttgaagacgtcgtccaccgatttcagcggatagttcttcggatacggcagggtagccacgccggtctcgatggcagccttggccacggcatcggagaccacggtgatcaggcgcttgtccatcggcttcggaatgatgtactcgcggccgaattccagcttgtccacaccataggcggcgcagacgtcctccggaaccggctgcttggccaggtcgcgcagggccagggcggcggcgatcttcatctcttcgttgatgcgcgtggcacgtacgtccagggcaccacggaagatgaaggggaaaccgagcacgttgttgacctggttcggatagtcggaacgaccggtagccatgatcacgtcgttacgggtggcatgggccagttccggcttgatctccgggtccgggttcgagcaggcgaacacgatcgggttcggcgccatgcgcttgaggtcttccggctccaacaggttggcgccggacaggccgacgaacacgtcggcgccctccagggcgtcggccagggtgcgcttgtcggtctcggtggcgaacaccgacttgtactggttcaggtcgtcgcgaccggcgtggatcacgcccttgcggtcgatcatgtagatgttctcgaccttggcgcccatgctcaccagcagcttcatgcaggagatggcggcagcgccggcgccgaggcagacgatcttcgcttcttccagcttcttgccggccagttccagcgcgttgagcatgcccgccgcggtcacgatggcggtgccgtgctggtcatcgtggaacaccgggatgtcgcactgttcgatcagcgcgcgctcgatctcgaaacactcgggagccttgatgtcctcgaggttgataccgccgaaggtgatggaaatacgcttgacggtatcgatgaaagcctgcgggctctcggcgtcgacctcgatgtcgaacacgtcgatgccggcgaagcgcttgaacagcacacccttgccttccatcaccggcttggaggccagcgggccgaggttacccaggccgagaatcgcggtgccgtcggaaatcactgccaccaggttgcccttgccggtgtactggtaggccagctcggcatcgcgggcgatttcacgcaccggctcggcgacacccgggctgtaggccagggacaggtcccgggcggtagcggtgggtttggtcagctcgacactcagttttccccggacggggttgtgcgtgatattcgagggcagcggttttaa

SEQ ID NO: 16207 - DNA, 2220 bp, Pseudomonas aeruginosa
gtgtcagacctgatcctacgcctagccctgccttcgccactccgccgcctgttcgactaccgcgcgccccgcggcattccgcgcagcgccctacagccggggattcgcctgctgctgccgttcgggcgccgggagctggttggcgttctgatagaggtgacggaccgttccgaagtacccgaagacaagctcaagcctgccctcagggtactcgacgccaagccgccgatgccggcgcacctgctcgaactctgtcgctggaccgcccagtactaccagcacagcctcggcgacaccctgtcctgggcgctgcccaacctgttacgccagggcgagccggccgaggcgcgccagcagcgcttctggcatgccaccgcgcaatccagcctcgacgatccgcgcctggcccgggcgccgcgccagcgccaggccctggcgattctcaagcagcatccgcacggggtgtcccatgagttgctgaaccagttgcagataaacaaggacagcctcgacctgctcaaggaaaaaggcttggtccaactggaggtgcggcgccacagcaccccgccgcgcgaaggcggctggctggcccaggcggagttgccgctgaaccccgagcagcgcgccgccttcgaggcggttcgcgccagccacggcggtttccattgcttcctgctggccggggtcaccggcagcggcaagaccgaggtctacctgcaactgatccgcgaaaccctggccgcaggccgccaggccctggtgctgattcccgagatcaacctggggccgcagaccctggcgcgtttcgaacgccgcttcaacgcgcgcatcgccctgctgcattcggccctgaccgaccgcgagcgcctcgacgcctggctcgccgcccgggatggcgaggccgacatcgtcatcggcacccgctcggcactgttcacgccgctgaagcgaccgggactgatcatcgtcgacgaggaacacgacgcctcctataaacagcaggacggcctgcgctaccacgcccgcgacctggcactggtacgcgcgcgcctggagaatgtgccgatcctgctcggttcggccacgcccgccctggaaagcctgcacaacgcccaggccggccgctacggcctgctgcgcctgacccagcgcgccggtggcgcgcacccgccgaagttcatccgcctcgacgtgaagagcatgccgctcgacgccggcctttcccgtccgctgcaacaggccatcggcgataccctggcggccggccagcaggtcctggtgttcctcaaccgccgcggcttcgctccgaccctgctttgccacgactgcggctggatcagccaatgcccgcgctgcgacgcgcggatgaccgtgcaccagggcagcggcgagttgcgctgccaccactgcgaccaccgccagcggccgccgatgaactgcccgcaatgcggcaagctcgacctgcgcccggtaggcgccggcaccgagcgcgccgaggaacgcctgcggattctcttcccgaaccatccggtgctgcgcatcgaccgcgacagcacctcgcgcaagcacgccatgcgcgacctcttcgccaccatcaacagcggtgagccatgcatcctggtcggcacccagatgctcgccaaggggcaccacttcccacgggtcaccctggtggcgatcctcgatgccgatggcggcctgttttccgccgacttccgcgccagcgaacgcatggcccagcagatcgtccaggtcgccggccgcgcaggacgcgccgaggagcccgggcgggtactgatccagacccacctggccgatcacccgctgctggtccagctcaccgaggacggctacttcgcctttgccgaacaggccctcagcgaacgccgcgccgccggcctgccgcccttcgcccacctcgccctgctgcgcgccgaagcgcacaagccgggccaggcggaagccttcctcgacagcgcctgcagtgccgccgagcaattgctcgagcagatgggcggaccggaggtggaactgctcgggccggtgcccgcgcccatggagcggcgtgccggcaagcaccgcgcgcaactgctgctgcagtgcatgagccgagcgccgctgcatcgcctgctgacgccctggctgcagagcctcgaacagttgcccggcgggcgccaggtgcgctggtcgctcgatatcgatccgatcgacctgttctga

SEQ ID NO: 16208 - DNA, 1938 bp, Pseudomonas aeruginosa
tcgccgcaacggttggcaacgcctgtccgcccacggataatgcgcggttctgagcctcgaccggccaccccgcgcacatcgcggggagtgaacttcggagcgccgcatccgccggcccttcccctgcccgaccgtcgcgcgccgcccctctgcccgcgagcacggagaaaaacgatgaaagacacgattcgccagctgatccagcaagccctcgaccaactgaccgcggacggcaccctgcccgccggcctggccccggacatccaggtggagaacaccaaggaccgtagccacggcgatttcgccagcaacatcgccatgatgctggccaagccggccgggatgaagccgcgcgacctggccgccaggctggtcgaggcaatccccgcccacgagcaactggccaaggtggagatcgccggccccggcttcctcaacttcttccaggatcacgtctggctcgccgccagcctcgaccgcgccctcgccgacgaacgtctcggcgtgcgcaaggcaggcccggcgcagcgcgtggtgatcgacctgtcctcgccgaacctggccaaggaaatgcacgtcggccacctgcgctcgaccatcatcggcgacgccgtcgcgcgcgtcctcgagttcctcggcgacacggtgatccggcagaaccatgtcggcgactggggcacccagttcggcatgctgctcgcctacctggaagagcaaccggtcgacgccgaggccgagctgcacgacctggaggtcttctaccgcgcggcgaagaaacgcttcgacgagtctcccgaattcgccgaccgcgcccgcgaactggtagtcaagctgcaggccggcgaccccgactgcctgcgcctgtggacccgcttcaacgagatttccctgtcgcactgccagaaggtctacgaccgtctcggcgtgaagctgagcatggccgacgtcatgggcgagagcgcctacaacgacgacctcgcccaggtggtcgccgacctgaccgccaagggcctgctcaccgaagacaacggcgcgttgtgcgtcttcctcgaagagttcaagaacgccgagggcaatccgctcccggtgatcgtgcagaaggccggcggcggctacctctacgccaccaccgacctcgccgccatgcgttatcggcacaacgtgctgcacgccgaccgcgtgctgtacttcgtcgaccagcgccaggccctgcacttccagcaggtcttcgaagtggcgcggcgcgccggtttcgttccggccggcatggagctggagcacatgggcttcggcaccatgaacggcgccgacggccgtccgttcaagacccgcgacggcggtacggtgaagctgatcgacctgctggaagaggccgagagccgcgcctatgcgctggtcaaggaacgcaacgagcagcgcgccgagcgtggcgaggagccgttcgacgaggtccagctgcgcgagatcggccgggtggtggggatcgactcggtgaagtacgccgacctgtccaagcaccgcaccagcgactacagcttcaacttcgaactgatgctgagcttcgaaggcaacaccgcaccctacctgctctacgcctgcacccgcgtggccagcgtcttccgcaagctcggccagggccgcgagcaactgggcgggaagatcgtcctcgagcagccccaggagctggccctggccgcacagctggcgcagttcggcgacctgatcaacaacgtcgcgctcaagggcgtgccgcacctgctctgcgcctacctatacgagttggccgggctgttctccagcttctacgagcattgcccgatcctcaccgccgaggacccggcgcagaaggacagccgcctgcgtctcgccgcgctgaccggccgtaccctggaacagggcctggagctgctcggtctgaagactctggaacgcatgtaa

SEQ ID NO: 16209 - DNA, 855 bp, Pseudomonas aeruginosa
tcgaacccgcccgaacaggagtccgggaacccccatggcaaagaagaaacccgcccccaagcgcggcgccagccgctaccaggcgcccgccgcgaagaacggcgttcccggctgggtctggctggtcgccggcctggccatcggcggcttcatcatgttcctgatgaagctcgaacccgggcgcaaggacgtccagcgcgaacgcccggacgcccagcgcccggccgccgccgtgcagggcaagcagccgcagcagaacggccaggcccagcagcccgcgcaaacgcagacgccggcccaggccaagccgaagtacgagttctacaccctgctgccggagtccgaggtcgtggtgccgccggaagcggtaccggagaaggccccgccgccgcccacccccgccgaactggccaaggccgacgaagcgcgggccaaggccgcactcgccgggcaggtgccaccgccgctgccgaaagcggtggtcgccgccagcacgcagttcttcctgcaggccggctcgttccgcaagcagtccgacgccgaccgcgtgcgcgcgcagatcatcctgctcgggcagtcggtgaacgtcgaggccggcaacgtccgcgacgagacctggtaccgggtgatggtcggcccgttcaacagccgcgaccagttgtcccaggcgcagaagacactgtcctccaacggcttcagcaacctgctgttacagcaacgcaaggcccgctgaacgcgggccacgccgtgcgttccgacgcacggcggtgcgtgcggttgaaaagccgcggatcgcccctatatctcccagcattccgggcattcggccccgcagtgtggagatttcccccttga

SEQ ID NO: 16210 - DNA, 1401 bp, Pseudomonas aeruginosa
ccatcgaggagctggacagcgccgtctgaagcgctcgtcccccgctggagtaaacgaatgtccatgacgccccgcgagatcgtccacgaactcaaccgccacatcatcggccaggacgacgccaagcgcgccgtcgccatcgccctgcgcaaccgctggcgacgcatgcaactgccggccgagctgcgcgccgaggtaacaccaaagaacatcctcatgatcggccccaccggcgtcggcaagaccgagatcgcccgccgcctggcgcgcctggcgaacgcgccgttcatcaaggtcgaggcgaccaagttcaccgaggtcggctatgtcggacgcgacgtcgagtcgatcatccgcgatctcgccgacgccgcggtgaagatgctccgcgaacaggagatccagaaggtcaagtatcgcgccgaggacgccgccgaagagcgcatcctcgatgccctgctgccggccgcgcgtcccgccatgggcttcggcgacgagccggcacgcgaggacagcaacacccgccagctgttccgcaagcgcctgcgcgaaggccagctggacgacaaggaaatcgacatcgaggtggccgacaacccggccggcgtggagatcatggccccgcccggcatggaggagatgaccaaccagttgcagaacctgttctccggcatgagcaagggcaagaagaagacccgcaagctgaaggtcgccgaggccctgaagctgatccgcgacgaagaggcggtgcgcctggtcaacgaggaagagctcaaggcacgcgccctggaggcggtcgagcagcacggcatcgtcttcatcgacgagatcgacaagatcgccaagcgcgccaacgccggcggcgccgacgtctcccgcgagggcgtacagcgcgacctgctgccgctgatcgagggctgcacggtgaacaccaagctgggcatggtcaagaccgaccacatcctgttcatcgcctccggcgccttccacctgagcaagccgagcgacctggttcccgagctgcagggccgcctgccgatccgcgtggagctcaaggccctcagtccgaacgatttcgagcgcatcctcaccgagccgcatgcctcgctcaccgagcagtaccgcgagttgctgaagaccgaggggctggccatcgagttcgccgaggacggcatcaagcgccttgccgagatcgcctggcaggtcaacgagaagaccgagaacatcggtgcccgccgcctgcatacgctgctcgagcggctgctggaagaggtctcgttcagcgccgccgacctggccagcgagcatagcgacaagccgatcctgatcgatgccggctacgtcaacagccacctcggcgagctggccgaggacgaggacctgtcccgctacatcctttga

SEQ ID NO: 16211 - DNA, 933 bp, Pseudomonas aeruginosa
cgtgccggtgcccgccgagttcatgagtgcacagagcgccatcgtcggcctgcgcggcaaggacctgctgacgacggtccgcagcctggctgtccacggcctgcgccagccgctgcacagtgcgcggcacctggtcgccttcggaggccagttgggcaaggtgctgctgggcgacaccctgcaccagccgaacccacaggacgcccgcttccaggatccatcctggcgcctcaatcccttctaccggcgcaccctgcaggcctacctggcgtggcagaagcaactgctcgcctggatcgacgaaagcaacctggactgcgacgatcgcgcccgcgcccgcttcctcgtcgccttgctctccgacgccgtggcacccagcaacagcctgatcaatccactggcggtaaaggaactgttcaataccggcgggatcagcctgctcaatggcgtccgccacctgctcgaagacctggtgcacaacggcggcatgcccagccaggtgaacaagaccgccttcgagatcggtcgcaacctcgccaccacgcaaggcgcggtggtgttccgcaacgaggtgctggagctgatccagtacaagccgctgggcgagcgccagtacgccaagcccctgctgatcgtgccgccgcagatcaacaagtactacatcttcgacctgtcgccggaaaagagcttcgtccagtacgccctgaagaacaacctgcaggtcttcgtcatcagttggcgcaaccccgacgcccagcaccgcgaatggggcctgagcacctatgtcgaggccctcgaccaggccatcgaggtcagccgcgagatcaccggcagccgcagcgtgaacctggccggcgcctgcgccggcgggctcaccgtggccgccttgctcggccacctgcaggtgcgccggcaactgcgcaaggtcagtag

SEQ ID NO: 16212 - DNA, 1092 bp, Pseudomonas aeruginosa
tgctggtcgccccgcatctgcgcagcgaggcccaacgctcggcggaaagcctggcgcagcgctacctgggaccggaatgaaaaacgcccggcgagtgccgggcgtgtgccttgccgccaggactcagccctggctgctcggcgtcgccggagcgttcgctgccggagcgctggcagccggtgtggcggcgggggcagcgggcgcgctcgaagacgcggcgggagcggccggtttcgccgcggcgggcttggctgccggcttcttcgccgcaggctttttcgcagccggcttggcggcaggtttcgccgcgggcttggcggcggtcgcagcggccggcttggctgcggcaggtttcgcagcaggcttcgccgcggccttggctgccggcttggtcgccggtttcgctgcggccttcgcagtcggtttggcggcgggcttggctgccggcttggcggccgcggttttcgccgcgggttttttcgccgcgggtttcgccgcaggcttggcggcggccttggctgccggtttagctgccggcttggccgctgcggttttcgccgcgggcttggcagccggtttcgccgcaggcttggccgctgccttcgccgccggcttgacgctgacgccggtgagtttctcgatctgcttggtcagcgtatcgaccttgctgtgcagctccttcacctcgttgcggctcggcacgccgagacgcgagatggcgctgttcaggcgcttgtcgaaagcttcctcgagctcgctccacttgccgagcgcacggtcccgaacctcgtcgaccttgctcttcgcagagcgggcggaagccttcgccgcaccgacctgcgcgtccacatcggacttcgcttctttttcagccttctcgccgtctttcaccaaggtctcgaacagcttgctgccgtccttgctgaccttcgagtaggcccccagaccagccagccagatctgccgcgagtatttctcgatctcgccgatccaactggactctttttcgctcttcttcttgccagccatcctgctctccttattgggttctcgcgacacgctcgagcactgcgctcagctcatccagcttag

SEQ ID NO: 16213 - DNA, 1866 bp, Pseudomonas aeruginosa
gcggaagatgggcgccgccaggacggcgaacgcccggcgggatcaggccagcgccttgtccagcgccttctcgatctcgcccttgagcaggccgctcatggccgacagcatcaggccgagcttgacgtccaccgcgaccttgtccgcccccaccgcgatcctgccgtcgacgccactgcgtttgaaggtcagctcgtcgccctgccattcgcactgcacgccgtgctccttcgccagacgttcggccagtttctccgccttggcccgtgcggcgtccagccccaggctgtgcggacgttcgatgtggatacgcgacatggatcgactcctgattgcagatcggaaaactatacgcggccagacaaaacaccgcacccgcgccgtcggacggcggcacagcactttccccacatcctgttagaatgcccggcattctttccaggtgagaacgtcatgaacgatccccgcaaaggcgccgacgccgaacccaccacccacttcggctaccagaacgttccggaaagccagaaggcgaagaaggtcgccgaggtatttcactcggtggcagccaagtacgacctgatgaacgacctgatgtccggtggcatccatcgcctgtggaagcgcttcaccatcgagctgtccggcgtgcgcagcgggaaccgcgtgctcgacatcgccggcgggcaccggcgacctgacccggcagttctcgcgcctggtcggcccgaccggcgaggtggtgctggccgacatcaacgcctcgatgctcaaggtcggccgcgacaagctgctcgacaagggcgtctccggcaacgtcagcttcgtccaggcggacgccgagaagctgcccttcccggacaaccacttcgactgcgtgaccatcgccttcggcctgcgcaacgtcacccacaaggacgaagcgatccgctccatgctgcgcgtgctcaagcccggtggccgcctgctggtgctggagttctccaagccgagcagcaacctgctgtccaaggcctacgacgcctattcgttcagcctgctgccgctgatgggcaagctggtcaccaacgactccgagagctatcgctacctggccgagtcgatccgcatgcaccccgaccaggaaaccctgaaggcgatgatggtggaagccggcttcgaccgcgtgacctaccacaacatgaccggcggcatcgtcgccctgcaccgcggtatcaagccttaaccgagggcgcgccgatgagctcgctgctgatccaggccgtgctggccaccgccgaaaccggcatcaatcgcgtcctgcgcctcgacgggacagcgctgccgcgcctgcgcaggctttccgccaaggtcatcgaggtcgactgcctgagcccgccgctgcggatcttcatcctgcccgccggcgacggcctgcacttcgccgcgcagcatgaggcggaggtcgactgcaccctgcgtgcgccggccggcaacctcctgcacctggccctggcgcgcgacaagacccgcgtcctgcacagcccggaagtcagcatggacggcgacagcgcggccctgctggaactggccggcatcctgcagagcctggagctggactgggagtacgaactgtcgcgctggctcggcccgctcgccacccaggtgctcggcagcggcctgcgcgacgcttcgcgctggagcgcgcagagcctgcacagcctgcgcctgaacctggccgactaccttgccgaggaaagccgtacgctggtcggccagcacgaagccgaagcacgcttcgccgaactggaccagctgaagctggccctcgatcgtctcgacgcgcgcgtcggacgcctcagccaaaagaccaagcccgacgcatga

SEQ ID NO: 16214 - DNA, 501 bp, Pseudomonas aeruginosa
gcccgcgccgatagccagtcgcgctcccggctggcacactactcccatttccgccggaaacgcgcgcaacgtaccggcaacgaacgtggaaagaccatgaaagactggctggatgagattcactggaacgccgacggcctggtcccggcgatcgcccaggatcacgagaccgggcgcgtgctgatgatggcctggatgaaccgcgaggcgctggccctgaccgccagcgagaaccgtgcaatctattggtcgcgttcgcgtggcaagctgtggcgcaagggcgaggagtccgggcatgtgcagaagctgcacgaactgcgcctggactgcgacgccgacgtggtcatcctgatggtcgagcaggtcggcgggatcgcctgccataccggccgggaaagctgtttctaccgtgtcttcgagaatggcgcctggaagaccgtcgatccggtgctgaaggacccggacgctatctacgaacacgcaggacaccaccatgagtga

SEQ ID NO: 16215 - DNA, 603 bp, Pseudomonas aeruginosa
caccctgacccgcctggcggcggtgctcgaggagcgcaagaacgccgcgcccgacagctcctacgtggccagtctgtaccacaagggcctgaacaagatcctggagaaggtcggcgaggagtcggtggaaaccatcatcgccgccaaggatgccgcagccagcggcgactgccaggacctgatttacgaaaccgccgacctctggttccactcgctggtgatgctctcggccctcggccagcatccgcaagccgtgctggacgaactggagcgccgcttcggcctttcccggccacgccgagaaagccgcccgccaaccatcggcctgaacctacacattgcgaggaatacgacatgggcatttttgactggaaacactggatcgtcatcctgatcgtcgtggtactggtgttcggcaccaagcgcctgaagaacctcggttccgacgtcggcgaagcgatcaagggcttccgcaaggcggtgaacaccgaggaagacgacaagaaggaccagcccgccgcccagccggcccaaccgctgaaccagccgcacaccatcgacgcccaggcgcagaaggtcgaagaaccggcgcgcaaggactga

SEQ ID NO: 16216 - DNA, 600 bp, Pseudomonas aeruginosa
tccatgagcgccgataaacccgagcagcccgagcacgaccaggaaatgcccctggtctcgcacctgaccgaactgcgtacgcgcctgctgcgcagcgtggcggcgatcttcctgatcttcgccggcctgttctacttctcgcagaagatctacaccctggtctccgagccgttgcgccgcttccttccggaaggcaccagcatgatcgccaccgacgtcgcctcgccgttcctcgcgccgttcaagctgaccatggtggtggcgctgttcctcgccatgccggtgatcctcgcgcaggtctggggcttcatcgcgcccggcctgtacaagcacgagaaacgcgtggcgctgccgctgctggtgtccagcatcatcctgttctacgccgggatggccttcgcctacttcctggtgttcccgatgatcttccacttcttcgccagcgtgacgcccgagggcgtggcgatgatgacggacatcaacagctacctggacttcgtcctgactctgttcttcgccttcggcgtcgccttcgagatcccggtggccacggtgctgctgatctggatcggagtggtcgacgtcgagtacctgaagtag

SEQ ID NO: 16217 - DNA, 207 bp, Pseudomonas aeruginosa
atccgcccgtacgtgatcatcggctgtttcgtggtcggcatggtcctgaccccgccggacatcttctcccagaccatgctcgcggtgccgatgtggctgctgttcgagatcggcctgctgttcggccgcctggtacgcaagcgcggcgagcatccggacgaccaaccggccagcgacggcgaccagcctccggccacccgccagtga

SEQ ID NO: 16218 - DNA, 2133 bp, Pseudomonas aeruginosa
aggttttccccgcccggccgacatcctctgtcgcgcagggctccgcacgacaaccataagacctcgcccgccggccacgtaccggccctccgcgcccgcacgccggacgcgacgacgctgagccattacctgttccgccacgccatggggctgccaacccagggtgtcgcactgcctggagtaatgacgatgtacgattggtgggttctccaactggccaagctgagcgtcagccgcaagctgatggtcggtttcggtgtcctcctcgcgctgcttctgctggtggtgatcagcagcaaccgcaccctcacgcaccagaccgccctcagcgagcagctcgccgaagtcgccagcctgatggaacagacccagcaagccgaacaaggccgcctggcattcgaagccggcagcgacccgcgccaggccgagcaggtccgccagaccctggccgggatgctccagcgcctgcaggcgctgcgcgacagcgagctcgacccggccgccctggcccaccagaccgaagccatcgaagcctaccgcaaggctttcgacgacctcgccgcagccgatcagcaacgcagcgccgcccgtggtgtgctggtgggcactgcacagcaggcgctggacagcttcgcccgcctcgaggaactgatggacgccagcctcgcgcagcaggccggcgacccgcaggcgttgcaacgtagccgtgcggtggccgacctgcaccaacagttgctcatggtgcgttaccaggtgcgcggctacgtcttcgaacgcagcgacaaggccgagcaggccgcgttcgccgcgttcgacgccctccgccaggccgccacgacgctgcgtggccagttgcccggcgaggccgatgcggcgctggaacaggccatgggtagcctccagggctatcgtggcgggatcgagcagttccgtgccggcgtcatccgcacgcgccaggcgcagcaagcgatgcaaagcagcacccaggatatggcccgggccggccggaccctcaccgaagccggtcgccaattgcgcgagagcaccgccagccgcgaccgcgccagcctctggctgatcgccgcgctggccctggccttcggctgcgtcgccggctgggcgatcaaccggcagatcgtccggccgctggacgaagccctcgcgcaggccgaggccatcgccgccggcgacctcggcaagcgtccgcagaatcccctgaccctccagcgccgcgacgaactgggccaattgcagcgagtcatgcagcgcatgggcgacagcctgcgcgagctggtcgggcggatcggcgacggcgtcagccagttggccagctccgccgaggaactctcggcggtcaccgagcagacccgcgccggggtcaacagccagaaagtggagaccgaccaggtcgccaccgccatgcacgagatggccgccaccgtgcaggacgtcgcgcgcaacgccgaactggcttcccaggccgctcgccaggccgacgaagaggcgcgccagggcgacgcggtggtcgaccaggcggtgacccgcatcgagcgcctggctagcgaaatggacgtttccagcgaagccatggcgcgcctgaagaacgagagcgagcagatcggcagcgtcctcgacgtgatcaagtcggtggccgagcaaaccaacctgctggcgctcaacgcagccatcgaagcggcacgcgccggcgacgccggacgcggcttcgcggtggtcgccgacgaggtccgcggcctggcccagcgcacccagcagtccaccgccgagatcgagggcctgatccagcgtctccagcagggcgccggcgaagccgccgaacgcctggagaacagccgctcgctgaccgccagcacggtggaactggcgcgccgcgcgggcgccgcgctggacagcatcacccgcaccgtctccgacatccagaacatgaacctgcagatcgccactgccgcggagcaacagagcacggtggccgaggagatcaaccgcagcgtcctcagcgtacgcgacgtcgccgagcagtcggccgccgccagcgagcagaccgccgcctccagcggcgagctggcgcgcctgggcacgcagttgcaggcacaggtgggacgcttccgcctgtaa

SEQ ID NO: 16219 - DNA, 498 bp, Pseudomonas aeruginosa
aggacctggcggaggaaggcctgggcccgcgggtcctgcggattgtcgaagaactgcgccggcggcgcgtcctccagcagcttgccgtggtcgaagaacagcacgcggtcggccacttcgcgggcaaagcccatctcgtgggtcacgcagaccatggtcatgccttccacggccagggtcttcatgacgtcgaggacttcgccgaccatctccggatcgagcgccgaggtcggttcgtcgaacagcatcaccttggggtccatgcacaacgcgcgagcgatcgccacgcgctgctgctggccgccggacaggcgcgagggatattcgtcggccttctgcccgatgccgaccttggccagcagcgcccgcgccttggcctcgcgctcggccttgccgcgcttgcgcaccacgcgttgggccaggcagaggttctcgagcacggtcatgtgcgggaacaggttgaaatgctggaacaccatgccgacttcgcggcggtag

SEQ ID NO: 16220 - DNA, 807 bp, Pseudomonas aeruginosa
gcattgatgtcggtcctcgggtcggccaggtcgacgccgtcgatgctcaccgagccttcgtcgaactcctccaggccgttcaggcagcgcaggaaggtcgacttgccggaaccggacggaccgatcaccaccagtacctcgcccctggccacgcgggtactcacgtcgtccaccgcgcgcactacctggccgcgggtatcgaagaccttcagcaggttgcgtacttcaatcactttgtccgagcctccgctccagtcgggatgccatgtgcgaaaggggcaggttcaacagcaggtacaacgcggcgacgcagaaccagatctcgaaggtggagaacgaggtggtgatcgcctcgcggccgctcttggtcagttcggtgatggcgatcaccgagaccagcgaggtgtccttgaccaggctgatgaactgcccggccagcggcggcagcacgcgcttgaaggcctgcggcaggatcacgtagcgcatcgactggccggcgttcaggcccagggagcgggcggcctcgttctgtccgcgggcgatggactgcacgccggcccggatgatctcggccacgtaggcgccggtgaacagcgccagcgccgcaaccccggcgaactcgcgggacaggttgagcacggtgccgatgaagaagtagaagatgaagatctgcaccagcaacggcgtgccgcgcaccagctcgacgtagatcgtcgacaggccgtgcagggtcgggttcttcgacagccggcagaggccggcgaccaggccgatagccagaccgatggcaccggacaccagcgatag

SEQ ID NO: 16221 - DNA, 645 bp, Pseudomonas aeruginosa
gtgtactcgtcggtggcgcgcagctcgcgcggcgtgtcgtactcctccgggatcaggaacagcttttcgtcgcgggcgcgcaggcccagcttcacccggctggagatcaccgataccgggatcgacaggatcagcgaaccgacgatcggcgacagccaccacaggaagcgcgggttgagccaggccaccagcagggtccaggcgatacccagtagagtctgcatgccgtgccggcggatcgcctcgctccagggcgtggcgtcgtcgtcgcgctgcggcgagttccactgcaccgaccagccgaggaaggcggcaagcacgaagcgggtgtggaagagcatgcgcaccggcgccagcagcaccgagaagaacatctccaggagcatgctcagggtcacccggatcaccccgccgaaacccttggcgcccttggcccagatcagcattacgctgagcagcttgggcaggaacaacagggtcagggtggtggagaacaacgcgatggccttctccggatgccactgcggccagatcgggaacagctgccgcggttccaggaagtactgcggctccatcagttggtgcaccgccagcagcgcggtggaaagcaccaggaagaagaaccacaacggcgccgacaggtag

SEQ ID NO: 16222 - DNA, 1590 bp, Pseudomonas aeruginosa
tcggccagcggtgctttcgtagtggatgggttattcatcggcaggcagctgatagctccaggtttcgctcagtggcttctgcgcctcgtcgaccagcgccgcgcgcatttccaccggtttcttcggatccttgaccttgatccgcagcgtcaggcgccagcctttcaggaccgggttgtaacgcaggctgttctccaccacctcggcgttgctgtcggtgctgacctgggtggtcaccggcgcgtccggcgccaggtccttcagggccggcccttcgaagtcgacgaccagggcggtgctgccgtcctgctggcggatcaggttcttctgcttcacgtcgccgaccgagcgcatggtctgcttgacccaggaggatttcgggtcgtgcagctcgtcttcatccatggtccagtgcaggcggtaggcgaagtccagcggctttccgacctcaggctgggtctcggggttccagaacgcgacgatattgtcgttggtttcgtccggggtcgggatttccaccagttccacggtgcccttgccccagtcgcccttcggctcgatccaggcactcggacgcaggtcgtagcggtcatccaggtcttcgtagcgggagaactcgcggccgcgctggagcaggccgaagcctttcgggttctccacgctgaaggtgctcaccgacaggtgcttcggattgttcagcggacgccacagccactcgccgttgccggcatggatctgcaggccgctggagtcatgcagctcgggccggaagttgtgctgctcggacggctggttggagccgaacaggtacatgctggtcagcggcgccaggcccagcttgctgaccttgtcgcggaggaacacgcgggcctggacatccatcaccgcatccttgcccggacgcagcacgaagcggtaggcgccggtggcccgcggcgagtcgagcagggcgtagatcaccagttgcttgtcctgcgccttcggccgctcgatccagaattcgcggaagcgcgggaactcttcgcccgaaggcagcgcggtatcgatcgccaggccgcgcgccgacagaccgtagacctggcccttgccgaccacgcggaagtagctcgcgccaaggaaggtggcgatctcgtcctgcttgtcggccttgttgatcggatagagcacgcggaaaccggcatagccgagatccttggtggcattctcgtcgaacttcagggatccgaaatcgaacttggtgcgatcgtacttgatcggcttgaccgtggtagcggtcacctcgttgatcttcaccggcgtgtcgaagtgcatgccctggtgatagaagctcagcttgaacggcgtcttcagcttgccccagtaggcgcgctcgttgatgaaacggatctgctggtaatcggcgaatttcatttcgctgaattccgatggcaggttgctggtcggcgcggaatacttgtcgccggccaggtccttggccttgctcgccacgtcgtcgatgctgaacgcccataccggggcggcgacgaatgccagcgcggtcgagccggcaagcagcagggtgcgcacgcgggcgcggaaatcggtgtttga

SEQ ID NO: 16223 - DNA, 708 bp, Pseudomonas aeruginosa
caaaaggccatgtatctgtcacaaaaattcaccgttccggccccgccatccctccctgaagcaccttggggaaaatcccctcgacgccgatcaactctccagcaggaaggtcaccggcccgtcgttgaccaggtgcacctgcatgtcggcgccgaaacgcccggtcgccacctgcggataggcctcccgcgccagtttcaccaggtgctcgaacaccgcctctccttgcgccggcggcgccgcgctggagaagctcggacgcagtccgctgcgggtgttcgccgccagggtgaattgcgagaccagcagcaagccgccctgcacgtccagcaaggaccggttcatcttgccctcgtcgtcgccgaacaccctgtagttgagcagcttgtgcagcatcttcgccgcgcaacgctcgccatcctcgggctcgaccccgaccagcaccagcaggccgcgatcgatggagccgacgatttcgccgccaacctccacccgcgccgcgccgacgcgctgcagcaatgccttcattcggcctccggcggcaggtcgagcagtcgccggccgatctcgttggtggcgcgcaccagcgcatcgactatccccggctcgctggcggtatgcccggcgtcgcggatgatctgcagttcgctgttcggccaggcctggtgcagggcccaggcattgtccagcggacagatggcgtcgtag

SEQ ID NO: 16224 - DNA, 687 bp, Pseudomonas aeruginosa
ggtttaatttccggatacagaactagcatgatgcgctcccgaggcgatgtgttcggcccccggcgcaaacgtcgacagcggggcccgtcctttgctctgccgcgcatgatacttcggcgccgggaaaaaaaccgagcggctttcatgtccgccccggtagaggggaaaccatcaatccaagcaacggcgcctggcgccgggagaacgagcatggccgaggccttgcgacaccgtatccgcgccgccggcctgctggtggtggagcaacgcatcctgctggtccgccacgaggtcggcggcgacatctactggattccgcccggcggcggcttcgagtcggaatgcgacgaatcgacgaaggataccgtccggcgcgagtttttcgaggagaccggcctgcgggtggacgtcggcccgctggtctacgtgcgcgaattcgccgaacccgccgccgggcgcttccacatggagctgttctaccgcatcgacgcctggcgtggcgagccgaccctggccaacctgaagggcctgggcggcgacgagttcgatatccgcgaagtcggctggatcgcccgcgacgaactgcctggcctgccgtcgttctatccggccgaactggccgacgacgtctggtcgcgcctggacgcgccgacgccgtcgatccgccacctcggcctgcagcgctag

SEQ ID NO: 16225 - DNA, 579 bp, Pseudomonas aeruginosa
tcggcctcgatgagatcgccgccgacctcgacgccacgcaccgccgcgccgccctcgacgatcttcgtcaccctgcggccatgcagttgccggcaatgtccggaagcctgcaagcgctcggcaagttgcacgcagaaggcatggcagtcggcgacctcctcgtccggcgtgtggatgccgccgacgaagggcgcggcggacagggccggctccagcgcgaggcactcggcggcggtcaggacgaattgcgccgaaggatcggccaggccctggcgggcccgcgcaaagctggccggttggcgaaacgccaccagcttgccgttgcgccgccagtcgaagccatcgaggccatcctcctcgcgccagtcctgcagggtgcgctggctgagcaatgccaggcgcagcaggtgcgcggcattgcggcggttcagcgagccgcggcaggccgcgaggaagcccagcagccagcgccactgcgccggatcaagacgcggccgcaggcgcaacggcgcatcgttgcgcagcagccagccgagcgcctgggccggcacgccgctgtcggccaatggcgccacgtag

SEQ ID NO: 16226 - DNA, 1026 bp, Pseudomonas aeruginosa
gccatgacaatcgttatccaggtgttttccaggacttcgacgataggcgcggatgacagcggtaggacaatgaataaagatggccagggtataaatccaggttatgggatcgcgccgatgaagctccgccatatcgaagtgttccaggcgatccgccaggctggctcggtcagcggcgccgcacagttgctgcatgtgtcccaaccggcggtgagcaaggtcctgcagcacgccgagcagcaactgggcttcccgctgttcttgcgagtgcgcggcaagctgctggcgactccggaagcgctggaactggagcgcgaagtggccaagctcagcgatagcctgcaggcggtgcggcgcctggcgcagaacctgcggcgccaaccgggccacagcctgcgcatcggcgccaccccggccctggcgctgtcgctgctgccgcgggcgatcggcgaatggagcgcgcgctatccgcagagcggctgcgaactggccaccttgcattcgcgcgagctggtgcagggcctgctgatgcgcgaactggacctggccctaagcctgaagcagccggaacaccccggcctgcgcggcgaagccatcgccagcggcgtattggtggccctggcgccgcgcgaacactggcccgaagcggaacgccggcagccgctgagcctggccgggctggccggcgaagcgctgatcgggctgtccaccgccgacccgctgttcgcccgcctggaggattacctcagcgccgtggagccaccgccgcaggtgaagatcgccgtgcagacctacgccctcgcccgcgccctggtggaggctggggccggcctggcgctggtcgatcccttcaccgccctcggcgccgacccgcacagcaccgcaatccgcccattgagcccggccttcccggtcaccctctacgccatcacccgcgccgacgaaaccccgccgcacaccctcgctccgctgctgcggatgctcgcccgccaggccgaggagcgtttgcgggccgtgcagatgtag

SEQ ID NO: 16227 - DNA, 1554 bp, Pseudomonas aeruginosa
gttttccctgacctgcttcaactgctcccgcttttcccgcaagtcatgcgccaggtcgcgctgtacctgcggcatcagttgctcctggcccaggcctttcatcatgtcgtaggtggtcttcgaggcgtcgctggagtcgggggtgttggtcacgacgaacaggtacaggtcgccgggcacgccccgggccttgcgcacctgcgcagtcttccgcaggcgctcggcgaagccggcataacggaagtactggttttccatgtagacgtagtcggtggcattgcccagggccttgagatagtgctccaggatcgagcgctcgtcgtcctgcggctgggtccggcaaatctgcgcgacgctgttgctggtgggcgtggcgatcttcggcagcggcaaggcgtcgcgctcggcggtcagcgatggcgtcgagaaccagcgcttgtaccacggcgtctcgaggtcccaggcctcgctgaagttgcggctgaggtcggccagcaccggtccctggacctgcatggagatatcctgccagggcccgaacccgggatcgcgaccggcggcgcggtcgtcgaacaggtgggcgctggtgtcccagtagttgcggtgcatgttgtgacccatgacgaagccgatggcctgcgggctgccatagtcgaccaggaccatcttctggtgatggctggcgaactgggtgagtaccagcaactggccgatgcccaggtcgtcgatgccatcggcgcgcagcaggtggatcaggctttgcagtcgcccattgacgaggcgcacttgctcgccgttcatcaccggtctggccgtctgctcgaagtcgcgggtacggaactcgacgttctgcaacccaccgccgcgtaccgccttgaaccagtcgcgggtgaatatctgcccccagggatcctggcgggtgccgccggaaccgcgcttgccgccgtagccctgggcctcgctgctgtcgagagtgcgctggatctcggcgttctccgcctccagctcggcgatgcgcgcccgcgcgtgggcggcgccccgcgggtcgaagctcggcagcctgccttcgcggtgcagccgttccgagcgctccagggcttcctgctgccgcgcgatgaggttgaggttatgctggcgccgctgctccagtcgcagcacctcgttgtccaccgcgctgccgctggcgacgcccgagcccgcccaggtgccgccggaaccgccgacgccggccccggggatggtgttttccttgagcctggcgagttggttgctccagaccagcactcgcgcctgcactccttcgcggcccttcgtctgcagcaattcgccgattcgcggtccgtcggggcgtttgaaacgcatggccgggtcgaagccccaggtgatgatgtcgatgctgtgccgggccgcctccatcgccgcatgcaccgcgtcgaaggccgcctggccattgatcagcggcttgatgtgcacacccgcgcgcggcgggtagaaagccttgttggcgaaccagtcgagggtcagccggacgctgccggcctgttgcgcgtatag

SEQ ID NO: 16228 - DNA, 633 bp, Pseudomonas aeruginosa
agccggggaatgtgccagtcggtatcggtcagcgcccgcgcctcctccaccaggccggcgtccaccgccggggtcaggcgcgtgccggggtgcggcatgctgatcagtagcggcacacggccgcgcttgaaactcaggacttcatccacggtatacctcctcggcgtggcgaatgacgcgtttcggcagatcgccgcccagccagtaggccagctccgccggacgctcgatgtcccaggcgacgaagtcggccagcttgccgacctccaggctgccgtgactggcttccagccccagcgcccgggcggcgtgcagggtgacaccggccagcgcctcctccggggtcaggcggaacagggtacaggccatgttcagcatcaggcgcaacgacagcgccggcgaggtgccgggattgagatcgctggcaatggccatggccacgccgtgccggcgcagggcatcgatcggcggcagctgggtctcgcgcagcaggtagaaggcgcccggcagcagcaccgcgacggtgcccgcctcgcccatggcgcgggcgtcgtcctcggtcatgtactccaggtggtcggccgacaaagcccggtagcgcgccgccaggctggaaccgtgcagcgaggatag

SEQ ID NO: 16229 - DNA, 1011 bp, Pseudomonas aeruginosa
catcttgcgctcgctggccaggtcgaggccgtagccggacttgatctccagcgccgtcacgccgtcgcgcagcaagggctccaggcgcttgcgcgcgctggccagcaattcttcctcgctggcctcgcgggtggcgcgtacggtgctggcgatgccgccgccggcggcggcgatctcggcgtagctgacgccctccaggcgctgctcgaattcgccgctgcggttgccgccgaacaccgcgtgggtgtggcagtcgataaaccccggggtcagccaggcgccatcgaggtcgatgcgttcggcgtagtcgtcgggcggcagttcggcgcgcgggccgatccagtggatcagcggaccgtcggtgaccagggcggcgtcctcgacgatcgagtacttgccgcccttgagggtggcggcatggcaatgctgccagagtcgtttcattgcaggtctcctatgctcgcggccagccgggcgagactcttccgctcgccgaggatggccgccgcgctggcgatgtcgggagccagccagcggtcggtgtcgtacgcgggcacgcgctcgcgcaggatgccccaggccgccgcggtgccctggccgaagcgttgcggggcgaggaattcgaaggcctgggcggccagcaggtactcgatggcgaggatccgccggaggttctccagggccctgccaagcttgagcgcggcactggtgccgaggctcaggtggtcctcctggagcgccgaggtgacgaagttgtcgaccaccgccggctgcgccagctggcggttctcgccagccagggaggcggcgacgtactgggtgatcatcatccccgagttgactcccggcttgcccaccaggaacgccggcaggccgctgaccagcgggttgaccaggcgatccaggcgccgctcggcgaccccgcccagctcggccacggcgatcgccagcaggtcggcggccatcgccaccgattcgccgtggggattggcctgggataccacccggtag

SEQ ID NO: 16230 - DNA, 471 bp, Pseudomonas aeruginosa
gcttccggcgtacccagcagcagcgggttgtcggtggccgagttgagttcggtctctatctgccgcgccgcgtgggccaactggtcacggcaggcgccatggatctgcggtatcgagcggatgctcagggcatcctgggtgcggatgccgcgggcgttctccagtacctggctgccagccagcaaggctcgcagattgacggcgacccgctgcatcccgggatgcggcttgagcgcaacgatctcggcgtcgaacgccgccagttggccgcgcagggcctcgaagctcatcgccccgatcacgtcggcccactgcgccaggcgctgcgcgtcgtccagggccaggcaggcgaggccggtcatgcacggcgtgccgttgaccaggcagagcccgtccttggctcccaggcgcaccgtcgccaggccttccgccgccaacgcggcggcggccggcacgacgctgccgcggtag

SEQ ID NO: 16231 - DNA, 2988 bp, Pseudomonas aeruginosa
acacgttcttcacttcgatcttgttcatctgcgcaccgctcatttgctcgtctcgtgccgggaacggccataggcctgggtgatgcggtcgatcaccaccgcgaggatgacgatcgccaggccggcttccaggcccttgcccacgttcagcgtctggatgcccaccagtacgtcttcgccgaggccgcgggcgccgatcatcgaagcgatcaccaccatcgacagggccatcatggtggtctggttgatccccgccatgatgctcggcagggccagcggcaactgcacgccgaacagctgctgccagcggttggcgccgaaggcgttgaccgcctccatcacctcgctgtcgacctggcggatgcccaggtcggtgaggcggatcagcggcggcgcggcatagatcacggtggcgaagatcgccggcaccttgcccaggccgaacaacatcagcaccgggatcaggtacacgaagctgggcatggtctgcatgatgtccagcagcggcatcagcaccgcgcgcaggcggttgctgcgcgcggcgaggatgcccagggggatgccgatcagcaccgagatgaaggtcgccaccagcatcagcgcgagggtctgcatcagcttgtcccagaggccgacggcgccgaccaggaacagcaggccggtgatcaccagggtcggcagcaggcgccgggtggcgtgccaggcgatcgccgcgacgatcgccagcaacagccaccagggcgtggcgcggagcagcccttcgaggttgacgatggcccacagcagggtgtcggagatcttgcggaacaggtcgccgtagttggtcaccagggcgtcgacccaagcgttgacccagtcggcgatggaaaatgtcaggcgttcgggaaacatggtctgctctcgtcggtcgtgggttcagagtgccgcttcgatcttcttcgccgcgtcctcgtcgacccaggcgtgccagacctcggggtgctccttgaggaactcgcgcgccaggcgcgccgcatcgatccggtccttggccatccgcgccaggtcgctgttcagcagctccgccggcaggttgaccttctccagcaccgccaccagctccggcgcctggtcgtggaaggtccgcgacaggccgacctggatcctgatgcgcttgtcgacgccgggcctttcctccaggcgcaccaggtcggcgcggcccatcagcggcgtcggcgaccagtagtagaacaggataggctcgccgcgccgatagctcgacagcaccgccgcgtccagtgccgggccggtgcccggacggaaattggtgaacgtctcctccaggccgtagcttttcagcatctcgctgttctccagctcgcaggtccagccggccgggcaattgtagaagcgccccttgcccggctcttccgggtcgcggaagacctcggcgtactgcgccaggtcggcgatagagcgcagcttcggcgccttcgcctcgagcttgcgctgcgggtcgccctcgatcacgtagcgcggcacgtaccagccctccaccgcgccgacgatgggttcgccgacgccgaccaccttgccggccgcggcagccttgttccaggcgtcgctgcggccgatccactcctcggcgaagacctggatgtcattggtgctcagcgcctgctccatggtgatcgagttgcccggcaggctgtcggtggtacagccgtagcccttggccaggacgaactgcatcagttcggtgagcagggtcccgctctcccagttcagcccggcgaacttcaccgccttgccggactcgcaccagccttccgcctgggcgcccgccgcggcggcgagcaggccgagggcacagagaacactcaacatcgacttcttgtatcgcatggttcgacgctccagatgcacgattgggaaaggcagttggaaaacctgcgggccgcgcccgggggaacggcctcgatcgttgttattggccggcggcccaggccgccgtcggttccgtcacagccctccctgggcctgaagcacgccatgcgcggcatcgcccttcggcctgacccagcgccggtaggcgatcaccagcaaggcgatccagatagccccgacccacagggccgggcgggtgtccgggaaatagccgagcaccacgaagatgaacagcatgaagacgatcgccgtcgccggcgcgaatggccacagcggcaccgggaacttcagcgcggcgacctggcgcggccctatgcgccggcgcatgccgacctgggccaggaggatcatcagccagacccacacggtggcgaaggtggcgatggacgcgatcaacaggaatacgctctgcgggatcaggtagttcagcgccacgccgagcagcagggccaccgccatcagcagcacggtcatccacggcacgccgtgccgcgacacccgcgagaagccgaccggcgcctggccctggcgggccatgccgtagagcatgcgaccggcgccgaagatgtcgctgttgatcgccgaaatcgccgcggtgatcaccacgacattgaggatcgccgcggccgactcgatccccaggccgtcgaagatctgcacgaagggactgccgttgctgccgatctgctgccaggggaagatcgccatcagcacgaacagggtcagcacgtagaacagccggatgcgcagcggcaccgcattgatcgcccgcgggatcacccgctgcgggtcctgcgcctcgccggcggtgatgccgaagatctcgatgccgccgaaggcgaataccaccagcgacagggaggcgaccagcccgggcccagccgttgggcaggaacccgccgtgctgccaaaggttgtgcacgccggtggcgggagtcgccgccgccgcccaagctgaagccgaagaacaagatgccgagcccggggagaatcatcgcgaagatggcaccgaccttgaccagcgacagccagaactccagctcgccgaagaccttgacatga

SEQ ID NO: 16232 - DNA, 798 bp, Pseudomonas aeruginosa
cgggcgttcagtccgcgccgaagccccgtgtcgtgcgtcatccctcggctctcctcttgttgttcttgctggagcgccccggccgagcggccgggggcgggtatcaaagactcggcaacagccgggccggcagcagcgcgttcaggcaaccgctggcgagcaactggctggcggcctcgatatcaggggcgaagaagcgatcctcctggtagtacggcaccttgtcgcgcagcaggcggcgagcctgctccagcttcggcgaactcttcaggccctcgcggaagtccaggccctggcaggcgcccagccactccacggcgagaatcccgcgggacgttctcggccatcgcccagagccgtttgccggcgttcggcgccatcgacacatggtcttcctggttggccgaggtcggcaggctgtcgacgctggccggatgggccagggccttgttgtcgctggccagcgcggcggcggtgacctgggcgatcatgaagccggagttgaccccgccgttggccaccaggaacggcggcaactgcgacatgtgcatgtccatcatcagcgagatgcgccgttccgacagcgaaccgatctcggccaacgccagggccaggttgtcggcggccatcgccaccggttcggcgtggaagttgccgccggagatcacgtcgccctcggcggcgaataccagcgggttgtcggacaccgcgttggcttcgatctccagcacctcggcggcctggcgcatctgggtcaggcaggcgcccatcacctgcggctggcaacgcagcgaatag

SEQ ID NO: 16233 - DNA, 270 bp, Pseudomonas aeruginosa
ccatgtccgggcgtacgccgcggcgaaccagttccggaaggatctcggcggcattgcccagcagggcgatggagatggccttgccttcggcggtgtagcgctggatccgcgccagggcgtcgtccaggtccttggcctgctcgtcgacgtagcgactgcgcaggcggaagtcgatgcggctctgctggcactcgatgttcagcgaacaggcgccggccagggtcgccgccagcggctgggcgccgcccatgccgccaaggccggcggtaa

SEQ ID NO: 16234 - DNA, 1278 bp, Pseudomonas aeruginosa
agggaggcgaacggcaccagtcccgccagtaccggccaaccccagcgctcatactggctggcgagcagtgcccaaccgccgtacaggcaggccgatcagcagccaggtcggccattcgctgcgcgcctggaaggtatcctggagccgccgcaccagggtgcgctgacgcccgctcaggtagtgcgccatgaaggctggcgaggcttacttcagggaggtatcgaggcgcgcggcgacttcggccggcacccagtggctccagatttcgcgatgctggcgaagaaactgcgcacgcacctcgccgacctcgcgatgattctgcgccatgtcggcgagcagctcgttgaacagcggcaaggggatctcgaccttgcggaacagctcgaccaacgccggcgccttgtcatggaaatcgcgggaaacgccaatggtgatcttcgccggcaacgagcgggaaccgatggggtcggggttcttcggatcggacagggtggcccaggccttctcgctgaacggcggctcttccagttgcaccagcttgaaacggcccatcaacggagtcggcgaccaatagtagaaaagcaccggctcaccgcgccggaaggccgcactgatcgccgcatccagcgccgggccggtgccggtgcggaagttcgtgtagctgtcctgcaacctgtaggccttgagcttctggctgttgacgatctcgcaggtccagccggtcgggcagttgtagaaacgccccttggcgggctcctcgggatcgcggaacagcgccttgtagcgcggcaggtcggcgaccgacctcaactccggcgccttcgcctcgatgcctcgttgcgggtcgcccttgaccaggtactccggcacccaccagccctcggtggcgcccttcaccgtctcgccgacggagaacacctcgcccgcctcctccgccgcgcgccacaccgggctacgcccggcccattgctccccggtgacctggatatcgttctggcgcagggcgttttccatggtcacggtattgcccggcagcgcgtcggtctcgcagccgtagcctttttccagtacgtagcgcaacaggtcggtggtgaacatgccgctttcccagttcagcccggcgaacaccactttgcccgggtacgggcattccgccgcgacggcggtctggctggcgaggctggcgcccagggcgaggacggcgaggatctggcgaagcgggggcatgcgggtctcccggttggagtcggacggcatgcggaactatataggcattaa

SEQ ID NO: 16235 - DNA, 1428 bp, Pseudomonas aeruginosa
gtttacgcaccgcttaatcgtctgtatatgtatatacaaataaaacagactgcatgtgagctgattatgtccgcaattttcgctgaacgtgcgttgctgccggaaggctgggcgcgaaatgtccgtttcgagatttccgcggacggagtcctcgccgggattcgtcccgacgccaacgccgacggcgccgaacgcctcggcggcgccgtgctgccggggatgcccaacctccattcgcacgcgttccagcgcgccatggccgggctcgccgaagtcgccggcaatcccaacgacagtttctggacctggcgcgagctgatgtaccggatggtcgctcgactgtcgccggaacagatcgaggtcatcgcctgccagctctacatcgagatgctcaaggccggctacaccgcggtggcggaattccactacgtccatcacgacctcgacggccgcccctacgccgaccccgccgaactttccctgcgcatctcccgcgccgccagcgccgcaggtatcggcctgaccctgctgcccgtgctttacagtcacgcaggcttcggcggccagccggccagcgagggccagcggcgcttcatcaatggcagcgaggcctacctggaactgctccagcgcctgcgcgcgccgctggaggcggcaggccactccctgggcctgtgcttccactccctgcgcgcggtgactccgcagcagatcgccacggtcctcgccgccggccacgacgacctgccggtccacatccatatcgccgaacagcagaaggaagtcgacgactgccaggcctggagcggacgccggccgttgcaatggctgtacgagaacgtcgcggtcgaccagcgctggtgcctggtccatgcgacccacgccgaccccgccgaggtggcggcgatggcgcgtagcggcgcggtggccggcctgtgcctgagcaccgaggccaacctcggcgacggcatattcccggcgacggacttcctcgcccagggcgggcgcctgggcatcggctcggacagccacgtctcgctcagcgtggtcgaggaactccgctggctggaatacggccagcgcctgcgcgaccggaaacgcaaccggctgtaccgcgacgaccagccgatgatcggccgcacgctctacgacgctgctctggctggcggcgcccaggcccttgggcagccgatcggtagtctcgccgtgggccgtcgcgccgacctgctggtgctcgacggcaacgacccctacctggccagcgccgagggcgacgccctgctcaaccgctggctgttcgccggcggcgaccgccaggtgcgcgacgtgatggtggccggcagatgggtggtgcgcgacggccggcatgcaggggaagagcgcagcgcacgggcattcgtccaggtgctgggggaactgctcgactga

SEQ ID NO: 16236 - DNA, 867 bp, Pseudomonas aeruginosa
gcaggttggcgctccagaaccagccgagcagcaacagcgccaccggcgcagcggcgagcagccgatactcccgcgggaagtcgcgcagcggccagggcaggctccgcccgccagccaccagcagcaggtaggcgctcgggaccaacgcccagcccagccaacgccaggcgttgtactgttcggcgagcagggcgaacaggtagcgcagctccagcgccagcacccctagcaacagccagcaaccgagcacatgggcaacgctcagggccttcgccggcagcaacggggcaaggcgtcgcagcgacagcaagtgcgtggcgaacagcagcggccaggccagccagccgaattcgccgaacggctggtaatcgaaacgccaggcactggccagggccaacagcgccaccgggaccagcgccaggcacagcagggccagttcgcgccagcgctcgcgcagcgccagcagcatccacgacgccactgtcgccgcggccaccagtagcaacgcatgctcgcgcaggccataaggcacgaagcggacggtttcgcacagcgcggtcagcgcccaccagccggctccccagagcagcagcaagtgcgacagctcggccaggccgagggtaccgatacccagcgcccgctcgcgctcgccggcgcggcgcagccgccaggcgccgaccagcgccgccagggccagcactgccggcgtccagaacccggaatgggccaggggccgcaggccttcgccgctcagcgagccgaacagcgacggcccggcgaggaggaacgccaggccgcccactacctgcaaggcgaggccgaagtagaagctcaggcgctggcgcagcaccaggctcagccagatga

SEQ ID NO: 16237 - DNA, 747 bp, Pseudomonas aeruginosa
cgctcgatgggctggacgggctcggggggacaaggcggaggcggcgcagcctcgacggccggcagctcgatgtcccagtccagcggcggggcaacctcggcgggaggagcgggaggcgtgtctgcgagcggctggtcgataccggcggccggctcgggaacgctttcgggaaggtcctgcgcctggcgctccacgcgcagcaagcgctggtggatgacctcggtgccgcgctcgaagcgttcggcgaattcgctcatctgcttgcgcaggcgctcgttctgttgcgccaggttctgcagcgagacggcctgtcccagggccaggccggaaaggccgccgaggagggcgccgaccagcgattccccggcgaagccgccgaggatcaggcccaccagcatgaaaatccattgcatgcgtcgaatccttgatcaagaggtaccacgatccactgatacctgccctggccatcctgccagagcggaacccgcaccgggagtatacagcccgcattccagagattcgacgcattccgacgcccgccccgtggcgagctacctcttcctggcgatgaactggaccacgcaggccgcgccggtgtggaaacggccctcgaccacctcgcgctcgatttcccgcgccagcagcacttcgcactccggcagctcagcctccagcgccgcacggctcaccagcatgtcgacgtccgccgggccgccggtgccgcggccgagttgttccggccgatag

SEQ ID NO: 16238 - DNA, 2355 bp, Pseudomonas aeruginosa
ggtcaagggcatgcggcaactggacataggcgaggtcgcgcgacgatccggggtaccggcctcgaccctgcgctactacgaggaaaagggactgatcgcctccagcggccggcacggcctgcgccggctgttcgatgcaggcgtgctggagcggctggcgctgatcgggctgggccgcgccgccgggttgtcgctggacgagattgccggcatgggcgcagccgacggcgcgctgcggatcgaccgcgcggcgctggcggccaaggccgacgaactggaccggacgatccgccgcctcgccgccatgcgcgacggcctgcggcatgccgcggcctgtccggcgcgcgagcacatggactgcccgacgttccgccgcttgctgcgggccgctgccgcgggggccatcaagccacgccggaaagcgcccggcgcatagcaaaacggccggcaggccgggcacccctgccctgcctgccggccgcgaggcacgccgttgcggcgcgccggtacggcaacggtttagaccttgctgcgctcgtagcgcttgcggtcgttctcgttgagcatcttcttgcgcaggcggatcgacttcggcgtcacttccaccagctcgtcgtcggcgatgaactccagcgcctgctcgagggtgaagcggatcggcggaaccagggcgatgacttcgtccttgccggaagcgcgcatgttgtcgagcttcttgcccttggtcgggttgatcaccaggtcgttgtcacggctgttgatgccggccaactggccttcgtagatttcgtcgcccgggccgaggaacagcttgccgcggctctgcagggtctccagcgagtaggtcagggcggtgccggtggccatggagaccagtacgccgttctggcggttgctgacttcgccggccttgatcggaccgtagtggctgaaggtcgaggtcaggatgccggtgcccgaggtcagggtcaggaagttgttgcggaagccgatcaggccgcgcgccggaatggtgtactccaggcgcacgcggcccttgccgtcgggaatcatgttgctcaggtcgcccttgcgcaggcccatctgctccatcaccgagccctggtgctgctcctcgatgtcgatggtgacgttctcgtagggctcctgcttctcgccgtccttctcgatgatcaccacttccgggcggcccacggccagctcgaagccttcgcggcgcatggtctcgatcagtaccgacaggtgcagttcgccacggccggaaaccttgaacttctccgggctgtcgcccggctcgacgcgcagcgccacgttatgcagcagttccttctccaggcgctccttgatgttgcggctggtgacgaacttgccttcgcggccggcgaacggcgaatcgttgacctggaaggtcatgctcacggtcggctggtcgacggtcagcggcggcagcgcctcgacgttctgcgggtcgcacagggtatcggagatgaacagctcctccatgccgctgacgcagacgatgtcgccggcttccgcctcggccacctcgacgcgctgcaggccgtggtggcccatgatcttcaggatgcggccgttgcgcttgctgccgtcgtcgctgatggccaccaccggggtgttggacttgaccttgccgcgggtgatgcggccgataccgatcacgccgaggaagctgttgtagtccagctgcgagatctgcatctggaacggaccctcggtgtccaccaccggagccgggacgtggtcgatgatcgcctggaacagcgcgtccatgttgtcgtccatcttctcgtggtcgaggccggcgatgccgttcagggcgctggcgtagacgatcgggaagtcgagttgctcgtcggtggcgccgaggttgtcgaacaggtcgaagatctggtcgatgacccagtccggacgcgcgcccgggcggtcgatcttgttcaccaccacgatcggacgcaggccggccttgaaggccttctgggtcacgaagcgggtctgcggcatggggccgtcctgggcgtcgaccaccagcagcacggagtcgaccatcgacatcacgcgctccacctcgccgccgaagtcggcgtgaccgggggtgtcgacgatgttgatgttgtagccgttccacttgatcgcggtgttcttcgccaggatggtgatgccacgctctttttcctggtcgttggagtccatcacccgctcgctttccgcttctttgcggtcgagggtgccggacagcttcagcagcttgtccaccagggtggtcttgccatggtcgacgtgggcgatgatggcgatgttgcgcagattttcgatcacaagtcttgtctcgtttaa

SEQ ID NO: 16239 - DNA, 1584 bp, Pseudomonas aeruginosa
gcggcggacgtgtcgggaggacggtggcggatgctgccgccgaacaagcccggctgcttaagccggacgataaacacgcacattggtgtgcccctcgttgagcaggtgatgggcatgcaggcggctcatcacccctttgtcgcaatacaggaggtactggcggttggcgtccagttccttgaagcggctgttgatcgcgtagaacggcagcgcctggacttcgacgccttccagggccaggggttcgtcttcctgggcatcaggatggcggatatcgatgacaatctgaccgggcagcacctcgccgacctcttccacctgcaggtcctggccgagttcgtcgatcacccggtcgacggtgcgctgggtggcgcgctccagggcgcgctcgagcaccgccatgtcgaatttcgactcttcgtgctcgacgcggtagggcttggcctgggtggtcgggttcaccgagatcaccccgcagtattccggcatgtgccgggcgaactcggcggtgccgatctgccgggcggtgtcgatgatgtcctgcttgtggctgacgatcagcggacgcagcaccagggtgtcggtaacccggtcgatcaccgagaggttcggcagggtctggctggacacctgggagatcgcctcgccggtcaccagcgcgtccagctccaggcgctcggccacgcggctggcggcgcgcagcatcatgcgcttgagggtcacgcccatatagctgtcgtcgaccttggtgaggatctcgccgaccacttcctcgaacggcacgctgacgaacagcacgcgctgcgagcggccgtacttctcccacaggtagtgggcgacttccatcacccccagttcgtgggcgcgcccgccgaggttgaagaacacgaagtggctgatcatcccgcggcgcatcatctggtaggccgccacggtcgagtcgaagccgccggacatcagcaccagcacctgttccagcgcgcccagcggatagccgcccaggcccggatgctggcgatggatgacgaacaggcggtcgaggcggatttccatccgcacctcgacttccggctgcttcaggtcgatcccggcagccccgcattcgcggcgcaggccgctgccgacgtaacgctccacctccatcgaggtgaacgcgtgcttgccggcgcgcttgcagcgcacggcgaaggtcttgccggccaactggtcgccgaaatgcgccttgcacttggcgaggatgtcgtcgaaatcgcccagcggatactcgtggacctcgaggaaatgaccgatgcccggggtgcaggtcaggcgctcgatcatctcgcgcctggccttggcgtcgaccacggcggtctctacctccaggttgtcccactcgccctcgaccttcagctccgggtccaggtcgcgcagcaccgcgcggatgttcttcgccaactgccggatgaagcgcttgcgcaccggccggctcttgatggtgatttcctggaaggtcttgacgatgagtttcatgcgagggacgcgaacgcgcggggcgacggaaaaaaaggggcggaattatatctgaaattgctcacgtattga

SEQ ID NO: 16240 - DNA, 1446 bp, Pseudomonas aeruginosa
tccctcctggaggacagcatgtcgtacaagtcgcaccaactgatcaaagaccatgacgtgaagtgggtagacctgcgcttcaccgataccaagggcaagcagcaacacgtcaccatgccggctcgcgacgcgctggacgatgagttcttcgaagccggcaagatgttcgacggctcctccatcgccggctggaaaggcatcgaagcctccgacatgatcctgatgccggacgacagcaccgccgtcctcgatccgttcaccgaagagccgaccctgatcctggtctgcgacatcatcgagccgagcaccatgcaaggctacgagcgcgacccgcgcaacatcgccaagcgcgccgaggagtacctgaagtccaccggcatcggcgacaccgtgttcgtcggcccggagccggagttcttcatcttcgacgaagtgaagttcaagtccgacatctccggctcgatgttcaagatcttctccgagcaggcttcctggaacaccgacgccgacatcgagtccggcaacaagggccatcgcccgggcgtgaagggcggctacttcccggtaccgccggtcgaccacgaccatgaaatccgcaccgccatgtgcaacgccctggaagaaatgggcctggtggtcgaagtccaccaccacgaagtggcaaccgccggccagaacgagatcggcgtgaagttcaacaccctggtcgccaaggccgacgaagtgcagaccctgaagtactgcgtgcacaacgtcgccgacgcctacggcaagaccgtgaccttcatgccgaagccgctgtacggcgacaacggttcgggcatgcacgtgcacatgtcgatctccaaggacggcaagaacaccttcgccggcgaaggctatgccggcctgtccgagaccgccctgtacttcatcggcggcatcatcaagcacggcaaggccctgaacggcttcaccaacccctcgaccaactcctacaagcgcctggtcccgggcttcgaagctccggtgatgctggcctactcggcgcgcaaccgttccgcctcgatccgtatcccctacgtatccagcccgaaggcccgccgtatcgaagcgcgcttcccggacccggcagccaacccctacctggccttcgccgcgctgctgatggccggcctggacggcatccagaacaagatccaccccggcgatgccgccgacaagaacctgtacgacctgccgccggaagaggcgaaggaaatcccgcaggtttgcggcagcctgaaagaggcgctggaagagctcgacaagggccgcgcgttcctgaccaagggcggcgtgttcaccgacgagttcatcgatgcctacatcgagctgaagagcgaagaagagatcaaggtgcgcaccttcgtgcaccccgctggaatacgacctgtactacagcgtctgatccaccctttcctataa

SEQ ID NO: 16241 - DNA, 1371 bp, Pseudomonas aeruginosa
  unsure (1353): Identity of nucleotide at the above locations are unknown.
caacgagtcaccctcttgaggcctccttcgggaggccttttttatgggccggcccatggagaaacgcaaagttcgccgcgccgttcggttagacttgccgcgctccccgccccaaggataaggaccgtccatgcgtcactctctctggctcctgcttgccgccatcctcagcctgcccgcccaggccggcaccgaatgccgcgatatccacgaccgcgacctgcggcgcatgtgcaacgcactggaacgcggcgacagcggggattgcggcgacatcgacagccgcgacctgcggcgttactgcggcgcactgctggcgccgggacagcgctacgactgcgacgacatccgcgacggcgacacgcgccgccagtgccgcgccatcgtccgcggcgaccgcaagcgctgcgacgacatcgacagccgcgacatgcgccgccagtgccgggccgtggtatcgcgtgcgccgtggcagtgcgacggcatcgacgaccgcgacatgcgccgcatctgccgggtcatcctgtcgcgctagatgccgccgtccgccggcgtgcccggctcgtccggttccgcggatttcgccttgggcgcccggctcaactgtacgttgagacgcggcatggacagttcgaggccggcctggtcgaggcgccgacgcaggcgcaagttgaacgcccgctggacctcccactgcttgatcggcgcggtcttgaagcggaagcgcaggatcgcctggccgttgtcgaaactctccacgccctgcaattccatcggcgaccacaggttgcggtagaccgccgggtcgctgcgcagctccatcgcgacctcgcgcaccagcgccaccgcgtcgtcgatcggcatgctcgccggcaccggccagcggaacatcgcgtagccgaactggcgcgagtagttcttgatgctcttgatctcgctgaacgggatggtatgcaccacgccgtccaggtcgcgcaggcgcacggtacggatagtcaggccctcgaccgtgccaaggtggccgccgacgtcgacgtagtcgtcgatcgacagcgagtcctcgatgatgatgaacaggccggtgatcaggtccgccaccagcgactgcgcgccgaagccgatggccaggccgatcacgccggcaccggccagcaacggggtgacgttcatgcccatgttggccagggcgacgatcagggcgagaaacgcgacttcgccgaatggcaggcggtgttcgccgccctggatgcctgcgtggagccgctgctgccgctctccgaggcgctggaacacccgcagttgcaggcgcgcgggctggtcgcccgggtgccgctggcggacggcggcagccangcgcagatggcctgtccg

SEQ ID NO: 16242 - DNA, 1284 bp, Pseudomonas aeruginosa
  unsure (20): Identity of nucleotide at the above locations are unknown.
tcggacaggccatctgcgcntggctgccgccgtccgccagcggcacccgggcgaccagcccgcgcgcctgcaactgcgggtgttccagcgcctcggagagcggcagcagcggctccacgcaggcatccagggcggcgaacaccgcctgccattcggcgaagtcgcgtttctcgccctgatcgtcgccctggccaacatgggcatgaacgtcaccccgttgctggccggtgccggcgtgatcggcctggccatcggcttcggcgcgcagtcgctggtggcggacctgatcaccggcctgttcatcatcatcgaggactcgctgtcgatcgacgactacgtcgacgtcggcggccaccttggcacggtcgagggcctgactatccgtaccgtgcgcctgcgcgacctggacggcgtggtgcataccatcccgttcagcgagatcaagagcatcaagaactactcgcgccagttcggctacgcgatgttccgctggccggtgccggcgagcatgccgatcgacgacgcggtggcgctggtgcgcgaggtcgcgatggagctgcgcagcgacccggcggtctaccgcaacctgtggtcgccgatggaattgcagggcgtggagagtttcgacaacggccaggcgatcctgcgcttccgcttcaagaccgcgccgatcaagcagtgggaggtccagcgggcgttcaacttgcgcctgcgtcggcgcctcgaccaggccggcctcgaactgtccatgccgcgtctcaacgtacagttgagccgggcgcccaaggcgaaatccgcggaaccggacgagccgggcacgccggcggacggcggcatctagcgcgacaggatgacccggcagatgcggcgcatgtcgcggtcgtcgatgccgtcgcactgccacggcgcacgcgataccacggcccggcactggcggcgcatgtcgcggctgtcgatgtcgtcgcagcgcttgcggtcgccgcggacgatggcgcggcactggcggcgcgtgtcgccgtcgcggatgtcgtcgcagtcgtagcgctgtcccggcgccagcagtgcgccgcagtaacgccgcaggtcgcggctgtcgatgtcgccgcaatccccgctgtcgccgcgttccagtgcgttgcacatgcgccgcaggtcgcggtcgtggatatcgcggcattcggtgccggcctgggcgggcaggctgaggatggcggcaagcaggagccagagagagtgacgcatggacggtccttatccttggggcggggagcgcggcaagtctaa

SEQ ID NO: 16243 - DNA, 1314 bp, Pseudomonas aeruginosa
gcaatttcagatataattccgcccctttttttccgtcgccccgcgcgttcgcgtccctcgcatgaaactcatcgtcaagaccttccaggaaatcaccatcaagagccggccggtgcgcaagcgcttcatccggcagttggcgaagaacatccgcgcggtgctgcgcgacctggacccggagctgaaggtcgagggcgagtgggacaacctggaggtagagaccgccgtggtcgacgccaaggccaggcgcgagatgatcgagcgcctgacctgcaccccgggcatcggtcatttcctcgaggtccacgagtatccgctgggcgatttcgacgacatcctcgccaagtgcaaggcgcatttcggcgaccagttggccggcaagaccttcgccgtgcgctgcaagcgcgccggcaagcacgcgttcacctcgatggaggtggagcgttacgtcggcagcggcctgcgccgcgaatgcggggctgccgggatcgacctgaagcagccggaagtcgaggtgcggatggaaatccgcctcgaccgcctgttcgtcatccatcgccagcatccgggcctgggcggctatccgctgggcgcgctggaacaggtgctggtgctgatgtccggcggcttcgactcgaccgtggcggcctaccagatgatgcgccgcgggatgatcagccacttcgtgttcttcaacctcggcgggcgcgcccacgaactgggggtgatggaagtcgcccactacctgtgggagaagtacggccgctcgcagcgcgtgctgttcgtcagcgtgccgttcgaggaagtggtcggcgagatcctcaccaaggtcgacgacagctatatgggcgtgaccctcaagcgcatgatgctgcgcgccgccagccgcgtggccgagcgcctggagctggacgcgctggtgaccggcgaggcgatctcccaggtgtccagccagaccctgccgaacctctcggtgatcgaccgggttaccgacaccctggtgctgcgtccgctgatcgtcagccacaagcaggacatcatcgacaccgcccggcagatcggcaccgccgagttcgcccggcacatgccggaatactgcggggtgatctcggtgaacccgaccacccaggccaagccctaccgcgtcgagcacgaagagtcgaaattcgacatggcggtgctcgagcgcgccctggagcgcgccacccagcgcaccgtcgaccgggtgatcgacgaactcggccaggacctgcaggtggaagaggtcggcgaggtgctgcccggtcagattgtcatcgatatccgccatcctga

SEQ ID NO: 16244 - DNA, 1110 bp, Pseudomonas aeruginosa
agaagcctgtcgtgtcgggcgccgccctgtccgaccccaccaccgccgcgaagccgcgcttcgggcgttaaacgagacaagacttgtgatcgaaaatctgcgcaacatcgccatcatcgcccacgtcgaccatggcaagaccaccctggtggacaagctgctgaagctgtccggcaccctcgaccgcaaagaagcggaaagcgagcgggtgatggactccaacgaccaggaaaaagagcgtggcatcaccatcctggcgaagaacaccgcgatcaagtggaacggctacaacatcaacatcgtcgacacccccggtcacgccgacttcggcggcgaggtggagcgcgtgatgtcgatggtcgactccgtgctgctggtggtcgacgcccaggacggccccatgccgcagacccgcttcgtgacccagaaggccttcaaggccggcctgcgtccgatcgtggtggtgaacaagatcgaccgcccgggcgcgcgtccggactgggtcatcgaccagatcttcgacctgttcgacaacctcggcgccaccgacgagcaactcgacttcccgatcgtctacgccagcgccctgaacggcatcgccggcctcgaccacgagaagatggacgacaacatggacgcgctgttccaggcgatcatcgaccacgtcccggctccggtggtggacaccgagggtccgttccagatgcagatctcgcagctggactacaacagcttcctcggcgtgatcggtatcggccgcatcacccgcggcaaggtcaagtccaacaccccggtggtggccatcagcgacgacggcagcaagcgcaacggccgcatcctgaagatcatgggccaccacggcctgcagcgcgtcgaggtggccgaggcggaagccggcgacatcgtctgcgtcagcggcatggaggagctgttcatctccgataccctgtgcgacccgcagaacgtcgaggcgctgccgccgctgaccgtcgaccagccgaccgtgagcatgaccttccaggtcaacgattcgccgttcgccggccgcgaaggcaagttcgtcaccagccgcaacatcaaggagcgcctggagaaggaactgctgcataa

SEQ ID NO: 16245 - DNA, 1944 bp, Pseudomonas aeruginosa
tgctcggtgcagcggcgctgttcagcttctggcagctgcgtcgcgcgccggcgaaagcgctggccgactgggagccggcctgccggccgttgctggcggccgccggcctggccttcctctacctggtcgcaccgctctgcctggccgtcgacggcaccgccatcgcctgggccgtggcccggcctggcgagcttgttcgccggcttgcgcctgggctcgcgtaccttcctgttctgcgccttcgccgtgcaactgctgggcggtgcgctgttcctcctgcatttgcagggcggcgatggccagggtggggtattcgactcgggctggcgtggcttgatgaccgcctcgctgattggcctggcgctgatcggcggcatgctgctggcggcgcgcgacccgctggtgaaggacgacagtcggctgctcatgggcttgagcctggtgctgctggccggtctggcgttcgtcaacctggcagtgctgttcgtcctgccttggcgcagcgccagcgcggtatgggccggtagcgggctgctgatcatctggctgagcctggtgctgcgccagcgcctgagcttctacttcggcctcgccttgcaggtagtgggcggcctggcgttcctcctcgccgggccgtcgctgttcggctcgctgagcggcgaaggcctgcggcccctggcccattccgggttctggacgccggcagtgctggccctggcggcgctggtcggcgcctggcggctgcgccgcgccggcgagcgcgagcgggcgctgggtatcggtaccctcggcctggccgagctgtcgcacttgctgctgctctggggagccggctggtgggcgctgaccgcgctgtgcgaaaccgtccgcttcgtgccttatggcctgcgcgagcatgcgttgctactggtggccgcggcgacagtggcgtcgtggatgctgctggcgctgcgcgagcgctggcgcgaactggccctgctgtgcctggcgctggtcccggtggcgctgttggccctggccagtgcctggcgtttcgattaccagccgttcggcgaattcggctggctggcctggccgctgctgttcgccacgcacttgctgtcgctgcgacgccttgccccgttgctgccggcgaaggccctgagcgttgcccatgtgctcggttgctggctgttgctaggggtgctggcgctggagctgcgctacctgttcgccctgctcgccgaacagtacaacgcctggcgttggctgggctgggcgttggtcccgagcgcctacctgctgctggtggctggcgggcggagcctgccctggccgctgcgcgacttcccgcgggagtatcggctgctcgccgctgcgccggtggcgctgttgctgctcggctggttctggagcgccaacctgctcagcgacggcgctgccgagccgctgccttacctgccgctggccaacccgctggaactggggctgctgatcgtgctgttcgccctctaccgctggagcgacgccagcctggcctcgctcgtcgatggcaatgccagcgcgcgcctggggcgccaggcgttggccggcgcctcgctgttcgccctgctgaccctggcggtgtgccgcgccgcgcaccacctggccggcgtaccgttccaggccgaggcgctggccgcgtcgatgctggtgcaggcggggctgtcgctggtctggacgctctgtgcgctgggcctgaccatcgccggtacccgtctcggccggcgcgacctgtggatggtcggcgcggcgctggtcggcgtcgtggtggtcaagctgttcttcgtcgagctgggcaacagtggcagcctggagcgaatcatctccttcatcggggtcggcgtcctgttgctggtcgtcggctacttctcacccttgcctccgcgtcgcgccgaggtcgcatcggaggccgagcagccatga

SEQ ID NO: 16246 - DNA, 372 bp, Pseudomonas aeruginosa
cggcctgcctgctggcttcgctgtccaccgccccgcaggctgctccttcgccttattcgacgctggtggtgttcggcgacagcctcagcgatgccgggcagttccccgatcctgccggccccgccggaagcacctcgcgtttcaccaaccgggtcggcccgacctaccagaacggcagcggcgagatcttcggaccgaccgcgcccctggggctcggcaatcagctcggcatcgcccccgggcgacctgggtgcctcgacttcgccggtcaacggcccagcagggcatcggccgacggcaacaactgggcggtgggcggctaccggaccgaccagatctacgactcgatcaccgcggccaacggctcgctga

SEQ ID NO: 16247 - DNA, 522 bp, Pseudomonas aeruginosa
agcgcaagttcgccctgggcggcggcgagcgcagcgagaaaggcgacaccaacggccacctgtgggcgttcagcgcgcgcctgggctacgacatcgcccagcaggccgacagtccctggcacctgtcgccgttcgtcagcgccgactatgcacgggtcgaggtcgacggctattccgagaagggcgccagcgccaccgcgctcgactacgacgaccagaagcgcagctcgaagcgcctgggcgccggcctgcaaggcaagtacgcgttcggcagcgatactcagctgttcgccgagtacgcccacgaacgcgagtacgaggacgacacccaggacctcaccatgtccctcaacagcctgccgggcaatcgctttaccctcgaaggctacaccccgcaggaccacctcaaccgcgtctccctcggcttcagccagaagctggcaccggagctgtcgctgcgcggcggctacaactggcgcaagggcgaggacgatacccagcagagcgtcagcctggcgctga

SEQ ID NO: 16248 - DNA, 1173 bp, Pseudomonas aeruginosa
acggcgagatggggtgcggctgacgaccgtcgatcggttgcgcgccgcggaaatgaaccgcgccgccgccgccgatctccaaccggcggttgcgcggagtcaagcgtgaccgccaattccgcgttaaactgcgcgggttttttcctctctccggagccatccatgtcccgcgttaccctgagccgctatctgatcgagcagacccgcagccacaacaccccggccgacctgcgcttcctcatcgaggtcgtggcgcgtgcctgcaaggaaatcagccatgcggtgtccaagggcgcgctgggcggcgtgctcggcagcatgggcaccgagaacgtgcagggcgaggtgcagaagaagctggacgtgatgtccaacgagatcctgctggaagccaacgaatgggccggcaacctggccggcatggcctccgaggagatggaccacccctaccagattccggggcgctatccgaaaggcgcctacctgttggtcttcgacccgctggacggctccagcaacatcgacgtcaacgtctcggtcggcaccatcttctcggtgctgcgctgccccaacgagtacctgaaccagaacgataccctgcgcgaggaagccttcctccagccgggcaccacccaggtcgccgccggctacgccatctacggcccgcagaccatgctgatgctgaccctcggcaatggcgtcaagggcttcaccctggatcgcgagctgggcagcttcgtcctcacccacgacaacatcagcgtgccggaaagcaccgccgagttcgccatcaacatgtccaaccagcgccactgggaagcgccggtgaaacgctacgtggaagaactgctggccggcaaggaaggcccgctgggcaagaactacaacatgcgctggatcgcctcgatggtcgccgacgtccaccgcatcctgacccgtggcggcgtcttcatgtacccgcgcgacgcccgcgagccggagaagcccggcaagctgcgcctgatgtacgaagccaacccgatgtcgttcatcatcgagcaggccggcggcgccgccaccaacggcacccagcgcatcctcgacatcaagccggagaacctgcaccagcgtgtcgcggtgttcctcggctcgaagcaggaagtcgagcgcatcaccggctaccacgcggagtag

SEQ ID NO: 16249 - DNA, 855 bp, Pseudomonas aeruginosa
ggcagcgcttcccccgaacaaggagttcctcatggcgtcgttccgtaccctggccgtggtcgctttctgcgtcgtcctggccgcctgcagcaagatcaaccaggaaaactattccaagctcaaggccggcatgagcaaggccgaggtcgaggcgatcctcggcaagcccaccgagtgctccggcgcgctgggcatgtccagttgcacctggggcgacgagaaggctttcatcagcgtgcagtacgcggccgacaaggcgctgctcttctccggccaggggctcaagtgatcggtctgccgatccgggtgctctgcaccctgtggctgggcttgctgctggtcggttgcgcgggctcgccgaagaatccgccggccaccgagcaggtcgatctccagcgctaccagggcacctggtacgaactggcgcgcttgccgatgttcttccagcgcaactgcgcgcaatcggaggcgcattaccgcttgcaggaagaccagagcatccaggtgatcaatcgctgcctgaccctggatggcgactgggagcaggtggaggggcgggcagtcgcccagcagccgggtcgcaccgacaagttgtgggtgcgcttcgacaactggttcgccaatctcttccccaacgtggcgcgcggcgactattgggtgctggcggtggacgacgactaccgtaccgcgctggtgggcaatccgaaccgtgaatacctgtggctgctgtcgcgtaccccgcaggtttcgcagcagacccgcgaacgtctgctggaagaagcgcgcagccgcggttacgcggtggacgagctgatctggcgggtacccgacggccagttgaagcggagccagtga

SEQ ID NO: 16250 - DNA, 444 bp, Pseudomonas aeruginosa
gcgagacgtggctgtccgagccgatgcccaggcgcccgccctgggcgaggaagtccgtcgccgggaatatgccgtcgccgaggttggcctcggtgctcaggcacaggccggccaccgcgccgctacgcgccatcgccgccacctcggcggggtcggcgtgggtcgcatggaccaggcaccagcgctggtcgaccgcgacgttctcgtacagccattgcaacggccggcgtccgctccaggcctggcagtcgtcgacttccttctgctgttcggcgatatggatgtggaccggcaggtcgtcgtggccggcggcgaggaccgtggcgatctgctgcggagtcaccgcgcgcagggagtggaagcacaggcccagggagtggcctgccgcctccagcggcgcgcgcaggcgctggagcagttccaggtaggcctcgctgccattga

SEQ ID NO: 16251 - DNA, 1779 bp, Pseudomonas aeruginosa
atgtgttcggtagacccagcccgacctctgcttcgtccccgaattcaggcgcaccctcgccggtcgccgcccgttgaacgccacgcccaggagcctgccgtgaccaccccgagcaaattccgcgatattgaaatccgcgccccgcgcggcactacgctgaccgccaagagctggctgaccgaagcgccgctgcgcatgctgatgaacaacctcgacccggaggtcgcggagaaccccagggaactggtggtttacggcggcatcggccgtgccgcgcgcaactgggagtgctacgacaggatcgtcgagaccctcaagcaactgaacgacgacgagaccctgctggtacagtccggcaagccggtcggcgtgttcaagacccacgccaacgcgccgcgggtgctgatcgccaactccaacctggtgccgcactgggcgacctgggaacacttcaacgaactggacgccaagggcctggcgatgtacggccagatgaccgccggttcgtggatctacatcggcagccagggcatcgtccagggcacctacgaaaccttcgtcgaggctggccgccagcattacgacggcaatctcaagggccgctgggtgcttaccgccggccttggcggcatgggcggcgcccagccgctggcggcgaccctggccggcgcctgttcgctgaacatcgagtgccagcagagccgcatcgacttccgcctgcgcagtcgctacgtcgacgagcaggccaaggacctggacgacgccctggcgcggatccagcgctacaccgccgaaggcaaggccatctccatcgccctgctgggcaatgccgccgagatccttccggaactggttcgccgcggcgtacgcccggacatggtcaccgaccagaccagcgcccacgatccactcaacggctacctgccggccggctggagctgggaagagtaccgcgaccgcgcgcagaccgacccggccgccgtggtcaaggccgccaagcagtccatggcggtacacgtgcgggccatgctggcgttccagcagcagggcgtgccgaccttcgactatggcaacaacatccgccagatggccaaggaagagggggtggccaatgccttcgatttccccggcttcgtcccggcctacatccgcccgctgttctgtcgcggcatcggtccgttccgctgggccgcgctgtcgggcgacccgcaggacatctacaagaccgacgccaaggtcaagcaactgatccccgacgatgcccacctgcaccgttggctggacatggcccgcgagcgcattagcttccagggcctgccggcgcgcatctgctgggttggcctggggctgcgcgccaagctcggcctggccttcaacgagatggtgcgcagcggcgagctgtccgcgccgatcgtcatcggccgcgaccacctcgactccggctcggtggccagccccaaccgcgagaccgaggccatgcaggacggctccgacgcggtgtccgactggccgctgctgaatgccctgctgaataccgccagcggcgccacctgggtctcgctgcaccacggcggcggcgtaggcatgggcttctcccagcactccgggatggtgatcgtctgcgacggtagcgacgaggccgccgaacgcatcgcccgcgtgctgaccaacgacccgggtaccggggtgatgcggcacgccgacgccggctaccaggtcgccatcgattgcgcgaaggagcagggcctgaacctgccgatgatcaccgcccagcgctga

SEQ ID NO: 16252 - DNA, 315 bp, Pseudomonas aeruginosa
ccctggcggcgaaggaaggcctggccctgctcaatggcacccaggtgtccaccgcctacgcgctgcgcgggttgttcgaggccgaggacctgttcgccgccgccaccgtctgcggcgggctcagcgtcgaggccatgctcggttcgcgggcgccgttcgatgcgcgcatccatgccgcgcgcggccagcgtgggcagatcgacgtggccgcggcctatcgcgacctgctcaccgccagcagcgaggtggcgcgctcccatgagaagtgcgacaaggtccaggacccctattcgctgcgttgccagccgcaggtga

SEQ ID NO: 16253 - DNA, 384 bp, Pseudomonas aeruginosa
tcgcccaggtcaccgccgccgcgctggccagcgacaacaaggccctggcccatccggccagcgtcgacagcctgccgacctcggccaaccaggaagaccatgtgtcgatggcgccgaacgccggcaaacggctctgggcgatggccgagaacgtcccgcgggattctcgccgtggagtggctgggcgcctgccagggcctggacttccgcgagggcctgaagagttcgccgaagctggagcaggctcgccgcctgctgcgcgacaaggtgccgtactaccaggaggatcgcttcttcgcccctgatatcgaggccgccagccagttgctcgccagcggttgcctgaacgcgctgctgccggcccggctgttgccgagtctttga

SEQ ID NO: 16254 - DNA, 951 bp, Pseudomonas aeruginosa
ttctccccgggctcggcatcttgttcttcggcttcagcttgggcggcggcggcgactcccgccaccggcgtgcacaacctttggcagcacggcgggttcctgcccaacggctgggcccgggctggtcgcctccctgtcgctggtggtattcgccttcggcggcatcgagatcttcggcatcaccgccggcgaggcgcaggacccgcagcgggtgatcccgcgggcgatcaatgcggtgccgctgcgcatccggctgttctacgtgctgaccctgttcgtgctgatggcgatcttcccctggcagcagatcggcagcaacggcagtcccttcgtgcagatcttcgacggcctggggatcgagtcggccgcggcgatcctcaatgtcgtggtgatcaccgcggcgatttcggcgatcaacagcgacatcttcggcgccggtcgcatgctctacggcatggcccgccagggccaggcgccggtcggcttctcgcgggtgtcgcggcacggcgtgccgtggatgaccgtgctgctgatggcggtggccctgctgctcggcgtggcgctgaactacctgatcccgcagagcgtattcctgttgatcgcgtccatcgccaccttcgccaccgtgtgggtctggctgatgatcctcctggcccaggtcggcatgcgccggcgcatagggccgcgccaggtcgccgcgctgaagttcccggtgccgctgtggccattcgcgccggcgacggcgatcgtcttcatgctgttcatcttcgtggtgctcggctatttcccggacacccgcccggccctgtgggtcggggctatctggatcgccttgctggtgatcgcctaccggcgctgggtcaggccgaagggcgatgccgcgcatggcgtgcttcaggcccagggagggctgtgacggaaccgacggcggcctgggccgccggccaataa

SEQ ID NO: 16255 - DNA, 2427 bp, Pseudomonas aeruginosa
catccaggtcttcgccgaggagtggatcggccgcagcgacgcctggaacaaggctgccgcggccggcaaggtggtcggcgtcggcgaacccatcgtcggcgcggtggagggctggtacgtgccgcgctacgtgatcgagggcgacccgcagcgcaagctcgaggcgaaggcgccgaagctgcgctctatcgccgacctggcgcagtacgccgaggtcttccgcgacccggaagagccgggcaaggggcgcttctacaattgcccggccggctggacctgcgagctggagaacagcgagatgctgaaaagctacggcctggaggagacgttcaccaatttccgtccgggcaccggcccggcactggacgcggcggtgctgtcgagctatcggcgcggcgagcctatcctgttctactactggtcgccgacgccgctgatgggccgcgccgacctggtgcgcctggaggaaaggcccggcgtcgacaagcgcatcaggatccaggtcggcctgtcgcggaccttccacgaccaggcgccggagctggtggcggtgctggagaaggtcaacctgccggcggagctgctgaacagcgacctggcgcggatggccaaggaccggatcgatgcggcgcgcctggcgcgcgagttcctcaaggagcaccccgaggtctggcacgcctgggtcgacgaggacgcggcgaagaagatcgaagcggcactctgaacccacgaccgacgagagcagaccatgtttcccgaacgcctgacattttccatcgccgactgggtcaacgcttgggtcgacgccctggtgaccaactacggcgacctgttccgcaagatctccgacaccctgctgtgggccatcgtcaacctcgaagggctgctccgcgccacgccctggtggctgttgctggcgatcgtcgcggcgatcgcctggcacgccacccggcgcctgctgccgaccctggtgatcaccggcctgctgttcctggtcggcgccgtcggcctctgggacaagctgatgcagaccctcgcgctgatgctggtggcgaccttcatctcggtgctgatcggcatccccctgggcatcctcgccgcgcgcagcaaccgcctgcgcgcggtgctgatgccgctgctggacatcatgcagaccatgcccagcttcgtgtacctgatcccggtgctgatgttgttcggcctgggcaaggtgccggcgatcttcgccaccgtgatctatgccgcgccgccgctgatccgcctcaccgacctgggcatccgccaggtcgacagcgaggtgatggaggcggtcaacgccttcggcgccaaccgctggcagcagctgttcggcgtgcagttgccgctggccctgccgagcatcatggcggggatcaaccagaccaccatgatggccctgtcgatggtggtgatcgcttcgatgatcggcgcccgcggcctcggcgaagacgtactggtgggcatccagacgctgaacgtgggcaagggcctggaagccggcctggcgatcgtcatcctcgcggtggtgatcgaccgcatcacccaggcctatggccgttcccggcacgagacgagcaaatgagcggtgcgcagatgaacaagatcgaagtgaagaacgtgttcaagatcttcggcccgcgcgccgatgccgcgctggcccttatccgccagggacgcagcaagggcgaagtgctggcgcagaccggctgcgtggtcggcgtcaacgacctgtcgctgaccatcggtgctggcgagatcttcgtgatcatgggcctgtcgggttccggcaagtcgaccctggtgcgccatttcaaccgcctgatcgaccccaccagcggcgagatcctggtggatggcgaggacatcctgcgctacgacatggaagccctccggcaattccgccggcgcaagatcagcatggtgttccagagtttcggcctgctgccgcacaagagcgtgctcgacaatgtcgcctacggcctgaaggttcgcggcgaaagccgggcgcagtgccacgagcgggccctgcactggatcgccacggtgggcctgaagggctacgagaagtcctatccgcaccagctttccggcggcatgcgccagcgtgtcggcctggcccgcgcgctggccgccgacaccgagatcattctcatggacgaggccttcagcgccctcgacccgttgatccgcgcggacatgcaggaccagttgctggaactgcagaaaaccctgcacaagaccatcgtcttcatcacccacgacctcgacgaggcggtacgcatcggcaaccgcatcgcgatcctcaaggacggccaactgatccaggtcggcacgccacgggaaatcctccaccagccggccgacgactacgttgaccgcttcgtccagcggcgggtggcgaacctatga

SEQ ID NO: 16256 - DNA, 438 bp, Pseudomonas aeruginosa
gcgacctaccgagcgtcgtgttcggcgacggtccgctgcgttggcaggaactggtcgcggtggcccggcacggtgcgcgcctggaactgtcggcggcggcctgggcacggatcgacaacgcccgcgccatcgtctgccgtatcgtcgccaacggcgagcgtgcctacggcatcagtaccggcctcggcgcgctgtgcgacgtcctgctggaaggcgagcagctcgccgagctgtcgcgcaacaccttgctcagccatgcctgcggggtcggcgagccgctgcgcgacgaacagacccgggcgatcatctgtgccgccgtcgccaactacagccagggcaagtccgggctcgaccgttcgctggtggaaggactgctggcgctgctcaaccacggcattaccccgcaggtgccggcccagggctcggtgggctacctga

SEQ ID NO: 16257 - DNA, 1227 bp, Pseudomonas aeruginosa
gagacctgcaatgaaacgactctggcagcattgccatgccgccaccctcaagggcggcaagtactcgatcgtcgaggacgccgccctggtcaccgacggtccgctgatccactggatcggcccgcgcgccgaactgccgcccgacgactacgccgaacgcatcgacctcgatggcgcctggctgaccccggggtttatcgactgccacacccacgcggtgttcggcggcaaccgcagcggcgaattcgagcagcgcctggagggcgtcagctacgccgagatcgccgccgccggcggcggcatcgccagcaccgtacgcgccacccgcgaggccagcgaggaagaattgctggccagcgcgcgcaagcgcctggagcccttgctgcgcgacggcgtgacggcgctggagatcaagtccggctacggcctcgacctggccagcgagcgcaagatgctacgagtcatccgccgcctcggcgaacgcctgccggcgaccgtgcgcagcacctgcctggccgcccatgcgctaccgccggaatacgccgggcgcgccgacgactacatcgagcatatctgctcgacgatgctccccgcgctggccggagagggactggtggacgcggtggacgccttctgcgagcacctggcgttttccccggcgcaggtcgagcgggtattcatcgccgcccgcgagctgggcctgccggtgaagctgcacgccgagcagctatcctcgctgcacggttccagcctggcggcgcgctaccgggctttgtcggccgaccacctggagtacatgaccgaggacgacgcccgcgccatgggcgaggcgggcaccgtcgcggtgctgctgccgggcgccttctacctgctgcgcgagacccagctgccgccgatcgatgccctgcgccggcacggcgtggccatggccattgccagcgatctcaatcccggcacctcgccggcgctgtcgttgcgcctgatgctgaacatggcctgtaccctgttccgcctgaccccggaggaggcgctggccggtgtcaccctgcacgccgcccgggcgctggggctggaagccagtcacggcagcctggaggtcggcaagctggccgacttcgtcgcctgggacatcgagcgtccggcggagctggcctactggctgggcggcgatctgccgaaacgcgtcattcgccacgccgaggaggtataccgtggatgaagtcctga

SEQ ID NO: 16258 - DNA, 849 bp, Pseudomonas aeruginosa
aggccgagttcggctacgcgctgctctgggacgcccactcgatccgttcccacgtgccgcacctgttcgacggccgactgcccgacttcaatctcggcaccaacgccggcgccagttgcgatccagcgctggcggcccgcctggaggcggtctgcgctgccgccgaaggctacagccatgtgctcaacgggcgcttcaagggcggccacatcacccgccactacggccagccggagcagcacgtccatgccgtccagctggagctggcgcagtgcacctacatggacgagcaggccccgttcgcttaccgcgcggacctcgccgaagcgacccgcgcagtcatccgcgaactgctggaaagcctcctcgcctggggtcgcgagcgctacgcctgaggtgctcggaggcggcggacgcctggcccgtcctggcggacgtgaaggccgcggatggggtggggcgtccgcgtcggcattctggaaattttctgttgcaaatttattgaggtcagcgttgatgcggccgggaggccgagtgcgcaaagagttgcacaactgttctcctctatcctctcggccagcatttccatcgcgcgggctcaggcgcgtcgcgcccggaaccgaatacgccaggaacgcacggctgcgtttccaagaggacagtgaatgttcgcccccgccaaccagacgcacttcagccttcgcatcgaaaacctccggcacgacttccaggtactcgccttccgcggtcgcgaagccatcagccagccctttcgcttcgacctggagctggtcagcgagcgatccgatctggacctcgacgcgctgctgcaccagccggccttcctga

SEQ ID NO: 16259 - DNA, 558 bp, Pseudomonas aeruginosa
ccggctatcgcgcgaccctggagccgcgcctggcctacctggggctgtgcagcgaccaacgcatcttccagcgcctcagcgtgccggaaatcatcggccgggtgctggagggccacggcattctcgccgacgcctaccgcttccagctgggcccgacgccgtacccggcccgcgaatactgcacgcagtacgacgaaaccgacctggcgttcctcagcaggctctgcgaggaggaaggcatccattaccaccatgagttttctgcccagggccatgtgctggtcttcggcgacgaccagacctcctttccgcggctgcaacgccccgtcgcctacgtgcaggacgccgggctggtcgccgaccagccggtggtcaagcgcttcggcgtgcgcttcgacacccgtgccagccgggttacccggcgcgactacgacttcgagcaacccgcgttgcagatgcaggccgcccatggcccgcagcccggggcgcagcaaccggacctggaggactacgactatcccggccgcttcacccaccgcgagcgcggcaagcacctga

SEQ ID NO: 16260 - DNA, 522 bp, Pseudomonas aeruginosa
ccggccccgccggcgagaccatccactgcgaccaatacggccgggtcaaggtgcagttcttctgggatcgcctcggccaggccgacgacaacaccagttgctggttgcgcgtcgcctccaactgggcgggcaaacgctatggcggcgtcgccatcccgcgggtgggcatggaagtcctggtgggtttcctggagggcgatccggatcagccgctggtcaccggctgcctctaccacagcgaaaaccgggtgccctacgagctgccgcagaacaagacccgcagcgttttcaagaccgacagctaccccggcggcggcggtttcaacgaactgcgcatcgaggaccgcaagggccaggaacagatcttcgtccacgcccagcgcgactgggacgagaacatcgagcacgaccagaagatccgcgtcggccacgagcgccacgacacggtcgagggcgatagctacagcgagttcagggccgaggaacagcgcacggtccatgccgaccgcaaggtcgaactga

SEQ ID NO: 16261 - DNA, 957 bp, Pseudomonas aeruginosa
tcaacagcggcggcagccccggcatcggtagcggcgttcgcgcgctgtcgccgctgcaaccgctcgcggccgacgccgcggcggcgggaggcgccttgttgggagccatcgcccagaaggtcggcgaagcgccgcagaaactcctgcgtttcgaactcagtccgttgcccggtgtgccatcggcggccaggcaaccgtatcggctctacgccaatggtgccttcaaggaggagggcatcgccgacgaaggcggcgcaatcagcttcgaaccgctgccgggcgaacgcacctatcgcatcgagaccgccaatggccacgcctacgaagtggagatggtcgaccagccggacgcactgcaggccgacgatcggctcgcccagcaggggttccgcgactaccgggcggaaatgccccagcacaagccgcgttccgccccggacgcctaccggcgcgacgcctcgcggcccggcgccgccgacaaggatgagcccacgccatgagcgacctgtacaaaccgcagaccctcaagctatacgcgcaacaggccggcagcgtccggctgaccctcgactggttcgccaacaaggctttctacccgccgcgcgcgggtgtgcacatcaagccgctgatcaatggccaggcggccttcgacgcggtgcatgcggcgatggaggcggcccggcacagcatcgacatcatcacctggggcttcgacccggccatgcgtttcaaacgccccgacggaccgcgaatcggcgaattgctgcagacgaagggccgcgaaggagtgcaggcgcgagtgctggtctggagcaaccaactcgccaggctcaaggaaaacaccatccccggggccggcgtcggcggttccggcggcacctgggcgggctcgggcgtcgccagcggcagcgcggtggacaacgaggtgctgcgactggagcagcggcgccagcataa

SEQ ID NO: 16262 - DNA, 975 bp, Pseudomonas aeruginosa
tttgcgttttcccaacttgataaaggaccatcctctgcctcctcacccgacccagggctacgacgcagatcggcccgactggaaaccggggcagtgatgcggctgatggctattggactttgggccgtgctctgtcttgcaggcgtccccgtgatggccaacagcaaaccatttgtctgcgctaatgaaaaagaccatctgccgccgttggatccgcaagccgatgcttggtaccgcgaagcagcagccttggccaagcccgatactctgcggccctggggccgtatcgtcgagctttacagcaaggcagtggagcgcggtcattggaaggccatgcataatttggcgaatctttatcgtacagggtggcccggaggagtagaaaaagatccgcagaaggcattggatctctatcaaaagatgatagatctggatgtgcctcaggggttctatgatatgggggcaatgattggtaatcgtgccggtgttaagaaccctgctaccgatggtctgaccttcttggataaagccgctagtttggggaacccgccagcactgaccgagttgggtaaactctatatttatgtggccaaggaaaaggaattggggctggcgtatgccagttgtgcttccagtcaaggttatgctccggcgagctatgagcttggaagctactatgagttggttgaaaataattatccaaaggcacttagctactatcaagtctccgtctctcaaggcggcaggagtgcagccttttttctctcgcgcgtcttcggaaagaggacgcctccttcaagtgcaatgtggtatacgccggatgaaaagcttgagaaattctactactccctctatctgcaaattgatgccgaccccgatcttcgttttcccaatttggtaaaagataaccccttgccaccccaccccgtccagggctacgacgcagctcgacccgactggaagccgggtcagtga

SEQ ID NO: 16263 - DNA, 417 bp, Pseudomonas aeruginosa
ggtaatcctccaggcgggcgaacagcgggtcggcggtggacagcccgatcagcgcttcgccggccagcccggccaggctcagcggctgccggcgttccgcttcgggccagtgttcgcgcggcgccagggccaccaatacgccgctggcgatggcttcgccgcgcaggccggggtgttccggctgcttcaggcttagggccaggtccagttcgcgcatcagcaggccctgcaccagctcgcgcgaatgcaaggtggccagttcgcagccgctctgcggatagcgcgcgctccattcgccgatcgcccgcggcagcagcgacagcgccagggccggggtggcgccgatgcgcaggctgtggcccggttggcgccgcaggttctgcgccaggcgccgcaccgcctgcaggctatcgctga

SEQ ID NO: 16264 - DNA, 801 bp, Pseudomonas aeruginosa
ccctgccggtcggcgcgcagcaccgcgcgccggataccagcatcaccgattacgaccgcaagatcgtctacgcgcgaatcggcgagcggctgcggatcgccgcgatggtcgacatcgtcggcttcgaccccggcctcgagcccgcgcgcctggcactgctgcgccagcaggcgcgagacacgttcccgcagggcggcgattttgacgccgccgtcgaatgggccggcatgcgcccggccacgcccaccggggtaccgctggtgggcaacggcggctaccgcaacctctggctcaacctcggccacggcgcgctcggcttcaccctggcctgcggcagcgggcgcctgctggccgagcagatcggccgccgcccgccgagcatcgatacctctggcctgcttccgcgcggcgcgctggctggctgaattcccctcgacctggagcactcccatggaaccgacccgtatcgccaccaatgaccgcctgtccgccgcggtctgcttcgacgccctggtatttctttccggccaggtgccgggccaggccgaggatatccatggccagacccgcgaggtgctggcgaagatcgacgcgctgctggccgaggccgggtcgcgcaaggagcgtatcctcagcgcgaccatctacctgaaggacatcgcccgcgatttcgccgccctgaacgaggtctggacccagtggttgccgaccggccaggcgcccagccggaccaccgtccaggcggagctggcgcgtccgtcggtgctggtggagatcaccgtggtggcggccaggggctga

SEQ ID NO: 16265 - DNA, 942 bp, Pseudomonas aeruginosa
cttactttccatagccataagaaaaaagaggcagaacctccgatgaaaatccttgtatccagcactctcgcactctccctgtcgctcgccatcggcgccgcgcaggccgaggaactcagcggcaccctgaagaaggttgccgacaacggcacgataaccctgggttatcgcgatgcctcggtgcctttctcctaccttggcgataacagcggccagcccatgggctattcggtggaactggccgacaaggtggtggagcggctcaaaagcaccctcggcaagccggaactcaaggtgaagtacaacctggtcacttcgcagacccgtatccctctggtgcagaatggcaccgtcgacctggagtgcggctccaccggggtcaccgccgagcggcagaaacaggtggcgttctcctacggcttcatctacgtcaagggccagttgctgacccgcaaggacagcggcatcgcccacttcgacgacctcaagggcaagaacgtggtgaccaccgccggcaccaccaacgagcgctacctgaagaactacaacgccgaacacaagctggggatgaacgtggtcagcgccaaggaccacggcgaagccttccagatgctgcaatcgggtcgcgcggtggccttctacatggacgatgcgctgctctacggcgaacgcgccaaggcgcgccagccgcacgactgggtggtggtcggcgagccgcaatcgcgggagatctacagctgcatggtgcgcaaggacgacccgcagttccttgccctggtcaacgagaccctggccgggctgtatcgctcgggcgagatacagggcatctaccagcgctggttccagcagccgatcccgcccaaggggttgaacctggagtttcccatgaccgcggagctgaaggcgatcctcgagaaccccaccagcgatccggtgcagtga

SEQ ID NO: 16266 - DNA, 549 bp, Pseudomonas aeruginosa
gcgtctagcgctgcaggccgaggtggcggatcgacggcgtcggcgcgtccaggcgcgaccagacgtcgtcggccagttcggccggatagaacgacggcaggccaggcagttcgtcgcgggcgatccagccgacttcgcggatatcgaactcgtcgccgcccaggcccttcaggttggccagggtcggctcgccacgccaggcgtcgatgcggtagaacagctccatgtggaagcgcccggcggcgggttcggcgaattcgcgcacgtagaccagcgggccgacgtccacccgcaggccggtctcctcgaaaaactcgcgccggacggtatccttcgtcgattcgtcgcattccgactcgaagccgccgccgggcggaatccagtagatgtcgccgccgacctcgtggcggaccagcaggatgcgttgctccaccaccagcaggccggcggcgcggatacggtgtcgcaaggcctcggccatgctcgttctcccggcgccaggcgccgttgcttggattgatggtttcccctctaccggggcggacatga

SEQ ID NO: 16267 - DNA, 384 bp, Pseudomonas aeruginosa
ttctgtatccggaaattaaaccctacgctcgccacgagctggccgtcgacgaaccgcatgtgctgtatgccgacgaaagcggttcgccggacggactgccggtcgtcttcgtccacggcggccccggctccggttgcgatgccctgtcgcgtcgcttcttcgatcccaacctctaccgtatcgtcaccttcgaccagcgcggttgcggccgttccacgccccacgccagcctggagaagaacagcacctgggagctggtggcggacatggagcgcctgcgcgagcacctgggtatcgagaagtgggtgctgttcggcggttcctggggctcgaccctgtcgctggcctacgcgcagacccatcccgagcgggtccatgcgctga

SEQ ID NO: 16268 - DNA, 1077 bp, Pseudomonas aeruginosa
ccgacgagcggcatgccccctggtcttccaggcccggtgcacgtaacgcgaatgactggaaacaggcattctttttgtcagatcgcgccaaatctggctatctatcgggtttggcagcgaatgtggcgaaaccatgttcgaccggcactccggtgccgtcggagacccctgaacggtcagggcgtcttcagtaattcatgttcacggacgagggggcctcgtgattttccgttccgtttcaaacaccgatttccgcgcccgcgtgcgcaccctgctgcttgccggctcgaccgcgctggcattcgtcgccgccccggtatgggcgttcagcatcgacgacgtggcgagcaaggccaaggacctggccggcgacaagtattccgcgccgaccagcaacctgccatcggaattcagcgaaatgaaattcgccgattaccagcagatccgtttcatcaacgagcgcgcctactggggcaagctgaagacgccgttcaagctgagcttctatcaccagggcatgcacttcgacacgccggtgaagatcaacgaggtgaccgctaccacggtcaagccgatcaagtacgatcgcaccaagttcgatttcggatccctgaagttcgacgagaatgccaccaaggatctcggctatgccggtttccgcgtgctctatccgatcaacaaggccgacaagcaggacgagatcgccaccttccttggcgcgagctacttccgcgtggtcggcaagggccaggtctacggtctgtcggcgcgcggcctggcgatcgataccgcgctgccttcgggcgaagagttcccgcgcttccgcgaattctggatcgagcggccgaaggcgcaggacaagcaactggtgatctacgccctgctcgactcgccgcgggccaccggcgcctaccgcttcgtgctgcgtccgggcaaggatgcggtgatggatgtccaggcccgcgtgttcctccgcgacaaggtcagcaagctgggcctggcgccgctgaccagcatgtacctgttcggctccaaccagccgtccgagcagcacaacttccggcccgagctgcatga

SEQ ID NO: 16269 - DNA, 852 bp, Pseudomonas aeruginosa
atggcgctggaaccgcgttccgcagtacttcgcctaccaggccgaggagccgttacgggccaacgagatcggccgggtcgaggctatcgaggaacagggcagggacgcgcgcgtcacgctgcttggcgagagcggcgagaagcaggtcgtgaccgttgcccaggacagcctgcaattctccgaaggcgacgacgtggccgagggcgacgcggtcggggtgacccgccactgggccgccggcccactgctctggggcctgtggaccaccctctggctatcgctggtgtccggtgccatcggtctggctatcggcctggtcgccggcctctgccggctgtcgaagaacccgaccctgcacggcctgtcgacgatctacgtcgagctggtgcgcggcacgccgttgctggtgcagatcttcatcttctacttcttcatcggcaccgtgctcaacctgtcccgcgagttcgccggggttgcggcgctggcgctgttcaccggcgcctacgtggccgagatcatccgggccggcgtgcagtccatcgcccgcggacagaacgaggccgcccgctccctgggcctgaacgccggccagtcgatgcgctacgtgatcctgccgcaggccttcaagcgcgtgctgccgccgctggccgggcagttcatcagcctggtcaaggacacctcgctggtctcggtgatcgccatcaccgaactgaccaagagcggccgcgaggcgatcaccacctcgttctccaccttcgagatctggttctgcgtcgccgcgttgtacctgctgttgaacctgcccctttcgcacatggcatcccgactggagcggaggctcggacaaagtga

SEQ ID NO: 16270 - DNA, 411 bp, Pseudomonas aeruginosa
gcaactgttggtgcaggtcggccaccgcacggctacgttgcaacgcctgcgggtcgccggcctgctgcgcgaggctggcgtccatcagttcctcgaggcgggcgaagctgtccagcgcctgctgtgcagtgcccaccagcacaccacgggcggcgctgcgttgctgatcggctgcggcgaggtcgtcgaaagccttgcggtaggcttcgatggcttcggtctggtgggccagggcggccgggtcgagctcgctgtcgcgcagcgcctgcaggcgctggagcatcccggccagggtctggcggacctgctcggcctggcgcgggtcgctgccggcttcgaatgccaggcggccttgttcggcttgctgggtctgttccatcaggctggcgacttcggcgagctgctcgctga

SEQ ID NO: 16271 - DNA, 513 bp, Pseudomonas aeruginosa
ctgttcagcagcaccagcttcggtacgcccatcgcggcgatggtctgcaacacccggcggagcatcttcggtcgcggcaaggccagcagcagggtgatcggcagcttggccggcggcggctggtcaaagcgcacttccagggtcgcctcgctggcgtcgagcttcagcaggcgaccttcgcccatccagccgccgaggcggccgacccgcagggtgtcgccgttctcggcgcggtgcacttcgtgcaggtgcttgaggcggcgatcgtgcaggaccgcacgatccgccgacacgaagtcggcgtcgtcgaggagcagcaggttcactggcgggtggccggaggctggtcgccgtcgctggccggttggtcgtccggatgctcgccgcgcttgcgtaccaggcggccgaacagcaggccgatctcgaacagcagccacatcggcaccgcgagcatggtctgggagaagatgtccggcggggtcaggaccatgccgaccacgaaacagccgatga

SEQ ID NO: 16272 - DNA, 816 bp, Pseudomonas aeruginosa
acggcgcgaggaacggcgaggcgacgtcggtggcgatcatgctggtgccttccggaaggaagcggcgcaacggctcggagaccagggtgtagatcttctgcgagaagtagaacaggccggcgaagatcaggaagatcgccgccacgctgcgcagcaggcgcgtacgcagttcggtcaggtgcgagaccaggggcatttcctggtcgtgctcgggctgctcgggtttatcggcgctcatggattacgcggcgtctcggacggtggcgaagggggagtggaggcagcgactgccggcggtgccgcggcgtccgcgggcggaaccgcaggcgtgctggtcggcggcggcgtgggtacgctcggcgccgggctctcggccgccggcggcggggtttcctgcgggggattctgaccggtcagcggggccagcagcttctgcgcttcgcgctccatcgagaggatgtgctcgttgtgcagttgccggcggatctcgtccgcgccgatttcccgttccacttcctgcttgatggtattgaaactgcgcttcaggcggccgatccacaggccggcggtacgtgcggcgcccggcaggcgctcggggccgagcaccagcagggcgaccagcccgaccagcaacagttcgctgaagctgattccgaacatcgatggctacccgtcagtccttgcgcgccggttcttcgaccttctgcgcctgggcgtcgatggtgtgcggctggttcagcggttgggccggctgggcggcgggctggtccttcttgtcgtcttcctcggtgttcaccgccttgcggaagcccttga

SEQ ID NO: 16273 - DNA, 660 bp, Pseudomonas aeruginosa
tgccggtttcggcggtggccagcacggcctggatcagcagcgagctcatcggcgcgccctcggttaaggcttgataccgcggtgcagggcgacgatgccgccggtcatgttgtggtaggtcacgcggtcgaagccggcttccaccatcatcgccttcagggtttcctggtcggggtgcatgcggatcgactcggccaggtagcgatagctctcggagtcgttggtgaccagcttgcccatcagcggcagcaggctgaacgaataggcgtcgtaggccttggacagcaggttgctgctcggcttggagaactccagcaccagcaggcggccaccgggcttgagcacgcgcagcatggagcggatcgcttcgtccttgtgggtgacgttgcgcaggccgaaggcgatggtcacgcagtcgaagtggttgtccgggaagggcagcttctcggcgtccgcctggacgaagctgacgttgccggagacgcccttgtcgagcagcttgtcgcggccgaccttgagcatcgaggcgttgatgtcggccagcaccacctcgccggtcgggccgaccaggcgcgagaactgccgggtcaggtcgccggtgcccgccggcgatgtcgagcacgcggttcccgctgcgcacgccggacagctcgatggtga

SEQ ID NO: 16274 - DNA, 969 bp, Pseudomonas aeruginosa
cgttctcacctggaaagaatgccgggcattctaacaggatgtggggaaagtgctgtgccgccgtccgacggcgcgggtgcggtgttttgtctggccgcgtatagttttccgatctgcaatcaggagtcgatccatgtcgcgtatccacatcgaacgtccgcacagcctggggctggacgccgcacgggccaaggcggagaaactggccgaacgtctggcgaaggagcacggcgtgcagtgcgaatggcagggcgacgagctgaccttcaaacgcagtggcgtcgacggcaggatcgcggtgggggcggacaaggtcgcggtggacgtcaagctcggcctgatgctgtcggccatgagcggcctgctcaagggcgagatcgagaaggcgctggacaaggcgctggcctgatcccgccgggcgttcgccgtcctggcggcgcccatcttccgcttagtatgcggtttctaattttccccgataccttgctctcacgctgccagcgttccggcggcgcctgcggtttcttcaacccaacgagcgtgaggtgccccatggccaagattgccctgaagaaaaagaccgtttccgaatccacttccctggtctccgagatccgccactatgcccgccagatctggcttgccggcctgggtgcgtattcccgcctgggcaccgaaggcagcgactacttcaaggaattggtgaaagctggcgaagccctggagaaaaaaggcaaatcgctggtcacaagtcaggtcgattcggccaatgacagtgtcaagaccggcctctcttcggtgaagggaaaagtcgaagaccagctcgacaggatcgagcaggcattcgacagccgtgtcgctagcacgttgaaccggataggcataccttcccggaacgatgtcgaagcactctctgctaagctggatgagctgagcgcagtgctcgagcgtgtcgcgagaacccaataa

SEQ ID NO: 16275 - DNA, 465 bp, Pseudomonas aeruginosa
accggcagccaaggccgccgccaagcctgcggcgaaacccgcggcgaaaaaacccgcggcgaaaaccgcggccgccaagccggcagccaagcccgccgccaaaccgactgcgaaggccgcagcgaaaccggcgaccaagccggcagccaaggccgcggcgaagcctgctgcgaaacctgccgcagccaagccggccgctgcgaccgccgccaagcccgcggcgaaacctgccgccaagccggctgcgaaaaagcctgcggcgaagaagccggcagccaagcccgccgcggcgaaaccggccgctcccgccgcgtcttcgagcgcgcccgctgcccccgccgccacaccggctgccagcgctccggcagcgaacgctccggcgacgccgagcagccagggctgagtcctggcggcaaggcacacgcccggcactcgccgggcgtttttcattccggtcccaggtag

SEQ ID NO: 16276 - DNA, 1455 bp, Pseudomonas aeruginosa
ccgcgtgttgtcgttgttccagtagaggatgtcgaacgccggcggctgcctgccgagcaggtagttgttgacccagtagttccagatcaggtcgttggggcgcatccaggcgaacaccttggccatgtcgcgcccgtccagcacgccatgctggtaggagcggcgcttgctgctctccagggtctgctcgtcggcgaagagcatcgccgggctttccatctggctgtcgagcaggctgaccaggtaggtgacgctactgaccttgcgcagttgccggcgcacctgcaggtggccgagcaaggcggccacggtgagcccgccggcgcaggcgccggccaggttcacgctgcggctgccggtgatctcgcggctgacctcgatggcctggtcgagggcctcgacataggtgctcaggccccattcgcggtgctgggcgtcggggttgcgccaactgatgacgaagacctgcaggttgttcttcagggcgtactggacgaagctcttttccggcgacaggtcgaagatgtagtacttgttgatctgcggcggcacgatcagcaggggcttggcgtactggcgctcgcccagcggcttgtactggatcagctccagcacctcgttgcggaacaccaccgcgccttgcgtggtggcgaggttgcgaccgatctcgaaggcggtcttgttcacctggctgggcatgccgccgttgtgcaccaggtcttcgagcaggtggcggacgccattgagcaggctgatcccgccggtattgaacagttcctttaccgccagtggattgatcaggctgttgctgggtgccacggcgtcggagagcaaggcgacgaggaagcgggcgcgggcgcgatcgtcgcagtccaggttgctttcgtcgatccaggcgagcagttgcttctgccacgccaggtaggcctgcagggtgcgccggtagaagggattgaggcgccaggatggatcctggaagcgggcgtcctgtgggttcggctggtgcagggtgtcgcccagcagcaccttgcccaactggcctccgaaggcgaccaggtgccgcgcactgtgcagcggctggcgcaggccgtggacagccaggctgcggaccgtcgtcagcaggtccttgccgcgcaggccgacgatggcgctctgtgcactcatgaactcggcgggcaccggcacgctacccgattcctgcttttctcgcatggaccacactccgtcgtaggaccacagtctggatgccacgggcgatcgtcccctggctcggaatactcagttatagcctgtgaattccgtttcacccggggcagaaccgcacacctgcctgaacagggaggatgccgcccgacagtggggcagcaagcgctgtaccacaacgccgggaggggcgtcgcagagcttgcgctgtcgcggcgaagccaggcgccatgcgccgttgcggaacattga

SEQ ID NO: 16277 - DNA, 474 bp, Pseudomonas aeruginosa
gttcgtggacgatctcgcggggcgtcatggacattcgtttactccagcgggggacgagcgcttcagacggcgctgtccagctcctcgatggtcaggttctggttggtgaagacgcagatcgagccggcgatgttcagcgcggtctcggcgacttcccgagcgctcagctcggcgttgtgctgcagcagggccagggccgcggcctgggcgaagccgccgccggagcccatggcgatcaggccgtgttcgggttcgaccacgtcgccgttgccggtgatgatcagcgaggcatccttgttggcgaccgcgagcatggcttcgaggcggctcagggagcggtcggtgcgccagtccttggccagttcgacggcggcgcggaccaggtgcccctggtgtttctccagttgctgctcgaagcgctcgaacagggtgaaggcatcggcggtggcgccggcgaaaccggccagtacctga

SEQ ID NO: 16278 - DNA, 1758 bp, Pseudomonas aeruginosa
tctgggtgtatggaagcgttcgccggtgctttcgctcgatcgactggcgcagagcggcttcgccgtggtccgcgggcgggtgctcgaggtcgaactcaaccggggcggtatctggctggagatggacggtccgctggtcctgcggatcgagccgaaggtgctcaaggcgttcgatgcgaaacgggtgatgcagatggcgggacgttcgctggaagtgcgtggctgggtggtcgatcgttcccgccgtggcgctgtgccggccggcaaggcgcgctggcagatgtcggtgaccgatccggcgatgctggaatggttgccatgaagaccgcctggctcctgctgctgttgctgggagtcggcgcgctgggcggctgcgcggtgaacccggccaccggcaagagcgatttcgtgatgatgagcgagcagcaggaactcggcatgggcgctcgctacaaccaggaaatcctcaagcagttcccccgctacaacgatgaaaagctccaggcctacgtgcaacgggtaggcgagcgggtcgcccgcagcagccaccgcagcaatctgcaatatcatttcaccgtcatcgattcgccggacatcaacgccttcgccctgccgggcggctacatctatatccatcgcggactgatcgcctaccttggctccgaggccgaactggccgcggtgctcggtcatgaggtcggccacgtcacggcgcgccacagcgtgcgccagcagagccaggccagcgcctggaacatccttggccaggcggtggcgatcggcaccggggtcggtgccgccggcgacctggccaacgtgctcggcacggccttcgtccgcggctacgggcgtgacatggaactggaagccgatggtctcggcgctcagtacctggcccgcgccggctacgatccgacggcgatgatccaggtggtgcgggtgctgaagaaccaggaggacttcgctcgcgaagaggctgcgcgcaatggccaggcggtacaggccggcggctaccacgggttgttcgatacccatccggacaacgaccggcgtctgcaggaagtggtcggcccggcccggcaactggccaacggacagcaggaagtggggcgcgaggtctttcttcgccatctggaaggcatgccgttcggcgactcggcatcggccggggtgcgtcgcgggcagaacttctaccatgccgagctggacttcaccctgagctatccggcgggctggaagatcctcaaccagcccagtgccctgcttggctatccggcggacgagcagtcgttcatcggcatgaagctggtgccccatgattcccgcctgacgcccgcggagttcctgcgcaagaacgccgggcaacggctggcccaggaagagtcgctgaagcaggcaggactgaacggctacacggcggtggtgccaggcaacccggcgcgacgggttgctgtgatctaccagggcgaccgcgcctacctgttcgtcggcgtggtcaaggtcggttccctggagacccaggacgaccgcttcctcagcgtgatccgcagcttccgtccgctgcgcgacaaggagcgggccctggcgcagccgcgacgcctgcacctggtgcaggtcaaggcggggcagacgctggagcaattggcggctggcggcgaggggtcattgagtgactccgtggctcgtctgcgtctgctgaatgacctttatccgagcggtgaaccccgtccgggcgattggcttaaagtcgtacgctag

SEQ ID NO: 16279 - DNA, 1092 bp, Pseudomonas aeruginosa
gtattgaacgctaatagggaattggtcgtgctagggctcataaagaagaaagcgaacaccttgctggggatcgacatcagctcgacctcggtaaagctccttgagttgagccgctccggaggccgctacaaagtggaggcctatgccgtcgagccgcttccgccgaatgcagtcgtggaaaagaacatcgtcgagctggaaggggtcggccaggcgttgtcacgggtgctggtcaaggcgaaaaccaacctgaagtcggccgtggtcgccgtcgccggttcggcggtgatcaccaagaccatcgagatggaggccgggctttccgaggatgaactggaaaaccagctgaagatcgaggccgaccagtacatcccctatccgctggaggaagtcgccatcgacttcgaggtccagggactctccgcgcgcaatcccgagcgcgtggacgtactcctggccgcctgtcggaaagagaacgtcgaggttcgcgaagcggccctggcgctggccggcctgaccgccaaggtggtcgacgtcgaggcctacgcgctggagcgctcctatgcgctgctgagcagccagctgggtgccgacaccgaccagttgaccgtggcggtagtggacatcggcgcgaccatgaccaccctgagcgtcctgcacaacggacgcaccatctatacccgcgaacagctgttcggcggtcgccagctcaccgaggagatccagcggcgttacggactctcggtggaggaagccggtctcgccaagaagcagggcggtcttccggatgactacgacagcgaagttctgcgtccgttcaaggacgccgtggtgcagcaggtttcccgctcgctgcagttcttcttcgccgccggacagttcaacgacgtcgactacatcgtcctggcgggcggtacggcgtctatccaggatctcgatcggttgatccagcagaagatcggcaccccgaccctggtcgccaacccgttcgccgacatggcgctgaacggcaaggtgaatgccggcgccctggccagcgacgctccggcgttgatgatcgcctgcggcctggcgttgaggagtttcgactga

SEQ ID NO: 16280 - DNA, 621 bp, Pseudomonas aeruginosa
cttcgagatcaagccggtcgcgcccggcagcacgtccaagctgcgcatgagcatcctggccaagacctatcgctacaacgacaaggggctgaagaaatgagagcccgcctgattctgagcagcctgctgctcgccagcctggccggatgcggcggcggttccgatttcgccgatctgcagtcctacatggacgaggttcgcgcccggcccaagggcaccatcgagccgttgccgaagttccagccgtacgaggccttcacctatagcgccgcgtcgctacgcagcccgttccagccgccggtgaagatcgacctgaccgtgcggcagaagggcaacaaggtgatcaagcccgacgagacgcgggtcaagcagttcctggaaggcttcaacatcgagaccttcgagatggtcggcaccctgtccaacgcccagggcaccttcgccctggtgaagggcgcgggtggcgtgcaccgggtgagggtcggggactacctggggcgcaacgacggcaaggtcgtcggcatcagcgaaggaaaaatagacgtgatcgaaatcgttcctgacggagaggggaactggctggagcgtccgcgcagcctgactctcaaggaacgctcctga

SEQ ID NO: 16281 - DNA, 2865 bp, Pseudomonas aeruginosa
gagttccttatgaaagcaggtctgtaccatcctgaaacgttcaaggataactgcggatttggcctgatcgcccatatgcagggcgagccgagccatcaacttctgcaaaccgcaatcgaagcactgacctgcatgacccaccgcggtgggatcaatgccgatggcaagaccggggacggctgcgggctgctgatccagaagcccgacctgttcctgcgtgccgtcgccagggaagccttttctgtcgacctgcccgagcaatacgcggtgggcatggtgttcttcaaccaggacccggtgaaagccgaggcggcacgcgagaacatgaatcgcgagatcgtcgccgccggactggagctggtcggctggcgcaaggtgccgatcgataccagcgttctcggccgcctggcgctggagcgtctgccgcagatcgaacaggtgttcatcggcggcgccggcctgagcgaccaggacttcgccatcaagctgttcagcgcacggcgccgctcgtcggtggccaacgccgccgacagcgaccactacatctgcagcttttcgcacaaaaccatcatctacaagggcctgatgatgccggccgacctggccgccttctatccggaccttggcgacgagcgcctgcagaccgcgatctgcgtattccaccagcgcttctccaccaacaccctgccgaaatggccgctggcgcagccgttccgcttcctcgcccacaacggcgagatcaacaccatcaccggcaaccgcaactgggcccaggcgcggcggaccaagttcaccaacgaactgatccccgacctggaagagctcggcccgctggtgaaccgcgtcggctccgactcgtcgagcatggacaacatgctcgaactgatggtcaccggcggcatggacctgttccgcggcctgcgcatgatcatcccgccggcctggcagaacgtcgaaaccatggacgccgacctgcgcgcgttctacgagtacaactcgctgcacatggagccctgggatggccccgccggcgtcgtgctgaccgacggtcgctatgccgtctgcctgctcgaccgcaatggcctgcgcccgtcgcgctgggtcaccacgaagaacggctacatcaccctggcttcggaaatcggcgtctgggactacaagcccgaggacgtcatcgccaaggggcgcgtcggcccggggcagatcctcgcggtggacaccgagaccggccaggtcctgcacagcgacgacatcgacaaccgcctgaagtcgcgccatccctacaagcagtggctgcggcagaatgccctgcgcatccaggcgaccctggacgacgaccatggcgtggccagctacgacgccgaccagctcaagcaattcatgaagatgttccaggtcaccttcgaggagcgtgaccaggtgctgcgtccgctcggcgagcagggccaggaagcggtgggctccatgggcgacgatacgccgatggcgatcctctcccggcgcatccgctctccgtacgattacttccgccagcaattcgcccaggtcaccaacccgccgatcgacccgctgcgcgaagccatcgtgatgtccctggaaacctgcctgggcgtcgagcagaacatcttcgaggaagccccgcaccatgccaaccaggcgatcctcaccactccggtgatctcgccggcgaagtggcggaccatcatgaccctggaccgcccgggcttcgaccgccacttcatcgacctcaactacgacgagtcgatgggcctggaggccgcggtgcgcaacatcgccgaccaggccgaggaggccgtgcgcggcggcaaggtgctgctgatcctcagcgaccgccatatcgctcccggcaaactgccggtgcatgctgccctggccgtcggtgcggtgcatcaccgcctggtgcagaccgggctgcgctgcgactccaacatcctggtggagaccgccaccgcccgcgatccgcaccatttcgcggtgctgatcggcttcggcgcctcggcggtctatccgttcctcgcctacgaggtgctggccgacctgatccgcaccggtgaagtgctgggcgacctctacgaggtgttcaagtactaccgcaaggggatctccaagggcctgatgaagattctctcgaagatgggcatctccaccgtcgcgtcctaccgtggcgcgcagctgttcgaggcggtgggcctgtccgacgaggtcaccgacctgtgcttcaccggagtcgccagccgcatccagggcgcgcgcttcgtcgatatcgagaacgagcagaagctcctggccgccgaggcctggagcaaccgcaagccgatccagcagggcggcttgctgaagttcgtctatggcggcgaataccacgcctacaacccggatgtggtgaataccctgcaggctgccgtgcagcagggcgactacgagaagttcaaggaatacaccgcgctggtggaccagcgcccagtgtcgatgatccgcgacctgttgcaggtgaagaccgccgcgcagccgctggcgctcgacgaggtggagccgctggaagccatcttcaagcgcttcgatgccgccgggatttccctcggcgcgctgtcgccggaggcccacgaggcgctggccgaggcgatgaacaccctgggcggtcgctccaactccggcgagggcggcgaggacccggcgcgctacggcacgctgaagagttcgaagatcaagcaggtggctaccggccgcttcggcgtgaccccggaatacctggtcaacgccgaggtcctgcagatcaaggtggcccagggcccccatgccccggcgagggcggccagttgccgggcggcaaggtcaacggcctga

SEQ ID NO: 16282 - DNA, 1443 bp, Pseudomonas aeruginosa
ggtttcgatatgtctgaacgtctgaattccgaccgcctgaacaacgacttccagttcatcgaagtcgggcgcaaggacccgaagaagaagctgctgcgccagcgcaagcgcgagttcgtggagatccacgacctgttcaagccgcagcaggccgccgaccaggcccaccgctgcctgggctgcggcaacccgtactgcgagtggaaatgcccggtgcacaacttcatccctaactggctgaagctggtttccgaaggcaacatcctggccgccgccgaactgtcgcaccagaccaacaccctgccggaagtctgcggccgggtctgcccgcaggatcgcctctgcgagggcgcctgcaccctcaacgacggttttggcgcggtgaccatcggctcggtggagaagtacatcaccgatacggccttcgccatgggctggcgtccggacctgtccaaggtcaagccgaccggcaggcgcgtcgcggtgatcggcgccggcccggccggcctcggctgcgccgacgtgctggtgcgcaacggcgtgaccccggtggtgttcgaccgcaacccggagatcggcggcctgctgaccttcggcattcccgagttcaagctggagaagcacgtcctcagccgtcgccgcgaggtgttcaccggcatgggcatcgagtttcgcctgaacaccgagatcggcaaggacgtggccatggagcagttgctcgatgagtacgatgccgtgttcatggggatgggcacctacacctacatgaagggcggtttccccggcgaggacctgccgggcgtacacgacgccctggacttcctgatcgccaacgtgaaccgcaacctcggcttcgagaagtcggccgaggacttcgtcgacatgaagggcaagcgcgtggtggtcctgggcggcggcgacaccgcgatggactgcaaccgcacttcgatccgccagggcgccaagtcggtgacctgtgcctatcgccgtgacgaagaaaacatgccgggctcgcgcaaggaagtgaagaacgccaaggaagagggcgtgaagttcctcttcaaccgccagcccatcgccatcgtcggcgaggaccgggtggaaggcgtgaaggtggtcgagacccgtctcggcgagccggacgcccgcggccgccgcagccccgaaccgatccccggttccgaggagatcatcccggcggaagccgtgctgatcgccttcggcttccggccgagtccggcgccgtggttcgagcgcttcgagatcgccaccgacagccagggccgcgtggtggctccggcgcaggcgcagttcaagcaccagaccagcaacccgaagatcttcgccggtggcgacatggtccgtggttccgacctggtggtgacggcgatcttcgaaggacgtaccgcggccgaaggcatcctcgactaccttggcgtctga

SEQ ID NO: 16283 - DNA, 1143 bp, Pseudomonas aeruginosa
cagcgcgcgtccgtccaggccgcgctcctccagcaggccgagcagcaggcgcgggtaggcagcggtgatggtcggtgcgtcggagtccgtgcggcggctcatgctggcgtgtcctggcccgaaatgatcggcagtctggcgcgagcgcgtctgccgctgcattggctggtgccgcgatactgcccggcaacgcagtcaagcggagaacgagcgatgcatccctgggcacgacgcaacattccacaactggccgggcgcctggcgctggtcaccggcgccaacagcggcctgggttggcaggcggcgcgcacgctggccggcaaaggggcgaccgtggtgatggcctgccgcaatcgcgaacaggcggagcgggcgcggcgggcgatcctcgacgagtatccccaggcacgcctggagctggccgatctcgacctggccgacctcgcctcgatccgcgcctgcgccgccggtttccgtcagcgccacgaacgcctcgatctcttgttcaacaacgccggagtgatgttcctgcccctgcggcgtacccgcgacggtttcgagatgcagatgggcaccaatcacctcggccacttcgcccttacgggactgctgctggagtcgttgctggccgctccacggcccagggtggtgggcatgaccagcggtttcaaccagttcggccggctgccgctcgacgacctcaacgccgagcgcggctacaaccgctatctcgcctattgccacagcaagcaggccaatctgctgttcagcctggagttgcagcgccgcgccggccagcggggcgtgcttctgcagagcctggcggcgcatccgggctacgcggcgaccaacctgcagtacgcggcgccggcgatggccggttcgcgcctgggacgctgggcgatgaaggtggccaacggagcgttcgcgcaatcggcggagatgggggcgttgccggcactttccgcgctgaccgaacagcgctggtatggcggcgcctatgtcggcccggatcgctggttggaaacccgcggttatccggcggcggcgcggattccgcggaatgcgcgcgacctggggctggccgcgcggctgtgggcgcgatcggaggaactgaccggagtacgcttctggtcggagtga

SEQ ID NO: 16284 - DNA, 231 bp, Pseudomonas aeruginosa
agcgacgaggcctggcccttggcgcgcagggcgcggcgcccgatccagctgctcgccaccgagtgcgcgccgaagaagccgaaggtgaatagcagcaggccggcgagcatcagcgggatcggctcgaacagggtcagcagcaggccgccgagcatcagcaggatgaccgcccagagcaccttgcgtcgccccagcttgtcggccagcgaaccgacccaggccgagctgtag

SEQ ID NO: 16285 - DNA, 285 bp, Pseudomonas aeruginosa
gtcatcgccaccgcggccaggccgctcaaggacagcccgaccagcgcgcgcatcagcagcacgccatgccaggtgggcatcaccgcgctgccgagggtgaacagcgcggcggccagcagcgagacgaccatcaccggcttgcgaccgatcgcgtcggagatcgggccggtgaccagcaggccaagggcgagcatggcggtggcgacggacaatgccaggctgctttccgcggcgctgatggaaaacgccttggacagcaccggcatcatcggctggatgcagtag

SEQ ID NO: 16286 - DNA, 936 bp, Pseudomonas aeruginosa
tatgtaaaaagacctaattggaggggccgcgtggaactcaggcacctgcgctatttcatcgccgtcgccgaggagctgcacttcggccgcgccgccgagcgcctggggatctcccagccgccgttgagccagcagatccaggcgctggaggaggaaatcggtgcgcgcctgttcgagcgcaccaaccgccgcgtcgaactcaccgacgccggccggctgttcctcgacgagtcccgccaggtgctggcccaggtagacaaggcggtgttgctggcgcgtcgggcccacctgggggaactgggcgagctgaagatcggtttcacttcctcggcacccttcacctcgaccatacccagcagcatccatgccttccgcaaggcctatccggacgtacacctcgacctgcaggaaatgagcagccgccaggtactcaaggcgctgctcgaggaaagcctgcaggtgggcgtgatccgcccgctggcgctgccggatgcggtgcattgggtggagttgttccgcgaaccgctggtggcggtgctgcgggccgaccatccgctggcggccggcagcgaggatggcctggccatcgccgccctggccgaggagcccttcgtgttcttcccgcgcagctacggcaccgggctctacgaccaggtcatcgccctgacccgacaggccggcttcagcccgcgcatcgcccaggaggccagcgaggcgatgaccatcatcggcctggtctcggccggactgggggtgtcgatcctgccggcgtcgttccgccgcacccgggtcgacggcgtggtctaccgcaccctgagcgatcccgaggcgacgactgcggtatggctggtccgtcggcagaacgagggctcgccgctggcgctgtccttcatcgacctggtgacccgcgaggcggccagcctgcgccggcgctga

SEQ ID NO: 16287 - DNA, 858 bp, Pseudomonas aeruginosa
accgctctacgtcaggaccgagacggcgctcgcgcttgcccgcggctttgcctatcatccgggatcaggctcggctcacggagatttcccatgcggcgcgtggtgttcaatcagaaaggcggggtaggcaagtccagcatcgcctgcaacctggcggcggtcagcgcggcggagggctatcgcaccctgctggtggacctggacgcccaggccaactccacgcactacctgaccggactgaccggcgaggacctgccggtggggatcgccgacttcttcaagcagaccttgtcttccgggcccttcagcaagaagggcagggtcgagatctacgagacgccgttcgacaacctgcacatcgtcacctccagccccgaactggccgacctgcagccgaagctggagtcgaagcacaagatcaacaagctgcgcaaactgctggacgaactggacgaagactacgaccggatctacctggataccccgccggcactgaatttctacacggtatctgcgctgatcgctgccgatcgctgcctgattcccttcgattgcgacagcttctcccgccaggcgctgtatggccttctccaggagatcgaggaactgcgtgacgaccacaacgaagacctgcaggtcgagggcatcgtggtcaaccagttccagccgcgcgccagcctgccgcagcaactgctcgacgagctggtggcggaggaactgccggtgctgccggtgtacctgatgagttcggtgaagatgcgcgagtcgcaccaggcttgtaccccgctgatcttcctcgaaccgcggcacaagttgacccagcagttcgtcgagttgcacgggctgctcgaaagctga

SEQ ID NO: 16288 - DNA, 402 bp, Pseudomonas aeruginosa
ccgcgtgcatgcgccggcgccgcgactcctggtctccgccttcttcctcgacgcgccggcggtaggcctcggcccagcggtcgaaggcctcgcggtcgacgaagtcgtcgcgcaggctggccagcgcccgctccggagtttcttcgccgagtcggcggaagaacagcgagtaatccaccgcgctgccctgcatgcgctgcaacagttcctggaccagggcctggtcgttctccgcggcgacgcccaggcccaggcgccggcgcatcaggtcgaggtagtgggcctggtagaggggcaggaacaggtcgaggctggcgcgcagttcgtccacttccaccagtggcgtcagcgcctgggccagggcggccaggttccaatgggcgatcggtacctggttgctga

SEQ ID NO: 16289 - DNA, 405 bp, Pseudomonas aeruginosa
tcacctcgccgagcagcaggccgcggccgtcgcccaggcgcgggttataggagccgaactggtggccggaatacaccatcgcccgcggctcggcctccgaccacagcttgtgcccgccgaacagttcggcgaacagcgcttcgtcgctggtttccgctggcaggtcgagcagcgccagggcggcggggctggctaccaccaggcgcggctcggcgatggggtcgggcaggacttcggtggagaaggcgtcgcccaggcgggcgaagcggttgtcgaagtcgaggtcgtcgagtgatttcaagagaggcctccggcaattcccgagcattgtgctgggaattgccggagggcgtccaggccctgaggttcagcgggtcggttcggcgggaccgtcctggcccttga

SEQ ID NO: 16290 - DNA, 285 bp, Pseudomonas aeruginosa
agcgaggccaccgccgacagctgggcatcgccttccagcacgaagtcgccgaagaagcgcgcgccgaggccccggtcgggcgcctggctgaacagcttgccgagggccggcaggtcgtgttcgtggccgatcacgcagagaatgtcgtcggcctcgaggatggtgctgcccgacgggtggagcagttcggtgccgcggaacagcgcggcgatccgggtcccgccgggcatcttcagctcgcgcagggcggcgccgatgcaccacttttccttgttcaggtggtag

SEQ ID NO: 16291 - DNA, 507 bp, Pseudomonas aeruginosa
acgaacagctcccactcgctggtcgggtggatctccaggccggcgcgggatatcggtgccggatccggcggcaccaccacccgcagcagcctggccgcccagggcaggctggtgccctgcaccagcagcgagaccaggacgatgaagaaggccacgttgaagaacagctgggcgttcggcaggccggccatcagcgggaacaccgcgaggatgatcggcaccgcgccgcgcaggccgacccaggcgatgaaggctttctcgcggtcgtggaaggcgcggaacgggatcagtccgatcagtaccgacagcggtcgtgccaccaggatcatccacagcgccagggccagtgccggcagggcgatcggccacaggtcgtggggggtgaccagcaggccgaggaccaggaacatgccgatctgcgccagccaggccatgccgtcgagcatgtgcaggatgccgtggcggctgcggatcgggcggttgccgaggagcaggccgcacaggtag

SEQ ID NO: 16292 - DNA, 483 bp, Pseudomonas aeruginosa
aggccgccggccaggtgcatgcggttgatcagttgcagcagcaaccagccgccgccaagaccgagcagggcgccgagaccgaactgctgcaccaggtgcagggcgaagccccagctgaggccggtctggccgctggcgagcatctcgatcagggtcacggtgaggaacaccgccattgggtcgttgctgcccgattcgatttccagggtcgcggtgacccgctcgttgagacctttgccgccgagcagggagaacaccgcggcggcatcggtggagccgacgatggcgccgatcagcaggccttccatccagtgcaggtcgaacagccaggctgccgcgatgccggtcaggccggtggtcaccagcacgcccagggtggccagcgacaatgccggccagagcgccacgcggaagctggagacgcgggtgcgcaggccgccgtcgaggaggatcacggcgagcgccaggttgcccaccaggtag

SEQ ID NO: 16293 - DNA, 1041 bp, Pseudomonas aeruginosa
aggtcgccaaccaacatcgatatgcgtgatacaagggccaaacctgcgacggcgagaccgctgccgaagcctcgggaggctggtagaatccgcgcccctcgcccatgggcgagggcctgtgccgacgcggggtcggcgcgaatccgccggggccgggcggtccggctagcagcgctgcctggcgctgtccaaggagcagtcatcatgaactatcgtcacgcttaccacgccggcaaccatgccgatgtcttcaagcacctggtgctggcgcggatcttcgccctactggggcgcaaggacacgccgtacgcctacctggacagccattccggggtcggcctctacgacctgcagggtgacgaggccagccgcaccggcgagtgggagcagggcatcgcccgcctgtgggagcgcgaaggcctgcccgagcaactggacgattacctggacgtgatccgtcacctgaatccggacggctccctgcgctactacccgggctcgccggaactggcgcggcgcctgacccgcgcccaggaccgcgtgctgctcaacgaattgcatcccgaggacggccgcctgctcaaggccaacatggctggcgaacggcgggtcgccgtgcaccagggcgacggttggctgctgccgcgggcgttcctgccggcgccggaaaagcgcgcggtgctgctgatcgatccgccgttcgagcaggccgacgaattgcagcgttgtgtcgctgcgctcgacgaggcgatcgggcggatgcgccagacggtggtggtgatctggtatccgatcaaggacgagcgccagctcaagcgtttctaccaggccctggaacgtagcgtcgcgccgaagctgctgcgtgccgagctgcacgtgcatccgatcgacgacgccgagcgtttcaacggctccgggctggccatcgtcaatccgccgtggccgctggaagacgaactgcgcgacctgctgccctggctggccgaggtcatggcccagagccagggcggctggcgtctcgactggctggtggcggaatag

SEQ ID NO: 16294 - DNA, 678 bp, Pseudomonas aeruginosa
tcgtcaggccggcaggcacaccccggtgccgcccaggccgcagtagccgttggggttcttcgccaggtactgctggtggtaggcctcggcgtagtagaagggcgggacgtcggcgatctcggtggtgatgcggtcgtagccggctttcgccagttcggcttggaagctctcccggctggccaaggccgcggccttctgggccgcgtcgaaggtgtagatcaccgagcggtactgggtgccgatgtcgccgccctggcgcatgccctgggtcgggtcgtgggcttcccagaataccttgagcagctgttcgaagctggtctcctgcgggttgtagaccaccagcacgacctcgctgtggccggtcaggccggagcagacttcgtcgtaggtcgggttcggcgtgtagccgccggcataacccaccgcggtcacccagacacccggttgctgccagaggcgacgctcggcgccccagaagcagcccatgccgaacagcacctgttgcaggccggcggggaacggcgcggtcagcgggcggccgttgacgaagtgcgcttcgggcaccggcatggcgctttcgcgacccggcagggcctggtccggcgtgggcagctcgcttttcttggtgaggatttcagaacgcagaaccatggctctcgtctcctgctcagggggtag

SEQ ID NO: 16295 - DNA, 1812 bp, Pseudomonas aeruginosa
cgagtagccggtgccgaagtcgtccatcgccagggtcaggccgaggctcttcaggcgttcgagttgctggcgggtatcgtcggtggcgtccagcagcaggctttcggtgagctccagttccagctggctggccgggatgttctcttcgtggaggatcgccgcgatcgagccgaccaggtccgggtcggtgaactgcttgggcgacaggttgatggcgatctgcagctcgcccagcccggcctcggccagctcgcgggcctggcgacaggcttcgcggatcacccacttgccgatcggcacgatcagcccggtttcctcggccacgctgatgaagcggtccgggcggatcatgcctttttccggatgctgccagcgcagcagggcttccaggccgagcaactggccgctgcgcaggcacagcttgggctggtagtgcaccgccagttcgttctgcgccagggcgcggcgcaggttgctctcgacgaacagcttgtagctggcctcggcggtcagcgcctcggtgaacacctggacctggtgcttgccgttggccttggccttgtgcagcgccaggccggcgtacttcatcagggtctgcgggtcgcagccgtgctgcggggcgctggccaggccgatggagccggtgatgttgatcaactggttgtcgacgaacagcggcttgtcgagcatgtgcaggacctgcgcggcaatgctttcgcccttttccaccgcggtgtcgtcgagcagcacggcgaactcgttgctggcgaagcgcgccagggtggcgccgtcgccgaggcaactgcgcaagcgccgggccaggctgaccagcagcttgtcgccggtctggtggccgaggctgtcattgatccgcttgaagttgtcgatgtccaccagcagcaggctgagcgggcggtcgccgctgctttccaggcgttcctcgagggcgccgatgaaatagtgccggttggccaggccggtgaggttgtcgcggtaggcgagtttctcgatgtgctgctgggccagcttgttctgcgtgatgtcttcgtagatgccgatgtagtgggtcagctcgccgagatcgtcgtagaccttcgacagcgacaactggccccagtaaggctcgtggttcttgcggcggctgcggaactcgccctgccagctgttctgctgggtcagcgcggaacgcgcgtcgaacagcagctcgctgaggttctccagcgccggaagctcggacaggcgtcggttacgcacttcgtcggcgctgtactgggtgatcgaggtgaagctcggattgacgtattccaccacgccgtcgcggtcgatcagcaggaaggcgctggcgctctgttccaccgcgcgctggaacaagtgcagggcgctggagacattgcgtcgctcgtggttcatcaggacctgcgcgtactggtcggcgagttccccggcgaaggcgatctcgtcgctctgccacatgcggttctcgccggcgtgttccaggcacagcacgccgaccacctcgccgccgatgcggatggtggcgtcgagcagggcgttgacgcccagcggcttcaggtagtccttgtagagttcctgggtgcgtgggtcgcgctgggccgttgtgggcgtcgatggcgcgcccgctgtgtaccgcctcgaggtaggcggggtagcggctggcgtcgatgctctggggcttctcgtactggtcgaggtcgcggcggtagacggtcaccgcttccaggcgctggtcgtcgagcaggcgccagatgccggcgcgcgcggtgccgtaggcttcgcaggcggcctgggtga

SEQ ID NO: 16296 - DNA, 432 bp, Pseudomonas aeruginosa
tcagttgcgcggcttccagcagcgggtcgctggacaggtagcgatggcgggccaggcggacgatcaggttctgctgggtgcgcgagcgcagcaggtgttgcaggtggtcgtcctgggagcgctggtagaggtccagggacgccttcaggcgcaggttctgcgattccaggtcgagcaactgttcgctgcgctcggcgctctccgctcgctcctcgaccatcaggtagccgtgcagcaactggcggccatgctgctggaaggcttcgccgaactccagcatggtcagcacgccgttgggtgtgtgcagcttgtagctcacctggtagtgcgggcgcttcaccagttgctgctggatctgctcgtgcaggcggtggcgggcctcgggttccatcaggctggcgtaaggcgcatcgagcagtgcgcagagggtag

SEQ ID NO: 16297 - DNA, 2952 bp, Pseudomonas aeruginosa
accatgagcctgccttcgctggcgaatctgccggccaccctgctgcccgccgccgaacgcgccgggactgccctccgctccgctgtcgccgccctcgatgccgccgccctggcccgcctggaggcctggcccgaggagcgcctggaggatttccgacgggtcgccgcggccagcgatttcgtcgccgagcaggcagtgcgcgacccggcgatgctgctggatctggccgaacgcggcgagctggagaacccccacgcgcccggcgaattgcgcagccagttgcaggcgcggctggaggattgcgccgacgaggacgaactcggtcggcgcctgcgacgtttccgcacacgccagcaactgcgcatcatctggcgcgacctgacccgccgcgccgcgctggcggaaacctgtcgcgacctgtcggccctggccgacgcctgcatcgacctggcttgcgagtggctccatcggcgccagtgcgagcagttcggcacgccgatcggccggcgctccggcgaaccgcagcggatggtggtcctcggcatgggcaagctgggcgcggtggagctcaacctgtcgtcggacatcgacctgatcttcggttacccggagggcggcgagaccgagggggcgaagcgttcgctggacaaccaggagttcttcacccgcctggggcagaagctgatcaaggcgctggatgcgatcaccgtcgacggcttcgtcttccgcgtcgacatgcgcctgcgtccctacggctccagcggaccgctggtctacagcttcgccgcgctggagcagtactaccaggaccaggggcgtgactgggagcgctacgcgatgatcaaggcgcgggtggtcggcggcgaccagcaggcaggcgagcaactgctcggcatgctgcggccgttcgtctatcggcgctacctggacttttccgccatcgaggcgctgcgcaccatgaagcagctgatccagcaggaggtccggcgcaaggggatgtcggaaaacatcaagctgggcgaaggcggtatccgcgaggtggagttcatcgcccaggccttccagttgatccatggcgggcgcgacctgagcttgcagcaacggccgctgctgaaggtgctggcgaccctggaggggcagggctacctgccgccggcggtggtcgaggagctgcgcggcggctacgagttcctgcgctacgccgagcatgccatccaggcgctggccgaccggcagacgcaaatgctgcccagcgacgaatacgaccgcatccgcgtggccttcatcatgggcttcgccagttgggccgcattccacgagcgcctgagccactggcgggcgcgcatcgactggcacttccgccaggtgatcgccgacccggacgaggacgaaagcggcgaggcggcctgcggcagcgtcggcgccgagtggatcccgctgtgggaggaggcgctggacgaggagtcggccagccggcaactggccgacgccggcttcgtcgatgccgaggcggcctggaagcgtctcagcgatctgcgccacggcccccaggtacgagcgatgcagcgtctcggccgggagcgcctggatgccttcgttccgcgcctgctggcgatgaccgtggaaaacccccagccggacctggtgctggagcgggtcctgccgctggtggaagcggtggcgcggcgttccgcctacctggtgttgctgaccgagaaccccggcgcgctggagcgcctgctgaccctctgcgcggccagcccgatggttgccgagcagatcgcgcggttcccgattctgctcgacgagctgctcaacgaggggcgcctgttccgtcctccacaggccgccgagctggccgccgagctgcgcgaacggctgatgcggattcccgaggacgacctcgagcagcagatggagacccttcgtcacttcaagctggcccacgggctgcgggtggcggcctcggagatcgccggcacgctgccgttgatgaaggtcagcgactacctgacctggctggccgaggcgatcctcgtcgaggtcctcgaactggcctggcggcagttggtgcagcgtcacggccggccgttgcgcgccgacggcacgccgtgcgatccggacttcgtcatcgtcggctacggcaaggtcggcgggctggagttcggccatggctcggacctcgacctggtgttcatccatgacggcgacccccagtgcgagaccgatggcggcaaatccatcgatggcgcgcagttctttacccgcctggggcagaagatcatccatttcctcaccgcgcagacgccatccggcaccctctacgaggtcgacatgcgcctgcgtccgagcggcgcggccggcctgctggtgagttcgctgggcgccttccagcgctaccaggagcaggaggcctggacctgggagcaccaggcgttggtccgcgcccgggtgctggccggttgccggcgggtgcaggcgagcttcgaggcggtacgtgccgaggtgctggcgaggccgcgcgatctcgacgcgttgcgcaccgaagtcagcgaaatgcgcgccaagatgcgcgacaacctgggaacccgcgcgaccgccgccggtaccgcctcgaatgccttcgaggccacggcagccttcgatctcaagcacgatgccggtggtatcgtcgatatcgaatttatggtgcaatatgcggttctagcttggtccggagaacacccggcgctgctcgaattcaccgataacatccgcattctggaaggactggaacgggctggcctgatcgccagcgaggacgtccgtctcctgcaggaggcctacaaggcctatcgcgcagccgcacaccgcctggcactacagaaggaggccggggtcgtgagcggcgagcacttccagacggagcggcgagaagtgatcaggatctggcgcgagctgcggctcggctga

SEQ ID NO: 16298 - DNA, 1038 bp, Pseudomonas aeruginosa
atgagaattctgatcgtaggtccctcctgggtgggggacatggtgatggcgcagaccctgttccagtgtctgcgccagcggcatcccgagtgcgtgatcgacgtgctggcgcccgagtggagccgaccgatcctcgagcgcatgcccgaggtgcgccaggccctgagcttcccgctcggccacggggtgatggacgtcgccacacggcgccggatcggacgcggcctgtgcggtcagtacgagcaggcgatcctgctgcccaactcgctgaagtcggcgctggtgccctggttcgccggaataccgaagcgcaccggctggcgcggcgagatgcgctacgggctgctcaatgacatccgcaagctcgacaagcagcgctatccgctgatgatcgaacgcttcatggccctggccttcgagccgggcgtggagttgccgaagccctatccgcagccgcgcctgcggatcgacgacggtagccgccaggcggcgctcgacaagttcgccctgagcctggaccgcccggtgctggcgctctgtcccggcgccgagttcggcgaggccaagcgctggccggcggaacactacgccgcggtcgccgaggcgaagatccgtgccggctggcaggtctggctgttcggctcgaagaacgaccatcccggtggagaggagattcgccagcgcctgattccggggttgcgcgaggagtccttcaatcttgccggggagacttcgctggccgaggccatcgacctgatgtcctgcgctggcgcggtggtgtccaacgattccggcctgatgcacgtggcggccgcgctggatcgcccgctggtgggcgtctatggctccacctcgccgcagttcaccccgccgctggcggaccgggtggagatcgtccgcctcagtctcgagtgcagcccgtgcttcgagcgcacctgtcgcttcggccactacaattgcctccgcgagctgccgcctggcctggtattgcaagccctggagcggctggtcggcgaccctgccgaggtcgccggatga

SEQ ID NO: 16299 - DNA, 612 bp, Pseudomonas aeruginosa
cccgctacgtgggcaagacgccggtcgccggtctcgatcgcgactcggcgcgcgagccgctcgccagccgcttctatcgccgtgcctatccggtcgcctggggacagcatgcggtggagcgcacgcgccagttgttcgcccaggcgctggactacccgttgcccgagtcggtcggtgactatggcctggaccgcgagcagttggccgacgccgaccctggcgcgccgtacctggtgttcctgcacggtactacctgggacaccaagcattggccggaagcctactggcgcgaactggccgagcgcatgtgcgagcgcggctggtcggtgcgcctgccctggggcagcgccgccgagcgggagcgggccgggcgcctggcggcggggttggaaaatgccgcggtactccccagattatccctggccggcatggccaaggtgcttgccggcgcgcgcgcctgcgtggcggtggataccggcctcggtcacctggcggcggcgctggacgtgccgacgctgtcgctgttcggcccgaccaatcctggcttcaccggcgcctacgggcgctcccaggtccacctgggcagcgacttcccctgtgcgccgtgcctga

SEQ ID NO: 16300 - DNA, 1983 bp, Pseudomonas aeruginosa
atccccagcgcgtggccacccagctggaggccatgctgctggccccggagaccctccgatgaccctggcgttcatcctctacaaatacttccccttcggcggcctgcagcgcgacttcatgcgcatcgccctggaatgtcagcggcgcgggcacgacatccgcgtctatacgctgatctgggagggcgacgtgccggacggcttcgaagtgctggtggccccggtgcgctcgatcttcaaccaccggcgcaacgagaagttcaccgcgtgggtccgcgccgacctggacaggcgcccggtgcagcgggtgatcggcttcaacaagatgcccggactggatgtctactacgccgccgacgcctgtttcgaggaaaaggcccagaccttgcgcaacccgctgtaccgccagtggggccgctaccgccacttcgccggctacgaacgggcagtgttcgacccggcctcgaagaccgagatcctgatgatctccgaggtgcagcagccgctcttcgtcaagcactacggcacccaggccgagcgtttccatctgctgccgccggggatcagccaggatcgccgggcgccggccaacgccgcggacgtgcgtgcggaattccgccgcgagttcggcctggaggaggacgacctgctgctggtgcagatcggttccggcttcaagaccaagggcctggatcgcagcctgaaggcgctgtccgcgctgcccaaggcgctgcgcaggcgtacccggctgatcgccatcggccaggacgatcccaagccgttcctgctacagatcgccgccctcggtctcaacgaccaggtacagatcctcaaggggcgcagcgatatcccgcgcttcctgctcggcgccgacctgctgatccacccggcctacaacgagaacaccggtacggtgctgctggaggcgctggtctccggcctgccggtgttggtgaccgatgtctgcggctatgcccactacatcgccgaggccgacgccgggcgggtgctgccgagtcccttcgagcaggacagtctcaaccgcctgctcgcggaaatgctggaggacgctccggcgcgcgccgcctggtcgcgcaatggcctggcctacgccgatcacgccgacctctacagcatgccgcagcgcgccgccgacctgatcctcggggaggcctcatgaggctggtgctggaagagccgttcaagcgcctgtggaacgggcgcgacccgttcgaggcggtggaggcgctgcaaggcaaggtctaccgcgaactggaagggcgccgcaccttgcgcaccgaggtcgacgggcgtggctacttcgtcaagatccaccgtggcatcggctggggcgagatcgccaagaacctgctcaccgccaagctcccggtgctcggcgcgcgccaggagtggcaggccatccggcgcctgcacgaggccggcgtagcgaccatgaccgcggtcgcctacggcgagcgcggcagcgatccggcgcggcagcattccttcatcgtcaccgaggaactggcgccgaccgtggacctcgaggtgttctcccaggactggcgcgaacgtcctccaccgccgcggctcaagcgcgcgctggtcgaggcggtggcgcggatggtcggcgacatgcaccgtgccggagtcaaccatcgcgactgctacatctgtcatttcctgttgcacaccgacaagccggtgagcgcggacgatttccgcctctcggtgatcgatctgcaccgtgcccagacccgcgacgccacgccgaaacgctggcgtaacaaggatctggcggcattgtatttctctgcgctggacatcggactgacgcgtcgcgacaagctacgcttcctgcgcacctatttccgccggccgttgcgcgagatactgcgcgacgaggccggcctgctggcctggatggaacgcaaggcggaaaaactctacgaacgcaagcagcgttacggagacctgctctga

SEQ ID NO: 16301 - DNA, 2289 bp, Pseudomonas aeruginosa
acgaatccgacaagaagcgtattcgccaggtggtggctttcttcgaggggcgcgaatgagcgttttcatcgccgcgcaggaccacgacctgctccagcgcaaccgtctggacagcttcgacgccctgtgggccttgcagctggacgccgtggacgaaccgaataccgagcggggtggctggagcagcgtctaccgcctcgacctgggcgactccgcctactacctgaagcgccagagcaaccacctgacccgcagcctgcgccatccgctgggcgagccgaccttcgcccgcgagttccgcaacatcgagcgctaccgggcgctgggcattcccgccctgcaggcggcgttcttcgcccagcaggcggtcggcggagagcgccaggcgatcctcctgacccgtgccctggacggttggcaggacctggacacctggctggcgtcctggcacgacctggccgaagagcggcgccgggcgattctccgggcggttggcaggctggcgcgccagctgcacgccgccggacagatgcatggttgcttctatcccaagcatgtattcctccgcgagggggccgatggtgtcttcgaggcctgcctgatcgacctggagaagacccgcccgatctggttcggccgccgcgaccaggtcaaggacctggagccgatgctgcgccgtgccccggactggagcgaagcggacgtgcacgaattcatctccgcctatgtcgacgaacccctcgactcggccgaggtcgagcagtggtatcgccttctcgaccagcgccgtcggcgcaaggagtcgcgccgatgagactggccgaactgcaagccgccgggcgccacccgcaactgccattgcgggtgaccctggcggatggcgctggcgctgccgaactgcgcctggacagtctgctgcgggtgctgcccgggcagcgctacgtcggtgccggcgaatggcgtgggcgcaaggtgctggccaagctgctggtgggcggcaaggccgcacggcatttccagcgcgaactggaaggggcgcgtctgctcgcggcccaggggctgaccaccccggcgctgctggccgacgggctgcagcagggcgagggcggctggctgctgttcgactacctcgacgcggcgcagagcctcggtgacgcctggcgtgcggtggaggcccaggcgccgctgggcgatgcccagcaagcggtgctcggcgaagccctggcagccattggcgagctgcatgcaaagggcctctggcaggacgacctgcacgtggacaacctgttgcgccacgccggccgcctgtatctcatcgacggtggcggcgtgcgtgcggaaactcccggccagccgctgtcgcgacagaaagtgctggaaaacctcggggtgttcttcgcccagttgccggcgctcctcgatcctttcctggaggagttgctggtgcattacctgctggccaacggcgagcatgcgctgccgctggaagccttgcagaaggaaatcgccaaggttcgccgctggcgggtgcgcgacctgctgaggaaggtcggtcgcgactgtagcctgttcagcgtcgtgcgcggtccgttccgcctgttcgccgctcgccgcagcgaggccgagacgatggcgcccctgctggcggacgcggaccgcctgatcgccgccggccacgtctacaaggacggcggcgcggccaccgtcgcccgggtcgaagcgaacggccgcacgctgatcatcaagcgctacaacatcaagggctgggtccattggctgaagcgcttctggcggccgagccgggcctgggcctcctggcgcgaaggcaaccgcctggaattcctcggcatcgccaccgcccgtccgctggcgatgctggagcggcgctggtgctggctgcgcgggcgcgcctacctgattaccgattatctcggcggtcaggatataatcgctcgttttaagccttgcctggacatgcccgatggcgccgtttcgccaccggaagccgagttggcggcactggatcggctgttttcgacgttgatccgcgaacgcatcagccacggcgacctgaagggacacaacctgttctggcaggcccatgaacaaggcggcgaatgggcgctgatcgacctggacgcgatgcgcaagcatcacagccaggcgtcctttgcccgcgcctacgcccgcgaccgtgcgcgcttcctgcgcaactggccgcaggacagcggcctctaccggctgctggagcaacggattccccgcctcggcgacgccgccggggcttga

SEQ ID NO: 16302 - DNA, 639 bp, Pseudomonas aeruginosa
ggccgatctcgccgatatccgtccgttccgccagttcaaccgcctgcgcctggccagcgatgccgacggcctgtcgacctggaacaatctgctgtccgatctccgcgagctgatcctgctggcacgtcccgaggtcatcgtcctgcctcatccgcatttcgatccgcacccggaccatgtccgcgcccaggaggctgtgcgcgaggcgctccagggcctggactggcagccgcaggcattgttgcactatgccaatcacctgcacgacaacgatcgctggccgatgggcgatgcgcacatgggggtcagcctgccaccgctgaccgaagaatgctcgccgttgctgccatggacgctggcgctggagcgcacgcgccaggtggacaaggccatggccttgggcatgatgcacgacctgcaacccaggccgccgttcaagcgccgtctgcgccgccgtctgcagggctggctcgccgggcgtcgctggccggcttacggcgaggacgagttcatgcgcaaggcggtgcgtcggcacgagttgttctgggtggagtcgctggatggggaggcgtgatgcttgggtcgagcgttcggcaaggttcgagccgccatgctgcttcggagcagccgcgaggatga

SEQ ID NO: 16303 - DNA, 1818 bp, Pseudomonas aeruginosa
gaaaccatgagcgatagtcctcagaatcccggaccttccagtctcaagatctatttccgcctgttgggctacgtgaagccctacatcggaatgttcctactcagcatcgtcggtttcctgatcttcgcctcgacccagccgatgctggcgggcatcctcaagtatttcgtcgacggcctctccaatcctgacgcggcattgtttccgaatgtgcagtggccctggttgcgcgacttgcacctggtctacgcggtgccgttgctgatcatcctgatcgctgcctggcaggggctgggctcgttcctcggcaacttcttcctcgccaaggtttccctggggctggtgcatgacctgcgggtcgccctgttcaacaagctgctggtgctgccgaaccgctatttcgacacgcacagctccggccacctgatctcgcgcatcaccttcaacgtgaccatggtcaccggagcggccacggatgccatcaaggtggtgatccgtgagggcctgaccgtggtcttcctgttcctctacctgctgtggatgaactggaagctgaccctggtgatgctggcgatcctgccggtcatcgcggtgatggtgactaccgccagccgcaagttccgcaagcagagcaagaagatccaggtggccatgggcgacgtcacccacgtcgcctcggaaaccatccagggctaccgggtagtgcgcagcttcggcggcgaagcctatgaagagaagcgcttcctcgacgccagccagagcaataccgacaagcagttgcggatgaccaagaccggcgcggtctacacgccgatgctgcaattggtgatctacgtcgccatggcgatactgatgttcctcgtgctgtggctgcgcggggacgcctcggccggcgacctggtggcctatatcaccgcggcgggcctgttgcccaagccgatccgccagctttccgaggtcagttccacggtccagcgcggcgtcgccggcgccgagagcatcttcgagcagctcgacgaagcggcggagaaagaccagggtaccgtcgagaaggagcgggtcagcgggcgcctggaagtgcgcaacctgagcttccgttatcccggaaccgacaagcaggtgctggatgacatcagtttcatcgccgagcccgggcagatgatcgccctggtcggccgttccggtagcggcaagtcgaccctggccaacctggttccgcgcttttatcagcacaatgacggcaagatcatgcttgatggcgttgaggtcgaggattatcgcctgcgtaacctgcgccgccacatcgccctggtgacccagcaggtcacgctgttcaacgacagcgtcgccaacaacatcgcctacggcgacctggctggcgcgccgcgcgaggaaatcgagcgggcggcgaaggctgccaacgccaaggaattcatcgacaacctgccgcaaggcttcgacaccgaggtcggcgagaatggcgtgctgctttccggcggccagcgccagcgtctggcgatcgcccgggcgctgctcaaggacgcgcccctgctgatcctcgacgaggcgacctcggcgctggacaccgagtcggagcggcatatccaggcggcgctggacgaagtgatgaaggggcgcaccaccctggtgatcgcccaccgcctgtcgaccatcgagaaggccgacctgatcctggtgatggaccaggggcagatcgtcgagcgcggcagccacgccgagctgctggcgcagaacggccattatgcgcggctgcacgcgatgggactggatgagcaggcgccggcgcctgtcggctga

SEQ ID NO: 16304 - DNA, 1251 bp, Pseudomonas aeruginosa
ccagccgaccatcgtcaagctgcgggtcatgagtcgtcaccagcaactgctgcgggtcgacttcgaggaaccgttccgcaccgacgcggcggccctggccgtggacgtcgagtcgctgctggccaaggtcaaggtgctggtgctgtccgactacggcaagggcgcgctacagaaccaccaggtgctgatccaggcggcgcgggcgcgcaacattccggtactggccgatcccaagggcaaggacttcgccatctatcgcggcgccagcctgatcaccccgaacctgtccgaattcgagaccatcgtcggccgttgcgccgacgaagccgaactggtcgccaagggccaggcgctgatgagcgaactcgacctcggtgccttgctggtgacccgcggcgagcatggcatgaccctgctccgcgatggccagccggccctgcacctgccggcgcgggcgcgggaagtgttcgacgtcaccggtgccggcgatacggtcatctccaccctggccgcggcgcttgccgccggcgaggagctgccgtccgcggtgggcctggccaacctggccgccggcatcgtggtcggcaagctgggtaccgcggcgatcagcgcgcccgaactgcgtcgcgcggtgcagcgcgagcagggttccgagcgtggcgtgctgggcctggagcaattgctgctggcaatcgaagacgcccgcgcccacggcgagaagatcgtcttcaccaatggctgcttcgacatccttcacgccggccacgtgacctacctcgaacaggcgcgcgcccagggcgaccgcctgatcgtcggggtcaacgacgacgcctcggtcactcgcctgaagggcgttggccggccgatcaactcggtggaccggcgcatggcggtactcgccgggctcggcgcggtggactgggtggtgagcttcgccgaagacactcccgagcgcctgctcgagcaggtgcgtccggacgtgctggtcaagggcggcgattacggcgtcgagcaggtggtcggcgcgcagatcgtcaaggcctacggcggcgaggtacgggtgctcggcctggtggagaacagctccaccaccgccatcgtcgagaagatccgccagcgctgattcccgttagcaggttcttcccgcttcacgccgacccctggccctgtggctggatcattgatgttccagccaagcctggaacatcaatacattccagagcgggccttgccagtttctttttccgctga

SEQ ID NO: 16305 - DNA, 231 bp, Pseudomonas aeruginosa
gaattaaatgccgtggtcgtcgggcaagtcatcttcaaagctttaaagagtgttaagaagtgtaaagtcagcgcgcgcctttctgctttccctgagtttccacggctagaatccgctgttctgagggatgggttccggcagaatgccgacctatccgggcaggtgactggctggtctgacaagttttcccggcgagacggtcataggcgctgcccatgcggcggcgcatga

SEQ ID NO: 16306 - DNA, 750 bp, Pseudomonas aeruginosa
gtgcgtcagcgtgaccggctcgatcaagttcgacctgcgcatcgacccgcagctgccgctggccgctgccgccctgcgcgaggaatgggacgcgacggcgcgaccgctgtggatcgccgccagcacccatgccggcgaggacgagatcgtcctggcagcccaccggcgcctgctggaaacgcgtcccgacgcgttgctgatcctggtgccgcgccatccggaacgcttcgccggcgtccacgagctatgccgccgcgaaggcttcgccacggtccggcgctccggcggcgagccggtggcacgcgcgacccaggtgctgctcggcgataccatgggcgagctgctgttcctctatgccctggccgacatcgctttcgtcggcggcagcctggtgcccaacggcgggcacaacctgctggagccggcggccctgggcaagccggtgttcgccggtccgcacctgttcaacttcctcgacatcgccgcgcaattgcgcgacgccggggcgctgctcgaggtgacggatgccggcgagctgtgcgacggcctcgtgcgcctgtgggcgcagccggaggtcgcgacggccatggccactgccggagagaaggtgctgcgcaacaaccagggcgccctggagcggctgctggcggggttggcgcggttgctcgggcgcggcgggtagcgctcgccccgtcggccctcccctggccctgcatcgcgacaggccgtttcagaacgtcggcggggtga

SEQ ID NO: 16307 - DNA, 1905 bp, Pseudomonas aeruginosa
caccagggtatcgacctcctcgaacagcatcgcctcgccgctggcgctgtgctgcatgtacaccgtggtatcgtcgcagccgtacaggcgggcgtagggcgtgaccgggatacccaggcggtgcagttcgccggccaactggtcgcgcacgtacagcggcaggctctcgccgcagtgggtgccgttcaccgccaggcgtacctggtggccctcgcgtacaagcttttccgcgataccggggccgatccagtcgccccgccagtcggtgaccagcaccgagcgaccgacccgcacctcgccgcgcagcacctgccaggcatccaccacctgcagctcgccgccgcgctcgaaaggcggccaatagggttcggcgccggtggcgacgatcaccaggtccggccgttcgcgctccaccagcgcgcggtcgaccggcgtgttgcggcgtacctcgacgccggccagttgcatctcccgttgcaggttggtggaggcgccgccgaattccgcgcggcgcggcagcagttgcgccaggttgacctggccgccgagctgggcgccggcctcgcagagcactacctcgtggccgcgctgtgccgccaccgccgccgccttcatccccgccgggccgccgccggcgaccagcacgcgcttgcgccgcgagggcggattgggcgttgcgtaggtcagctcgcggccggtttccgggtgctggatgcaggagatcggatagcctcggtggaaatgtccgatgcaggcctggttgcaggcgatgcaggcgcgcacgtcgtcgctgcgcccggcctcggccttgttcggcatctgcgggtcgcagatcagcgcgcgggtcatgccgcagacgtcggcctggcctcgggcgaggatggcctcggcctcctggggctggttgatgcgcccggtgacgaacagcgggatcgccaggcgcgccttgaaggtactggcttcgcgggccaggtaggccggctcgatggccatcggcgggacgatatgaatggcgccgccgagggaggccgaagtgccggcgacgatgtgcaggtagtccagctcgccctggaccgcctcggccgcctgcagcgactcgctttcgctgagaccctcggggtcgcgctcgtcggcggacaggcgcaggccgacgatgaagtcctcggaggtggccgcgcgcaccgccgccagcacttcgcggaggaaacgcaggcgggcatcgaggtcgccgttgtagccatccttgcggcggttcacccgcgggttgaggaattgcgccggcaggtagccgtggctggcgaccacctccaccccgtccagtcctgcctcgtgcaggcggcgcgcggcggcggcgtagccggcgacgatctcgtcgatcagcggctggtcgagttcgcgcggcatcacccggaaccgttcgttgggcgaggccgaggcggaataggccaccgccagcaggccgtcggcggactccatgatctcgcgcccgggatggaagatttgcgacagcaccacgcagccttcggcgtggcaggcctcggcgacccgccggtagccggggatgcaggcatcgtcggtggccatcagcacgtgcgaggtgtagcgcgcgctgtcgtggacccccgccacctgcatgacgatcagtccggcgccgccgcgggcccgggcgcggtgataggcgacgagtggctcgttgaccaggttgtcggtaggcatcgacgtgtcgtggccgctcgacatgatgcggtttttcaggcgtttgccccggatttccagggggctgaacaggtgcgggaaattcacggttggcgtccttcttgttgttctcgcggcgcgcttcagaaacaggatatgaatttaccatcagtaaaaaatcaacttgtttttttaaaatcgactggatag

SEQ ID NO: 16308 - DNA, 363 bp, Pseudomonas aeruginosa
cgtccacctacaccggggcgcatcgccgacgcccaccgcgcggggcgcaacctggccctggtatggcagggcagcctgtacggcatggactactgggcggtggtcaagggttcgaagcgcggcgccgaggcgcgtcgcttcatcgccttcgccaatgccccggatgcccaggtgcgctacgtcgagaacattccctacgggccgaccaaccgccaggccgcccagcgtctgcccgcgcaactggcgagctgggtgccgaccgcgccggcgaacctggagcagggcctggcgatggacgacgaattctgggtcgagcacggcgaggagctggaggagcgcttcaacgcctgggccagccagtga

SEQ ID NO: 16309 - DNA, 3675 bp, Pseudomonas aeruginosa
cgtcctctgcgccggcaacgccgagcaggcggaagcctgccttgccgagtgcgcccatctcggccagccggtcgagctggtgctgctggacatccgcctgcccggcaaggacggcctgaccctgacccgcgagctgcgggtgcgctccgaggtggggatcatcctgatcaccgggcgcaacgacgagatcgatcgcatcgtcggcctggagtgcggcgccgacgattacgtgatcaagccgctgaacccgcgcgaactggtgtcgcgggcgaagaatctgatccgccgggtgcgccatgcccaggccagcgccggccccgcccggcaggccctcaggcagttcggcgactggctgctggacgccgaccggcgccgcctgatcgaccacgcgggcaacgaaaccctgctcacccatggcgaattccaattgctcggcgctttcctgcgcaacagcgggcataccctgagccgcgaccagttgatggaccagatccgcaaccgcgagtggctgcccagcgatcgctccatcgacgtgctggtcggccgcctgcgtcgcaagctgcgcgacgacccggccgaaccgcaactgatcatcaccatccacggcgccggctacctgttcaccgccgcggccagcgacgcctgagccatgcaggcctgctggctggcgctctgcggatggctgctgggcggcctggcacaggctgcggagaccatccgctattgcgactatccggtatacccgccgatctcctggagcgacggccagcaggtccgggggctggcgccggagctggtgaagcggctgttcggcgcgctgggctaccgggtcgaggtggtggtgctgggcaactggcggcgctgcctgctcgacgccgccgccggacgggtcgacctgatactggcctaccgcacgcccgcgcgcgatcgcgacctggcgttttccgccgagccggtgctgcgcgaggacgtggcgatcttctacaaccgccagcggccggtgcgcatccaatccctcggcgacctcgccggctatcgcggcgggctgttgttcggcgaaagctacggggcggacttcgaccgcttcgtcggccgccacggcaacgtcgaatgggtttccgacagccgacagaacttcggcaagctggtgcgccagcgcatcgactacatcgcccacgaacggcgcaccggcacgctgttcgccgagcgcctggccggcggcgagaacatccgtgcgctgcccgaaccgctgacggtggactacctgcgggtggcggtctcgcggcactcgccgctggcggcgaagatggacgagatcgaccgggccctgcgtggctatcgcgacgacggcagcatccagcgttggctggacgacagcgtgcgcgactatcggcgcctcgccggcaaccgcgcggacgcctggtgagcggccacggcggagtgttggcgcggcgcctgctgtggcgggtgctgctgttcagcctgtgtttcaccgtcctcgccggcgccgtgcagctgttcttcgaataccgccgcgaaatgcgcgagatcgaggcgcgcctggaactgatccgcagcggctacctggccagcttcgagcgcagcctgtgggatctcaaccaggagcagttgaacgtgcagttgcgcggcctcggggatttccccgacatcgcccgtgtcagcctgcaaagcgccgacttcaacctgttgcagggcgaccagcgtccacgcggcatgctgcgggtcgagcgctttcccttgagctaccagccgccggggggcgagcgtcggcaactgggcgagctggagatcgccatcgacctggcggcggtctatcgccggctggtttccggcggcctggccagcctcttgtggatgggcagtttcctttgcggcctggcggtggccctcagttggctgttccacagcctggtcactcgccatctgtggcgcatgtccgagttcgccgggcatatcgccgaaggcgacctgcaacagccgctgcgactggacaaggtggaccgcgagcgcgatgagatcgacgccgtcgccgccgccctggaagacatgcgccaggctctgcgcaccgaccgccgccggcgcgatgccgatcgcgacgagttgcgccgacaggtcgagcgacgcaccgccagcctgcgtcgggcgaaggaccaggcggaagccgccgaccgggcgaagagccgtttcctcgcgaccatgagccatgagatccgtaccccgctgaacggcatcctgggcatggccgagctgctgcgcgaggcatcgctcggcgagcgtgaccgccagcgcctgcgggcactggcgacagcgggggagggactgctggcgatcctcaacgaggtcctccacttcgcccggctggaggaagcgccggatgtgccggaagcggtggacttttccttgcgaagcctgctcgaggacgtcctcaccctgctcgaaccgcgggcgcgggagaacgccacgcggctggacctgtggctggacccacaggttcatgacggccatcgcggcgccgagcagttcctgcgccaggtgttgaccaacctgctgggcaacgcggtgaagttcaccgaggccggcgaggtgcgcgttcgcgtcgagcggctggcgcgcagcgcaggaagcgagcgcctgcggctgagcgtcgcggacgatggaatcggcattcccgaggaaatgcgcgaacgcatcttcgaacgcttcacccagggcggcgacgccgtgacccgccgttacggcggaaccggcctgggcctggcgatcagcaagcggctggtggaagcgctggggggacggatcggcgtggaaagccgggtcggccagggcagcacgttctggttcgagatcgagctggcgctggcgagcttgtccggcgcgacgccgccggcggcatcggtgtctgcgctggaggtgctgctggtggaggacgtggcgctcaaccgcgaggtggcccagggcctgcttgagcgggacggccaccgggtgatgctggccgaggacgcggggccggccctggcgttgtgccggcagcggcgcttcgacctgatcctgctggacatgcacctgccggggatggctggcctcgagctttgcgccgggattcgccggcagctcgacggcctgaaccgctccacgccgatcttcgccttcaccgccagcatccagccggacatggtgcgtcggtacttcgccgcgggcatgcagggcgtgctcggcaagcccctgcggatggacgagctgcgccgcgcgctgggcgaggtcggcaccagcgtgcctgcgcttgcggtggaggccgcgctggaccggcaaatgctcgagacccaccgccgcctgctggggcggcacaagctcgccggactgctgggcaacctgctgggaagcctggacgagcagttgccgctgctggccgaagccctggaccaggcggacctggccgaggcggcgaacatcgcccatcgcctgtccggaagctgccactccatgggcctggtggcgctcggcgccggcctgggcgagctggagcgcgaggccctgggcgcggccggggtcgacccgcgagcctggggcgcacgcctgggtagcctgcgccgcgacggcgccgaagccctgcgccgcgccggcttcctcggcgaagccgactcagcggccggttga

SEQ ID NO: 16310 - DNA, 1458 bp, Pseudomonas aeruginosa
gccatctcgaagacccctgtgcgtaccctcatccggaggtgcgccatggctgacggcaaggaaaggctgcaactcacccgggccctggcgagccgccacatcttcatgctgtccctcggcggggtgatcggcaccggcctgttcatgggctccggcgtgaccatcaaccagggcggcccggccggcgcggtgctggcctacctggtggccggggtgctgatgtacctggtgatggtctgcctcggcgagctgtcggtgcagatgccggtctccggttcgttccaggcccacgcgacgcgtttcatcggcccggcgactggcttcatgatcggctgggtctactggatgagctgggcctccacggtaggcctggaattcaccgcggccgggatgctcatgacccgctggttcccggaggtgcccgtgtggctatggtcgggtttcttcgtggtcgtgctgttctctctcaatgccctggcgacccgcgccttcggcgaggccgagtactggttcgccgggatcaaggtggcggcgatcctggtgttcatcgtggtcggggggctggtgatcttcggcggtatcgaactgaagagcggtgcgccggcgccgatgttctccaacctggtcggcgagcggctgttccccaacggcctgtcggcggtgttcgcggtgatgatgacggtggtctatgccttccagggttgcgagatcatgggcgtcgccgccggcgagaccgagcgaccggagaagagcatcccgcgggcggtgcgcaacgtggtgttccgcgtactgatcttctacgtgctggccatcgtcgtgctttccgccatcattccctggcaacaggccgggctgatggaaagcccgttcgtgcaggtgttcgacatggtcgggattccctacgcggcggacctgatgaacttcgtcatcctcaccgccatcctctcggtaggcaactcgggcctgtacgcctcgacgcggatcctctgggcgatgtccaggaccggcatggccccgcgcggcctgtcgaagctcagcgcgcgcggcgtaccgctctacgcgttgctgatcaccctgtgcttcgccctgctctcgttgctgaccagcgtggtcgccgccgacaccctgttcatggtgctgatggcggtgagcgggatgtccggcaccgtcacctggatcgtcatcgcctacgcccaataccgcttccgccgcgagcacatggccagcggcggcacggtcgccggactgaaatatgccgcgccgctgttcccgctggtgccgctggcctgcatcgccgtgtgctgctcgctgttcgtcttcctcgccctcgatcccacccagcggccgtccttgtactggggcttcggcttcatcgccgcctgctacctggcctattacgtggttcgtcgccggcagccgcagggactgggcgaccccgccctgggacgggccggctga

SEQ ID NO: 16311 - DNA, 834 bp, Pseudomonas aeruginosa
aagccgcgatcgccatcaaccaacaataagaacgagggccgcatgactgacctttccccattgcagacgcgggtcgaagccgggatcgcctggctcgtcctgaatcgtccgcaacagcgcaatgcactggatatccccaccctggaggccctgcacgtccgactcgatgcctgcgagcgcgacccggcagtgcgcgccgtggtcctcggcggcagcggacgcagtttctgcgccggggccgatctcgccgaatgggcggcggctgaagcccgtggcgagctggaaagctatggctggaccgaggccgcccacgccctgatggggcgcctgcacgccctcgacaaacccacagtcgccgccgtcaacggcagcgccgtgggcgctggcatggacctggcgctgtgctgcgatttccgcatcgccgccgcctcggcgcgcttcaaggccggctacaccggcatggcctactgcccggacgccggcgccagttggcatctgccacggctgctcggcagcgaggcggccaagcgcctgctgttcctcgacgaagcctggagcgcggagcgcgctctgggcgccggactggtcggcgaggtggtcgccgacgagcgcctggttgagacggtcggcgccttcgctgcgcgtctcgccagcggcccgaccttcgccttcgcccagaccaagcgcctgctgcgcgacggcgccgggcgctcgctggccgagcagttgcgtgccgagcaggccgccgggctgctctgcgggcgcagcgaggatgccgccgaggcgctgcgcgccgtggccgagaaacgttcccctcaattcagcgggcgctag

SEQ ID NO: 16312 - DNA, 429 bp, Pseudomonas aeruginosa
cccaggaacaggacatgctggtcgaggcggtgcgcagcttcgtcgagaaggaactgctgccccacgaggacgatgtcgaccgcgccgacgcggtgtcgccggagctggccgcacagattcgcggcaaggccctcgccgccggtttctatgccttcaacatgcccgaggaagtgggtggcggcggcctcgactacctgtcccaggcgctggtcgaacgcgagctgtcgaaggtctcctgggccctccacgtattcgtcgcgcggccctcgaagatcctcatggcctgcaccggagaacagctcggcgactacctgttgccctgcgtgcagggcgaaaagaccgattgcttcgccctcaccgagccgggcgccggctccgacgccaattcgatcaagacccgcgcggtgcgcgacggcgacgccttcgtga

SEQ ID NO: 16313 - DNA, 1440 bp, Pseudomonas aeruginosa
ctggagcgctgccgtggcgcgccgccctggtcgtggcgtgccgtgcaccgaggcattgcgggcggcggcggagcgcctggctgcggcccggcgaccaatgctcatcgccggcggcggcgcgctggcggccggcgatgcgcttgccgcgctgagcgagcgcctggccgcgccgctgttcaccagcgtcgccggcaagggcctgcagccgccggacgcgccgctcaacgccggggccagcctgtgcgtagcgccgggctgggagatgatcgccgaggccgacctggtgctggcggtgggcaccgagatggccgacaccgacttctggcgcgaacgcctgccgctgtcgggcgaactgatccgcgtcgatatcgacccgcgcaagttcaacgacttctatccctctgccgtagcgctcaggggcgatgcccggcagaccctggaggcgctgctggcgcgcctgccgcaggaggcccgcgacgccgcgccggccgccgcgagggtggcgcgcctgcgcgcggatatccgcgcggcacacgcgccgctgcaggcgctgcaccaggcgatcctcgaccggatcgccgccgcgctgccggccgatgctttcgtcagcaccgacatgacccaactggcctataccggcaactacgcgttcgccagccgagcgccgcgcagctggctgcatcccaccggctacggcaccctcggctacggcctgccggccggcatcggcgccaagctcggcgccccgcagcgcccgggcctggtgctggtcggcgatggcggcttcctctacaccgcgcaggaactggccaccgccagcgaggaactggacagtccgctggtggtgctactgtggaacaacgacgcgctcggccagatccgcgacgacatgctcggcctggacatcgagccggtcggcgtgctgccgcgcaaccccgacttcgccctgctgggccgcgcctacggttgcgcggtgcgccagccgcaggacctgaacgaactggagcgcgacctgcgcgccggcttcgggcagcccggcgtgaccctgatcgaactgcggcacgcctgtgcgcgctgaccgccggacaaggagagcatccatgcgctattccgacttcactcaacgtatcgccggcgacggcgccgctgcctgggacatccactatcgcgcgctggcgcgggtcgagcagggcgaggaaatcctcctgctgtcggtcggcgaccccgacttcgataccccggcgcccatcgtccaggcggccatcgacagcctgctggccggcaacacccactacgccgacgtgcgcggcaagcgcgccctgcgccagcgcatcgccgagcgccaccggcggcgcagcggccaggcggtggacgcggagcaggtggtggtgctggcaggtgcccaatgcgcgctgtacgcggtggtgcagtgcctgctga

SEQ ID NO: 16314 - DNA, 2034 bp, Pseudomonas aeruginosa
cgtccggttccgcctcgcgcggaccgcagcaacccgcgtagggaacaagatgtccgcgccatgcctgccttgccggcgcgtccttctcgccaccagtcccggtggccccgcgtgccaggttctcccgacaatcacccaggagagccatcgatgagcgcaacgcagaagaacaacatcacccgccttgagcagctcgaccgccagtcgacgcagcctttcccgaactcgcgcaaggtctacctgaccggctcgcgcccggacatccgcgtcccggtgcgggaaatctccctcgccgacacccccaccgccttcggcggcgaaaaaaacccgccggtgttcgtctacgacacctccggcccgtataccgaccctgaggtccgcatcgacctgcgcaagggcctgcctgacgtgcgttcgcgctggatcgacgagcgcggcgacaccgagatcctccccggcctgacctccgagttcggccaggcccgcctggccgacgccagcctcgacgccctgcgcttcgcccacgtgcgcacgccgcgccgggccaagccgggcgccaacgtctcgcagatgcactacgcgaagaaaggcatcatcaccccggagatggaatacattgccatccgcgagaacatgaagctgcaggaagcccgggccgccggcctgctcgaccagcagcacccggggcacagcttcggtgccaacatcccgaaggaaatcacccccgagttcgtccgcgaggaagtcgcccgcggccgcgcgatcattccggcgaacatcaaccacaccgagcttgagccgatgatcatcggccgcaacttcctggtgaagatcaacggcaacatcggcaacagcgcgctgggctcctcgatcgaggaagaagtggagaagctcacctggggtatccgctggggcgccgacacggtgatggacctgtccaccggcaagcacatccatgaaacccgcgagtggatcctgcgcaacagcccggtaccgatcggcaccgtaccgatctaccaggcgctggagaaggtcaacggcgtcgccgaggacctgacctgggaaatcttccgcgacaccctgatcgaacaggccgagcagggcgtcgactacttcaccatccacgccggcgtgctgctgcgctatgtgccgctgaccgccaagcgggtcaccggcatcgtttcccgcggcggctcgatcatggccaagtggtgcctggcgcaccaccaggagaacttcctctacacgcatttcgaagagatctgcgaaatcatgaaggcctatgacgtcagcttctcgctgggcgatggcctgcgtccgggctcggtggccgacgccaacgacgccgcccagttcggcgagctggaaaccctcggcgagctgaccaagatcgcctggaagcacgacgtgcaggtgatgatcgaaggccccggccacgtgccgatgcaattgatcaaggaaaacatggacaagcagctggagtgctgcgacgaggcgccgttctataccctcggcccgctgaccaccgacatcgcccccggctacgaccacatcacctccggcatcggcgcggcgatgatcggctggttcggctgcgccatgctctgctacgtcacgcccaaggagcacctgggtctgccgaacaaggatgacgtgaagaccgggatcatcacctacaagatcgccgcccatgccgccgacctcgccaagggccacccgggcgcgcagatccgcgacaacgcgctgtccaaggcgcgcttcgagttccgttgggaggatcagttcaacctcggcctggacccggacaccgcgcgggcgttccatgacgagaccctgccgaaggactcggccaaggtcgcgcacttctgctccatgtgcggaccgaagttctgctcgatgaagatcacccaggaggttcgcgactacgccaaggaaaacggcctgtccgacgagagcaaggccatcgaggccggcttccaggagcaggcggcgcgcttcaaggacgaaggatcggtgatctacaggcaggtgtag

SEQ ID NO: 16315 - DNA, 630 bp, Pseudomonas aeruginosa
agtgagtcgaggatgtccgaaaccttcaaacccgcccccggtgacgtcgagctcgtgcagcgcgaggaatgcttccgcggcttctatcgtctcgatcgcctgcgcctgcggcatcgccagttcgacggcagcatgggccgggaaatcagtcgggaactgttcgtccgccatgacgcggtctgcgtgctgccctacgacccgcagcgcgattgcgtggtgctcatcgagcaattccgcgtcggggcgatgcagaagctcgccaacccctggctgctggagctggtcgccggcctgatcgacaaggacgagcaaccggaggaagtggcccatcgcgaggcgatggaggaggccgggctgaccctcggtgcgctctggccgataacccagtacctgccgtcgccgggcggcaccgacgaggtggtgcacctgttcgtcggccgttgcgacagcgaaggcgtcggcggcgtgcatggcttgccggaggagggcgaggacatccgcgtccacgtctggccgttggaagatgcgctgcaggccgtgcgcgacgggcggatcaacaacgcggcgagcatcatcgccctgcagtggctggccctgaaccgggccgaggtgcgtgggctatgggcctga

SEQ ID NO: 16316 - DNA, 651 bp, Pseudomonas aeruginosa
gcgcgccgctggccgcgccgttgcgctggttcgccggtaaccacgacgaacgcgagccgatgcagcgggcgaccgagggcagcgacctgctggagcaggtcgtcgacgtcggcaactggcgcgtggtgttgctcgactcgagcattcccggcgcggtgccgggctatctcgaggacgaccagctcgacctgctgcggcgtgccatcgacagcgccggcgaacgcttcctgctggtttccttccatcaccacccggtgccgatcggcagcgactggatggaccccatcggcctgcgcaacccgcaggcgctgttcgacctgctggcaccctatccgcaggtgcgttgcctgctgtgggggcacattcaccaggagttcgaccgccagcgcggcccgctgcgcctgctggcctcgccgtccacctgcgtgcagttcgcccccggcagcagcgacttcaccctcgaccgcctggcgccgggctaccgctggttgcgcctgcacgacgacgggcgcctggaaacggggatctcgcgggtcgacgacgtcgtcttcgaagtggactacgacaccgccggatactgacatgccccccggccgcgggatgccgcggccgcgtgcgtcgttgccgatcggcgcgcaggctggaagatga

SEQ ID NO: 16317 - DNA, 711 bp, Pseudomonas aeruginosa
agaccccatggctacttacaacgcagacgccatcgaagtcctttccggcctcgacccggtgcgcaagcgcccggggatgtacaccgacaccacccgccccaaccacctggcccaggaagtcatcgacaacagcgtcgacgaagccctggccggccacgcgaagagcgtgcaggtgatcctgcaccaggacaactcgctggaagtcatcgacgacggccgcggcatgccggtggacatccacccggaagagggcgtgccgggcgtcgagctgatccttaccaagctgcatgccggcggcaagttctcgaacaagaactaccagttctccggcggcttgcacggggtcggcatctcggtggtgaacgcgctctcgacccgggtcgaggtacgcgtcaagcgcgacgccaacgagtaccggatgaccttcgccgacggcttcaaggacagcgacctggaagtcatcggcacggtcggcaagcgcaataccggtaccagcgtgcatttctggccggatccgaagtatttcgattcggcgaagttttcggtcagccgcctcaagcatgtgctcaaggccaaggcggtgctgtgcccgggcctgagcgtggtgttcgaggacaagaacaccggcgagcgcgtcgagtggcacttcgaggacggcctgcgctcctacctgaccgacgcggtcgccgagctgccgcgcctgcccgatga

SEQ ID NO: 16318 - DNA, 645 bp, Pseudomonas aeruginosa
gtcggtgcaggaaagctacgtcaacctgattcccacggcccagggcggcacccatgtgaacggcctgcgccagggcctgctcgacgccatgcgcgaattctgcgagttccgcaacctgttgccgcgcggcgtcaagctggcgcccgaggacgtctgggaacggatcgccttcgtcctctcgatgaagatgcaggaaccgcagttctccgggcagaccaaggagcgcctgtcgtcccgcgaggcggcggcgttcgtctcgggcgtggtgaaggacgccttcagcctgtggctcaacgagcacgccgaaatcggcctgcaactggcggaactggcgatcagcaacgccgggcgtcgcctcaaggcgggcaagaaggtcgagcgcaagaagatcacccaggggccggcgctgcccggcaaactggccgactgcgccggacaggaaccgatgcgcgcggaactgttcctggtcgagggcgactccgccggcggctcggcgaagcaggcgcgggacaaggaattccaggcgatcatgccgctgcgcggaaagatcctgaacacctgggaagtggacggcggcgaggtgctcgccagccaggaggtccacgacatcgcggtggccatcggcgtcgatccgggtgccagtga

SEQ ID NO: 16319 - DNA, 414 bp, Pseudomonas aeruginosa
cctggcccagctgcgctacggcaagatctgtatcctcgcggatgccgactccgacgggctgcacatcgccacgctgctctgcgcgctgttcgtccgccatttccgcccgctggtggaagccggccacgtctacgtggcgatgccgccgctgtaccgcatcgacctcggcaaggacatctactacgccctcgacgaagccgagcgcgacggcatcctcgagcgcctggccgcagagaagaagcgcggcaagccgcaggtcacccgcttcaagggccttggcgaaatgaatccgttgcaactgcgcgagaccaccatggatccgaatacccggcggctggtccagctcaccctggaggacgccaccggtaccctggagatcatggacatgctgctggccaagaagcgcgccggtga

SEQ ID NO: 16320 - DNA, 1065 bp, Pseudomonas aeruginosa
ccgcaagtcctggctggaaagcaagggcaacctggccgaggtgctggtctgatgcgccgcctgctggccatcctcggcctgttcgggggcctggtccaggcggccgaggcgccgccagagccaccggttccggcagccttgagcttcatctccgaacatgcggtggagggcatgcgcggcggcaacctctccgggctggcctggtgtggcggcgcgctgtggacggtttccgaccgcgacgatgaccgcctgtatcgcctgcaaccctcggccgaaggctccgaccagccctggcaggccgaggccgagagtttcatcgctccgaccccgccggacagcgggttgccctggggcatgagcacgcgggtctggctcagtggcctggtgcgcggcggcaacctcgacttcgaaggcatcgcctgcgatgccgccggcaatcgctacctggtcagcgaggcgcacgcggcggtcctgcaactgccggtgagcggcgcgccgaactggctgcgcctgccgcccggcctgctgtcgcaagcgcgggccagcggcatgctgatgaatttcaacgcgctgttcgaagggatcgccgtcgaccccgagggcaagcgcctctggctggctgccgagcgcgagcgccgcggcctgctggtggcccaccgcgacaacagtgcctggcgctgcgagggcagctgcgtactgctcgccgagggcggcaagatcgagccgccgccggaactgggcagcgcgcgcaagctgccgaaggatttctccgacctcgccttctaccgcggcaagctgttcaccctggagcgcctggcgcatcagatctgtcgccgcgacctggcccaggccaaggtcgagcgctgctggtcgttcgcctcggcggtcctggcgccggagcgtcgctacgagctgccttatggcgtcgcggaagccctgtcgctggacgacaagggcgcctggctgggcatcgacaatggcgaccatgcgcgcgccgatggcgacgtgcggcccttcgtcctgcgcttcgccgcgcccgccggcggctggttgggggacaagtga

SEQ ID NO: 16321 - DNA, 2343 bp, Pseudomonas aeruginosa
aacaactcgaattcacccagcgcgacggcaccctggtgctgcgccaaaacacttctccgtgaggtacgcatgagcgaatccctcgatctgagcctggaaggggtcgaacgccggtcgttggccgagttcaccgagcaggcctatctgaactattccatgtacgtgatcatggaccgcgccctgccgcatatcggcgacggcctgaaaccggtgcagcgacgcatcgtctacgccatgagcgaactggggctggatgccgattccaagcacaagaagtcggcgcgcaccgtcggcgacgtgctcggcaagttccacccgcacggcgactcggcctgctacgaggccatggtgctgatggcgcagccgttctcctatcgctatccgctggtggacggccagggcaactggggggcgccggacgatcccaagtccttcgccgccatgcgttataccgaggcgcgcctgtcgcgctattccgaggtgctgctcagcgaactgggccagggtaccgtggactgggtacctaacttcgacggcaccctggacgagccggccgtgctgccggcccgcctgcccaacctgctgctcaacggcaccaccggcatcgcggtgggcatggccaccgacgtgccgccgcacaacctgcgggaagtcgcgtcggcctgcgtgcgcctgctcgaccagccgggcgcgacggtcgccgaattgtgcgaacacgtgccgggcccggacttccccaccgaagccgagatcatcaccccgcgcgccgacctgcagaaggtctacgagaccggccgcggttcggtgcgcatgcgcgcggtgtaccgcgtcgaggacggcgacatcgtcatccacgccctgccgcaccaggtgtccggttccaaggtgctggaacagatcgccgggcagatgcaggccaagaagctgccgatggtggccgacctgcgcgacgagtcggaccacgagaacccgacccgcatcgtcatcatcccgcgttcgaaccgggtcgatgtcgaagagctgatgacccatctgttcgccaccaccgacctggaaaccagctaccgggtcaacctgaacatcatcggcctcgacggcaagccgcaggtcaaggacctgcgccagttgctctcggagtggctgcagttccgcatcggcaccgtgcgtcgacgcctgcagttccgcctggacaaggtcgagcgccgcctgcatctgctggatggcttgctgatcgccttcctcaacctcgacgaggtgatccacatcatccgcaccgaggaccagcccaaggcggtgctgatggagcgcttcgaactcagcgaggtgcaggccgactatatcctcgacacccgcctgcgccagttggcgcgcctggaagagatgaagatccgcggcgagcaggaagagttgctgaaggagcagaagcgcctgcagaccctgctcggcagcgaggccaagctgaagaagctggtgcgcgaggagctgatcaaggacgccgagacctacggcgacgaccgccgttcgccgatcgtcgcccgcgccgaggcccgcgcgctgtcggaaaccgagctgatgcccaccgaaccggtgaccgtggtgctctcggacaaaggctgggtgcgttgcgccaagggccacgacatcgacgccgccggcctttcctacaaagccggcgaccgctttcatgccgccgcgccgggacgctcgaaccagtatgcggtgtgcatcgactccaccggggcgcagctactcgctgccggccccactgcctgccgtccgcgcggggccagggcgagccgctcaggcggcccggctgacgccgccgccgggggccagcttcgaatgcgtgctgctgccggacgacgatgcgctgttcgtgatcgcttccgacgccggctatggtttcgtggtcaagggcgaggacctgcaggccaagaacaaggccggcaaggccctgctcagcctgcccaacggctccgccgtggtggcgccgcgcccggtgcgcgatgtggagcaggattggctggcggccgtgacgaccgagggccgtctgctattgttcaaggtctccgacctgccgcagctcggcaagggcaagggcaacaagatcatcggcatccccggcgaacgcgtggccagccgcgaggaatacctcaccgacctggctgttctgccagccggggcaacgttggtcctgcaggccggaaagcgtaccctgtcgctcaagggcgacgacctggaacactacaagggagagcgcggccgtcgaggcaacaagctgccgcgcggattccagcgcgtcgacagcctgctggtggatattccgccacaggattgaaatga

SEQ ID NO: 16322 - DNA, 468 bp, Pseudomonas aeruginosa
acgggctgggctcgcggagcaactcggcgcaatgctgccgccactcggccagggcttccgccgagggcggcggcgggggcgccgcttcggcacgccagcggctggcctgccagggccagatcaaggccaccgccggatgccacagcggcggccgggcgtgcaggcgcgcgctttgcgcggcgagcatgtgcacctgctgctggacttcggtcagcggctggcccaggtacagaccggtcaggcgctgccagcgcagcatgtgcggcccgtcccagctctggtgcgcggcgatggccaggccattggcgaggagagtgcagttggccggctgggtcagccagcgggcgagatcgggctgggcatcgagttgctgttgctggagcaggggcgactgatggtcgcgggcgatacgcagggctcgaaccagcaggcgacggtcgcaggcgagcaggcgatagccctggatga

SEQ ID NO: 16323 - DNA, 264 bp, Pseudomonas aeruginosa
cccactgcggtagccgccagcgttcggccagcgccaggcagatcggcagcaggcgcatgccgagcagttcgcgctccactcgcagggtcggttcgccctgtaccagcacgcgttgctgccattgctccagcaactgcgggcgggcgttggccagcgcccagaccggagccatggtcagcaggctgccccagtggatttcctgccagagcctggccaggcgcgcgccgaacaggccgctggcctgctgcatggcgtgctggctga

SEQ ID NO: 16324 - DNA, 1221 bp, Pseudomonas aeruginosa
gggccacctccaggctttccgcggggttgtcgcgggcgctctcggcgcgattggcctcgcgcaggatggacaacgccagcgtcgggctgccctgcaactggtcggcgatctcgcgcagcgagcggcggctgtcgctcagcgcggcgtgcaggccggcatagtggctggcggggatcggcaggggttgccggtcgagctcttcgagccaggcggcgaggcggtctgtcatgggtgtcgggctcggtgtcggcgaggcggcgaactggcttttcgagtattcggactatagtcttgcggctagcaaccgataacaagagggagcctagcagtccccctccttatcctgttcatttcgcacgtccggtcctcatgtcaaaaatcatcggcatcatcgtcgttttcgccagtgtcctcgggggcttcctgctctccggcggcaagatcggcgccatcatccagcccttcgaggtcctgatcatcggtggcgcggcactgggggcgttcctccagtccaacccgggcagcacgttcatggtggtgctgaagaaagcgccgaagatgttcagcaaccgcttcacccagacctactacctcgaggtgctgggcatgctctacgagatcctcaacaagagccggcgcgaagggatgatggcgatcgaggcggacatcgaagaccccgcggccagccccatcttcagcaagtaccccggtgtgctgaaggatgagcggatgaccgcctatgtctgcgactacctgcgcatcatgtcctccggcaacatggcgccgcacgagctggaaggcctgttcgacatggagctgtccagtctcaaggaggacctggagcatccgtcccacgcggtgaccaaggtcgccgacgccctgccgggcttcggtatcgtcgccgcggtactcggcatcgtcatcaccatggcgttgcttggcgaaggcagccaggcggagatcggccaccacgtcgccgccgccctggtgggcaccttcctcgggattctcgccgcctacggcttcgtcggcccgctggcgggcgccctggagcacgatgccaaggaagagttgaacctgttcgaggcgatcaaggcctgcctggtcgcttccgcttccggcatgccgccttcgctggccgtcgagttcggccgcaaggtgctgctgcccgcccatcggccgaccttcgccgagctcgagcaggccgtgcgcggccgctga

SEQ ID NO: 16325 - DNA, 798 bp, Pseudomonas aeruginosa
gcacatgcccaggctggaaggctacttccactaccgcaacctcgacgtctccaccctcaaggagctggctgcgcgctgggcgccgcaggtccgcgagagcttcaagaagggcaacacccacctggcgctggacgatatccgcgagtcgatcgccgagctgcgccactatcgcgaccacttcatcaagctctgatccgtccgggccgggcggtaggcgccggctgggctaggtttccccgtggcgccgcagggcccattccacgtgctcgcggaccagctccgaagggaacccgcggcgcgccttcagcgcctccagcaccgggatggtcgagggcgcgttgcccagccccaccgccaggttgcgcaaccagcgctcgtagccggcgcggcgcagcggcgaaccctcggtgcggccgaggaactcctcctcgctccagaggaacagttcggcgagttcggcgttgtccaggctgtggcgcggctgaaagtcgccctgcccggtggggcgggcgaagcgattccatgggcagacgatctggcagtcgtcgcagccgaatacccggttgccgatcagtggccgcagctccagcggaatcgcgcccttgtactcgatggtcaggtaggagatgcagcgtcgcgcgtccagccggtaggggccgacgaaggccgcggtcgggcagatgtccaggcaggccgagcagcgtccgcaatgctcgctgtccatcgccgggtcgacgggtagcggcatgtcgacgaacagctcgccgaggaagaagtagctgccggccttgcggttga

SEQ ID NO: 16326 - DNA, 678 bp, Pseudomonas aeruginosa
ttctgccagactgcgcgcctgacgccgaatcgatccgatgaccatgaccttccagcacgacgacctgccactcgccctctattccgccgcccaggtgcgcgacctggatgcgcgcctgatcgctgccggcacgccgggcttcgaactcatgcagcgcgccgcccacgccgcctggcgtgccttgcgccgccgttggccggaggccgcggcgctgacggtgctcgccggggacggcaacaatgctggcgacggctacctgatcgcggcgctggcgcaacgtgcgggttggcgagtgcgggtgctggcggtcgcggcgccgcagcggcttgccggcgacgcggcgcaggcgcatgccgccgcgctggcgaccggggtcgtggtggagccctggagcgagtgcgccgtgctcgagggcgtagtagtggatgcattgctcggcaccggcctggcaggtgccgtgcgcgagccctttgcgcaggccatccgcctggccaacgccgccgacctgccggtgctggcggtggatattccttccggcttgagcgccgacaccggcgcggtattgggggaagcgatcagggcggatctgaccgtgactttcatcggcctgaagatcgggctgttcactggcgatgcgccggcacgggtcggcgagctggtgttcgacgaactcggtag

SEQ ID NO: 16327 - DNA, 687 bp, Pseudomonas aeruginosa
cgacgccgtcgtgctgcaagcgctccagccccgggctcgccgcctggcgcgaaatgcccctgccgaggctggcagcgcggccgcggaccgcacacaaggggctgttcggccacctgctggtggtcggcggcgacaccggcatgggcggggccgtgctactggccgccggaaagcgcccctgcgctgcggcgcccgggctggtctcggcggcgacccgcggtcgaacatgtgccgggcgttgttgagccgttgtcccgaggtcatggcccatggcgtggcgtcggcgaaccaactgctgggcccttgccgaacgcgccagcgtgctgttgctcggtcccggtcttggccagcgcgccctgggggcgtagccctgctgagcgctgtccggtcgcgaccgttgccgcaggtctgggatgccgacgcgttgaacctgctggccctggaaccggtcggagcagggccgcggacatggattctgacgccgcatcccggcgaggccgcgcgcctgttgggtcgctcgaccgccgaggtgcaggcggatcgcccggcggcggcgctggaactggcgtgtcgctaccaggcggtggtggtgctgaagggcgccggcagcctggtcgccgcgccggacggacgacttgccgtctgttcccaggggcatccggcgatggctggtgccggcctgggtga

SEQ ID NO: 16328 - DNA, 1986 bp, Pseudomonas aeruginosa
gcggctcggcgcccaggggcgtggactggcggcgaccgatctcatacctaccgttcgtcagttgctcgaggagtgcagtccgtgtctgaagtgatcctgtccgccgaaggggaagacgcgatgctcgaactgggcgggcgcatcgcccgggccagcggggggcagggggtgatctacctgcatggcgacctcggcgccggcaagaccaccctctcgcgcggcatcctgcgcggcctcggccatgccggctcggtgaaaagcccgacctttaccctggtcgagccttacgaaatcggcgagctgcgcgcctaccatttcgacctgtaccggctcgccgatgcggaggaattggagttcttcggcatccgcgactatttcgacggcagcgcactctgtctgatcgagtggcccgagcgcggtgcgggcgttttgccaaccgccgatctggacattaccattactgcccaagcgggtggacggacactgcgcctggtaccgcacggtgcgcgggggcgaagcctggtgtgccaccctgaccatgggagcatgagaaaaacgatgggttggggcttgcgtctgcggacgttgttgactggggtgatgattctgctggcctgccaggtcggcgaggttctggccgccgcgcaaatcaagagcgtgcggatctggcgcgctccggacaacacccgtctggtcttcgatctctccggtccggtgcagcacagcctgttcaccctggccgcgcccaaccgtatcgtcatcgacgtcagcggcgcccagctggcgacccagctcaacggtctcaagctcggcaacaccccgatcaccgcggtgcgctccgcccagcgcacgcccaacgacctgcgcatggtcctcgacctgtcggcgcaggtcaccccgaaaagcttcgtcctgccgcccaaccagcaatacggcaaccgcttggtggtcgatctctacgaccagggcgccgacctgaccccggacgtacccgcgacgccgaccccgagcgtgccggtcaccccggtgacgccgacccagccggtggccaagctgccgctgccaaccaagggcggcacccgcgatatcgtcatcgccatcgacgccggccacggcggtgaagaccctggcgcccttggcccgggcgggttgcacgagaagaacatcaccctgtcgatcgctcgcgagctgcaacgccagatcaaccaggtgcgcggttaccgggccgagctgacccgtaccggcgactatttcatcccgctgcgcaagcgcaccgagatcgcccgcaagaagggcgccgacctgttcgtctcgatccatgccgacgccgcgccgagccgcagcgccttcggtgcctcggtgttcgccctgtccgaccgcggcgccacttcggaaaccgcgcgctggctggccgacagcgagaaccgttccgacctgatcggcggcgatggcagcgtcagcctcggcgacaaggaccagatgctcgccggcgtgctgctcgacctgtcgatgaccgccaccctctcgtcgagcctggatgtcggccacaaggtactgaccaatgtcggccgcatcacttcgctgcacaagcgtcgtgtcgagcaggccgggttcatggtgctgaagtcgcccgacatcccgtcgatcctggtggaaaccggcttcatctcgaacgtcaacgagtcgcgcaagctggccagcgccagccatcagcaggccttggcgcgttcgatcaccagcggcatccgccagtatttccagcagagcccgccgcccggtacctacatcgcctctttgcgcgcccagggcaagctctccatggggccgcgcgagcacgtggtgcggcccggagagaccctggcgatgatcgcccagcgctatgaagtgagcatggccgcgctgcgtagcagcaacagcctgtccagcgacaacctgaaagtcggccaggccctgtccatcccgagcaccgccctggcggcccagtga

SEQ ID NO: 16329 - DNA, 441 bp, Pseudomonas aeruginosa
cctcgcgtaccgccgacgccggcgaagcctggcaggtggaaaccgagggccgcgacatgcagccgcgggtacagccggcggcgcacccggtggggaccagcgtcgaggttcgcgacctgttcttcaacaccccggcgcggcgcaagttcctgcgtgccgagaagaccgagttcgaccatctgcaggaggtcatcaagcgcctggcgctggcccgcttcgacgtggctttccacctgcgccacaacggcaagaccatcttcgccctgcacgaggcgcgagacgagctggcccgcgcgcgccgggtcggcgcggtgtgcggccaggcattcctcgagcaggcgctgccgatcgaggtcgagcgcaacggcctgcacctgtggggctgggtcggcttgccgaccttctcccgcagccagccggacctgcagtacttctatgtga

SEQ ID NO: 16330 - DNA, 660 bp, Pseudomonas aeruginosa
ccgagccgcgtccgaccggcgctgccgccggcgagttcggcccgcagggcgagatgcgcctggccgagagcgtgctggagagtccggcggcacgggtgggctggagtggcggctcatcggcctccggcggctcctccggctattccgcctatacccggccggaggcgccgccctctctggccgaggccggtggcgcctacaaggcctacttcgcgccgttacccgcgggcgaggcgccagccgcgttgcccgagagcgcccaggacatcccgccgctgggttacgccctggcgcagctcaagggcatctacattttcgccgagaacgcccacggcctggtgctggtggacatgcacgcggcccacgagcggatcacctacgagcgcctcaaggtggcgatggccagcgaaggcttgcgtgggcagccgttgctggtgccggagtcgatcgcggtcagcgagcgcgaggcggattgcgcggaagagcattccagctggttccagcgcctgggcttcgagctgcagcgcctggggccggaaagcctggcgatccggcagatccctgcgctgctcaagcaggcggaggcgacccagttggtgcgcgatgtcatcgccgacctgctggaatacggcaccagcgaccgtatccaggcgcacctga

SEQ ID NO: 16331 - DNA, 780 bp, Pseudomonas aeruginosa
tcgatatccgcgatccggcggagagctattcggccgcggaattccgcgccgacgccctggcggcgatggccgaggccaccgcgcgcggcaggattcccctgctggtggggggcaccatgctctattacaaggcgttggctcgagggcctggccgacatgcccggcgccgatcccgaggtgcgcgcggcgatcgaggccgaggccctgtccaaaggttgggacgcgctgcaccggcaactcgccgaggtcgacccggagtcggctgcgcgcatccaccccaacgacccgcagcgactgatgcgggcgctcgaggtgtatcgcctcggcggggtgtcgatgagcgacctgcgtcgccggcaaagcgctgaaaaggcggattttgacgcgtcaggcaggaatcaattgccgtatactgtcgctcagctggcgattgctcccgagcagcgccaggtgttgcacgcgcggattgcgcagcgttttcgccagatgctggaacagggtttcatcgccgaggtcgaagcactgcatgccagaagtgacttgcatgcaggattaccgtctattagagccgtgggttaccgtcaggtgtgggattacctggatggcaagctgtcctacgctgaaatgaccgaacgcggcatcatcgctacccgccagttggccaagcgccagttcacctggctgcgaagctggagccatctacactggatggacagcctagcaggtgacaatctgccgcgtgccttgaaatacctgaaaacggtctccatattggcctga

SEQ ID NO: 16332 - DNA, 354 bp, Pseudomonas aeruginosa
gaccttaatttgtccgtctgtttccggaacgactccggagtttggacggcgccaagtcaccctattcgactacttcaaactacgatccttaaaggagtgcggcacatgtcaaaagggcattcgctacaagacccttacctcaataccctgcggaaagaacgcgtcccggtttccatctatctggtcaacggcatcaagctgcaaggccagatcgagtccttcgaccagtttgtcatcctgctgaagaacaccgtcagccagatggtttacaagcacgcgatctccaccgtggtaccgagccgtccggtgcgtctgccgagcggtgaccagccggccgagccgggcaacgcttga

SEQ ID NO: 16333 - DNA, 1314 bp, Pseudomonas aeruginosa
cgggagtccgctttgttctttgagcgcccaggtggtggggaacaggctgttctggtgcatctggaagggcagaaccccgaggcgcgtgaagacccgcaggagttccaggagctggtgcgttcggccggcgcggaaacggtggcattcgtcagcgtctcccgccaccagccgagcgccaaatatcttatcggcagtggcaaggtcgaggagttgcacgacctggtcaaggccgaaaacgtcgagctggtgattttcaaccacaccttgacgcccagccaggagcgcaacctcgagcgtgcgttcgagtgccgcgtactcgaccggaccgggctgatcctcgacatcttcgcccagcgcgcacgtacccacgaaggcaagttgcaggtggaactggcgcaactggagcacatgagcacgcggctggtacgcggctggacccacctcgaacggcagaaaggcggtatcggtctgcgcggtccgggcgagacccagctggaaaccgaccgacgcctgctgcgcgtgcgcatccgccagatcaagcagcgcctggagaaggtccgcagccagcgcgagcaggctcgacgcgggcgcaagcgcgcggatatcccggcggtctccctggtcggctataccaacgccggcaaatcgaccctgttcaattcgctcaccgcctccgaggtgtatgccgccaaccagttgttcgccaccctcgaccccaccctgcgtcgcctgcaactggacgatctcgggccggtggtgctggccgacacggtgggcttcatccgccacctgccgcacaagctggtggaggccttccgcgctacgctggaagagtcgagcaacgccgacctcctgctgcacgtgatcgacgcctacgagcccgaacgggatgcgcaggtcgagcaggtgctggcggtgctcggcgagatcggcgccaacgaattgccgatgctcgaggtctataacaaggttgacctgctaccctcggtcgagccgcacatccagcgcgacgactccggcaagccggtgcgcgtctggctgtcggcgcagaccggcgaaggcctcgacctgttgcgccaggccatcgccgagctgcttggcgaggacctgttcgtcggaaccttgcgcctgccccagcggctcgggcgcctgcgcgcccagttgttcgaactgggcgcggtgcagtccgaggcgcacgatgaggagggttgtaccctgctgcaggtgcgcctgccgcgggccgagttgaaccgcctggcgagccgcgctggctggcagccggcggagttcgttgcgcaacacactttgcaataa

SEQ ID NO: 16334 - DNA, 993 bp, Pseudomonas aeruginosa
cgccgcgcccgctacgggggccggtgcttccgccggtggtggcagcgccagcgcttccgacctggggtcgcggatcgtcaacgatctgcgccagcaagacgcgcgtacgagggagagccgctgatgggcaacaagtctttgatcgctctgatcgtcggtgtcgtcgccgccatcgtcctgtggaacagcgtctacgtagtccagcagaccgagcgcgcggtcatgttgcgcttcggccgggtggtcgagtccgacgtcaagccgggcctgcacttcaagatcccgtacgtcaaccaggtgcgcaagttcgacgctcgcctgctgaccctggatgccccgacccagcgcttcctgaccctggaaaagaaagcggtgatggtggatgcctatgccaagtggcgggtggcggatgccgagcgcttctacaccgctacctcgggcctcaagcagatcgccgacgaacgcctgtcgcggcgtctcgaagcgggtctgcgcgaccagttcggcaagcgtaccctgcatgaagtggtatcgggcgagcgcgacgcgctgatgggcgacatcaccgcttcgctgaaccgcatggcgcagaaggagctgggtatcgaggtgatcgacgtgcgggtcaaggccatcgacctgccgaaggaagtcaaccgcagcgtcttcgagcggatgagcaccgagcgtgagcgcgaggcccgcgagcaccgcgccaagggtcgcgaactggccgaaggcattcgtgccgacgccgatcgccagcgccgggtaatcgttgccgaagcctaccgcgagtcggaagagacccgcggtgacggcgactccaaggctgccgcgatctacgccaaggcctacaaccaggatccggagttctattccttctaccgtagcctgaaggcgtatcgcgaaagcttcgccgagaagcgcgacgtactggtgctcgatccgagcagcgagttcttccgctatctgaacaaggccaacaagtaa

SEQ ID NO: 16335 - DNA, 1200 bp, Pseudomonas aeruginosa
aaggggagaggcgaaatggcaacggtagaccgctggctgctgccagatgggatcgaagaggtgctgcccccggaggcggcgcgcatcgaagcagcccgccgtcaggtgctggatctgttccaccgctggggttacgagttcgtcgtgaccccgcatatcgaatacctggagtcgctgctcaccggcgcgggacaggatcttgacctgcgcaccttcaaggtgaccgacccggcgtccggccggctcatgggtttccgtgccgacattacgccgcaagtggcgcggatggatgcgcacagcctgcgccgcgaggggccgagccgcctgtgctatgccggcagtgtgctgcatgcgcagccgcgcgcgctgtccacttcgcgtagtccgatccagctgggcgccgagctgtacggcgatccgagccctgccagcgatgtcgaggtgatcagcctgatgctggaaatgctcgagatggcggaagtgccggacgtgcacatggacctcggccatgtcggtatctaccgcggcctggcgcgcgcggcagggctgtccggcgaagtcgagcagcagttgttcgatgccttgcagcgcaaggcggtggacgaggtcgaggcgctgactgcagacctgcctgccgagctgcgcggcatgttgcgtgcgctggccgagctatgtggcggccgcgatgcgctggagcagggccgtgcccgtctggcggcggcgccggccgatgtccaggtggcgctgaacgagctgatcgagatcgccgattcgctggccgggcgcttccccggcttgccgctgtatttcgacctcggcgagctgcgtggctatcactatcacaccggcgtggtgtttgcggccttcgtgcccggcgttggccagtccatcgcccagggcggtcgctatgatgatatcggtgccgatttcgggcgcgcccgcccggccaccggtttctccaccgatctgaaaagcctggtcactctcggccaggcccggttggaccaggctgtatcgggtatctgggcgccggccgaaggggccgggctctggcaggcggtgcaacgactgcgccgcgacgggcagcgtgtcgtccaggctctgcccgggcaggatgcggcttctgcgcgcgaggcgggctgcgaccggcagctggcgctgcgcgatggcaattggcaggtggcgccgctggcgtcctga

SEQ ID NO: 16336 - DNA, 1344 bp, Pseudomonas aeruginosa
gattccgccggccgcggccggcatcgaacttccacgatggggacaagtgttatgggtaagaatgtcgtagtcctgggcacccaatggggtgatgagggcaagggcaagatcgtcgacctgctcaccgagcaggcggctgccgtagttcgctaccagggtggtcacaacgctggccacaccctggtgatcgatggcgagaaaaccgtcctgcacctgattccatcgggcatcctgcgcgaaggcgtgcagtgcctgatcggcaatggcgtggtgctggcgccggatgcgctgctgcgcgaaatcaccaagctggaagagaagggcgtgccggtgcgcgagcgcctgcgcatcagtccttcctgtccgctgatcctgtcctatcacgtcgccctcgaccaggcgcgcgagaaggcccgcggcgaagccaagatcggcaccaccggtcgtggcatcggcccggcatacgaggacaaggtggcacgtcgcggcctgcgcgtcggcgacctgttccaccgcgagcgcttcgccgccaagctgggcgagctgctggactaccataacttcgtcctgcagcactactacaaggagccggccatcgacttccagaagaccctggacgaggcgatggagtatgccgagctgctcaagccgatgatggccgatgtcgctgcgaccctgcacgacctgcgcaagcacggcaaggacatcatgttcgaaggcgcccagggatcgctgctggacatcgaccatggcacctacccctacgtgaccagttccaacaccaccgctggcggtaccgccaccggttccggcttcggcccgctgtacctggactacgtactgggtatcaccaaggcctataccactcgcgtcggctccggtccgttcccgaccgagctgttcgacgacgtcggcgcctacctggccaagcgcggccacgagttcggcgccaccaccggtcgcgctcgtcgctgcggctggttcgatgccgtgatcctgcgccgcgccatcgagatcaacagcatctccggcctgtgcctgaccaagctcgacgtgctcgatggcctggatgtggtgcgcctgtgcgtcggctacaagaatgccgatggcgatgtgctggaagcgccgaccgatgccgacagatacatcggcctgcagccggtctacgaggaaatgcccggctggagcgagtcgaccgtgggtgcgaagaccctggaagagttgccggccaacgcccgcgcatacatcaagcgcgtggaagagctggtgggtgcgccgatcgatatcatctccaccggtccggaccgcaacgagaccatcatcctgcgccatccattcgcctga

SEQ ID NO: 16337 - DNA, 1041 bp, Pseudomonas aeruginosa
tccgcgggtccaggtgctcaccgagctggccgccgggttccgtattccggtagggcagcgcgatcggcgcgaactcgacgagtgggcggaaggcgtccaccagggcgtggtcgcggaagtcagccccagccaggtctggggcgaaaacatgctcgaggaactgctcgagcggagcgagggcgtgccgctgctgctggccctggatggcgtcaccgatccgcacaacctcggcgcctgcctgcgtaccgccgatgcggcgggggtgcaggcggtgatcgtgcccaaggacaagtccgcgaccctcaacgccaccgtgcgcaaggtcgcttgcggcgccgccgaggtgatcccgctggtggcggtgaccaacctcgcgcgcaccctggaaaagctccagcagcgcggcctgtgggtggtcggcaccgctggcgaggcggacaagaccctctaccagctcgacctcaaggggccgaccgtgctggtgatgggcgcggaaggcaagggcatgcgccggctgacccgcgagcactgcgacttcctcgccaggttgccgatggccggcagcgtcagcagcctgaacgtctcggtcgccaccggcgtctgcctgttcgagatcctccgccagcgcaccccgctggagtgagcgcgtgcggggccgccgcggcgcggccccgcgccattccatccgctgtacaaatattcgccaatcttccttgcttcgccggttgcccttctctagaatgtcgccccttgccgcgcgggcaggcgttcgttcgcctctccaccaggcaagccaagaaaacattcactccttgcctgaccgttctgcggcaggctgcaacccgtaaggagcatttatgcgtcattacgaaatcgtgttcctggttcacccggaccagagcgaacaagtcggtggcatggtcgagcgttacaccaaggccatcgaagaagacggcggcaagatccaccgtctggaagactggggccgtcgtcagctggcctacgccatcaacaacgtgcacaaggcccactacgttctga

SEQ ID NO: 16338 - DNA, 519 bp, Pseudomonas aeruginosa
gtaagcgatccgatcggtagggctgggcgggcatatgcgtgtccgcggcagtccgctaacatcgggcacggtaccggcaacggcaccgtgcccgttgttttttccgctgttcctttttcttgcgtcgagtctatgaacgagatcaccagccccgagcaatacgacctggaaaccacagccctgaaggtgccgccgcactcgatcgaggccgagcaggccgtgctgggtggcctgatgctggacaacaacgcctgggagcgtgtgtcggattcggtgtccgacggcgatttctaccgccatgaccatcgcctgatcttccgcgccatctacaagctggccgaggccaaccagccgatcgacgtggtgaccctctccggagcagttggagaaggaaggacaactggcccaggtcggcgggcctggcctatctcggcgaactggcgaagaacattccctcggtcgccaacatcaaggcctacgcgcagatcatccgcgagcgcgccaccctgcgccaactga

SEQ ID NO: 16339 - DNA, 1410 bp, Pseudomonas aeruginosa
tcatgttcgtctaccgcgacgaggtgtaccacccggagaccgagttcaagggcgtcgccgaaatcatcatcggcaagcagcgtaacggtccgatcggtacggtgcgcctggccttcatcggcaaatacacgcgcttcgagaatcttgccgccggcatgtacaacttcgaggacgaatgacccggcttgggtcttgcccggcgggcgccttaccataggcacccgtttcagttgcaggacccgatgccatgcgtcccctcgttgccaccgtcgacctttccgccattcgccacaactatgccctggccaagcgctgcgcgccgcagcgccaggcgttcgcggtggtcaaggcgaacgcctatggccacggtgcgcgcgaagtggttaccgcgttgcacgacgatgccgatggcttcgccgtggcctgcctggaggaggccgcggaagtccgcgccttgcacgccagcgcgcgcatcctgttgctggaaggctgcttcgaggcgagcgaatacgccctcgccgggcaattgcgcctggacctggtgatccagggcgcggaacagggcgaggcgttcctcgccgccggcctggatattccactcaacgtctggctcaagctcgactccggcatgcaccgcctgggcttcgatcctgccgcgctgcgcgcctggcatgcgcgcctgcgcaaccatcctggtgtgcgcgagctgaacctgatcagccatttcgcctgcgccgacgaacgcaaccatccgctcaccgagcagcagctggagagtttcctcggcctgctcgacctggatttcgaccagcgcagcctggccaattcggcggcggtgctgactatcccggccgcccacatggactggctgcggccgggaatcatgctctacgggtcgaccccgctggccgacctgagcgccgccgaactgggcctgaggccggccatgagcctgggcgcgcagttgatttcactgcgcgaggtggccgtgggcgagagcgtcggctacggcgccacctggatcgccgagcggccggcgcggatcggcacggtcagttgcggctacgccgacggctatccgcgtaccgcgccagccgggactccggtactggtcgggggacgccgcgcgaccctggccgggcgggtctcgatggacatgctggcggtcgacctctccgacctgccggaggctcgcgttggcgacccggtggagttgtggggcgccgggttgtcggtggacgaggtcgcccgtgcctgcggcacccttggctacgagcttctgagcaaggtcacggctcgggttccgcgacgctacagccactgattcaggagatacgctccggtgccagggcggtcggccaggggagcgccggcgcggtctcgcgttcatcgtcggcagccatcgcatag

SEQ ID NO: 16340 - DNA, 453 bp, Pseudomonas aeruginosa
gcgtggtcgcggccctcggcgaagggcaccgcttcgccgctgcgatgttcacggaacccgccgcgctcgtcggggaggtacaggcgcaggtcgtgcaggctggcgctggcgacttccagccaccagccgccggataccgcctcgcgtctcggcaggtcgaggcgcagccaccaggcgctgcggctgaggccgacgctggtgcggccggcggcggcgacgaagcggccggcctgctccgcttgttcgaggtcctccaccgccaggttgccatcggggtcttcgagcaggtccagcgagccgttcaaccaggcgccgctggccggaggcgccggaaactccggcgcggcgcgcgaaacggcgctggccagtagcaggaagatgaccgcgagcagagcaagaggatggcgcacgatgactctcccgggggcctgccttagaggccgggtgagatga

SEQ ID NO: 16341 - DNA, 2019 bp, Pseudomonas aeruginosa
cacgacgatcgtcaacgtaggtaccgagaagatcaacgcgctctgggcgatggtgtcccagtacgccttcgccttcggcatcaagattctcgcggccatcgccttctgggtgatcggtcgttggctgatcggcttcgccgtcggcatggtgcagaaatccctcgagcggcaaaaggtcgatcccaccgtgctgcgctacgtgggttcgttcatcacggtgaccctgaacgtgctgctggtggtgggcatcctcggtttcttcggcatccagaccaccagcctggcggcgctgatcgcggcggtcggcctggccatcggcatggcctggtcgggattgctggcgaacctggcggccggcggcttcatcatcgtcctgcggccgttcaaggtcggcgacttcatctgcgccggcggagtgaccggcacggtcaaggagatcggcctgttcaccacggcgatcaacactccggacaacgtgctgaccatggtcggcaacaacaagatattcggcgacaacatccagaacttcacccacaacccgttccgccgggtcgagttgaaggcgcagctttccggtgccgccgactaccaggcggccatcgccctgctcaagcagcgcgtcgcggcgattcccaacgtgctcggcgagccgccggtggacgtggagatcctcgagttcaacctggtcgggccggtgctggcggtgcgcccgtattgccacaacgaccattactggcaggtctatttcgataccaacaaggtgatcaaggacgccctcggcgccgacttcccggcaccgatgccggcgcagacggtgatcgtgcagcagtccgccggcgcctgacgtttcccgctcggcaccgacgccccgtcctgcggggcgttggcgtttgtgcgcggaccgggtggcgggccgcgcggagaaaacgggccatcggcgagtccaacgggcaccccggcgaacaaggtatagtgcgggcctgcaaccgtcgccgcagccggccgggtttcatcgggaaaaggattccgtgtgttcttcagattgctcttgatcgccgtcctgctggcggtatccgcgtgcagctccaaggctcccggcccgggggcgtcggtgccgaaggtcgtgcgcggcgagtatcgcgtcaagcgcggcgacaccctctattcgatcgccacccggcacggctggaactacaaggacctggcgcgcgccaacggcatccgcccgccctacgcggtcaaggtcggccaggtagtgcgcttcgacgggcgcaagtcgacctacgtcgccagcagccgctcctcgtcgagcagccgtgcgcgcaagccgccgcctccgccgccgtcggtgaccctgcgcggctggcagtggccgatgaaggggccggtgatccgccgcttctcaagttccgacaagctcaacaagggcatccgcatcgccggcaccctgggccagccggtacaggcctcgctggccggcaaggtggtgttcgcggtgaacaacatgcgtggctacggcaacctggtgatcatccagcacggtacctcgtacaccagcacctacgcgcacaacagccgcttgctggtgaaggaggggcagatggtcagcaagggccagaagatcgccgaggccggttcctcggatgccgaccgggtgcaactgtacttcgagatccgccagaacggccggccgctcgacccgctgagcctgctgccgccgtcctgagagaggagcggatcactgcggggtgcggtcgacccacttcggcgccacgcttggcgtccaggcggcgagggaatcgagcagtgcctccgggctggcaccgcgctgcagcatgccgcggtgttcggcgcggacgaagcgttcgtcgaccaggtggtcgaggaaggtcagcagcggatcgtagaaaccgttcacttcgagcaggcccagcggcttggcgtggtagcccagttggccccaggtccagacctcgaacagctcttccagggtgccgagcccgccgggcagggcgatga

SEQ ID NO: 16342 - DNA, 579 bp, Pseudomonas aeruginosa
acgccgggcagatcccgctcgatgccccgccacgtccggttcgggtttgacctgaatcagtggaactcggtgcccgatcgggcagtctgctctttcaggattcatcgcccaacctgcctaggaggctgctccatgctacgtaaactcgctgcggtatccctgctgtccctgctcagtgcgccgctgctggctgccgagtgctcggtggacatccagggtaacgaccagatgcagttcaacaccaatgccatcaccgtcgacaagagctgcaagcagttcaccgtcaacctgtcccaccccggcaacctgccgaagaacgtcatgggccacaactgggtactgagcaccgccgccgacatgcagggcgtggtcaccgacggcatggcttccggcctggacaaggattacctgaagcccgacgacagccgtgtcatcgcccacaccaagctgatcggctcgggcgagaaggactcggtgaccttcgacgtctccaagctgaaggaaggcgagcagtacatgttcttctgcaccttcccgggccactccgcgctgatgaagggcaccctgaccctgaagtga

SEQ ID NO: 16343 - DNA, 951 bp, Pseudomonas aeruginosa
agacctggttgcgacaggcacattcccgcccgcgacaaaggcccgtcgacgacgggcctgccgcacggaccgggaggctcagggcgccttcggcagttcgcgcttgtgctgggtcttgtggtaggtgtcgacgatcacccgcgcagcttcctcgcgcagcggctggccgtgcaggaaggcgtcgatctcggcataggtgacgccgtgggaagcctcgtccggatggccggggcgcaggtcctcgaggtcggcggtggggatcttctccaccaggttctccggagcgccgagggcgcgggcgagggcgcgcacctgatgcttggccaggccgctgagcggagccaggtcgcaggcgccgtcgccgaacttggtgaagaaccccatgaccgcctcggcggcatggtcggtgccgatcaccaggccgccgcgggcgccggcgatggcgtactgggcgaccatgcggatgcgcgccttgatattgccgatgacgaagtcgctcttcgccggctcgagtccttccagggcttccagctgttccgccagggctttcaccgacggaccgatgttgacggtctgctcttcgtcggcgcggatggtcgccagcgaggcctgggcatcggcctcgtcctgctgcacctggtagggcaggcgcacggcgatgaagcggtaggcctggtcgccggtctgctcgcgcagttgctcgacggcgcgctgggccagcaggccggcggtgagcgagtcgacgccgccgctgatccccagcaccagggtcttcagcccggaatccttcaggcactgctggatgaaggcgatgcgccgggcgatctgcgcctgcacgtcggcctccgactggaacggcggctggacctgcagggcttgggcgatgtcgcgttggatctgttgcatgttcgggctcccgttaggtgcgaaaggattaggccggcacgttga

SEQ ID NO: 16344 - DNA, 756 bp, Pseudomonas aeruginosa
aggacgaactgcactgctatggcggcgaacgccaggcgggctgaagagaggagtgacgatgagttcagcggaagtattggccagcgtggatatcgtggcgttgcgcctgaaccccgggcacggactggagctgttgctgatccgccgcgcccaggcgcctttcgccggccagtgggccttgcccggcgtgctggtcaacggccgcagcgccgaccacagcctctacgacacggcggtgcgcccccctgcgctaccaggcgcgggctggagccggcttacatcgagcaggtgcccacggtcggcaacgcggtacgcgacccgcgcggctggtcgctgagcgtgttctacctggtgctggtcggtccggacacccggatggaggacgacgacctcgacttcgtgccgctgcgcgacgttcgcagcgagcgcttcgccctgccgttcgaccacgcccaactggtacagcaggcctgcgagcgcctggcgagcaagtcggtgtacagcgccctgccgctgttcctgctggcgccgcgcttcaccgtggccgaggcgctgaaggccttcgagtgcgccatcggccaggaagtccagcattccagcctgcgcgggcgcctggagcggatgaaggaggctggctgggtcgaggacaccggcgaacgccagcgtccgcccatggggcgcccgcaacacgtcctgcatttcaccccgaagccgggcggcgccttcgttttcgaccgcagcctgctggcgtcctga

SEQ ID NO: 16345 - DNA, 555 bp, Pseudomonas aeruginosa
ttacgagcgccaacatcatcctcaggagcaacaccccatgtccaagaagctgttcagaaaaggcatcctggctctcgcggtttcatccgtgatgggtctttccacgcatgcgctggccgacgtcgtgatcggcgtggccggaccgcataccggcgccaacgcctccttcggcgagcaatactggcgcggcgcgtcccaggcggcggaagacatcaacgcggcgggtgggatcaacggcgagaagatcaagctggtcaaggccgacgacgcctgcgaaccgaagcaggccgtggccgtggccaaccgcctggtggaccaggacaaggccatcgccgtggtcggccatttctgctcttcttcgaccatccccgcatccgaggtctacgacgaggccgggatcatcgccatcacccccggttccaccaacccgcaggtcaccgagcgcggactctccgggatgttccgcatgtgcggccgcgacgaccagcagggcgtggtcgccggcgactatatcgtcaacgtgctcaaggccaagaaggtcgcggtgatccatga

SEQ ID NO: 16346 - DNA, 1005 bp, Pseudomonas aeruginosa
cacccgtccgctttcaccggcgagcgccggcgcgccttacaaaggccgtcgcgattcgccctgaagagactgaaaaatggacggcatcttcctccagcaaatgatcaacgggctgaccctcggctcggtctacggcctcatcgccatcggctacaccatggtctacggcatcatcggcatgatcaacttcgcccacggcgaggtgtacatgatctccgcctacctgtcggccatcgcccttgccctgctggccttcttcggcctgcagaacttcccgctgctgatcctcggcaccttgctgttcaccgtgctggtgacctgcacctacggctgggtgatcgagcgcatcgcctacaagccgctgcgcaactccacgcgcctggcgccgctgatctcggcgatcggcatgtcgctgatcctgcagaactacgtgcaggtggcgcagggaccgcgccagcaggggatcccgaccctgctcgacggcgccctgaaattccacgtcggcgacggtttcgtccagctcacctacaccaagctgttcatcctgatcgcttcgctgatcggcatggcggtgctgacctacgtgatccgctacaccaagctcgggcgcatgtgccgggcgacccagcaggaccgcaagatggcttcgatcctggggatcaacaccgaccgggtgatctcctacgtgttcgtcatcggcgcagcgatggccgccctggccggggtgctgatcaccatgaactacggcaccttcgacttctacgccggcttcatcatcggcatcaaggcgttcaccgcggcggtgctcggcggcatcggctcgctgcccggggcgatgctcggcggcctggtgctgggagtggccgaggcgcagttctcggggatggtcaacaccgactacaaggacgtgttcgccttctcgttgctggtactgatcctgatcttccgtccccagggcctgctcggccgcccgcagatcgccaaggtgtaaggggacgacgatga

SEQ ID NO: 16347 - DNA, 774 bp, Pseudomonas aeruginosa
tccgcatcagccgggtgggcttcgccccgcgcaagggggtggcgccatgagcgacaagatcctcagcgtcgagcacctgatgatgcacttcggcggcatcaaggcgctcaacgacgtcaacctcgacgtcgagcgcggttcgatcaccgcgctgatcggccccaacggcgccggcaagaccaccgtgttcaactgtctcaccggcttctacaaggccaccggcggcaacatcctgctcaacacccaggggcgcaccacggacgtcatccaggtgctcggcgagccgttccagctggacgacttcgtcaagccgccgcaactgggcagtcgcctctactacaagatgttcggcggcacccacctggtgaaccgcgccgggctggcgcggaccttccagaacatccgcctgttcaaggacatgtcggtggtggagaacctgctggtggcgcagcacatgttcgtcaaccgcaacctgctcgccggcatcctcaacactcccggctatcgccgcgccgagagcgaggcgctggaccacgcgttctactggctggaggtggtcgacctggtggactgcgccaaccgcctggccggcgagatgtcctacggccagcagcggcgcctggagatcgcccgggccatgtgcacgcggccggaactcatctgcctggacgaaccggccgccggcctcaacccggccgagacccacgccctgagcaacatcgtccgctacctgcgcgaccaccacgggatcaccgtactgctgatcgagcatga

SEQ ID NO: 16348 - DNA, 765 bp, Pseudomonas aeruginosa
cgagaaggtgatcgccgcctatctcggtgccgacgaaaaggagctgtcatgagcgcggcgttgctggaattccgtgaggtggacgtgttctacgggccgatccaggcgctgaaaaaggtctcgctgcaggtcaacgagggcgagacggtgagcctgatcggtgccaatggcgcgggcaagtcgacgctgttgatgtcgatcttcggccagccgcgcgcggcggccgggcagatcctctatcgcggccaggacatccgccagaagtcggcgcactacgtggcgtccaacggcatcgcgcagtcgccggaaggacgccgggtgttccccgacatgagcgtcgaggaaaacctgctgatgggtaccattcccatcggcatggaccacgccgaggaggacatgcagcgcatgttcgagctgttcccgcgcctgaaggagcggcgcaaccagcgcgccatgaccatgtccggcggcgagcagcagatgctcgccatcgcccgcgcgctgatgagccggccgaagctgctgttgctcgacgagccctccctgggcctggcgccgatcgtggtcaagcagatcttccagaccctgcgcgagctggccaggagcggcatgaccatcttcctcgtcgagcagaacgccaaccatgcgctgaagctctccgaccgcgcctacgtgatggtcaccggggaaatccgcatgagcggcagcggcgaagaactgctcggcaaccaggaggtgcgcaacgcctatctcggcggacattga

SEQ ID NO: 16349 - DNA, 747 bp, Pseudomonas aeruginosa
  unsure (648): Identity of nucleotide at the above locations are unknown.
ggggatcggcgtgaaactggtgacggtgttccctggcaatggggcgcgtggcctgccggcggtggccgcggtgttcgctctgttcgacggcgaagacggtcgcccgctggcgttgctggaggcttcggagctgaccgcccggcgtaccgcctgcagctcggcgctggccgccgactacctggcgcgggacgatgcgcggcgcctgctggtggtcggctgcggaaccctggctgcgcacatggtgcgggcccacgcctgcgtgcgcgactatcgccacatcgacatctggggccgcgatccggccaaggccgccgcgctggccgcccggctgcgcgaggagggctacccggcgcgagcggccgacgggttgcgcgcggcggtggaggcggccgactgcgtcagttgcgttaccacctcccgcgaagcgctggtgcgcggcgcatggctgaagccgggcgtccatctcgacctggtcggcgccttcctgccgtccatgcgcgagaccgacgccctggcggtggcgcgcgcgcgggtcgtggtggatacccgcgcaggcgcgctggaagaagccggcgacctgttgcaggcgatcgccgaaggcgccatcgggcgcgaggcgatatccaccgaactgcgcgacttgctgancggggcagggcggcgcggcgatcccggggaaatcaccctgttcaagtcggtgggttatgcgctggaggacctggtccccgcgcgccgggttgtggataa

SEQ ID NO: 16350 - DNA, 840 bp, Pseudomonas aeruginosa
  unsure (19): Identity of nucleotide at the above locations are unknown.
cggacaggccatctgcgcntggctgccgccgtccgccagcggcacccgggcgaccagcccgcgcgcctgcaactgcgggtgttccagcgcctcggagagcggcagcagcggctccacgcaggcatccagggcggcgaacaccgcctgccattcggcgaagtcgcgtttctcgccctgatcgtcgccctggccaacatgggcatgaacgtcaccccgttgctggccggtgccggcgtgatcggcctggccatcggcttcggcgcgcagtcgctggtggcggacctgatcaccggcctgttcatcatcatcgaggactcgctgtcgatcgacgactacgtcgacgtcggcggccaccttggcacggtcgagggcctgactatccgtaccgtgcgcctgcgcgacctggacggcgtggtgcataccatcccgttcagcgagatcaagagcatcaagaactactcgcgccagttcggctacgcgatgttccgctggccggtgccggcgagcatgccgatcgacgacgcggtggcgctggtgcgcgaggtcgcgatggagctgcgcagcgacccggcggtctaccgcaacctgtggtcgccgatggaattgcagggcgtggagagtttcgacaacggccaggcgatcctgcgcttccgcttcaagaccgcgccgatcaagcagtgggaggtccagcgggcgttcaacttgcgcctgcgtcggcgcctcgaccaggccggcctcgaactgtccatgccgcgtctcaacgtacagttgagccgggcgcccaaggcgaaatccgcggaaccggacgagccgggcacgccggcggacggcggcatctag

SEQ ID NO: 16351 - DNA, 1500 bp, Pseudomonas aeruginosa
tacaggtcgtattccagcggggtgcacgaaggtgcgcaccttgatctcttcttcgctcttcagctcgatgtaggcatcgatgaactcgtcggtgaacacgccgcccttggtcaggaacgcgcggcccttgtcgagctcttccagcgcctctttcaggctgccgcaaacctgcgggatttccttcgcctcttccggcggcaggtcgtacaggttcttgtcggcggcatcgccggggtggatcttgttctggatgccgtccaggccggccatcagcagcgcggcgaaggccaggtaggggttggctgccgggtccgggaagcgcgcttcgatacggcgggccttcgggctggatacgtaggggatacggatcgaggcggaacggttgcgcgccgagtaggccagcatcaccggagcttcgaagcccgggaccaggcgcttgtaggagttggtcgaggggttggtgaagccgttcagggccttgccgtgcttgatgatgccgccgatgaagtacagggcggtctcggacaggccggcatagccttcgccggcgaaggtgttcttgccgtccttggagatcgacatgtgcacgtgcatgcccgaaccgttgtcgccgtacagcggcttcggcatgaaggtcacggtcttgccgtaggcgtcggcgacgttgtgcacgcagtacttcagggtctgcacttcgtcggccttggcgaccagggtgttgaacttcacgccgatctcgttctggccggcggttgccacttcgtggtggtggacttcgaccaccaggcccatttcttccagggcgttgcacatggcggtgcggatttcatggtcgtggtcgaccggcggtaccgggaagtagccgcccttcacgcccgggcgatggcccttgttgccggactcgatgtcggcgtcggtgttccaggaagcctgctcggagaagatcttgaacatcgagccggagatgtcggacttgaacttcacttcgtcgaagatgaagaactccggctccgggccgacgaacacggtgtcgccgatgccggtggacttcaggtactcctcggcgcgcttggcgatgttgcgcgggtcgcgctcgtagccttgcatggtgctcggctcgatgatgtcgcagaccaggatcagggtcggctcttcggtgaacggatcgaggacggcggtgctgtcgtccggcatcaggatcatgtcggaggcttcgatgcctttccagccggcgatggaggagccgtcgaacatcttgccggcttcgaagaactcatcgtccagcgcgtcgcgagccggcatggtgacgtgttgctgcttgcccttggtatcggtgaagcgcaggtctacccacttcacgtcatggtctttgatcagttggtgcgacttgtacgacatgctgtcctccaggagggattagagctgggagctttttctgtgccccagtatcgggtgatgccggccggaatactccgccagggcaacctgcctcacaagtga

SEQ ID NO: 16352 - DNA, 1500 bp, Pseudomonas aeruginosa
ttccgcccctttttttccgtcgccccgcgcgttcgcgtccctcgcatgaaactcatcgtcaagaccttccaggaaatcaccatcaagagccggccggtgcgcaagcgcttcatccggcagttggcgaagaacatccgcgcggtgctgcgcgacctggacccggagctgaaggtcgagggcgagtgggacaacctggaggtagagaccgccgtggtcgacgccaaggccaggcgcgagatgatcgagcgcctgacctgcaccccgggcatcggtcatttcctcgaggtccacgagtatccgctgggcgatttcgacgacatcctcgccaagtgcaaggcgcatttcggcgaccagttggccggcaagaccttcgccgtgcgctgcaagcgcgccggcaagcacgcgttcacctcgatggaggtggagcgttacgtcggcagcggcctgcgccgcgaatgcggggctgccgggatcgacctgaagcagccggaagtcgaggtgcggatggaaatccgcctcgaccgcctgttcgtcatccatcgccagcatccgggcctgggcggctatccgctgggcgcgctggaacaggtgctggtgctgatgtccggcggcttcgactcgaccgtggcggcctaccagatgatgcgccgcgggatgatcagccacttcgtgttcttcaacctcggcgggcgcgcccacgaactgggggtgatggaagtcgcccactacctgtgggagaagtacggccgctcgcagcgcgtgctgttcgtcagcgtgccgttcgaggaagtggtcggcgagatcctcaccaaggtcgacgacagctatatgggcgtgaccctcaagcgcatgatgctgcgcgccgccagccgcgtggccgagcgcctggagctggacgcgctggtgaccggcgaggcgatctcccaggtgtccagccagaccctgccgaacctctcggtgatcgaccgggttaccgacaccctggtgctgcgtccgctgatcgtcagccacaagcaggacatcatcgacaccgcccggcagatcggcaccgccgagttcgcccggcacatgccggaatactgcggggtgatctcggtgaacccgaccacccaggccaagccctaccgcgtcgagcacgaagagtcgaaattcgacatggcggtgctcgagcgcgccctggagcgcgccacccagcgcaccgtcgaccgggtgatcgacgaactcggccaggacctgcaggtggaagaggtcggcgaggtgctgcccggtcagattgtcatcgatatccgccatcctgatgcccaggaagacgaacccctggccctggaaggcgtcgaagtccaggcgctgccgttctacgcgatcaacagccgcttcaaggaactggacgccaaccgccagtacctcctgtattgcgacaaaggggtgatgagccgcctgcatgcccatcacctgctcaacgaggggcacaccaatgtgcgtgtttatcgtccggcttaa

SEQ ID NO: 16353 - DNA, 2034 bp, Pseudomonas aeruginosa
gcagccgggcttgttcggcggcagcatccgccaccgtcctcccgacacgtccgccgcctaggccgatgcccgcccttcggcgtgccggccggaccggggcagcgtccgcctgctgcccgccccttaattgaagaagcctgtcgtgtcgggcgccgccctgtccgaccccaccaccgccgcgaagccgcgcttcgggcgttaaacgagacaagacttgtgatcgaaaatctgcgcaacatcgccatcatcgcccacgtcgaccatggcaagaccaccctggtggacaagctgctgaagctgtccggcaccctcgaccgcaaagaagcggaaagcgagcgggtgatggactccaacgaccaggaaaaagagcgtggcatcaccatcctggcgaagaacaccgcgatcaagtggaacggctacaacatcaacatcgtcgacacccccggtcacgccgacttcggcggcgaggtggagcgcgtgatgtcgatggtcgactccgtgctgctggtggtcgacgcccaggacggccccatgccgcagacccgcttcgtgacccagaaggccttcaaggccggcctgcgtccgatcgtggtggtgaacaagatcgaccgcccgggcgcgcgtccggactgggtcatcgaccagatcttcgacctgttcgacaacctcggcgccaccgacgagcaactcgacttcccgatcgtctacgccagcgccctgaacggcatcgccggcctcgaccacgagaagatggacgacaacatggacgcgctgttccaggcgatcatcgaccacgtcccggctccggtggtggacaccgagggtccgttccagatgcagatctcgcagctggactacaacagcttcctcggcgtgatcggtatcggccgcatcacccgcggcaaggtcaagtccaacaccccggtggtggccatcagcgacgacggcagcaagcgcaacggccgcatcctgaagatcatgggccaccacggcctgcagcgcgtcgaggtggccgaggcggaagccggcgacatcgtctgcgtcagcggcatggaggagctgttcatctccgataccctgtgcgacccgcagaacgtcgaggcgctgccgccgctgaccgtcgaccagccgaccgtgagcatgaccttccaggtcaacgattcgccgttcgccggccgcgaaggcaagttcgtcaccagccgcaacatcaaggagcgcctggagaaggaactgctgcataacgtggcgctgcgcgtcgagccgggcgacagcccggagaagttcaaggtttccggccgtggcgaactgcacctgtcggtactgatcgagaccatgcgccgcgaaggcttcgagctggccgtgggccgcccggaagtggtgatcatcgagaaggacggcgagaagcaggagccctacgagaacgtcaccatcgacatcgaggagcagcaccagggctcggtgatggagcagatgggcctgcgcaagggcgacctgagcaacatgattcccgacggcaagggccgcgtgcgcctggagtacaccattccggcgcgcggcctgatcggcttccgcaacaacttcctgaccctgacctcgggcaccggcatcctgacctcgaccttcagccactacggtccgatcaaggccggcgaagtcagcaaccgccagaacggcgtactggtctccatggccaccggcaccgccctgacctactcgctggagaccctgcagagccgcggcaagctgttcctcggcccgggcgacgaaatctacgaaggccagttggccggcatcaacagccgtgacaacgacctggtgatcaacccgaccaagggcaagaagctcgacaacatgcgcgcttccggcaaggacgaagtcatcgccctggttccgccgatccgcttcaccctcgagcaggcgctggagttcatcgccgacgacgagctggtggaagtgacgccgaagtcgatccgcctgcgcaagaagatgctcaacgagaacgaccgcaagcgctacgagcgcagcaaggtctaa

SEQ ID NO: 16354 - DNA, 444 bp, Pseudomonas aeruginosa
accgttgccgtaccggcgcgccgcaacggcgtgcctcgcggccggcaggcagggcaggggtgcccggcctgccggccgttttgctatgcgccgggcgctttccggcgtggcttgatggcccccgcggcagcggcccgcagcaagcggcggaacgtcgggcagtccatgtgctcgcgcgccggacaggccgcggcatgccgcaggccgtcgcgcatggcggcgaggcggcggatcgtccggtccagttcgtcggccttggccgccagcgccgcgcggtcgatccgcagcgcgccgtcggctgcgcccatgccggcaatctcgtccagcgacaacccggcggcgcggcccagcccgatcagcgccagccgctccagcacgcctgcatcgaacagccggcgcaggccgtgccggccgctggaggcgatcagtcccttttcctcgtag

SEQ ID NO: 16355 - DNA, 519 bp, Pseudomonas aeruginosa
cgtttcggcacctgggccgtgacgaaatacagacgaggtgaacctcatgtgggacaaacgctatgccgccgaagagtatgtctacggaaccgaacccaacgctttcctgaaggagcatgcgcagcggctggccgggccggtgctgagcgtcgccgagggcgaggggcgcaacgcggtgttcctcgcttcgctggggctggaggtgcttggcgtggacggctccaccgtcggcctggccaaggcgcgccggctggccgaggcgaaaggcgtgtcgatcgacaccctggtggtcgacctggcggactacgaaccgccggcagcggcgttcggcgcggtggtgtcgatcttcgcgcacctgcccagtcgcgtgcgcggcagactcaaccgcctgctggagcgttcgctgcgaccgggcggtctcttcctgctggaggcctatcggccggaacaactcggccgcggcaccggcggcccggcggacgtcgacatgctggtgagccgtgcggcgctggaggctga

SEQ ID NO: 16356 - DNA, 1191 bp, Pseudomonas aeruginosa
cgcccagccagcgccgcgccgtgccgcccctccagcgtctccacgcgaaccctcgctggtcgagcgtggcttcgccgcggccaagggctggctgttcggcggcaacacggtattgcgcatcggcgtggtgctgctgttcatcggcctggccttcctcctgcgctatgcctcggaacgggtggcggtgccggtggagtaccgctacgccggggtggcgctggcagcgatggcgctgctcggcgtcggctggtggctgcgcgagcggcgcgccgcctacggcctgatcctgcaaggcaccggtatcgcggtgctgtacctgaccatcttcgccgccatgcgcctgcatccgctgatctctcccggcgcggcgctggccctgctggtggtggtgatgatctgctcggcgatcctcgccgtgctgcagaacgccatgggcctggcggtggtggcggcgctcggcggcttcgccgcgccgatcctgacctccaccggcagcggcaaccatgtagcgctgttcagctacttcgccctgctcaacgccggcatcttcgccatcgcctggttccgcgcctggcggccgctcaacctggtcggcttcgtcggcaccttcggcatcggcttcgcctggggactgcgctcctatacaccggagctgttcgccagcaccgagccgttcctggccctgttcttcctgatgtacgtcgggatcggcctgctcttcgcccgccgcaagctgctggaggccgcgcaggcgcctgccgagcgcggcgaactgctgcgctggtcggcgcgacaggccgactacatcgacgccaccgtgctgttcggcccgccactggtggggttcggcctgcaatgcgcggtgatcggccacatcgacttcggcatggccttcagcgccctggccctggggctcttctacatggtcctggcgcgggtgctgcgcggccatgcttcggccggacgcaccagcctgctggtggaaatctgcctggcgctgggggtggtcttcggcaccctggccattccgctcggcctggacgcgcgctggacctcggccgcctgggccgtcgagggcgccggcatctactggctcggcctgcaccagcaacgccgcctggcgcggctcttcgccctgctgttgcagggcggtgcggcgttggcctacctgaatggcgtgcgcccgggtga

SEQ ID NO: 16357 - DNA, 1365 bp, Pseudomonas aeruginosa
cgtgcaggccctgcagcaggccggcgcgcgctacatcgtggtctggctgttgcccgacctgggcctgaccccggctaccttcggtggtcccttgcagcctttcgccagccaactcagcggcacgttcaacgccgagctgaccgcccagttgagccaggccggcgccaacgtcattccgttgaacatcccgctgctgctcaaggaaggcatggccaacccggcttccttcggcctggccgccgaccagaacctgatcggcacctgtttcagcggcaacggctgtaccatgaacccgacctacgggatcaacggcagcacgcccgacccgagcaaactgctgttcaacgacagcgtgcacccgaccatcaccggccagcgcctgatcgccgactacacctattcgctgctgtcggcgccctgggagttgaccctgctgccggaaatggcccacggcaccctgcgtgcctaccaggacgaactgcgcagccagtggcaggcggactgggagaactggcagaacgtcggccagtggcgcggcttcgtcggcggcggcggccagcgcctggacttcgactcccaggacagcgccgccagcggcgacggcaatggctacaacctgacccttggcggcagctaccgcatcgacgaggcctggcgcgccggggtcgccgccggtttctaccggcagaagctggaagccggcgccaaggattccgactaccgaatgaacagctacatggccagcgccttcgtgcagtaccaggaaacccgctggtgggccgacgcggcgttgaccggcggctacctcgactacgacgacctgaagcgcaagttcgccctgggcggcggcgagcgcagcgagaaaggcgacaccaacggccacctgtgggcgttcagcgcgcgcctgggctacgacatcgcccagcaggccgacagtccctggcacctgtcgccgttcgtcagcgccgactatgcacgggtcgaggtcgacggctattccgagaagggcgccagcgccaccgcgctcgactacgacgaccagaagcgcagctcgaagcgcctgggcgccggcctgcaaggcaagtacgcgttcggcagcgatactcagctgttcgccgagtacgcccacgaacgcgagtacgaggacgacacccaggacctcaccatgtccctcaacagcctgccgggcaatcgctttaccctcgaaggctacaccccgcaggaccacctcaaccgcgtctccctcggcttcagccagaagctggcaccggagctgtcgctgcgcggcggctacaactggcgcaagggcgaggacgatacccagcagagcgtcagcctggcgctgagcctggacttctgaggtag

SEQ ID NO: 16358 - DNA, 777 bp, Pseudomonas aeruginosa
tgtacgaagccaacccgatgtcgttcatcatcgagcaggccggcggcgccgccaccaacggcacccagcgcatcctcgacatcaagccggagaacctgcaccagcgtgtcgcggtgttcctcggctcgaagcaggaagtcgagcgcatcaccggctaccacgcggagtaggccgatgagcgcgccctgggagaccttgctcgactggtggttcggcacctccagcgacgccgccgaggtggttgcccagcgcaacggcctgtggttcggcaagaacgtctgccaggacgccgatgccggcggccgtttcggcgacctggtgaaccaggcgctggacggcggcttgcaggagtggacggccgaggccgatggctggctggcgctgatcctgttgctcgaccagttgccgcggatgatctaccgcgacacgccgcgcgcctacgccggcgacgcccgggcgcaacgggtggtgcgcgagggcctggaaaaaggcttcgaccgccagttgccgccggtgcgccgggtgttcgcctacctggtcctggagcacgccgaggacctgcccagccaggagcgggcggtagcctgcttccgcgacctgcgcgatcaggtcggtggcagcgtgcgcaagcccttcgacgatttctacgactatgccgagcggcatcatgcggtagtcgcccgcttcggtcgctttccccatcgcaacgccattctcggccgcccctccagcgaggaggagacggcgttcctcagggaacccggttcgcgtttctga

SEQ ID NO: 16359 - DNA, 330 bp, Pseudomonas aeruginosa
ctccaaggctccggatttcccccgcgtgtgccaagctgtagggcagcgcttcccccgaacaaggagttcctcatggcgtcgttccgtaccctggccgtggtcgctttctgcgtcgtcctggccgcctgcagcaagatcaaccaggaaaactattccaagctcaaggccggcatgagcaaggccgaggtcgaggcgatcctcggcaagcccaccgagtgctccggcgcgctgggcatgtccagttgcacctggggcgacgagaaggctttcatcagcgtgcagtacgcggccgacaaggcgctgctcttctccggccaggggctcaagtga

SEQ ID NO: 16360 - DNA, 2865 bp, Pseudomonas aeruginosa
cgcccgacggctcgaacgagtggggcggataagcgcaacgcggttgtccgccgctgtgcagggtcagtcgagcagttcccccagcacctggacgaatgcccgtgcgctgcgctcttcccctgcatgccggccgtcgcgcaccacccatctgccggccaccatcacgtcgcgcacctggcggtcgccgccggcgaacagccagcggttgagcagggcgtcgccctcggcgctggccaggtaggggtcgttgccgtcgagcaccagcaggtcggcgcgacggcccacggcgagactaccgatcggctgcccaagggcctgggcgccgccagccagagcagcgtcgtagagcgtgcggccgatcatcggctggtcgtcgcggtacagccggttgcgtttccggtcgcgcaggcgctggccgtattccagccagcggagttcctcgaccacgctgagcgagacgtggctgtccgagccgatgcccaggcgcccgccctgggcgaggaagtccgtcgccgggaatatgccgtcgccgaggttggcctcggtgctcaggcacaggccggccaccgcgccgctacgcgccatcgccgccacctcggcggggtcggcgtgggtcgcatggaccaggcaccagcgctggtcgaccgcgacgttctcgtacagccattgcaacggccggcgtccgctccaggcctggcagtcgtcgacttccttctgctgttcggcgatatggatgtggaccggcaggtcgtcgtggccggcggcgaggaccgtggcgatctgctgcggagtcaccgcgcgcagggagtggaagcacaggcccagggagtggcctgccgcctccagcggcgcgcgcaggcgctggagcagttccaggtaggcctcgctgccattgatgaagcgccgctggccctcgctggccggctggccgccgaagcctgcgtgactgtaaagcacgggcagcagggtcaggccgatacctgcggcgctggcggcgcgggagatgcgcagggaaagttcggcggggtcggcgtaggggcggccgtcgaggtcgtgatggacgtagtggaattccgccaccgcggtgtagccggccttgagcatctcgatgtagagctggcaggcgatgacctcgatctgttccggcgacagtcgagcgaccatccggtacatcagctcgcgccaggtccagaaactgtcgttgggattgccggcgacttcggcgagcccggccatggcgcgctggaacgcgtgcgaatggaggttgggcatccccggcagcacggcgccgccgaggcgttcggcgccgtcggcgttggcgtcgggacgaatcccggcgaggactccgtccgcggaaatctcgaaacggacatttcgcgcccagccttccggcagcaacgcacgttcagcgaaaattgcggacataatcagctcacatgcagtctgttttatttgtatatacatatacagacgattaagcggtgcgtaaactcacttcatcgacgcctcgacaaggagtctctccgtgacgtcctcttcctccgatcgttccccgctggcctcgcaactcggcgaggtaccggcgccgctctacgcgcgggtcaagcagatgatcgtcagccagatccagtcgggcgcctggccgccgcaccaccgggtgccgtccgagagcgaactggtcagccagctcggcttcagtcgcatgaccatcaatcgcgccctgcgcgaactgaccagcgacggcctgctggtgcgcatgcagggggtaggaaccttcgtcgccgagcccaagggccagtcggcgctgttcgaggtgcacaacatcgccgacgagatcgcggcccgcgggcatcgccatcgttgccaggtgatcaccctcggcgaggaggtcgccggccccgagcgcgccctggcactggacgtgcgcgaaggccagcgggtgttccactcgctgatcgtgcactacgagaacgatatcccggtgcagatcgaggaccgctacgtgaacgccgcggtggcgccggactacctcaagcaggatttcacccggcaaacgccctatgcctacctgacccaggtggcgccgctcaccgagggcgagcatgtggtcgaggcgatcctcgccgagccggccgagtgcaagctgttgcagatcgaacgcggcgagccgtgcctgctgatccgccgccgcacatggtccgggcgtgtcgcggtgaccgccgcgcggctgctgcacccgggttcccgccaccgtctggaaggacgtttcagctcatgagcgaactccgcatcctgcgcgccgtcgactacccgagaatgccgtggaagaacggcgccggctccaccgaggagatcgcccgcgacggcggcgacggcctggacggcttcggctggcgcctgtcgatcgccgatgtcggcgagtccggcggcttctcccgcttcgccggttaccagcggatcatcagcgtgctggagggcggcggcatgcgcctgcgggtggatggcgcggaatccgcgccgctacgcgcccggcaggccttcgccttttccggcgacagcgaggtgcactgcaccctgctcgatggagctatccgcgacttcaacctgatctatgcgccccagcgccatcgcgcgcgcctgcaatggctgcgggtcgagggcgagctggactggcacggcacggcgagcacgctgctgctgttcgcccagcaggacggggtagcgatttccttgcaagggcaacctcgcgggcaactggctgcccacgactgcctgtgcgccgaggggctgcagggcttgcagcattggcgcctgacggcccacgagccggcgtgggtctgtgcggtggaactcgattcgctgtga

SEQ ID NO: 16361 - DNA, 1059 bp, Pseudomonas aeruginosa
ttccgcatgccgtccgactccaaccgggagacccgcatgcccccgcttcgccagatcctcgccgtcctcgccctgggcgccagcctcgccagccagaccgccgtcgcggcggaatgcccgtacccgggcaaagtggtgttcgccgggctgaactgggaaagcggcatgttcaccaccgacctgttgcgctacgtactggaaaaaggctacggctgcgagaccgacgcgctgccgggcaataccgtgaccatggaaaacgccctgcgccagaacgatatccaggtcaccggggagcaatgggccgggcgtagcccggtgtggcgcgcggcggaggaggcgggcgaggtgttctccgtcggcgagacggtgaagggcgccaccgagggctggtgggtgccggagtacctggtcaagggcgacccgcaacgaggcatcgaggcgaaggcgccggagttgaggtcggtcgccgacctgccgcgctacaaggcgctgttccgcgatcccgaggagcccgccaaggggcgtttctacaactgcccgaccggctggacctgcgagatcgtcaacagccagaagctcaaggcctacaggttgcaggacagctacacgaacttccgcaccggcaccggcccggcgctggatgcggcgatcagtgcggccttccggcgcggtgagccggtgcttttctactattggtcgccgactccgttgatgggccgtttcaagctggtgcaactggaagagccgccgttcagcgagaaggcctgggccaccctgtccgatccgaagaaccccgaccccatcggttcccgctcgttgccggcgaagatcaccattggcgtttcccgcgatttccatgacaaggcgccggcgttggtcgagctgttccgcaaggtcgagatccccttgccgctgttcaacgagctgctcgccgacatggcgcagaatcatcgcgaggtcggcgaggtgcgtgcgcagtttcttcgccagcatcgcgaaatctggagccactgggtgccggccgaagtcgccgcgcgcctcgatacctccctgaagtaa

SEQ ID NO: 16362 - DNA, 516 bp, Pseudomonas aeruginosa
cagccacttgcggcaccacctcgacgagcaactgacctacccggggctggaccccgagagtcgctacgtcagtctgtccgagtggccgcgcctgggctcctggcggcggcgctggctctgcctggacaagaccctgcttggtcgcgccaccctcggcccgctgctggccctggcggcgatggcgcgcctggagggttcgcggttgcgccggggagagggcgccgcctggcgcctgtggggcctgcatgccgtgctgctgggcgggttgctggccgggctttggcgctgggcgggcatcccgccctggctgtacctgccggcggtggcctatccggccctcggcctgagcatgctgcgctctttctacgagcaccgtccggcccacgagccggcgcagcgcagcgtgctggtcgaggcggggtggccgtggcggctgctgttcctcaacaacaacttgcatctggtccaccacgatctgccgggcctgccctggtacctgctgccgcgcgtgtatag

SEQ ID NO: 16363 - DNA, 567 bp, Pseudomonas aeruginosa
acatcgagtgccagcagagccgcatcgacttccgcctgcgcagtcgctacgtcgacgagcaggccaaggacctggacgacgccctggcgcggatccagcgctacaccgccgaaggcaaggccatctccatcgccctgctgggcaatgccgccgagatccttccggaactggttcgccgcggcgtacgcccggacatggtcaccgaccagaccagcgcccacgatccactcaacggctacctgccggccggctggagctgggaagagtaccgcgaccgcgcgcagaccgacccggccgccgtggtcaaggccgccaagcagtccatggcggtacacgtgcgggccatgctggcgttccagcagcagggcgtgccgaccttcgactatggcaacaacatccgccagatggccaaggaagagggggtggccaatgccttcgatttccccggcttcgtcccggcctacatccgcccgctgttctgtcgcggcatcggtccgttccgctgggccgcgctgtcgggcgacccgcaggacatctacaagaccgacgccaaggtcaagcaactga

SEQ ID NO: 16364 - DNA, 1275 bp, Pseudomonas aeruginosa
tcaccgcccagcgctgacctcgaaaaccgcctccacgccggcggggcgtgggggcggccgcccactgtcccgaccaggccacaacaagaatggcggcgcgcgagccgcagcggagtacagcagcatgacccagggcagcgacagcaagccactgatcgaacggcgctcgatcgactacatcccggcgaacgagcgccacggccgcctctacagccagttcaccctctggctgggggccaacctgcagatcaccgccatcgtcaccggcgccctcgccgtggtcctcggcggcgacgtgttctggtcgctggtcggcctgctcatcggccagctcctcggcggcgcggtgatggccctgcacgccgcgcaggggccgcgcctggggctgccgcagatgatttccagccgggtgcagttcggcgtctacggcgcctgcatcccgatcgcactggtgtgcctgatgtacctgggcttcaccgccaccggcacggtgctttccggccaggccatcggccagctcaccgggctcagcgacagcaccgggatcttcatcttcgccgccttcatcgtcctggtgacggtgctcggctatcgcgtcatccacatcatcgggcggatcgccagcgtcctcggcatcatcgccttcgcctacctgttcagccgcctgatgctgctcagcgacatcggcgacctgctcgccatccgccatttcagctgggcctcgttcctcctcgcggtgtcgctggcggcgtcctggcagatcgccttcggcccctacgtggccgactattcacgctacctgccggcgtccacctcgtcgtggaagaccttcctcgccgtcggcctcggctcggtgctcggcgcccaggcctcgatggtcctcggggtgttctccgcagccctggccaacggccagttcgccggccgcgaggtggcctacatcgtcggcctgggcagcagcgggaccgtcgccgcgctgctctacttcagcatcgccttcggcaaggtgaccatttccacgctgaactcctacggcagcttcatgtgcatcgcgaccatcatcagcagcgtacgcggccaactggagatcacccgcgtgcaacgcctgttcttcgtcctcgcgatcgtcggcgcctcgacgctcatcgcgctgctcggccagcactcgttcctcgctgcgttcaagtccttcatcctgttcctgctgaccttcttcaccccgtggagcgcggtgaacctggtcgactactacttcatcacccgcgagcgctatga

SEQ ID NO: 16365 - DNA, 1506 bp, Pseudomonas aeruginosa
acgcgctgctgccggcccggctgttgccgagtctttgatacccgcccccggccgctcggccggggcgctccagcaagaacaacaagaggagagccgagggatgacgcacgacacggggcttcggcgcggactgaacgcccgtcatattcgtttcatggcactggggtcggcgatcggcaccggcctgttctacggttccgcatcggccatccagatggccgggccggcggtgctgctggcctacctggtcgccggcgcggcggtgtacatggtgatgcgcgcgctcggcgagatggcagtgcacgagccggtgtccggctcgttcggccattacgccagcagctatctcggccccctggccgggttcgtcaccggctggacctacgctttcgagatgatcatcgtctgcctcgccgatgtcaccgcgttcggcatctacatggggttctggtttcccgacgtgccgcgctggatctgggtactgtccatcgtgctgttcatcggcgggctgaacctctgtcatgtcaaggtcttcggcgagctggagttctggctgtcgctggtcaaggtcggtgccatcttcgcgatgattctccccgggctcggcatcttgttcttcggcttcagcttgggcggcggcggcgactcccgccaccggcgtgcacaacctttggcagcacggcgggttcctgcccaacggctgggcccgggctggtcgcctccctgtcgctggtggtattcgccttcggcggcatcgagatcttcggcatcaccgccggcgaggcgcaggacccgcagcgggtgatcccgcgggcgatcaatgcggtgccgctgcgcatccggctgttctacgtgctgaccctgttcgtgctgatggcgatcttcccctggcagcagatcggcagcaacggcagtcccttcgtgcagatcttcgacggcctggggatcgagtcggccgcggcgatcctcaatgtcgtggtgatcaccgcggcgatttcggcgatcaacagcgacatcttcggcgccggtcgcatgctctacggcatggcccgccagggccaggcgccggtcggcttctcgcgggtgtcgcggcacggcgtgccgtggatgaccgtgctgctgatggcggtggccctgctgctcggcgtggcgctgaactacctgatcccgcagagcgtattcctgttgatcgcgtccatcgccaccttcgccaccgtgtgggtctggctgatgatcctcctggcccaggtcggcatgcgccggcgcatagggccgcgccaggtcgccgcgctgaagttcccggtgccgctgtggccattcgcgccggcgacggcgatcgtcttcatgctgttcatcttcgtggtgctcggctatttcccggacacccgcccggccctgtgggtcggggctatctggatcgccttgctggtgatcgcctaccggcgctgggtcaggccgaagggcgatgccgcgcatggcgtgcttcaggcccagggagggctgtga

SEQ ID NO: 16366 - DNA, 1086 bp, Pseudomonas aeruginosa
cggaaccgacggcggcctgggccgccggccaataacaacgatcgaggccgttcccccgggcgcggcccgcaggttttccaactgcctttcccaatcgtgcatctggagcgtcgaaccatgcgatacaagaagtcgatgttgagtgttctctgtgccctcggcctgctcgccgccgcggcgggcgcccaggcggaaggctggtgcgagtccggcaaggcggtgaagttcgccgggctgaactgggagagcgggaccctgctcaccgaactgatgcagttcgtcctggccaagggctacggctgtaccaccgacagcctgccgggcaactcgatcaccatggagcaggcgctgagcaccaatgacatccaggtcttcgccgaggagtggatcggccgcagcgacgcctggaacaaggctgccgcggccggcaaggtggtcggcgtcggcgaacccatcgtcggcgcggtggagggctggtacgtgccgcgctacgtgatcgagggcgacccgcagcgcaagctcgaggcgaaggcgccgaagctgcgctctatcgccgacctggcgcagtacgccgaggtcttccgcgacccggaagagccgggcaaggggcgcttctacaattgcccggccggctggacctgcgagctggagaacagcgagatgctgaaaagctacggcctggaggagacgttcaccaatttccgtccgggcaccggcccggcactggacgcggcggtgctgtcgagctatcggcgcggcgagcctatcctgttctactactggtcgccgacgccgctgatgggccgcgccgacctggtgcgcctggaggaaaggcccggcgtcgacaagcgcatcaggatccaggtcggcctgtcgcggaccttccacgaccaggcgccggagctggtggcggtgctggagaaggtcaacctgccggcggagctgctgaacagcgacctggcgcggatggccaaggaccggatcgatgcggcgcgcctggcgcgcgagttcctcaaggagcaccccgaggtctggcacgcctgggtcgacgaggacgcggcgaagaagatcgaagcggcactctga

SEQ ID NO: 16367 - DNA, 876 bp, Pseudomonas aeruginosa
acccacgaccgacgagagcagaccatgtttcccgaacgcctgacattttccatcgccgactgggtcaacgcttgggtcgacgccctggtgaccaactacggcgacctgttccgcaagatctccgacaccctgctgtgggccatcgtcaacctcgaagggctgctccgcgccacgccctggtggctgttgctggcgatcgtcgcggcgatcgcctggcacgccacccggcgcctgctgccgaccctggtgatcaccggcctgctgttcctggtcggcgccgtcggcctctgggacaagctgatgcagaccctcgcgctgatgctggtggcgaccttcatctcggtgctgatcggcatccccctgggcatcctcgccgcgcgcagcaaccgcctgcgcgcggtgctgatgccgctgctggacatcatgcagaccatgcccagcttcgtgtacctgatcccggtgctgatgttgttcggcctgggcaaggtgccggcgatcttcgccaccgtgatctatgccgcgccgccgctgatccgcctcaccgacctgggcatccgccaggtcgacagcgaggtgatggaggcggtcaacgccttcggcgccaaccgctggcagcagctgttcggcgtgcagttgccgctggccctgccgagcatcatggcggggatcaaccagaccaccatgatggccctgtcgatggtggtgatcgcttcgatgatcggcgcccgcggcctcggcgaagacgtactggtgggcatccagacgctgaacgtgggcaagggcctggaagccggcctggcgatcgtcatcctcgcggtggtgatcgaccgcatcacccaggcctatggccgttcccggcacgagacgagcaaatga

SEQ ID NO: 16368 - DNA, 963 bp, Pseudomonas aeruginosa
tccaggtcggcacgccacgggaaatcctccaccagccggccgacgactacgttgaccgcttcgtccagcggcgggtggcgaacctatgagcgacctaccgagcgtcgtgttcggcgacggtccgctgcgttggcaggaactggtcgcggtggcccggcacggtgcgcgcctggaactgtcggcggcggcctgggcacggatcgacaacgcccgcgccatcgtctgccgtatcgtcgccaacggcgagcgtgcctacggcatcagtaccggcctcggcgcgctgtgcgacgtcctgctggaaggcgagcagctcgccgagctgtcgcgcaacaccttgctcagccatgcctgcggggtcggcgagccgctgcgcgacgaacagacccgggcgatcatctgtgccgccgtcgccaactacagccagggcaagtccgggctcgaccgttcgctggtggaaggactgctggcgctgctcaaccacggcattaccccgcaggtgccggcccagggctcggtgggctacctgacccacatggcgcacgtcggcatcgccctgctcggcatcggcgaggtcagctaccgcggcagcgtcgtgccggccgccgccgcgttggcggcggaaggcctggcgacggtgcgcctgggagccaaggacgggctctgcctggtcaacggcacgccgtgcatgaccggcctcgcctgcctggccctggacgacgcgcagcgcctggcgcagtgggccgacgtgatcggggcgatgagcttcgaggccctgcgcggccaactggcggcgttcgacgccgagatcgttgcgctcaagccgcatcccgggatgcagcgggtcgccgtcaatctgcgagccttgctggctggcagccaggtactggagaacgcccgcggcatccgcacccaggatgccctgagcatccgctcgataccgcagatccatggcgcctgccgtga

SEQ ID NO: 16369 - DNA, 1860 bp, Pseudomonas aeruginosa
ccagttggcccacgcggcgcggcagatagagaccgaactcaactcggccaccgacaacccgctgctgctgggtacgccggaagcctaccgggtggtatcccaggccaatccccacggcgaatcggtggcgatggccgccgacctgctggcgatcgccgtggccgagctgggcggggtcgccgagcggcgcctggatcgcctggtcaacccgctggtcagcggcctgccggcgttcctggtgggcaagccgggagtcaactcggggatgatgatcacccagtacgtcgccgcctccctggctggcgagaaccgccagctggcgcagccggcggtggtcgacaacttcgtcacctcggcgctccaggaggaccacctgagcctcggcaccagtgccgcgctcaagcttggcagggccctggagaacctccggcggatcctcgccatcgagtacctgctggccgcccaggccttcgaattcctcgccccgcaacgcttcggccagggcaccgcggcggcctggggcatcctgcgcgagcgcgtgcccgcgtacgacaccgaccgctggctggctcccgacatcgccagcgcggcggccatcctcggcgagcggaagagtctcgcccggctggccgcgagcataggagacctgcaatgaaacgactctggcagcattgccatgccgccaccctcaagggcggcaagtactcgatcgtcgaggacgccgccctggtcaccgacggtccgctgatccactggatcggcccgcgcgccgaactgccgcccgacgactacgccgaacgcatcgacctcgatggcgcctggctgaccccggggtttatcgactgccacacccacgcggtgttcggcggcaaccgcagcggcgaattcgagcagcgcctggagggcgtcagctacgccgagatcgccgccgccggcggcggcatcgccagcaccgtacgcgccacccgcgaggccagcgaggaagaattgctggccagcgcgcgcaagcgcctggagcccttgctgcgcgacggcgtgacggcgctggagatcaagtccggctacggcctcgacctggccagcgagcgcaagatgctacgagtcatccgccgcctcggcgaacgcctgccggcgaccgtgcgcagcacctgcctggccgcccatgcgctaccgccggaatacgccgggcgcgccgacgactacatcgagcatatctgctcgacgatgctccccgcgctggccggagagggactggtggacgcggtggacgccttctgcgagcacctggcgttttccccggcgcaggtcgagcgggtattcatcgccgcccgcgagctgggcctgccggtgaagctgcacgccgagcagctatcctcgctgcacggttccagcctggcggcgcgctaccgggctttgtcggccgaccacctggagtacatgaccgaggacgacgcccgcgccatgggcgaggcgggcaccgtcgcggtgctgctgccgggcgccttctacctgctgcgcgagacccagctgccgccgatcgatgccctgcgccggcacggcgtggccatggccattgccagcgatctcaatcccggcacctcgccggcgctgtcgttgcgcctgatgctgaacatggcctgtaccctgttccgcctgaccccggaggaggcgctggccggtgtcaccctgcacgccgcccgggcgctggggctggaagccagtcacggcagcctggaggtcggcaagctggccgacttcgtcgcctgggacatcgagcgtccggcggagctggcctactggctgggcggcgatctgccgaaacgcgtcattcgccacgccgaggaggtataccgtggatga

SEQ ID NO: 16370 - DNA, 555 bp, Pseudomonas aeruginosa
agtgtggacgccctaccaccggaccatcgccgaggaactggcgcggctgaaggccgagttcggctacgcgctgctctgggacgcccactcgatccgttcccacgtgccgcacctgttcgacggccgactgcccgacttcaatctcggcaccaacgccggcgccagttgcgatccagcgctggcggcccgcctggaggcggtctgcgctgccgccgaaggctacagccatgtgctcaacgggcgcttcaagggcggccacatcacccgccactacggccagccggagcagcacgtccatgccgtccagctggagctggcgcagtgcacctacatggacgagcaggccccgttcgcttaccgcgcggacctcgccgaagcgacccgcgcagtcatccgcgaactgctggaaagcctcctcgcctggggtcgcgagcgctacgcctgaggtgctcggaggcggcggacgcctggcccgtcctggcggacgtgaaggccgcggatggggtggggcgtccgcgtcggcattctggaaattttctgttgcaaatttattga

SEQ ID NO: 16371 - DNA, 2247 bp, Pseudomonas aeruginosa
gcccacgccatgagcgacctgtacaaaccgcagaccctcaagctatacgcgcaacaggccggcagcgtccggctgaccctcgactggttcgccaacaaggctttctacccgccgcgcgcgggtgtgcacatcaagccgctgatcaatggccaggcggccttcgacgcggtgcatgcggcgatggaggcggcccggcacagcatcgacatcatcacctggggcttcgacccggccatgcgtttcaaacgccccgacggaccgcgaatcggcgaattgctgcagacgaagggccgcgaaggagtgcaggcgcgagtgctggtctggagcaaccaactcgccaggctcaaggaaaacaccatccccggggccggcgtcggcggttccggcggcacctgggcgggctcgggcgtcgccagcggcagcgcggtggacaacgaggtgctgcgactggagcagcggcgccagcataacctcaacctcatcgcgcggcagcaggaagccctggagcgctcggaacggctgcaccgcgaaggcaggctgccgagcttcgacccgcggggcgccgcccacgcgcgggcgcgcatcgccgagctggaggcggagaacgccgagatccagcgcactctcgacagcagcgaggcccagggctacggcggcaagcgcggttccggcggcacccgccaggatccctgggggcagatattcacccgcgactggttcaaggcggtacgcggcggtgggttgcagaacgtcgagttccgtacccgcgacttcgagcagacggccagaccggtgatgaacggcgagcaagtgcgcctcgtcaatgggcgactgcaaagcctgatccacctgctgcgcgccgatggcatcgacgacctgggcatcggccagttgctggtactcacccagttcgccagccatcaccagaagatggtcctggtcgactatggcagcccgcaggccatcggcttcgtcatgggtcacaacatgcaccgcaactactgggacaccagcgcccacctgttcgacgaccgcgccgccggtcgcgatcccgggttcgggccctggcaggatatctccatgcaggtccagggaccggtgctggccgacctcagccgcaacttcagcgaggcctgggacctcgagacgccgtggtacaagcgctggttctcgacgccatcgctgaccgccgagcgcgacgccttgccgctgccgaagatcgccacgcccaccagcaacagcgtcgcgcagatttgccggacccagccgcaggacgacgagcgctcgatcctggagcactatctcaaggccctgggcaatgccaccgactacgtctacatggaaaaccagtacttccgttatgccggcttcgccgagcgcctgcggaagactgcgcaggtgcgcaaggcccggggcgtgcccggcgacctgtacctgttcgtcgtgaccaacacccccgactccagcgacgcctcgaagaccacctacgacatgatgaaaggcctgggccaggagcaactgatgccgcaggtacagcgcgacctggcgcatgacttgcgggaaaagcgggagcagttgaagcaggtcagggaaaacctacatcccgatccctatgtccggcgcggccaggaaaacaacatcgaacggctggagcgcaagatcgaggcgctcgaagagaaaggcgtgacgccggaagtcgagcaacgcctcggcgatctcggcgcgcaggagattcccggactggcgaagaacaccggcgaggacgacaagccctatcaactcgtcgaagtacccggcctcaaggtggtcgtcgccaccctggccaccagcgaccctgcccccggcagcccgccgccagcgcgcctgtccgccgaagccgaggccgccctcggggcgccgccgctgaaggcgcgctacaagcacatctacgtgcactccaagctgctgctggtggatgacctctataccctgctcagctcggccaatatcaatgtccgcagcatgcatggcgacagcgagttggggattgcccagcccaatccggatttggcgagggcgatgcgggaggagttgtgggagctacatgcccagaaagtggctgcgacaaccgaaaaaaacttcaaactctggaatcagaaaatggatgcgaattggagacagcaacgtaaagacgagcctttggtagctaacttgcttcgcttctgggatgtcgtgacaccttatagccccggtctcacggtggactga

SEQ ID NO: 16372 - DNA, 882 bp, Pseudomonas aeruginosa
atgatgcgtccattatgtttttttctcttgatttttttgttgtcgggaaatcctgtcatggcggctgaactacgaccttttatatgcgttaacgaaaaagaccatttgccatctctagatcctcaggctgatgcatggtatcgggaggcagtagctctcgccaagcccgataccctgcgtccctgggatcgtatcgtcgatctatacagtaaggcagttgagcgtggtcactggaaggctatgcataacttggcgagcctctatcgtaccggttggccaggcggtgtggagaaggatactcagaaagctctagatctctaccagaagatgatcgatttgaaggttcctcaaggtttctacgatatggcggcaatgatcggaaatcgtgctggcgtcaagaatcctgcgactgatggacttacctttctcgataaggctgcaagcttgggtaatccaccagcattaactgagttaggaaggctatatatatatgttgctggtcaggatgagttggggctgaaatatacgaactgtgctgcaggccagggctatgctcctgccaattacgagctggcgatgtactatcgtttggtggcacataactacccaaaggcggcaggctattaccttcttgctgcaagccaaggaaatgatgatgctgccttcttcatgtccggagtttttgataagactagtcccgatgttgacagaatgtggtacgcccccgatgagaagctgcacaaactatatgatggtatttacgatcaacttgccgctgatcctgatttgcgttttcccaacttgataaaggaccatcctctgcctcctcacccgacccagggctacgacgcagatcggcccgactggaaaccggggcagtga

SEQ ID NO: 16373 - DNA, 300 bp, Pseudomonas aeruginosa
acgtggtcagcgccaaggaccacggcgaagccttccagatgctgcaatcgggtcgcgcggtggccttctacatggacgatgcgctgctctacggcgaacgcgccaaggcgcgccagccgcacgactgggtggtggtcggcgagccgcaatcgcgggagatctacagctgcatggtgcgcaaggacgacccgcagttccttgccctggtcaacgagaccctggccgggctgtatcgctcgggcgagatacagggcatctaccagcgctggttccagcagccgatcccgcccaaggggttga

SEQ ID NO: 16374 - DNA, 528 bp, Pseudomonas aeruginosa
accctacgctcgccacgagctggccgtcgacgaaccgcatgtgctgtatgccgacgaaagcggttcgccggacggactgccggtcgtcttcgtccacggcggccccggctccggttgcgatgccctgtcgcgtcgcttcttcgatcccaacctctaccgtatcgtcaccttcgaccagcgcggttgcggccgttccacgccccacgccagcctggagaagaacagcacctgggagctggtggcggacatggagcgcctgcgcgagcacctgggtatcgagaagtgggtgctgttcggcggttcctggggctcgaccctgtcgctggcctacgcgcagacccatcccgagcgggtccatgcgctgatcctgcgcggcatcttcctttgccgtccgcaggacatccactggttctaccaggaaggcgccagccgcctgttccccgactattgggaagactatgtcgcgccgatcccgccggaagagcgcggcgacctgctggcggccttccacaagcgcctgaccggtag

SEQ ID NO: 16375 - DNA, 852 bp, Pseudomonas aeruginosa
cgaccagatcgcccagatgcacgccgccaaggcctggtcgacctgggagggccgcaccgccacgctgcgccccaaccccatggtggtggaccgcttcaccgagccgggcagggcgctgtcgatctcgcgcatcgagaaccacttcttcgtcaaccagggcttcctcaggcccaaccagttgctcgaggacatgcaccgcatcgcccatctgcctggcgtgatcgtgcatggccgctacgacgccatctgtccgctggacaatgcctgggccctgcaccaggcctggccgaacagcgaactgcagatcatccgcgacgccgggcataccgccagcgagccggggatagtcgatgcgctggtgcgcgccaccaacgagatcggccggcgactgctcgacctgccgccggaggccgaatgaaggcattgctgcagcgcgtcggcgcggcgcgggtggaggttggcggcgaaatcgtcggctccatcgatcgcggcctgctggtgctggtcggggtcgagcccgaggatggcgagcgttgcgcggcgaagatgctgcacaagctgctcaactacagggtgttcggcgacgacgagggcaagatgaaccggtccttgctggacgtgcagggcggcttgctgctggtctcgcaattcaccctggcggcgaacacccgcagcggactgcgtccgagcttctccagcgcggcgccgccggcgcaaggagaggcggtgttcgagcacctggtgaaactggcgcgggaggcctatccgcaggtggcgaccgggcgtttcggcgccgacatgcaggtgcacctggtcaacgacgggccggtgaccttcctgctggagagttga

SEQ ID NO: 16376 - DNA, 1626 bp, Pseudomonas aeruginosa
acggtcagggcgtcttcagtaattcatgttcacggacgagggggcctcgtgattttccgttccgtttcaaacaccgatttccgcgcccgcgtgcgcaccctgctgcttgccggctcgaccgcgctggcattcgtcgccgccccggtatgggcgttcagcatcgacgacgtggcgagcaaggccaaggacctggccggcgacaagtattccgcgccgaccagcaacctgccatcggaattcagcgaaatgaaattcgccgattaccagcagatccgtttcatcaacgagcgcgcctactggggcaagctgaagacgccgttcaagctgagcttctatcaccagggcatgcacttcgacacgccggtgaagatcaacgaggtgaccgctaccacggtcaagccgatcaagtacgatcgcaccaagttcgatttcggatccctgaagttcgacgagaatgccaccaaggatctcggctatgccggtttccgcgtgctctatccgatcaacaaggccgacaagcaggacgagatcgccaccttccttggcgcgagctacttccgcgtggtcggcaagggccaggtctacggtctgtcggcgcgcggcctggcgatcgataccgcgctgccttcgggcgaagagttcccgcgcttccgcgaattctggatcgagcggccgaaggcgcaggacaagcaactggtgatctacgccctgctcgactcgccgcgggccaccggcgcctaccgcttcgtgctgcgtccgggcaaggatgcggtgatggatgtccaggcccgcgtgttcctccgcgacaaggtcagcaagctgggcctggcgccgctgaccagcatgtacctgttcggctccaaccagccgtccgagcagcacaacttccggcccgagctgcatgactccagcggcctgcagatccatgccggcaacggcgagtggctgtggcgtccgctgaacaatccgaagcacctgtcggtgagcaccttcagcgtggagaacccgaaaggcttcggcctgctccagcgcggccgcgagttctcccgctacgaagacctggatgaccgctacgacctgcgtccgagtgcctggatcgagccgaagggcgactggggcaagggcaccgtggaactggtggaaatcccgaccccggacgaaaccaacgacaatatcgtcgcgttctggaaccccgagacccagcctgaggtcggaaagccgctggacttcgcctaccgcctgcactggaccatggatgaagacgagctgcacgacccgaaatcctcctgggtcaagcagaccatgcgctcggtcggcgacgtgaagcagaagaacctgatccgccagcaggacggcagcaccgccctggtcgtcgacttcgaagggccggccctgaaggacctggcgccggacgcgccggtgaccacccaggtcagcaccgacagcaacgccgaggtggtggagaacagcctgcgttacaacccggtcctgaaaggctggcgcctgacgctgcggatcaaggtcaaggatccgaagaaaccggtggaaatgcgcgcggcgctggtcgacgaggcgcagaagccactgagcgaaacctggagctatcagctgcctgccgatgaataa

SEQ ID NO: 16377 - DNA, 432 bp, Pseudomonas aeruginosa
ccgctaccggatctccggcagcagcgccggcagcgagccgatcgccgccgacgcccgcacggcgatcgtcatgccgatctgcaacgaagacgtgccgcgggtattcgccggcctgcgggcgaccgtcgagtcgatggccgccaccggcgagatggagcgcttcgacttcttcgtcctcagcgacaccaacgacccggatatcgccgtcgccgagcagcaggcctggctcgagctgtgccgcgagaccaagggcttcggcaagatcttctaccgtcgccgccggcgtcgggtgaagcgcaagagcggcaacatcgacgacttctgccggcgctggggcggcgactaccgctacatggtggtgatggacgccgacagcgtgatgagcggcgactgcctggccaagctggtacgcctgatggaggccaatcctga

SEQ ID NO: 16378 - DNA, 1260 bp, Pseudomonas aeruginosa
ggcggggatcatccagaccgcgccgaaggcgtccggcatggacaccctgtatgcgcgcatgcagcagttcgccacccgcgtctacggcccgctgttcaccgccggcctgcacttctggcaactcggcgagtcgcactactggggccacaacgcgatcatccgcatgcagcccttcatcgaccactgcgccctggcgccgttgccgggcaagggctcgttcgccggcgcgatcctgtcccacgacttcgtcgaggctgcgttgatgcgccgtgccggctggggcgtgtggatcgcctacgacctcgacggcagctacgaagaactgccgccgaacctgctcgacgaactcaagcgcgaccgccgctggtgccacggcaacctgatgaacttccgcctgttcctggtcaagggcatgcacccggtgcaccgcgcggtgttcctcaccggggtcatgtcctacctgtcggcgccgttgtggttcttcttcctggtgctttccaccgcgctgctggcggtgcaccaactgatggagccgcagtacttcctggaaccgcggcagctgttcccgatctggccgcagtggcatccggagaaggccatcgcgttgttctccaccaccctgaccctgttgttcctgcccaagctgctcagcgtaatgctgatctgggccaagggcgccaagggtttcggcggggtgatccgggtgaccctgagcatgctcctggagatgttcttctcggtgctgctggcgccggtgcgcatgctcttccacacccgcttcgtgcttgccgccttcctcggctggtcggtgcagtggaactcgccgcagcgcgacgacgacgccacgccctggagcgaggcgatccgccggcacggcatgcagactctactgggtatcgcctggaccctgctggtggcctggctcaacccgcgcttcctgtggtggctgtcgccgatcgtcggttcgctgatcctgtcgatcccggtatcggtgatctccagccgggtgaagctgggcctgcgcgcccgcgacgaaaagctgttcctgatcccggaggagtacgacacgccgcgcgagctgcgcgccaccgacgagtacacctacgagaaccgctggcatgcgctcaaggatggcttcctcaaggccgccgtcgatccgttgctcaacgccctggcctgcgccatgggcacggctcgccacaaccgtgcgcaagccatcgagacggtgcgcggcgagcgtatcggcaaggccatcgataa

SEQ ID NO: 16379 - DNA, 1020 bp, Pseudomonas aeruginosa
cggcccccgcgaagggggccgtcgtacctgcgcattccatcgttcgagagagtttccgtgaccaagaagaaacgttccgtctggccctggcacctgctgaccgggctgatcctgctggtcctggcctgggcgctgtggttctccacctcgctgatttcctatgaatggcgctggaaccgcgttccgcagtacttcgcctaccaggccgaggagccgttacgggccaacgagatcggccgggtcgaggctatcgaggaacagggcagggacgcgcgcgtcacgctgcttggcgagagcggcgagaagcaggtcgtgaccgttgcccaggacagcctgcaattctccgaaggcgacgacgtggccgagggcgacgcggtcggggtgacccgccactgggccgccggcccactgctctggggcctgtggaccaccctctggctatcgctggtgtccggtgccatcggtctggctatcggcctggtcgccggcctctgccggctgtcgaagaacccgaccctgcacggcctgtcgacgatctacgtcgagctggtgcgcggcacgccgttgctggtgcagatcttcatcttctacttcttcatcggcaccgtgctcaacctgtcccgcgagttcgccggggttgcggcgctggcgctgttcaccggcgcctacgtggccgagatcatccgggccggcgtgcagtccatcgcccgcggacagaacgaggccgcccgctccctgggcctgaacgccggccagtcgatgcgctacgtgatcctgccgcaggccttcaagcgcgtgctgccgccgctggccgggcagttcatcagcctggtcaaggacacctcgctggtctcggtgatcgccatcaccgaactgaccaagagcggccgcgaggcgatcaccacctcgttctccaccttcgagatctggttctgcgtcgccgcgttgtacctgctgttgaacctgcccctttcgcacatggcatcccgactggagcggaggctcggacaaagtgattga

SEQ ID NO: 16380 - DNA, 738 bp, Pseudomonas aeruginosa
agtacgcaacctgctgaaggtcttcgatacccgcggccaggtagtgcgcgcggtggacgacgtgagtacccgcgtggccaggggcgaggtactggtggtgatcggtccgtccggttccggcaagtcgaccttcctgcgctgcctgaacggcctggaggagttcgacgaaggctcggtgagcatcgacggcgtcgacctggccgacccgaggaccgacatcaatgcctaccgccgcgaagtcggcatggtgttccagcatttcaacctgttcccgcacatgaccgtgctcgagaacctctgcctggcccaacgcgtggtgcgcaagcgcggcaaggccgagcgcgaggccaaggcgcgggcgctgctggccaaggtcggcatcgggcagaaggccgacgaatatccctcgcgcctgtccggcggccagcagcagcgcgtggcgatcgctcgcgcgttgtgcatggaccccaaggtgatgctgttcgacgaaccgacctcggcgctcgatccggagatggtcggcgaagtcctcgacgtcatgaagaccctggccgtggaaggcatgaccatggtctgcgtgacccacgagatgggctttgcccgcgaagtggccgaccgcgtgctgttcttcgaccacggcaagctgctggaggacgcgccgccggcgcagttcttcgacaatccgcaggacccgcgggcccaggccttcctccgccaggtcctctagtaccgcgctag

SEQ ID NO: 16381 - DNA, 2358 bp, Pseudomonas aeruginosa
tggtcgattcccggggtatccagggcgaaggccagttcgtcgatatcgatggtcatcgggcgcatggcgtcatctcccaaaaggcgaaagcctgatcctacgcaaaggtgcccctcctgtccgctttcgatggacgggaggggctgccgatgcaaggaggatcctctcgggatgttacaggcggaagcgtcccacctgtgcctgcaactgcgtgcccaggcgcgccagctcgccgctggaggcggcggtctgctcgctggcggcggccgactgctcggcgacgtcgcgtacgctgaggacgctgcggttgatctcctcggccaccgtgctctgttgctccgcggcagtggcgatctgcaggttcatgttctggatgtcggagacggtgcgggtgatgctgtccagcgcggcgcccgcgcggcgcgccagttccaccgtgctggcggtcagcgagcggctgttctccaggcgttcggcggcttcgccggcgccctgctggagacgctggatcaggccctcgatctcggcggtggactgctgggtgcgctgggccaggccgcggacctcgtcggcgaccaccgcgaagccgcgtccggcgtcgccggcgcgtgccgcttcgatggctgcgttgagcgccagcaggttggtttgctcggccaccgacttgatcacgtcgaggacgctgccgatctgctcgctctcgttcttcaggcgcgccatggcttcgctggaaacgtccatttcgctagccaggcgctcgatgcgggtcaccgcctggtcgaccaccgcgtcgccctggcgcgcctcttcgtcggcctggcgagcggcctgggaagccagttcggcgttgcgcgcgacgtcctgcacggtggcggccatctcgtgcatggcggtggcgacctggtcggtctccactttctggctgttgaccccggcgcgggtctgctcggtgaccgccgagagttcctcggcggagctggccaactggctgacgccgtcgccgatccgcccgaccagctcgcgcaggctgtcgcccatgcgctgcatgactcgctgcaattggcccagttcgtcgcggcgctggagggtcaggggattctgcggacgcttgccgaggtcgccggcggcgatggcctcggcctgcgcgagggcttcgtccagcggccggacgatctgccggttgatcgcccagccggcgacgcagccgaaggccagggccagcgcggcgatcagccagaggctggcgcggtcgcggctggcggtgctctcgcgcaattggcgaccggcttcggtgagggtccggccggcccgggccatatcctgggtgctgctttgcatcgcttgctgcgcctggcgcgtgcggatgacgccggcacggaactgctcgatcccgccacgatagccctggaggctacccatggcctgttccagcgccgcatcggcctcgccgggcaactggccacgcagcgtcgtggcggcctggcggagggcgtcgaacgcggcgaacgcggcctgctcggccttgtcgctgcgttcgaagacgtagccgcgcacctggtaacgcaccatgagcaactgttggtgcaggtcggccaccgcacggctacgttgcaacgcctgcgggtcgccggcctgctgcgcgaggctggcgtccatcagttcctcgaggcgggcgaagctgtccagcgcctgctgtgcagtgcccaccagcacaccacgggcggcgctgcgttgctgatcggctgcggcgaggtcgtcgaaagccttgcggtaggcttcgatggcttcggtctggtgggccagggcggccgggtcgagctcgctgtcgcgcagcgcctgcaggcgctggagcatcccggccagggtctggcggacctgctcggcctggcgcgggtcgctgccggcttcgaatgccaggcggccttgttcggcttgctgggtctgttccatcaggctggcgacttcggcgagctgctcgctgagggcggtctggtgcgtgagggtgcggttgctgctgatcaccaccagcagaagcagcgcgaggaggacaccgaaaccgaccatcagcttgcggctgacgctcagcttggccagttggagaacccaccaatcgtacatcgtcattactccaggcagtgcgacaccctgggttggcagccccatggcgtggcggaacaggtaatggctcagcgtcgtcgcgtccggcgtgcgggcgcggagggccggtacgtggccggcgggcgaggtcttatggttgtcgtgcggagccctgcgcgacagaggatgtcggccgggcggggaaaaccttcagtcttttaccggagttttttcagaacaaccgcgcaagcagggcgctga

SEQ ID NO: 16382 - DNA, 1041 bp, Pseudomonas aeruginosa
ggcggcgatcgtgcaggaccgcacgatccgccgacacgaagtcggcgtcgtcgaggagcagcaggttcactggcgggtggccggaggctggtcgccgtcgctggccggttggtcgtccggatgctcgccgcgcttgcgtaccaggcggccgaacagcaggccgatctcgaacagcagccacatcggcaccgcgagcatggtctgggagaagatgtccggcggggtcaggaccatgccgaccacgaaacagccgatgatcacgtacgggcggatctacttcaggtactcgacgtcgaccactccgatccagatcagcagcaccgtggccaccgggatctcgaaggcgacgccgaaggcgaagaacagagtcaggacgaagtccaggtagctgttgatgtccgtcatcatcgccacgccctcgggcgtcacgctggcgaagaagtggaagatcatcgggaacaccaggaagtaggcgaaggccatcccggcgtagaacaggatgatgctggacaccagcagcggcagcgccacgcgtttctcgtgcttgtacaggccgggcgcgatgaagccccagacctgcgcgaggatcaccggcatggcgaggaacagcgccaccaccatggtcagcttgaacggcgcgaggaacggcgaggcgacgtcggtggcgatcatgctggtgccttccggaaggaagcggcgcaacggctcggagaccagggtgtagatcttctgcgagaagtagaacaggccggcgaagatcaggaagatcgccgccacgctgcgcagcaggcgcgtacgcagttcggtcaggtgcgagaccaggggcatttcctggtcgtgctcgggctgctcgggtttatcggcgctcatggattacgcggcgtctcggacggtggcgaagggggagtggaggcagcgactgccggcggtgccgcggcgtccgcgggcggaaccgcaggcgtgctggtcggcggcggcgtgggtacgctcggcgccgggctctcggccgccggcggcggggtttcctgcgggggattctga

SEQ ID NO: 16383 - DNA, 858 bp, Pseudomonas aeruginosa
gagctgtcgggcgcggcgttcttgcgctcctcgagcaccgccgccaggcgggtcagggtgtcactcatggtggtgtcctgcgtgttcgtagatagcgtccgggtccttcagcaccggatcgacggtcttccaggcgccattctcgaagacacggtagaaacagctttcccggccggtatggcaggcgatcccgccgacctgctcgaccatcaggatgaccacgtcggcgtcgcagtccaggcgcagttcgtgcagcttctgcacatgcccggactcctcgcccttgcgccacagcttgccacgcgaacgcgaccaatagattgcacggttctcgctggcggtcagggccagcgcctcgcggttcatccaggccatcatcagcacgcgcccggtctcgtgatcctgggcgatcgccgggaccaggccgtcggcgttccagtgaatctcatccagccagtctttcatggtctttccacgttcgttgccggtacgttgcgcgcgtttccggcggaaatgggagtagtgtgccagccgggagcgcgactggctatcggcgcgggcctagtggccgtgcgcggcgctagcggcgcaggatcaggaacaccccgccggccagcatcacccacgccggccaggcttccagctgctgacccaggccgacctcggcggcgccgaccagcagcaccgcgcccaccaggcgcccgagccagtcgtggcgggaacctttccactccggcggcggcgcattgtgggcgtgcggttgtgacaggcgttcgagggtgtcgcgggccatttgcgacaggtgcggcacctgctcgacctgttgctggaaattgcgcagcaactgcttcgggctga

SEQ ID NO: 16384 - DNA, 597 bp, Pseudomonas aeruginosa
gccttggacagcaggttgctgctcggcttggagaactccagcaccagcaggcggccaccgggcttgagcacgcgcagcatggagcggatcgcttcgtccttgtgggtgacgttgcgcaggccgaaggcgatggtcacgcagtcgaagtggttgtccgggaagggcagcttctcggcgtccgcctggacgaagctgacgttgccggagacgcccttgtcgagcagcttgtcgcggccgaccttgagcatcgaggcgttgatgtcggccagcaccacctcgccggtcgggccgaccaggcgcgagaactgccgggtcaggtcgccggtgcccgccggcgatgtcgagcacgcggttcccgctgcgcacgccggacagctcgatggtgaagcgcttccacaggcgatggatgccaccggacatcaggtcgttcatcaggtcgtacttggctgccaccgagtgaaatacctcggcgaccttcttcgccttctggctttccggaacgttctggtagccgaagtgggtggtgggttcggcgtcggcgcctttgcggggatcgttcatgacgttctcacctggaaagaatgccgggcattctaa

SEQ ID NO: 16385 - DNA, 375 bp, Pseudomonas aeruginosa
caggatgtggggaaagtgctgtgccgccgtccgacggcgcgggtgcggtgttttgtctggccgcgtatagttttccgatctgcaatcaggagtcgatccatgtcgcgtatccacatcgaacgtccgcacagcctggggctggacgccgcacgggccaaggcggagaaactggccgaacgtctggcgaaggagcacggcgtgcagtgcgaatggcagggcgacgagctgaccttcaaacgcagtggcgtcgacggcaggatcgcggtgggggcggacaaggtcgcggtggacgtcaagctcggcctgatgctgtcggccatgagcggcctgctcaagggcgagatcgagaaggcgctggacaaggcgctggcctga

SEQ ID NO: 16386 - DNA, 951 bp, Pseudomonas aeruginosa
gcgcagtgctcgagcgtgtcgcgagaacccaataaggagagcaggatggctggcaagaagaagagcgaaaaagagtccagttggatcggcgagatcgagaaatactcgcggcagatctggctggctggtctgggggcctactcgaaggtcagcaaggacggcagcaagctgttcgagaccttggtgaaagacggcgagaaggctgaaaaagaagcgaagtccgatgtggacgcgcaggtcggtgcggcgaaggcttccgcccgctctgcgaagagcaaggtcgacgaggttcgggaccgtgcgctcggcaagtggagcgagctcgaggaagctttcgacaagcgcctgaacagcgccatctcgcgtctcggcgtgccgagccgcaacgaggtgaaggagctgcacagcaaggtcgatacgctgaccaagcagatcgagaaactcaccggcgtcagcgtcaagccggcggcgaaggcagcggccaagcctgcggcgaaaccggctgccaagcccgcggcgaaaaccgcagcggccaagccggcagctaaaccggcagccaaggccgccgccaagcctgcggcgaaacccgcggcgaaaaaacccgcggcgaaaaccgcggccgccaagccggcagccaagcccgccgccaaaccgactgcgaaggccgcagcgaaaccggcgaccaagccggcagccaaggccgcggcgaagcctgctgcgaaacctgccgcagccaagccggccgctgcgaccgccgccaagcccgcggcgaaacctgccgccaagccggctgcgaaaaagcctgcggcgaagaagccggcagccaagcccgccgcggcgaaaccggccgctcccgccgcgtcttcgagcgcgcccgctgcccccgccgccacaccggctgccagcgctccggcagcgaacgctccggcgacgccgagcagccagggctga

SEQ ID NO: 16387 - DNA, 219 bp, Pseudomonas aeruginosa
gacattcgccgtggcgaccgcgccgaccggatgtctggtctggcagtctgcggggcgaatgttgcaaatgacgtgccctcgttcggggcagcggagaaaaatcgcctggatgccgtgtgccgcgaaggggcactcggcccggcgcttcagagcatcagcttgacgaccgactcgtcggggtcgcgcgacttgccggcgctgaccagctccgccaggtag

SEQ ID NO: 16388 - DNA, 1569 bp, Pseudomonas aeruginosa
cgcagggtcagggtcttcgaggctttgtgcagctggatggcggaagggatacgcatcgcatcggactcgcggaagggcggagtacaaggataccccggttcgggaccgcgcggcccgccgccacggtgttggccgtggcggcggcggtggtcaaaggatgtagcgggacaggtcctcgtcctcggccagctcgccgaggtggctgttgacgtagccggcatcgatcaggatcggcttgtcgctatgctcgctggccaggtcggcggcgctgaacgagacctcttccagcagccgctcgagcagcgtatgcaggcggcgggcaccgatgttctcggtcttctcgttgacctgccaggcgatctcggcaaggcgcttgatgccgtcctcggcgaactcgatggccagcccctcggtcttcagcaactcgcggtactgctcggtgagcgaggcatgcggctcggtgaggatgcgctcgaaatcgttcggactgagggccttgagctccacgcggatcggcaggcggccctgcagctcgggaaccaggtcgctcggcttgctcaggtggaaggcgccggaggcgatgaacaggatgtggtcggtcttgaccatgcccagcttggtgttcaccgtgcagccctcgatcagcggcagcaggtcgcgctgtacgccctcgcgggagacgtcggcgccgccggcgttggcgcgcttggcgatcttgtcgatctcgtcgatgaagacgatgccgtgctgctcgaccgcctccagggcgcgtgccttgagctcttcctcgttgaccaggcgcaccgcctcttcgtcgcggatcagcttcagggcctcggcgaccttcagcttgcgggtcttcttcttgcccttgctcatgccggagaacaggttctgcaactggttggtcatctcctccatgccgggcggggccatgatctccacgccggccgggttgtcggccacctcgatgtcgatttccttgtcgtccagctggccttcgcgcaggcgcttgcggaacagctggcgggtgttgctgtcctcgcgtgccggctcgtcgccgaagcccatggcgggacgcgcggccggcagcagggcatcgaggatgcgctcttcggcggcgtcctcggcgcgatacttgaccttctggatctcctgttcgcggagcatcttcaccgcggcgtcggcgagatcgcggatgatcgactcgacgtcgcgtccgacatagccgacctcggtgaacttggtcgcctcgaccttgatgaacggcgcgttcgccaggcgcgccaggcggcgggcgatctcggtcttgccgacgccggtggggccgatcatgaggatgttctttggtgttacctcggcgcgcagctcggccggcagttgcatgcgtcgccagcggttgcgcagggcgatggcgacggcgcgcttggcgtcgtcctggccgatgatgtggcggttgagttcgtggacgatctcgcggggcgtcatggacattcgtttactccagcgggggacgagcgcttcagacggcgctgtccagctcctcgatggtcaggttctggttggtga

SEQ ID NO: 16389 - DNA, 3744 bp, Pseudomonas aeruginosa
gtaggcgcagagcaggtgcggcacgcccttgagcgcgacgttgttgatcaggtcgccgaactgcgccagctgtgcggccagggccagctcctggggctgctcgaggacgatcttcccgcccagttgctcgcggccctggccgagcttgcggaagacgctggccacgcgggtgcaggcgtagagcaggtagggtgcggtgttgccttcgaagctcagcatcagttcgaagttgaagctgtagtcgctggtgcggtgcttggacaggtcggcgtacttcaccgagtcgatccccaccacccggccgatctcgcgcagctggacctcgtcgaacggctcctcgccacgctcggcgcgctgctcgttgcgttccttgaccagcgcataggcgcggctctcggcctcttccagcaggtcgatcagcttcaccgtaccgccgtcgcgggtcttgaacggacggccgtcggcgccgttcatggtgccgaagcccatgtgctccagctccatgccggccggaacgaaaccggcgcgccgcgccacttcgaagacctgctggaagtgcagggcctggcgctggtcgacgaagtacagcacgcggtcggcgtgcagcacgttgtgccgataacgcatggcggcgaggtcggtggtggcgtagaggtagccgccgccggccttctgcacgatcaccgggagcggattgccctcggcgttcttgaactcttcgaggaagacgcacaacgcgccgttgtcttcggtgagcaggcccttggcggtcaggtcggcgaccacctgggcgaggtcgtcgttgtaggcgctctcgcccatgacgtcggccatgctcagcttcacgccgagacggtcgtagaccttctggcagtgcgacagggaaatctcgttgaagcgggtccacaggcgcaggcagtcggggtcgccggcctgcagcttgactaccagttcgcgggcgcggtcggcgaattcgggagactcgtcgaagcgtttcttcgccgcgcggtagaagacctccaggtcgtgcagctcggcctcggcgtcgaccggttgctcttccaggtaggcgagcagcatgccgaactgggtgccccagtcgccgacatggttctgccggatcaccgtgtcgccgaggaactcgaggacgcgcgcgacggcgtcgccgatgatggtcgagcgcaggtggccgacgtgcatttccttggccaggttcggcgaggacaggtcgatcaccacgcgctgcgccgggcctgccttgcgcacgccgagacgttcgtcggcgagggcgcggtcgaggctggcggcgagccagacgtgatcctggaagaagttgaggaagccggggccggcgatctccaccttggccagttgctcgtgggcggggattgcctcgaccagcctggcggccaggtcgcgcggcttcatcccggccggcttggccagcatcatggcgatgttgctggcgaaatcgccgtggctacggtccttggtgttctccacctggatgtccggggccaggccggcgggcagggtgccgtccgcggtcagttggtcgagggcttgctggatcagctggcgaatcgtgtctttcatcgtttttctccgtgctcgcgggcagaggggcggcgcgcgacggtcgggcaggggaagggccggcggatgcggcgctccgaagttcactccccgcgatgtgcgcggggtggccggtcgaggctcagaaccgcgcattatccgtgggcggacaggcgttgccaaccgttgcggcgattagccgacagtttgcgccggacatcgcggattccggctgaccccagtcaagcggggcgtcttcctggaaggcgctcagaacaggtcgatcggatcgatatcgagcgaccagcgcacctggcgcccgccgggcaactgttcgaggctctgcagccagggcgtcagcaggcgatgcagcggcgctcggctcatgcactgcagcagcagttgcgcgcggtgcttgccggcacgccgctccatgggcgcgggcaccggcccgagcagttccacctccggtccgcccatctgctcgagcaattgctcggcggcactgcaggcgctgtcgaggaaggcttccgcctggcccggcttgtgcgcttcggcgcgcagcagggcgaggtgggcgaagggcggcaggccggcggcgcggcgttcgctgagggcctgttcggcaaaggcgaagtagccgtcctcggtgagctggaccagcagcgggtgatcggccaggtgggtctggatcagtacccgcccgggctcctcggcgcgtcctgcgcggccggcgacctggacgatctgctgggccatgcgttcgctggcgcggaagtcggcggaaaacaggccgccatcggcatcgaggatcgccaccagggtgacccgtgggaagtggtgccccttggcgagcatctgggtgccgaccaggatgcatggctcaccgctgttgatggtggcgaagaggtcgcgcatggcgtgcttgcgcgaggtgctgtcgcggtcgatgcgcagcaccggatggttcgggaagagaatccgcaggcgttcctcggcgcgctcggtgccggcgcctaccgggcgcaggtcgagcttgccgcattgcgggcagttcatcggcggccgctggcggtggtcgcagtggtggcagcgcaactcgccgctgccctggtgcacggtcatccgcgcgtcgcagcgcgggcattggctgatccagccgcagtcgtggcaaagcagggtcggagcgaagccgcggcggttgaggaacaccaggacctgctggccggccgccagggtatcgccgatggcctgttgcagcggacgggaaaggccggcgtcgagcggcatgctcttcacgtcgaggcggatgaacttcggcgggtgcgcgccaccggcgcgctgggtcaggcgcagcaggccgtagcggccggcctgggcgttgtgcaggctttccagggcgggcgtggccgaaccgagcaggatcggcacattctccaggcgcgcgcgtaccagtgccaggtcgcgggcgtggtagcgcaggccgtcctgctgtttataggaggcgtcgtgttcctcgtcgacgatgatcagtcccggtcgcttcagcggcgtgaacagtgccgagcgggtgccgatgacgatgtcggcctcgccatcccgggcggcgagccaggcgtcgaggcgctcgcggtcggtcagggccgaatgcagcagggcgatgcgcgcgttgaagcggcgttcgaaacgcgccagggtctgcggccccaggttgatctcgggaatcagcaccagggcctggcggcctgcggccagggtttcgcggatcagttgcaggtagacctcggtcttgccgctgccggtgaccccggccagcaggaagcaatggaaaccgccgtggctggcgcgaaccgcctcgaaggcggcgcgctgctcggggttcagcggcaactccgcctgggccagccagccgccttcgcgcggcggggtgctgtggcgccgcacctccagttggaccaagcctttttccttgagcaggtcgaggctgtccttgtttatctgcaactggttcagcaactcatgggacaccccgtgcggatgctgcttgagaatcgccagggcctggcgctggcgcggcgcccgggccaggcgcggatcgtcgaggctggattgcgcggtggcatgccagaagcgctgctggcgcgcctcggccggctcgccctggcgtaa

SEQ ID NO: 16390 - DNA, 984 bp, Pseudomonas aeruginosa
cgtcatcaagacccgttccaccctgtgcaagccgatccacctggacgtgtgctccgaatgccacccgttctacaccggcaagcagaaggtgctggacaccggcggccgtatcgaccgcttcaagcagcgtttcggcgtattcggcgccaccaagtaagccgcttgccgcggacgcgcgcaatgctacttgtcgctgtaccgagaaaggcgtccctggtgggcgcctttttcatgtccgtggtttccgccttcgccggtgcggcggaggcctgccggcctaccggcgccttgcagaacgtcgaggtggcgcgggtggtggacggcgataccgtgcgcctgcgcgatggccgcagcgtgcggctgatcggtatcaacgcgcctgagctggcgcacaacggtcgcaccaccgagcccttcgctgaagccgcgaagcagcgactgcaggcgctggtatcggccagcgacgggcgtctcgccctgcagccgggccgccaggcccgcgatcactacgggcggaccctggcgcacctgttcgatgccagcggcgccaacctcgaggcgcgcctgctcggcgagggcctgggctacctggtggcggtcgcgccgaacaccgagctgacggcctgtcagcaagcggcggaacgtgcagcgcgttcggctaatctgggtgtatggaagcgttcgccggtgctttcgctcgatcgactggcgcagagcggcttcgccgtggtccgcgggcgggtgctcgaggtcgaactcaaccggggcggtatctggctggagatggacggtccgctggtcctgcggatcgagccgaaggtgctcaaggcgttcgatgcgaaacgggtgatgcagatggcgggacgttcgctggaagtgcgtggctgggtggtcgatcgttcccgccgtggcgctgtgccggccggcaaggcgcgctggcagatgtcggtgaccgatccggcgatgctggaatggttgccatga

SEQ ID NO: 16391 - DNA, 1431 bp, Pseudomonas aeruginosa
atgacctttatccgagcggtgaaccccgtccgggcgattggcttaaagtcgtacgctagaggtcttgacagccgggtcctgacgatcttgtggggcgtcgtcttcttgcgtatgctcggtcgccccgtctgtccaacaagcaataaagcggaagtgcccaaatgtccgatcttaaaaccgctgccctcgaatatcacgcacaaccccgtccggggaaaactgagtgtcgagctgaccaaacccaccgctaccgcccgggacctgtccctggcctacagcccgggtgtcgccgagccggtgcgtgaaatcgcccgcgatgccgagctggcctaccagtacaccggcaagggcaacctggtggcagtgatttccgacggcaccgcgattctcggcctgggtaacctcggcccgctggcctccaagccggtgatggaaggcaagggtgtgctgttcaagcgcttcgccggcatcgacgtgttcgacatcgaggtcgacgccgagagcccgcaggctttcatcgataccgtcaagcgtatttccatcaccttcggcggtatcaacctcgaggacatcaaggctcccgagtgtttcgagatcgagcgcgcgctgatcgaacagtgcgacatcccggtgttccacgatgaccagcacggcaccgccatcgtgaccgcggcgggcatgctcaacgcgctggaactggccggcaagaagctggaagaagcgaagatcgtctgcctcggcgccggcgctgccgccatctcctgcatgaagctgctggtgagcatgggcgccaaggtcgagaacatctacatgatcgaccgcaagggcgtgatccacgccggtcgcgacgacctgaaccagtacaagtcggtgttcgccaccgagaccgacaagcgcaccctggccgacgccctggagggcgccgacgtgttcgtcggcctgtccggcgccaacctgttggagccggaagacctcaagcgcatggcgccgaacccgatcgtgttcgcctgctcgaacccggacccggagatcaagccggaactggcccatgccacccgtaacgacgtgatcatggctaccggtcgttccgactatccgaaccaggtcaacaacgtgctcggtttccccttcatcttccgtggtgccctggacgtacgtgccacgcgcatcaacgaagagatgaagatcgccgccgccctggccctgcgcgacctggccaagcagccggttccggaggacgtctgcgccgcctatggtgtggacaagctggaattcggccgcgagtacatcattccgaagccgatggacaagcgcctgatcaccgtggtctccgatgccgtggccaaggctgccatcgagaccggcgtggctaccctgccgtatccgaagaactatccgctgaaatcggtggacgacgtcttcaacggctga

SEQ ID NO: 16392 - DNA, 1230 bp, Pseudomonas aeruginosa
ggagtttcgactgatggcacggatcaaccttctaccctggcgcgaagagctgcgcgagcagcgcaagcagcagttcctggtgattcttggcggcgtcctggtggcatcggctgcgctggtattccttggcgaccagtacttcaccgcggccatcgagaaccagaacgcccgcaacgacttcctgcgcaaggaaatcgtcgtactcgacgcccggatcaaggaaatcagcgaactgaagtcgcggcgccagcaattgctcgagcggatgaagatcatccaggacctgcagggcaaccgtcccatcatcggacgggtgttcgaccagctcgtgcggaccttgcccgacggcgtgtatttcaccgacctgaagatgaccggcaagaacatcgccatcgccggcgcggccgagtccaacaaccgcgtttccaatctcatgcgcaacatggacgcgtccgagtggctgaccgccccgaccctgaacgaggtcaaggcggtgacccagggcgcggtggaccaggccaacgtgttccaactgaccgtgcagcagacgcagcccggcgaggaagacgccaaggcgaagcatggggttgcgcaaggagccaagaaatgagtctggccagttccctggaaagtctgcgcaagatcgatatcaacgatctcgacctgaacaacatcggttcctggccggcggcggtcaaggtcatcgtctgcgtgctgctgaccgcggcggtcctggcgctgggctacaacttccatctgagtgacatgcaggctcagctcgaacagcaggccgcggaagaggagacgctcaagcagcagttctccaccaaggccttccaggccgcgaacctggaagcctacaaggcacagatgaaggagatggaagagtcctttggcgccttgctgcggcagttgcccagcgacaccgaggtacccgggctgctcgaggacatcactcgtaccggcctgggcagcggcctggagttcgaggaaatcaagctgcttcccgaggttgcccagcagttctacatcgagctgccgatccagatcagcgtggtcggcggctaccacgacttggcgaccttcgtcagcggcgtgtccagcctgccgcggatcgtcaccctgcatgacttcgagatcaagccggtcgcgcccggcagcacgtccaagctgcgcatgagcatcctggccaagacctatcgctacaacgacaaggggctgaagaaatga

SEQ ID NO: 16393 - DNA, 555 bp, Pseudomonas aeruginosa
tcaggccatcgcaatcggtcgctgatatcgaacaacgtggtcaacctgatcctcgtcggcccgatgggtgctggaaagagcaccatcgggcgcctgctcgccaaggagctgcatctcgcgttcaaggactccgacaaggagatcgaacagcggtgcggcgcgaatatcccatggatcttcgatgtcgagggcgaggtcggtttccgcgagcgcgagcaggccatgctcaccgaactctgcgccgccgacggcatggtgatcgccaccggcggcggggcggtgatgcgcgacggtaaccgccaggtgctgcgcgccggtggccgggttgtgtacctgcatgcctcggtcgagcaccagatcgcgcgcacggcgcgggaccgcaaccgccccttgttgcagaagcccaacccgggacagatcctccgcgacctgatggcgctgcgcgatccgctctaccgcgaaatcgccgatgtggtggtggagaccgacgaaaggccgccgcgcctggtcgtccaggaaattctcgaacgcctgcgcaagttgccgccccgctga

SEQ ID NO: 16394 - DNA, 468 bp, Pseudomonas aeruginosa
ggccttcctgggccactaccaattcagtcacgacccgttcgcgccgcgcgttccgggtttcaagttcttcccggcgcagcgcaagccggtgctcggccagttgcaccatctggcccgctacagccagctcctgctgctggtcaccgggcccctgggcagcggcaagaccctgctgcgccaggcgctggtggccagcaccaacaaggatgcggtcctcagcgtggtgatctcggcgcgcaccgccgccgacgagacttcgttgctgcgccaggtggcgcagggcctgagcatcaaccaggcgagcctggaggcgatcctgaccaaggtggcgcagctggcgatcaccgggcaggacgtctacctgatggtggacgatgccgaacagctccaggacagcgcgctggaagtgctgttgctgctggcttccggcaccaacgagggacgcctgcatgtattcctgttcggtga

SEQ ID NO: 16395 - DNA, 1134 bp, Pseudomonas aeruginosa
ggagcgcttccatgccatcgaattgcagccatacagcgaagaggaaacccgcgactacctggcccagcgtctcgagggcgccgggcagggcatcgagctgatttccaacgacctgctggtggacatccacgagcagtcggaaggctggccgggagcgatcaaccaggtcgcccgcgatgccctgatcgaagcgatgctggccaatcgtggcgcagcgcgcaaggcaaccggagggtctttcaacttgcccaagaagcatctggtgattcttgcggtcgtggccatcggcgtgatcgccgcctggttcatgcaaggcaagagcaagccggaggcgccgcagaccgcctctaccgaattgtccatgaatggtggtacgccggcccaggcccagcagccgggcagcggcccggccgtggagttcaacggctccagccagccgttgccgctaccgttggtcggcgagtcgcagccggtcattcgcgagccgctggcccaggccgccgggcaaggtggcgacgacgaaggcggcctgccgttccgccgcggtgccgcctaccgtttccagctcgggtcctcccgggtgacgccgctggccaacaacggcgtcacgccgatgcatccgggtgcccccggccccgaccgaaccgaccgcccctgcggagacccccgattccgggggcaggcccccgacaccggcccgggccggtcgccaagggccccggccagcaagccggccccggccccgtttcaggcccaagccgggggcgagcaagccggccaccaccgccgggggggaagccggccccggatccggccgccaagccggccagcggtggcggtgcgggaagtcagtggtatcgcaaccagtctggtggtaacttcgccctgcagatcctcggtaccggctccgaagccaatgcccaggcgttcattcgccagcagggcggcggcgatttccgctacttcaagaaaaccctgcaaggcaagccgttctacgtcgtcacctatggcagcttcccgaaccgtgccgccgccctggccgcagtgaaaaaactgccgtccaaggtgcaggccggcaagccgtggccgcgtaccttcgccagcatccagcaggagatcggccaggcgcattga

SEQ ID NO: 16396 - DNA, 822 bp, Pseudomonas aeruginosa
ccccggaatacctggtcaacgccgaggtcctgcagatcaaggtggcccagggcccccatgccccggcgagggcggccagttgccgggcggcaaggtcaacggcctgatcgcccgcctgcgctatgcggtgcccggcgtgaccctgatctcgccgccgccgcaccacgacatctactccatcgaagacctggcgcagctgatcttcgacctcaagcaggtcaacccgcaggcgctggtatcggtgaagctggtatccgagccgggcgtcggcaccatcgccgccggcgtggccaaggcctatgcggacctgatcaccatctccggctacgacggcggtaccggcgcctcgccgatcacctcgatcaagtacgccggctcgccctgggaactgggcctggcggaaacccaccagaccctgcgcggcaacgacctgcgcggcaaggtccgggtgcagaccgatggcggcctgaagaccggcctggacgtgatcaaggcggccattctcggcgccgagagcttcggcttcggcaccgcgccgatgatcgccctgggctgcaagtacctgcgcatctgccacctgaacaactgcgccaccggcgtggcgacgcagaacgacaagttgcgcaaggaccacttcatcggcaccaccgcgatggtgatcaacttcttcaccttcatcgccacggaaacccgcgagtggctggcgcgcctcggcgtgcgcagcctgggcgagctgatcggccgcaccgacctgctggagatcctccccggcgagaccgccaagcagcagaatctggatctcgctccgttgctgggcagtga

SEQ ID NO: 16397 - DNA, 882 bp, Pseudomonas aeruginosa
agccagcagcctttgatcggatgccgttatgactgccctgaagaacgaccgcttcctccgcgccctgctcaagcagcccgtcgatgtcacccccgtctggatgatgcgccaggccggtcgttacctgccggaataccgtgccacccgtgccaaggccggcgatttcatgagcctgtgcatgaacccggagctggcctgcgaagtgaccctgcagccgctggaccgttacccgcagctggacgccgcgatcctcttctccgatatcctgaccattcccgatgccatgggccagggcctgtacttcgagaccggcgaaggcccgcgcttccgcaaggtggtctcgtcgctggccgacatcgaggcgctgccggttcccgatccggaacaggacctgggctatgtgatggatgccgtgcgcaccatccgccgcgagctgaacggccgcgtaccgctgatcggcttctccggcagcccctggaccctcgccacctacatggtcgagggcggctcgagcaaggacttccgcaagtccaaggcgatgctctacgacaaccctcaggccatgcacgctctgctggacaagctggcgcaatcggtgaccagctacctcaacgggcagatccacgccggcgcccaggcggtgcagatcttcgactcatggggcggcagcctgtcggcggcggcctaccaggagttctccctgacctacatgcgcaagatcgtcgatggattgatccgcgagcacgacggacgccgggtgccggtgatcctcttcaccaagggaggcggcctgtggctggagtcgatggccgaggtcggcgccgaggcgctgggcctggactggacctgcgacatcggcagcgcccgggcccgtgtcggtga

SEQ ID NO: 16398 - DNA, 1938 bp, Pseudomonas aeruginosa
ccgatccgctcagcgtgcggcggcggccagggcctggtcgaggtcggcgaggatgtcgtcgatgtgctcgatgccgatcgacagccgcaccatgtcgtcggagactccggcgcgggccagttcctccgcgttcaactggcggtgggtggtgctcgccgggtggcaggccagggacttggcgtcgccgatgttgaccagccgcaccaccagcttcaaggcgtcgatgaagcgcgcgccggcggcgctgccgccctggatgccgaaggacaggatcgccgccgggcggccccccaggtagcgccgggccagggcgtgctcggggttgtcggcgaggccggcgtatttcacccaggccacctgcggatgttgttgcaggtagcgggctacggcgagggcgttgtcgcagtggcgctccatgcgcagcgccagggtctccaggccttggaggatgaggaaggcgttgaacggcgagagcgccgcccccatgttgcgcagcggtaccacccggcagcggccgatgaaggcggcgggtccgaaggcctcggtgtaggtgacgccgtggtaggacggatcgggcgtgttcagcagcgggaagcgcgacttgttcgccgcccagtcgaatttgccggagtcgaccacgatcccgccgatgctggtgccgtggccgcccatgtacttggtcagcgagtgcacgatgatgtcggcaccgtgctcgaacggccggcagagcaccggggtggctaccgtgttgtcgacgatcagcggtacgccgtggcggtgagcggcgtcggccagtgcctgcaggtcgatgatgttgcccgccgggttgccgatggtttcgcagaacacggccttggtccgctcgtcgatcagcgcttccagggcggcgatgtcgtcgtgggcggcgaagcgcgcctggatgccgatgcgtggcagggtgtgggccagcaggttgtaggtgccgccgtagagcttggccaccgagacgatgttgtcgccggcttcggcgacggtctggatcgcgtaggtgatggccgccatccccgaggccaccgccagcgccccgaccccgccttccagcgccgcgacgcgctgttccagtacatcgttggtggggttcatgatccgtgtgtagatgttgcccggtaccttcaggtcgaacaggtcggcgccatgctgggtgtcgtcgaaagcgtaggaggtggtctggtagatcggcaccgccaccgcgcgggtggacgggtcagggctgtagccggcgtggacggccagggtttccagtttcatgcagcgttccttcgggcagattggaaggacgcagcatgggaaagcgcgccgggcgggtcaatgcgcccgggcaaggaaaagcgtgcctggttagatcgttgtgttcgccgcttatgcctatcagcgcaggccgatgtagatgttgtaggcgctgatcagggtgatcagggtgccgacgatgaccagcagggtgcgcggcgaaagcttcttgcacagcagggcggcgaacggcgcggcgaacaggccgccgaagaccagtccggcgaccatcttccaggtgtccggctggccggcgaggaggatgaaggaggtggcgctggcgatggtcaggaagaactcggcgaagttcaccgagccgatggtggtgcgcgggtcgctacccgagccgatcaggctgctggtgaccaccgggccccagccgccgccgccggcggcatcgacgaagccgccgaagagtgccagcttggccacgtggcgcggtgcccggcgcttgatcacgtggcggtaggccttgctcaggatgtacaggcccatcagcagcaggtaggcggagatgaagggcttgagctggtggccgtcgaagcgggtgatcagcacggcgccgagcaccgcgccgatcattcccggcagcagcaggcggaggaagagtga

SEQ ID NO: 16399 - DNA, 1662 bp, Pseudomonas aeruginosa
cgcctggtgttcggtgttgatcgaactctggctgagatcgaggtcgcgtatcttcatgcggcaaggcgcctgacaggaggtggtagaacaggctggaataagtgtggcggcgaagataatcggcttttcttagtgcgtctaagaagttttccgaaggtatttattccattgcggcattatcggccgccgttctgtcagggcatcccgtcaggaggagcaactgatttccaggtgccgcccccagtccggcgggcgccgagtgaagcgctccatgcccggctgttcctcgaacgggcgactcagcacctggtgcagcaagcggacttccgtgtagtcgccctgctcggccgcttcgatggcctgctgtgccaggtagttgcgcagcacatagagcggattgaccgcgtgcatgcgccggcgccgcgactcctggtctccgccttcttcctcgacgcgccggcggtaggcctcggcccagcggtcgaaggcctcgcggtcgacgaagtcgtcgcgcaggctggccagcgcccgctccggagtttcttcgccgagtcggcggaagaacagcgagtaatccaccgcgctgccctgcatgcgctgcaacagttcctggaccagggcctggtcgttctccgcggcgacgcccaggcccaggcgccggcgcatcaggtcgaggtagtgggcctggtagaggggcaggaacaggtcgaggctggcgcgcagttcgtccacttccaccagtggcgtcagcgcctgggccagggcggccaggttccaatgggcgatcggtacctggttgctgaaggagtagcggccggcgtcgtcggagtggttgcagatgtgattggcgtcgaaatcgtcgaggaaggcgtagggcccgtagtcgaaggtaatgccgaggatcgacatgttgtcggtgttcatcaccccgtggcagaagccataggcctgccagcgggcgatgagttcggcgttgcgctcgacgacctggcggaacatcgccgcgtatggccgctcggctgcgttgcagtcggcgaagtggtgttccagaacgaacgccgccaactgtttcaactggtcgtgctggcgggtgtagtagaagtattcgaagtgaccgaagcgcacgtggctgggcgccaggcgcagcagcgtcgccgcgctttccttcttctcgcgccagaccggcgtgctcgaaccgatcacgcagagcgcccggctgctgggaatgcccagtgccggaagggcttcggaggcgaggaactcgcggatcgacgagcgcagcacggcgcgcccgtcgcccatccgcgagtagggggtctggccggcgcccttgaggtgcaggtcccagtgctcgccggcctggttgatcacctcgccgagcagcaggccgcggccgtcgcccaggcgcgggttataggagccgaactggtggccggaatacaccatcgcccgcggctcggcctccgaccacagcttgtgcccgccgaacagttcggcgaacagcgcttcgtcgctggtttccgctggcaggtcgagcagcgccagggcggcggggctggctaccaccaggcgcggctcggcgatggggtcgggcaggacttcggtggagaaggcgtcgcccaggcgggcgaagcggttgtcgaagtcgaggtcgtcgagtga

SEQ ID NO: 16400 - DNA, 1638 bp, Pseudomonas aeruginosa
ggttcagcgggtcggttcggcgggaccgtcctggcccttgagcgcgggcggattgccgacgccgctgtgctgcggctcgccgacgaacagctggacctgctggccctggaggttcttgacgaacacatcgacctggttgaaagccatgtcgatcttgtgttcgcggaagctggtggcgatcttcgtcaggatctcgtcggtagaggggttgcggtcgcccagttcgcggacgtggaagcgcagctcgtagtcgaaggtactggcgctgatggtcaggaagtacagcagcggctccgggtcgcgcagtacccgcgggttttccttgaccgcctgcatcatcagcttgcgcgccagcggcaggtcggtctcgtaggccaggccgatcttgatggtgacccgggtcacggtatcgctcagcgaccagttcaccagttgcccggtgatgaaggtctggttcgggacgatgatctccttgcggtcgaaatcggtgatggtggtggcgcggatgcggatccggctgaccgtgccggacaggttgccgatggtcaccacgtcgccgattcgtaccggacgctcgaagaggatgatcaggccggagacgaagttggagaagatcgcctgcaggccgaaaccgaggcctaccgagagcgccgccaccagccattgcagcttgtcccagctgaccccgagggtggacagggcgctgacgatgccgatgccgctgatggcgtaggaaagcagggtggtggtggcgtaggcgctgccctgggccagggtcaggcgctgcagtaccaggacttccagcaggccgggcaggttgcgcgccagggccacggtgaccaccgcgatggccagcgccgcgaggaagtcgcgcaggctgatcggcacgctggtggccgcttcgccggtgccggcggtgtactggtacagggtgacgttgtcgaggtaggagatcacgctgatcaggtcggcccagacccagtacaggcagacgatgaagccgatcagcagggccagtcggatcagccgcagcgattgctggttgatctgctcgatgccgagggtcggctcctcgacgttggtctcgccgtcgacgccttccttcgccgcgttctgccgtttcgccagggcccgggcgtaggccaggcgccgggccgccacgcccaggccgcggacgaaggcggcttcgatgacgaaccagagcagcagcaggtaaagggtatcgatgagacggtcggtgagcttcagcgaggtgtagtagtagccgaagcagaccgcgacgaagagcaccagcggcagcgcggtgaagaggatgccgacgatcatcttgatcagcgacggacgttcgtcgccggggctgctgaacagcaggcggctgagcagccaggccatggccgcgtagccgagcaggaccacggcgatgccgatcacgtcgtcggccagactcgccggctggtgctcggccaccgtcaccacgccgaccagcgccaggaccacaacgccgaggcggaccaggtgccggtcgaggaagccgacctgttcgcggctccagtggaaatgccgctcggcgatgccgcccggggtgaggatgcgatgggcggtgtagaacagcagccagacctgggccatttccagtag

SEQ ID NO: 16401 - DNA, 1761 bp, Pseudomonas aeruginosa
ggcgctgccgagggtggcgttctggccgcgggcgtccagcagcagggccagcccggcgacggcaaaggtcagggtgccgggcagggcgaggaggatggtgatcaggatcgccagcggggtatgcagctggctgtcgcgcttgaagtggccgatgtcgtcgttcagctccgccagcttgtcgtacaggtagcggcgtttccacagcagcgcggcgatcagcaggaacagcggcaggaacagcagcggccgatcgaccaggccttcgcccagttcacgcaccccggagccccaggggatctcggtgagctggttcttcagcagggtcggggtcatcttgaaccaggacaggtcgagcggctggttgctgggaatccagaacatctgctcgtcgagggtggtgcgcaggctctcgctggtggaaagcaactgtttctggttcaactgcaaggtgatcgcttcgttgagcagcgcgttgagttcgtggttgagccgttcgagcaactcggaacgggttgccaacagggtgtcgagatccttgcgcagttccggcgtgacctgctcgctgggctgctgggcgagcaggtcgtccaggtattgctgcggggtcgccagcttgtcgcgttcctggttcagttcgaactggccgaggcgcaggtcggcgatctcgtcggccaggctctggtcggccttgatcttgggcagcgcctgtttctgcttgtagaggatgcgcgacagcagcaggctgccgcgcaggacgttgatctgttcctcgagggcctggttggactgggtcaggttgtccagttgctgcttggtctcgaggttgcgccgggtgagcacgttgaggcggtcggtggcacgcaggaggtagtcggagagacgcaggttcttggcgttctcctggctcagcaggctgtcggtgccggctccctgggcgccttccttggacagctcggcgacggtcttttccgactgctcgcggcgcttctcgctgatcagcgcctgcaggtcgagggtttccttttccaggcgcgagatcttctcggtgagcagatcgtgctggctcttgccgaggtcctgcagcaggttgttgccggccagctcctggcgcaacagctggctctgcacggtcaatgcggcctgctcggcgagcagctcgccgcgacggtcggcgttgatcgtcttgccgctttccttgccggccttgagcagcgagccgatttccaggatccgtgcctgcatgctgctgatgccggcctgggctcgttccggacgggtctcggcggtgatcgacaggctgttggcctcgcccagggctttctgccactcggcctgctgggtggtgcggtcgttgagcagcatttccaggcgggccgcgctctcgccgctgtagcgttcgctgaccggacgttctttggtcttcttcaggcgctccagttcgcgctggttttcctcgatctgccggggcgcgtcgctcaggcgctttttcaggtcctccaggctctgcagcgcttcgtcgcgcgcggcgaggaacttgagggtctgttcgaggctggccttggcgaccttctggtcggcttcggcgagcttgcgctcggccagcttgtcgaggctttgctggacggcctcggccgagggcggctcggactgggcgaggagcggcggactggcaaggcagaggccgaggaaaagaatagcgatcagggagcgaagggcaggcatggtcgagaagagactcgaagaagggtgaatgcaggttag

SEQ ID NO: 16402 - DNA, 2007 bp, Pseudomonas aeruginosa
gcgtatccgggaaaaaaccgctggacggtcggaggtctgcggtgccgctggaaaagccctgtttttcgtagggttggcttcgccgggagggttggcgtcgagcgcctgtcatcgtgcgcgccgaactcgcgcctgcgggtcctgtggcattcgctggcggtacgacgggacgcagtttcgccgagccgtcaggcgggcaaaaaaagccccaccatccggtggggccgagagacgagcgtggcatgctcgcgagaggggctggccgctccgtggggagcggcgcaggtattacaggagcagggtgcggatgtccgccagcagctcgcccaggcgcttggtgaagcgcgccgcggcggcgccgttgatcacgcgatggtcgtaggacagcgacagcggcagcatcaggcgcggctggaaggccttgccgtcccataccggctgcatggtcgccttggacacaccgaggatcgccacttccggcgcgttgacgatcggcgtgaagccggtgccgccgatgtggccgagactggagatggtgaagcaggcgccctgcatggcatcggccgagagcttcttgttgcgggccttgtcggccagctcggcggcctcggcggccagttgcaggaggctcttccggtcgacatcgcggatcaccgggaccagcaggccgtccggagtgtccacggcgaagccgatgtgtacgtacttcttgcggatcagcgccttgccgctgggggccagcgaactgttgaagtccggcagttccttgagcaggtgggcgcaggccttgagcaggatcggcagtacggtcagcttgaccccggccttctccgccgcggccttctgggcaacgcggaaggcttccatgtcggtgatgtccgactggtcgaactgggtcacgtgcggcacgttcagccagctgcgatgcaggttggcggcgccgacctgcatcaggcgggtcatcgccacttcttccacttcgccgaacttgctgaagtcgacttccgggatcggcgggatgccggctccgccggtggcgccggcaccgccggacttggcgcgctgcagttgctccttgacgaagacctggacgtcttccttgaggatgcgacccttgggaccgctggctttcacttcgctcagctcgacgccgaactcgcgcgccagcatgcgcaccgccgggccggcgtggaccttggcgccgtcgcggctgggtgcgccgaccggagccggggtatcggccttggctggcgcaggggccgccgcggcgggcttctgctcggcggcgggcgccgcggcctgggccggagcggctgccggttgctcttcggctgccggagcggcgccttccaccttcagcttgaggatcaggtcgccggtgccgacttcgtcaccgaccttgatcgagacgctttccaccaccccggaggccggcgagggaatctccatgctggccttgtcggattccagggtgatcagcgactggtcggcctcgaccgtgtcgccggccttgaccatcacttcgatgacgttggccttgccggccgagccgatgtccgggaccttgatgtcctggacgctggccgcggcgggggcggccggcttgctctcgctcggggcgggagcaggcgcttcggctttcggcgcttccggttgggcgggcgctgcctcggccttggcttcggcaggctgttcgccgccttccacttccagctcgaggatttcgtcaccttctttcaaggtgtcgccgaccttcgccttgatgcttttcactaccccggccttgggactggggatttccatgctggccttgtcggattccagggtcagcaggctctgatcggcctcgaccttgtcgccgggcttgaccagcagctcgatgacttcaccctcaccgttgccgatgtcgggtacgcgaatgagttcgctcacattcctctccttttacgtgccaccaccgctgtgcggcgcgcaaaacaaagacttttggtccttggttcgttgtga

SEQ ID NO: 16403 - DNA, 2766 bp, Pseudomonas aeruginosa
gccggcgccgcccgttggcggcgccggcgtgctcgaaacccctcgctgccgagaggagtatggagcgaattagcaatccagcgggttgcgcttctccggatcgatcccgtacttggcgatggcctcggccaccactttcggctcgatatcgccgcgatcggccagcgcttcgagcgcggccagcaccacccagtgacgatccacttcgaagaagttgcgcagcttcttgcggctgtcgctgcggccgaagccgtcggtgccgagcaccttgtactccttggagggaacccactggcggatctgctcggcgtagagcttcatgtagtcggtggaggcgatcaccgggccgcgacggccgcccaggcactcctcgacgtagctctgcttcggcttctggcccggatgcaggcggttccagcgctcgacggcaaggccgtcgcgacgcagctcgttgaagctcggcacgctccagacgtcggcgccgatgccgaagtcgttgcgcagcagcttggccgcttcctcgacttcgcgcaggatggtgccggagcccagcagttgcacgtggtgagcggcttccttcttgtcctcctcgaggaggtacatgcccttgatgatgccttcctctgcgcccttcggcatggccggctggacgtagttctcgttcatcacggtgatgtagtagaagatgtcctgctgctcttcgatcatctgccgcgagccttcgcggatgatcaccgccagttcgtaggcgtaggtcggatcgtaggtgcggcagttcgggatggtcgaggccagcaggtggctgtggccgtcctcgtgctgcaggccttcgccgttcagcgtggtgcgaccggcggtgccgccgatcaggaagccgtgcgcgcggctgtcgccggcggcccaggccaggtcgccgatgcgctggaagccgaacatcgaatagaagatgtagaacggcagcatcggctggttgtgggtgctgtaggaggtaccggcggcaatccagctggacatggcgccggcctcgttgatgccttcctcgaggatctggcccttcttgtcctcgcggtagaacatcacctggtccttgtccaccggctcgtagagctggccgaccgaggagtagatgccgagctggcggaacatgccttccatgccgaaggtacgggcctcgtccgggacgatcgggacgatgcgcgggccgagttccttgtccttgaccagctgcgagatgatccgcacgaaggccatggtggtggagatctcgcgatcgccggagccgtcgagcatggccttcagggtttccagcggcggaaccggcacgctcatgctcttctgccggcgcaccggcatgaagccgcccagcgcggcgcggcgctcggccaggtacttggcctcggcgctgccttcttcaggcttgtagaacggcagcttctccaggtcggcgtccttgaccgggatgtcgaacttgtcgcggaacgcgcgcaggctgtcgacgtcgaccttcttcacgttgtgcgcgatgttcttcgcttcgccgctgccggtgccgtagcccttgatggtcttggccaggatgacggtcggctggcccttgtggttgaccgcctggtggtaggccgcatagaccttgtaggggtcgtggccgccgcggttgagcttccagatttcctcgtcggaaaggtccttgaccatttccagcagttccggacgcgcgccgaagaagtgctcgcgcacgtaggcgccgtctttcgccttgtagttctggtattcgccgtcgatgacctcgtccatgcgctgctgcagcaggccggcggtgtccttggcgaacagcgggtcccagaagcgaccccagatgaccttgttgacgttccactcggcgccgcggaacacgccttccagttcctggatgatcttggcgttgccgcggaccgggccgtcgaggcgctgcaggttgcagttgatgacgaagatcaggttgtcgagtttctcgcggccggccagggagatcgcgccgagggattccggctcgtcgcactcgccgtcgcccatgaagcaccagaccttctgcttgccggcggggatgaagccgcggctttccaggtacttcatgaagcgtgcctggtagatcgcctggatcgggccaaggcccatggatacggtggggaactgccagaagtctggcatcagccaggggtgcggataggaggacaggccgttgccgtccacttcctggcggaagttctccagttgttcctcgctgatgcggccttcgaggaaggcccgggcgtagacgccgggggacgcgtggccctggaagaacaccaggtcgccgccgtgttcgtcggtgggagcctggaagaaatagttgaagccgatgtcgtagagggtcgccgaggaggcgaaggtggagatgtggccgcccaggtccgggtcgtgcttgttcgcccgcatcaccatcgccagggcgttccagcgcaccagggagcggatccggcgttccatgaacaggtcgccgggcatgcgtgcttcgtgggttaccggaatggtgttgcgatagggcgtggtgatcgcgtagggcagttgggtgccgctacggctggccagctcgcccatgcgggtcatcaggtaatgagcgcggtcttcaccttcgcggtcgagtacggactccagggcgtccagccattcctgggtttcgacgggatcgaggtcttgcatggcttgctccagggcggaaaggcttccagaatcggatgccataggtga

SEQ ID NO: 16404 - DNA, 207 bp, Pseudomonas aeruginosa
ttcttggatgttctccgggggtgtacccggcgacttgtagttttactacagatcagtctgagaaacagccctctggatacaatttttagtagtaaaactacatttcgattgtcgctgtcaggctataaggcccgatgtagagccttttcgacgttgtgcgtcgagcctgtggtcttcggtcggaagcccaaacaggatagaccatga

SEQ ID NO: 16405 - DNA, 1011 bp, Pseudomonas aeruginosa
tcaggatctggcgcgagctgcggctcggctgatccactcaggcacgtaacgcaagtacgtaacgaatatctgaaggagctggcaactatgtcgatggccgatcgtgatggcgtgatctggtatgacggtgaactagtgcagtggcgcgacgcgaccacgcacgtgctgacccataccctgcactatggaatgggcgtgttcgagggcgtgcgcgcctacgacaccccgcagggcacggcgatcttccgcctgcaggcgcataccgaccggctgttcgactccgcgcacatcatgaacatgcagatcccgtacagccgcgacgagatcaacgaggcgacccgcgccgccgtgcgcgagaacaacctggaaagcgcctatatccgcccgatggtgttctacggaagcgaaggcatgggcctgcgcgccagcggcctgaaggtccatgtgatcatcgccgcctggagctggggcgcctacatgggcgaggaagccctgcagcaaggcatcaaggtgcgcaccagttccttcacccgccaccacgtcaacatctcgatgacccgcgccaagtccaacggcgcctacatcaactcgatgctggccctccaggaagcgatctccggcggcgccgacgaggccatgatgctcgatccggaaggctacgtggccgaaggctccggcgagaacatcttcatcatcaaggatggcgtgatctacaccccggaagtcaccgcctgcctgaacggcatcactcgtaacactatcctgaccctggccgccgaacacggttttaaactggtcgagaagcgcatcacccgcgacgaggtgtacatcgccgacgaggccttcttcaccggcactgccgcggaagtcacgccgatccgcgaagtggacggtcgcaagatcggcgccggccgccgtggcccggtcaccgaaaagctgcagaaagcctatttcgacctggtcagcggcaagaccgaggcccacgccgagtggcgtaccctggtcaagtaa

SEQ ID NO: 16406 - DNA, 1206 bp, Pseudomonas aeruginosa
gcagccgctgtgcttcacccggctgaatccccagcgcgtggccacccagctggaggccatgctgctggccccggagaccctccgatgaccctggcgttcatcctctacaaatacttccccttcggcggcctgcagcgcgacttcatgcgcatcgccctggaatgtcagcggcgcgggcacgacatccgcgtctatacgctgatctgggagggcgacgtgccggacggcttcgaagtgctggtggccccggtgcgctcgatcttcaaccaccggcgcaacgagaagttcaccgcgtgggtccgcgccgacctggacaggcgcccggtgcagcgggtgatcggcttcaacaagatgcccggactggatgtctactacgccgccgacgcctgtttcgaggaaaaggcccagaccttgcgcaacccgctgtaccgccagtggggccgctaccgccacttcgccggctacgaacgggcagtgttcgacccggcctcgaagaccgagatcctgatgatctccgaggtgcagcagccgctcttcgtcaagcactacggcacccaggccgagcgtttccatctgctgccgccggggatcagccaggatcgccgggcgccggccaacgccgcggacgtgcgtgcggaattccgccgcgagttcggcctggaggaggacgacctgctgctggtgcagatcggttccggcttcaagaccaagggcctggatcgcagcctgaaggcgctgtccgcgctgcccaaggcgctgcgcaggcgtacccggctgatcgccatcggccaggacgatcccaagccgttcctgctacagatcgccgccctcggtctcaacgaccaggtacagatcctcaaggggcgcagcgatatcccgcgcttcctgctcggcgccgacctgctgatccacccggcctacaacgagaacaccggtacggtgctgctggaggcgctggtctccggcctgccggtgttggtgaccgatgtctgcggctatgcccactacatcgccgaggccgacgccgggcgggtgctgccgagtcccttcgagcaggacagtctcaaccgcctgctcgcggaaatgctggaggacgctccggcgcgcgccgcctggtcgcgcaatggcctggcctacgccgatcacgccgacctctacagcatgccgcagcgcgccgccgacctgatcctcggggaggcctcatga

SEQ ID NO: 16407 - DNA, 1020 bp, Pseudomonas aeruginosa
cgacctgaagtggcgcaacctgctggtggacgaccagccgctggtgtatttcatcgactgcccgaacggcgcgttctggtggagcttcatgctgcgctatcggatcaccaaggacctggcctgcctggacaaggtggccaagtaccacctgtcgcgcacccagcgcctgcgcttctacctgcaatatcgccgtcgccggcacctgaacgaatccgacaagaagcgtattcgccaggtggtggctttcttcgaggggcgcgaatgagcgttttcatcgccgcgcaggaccacgacctgctccagcgcaaccgtctggacagcttcgacgccctgtgggccttgcagctggacgccgtggacgaaccgaataccgagcggggtggctggagcagcgtctaccgcctcgacctgggcgactccgcctactacctgaagcgccagagcaaccacctgacccgcagcctgcgccatccgctgggcgagccgaccttcgcccgcgagttccgcaacatcgagcgctaccgggcgctgggcattcccgccctgcaggcggcgttcttcgcccagcaggcggtcggcggagagcgccaggcgatcctcctgacccgtgccctggacggttggcaggacctggacacctggctggcgtcctggcacgacctggccgaagagcggcgccgggcgattctccgggcggttggcaggctggcgcgccagctgcacgccgccggacagatgcatggttgcttctatcccaagcatgtattcctccgcgagggggccgatggtgtcttcgaggcctgcctgatcgacctggagaagacccgcccgatctggttcggccgccgcgaccaggtcaaggacctggagccgatgctgcgccgtgccccggactggagcgaagcggacgtgcacgaattcatctccgcctatgtcgacgaacccctcgactcggccgaggtcgagcagtggtatcgccttctcgaccagcgccgtcggcgcaaggagtcgcgccgatga

SEQ ID NO: 16408 - DNA, 1770 bp, Pseudomonas aeruginosa
agaggttctaccgtggcattgaccgtcctaggcctgtctggcgccgtaagccatgacccgtccgccgccctgtacatcgacggcaagctggtcgcggccgtcgaggaagagcgcttcgtgcgcgacaagcacgcgaagaaccgcatgccctacgaatcggcgaagttctgcctggagcaggcagggatcgagccggccgatgtcgacgtggtagcgattcccttcgctcccatcagcatcatggaaaaggcccgctggcactacgccaagcgctacgcctacgcgccggatcgcgcgctggatgcgatcctgctcggcaaccgccgctacaagcgttactacaagcgcatcgagtggtgcctgcaacaactcggcttcgacctgaagaaaatcaagatccagccggtcgagcaccaccttgcccacgcctccagtgcctaccattgctcggggttcaaggaaaagaccgcgatcctcggcatcgacggcaagggcgaatacgccaccactttcttcggctggggcgagaacggtcggatccacaagatcaaggagttctacgatccggattcgctgggcggcctgtacggcgcgatcaccgagtacctcggcttcgacatgctcgacggcgagttcaaggtcatgggcatggcgccctacggtgacgccagcaagtacgatttctcccgtctcgccaagttcgagaacggcgaactggtgatcaacaccgattatgccaacgtcatcggcttccgccgctacaaggagaaaggcaagggctactacttctcgcccaagctgatcgagtggctggggcccaagcgcgaaggcgacatcgccgacgatccctacatccattacgccgcgagcatccaggcgctgttcgagaagctcgcgctggagatgatggactactacctcggcgatatcatccgcgagaccggcaaggtcgctttcgccggcggctgcgcgctgaacgtcaagctcaaccagaagatcatctcgcgccccgaagtgaaggagctgttcgtccagccggcggccagcgacgccggcaccgcggtcggcgcggcggcctacgtgtcgcaccagcgcggcgtgccggtggagaagatggagcacgtctacctcggcccggagtattccaacgaggacgtcatcgccgcctgcgcccgtcacgaggccaggccgcagtggcagaagatcgacaaccgcagccggcgtatcggcaggatccttgccgacggcaacccggtggcctggttccagggacgcatggagttcggtccgcgtgccctcggtggccgctccattctcggctgcccgagcgtgccgggcgtggccgaccggatcaatgcgcagatcaagttccgcgagcgctggcggcccttctgcccgtcgatgctggataccgtcggcccgcagatgttcaagatcgaccacccggccccgttcatgaccttcaccttcgaagtcaacgaagagtggaaggagcgagtgccggaagtggtgcacgaagacggtacctcccgcgcccaggtgctgaagcgcgagtacaacccgcgctactacgacctgatgaaggaactggagaacctcaccggcaacggcgtggccctgaacacttcgctcaatcgccgtggcgaaccgatgatctgctcgccgaccgacgccctgaacatgttcttcggctccgatctgcagtacctgatcatggaggacatcctggtcgtgaaggagggcgtggactggtatgactcggtcggctga

SEQ ID NO: 16409 - DNA, 855 bp, Pseudomonas aeruginosa
ggtggcggcgcgttgcgcctccgacgaggtactgttcctcgagtacggctccagggacatccgtggcctcaagctgaaggcgatccgcgacttgcgcgagatcgcccgttcgcgcgacttccgcttctgcatcgcgcaccgcttcaagccgatctggatcgccagcctggccactcgtctgccgatcgttggcgtgcaccacgccttcggcgattaccagcggttgtcgcgcaaggtcttcgccggcctgatgagcaagcgcctgagcctgctggcggtgtccgacgcggtgcgcgacgatatccgccgttgcctgccgaagtggccggcggagcggatcgagacgctctacaaccgcatcgacgtcgctgcgctgcaggccgagcaggtcgagcgcctgagtgcgcgccggcaactgcgcctgcccgacgaggcctgggtggtcggcaacgtcggccgcctgcatccggacaaggaccaggctaccctgctgcgcggctttgccgccgcgctgccgcgcctgccgcagaacagcctgctggcgatcctcggcagcggccgcctggaagagcagctcaaggacctggcctgcgaactgggtatcggcgagcgcgtgctgttcctcggccaggtcgaagaggcacggcgctacttcaaggcgttcgacgccttcgccctgagttccgaccacgagccgttcggcatggtcctgctggaggccatggttgccggtgtaccgctgatcgccaccgcctgtggcggcgcccgcgaagtggtggaaggggtcggcatcctcttcccgctgggcgacgagacggccctggccgagggcctgacccacctggcggcgcttga

SEQ ID NO: 16410 - DNA, 1023 bp, Pseudomonas aeruginosa
ccgccgccagcgcgaggcctgtgcgcggctcatgctcgagcgcctggagacacgcttctccgacgctgcggtgcgccgcgaattctggcgcctgccgacgattgccggcttcgcttcggagtctgcatgctgaacaggttgcgcgccttccgcgaacgcggttggcgcgaagtggacgcgccgacctacgcccaggcctggcagcgtttcggcggcagcgtcgcgacccacccgctggtggtcgagcagctcgccgaaatggctggaatcccggtgcgttacctgggttgggagagcgctggcgaactggttgcggcgatcccgacctggggccgccacctggcgttgtccaaggacgtgctcaagcggcgcggcaagaagggcctgtacgacctgggcaacgccgaactgatcctgccggtggccggcgatgcccgcatcgccctccgccatgcgggacgctacctgtcggcgctgcatgagcggaacatcgtcacgctgcgccctcagaccgagcaactggctttcgctcgtgctcccgaggatttctccaagaagttccgctataaccagcggcgcgaagtgcgcctggtggaggaggccggtggccaggtgcgccaggcagacagcttcgccccggccgagttcgctgccatctatcttgaactgttccagcgtcgctggggtttccctgccaccggcgcggagcgcatggccgaggtcttcgagcggctgcgcgaattgctgcgcggctcggtcctgctgctcaacgaccagcccatcgcggtccaggtactgtatcgcgccgaagcgccgggctggctcagcgtcgagtacatcaacggcggcgtcgatccgcagacccgcgagttcagccctggcagcgtgctcagttacctgaacacccaggccgcctgggaggatgcgcgagcgctgggcaaacccctgcgctattcgttcggtcgcgccgaccgcgaatacaaggatcgctggtgccatccttctccggtcttccaggtctga

SEQ ID NO: 16411 - DNA, 1422 bp, Pseudomonas aeruginosa
agcatgagcgcacgcaagcagcagttgctcaagcgtcatcgacgcaacaagcggatcggcctactggttgcgctgctggcattgctggccgtcggtctgctggtcagcccctggttgttgccgatcctcctcgtggccctgtgggtcgcccacgaagcctggttcgccgatcacctgttctattcgccgggcgaggactaccgctaccgtttcgcggaaggggtcgagtcgctgccggtacgcctggcggatggccgtctgcgagtcgacggtgagctgcgcgaaggcgatacgctggtgcttggcatcggcgtgcgcgctggctggctggggcgcttcctcgaaccctcggtgctgctggaaggtggcgcggaggccgatgcccaggctttcgaacgtggggtgaacggcttgcgctacctgaacctgacgggactggccgggccgctgggcgagggccggattcgcctgcgcggccggcattgccggctggtcggcgaaccgaccctgtggcgtgcgcgccatcccgactaccgtgatcggcgggtgatggtcatcgctccgcatgccgacgacgccgagctggccgccttcggcctctacagccaggctcgcgaggcctggatcgtgaccctgaccgccggcgagatcgaaaccgagcattaccgccgcatgggcctcgacggaatagctgcggcgcgcctgaagggccgcctgcgcgcctgggatagccaggccgtgccgacgtggggtggggtgccggccgagcgctgcgtgcaactgggttatttctgcctgcaattgcctgccatgcaggcgaacccgggcgaggtggtgccgtcccgtgaggccgatctcgccgatatccgtccgttccgccagttcaaccgcctgcgcctggccagcgatgccgacggcctgtcgacctggaacaatctgctgtccgatctccgcgagctgatcctgctggcacgtcccgaggtcatcgtcctgcctcatccgcatttcgatccgcacccggaccatgtccgcgcccaggaggctgtgcgcgaggcgctccagggcctggactggcagccgcaggcattgttgcactatgccaatcacctgcacgacaacgatcgctggccgatgggcgatgcgcacatgggggtcagcctgccaccgctgaccgaagaatgctcgccgttgctgccatggacgctggcgctggagcgcacgcgccaggtggacaaggccatggccttgggcatgatgcacgacctgcaacccaggccgccgttcaagcgccgtctgcgccgccgtctgcagggctggctcgccgggcgtcgctggccggcttacggcgaggacgagttcatgcgcaaggcggtgcgtcggcacgagttgttctgggtggagtcgctggatggggaggcgtga

SEQ ID NO: 16412 - DNA, 1029 bp, Pseudomonas aeruginosa
tgcttgggtcgagcgttcggcaaggttcgagccgccatgctgcttcggagcagccgcgaggatgaaggtctgatgaaagttctgtttctggtccagaaagagcagcgcgcgatcctggatcgcctgtacgacggcatcgccgcccattgcgagtgcgatacccgctggctgagcagcgaggagcaggccgacctgcgcggctacttccgcaagcacgtggatgtctcgcgctacgaccgcatcctgttcttcctccgtttcaagaaggaaatgcgccaggtccgcttcatccgcagcgtgcccaacctggtgatcctcgagcacgatgcctaccagaactacattccctgcaagtacaccggcaagttcagcgcccattaccggcgcctgccctgggcacgggtgatcagttcgggccatacggtcagcgaacgcctgcgccaggagggattcgacgcggtattcgtgcccaagggctacgaccagaccctgttgcatgacctgggcctcgcgcgcgatatcgagctgggcttcgtcggcagtaccggcagcgtggcttacagtggacgcaaggcgctgctcgacgagttgggcggagtggagaacctgctggtgaccaagaccaagtccggcgaggagtacctgcgtacgctcaaccgcatccgtttcttcgtcagcgcggatgtcggcatgggcgaatacatgatcaagaatttcgaggcgatggcctgcggttgcgtactgctggcctacgaccagggcgagcgggaaaacgaggccttgggtttccgggacatggagaatatcgtgctgtatcgctcggtggcggacatccaggaaaagctcgcgatcctgcgcctcgatacggctctcgccgagcggatcgcgcgaagcggccaggcgctggccatcgaacgattcagcttcgccgctgtcggtcagagtatcgtcgaggccatgcggcccgcgttgcgcgagccggagcgtcccggatggctggagaagacctggcgacgtatttttacctga

SEQ ID NO: 16413 - DNA, 1581 bp, Pseudomonas aeruginosa
tggaccaggggcagatcgtcgagcgcggcagccacgccgagctgctggcgcagaacggccattatgcgcggctgcacgcgatgggactggatgagcaggcgccggcgcctgtcggctgataaactgggcgtctgccccgagaggttgtttggagttcccatgaagttgtccatgccccgtttcgaccaggccccggtgttggtggtcggtgatgtgatgctcgaccgctattggcatggcgcgacttcgcgcatttcgccggaggccccggtgccggtggtccgcgtcgaacagcacgaggaccgccccggcggcgccgccaacgtcgcgctgaacatcgccgcgctgggcgcgcaggccttgctggtcggcgtcaccggccgcgacgaggccgccgacagcctggccaacagcctcaaggccgctggagtggacgcgcgcttccagcgcatcgatagccagccgaccatcgtcaagctgcgggtcatgagtcgtcaccagcaactgctgcgggtcgacttcgaggaaccgttccgcaccgacgcggcggccctggccgtggacgtcgagtcgctgctggccaaggtcaaggtgctggtgctgtccgactacggcaagggcgcgctacagaaccaccaggtgctgatccaggcggcgcgggcgcgcaacattccggtactggccgatcccaagggcaaggacttcgccatctatcgcggcgccagcctgatcaccccgaacctgtccgaattcgagaccatcgtcggccgttgcgccgacgaagccgaactggtcgccaagggccaggcgctgatgagcgaactcgacctcggtgccttgctggtgacccgcggcgagcatggcatgaccctgctccgcgatggccagccggccctgcacctgccggcgcgggcgcgggaagtgttcgacgtcaccggtgccggcgatacggtcatctccaccctggccgcggcgcttgccgccggcgaggagctgccgtccgcggtgggcctggccaacctggccgccggcatcgtggtcggcaagctgggtaccgcggcgatcagcgcgcccgaactgcgtcgcgcggtgcagcgcgagcagggttccgagcgtggcgtgctgggcctggagcaattgctgctggcaatcgaagacgcccgcgcccacggcgagaagatcgtcttcaccaatggctgcttcgacatccttcacgccggccacgtgacctacctcgaacaggcgcgcgcccagggcgaccgcctgatcgtcggggtcaacgacgacgcctcggtcactcgcctgaagggcgttggccggccgatcaactcggtggaccggcgcatggcggtactcgccgggctcggcgcggtggactgggtggtgagcttcgccgaagacactcccgagcgcctgctcgagcaggtgcgtccggacgtgctggtcaagggcggcgattacggcgtcgagcaggtggtcggcgcgcagatcgtcaaggcctacggcggcgaggtacgggtgctcggcctggtggagaacagctccaccaccgccatcgtcgagaagatccgccagcgctga

SEQ ID NO: 16414 - DNA, 432 bp, Pseudomonas aeruginosa
agtcgttacctatctttattggagataggttatgcagtggaacctggagcagatccgcctgttcgtcagcgtcgccgagcgccagtcgttctctgccgccgcccgcgaactgaagcgggtgcaatcggcggtgagcaacggcatcgcgctgctggaggcggacctcggcgtcaccctgttcgaacgcagcagcggacgccagccgcgcctgaccgacgagggccgggtgctgctggcggaggcgcgcgaggtgctgcgccagtgcgagcgcctgcaggggcgcgcgctggggctggcgcgcggcgaggagccgcggctgcgcctggcccaggacgaggcgatgccctaccagccggtgctggacagcctggaagcgctggcgcagcgctttcccagtctggaggtgcaggtgtccagcggcggccagggtga

SEQ ID NO: 16415 - DNA, 1728 bp, Pseudomonas aeruginosa
gtcgctggagcggcggcgcctcggcagcgtcgagatggtcacggtgtgcggtgccggccacccgctggccgggctgcaacgggtcagtcgccgcgagctggcacagcaccggcaacttttgatcgtgccccagcagagcggctatccgggcggcgagcagatcagcccgcaggtctggcggctggacagcttctattccatggccgagctgctgatgcgcaacctcggctgggcctggctaccgcggcacgtggtgcagtaccccacctacgaccggctgatggtggagctgaccagcgactggacgccgccggcgctggtggtcgaactggtctggcggcgcaacgaggtgctcggcccggcggcggcctggctcggcgaaaccttcacccgccacctgcgcgccatcggctgagccggtcggcgggagttttgctaagctgcgcgcccatgaaccgtaccctctataccctgctgttccacctcggcttgccgctggtggcgttgcgcctgtggtggcgcgcgcgccaggcaccggcctatgccaagcgcatcggcgagcgtttttccctgtccttgcccgaggtgccgcccggcggcatctgggtgcacgctgtctcggtgggcgagagcatcgccgccgcgccgatggtgcgggcgctgctggagcgccatccgcagctgccggtcaccgtcacctgcatgaccccgaccggctcggagcgcatccgcgcattgttcggcgagcaggtccggcactgctacctgccctacgacctgccctgggcggcggcgcgcttcctcgaccgggtgcggccgcgcctggcggtgatcatggaaaccgagctgtggcccaaccatatccatgcctgcgccgtgcgcgggatcccggtggcgctggccaatgcgcgcctgtccgagcgctcggcgcgtggctacgcgcgcttcgccgggctgacccggccgatgctcgccgagctgtcctggatcgccgtgcagaccgaggccgaggccgagcgcttccgtcgtctcggcgcgcgtcctgagtgcgtcagcgtgaccggctcgatcaagttcgacctgcgcatcgacccgcagctgccgctggccgctgccgccctgcgcgaggaatgggacgcgacggcgcgaccgctgtggatcgccgccagcacccatgccggcgaggacgagatcgtcctggcagcccaccggcgcctgctggaaacgcgtcccgacgcgttgctgatcctggtgccgcgccatccggaacgcttcgccggcgtccacgagctatgccgccgcgaaggcttcgccacggtccggcgctccggcggcgagccggtggcacgcgcgacccaggtgctgctcggcgataccatgggcgagctgctgttcctctatgccctggccgacatcgctttcgtcggcggcagcctggtgcccaacggcgggcacaacctgctggagccggcggccctgggcaagccggtgttcgccggtccgcacctgttcaacttcctcgacatcgccgcgcaattgcgcgacgccggggcgctgctcgaggtgacggatgccggcgagctgtgcgacggcctcgtgcgcctgtgggcgcagccggaggtcgcgacggccatggccactgccggagagaaggtgctgcgcaacaaccagggcgccctggagcggctgctggcggggttggcgcggttgctcgggcgcggcgggtag

SEQ ID NO: 16416 - DNA, 708 bp, Pseudomonas aeruginosa
cctgcgatcatcggggctgcccgccggtggtcgcgggcgacgagcaggagccgcgaaaggatgaaccaggaagtgcgcttttcccgtctggagccagagcagcgcaaggcgctgctgatcgaggcgaccctggcctgcctgaagcggcatggcttccagggcgcctcggtgcgcaagatctgcgccgaggccggggtatcggtgggcctgatcaatcaccactacgatggcaaggacgcgctggtggccgaggcctacctggcggtcaccggacgcgtcatgcgcctgctccgcggtgccatcgacaccgcgccgggcggcgcccgcccgcggctctcggcgttcttcgaggcatccttctccgccgagctgctcgatccgcaattgctcgacgcctggctggcgttctggggtgcggtgggcagcatcgaagcgatcgggcgggtccacgaccattcctatggcgagtaccgggcgctgctggtcggcgtgctgcggcaactggcggaggagggcggctgggcggacttcgacgcggaactggcggccatcagcctcagcgccctgctcgacgggctgtggctggagtctgggctgaatcccgcgaccttcacgccgcggcagggcgtgcagatttgcgaggcctgggtggatggcctggaggcgggcgcccatcgccgcttccggcgtgcgatggaagcttgttga

SEQ ID NO: 16417 - DNA, 837 bp, Pseudomonas aeruginosa
tggataggctgctgctggcagcggaaggcgccccggccccttccgcccaccgtccgacaacccagaacaagaaacgccccggcccgccggaggcgcaaggtgatggcgatggttccgcgcgtattggtggtcgacgacgacccggtgattcgtgagcttctccaggcctatctcggcgaggagggctatgacgtcctctgcgccggcaacgccgagcaggcggaagcctgccttgccgagtgcgcccatctcggccagccggtcgagctggtgctgctggacatccgcctgcccggcaaggacggcctgaccctgacccgcgagctgcgggtgcgctccgaggtggggatcatcctgatcaccgggcgcaacgacgagatcgatcgcatcgtcggcctggagtgcggcgccgacgattacgtgatcaagccgctgaacccgcgcgaactggtgtcgcgggcgaagaatctgatccgccgggtgcgccatgcccaggccagcgccggccccgcccggcaggccctcaggcagttcggcgactggctgctggacgccgaccggcgccgcctgatcgaccacgcgggcaacgaaaccctgctcacccatggcgaattccaattgctcggcgctttcctgcgcaacagcgggcataccctgagccgcgaccagttgatggaccagatccgcaaccgcgagtggctgcccagcgatcgctccatcgacgtgctggtcggccgcctgcgtcgcaagctgcgcgacgacccggccgaaccgcaactgatcatcaccatccacggcgccggctacctgttcaccgccgcggccagcgacgcctga

SEQ ID NO: 16418 - DNA, 780 bp, Pseudomonas aeruginosa
gccatgcaggcctgctggctggcgctctgcggatggctgctgggcggcctggcacaggctgcggagaccatccgctattgcgactatccggtatacccgccgatctcctggagcgacggccagcaggtccgggggctggcgccggagctggtgaagcggctgttcggcgcgctgggctaccgggtcgaggtggtggtgctgggcaactggcggcgctgcctgctcgacgccgccgccggacgggtcgacctgatactggcctaccgcacgcccgcgcgcgatcgcgacctggcgttttccgccgagccggtgctgcgcgaggacgtggcgatcttctacaaccgccagcggccggtgcgcatccaatccctcggcgacctcgccggctatcgcggcgggctgttgttcggcgaaagctacggggcggacttcgaccgcttcgtcggccgccacggcaacgtcgaatgggtttccgacagccgacagaacttcggcaagctggtgcgccagcgcatcgactacatcgcccacgaacggcgcaccggcacgctgttcgccgagcgcctggccggcggcgagaacatccgtgcgctgcccgaaccgctgacggtggactacctgcgggtggcggtctcgcggcactcgccgctggcggcgaagatggacgagatcgaccgggccctgcgtggctatcgcgacgacggcagcatccagcgttggctggacgacagcgtgcgcgactatcggcgcctcgccggcaaccgcgcggacgcctggtga

SEQ ID NO: 16419 - DNA, 990 bp, Pseudomonas aeruginosa
tggggcgcctgcacgccctcgacaaacccacagtcgccgccgtcaacggcagcgccgtgggcgctggcatggacctggcgctgtgctgcgatttccgcatcgccgccgcctcggcgcgcttcaaggccggctacaccggcatggcctactgcccggacgccggcgccagttggcatctgccacggctgctcggcagcgaggcggccaagcgcctgctgttcctcgacgaagcctggagcgcggagcgcgctctgggcgccggactggtcggcgaggtggtcgccgacgagcgcctggttgagacggtcggcgccttcgctgcgcgtctcgccagcggcccgaccttcgccttcgcccagaccaagcgcctgctgcgcgacggcgccgggcgctcgctggccgagcagttgcgtgccgagcaggccgccgggctgctctgcgggcgcagcgaggatgccgccgaggcgctgcgcgccgtggccgagaaacgttcccctcaattcagcgggcgctaggcgccgagcaggtgattcccatggatttcaggctgacccaggaacaggacatgctggtcgaggcggtgcgcagcttcgtcgagaaggaactgctgccccacgaggacgatgtcgaccgcgccgacgcggtgtcgccggagctggccgcacagattcgcggcaaggccctcgccgccggtttctatgccttcaacatgcccgaggaagtgggtggcggcggcctcgactacctgtcccaggcgctggtcgaacgcgagctgtcgaaggtctcctgggccctccacgtattcgtcgcgcggccctcgaagatcctcatggcctgcaccggagaacagctcggcgactacctgttgccctgcgtgcagggcgaaaagaccgattgcttcgccctcaccgagccgggcgccggctccgacgccaattcgatcaagacccgcgcggtgcgcgacggcgacgccttcgtgatcaacggtag

SEQ ID NO: 16420 - DNA, 1377 bp, Pseudomonas aeruginosa
aaacctcaagcgcctgctggcacccaggcatctcgccttcattggcggccgtggcatggcgcgtgccctgaaacgctgtgccgaaggcggtttcgccggccagttgtggctggtcaatccgcagcacgccgaactcgaaggcgtaccctgcgtggccagcgtcgccgacctgccgtgcggcccggacgcggcgttcgtcgccaccaaccgcgaactgaccctcgacgcggtcgccgcgctcgccgccaaaggcgccggcggggcgatctgctatgcctccggcttcgccgaaaccggcgaacagggcctggccgtgcaacgccggctgctggccgccgccggcgaaatggcgctgctcggcccgaactgctacggcttgctcgactacctgcacggcgccgcgctatggccggtggcacatggcggtcggcaggtggagcggggcgtcgcggtgctgacgcagagtggcaacttcgcctacaacctgtcgatgagcgaccgttcgctgccggtggcctatatggcatcggtgggcaaccaggcgcagctgggcatcgccgagctgatggacgtgctgctcgacgagccgcgggtgactgccatcggcctgcatctggaagggctgaagaacgtcccggggttcgcccgcgcagcctacaaggcgttgcagaaaggcgtgccggtgatcgccctgaagaccggggtgtcggagatcggcgcggccctcgcgctcagccacaccagttccctggccggttccgacgcgctatacgacagcctgttcgagcgcctcggggtgatccgcgtgagcggcccggtgagcttcgtcgaaaccctcaaggccgccgcctgcggccacctgcctggcgggccgagcctggtcgcgctggcctgttccggcggcgacgccgggttgatcgccgattacgccgagcgcaacggcctggggttgccgtctttcgacgccgaacagcgcgacgaactggccggggtgctgcccgactacgccaacatcgccaacccgctggacttcaccaccgccatctggggcgatgccgcggccctggaggaaatgctcgacagcgctttgcgcagccctgccgacgccgccctgctggtgctcgactatccgggcgaggaaaccggcgagcggccgcagtgcgacctgcttttgcaacgctactgcgcggcgctgaagtgccacggaaaagtcggcttcatcgcctcggcgttcccggaattgctgccggcccgggcccgcgagctgttgcacggcgagggcgtcgccgcgctgcagggcgtcgaggatggtctcgccgcctggggacggatcgcccgctaccgccagcgccgcgcggcgctgctggagcgcggtga

SEQ ID NO: 16421 - DNA, 2424 bp, Pseudomonas aeruginosa
ggcggcgttggtgccgatctgcccagggccgctggcgggcgacggctacctgctcgacgagtggcaatccaagcaggcgctgaaacccttcggcctgccactgccccagggggtgctgagcacccccggccaggcccgcgaagcggccctcgacctcggcttcccgctggtgctcaaggcggtcagcgccgcactgccgcacaagaccgaggccggtggcgtggcgctcggcctacgcaacgaggcggcgttggaggcggcattgttcgacatgcgcgaaagcctggcccggcacgcgccgcaactggtcttcgagcgtgttttattggagcgcatggctggcgcgccgctggccgagctgatcgtcggggtcaagcgcgaggagggcttcggcctggcattggtgatcggtgccggcgggatactcgtggagctgctgcgcgacagtcgcagcctgctcctgccaaccaccgacgcggcgatccgcgatgccctgctgagcctgcgcagcgcgccgttgctcagcggcttccgcggtcgcccggcagtgtgcatggaggccctggtggcggcgatccgcgcggtcgccgaattcgcctgcgaacatgccgagcgcttgctggagctggacgtcaatccgttgctggcggatgccgagggagcgctggcggtggatgcgttgatccggctggccaatggctgaaggccggggggacacgacggctccccctcccgcttgtgggaatgggagcaagagcgctgcggcgcgaacggcgactccgatggtcgccgaactggatgaggatattgcccatgcaaccacagaagaccctcaccgccggccaggccctggtccgcttgctggccaactacggcgtggataccgttttcggcatccccggcgtgcataccctggagctgtaccgcggacttccgggcagcggcatccgccacgtgctgacccgccacgagcagggcgccggcttcatggccgacggttatgcgcgggtcagcggcaagccgggagtgtgcttcgtcatcaccgggccgggcgtgaccaacgtcgccaccgccatcggccaggcctacgccgactcggtgccgctgctggtgatttccagcgtcaaccacagcgccagcctgggcaagggctggggctgcctgcacgagacccaggaccagcgtgccatgaccgcgccgatcactgccttctccgccctggccttgagcccggaacagctgcccgaactgatcgcccgggcctacgcggtgttcgacagcgagcgtccgcgcccggtgcatatctcgatcccgctcgacgtgctcgccgcgccggtggcccatgactggagcgctgccgtggcgcgccgccctggtcgtggcgtgccgtgcaccgaggcattgcgggcggcggcggagcgcctggctgcggcccggcgaccaatgctcatcgccggcggcggcgcgctggcggccggcgatgcgcttgccgcgctgagcgagcgcctggccgcgccgctgttcaccagcgtcgccggcaagggcctgcagccgccggacgcgccgctcaacgccggggccagcctgtgcgtagcgccgggctgggagatgatcgccgaggccgacctggtgctggcggtgggcaccgagatggccgacaccgacttctggcgcgaacgcctgccgctgtcgggcgaactgatccgcgtcgatatcgacccgcgcaagttcaacgacttctatccctctgccgtagcgctcaggggcgatgcccggcagaccctggaggcgctgctggcgcgcctgccgcaggaggcccgcgacgccgcgccggccgccgcgagggtggcgcgcctgcgcgcggatatccgcgcggcacacgcgccgctgcaggcgctgcaccaggcgatcctcgaccggatcgccgccgcgctgccggccgatgctttcgtcagcaccgacatgacccaactggcctataccggcaactacgcgttcgccagccgagcgccgcgcagctggctgcatcccaccggctacggcaccctcggctacggcctgccggccggcatcggcgccaagctcggcgccccgcagcgcccgggcctggtgctggtcggcgatggcggcttcctctacaccgcgcaggaactggccaccgccagcgaggaactggacagtccgctggtggtgctactgtggaacaacgacgcgctcggccagatccgcgacgacatgctcggcctggacatcgagccggtcggcgtgctgccgcgcaaccccgacttcgccctgctgggccgcgcctacggttgcgcggtgcgccagccgcaggacctgaacgaactggagcgcgacctgcgcgccggcttcgggcagcccggcgtgaccctgatcgaactgcggcacgcctgtgcgcgctga

SEQ ID NO: 16422 - DNA, 615 bp, Pseudomonas aeruginosa
ccgccggacaaggagagcatccatgcgctattccgacttcactcaacgtatcgccggcgacggcgccgctgcctgggacatccactatcgcgcgctggcgcgggtcgagcagggcgaggaaatcctcctgctgtcggtcggcgaccccgacttcgataccccggcgcccatcgtccaggcggccatcgacagcctgctggccggcaacacccactacgccgacgtgcgcggcaagcgcgccctgcgccagcgcatcgccgagcgccaccggcggcgcagcggccaggcggtggacgcggagcaggtggtggtgctggcaggtgcccaatgcgcgctgtacgcggtggtgcagtgcctgctgaatccgggcgacgaggtgatagtcgccgagccgatgtacgtcacctacgaagcggtgttcggcgcctgtggcgcgcgggtggtgccggtgccggtgcgctccgagaatggcttccgcgtgcaggccgaggaggtcgccgcactgatcaccccgcgcacgcgcgcgatggcgctgaacagcccgcacaacccgtccggcgccagcctgccgcgggccacctgggaagccctggccgagctgtgcatggcccatga

SEQ ID NO: 16423 - DNA, 1440 bp, Pseudomonas aeruginosa
cctgtggatgatctccgacgaggtctacagcgaactgctgttcgacggcgagcatgtcagcccggccagcctgccggggatggccgaccgtaccgcgaccctcaacagcctgtcgaaatcccacgccatgaccggctggcgggtcggctgggtggtcggtcccgcagcactctgcgcgcacctggagaacctcgccctgtgcatgctctatggctcgccggaattcatccaggatgccgcctgcaccgcgctggaagcgccgctgccggagttggaggcgatgcgcgaggcctaccgccgccgccgcgacctggtaatcgagtgcctggccgacagccccggcctgcgtccactgcgcccggacggcggcatgttcgtgatggtcgacatccgtcccaccggactttccgcccaggccttcgccgaccgcctgctggaccgccatggcgtatcggtgctcgccggcgaagccttcggcccgagcgccgccggtcacatccgcctcggcctggtgttgggcgccgaaccgctgcgcgaagcctgtcggcgcattgcgctgtgcgccgccgagttgctcggccaggcctgaacccctcggccgcgagcgatgcggccggtcaccacgattcggaaaccacgatgaacgtactgatcgtccacgcccacaacgaaccgcaatccttcacccgcgcgctctgtgaccaggcatgcgagaccctggcaggccaggggccacgcggtgcaggtctcggatctctacgcgatgaactggaatccggtggccagtgccgccgacttcgccgagcgcgccgatcccgactacctggtgtacgccctggagcagcgcgagagcgtcaagcgccagagcctggccgccgacatccaggccgagctggacaagctgctgtgggccgacctgctgatcctcaactttccgatctactggttctcggtgccggcgatcctcaaggggtggttcgaccggatactggtgtccggggtctgctatggcggcaagcgcttctacgaccagggtggcctggccggcaagaaggcgctggtcagcctgaccctgggcgggcgccagcacatgttcggcgagggtgccatccacggaccgctggaggacatgctgcggccgatcctgcgcggcaccctggcctatgtcggcatgcaggtgctggagcccttcgtcgcctggcacgtgccatacatcagcgaggaagcgcgcggcaacttcctgcgcgcctaccgggcgcggctggaaaatctcgagcaggatgtacccctgcggttcccgcggctggagcagttcgacgcgctgctccagccgctggcgcgctgacccgggcgacgcgcgccaggccagtcaagccaagacgcccccgaccgggggcgtcttggctcgtgctagtactgctggcgcggcttgctctgtaa

SEQ ID NO: 16424 - DNA, 1587 bp, Pseudomonas aeruginosa
ctgctcggcggcggccttggccaggtccggcgggaggaagtccttgtccggatcgtagtcctgcttcaggtaggcgctgagcgcctccaggtcggccgggctgagggtgccggccgcctgcttcaggcgcagggtatcgaggatgtagtcgtagcggctgttgttgtagtcgcgcacggcggcgtacagctggcgctgggcgttgagcacgtcgacgatgttgcgggtgccgacctggtagccgatctcggtggcttccagcgaactctggttggagatgatcgcctggcgccgcgcctggacctgctcgacgtcggtattcaccgcgcggtgcaggttgcgggtatcctgcaccacctggcggcgctggccttcgcgggattgctcgctctggttgaggcgctggtaggactcgcggacctgggaggaggtcaggccgccgctgtagatcgggatgttcagttccaggccaatgctgcgctcgtcgacatacttgccatagtgcaccagcggattggcggcgctgttggcgaagccgagggcgtcgttgtcgcccttctggtactgggccacggcatcgagggtcggcaggtgcccggccttgcgctggcggagggtttcctcggcggcgttgaccgcgtagttgctggccagcaggcgcaggttctgctgcaccgcggtgtcgacccaggccttggcgtcgttcggcgccggcggcaccaccggcagggtgtggcgcatgccctcgatggcgctgtagtcgcggttggtcagggtcaccagggcctggaaggcatcgtccacgcgctgttcggcgatcaaccggttggcgcgggcggtgtcgtagctggcctgggcctcgagcacgtcggtcttgtcggaaaggcccacgtcgaagcgctcgttggcctggtccagctggcgcttgaaggcggcttcctcggccttgctggtggccaggttgtcctgggcgcggagcaccgtgaagtaggtctcggcgctgcgcaggatcaggtcctgctgggtcgcggagaattccagccgggcctggtcgctggtttccttggcggcctgccactggaaccagcggtcggcgcggaacaacggctggctgagggtggcctggacgacctggctgttgcgcttgacggtcgccggacgctcgtcgaatgcgatccgggtgtctccgacgcgggcgccggcgccgagttgcggcagcaggccggcgcgggcctggggcaccacttccttgcgcgccaggtagtcggcctgggcggcggcgaggtcggcgttgttgtcgacggcttccttgtagacgctgatcaggtcggtcttggtcggcagcggggtcggctgggcggcccaggcgacaccggtagcagcggccacggcggccgccagggagagtctgcgcagcattcgttcgtcctggaaaagatgcgaggtggggcaaggctaaggtcgctaccggtggcggtcaaggcacctgcgcggcaactgatcgaagagccagtccggatcgatgtgccggcgaacgtgcggggatctgcgtcttccctggcgagagggcgccggactggaccatga

SEQ ID NO: 16425 - DNA, 1905 bp, Pseudomonas aeruginosa
ctgaatagagaccccatggctacttacaacgcagacgccatcgaagtcctttccggcctcgacccggtgcgcaagcgcccggggatgtacaccgacaccacccgccccaaccacctggcccaggaagtcatcgacaacagcgtcgacgaagccctggccggccacgcgaagagcgtgcaggtgatcctgcaccaggacaactcgctggaagtcatcgacgacggccgcggcatgccggtggacatccacccggaagagggcgtgccgggcgtcgagctgatccttaccaagctgcatgccggcggcaagttctcgaacaagaactaccagttctccggcggcttgcacggggtcggcatctcggtggtgaacgcgctctcgacccgggtcgaggtacgcgtcaagcgcgacgccaacgagtaccggatgaccttcgccgacggcttcaaggacagcgacctggaagtcatcggcacggtcggcaagcgcaataccggtaccagcgtgcatttctggccggatccgaagtatttcgattcggcgaagttttcggtcagccgcctcaagcatgtgctcaaggccaaggcggtgctgtgcccgggcctgagcgtggtgttcgaggacaagaacaccggcgagcgcgtcgagtggcacttcgaggacggcctgcgctcctacctgaccgacgcggtcgccgagctgccgcgcctgcccgatgaacccttctgcggcaacctcgaaggttccaaggaagcggtgagctgggccctgctgtggctgcccgagggcggtgagtcggtgcaggaaagctacgtcaacctgattcccacggcccagggcggcacccatgtgaacggcctgcgccagggcctgctcgacgccatgcgcgaattctgcgagttccgcaacctgttgccgcgcggcgtcaagctggcgcccgaggacgtctgggaacggatcgccttcgtcctctcgatgaagatgcaggaaccgcagttctccgggcagaccaaggagcgcctgtcgtcccgcgaggcggcggcgttcgtctcgggcgtggtgaaggacgccttcagcctgtggctcaacgagcacgccgaaatcggcctgcaactggcggaactggcgatcagcaacgccgggcgtcgcctcaaggcgggcaagaaggtcgagcgcaagaagatcacccaggggccggcgctgcccggcaaactggccgactgcgccggacaggaaccgatgcgcgcggaactgttcctggtcgagggcgactccgccggcggctcggcgaagcaggcgcgggacaaggaattccaggcgatcatgccgctgcgcggaaagatcctgaacacctgggaagtggacggcggcgaggtgctcgccagccaggaggtccacgacatcgcggtggccatcggcgtcgatccgggtgccagtgacctggcccagctgcgctacggcaagatctgtatcctcgcggatgccgactccgacgggctgcacatcgccacgctgctctgcgcgctgttcgtccgccatttccgcccgctggtggaagccggccacgtctacgtggcgatgccgccgctgtaccgcatcgacctcggcaaggacatctactacgccctcgacgaagccgagcgcgacggcatcctcgagcgcctggccgcagagaagaagcgcggcaagccgcaggtcacccgcttcaagggccttggcgaaatgaatccgttgcaactgcgcgagaccaccatggatccgaatacccggcggctggtccagctcaccctggaggacgccaccggtaccctggagatcatggacatgctgctggccaagaagcgcgccggtgaccgcaagtcctggctggaaagcaagggcaacctggccgaggtgctggtctga

SEQ ID NO: 16426 - DNA, 939 bp, Pseudomonas aeruginosa
atttcaacgcgctgttcgaagggatcgccgtcgaccccgagggcaagcgcctctggctggctgccgagcgcgagcgccgcggcctgctggtggcccaccgcgacaacagtgcctggcgctgcgagggcagctgcgtactgctcgccgagggcggcaagatcgagccgccgccggaactgggcagcgcgcgcaagctgccgaaggatttctccgacctcgccttctaccgcggcaagctgttcaccctggagcgcctggcgcatcagatctgtcgccgcgacctggcccaggccaaggtcgagcgctgctggtcgttcgcctcggcggtcctggcgccggagcgtcgctacgagctgccttatggcgtcgcggaagccctgtcgctggacgacaagggcgcctggctgggcatcgacaatggcgaccatgcgcgcgccgatggcgacgtgcggcccttcgtcctgcgcttcgccgcgcccgccggcggctggttgggggacaagtgacgcaacgggcgcccggtcagcggctgggacggatcatgctggtgctggcctggatcgccgggctggcgctggcgacgcgctatttcggcgtctgggaagatcgacagcgcaacccgaaccaggcgccgcaatcgatccatggcgacggctacgtcgagttgcgcctggccagcagccggcagggccattacctgctgaacgggcagatcaacggccagggcgtgaccttcctgctcgataccggggcgacccaggtggcggtgccggaagccctggcggcaagactcgcgctggagcgcggcgcgccgatcaccctgagcacggccaacggccgcgccacgggctggcgcacgcggctggaccagctgcaactcggcgatatccgcctgtccggggtcgcggcgctgattgcgccgggcatggacggcgatga

SEQ ID NO: 16427 - DNA, 669 bp, Pseudomonas aeruginosa
tggcgcagccgttctcctatcgctatccgctggtggacggccagggcaactggggggcgccggacgatcccaagtccttcgccgccatgcgttataccgaggcgcgcctgtcgcgctattccgaggtgctgctcagcgaactgggccagggtaccgtggactgggtacctaacttcgacggcaccctggacgagccggccgtgctgccggcccgcctgcccaacctgctgctcaacggcaccaccggcatcgcggtgggcatggccaccgacgtgccgccgcacaacctgcgggaagtcgcgtcggcctgcgtgcgcctgctcgaccagccgggcgcgacggtcgccgaattgtgcgaacacgtgccgggcccggacttccccaccgaagccgagatcatcaccccgcgcgccgacctgcagaaggtctacgagaccggccgcggttcggtgcgcatgcgcgcggtgtaccgcgtcgaggacggcgacatcgtcatccacgccctgccgcaccaggtgtccggttccaaggtgctggaacagatcgccgggcagatgcaggccaagaagctgccgatggtggccgacctgcgcgacgagtcggaccacgagaacccgacccgcatcgtcatcatcccgcgttcgaaccgggtcgatgtcgaagagctga

SEQ ID NO: 16428 - DNA, 747 bp, Pseudomonas aeruginosa
ccgtggtgctctcggacaaaggctgggtgcgttgcgccaagggccacgacatcgacgccgccggcctttcctacaaagccggcgaccgctttcatgccgccgcgccgggacgctcgaaccagtatgcggtgtgcatcgactccaccggggcgcagctactcgctgccggccccactgcctgccgtccgcgcggggccagggcgagccgctcaggcggcccggctgacgccgccgccgggggccagcttcgaatgcgtgctgctgccggacgacgatgcgctgttcgtgatcgcttccgacgccggctatggtttcgtggtcaagggcgaggacctgcaggccaagaacaaggccggcaaggccctgctcagcctgcccaacggctccgccgtggtggcgccgcgcccggtgcgcgatgtggagcaggattggctggcggccgtgacgaccgagggccgtctgctattgttcaaggtctccgacctgccgcagctcggcaagggcaagggcaacaagatcatcggcatccccggcgaacgcgtggccagccgcgaggaatacctcaccgacctggctgttctgccagccggggcaacgttggtcctgcaggccggaaagcgtaccctgtcgctcaagggcgacgacctggaacactacaagggagagcgcggccgtcgaggcaacaagctgccgcgcggattccagcgcgtcgacagcctgctggtggatattccgccacaggattga

SEQ ID NO: 16429 - DNA, 981 bp, Pseudomonas aeruginosa
tacgccccttcggccgccgtttccgatggcgggtggccagtagaattcaagtcttgcatcagtagtgccgatcttcggcgaaatacggtggttctcgatgagcgcgtggcgcgtcttcgcatgtctttccctcgtcagcctgctcgggctgacgggttgtgcggtccatccgccggcccagctctaccagttggacgtcggtgccgctgcggtaccgaaaaaggacggcggtgcggccgtcctgctcgggccggtacaactggccgactatctcaagcgcgatgtgatggtgcagcggcaggccgatggtattctcagtctgtccaccgaagcgcgctgggccggcaacctggagaccaatgtcagccagcaactgctgcggcagatgtccagcgagctgggcagcagccgcctggcgctgttcccggaaaaacccggtttcaccccccaggtccaggtgatgctgaccatcagtcgcctcgactccggccccaagcagccggcagtgatcgaggcgcgctggcgcctgttggaccagaagggcgacctgaaggacagccgggtgttccacgaggaagaacagcatcagggcagcatcggcgaccagatccgtgcccagagcgacctgctcaagcgcctggcggcgcagttggccaaggacgtcaagccgatcgccgtggcggccgaggcgccgccgccggcgaccgcgcgcaagccggtggccaagccgaaggtcaaggaagaggaaggtccgaaaatgccactggtggtgccgattcgcaccgacgccgaggtctatcggttctgattgtcgatagccgaccaggagaaagccccgccgaagcggggctttttcgtttcggcgtcagcgtgagcggcgcaacaggaagcgcagggccatgccggcgagcgccagcagcaggcagggcagccagacccagcgcgcctccgattgcagcaccagcaatccgcgttcgctga

SEQ ID NO: 16430 - DNA, 1572 bp, Pseudomonas aeruginosa
tcagggtggtcacgggcgggcgcggtcgtgcatgcgcgccagttggcgctcgagcatcgacggatacggctccagcagacgctcgacgcagcaggctccttccggactggcgatggcgcggatacgggcgcgctcgcggaccaccgcgtcgtcggcgatgctgcgttcgaccagcagcaggttgcggctgtgctggttgagggcgagggcgttctgcacggtttcgttgagcagcaggtcggcctgggtctgttcgctgaggtcttcgccgaggctcaggcccagttgcagttgcaaggtgatgccgctgtcggcgacctcgatctgcagggcatggccgagcgcacgcatcagttcaccgcagcagagcgcgttggtcaggtagtcggcgcggttgtcgcggctgtggaagagaatcaggctgccgccgtcgctgagcgtgtgcaggctgcccttgtactggcgggcggcctgttccaggcagtcgcgatagcgttgcaggagatccaccaggcggctgcgcggcaaccggcgcaactgttcctgggcgccgagctggatcgccagcaccgcactgtgttgcggttcgcgcgcagcggcgggcgctgcgggctgttccccggcttcggctccgttctcgtcgaaggcgtcctggtccagcgggtcttcgtcgatggaggtgaattccaccggcttggtctcgtccagcagggcgtcgcccagcggaatgtcgtcttcctcgaaggccgaggcctcgaccttgcggctgcgcaggtcggcttcgtcgtcttccagcaggatgtcgtcgaagttctgcggcagcggtgcttcttccggctccggcgccggcggcttttccggcaccaggcgctcttccaggtcgcgcgccaggtcgcccagctcgttctgcagttcggcgccgggggccggattgtccggatcacgcaaccagacacgcaattgcaacaagggtgtggaaatctgccgccccaggcgcaggctgaaatacagggcgaggatcagcaggatcaggctgatcaggcccatgctctgcaggctgatcatcatcggctgctgaaactgctgcatgtccaggctgatgcgcaggtgcccggcgatcacttcctggaaggtgatcggcgtcgagtacaggccttcggtggcgccgagcaggctctgcttcggacggctgccggcctcggcgaggatgcgctggtcgacgctgtagatcgccgcatgggccaccagcgggttcttcaccaggttgttcagcagcacgttgaggctgaggatgtcgttggacaccagcaactcggtggcggacgcggcggtctgggtgatcaggctctggcccagggcatcggcctgctgttgcatggcctggcgaaactgcatgcccatgacccaggcgtagatcagcagggccagggccaccaggatcaggctatggctggcgagccgcagggcgatcgggacgcggcgctggcgcaaggcacgaaacagcaggaggaagaaattgtcgggcttgacggacgtgggccgggtcacagggggctcggtcttctgaaatag

SEQ ID NO: 16431 - DNA, 573 bp, Pseudomonas aeruginosa
actggacttccgcgccagcttcaaggagcgcctggcgctgctgcaggggctgtcggaagacgtgctggaggagatcggcgcctcgctgcgtctgaccgagggtgcggaaaccctgttcgccgaactcaagcgcctgggttacaagaccgccatcctgtccggcggcttcacctatttcgcccgtcaattgcaggcgaagctggggatcgactacgtgttcgccaacgagttgcagatcgtcgacggcaaggtcaccggggtggcggtcgagccgatcgtcgatgcccagcgcaaggccgacctgctgcgcgaactggcggcgaaggaaggcctgagcctggagcagaccatcgccgtcggcgacggcgccaacgacctgccgatgctcggcctggccggcctgggcgtggcgttccgcgccaagccgctggtcaagcagtcggccaagcaggcgatctcgaccctgggcctggacggcatcctctacctgctcggctaccgcgaccgcgaaggacgagcctgaggccggcgggcgtctcttgccggcccggcagccacgaaccaggtcggtag

SEQ ID NO: 16432 - DNA, 2244 bp, Pseudomonas aeruginosa
agcggaaaagcaacgggcgcccagggcgcccgttcttcattcgtctcccgaggagaagtcgtagtccatcgcctggctcggcccctgcaggtagtagccctggatgtaggtggcgccggcttgccacagggtggcgaggacgctggcgctctcgacgaaggggacgatgctgagcttctgctgttcgtgcagttcggcgatcaggcccttgaggatctcctggttttccacctggttgaggtcctggacgaaggaaccatcgatcttgatgaattgcacggtcaggtgcttcagcgcgttgaacgggttcagcgagcagccgaactggctgatcgccgcctggcaatgcagggtggccaggccctgggtcagttgcttggcctgcttcagatagctggtggcgtcagcttcgctgatctggaacaccagcgactccggcggcaggcgcgcggccttcagcgccaccccgagccagggcagcaggccggggtcttgcaggctcgcgctggacaggtggacgaacagcttggtctggtgccccttggcgcgatgctcggcgagcagcttaatcgaattgaggatcacccagcggtcgatcttctccgccagcccggcttccttggcggcatgcaggaactccgccggcggcacttcctggccctgcggattgagcaggcgcaggagcacctcgtagttctcgtggctgtcgccgcgcaggctgatgactggctggaacagcaggcggaagctgttggtctccagcgcctgctggaggatcgcgatgacgtcgccgcgctgggcggcggcggcaagctcttccgccgggttgtactgcttgatctgcgacccgcccttgcgtgccgcgtcatcggcgcagcgatgcgcacggttcatcacgtcctgggccttggcggtcttctcgtcgagaccggcgacgccgatgctgagggtggcctgggcgctgcggccgttcagctcgaaaaggtggttctcgactttcttcagcagtcgttgcagcgccgcttgcgcctgctcgggagtcttgcccttgaacagggcggcgaagatcgaatcgccgaaacgcgccaggtcggcttcctcgccgaactgttcacgcatcagtccggccaactggccgagcagcaggtcgatcccggaaagcccgtggtcggcctggagagaggggtagccgttgagatggatataggccagggtcgacggcttgcgggcggtcaccgcctgctgcacggcggcatccatcaggtcgaggaagtggctgcggttgtagagaccggtgaccgggtcctggctgctgacttcgcggagcttttcttccagctcggcgttgtcgacctcgccgcggatcaccacctggatgcagggttcgccgtcgtacgtggcggcggagaggctgatgcgcgccttgaattcctggccgtcgagcttgaccccggtgcaaaccagttcggtctggcgctggtcgttctggtagcccttgaggaaatccttgaaggcgccctggtcgcaggaggcgatcaggtcgatgaccggcaggccttccagttcctcggcgtcctcgtagccgaacagcgccatgtaggagcggttggcgtagatgtgcatgccgtcgtggacgtaggtgatggcgtcgaccgagctgtcgagcagcaactggcagcgtttttccgcctcgcgcagggcgagttcggcggcgcggcgcgcgcggcgttcggcgaggccggccagctcgcggttggcgaccagcaccaggcgctcgtcctcgccttgcggcagggcgtcctgggcgccgagcatcaaggcgtcggtgatggcgtcggagctgttgtcggccaccagctggatgaacgggatgtcgcgcgactggcggcgcaaggtggcgagcgcctcgccgggctcgagacactcgctggtcggcgcggcgatcagcaggtcccagctttgctggagggtttcggcgaggtcctcgggagaggtcagtcgatgtacgcgggtcgcgtggccggcattgcggaacagactgaccaggcgttcggcttcgttctgcgagtcttccagaatcagcaggcggatggttttcttttcgatggccatggaaagggctcagtccgcgtccgggcaggcgcgaaaagacggcgaatggaggggtcggggcaatctacagagacttccagagcgagtcaaaatcttcctcccccgcaggcggccgggccactggcgctgtga

SEQ ID NO: 16433 - DNA, 477 bp, Pseudomonas aeruginosa
acagtgagccgggcagcgtcgcgctctgtatcgacagcagctggctccagggttcgagcacctcggcgagccgtgcaatgttgttctggcgcatctggttgcagcgcgcgcagccgagcagcagcggaatcaggtaggcctgctcgacgctcaggccgggggtgtgcttggccagttcgtcgcgcaccgcgagacgatgcacgccgcgctggctggccaactggtagagctggtggagttccagccaaagcccctcggggaccgggcagtacaactggctggcgcggatcagcggcccgcacaggctgcggatcgcccgctggatgccgaccgcgagcagctgcgcgcggtcgcggctgttgcgcggcgcttcctggaccacgatcagcttgtagccgatggccaggtggttctgcagggcctggcagaggttggcgatcttgcgcggccgttcgtcgaggacgatggcctggttga

SEQ ID NO: 16434 - DNA, 1299 bp, Pseudomonas aeruginosa
agcggcccgcccagccgccgccttcgtcgtcgtagaccacgtaggtcgcctccgggcggtggcccagctcgccgaacagggcttccaggtcggccttcgccggtagcaggccgggtgccgggggttgtccccactgggtgcgtttggggtcgacgaaacgcgcgccggggatatgcccttcggcgtagcgggcggcactggtcaggtcgaccaggatcagctcgggcgcgcccaggcgcggcgcgaggtcgctgggctcgatcaccaatggcaggtcggagaagacggacatgcgagtacccccgggttgaagaagggcagcagtttaacggaaagcgcgcccgaccagtgtgccgggcatgtccctcattccgtgcggcgctggcggccgaactgctggatcgcgcgctcggtgcactgggcggtcttggcgaaggcctgggcatgcaggtcgctgaacggctggccgccgaggtcggccaggaccagcatcaccacccgcgagccgttgcccagcgagcgcagcagcaggtgaggtccggggaacagttggcgcaagggttcgccgagggccggcagcaactggtcctggttgttcgggccgatgcgcagcagggcaggctgctggaacagtttcttcagcagcgggctgctggcaatctccagttgcaatttctcctggcccggttcgagtccggcgctctgctgcgccagcacgtgtacctgtgtgcgatcggccaccagcagcagcatcctttgcaggccgcaggcgcgcagcgcatcgcgggcacaggcggtgagctgcaccacgttgctgaacgggctgggctcgcggagcaactcggcgcaatgctgccgccactcggccagggcttccgccgagggcggcggcgggggcgccgcttcggcacgccagcggctggcctgccagggccagatcaaggccaccgccggatgccacagcggcggccgggcgtgcaggcgcgcgctttgcgcggcgagcatgtgcacctgctgctggacttcggtcagcggctggcccaggtacagaccggtcaggcgctgccagcgcagcatgtgcggcccgtcccagctctggtgcgcggcgatggccaggccattggcgaggagagtgcagttggccggctgggtcagccagcgggcgagatcgggctgggcatcgagttgctgttgctggagcaggggcgactgatggtcgcgggcgatacgcagggctcgaaccagcaggcgacggtcgcaggcgagcaggcgatagccctggatgacccactgcggtag

SEQ ID NO: 16435 - DNA, 1044 bp, Pseudomonas aeruginosa
atggacaataaccagccgatcatcgtcaagcgcgtcaagcgctatgccgccggccaccacggcggctcgtggaagatcgccttcgccgacttcgccacggcgatgatggcgttcttcctggtgctctggctgctgtcttcggccaccccggagcagaagaaggcgatttccggatacttccaggaccccatcggtttcagcgaaagcgccagcccctacgtcatcgacctcggcggcacgccgacgccggcgccggacaagaccctcaatccgcaggttcaggcccagccggactccaacgaaagccggatcagccccgagcaggaccaccaggtcaacgccgatcaggccgagaacctcgccgagcaggttgagcgagagcgtctggcgctgctgctgcaggagttgcagaacaaggtcgacgaaaatccgatgctcaaggacttcaaggaccagatccacttcgagatcacccgcgacggcctgcgcatccagatcgtcgacgccgccaaccggccgatgttcgacctcggcagcgcgcgcctgcagccgtatttcgaggacatcctgctggccatggccgagaccatccgccaggtgccgaacaagatcagcatcagcggccacaccgacgccaagccctatgccggcaacggcgacttcggcaactgggagctatcggccaatcgcgccaacgccgcgcgccgtgcgctggtcgccggcggctatccggaagggcagatcgcccaggttgtcggctatgcctcggcacgcctgttcgacgacaaggacccgctgaacccggtgaaccggcggatcgacatcgtggtcctgacccgcaaggcgcagaaggccatcgaaggcgagaccggcgctcccgaagccagcgcccccgcggctgccccgggcgagcagccgaagccggctgccgaggcaccggcggcgggcgcgcaaccttcgctaccggcggacgaggtgcagaagaagctcaacctgttcgacgacggcggcagcctgaagctggagcagatcaagggcgactga

SEQ ID NO: 16436 - DNA, 1038 bp, Pseudomonas aeruginosa
ggttcagtagtccgtttccggcatgcttgccagaatgtgccggtagctggccatgcgttgcggcatgatgcgcccgtcctccaaggcctggagcagggcgcaacctggttcacggtcgtgcttgcagtcgcggaagcggcaatgtccgagcaggtcgcggaactcgatgaaaccggcctcgacatcgtctcgcgacacgtgccccaggccgaactcacggatgccgggcgagtcgatcaggtcgccgccgccgggaaaatggaacagtcgcgcggtggtggtggtatgggtgcccttgccggtcaccgtggagaggtcgccgacacgtgtgtcgacacctggcaacaaggcattcaccagcgacgacttgcccaccccggactgcccgacgaagacgctcacgtgaccgtccagcgcgccgcgcagttcgtccatcgccaggccattgaaggccgacacctcgatcagcgggtaacccagggtgcggtagacattcagcagcgcatcgatgccttcggcattgctctcgtcgaccagatcggccttgttcagcagcagcagcggctggatgccggcatgttcggcggcgatcaggtaacggtcgatcaggttggcgtgcggttcgggacgcggggcgaagacgatgacgatgcggtcgacgttggccgccaccggcttgagcagcccgcgcatgtccgggcggcacagctcggagcggcgcggcaattgcgcgacgatcacgccgatgccctggttgccggcgcgccagaccacctggtcgccagtcaccagtgccggcaggttggcgcgcaggtgacagcgggaaacctggccgtcggcggactcgacctctacctgaaccccgaaatgagcgatcacctggccggtttgctccggtcccaggtcgccgccctccagctcttccacggcacgcgactcgcgacgggccgcccgggccgcgcgttcttcctggatcttttcgatgcgccagctctgccggcgggtcaagtggcgtttggccatgatgcgtccgcatga

SEQ ID NO: 16437 - DNA, 561 bp, Pseudomonas aeruginosa
cgactggagcgactccccatgcagaacccgcagaaccttatctggatcgacctggagatgaccggcctcgatccggaccgggacgtcatcatcgagatggccaccatcgtcaccgacagtgacctcaacaccctggccgaaggaccggtgatcgccatccaccagccagaggaaatcctcgccggcatggacgagtggaatacccgccagcacggccaatccggcctgacccagagggtccgggaaagcaccgtgagcatggccgaggccgaggcgcagaccctggccttcctcgagcagtgggtgcccaagcgcagctcgccgatctgcggcaacagcatctgccaggaccgccgcttcctctataggcacatgcccaggctggaaggctacttccactaccgcaacctcgacgtctccaccctcaaggagctggctgcgcgctgggcgccgcaggtccgcgagagcttcaagaagggcaacacccacctggcgctggacgatatccgcgagtcgatcgccgagctgcgccactatcgcgaccacttcatcaagctctga

SEQ ID NO: 16438 - DNA, 1533 bp, Pseudomonas aeruginosa
cgccgaatcgatccgatgaccatgaccttccagcacgacgacctgccactcgccctctattccgccgcccaggtgcgcgacctggatgcgcgcctgatcgctgccggcacgccgggcttcgaactcatgcagcgcgccgcccacgccgcctggcgtgccttgcgccgccgttggccggaggccgcggcgctgacggtgctcgccggggacggcaacaatgctggcgacggctacctgatcgcggcgctggcgcaacgtgcgggttggcgagtgcgggtgctggcggtcgcggcgccgcagcggcttgccggcgacgcggcgcaggcgcatgccgccgcgctggcgaccggggtcgtggtggagccctggagcgagtgcgccgtgctcgagggcgtagtagtggatgcattgctcggcaccggcctggcaggtgccgtgcgcgagccctttgcgcaggccatccgcctggccaacgccgccgacctgccggtgctggcggtggatattccttccggcttgagcgccgacaccggcgcggtattgggggaagcgatcagggcggatctgaccgtgactttcatcggcctgaagatcgggctgttcactggcgatgcgccggcacgggtcggcgagctggtgttcgacgaactcggtagcgacgccgtcgtgctgcaagcgctccagccccgggctcgccgcctggcgcgaaatgcccctgccgaggctggcagcgcggccgcggaccgcacacaaggggctgttcggccacctgctggtggtcggcggcgacaccggcatgggcggggccgtgctactggccgccggaaagcgcccctgcgctgcggcgcccgggctggtctcggcggcgacccgcggtcgaacatgtgccgggcgttgttgagccgttgtcccgaggtcatggcccatggcgtggcgtcggcgaaccaactgctgggcccttgccgaacgcgccagcgtgctgttgctcggtcccggtcttggccagcgcgccctgggggcgtagccctgctgagcgctgtccggtcgcgaccgttgccgcaggtctgggatgccgacgcgttgaacctgctggccctggaaccggtcggagcagggccgcggacatggattctgacgccgcatcccggcgaggccgcgcgcctgttgggtcgctcgaccgccgaggtgcaggcggatcgcccggcggcggcgctggaactggcgtgtcgctaccaggcggtggtggtgctgaagggcgccggcagcctggtcgccgcgccggacggacgacttgccgtctgttcccaggggcatccggcgatggctggtgccggcctgggtgacgtgctgtcgggcatcaccggtgccttgctggcccagcacgtggaggcgttcgaggcggcctgcctggcggtctggctgcatgccgccgccggtgagcggctcggcgcccaggggcgtggactggcggcgaccgatctcatacctaccgttcgtcagttgctcgaggagtgcagtccgtgtctgaagtga

SEQ ID NO: 16439 - DNA, 375 bp, Pseudomonas aeruginosa
ttctgctggcctgccaggtcggcgaggttctggccgccgcgcaaatcaagagcgtgcggatctggcgcgctccggacaacacccgtctggtcttcgatctctccggtccggtgcagcacagcctgttcaccctggccgcgcccaaccgtatcgtcatcgacgtcagcggcgcccagctggcgacccagctcaacggtctcaagctcggcaacaccccgatcaccgcggtgcgctccgcccagcgcacgcccaacgacctgcgcatggtcctcgacctgtcggcgcaggtcaccccgaaaagcttcgtcctgccgcccaaccagcaatacggcaaccgcttggtggtcgatctctacgaccagggcgccgacctga

SEQ ID NO: 16440 - DNA, 1482 bp, Pseudomonas aeruginosa
cttcctctatggcaccctgcatcgtgcgctgggcgaggtccgtcccgacgaccagctcgcgccgcccggggcgaccagcctgaccgagccgcgtccgaccggcgctgccgccggcgagttcggcccgcagggcgagatgcgcctggccgagagcgtgctggagagtccggcggcacgggtgggctggagtggcggctcatcggcctccggcggctcctccggctattccgcctatacccggccggaggcgccgccctctctggccgaggccggtggcgcctacaaggcctacttcgcgccgttacccgcgggcgaggcgccagccgcgttgcccgagagcgcccaggacatcccgccgctgggttacgccctggcgcagctcaagggcatctacattttcgccgagaacgcccacggcctggtgctggtggacatgcacgcggcccacgagcggatcacctacgagcgcctcaaggtggcgatggccagcgaaggcttgcgtgggcagccgttgctggtgccggagtcgatcgcggtcagcgagcgcgaggcggattgcgcggaagagcattccagctggttccagcgcctgggcttcgagctgcagcgcctggggccggaaagcctggcgatccggcagatccctgcgctgctcaagcaggcggaggcgacccagttggtgcgcgatgtcatcgccgacctgctggaatacggcaccagcgaccgtatccaggcgcacctgaacgagttgctcggcaccatggcctgccatggcgcggtgcgcgccaaccggcgcctgaccctgccggaaatgaacgccctgttgcgcgacatggaaatcaccgagcgcagcggccagtgcaaccatgggcgtccgacctggacccaactgggcctggacgagctggacaagctcttcctgcgcggacgctgagccttgcagcttcgggcgcaaagcccgaagctatgcgctttgtccaagagcgttccgatgtcttccctgcctcccgccatctttctcatggggccgaccgccgccggcaagaccgacctggcgatggcgctggccgatgcgctgccctgcgagctgatcagcgtcgactcggcgctgatctaccgcggcatggatatcggtacggccaagccttcccgggagctgctggcgcgctatccgcaccgcctgatcgatatccgcgatccggcggagagctattcggccgcggaattccgcgccgacgccctggcggcgatggccgaggccaccgcgcgcggcaggattcccctgctggtggggggcaccatgctctattacaaggcgttggctcgagggcctggccgacatgcccggcgccgatcccgaggtgcgcgcggcgatcgaggccgaggccctgtccaaaggttgggacgcgctgcaccggcaactcgccgaggtcgacccggagtcggctgcgcgcatccaccccaacgacccgcagcgactga

SEQ ID NO: 16441 - DNA, 453 bp, Pseudomonas aeruginosa
gcacgcggctggtacgcggctggacccacctcgaacggcagaaaggcggtatcggtctgcgcggtccgggcgagacccagctggaaaccgaccgacgcctgctgcgcgtgcgcatccgccagatcaagcagcgcctggagaaggtccgcagccagcgcgagcaggctcgacgcgggcgcaagcgcgcggatatcccggcggtctccctggtcggctataccaacgccggcaaatcgaccctgttcaattcgctcaccgcctccgaggtgtatgccgccaaccagttgttcgccaccctcgaccccaccctgcgtcgcctgcaactggacgatctcgggccggtggtgctggccgacacggtgggcttcatccgccacctgccgcacaagctggtggaggccttccgcgctacgctggaagagtcgagcaacgccgacctcctgctgcacgtga

SEQ ID NO: 16442 - DNA, 1215 bp, Pseudomonas aeruginosa
atggagagcgctatggcttggaacgagccgggtgacaactcgaacaacaacgatcgagacccgtggggaggccgccgcggtggtggtggcggcggtggtgaccgcaaggggccgcccgacctggatgaggctttccgcaagcttcaggacagcctgaacgggctgttcggtggaaaaaaacgcagtggcaacggttccggctccggttccggcggcaagggcggtggcctgggcctgttcggcatcggcctggcgatcctcgccgtgctctggctgtacaacgccatctatgtggtggacgagcaggagcaggcggtcatcctgcgcttcggcaagtattacgagacggtcggtcccggcctgaacttctacttcccgccgatcgacaagcgcttccaggagaacgtcacccgcgagcgtgcgtacagcaagcaggggcagatgctcaccgaggacgagaacatcgtcgaagtgccgctgaccgtgcagtacaagatcagcaacctgcaggacttcgtgctcaacgtcgaccagcccgaggtcagcctgcagcaggcgaccgagagcgcgctgcggcatgtcgccggctccaccaccatggaccggatcctcaccgaaggccgcgagcagatggcgaccgaggtgcgcgagcgcctgcaacgcttcctggatacctacaggaccggtatcaccgtgacccaggtgaacatccagagcgcccaggcaccgcgtgaggtgcaggaagcgttcgacgatgtgatccgggcccgcgaggacgagcagcgcgagaagaaccaggccgaagcctatgccaacggcgtggtgccggaggcacgtggccaggcccagcgcatcatcgaagaagccaacggttaccgcgacgaggtgatttcgcgcgcccagggcgaggcggatcgcttctccaagctgctggtggaatatcgcaaggctccggaagtgacgcgcgagcgtctgtacctggacaccatgcaggaagtcttcagccagaccagcaaggtgctggtgaccggtcagcaggggcagaacaacctgctctacctgccgctggacaagatgatcgatggtcgtaacgccgcgcccgctacgggggccggtgcttccgccggtggtggcagcgccagcgcttccgacctggggtcgcggatcgtcaacgatctgcgccagcaagacgcgcgtacgagggagagccgctga

SEQ ID NO: 16443 - DNA, 1215 bp, Pseudomonas aeruginosa
cggcccgccgcaggagaaactcaacaacctgcgccagttcctcggcgagctggggttgagcctcggccgcggcaaggccgcgccgaccccgggcgactaccaggagttgctggagaagatccacgaccgcgccgacttccgcctgatccagacggtcatgctgcgttcgctcagccaggcggtgtacagcccggacaacaatggccacttcggcctcaactacgacgcctacacccacttcacctcgccgatccggcgctacccggacctgctggtgcatcgtgcgatccgcagtgtgatccgctccaaggcggagactccgcacgtgcagcgggccggcgcggcgagcatgcccaaggcgcgtatctatccgtacgacgaattgcgcctggaccagttgggcgagcagtgctcgatgaccgagcggcgtgccgacgaggccacccgcgacgtgaccaactggctgaagtgcgaatacatgcgcgagcgggtcggcgagaccttccctggcgtaatcactgcggtcaccggtttcggtctgttcgtcgagctgaccgacatcttcgtcgaaggcctggtccatgtgaccgcgctgcccggcgactactatcatttcgacgccgtgcaccatcgcctcagcggcgaacgcaccgggcgcagcttccgtctcggcgacaccacggaagtggtagtggcgcgggtcgacctggacgagcggaagatcgatttcgagctggccggaaacgtgctgagcgcgccgatcggacgcaagaagcgcaacggcgacaagtcggcgaacgccggcaaggcgccgaaggggcgcaagggcgcatccgtgcccgaggtcgacctggagccggcgctggccagtcccgacgccgcggtggtgccgcggcgcaaggccggcaaggtgcaggcgctgccgccggtcgcgccggagctgctggcgcaggccgcggagatgctcggcaacaccgacgtgcgcaagagtcgcgaggtgaagcaggcgctgctcgccgaggcgcgtgtcggcggcaaggacaagggcgggaagaagggcaaggtcgttcctgcgggcaagagcgcgaagggcaaggccaaggacggcaagcccgccgctgccgccaagccgggcaagccgaccaagcatcgcaaggggccttccaagccgaaggccgacaacgctccggccgccaccggggcgcgcaaacgtaa

SEQ ID NO: 16444 - DNA, 756 bp, Pseudomonas aeruginosa
ggccaagtcatgagtcagtgggaaaaggtctacggcgtgcatgccgtggaagcgttgttgcgtcatcacccgaagcgggtcaagcagttgtggctggccgaggggcggcatgatccgcgggtccaggtgctcaccgagctggccgccgggttccgtattccggtagggcagcgcgatcggcgcgaactcgacgagtgggcggaaggcgtccaccagggcgtggtcgcggaagtcagccccagccaggtctggggcgaaaacatgctcgaggaactgctcgagcggagcgagggcgtgccgctgctgctggccctggatggcgtcaccgatccgcacaacctcggcgcctgcctgcgtaccgccgatgcggcgggggtgcaggcggtgatcgtgcccaaggacaagtccgcgaccctcaacgccaccgtgcgcaaggtcgcttgcggcgccgccgaggtgatcccgctggtggcggtgaccaacctcgcgcgcaccctggaaaagctccagcagcgcggcctgtgggtggtcggcaccgctggcgaggcggacaagaccctctaccagctcgacctcaaggggccgaccgtgctggtgatgggcgcggaaggcaagggcatgcgccggctgacccgcgagcactgcgacttcctcgccaggttgccgatggccggcagcgtcagcagcctgaacgtctcggtcgccaccggcgtctgcctgttcgagatcctccgccagcgcaccccgctggagtga

SEQ ID NO: 16445 - DNA, 243 bp, Pseudomonas aeruginosa
ggagccaatcacatggcacgtttcttccgtcgtcgtaagttctgccgcttcaccgccgaaggcgtgaaagagatcgattacaaggatctcaacaccctgaaggcctacgtttccgaaaccggcaagatcgttccgagccgtatcaccggcaccaaggccaagtaccagcgtcagctggcgaccgctatcaagcgcgcccgctacctggccctgcttccttacaccgacagccacggccgttga

SEQ ID NO: 16446 - DNA, 882 bp, Pseudomonas aeruginosa
gggatagatcgcatgcgcgcactggctgagttcaccatgcgcggccgcatgcaggccacgctcgccgtggcaggctccgcggttgttccactgttgttctggctgagtgccgccgccggtagcctggtgctgctgcggcgcggattcggcgacgccttcggcgtcctggcctgggcggtgctaccggcgatgttctggtggtacctgggcgatccgagcatccttctggtcctgctcggtaccctgacgctggcgcagattctgcgcgccagcacgtcctggagccatgtgctgctgggcagtgttgcagttggcgtggtattcgcgctggtgctggggcatacctccagcgagctgatcggcgccctggcgacggaagtcaccaaggtcctgacccagcttcgcggggagtcccagctgtcgggcgaagagctggacaagttgcaggtggcgctggtgccgaccctgaccggggtcatggcttcctcgctgcaggtgacctgcctgctctgcctgatgctcgcgcggtactggcaggcttcgctgtacaacccgggcggcttcggccgcgaattccggagtttgcggctggcgccggcggttgccgtgatcctgctactgggggccgtcgtggtcccggcgctggaagtgcaggccgcggtgctcggtccgttgtgcagcgtgccgctgatcatcgccggcgtggcgctcgggcatggcctgatcgccctgaagcgcctcgcgggtggttggctggtgggcctgtacctggctgtattgctgctggggaacctgatctgtcttttggcggttgtcgacagtctgtttgattttcgtggacgcctggcccggcgccagggttccacgaacggtgaaggttaa

SEQ ID NO: 16447 - DNA, 468 bp, Pseudomonas aeruginosa
aagttaagaggtaagactcaaatggaagtcatcctgctggaaaaagtcgccaacctgggcaacctgggcgacaaggtgaacatcaagggcggttacgcccgtaacttcctgctgccgcagggcaaggccaccgtcgccaccgccgagaacgtcgctgcgttcgaagcacgccgcgccgagctggaaaaggctgccgccgagaagaaggccgctgccgaagcccgtgctgcccagctctccgagctggtggtaaccctcggcgcccacgctggcgacgaaggcaagctgttcggttcgatcggcacccgcgacatcgccgaagccgtttccgctgccggttacccgctggaaaaagccgaagttcgcctgcccaacggcgcgctgcgcaacaccggtgagttcgacgtcgccgtgcacctgcacaccgacgtggaaaccactctgaagctgatcatcgtcgctgagtaa

SEQ ID NO: 16448 - DNA, 450 bp, Pseudomonas aeruginosa
ccctctccggagcagttggagaaggaaggacaactggcccaggtcggcgggcctggcctatctcggcgaactggcgaagaacattccctcggtcgccaacatcaaggcctacgcgcagatcatccgcgagcgcgccaccctgcgccaactgatcggcatcagcaacgagatcgccgacagcgccttccacccggaagggcgcggcgccaacgagatcctcgacgaggccgagcggaagatcttcgagatcgccgaagcgcgaccgaagactggcgggccggtagggatcagcgatatcctggtcaagaccatcgaccgcatcgactacctgttcaacaccaccgaggcgctgaccggggtgtccaccggtttcaccgacctcgacgagaagaccagcggcctgcagccggccgacctgatcatcgtcgccgggcgtccgtcgatgggtaa

SEQ ID NO: 16449 - DNA, 1107 bp, Pseudomonas aeruginosa
gcacccgtttcagttgcaggacccgatgccatgcgtcccctcgttgccaccgtcgacctttccgccattcgccacaactatgccctggccaagcgctgcgcgccgcagcgccaggcgttcgcggtggtcaaggcgaacgcctatggccacggtgcgcgcgaagtggttaccgcgttgcacgacgatgccgatggcttcgccgtggcctgcctggaggaggccgcggaagtccgcgccttgcacgccagcgcgcgcatcctgttgctggaaggctgcttcgaggcgagcgaatacgccctcgccgggcaattgcgcctggacctggtgatccagggcgcggaacagggcgaggcgttcctcgccgccggcctggatattccactcaacgtctggctcaagctcgactccggcatgcaccgcctgggcttcgatcctgccgcgctgcgcgcctggcatgcgcgcctgcgcaaccatcctggtgtgcgcgagctgaacctgatcagccatttcgcctgcgccgacgaacgcaaccatccgctcaccgagcagcagctggagagtttcctcggcctgctcgacctggatttcgaccagcgcagcctggccaattcggcggcggtgctgactatcccggccgcccacatggactggctgcggccgggaatcatgctctacgggtcgaccccgctggccgacctgagcgccgccgaactgggcctgaggccggccatgagcctgggcgcgcagttgatttcactgcgcgaggtggccgtgggcgagagcgtcggctacggcgccacctggatcgccgagcggccggcgcggatcggcacggtcagttgcggctacgccgacggctatccgcgtaccgcgccagccgggactccggtactggtcgggggacgccgcgcgaccctggccgggcgggtctcgatggacatgctggcggtcgacctctccgacctgccggaggctcgcgttggcgacccggtggagttgtggggcgccgggttgtcggtggacgaggtcgcccgtgcctgcggcacccttggctacgagcttctgagcaaggtcacggctcgggttccgcgacgctacagccactga

SEQ ID NO: 16450 - DNA, 429 bp, Pseudomonas aeruginosa
agtgatccaggtcgatcagcagcagcgccatgctgttaccgtggcggcgcgcgtcgtccagggcgctttcggcgaactccatcaggtgcctgcggttgccaagcccggtcagcgggtcgtgatgggcggcgtactgcagttgcgcttcgcgcatctgcaactggcgattggcctcgctcaactcgttggtacggacttccacggcgcgtgccaggtcgcgctgggcgctgtgcagcagggccaggcgcgcgttcttttcctggtcggcctggtccagggccagggccctttcctgcttcagatcctggatgcgcgaggcgagcgccagggagaacagcagggcctccagggtcagcgccagcgggaagaccatggcgttggccgaggtcggctggaccagcgcggtggcgcgcatcacgccaaggctga

SEQ ID NO: 16451 - DNA, 966 bp, Pseudomonas aeruginosa
gggacggatcatccagaaccgctcgcacgactcgatcatccgcgagatcgaggagatgcgcgacaaggtgcccggcttcaccggcgtggtctccgaccttggcggaccgacggcgaacatgtaccgcatcgcctgcaagagcccggacatcgagcggcactgccgcaagccatcctgcgtgttccccggcatctgcgagaacctcgataccgaccacagctcgctgatcgagctgtaccgcaaggcccgggcgctgccgggggtgaagaagatcctgatcgcctccggcctgcgctacgacctcgccgtcgagtcgcccgagtacgtcaaggaactggtgacccaccacgtcggcggctacctgaagatcgccccggagcacaccgagcgcggtccgctggacaagatgatgaagccggggatcggcacctacgaccgcttcaagcagatgttcgagaagttctcgaaggaagccggcaaggagcagtacctgatcccgtacttcatcgccgcccatcccgggaccaccgacgaagacatgatgaacctggccctgtggctcaagcgcaacggcttccgcgccgaccaggtccaggcgttctatccttcgccgatggccactgccaccgctatgtatcactcgggcaagaacccgctgcgcaaggtcacctacaagagcgatggcgtgaccatcgtcaagagcgaccagcagcggcgcctgcacaaggccttcctgcgctaccacgacccgaaaggctggccgctgctgcgcgaggcgctggagcggatggggcgcgccgacctgatcggcaatggcaagcaccacctggtcccgacctaccagccggataccggcgaataccagagcgctcggcggaagaactcgacgccggccggcagcaagaaggccggcaagctgctgacccagcataccggcctgccgccacgcgccagcgacggtggtaa

SEQ ID NO: 16452 - DNA, 729 bp, Pseudomonas aeruginosa
gcaattgcgccagcgccaggccctggtggaacggcagatccaggagaacggcgtcacctacaacgtttacgccgatcccaagggcaccgaccgcccctgggcgctggaccttctgccgaacctgctgtccgccgccgagtggcagccgatcgccgctggtgtggcgcagcgtgctcggctgctcaatgcgctgctggccgacctgtacggcgaccagcgtctgctcgccgaagggctgctgcccagcgaactggtcttcggccatccgaacttcctctggccggcgctcggcatccggccgcccggcgggattttcctgcacagctatgccgtggacctggcgcgcgatgccgacggacgctggcaggtccttgccgaccgcacccaggctccgtccggcgcgggctatgcgctggagaaccggcagatcgtctcgcgggccttgccggaactctatcgcgacctgcgcgtgcagcatctcgccgggtatttccgcaccctgcaggagaccctcgccagccaggccgccggcgacggcgagacgccgctggtggtgctgctgactcccggacgtttcaacgaaacctacttcgagcatctctacctggcgcgccagctcggtttcccgctggtcgaggggcacgacctgacggtgcgcgacgccaccctctatctcaagaccctcggcggcctgaaacgggtgcacgcggtattgcggcgtctcgatga

SEQ ID NO: 16453 - DNA, 1218 bp, Pseudomonas aeruginosa
cgacttctgcgacccgctggaattgcgtaccgactcggcgctgggcattcccggcctgctcgaggcggtacgccaggggcgcgtactggtggccaacgcgttgggcaacggggtgctggaatcgcccggcctgctcggcttcctgccgcaggcctgtcgccgcctgctcggcgaggagttggcgctgccctcgctcgacacccgctggtgcggcgagccgcaggcactcgaggcgatactcgcggcactgcccgacctggtgatcaagccggcctttcccggccagcgctgcgaacctctgttcggccacgccctcgacggtgccggcctggcgtccctcggcgagcgcttgcgcgagcgcccgcaggcctacgtggcgcaacgcctggcgcagttgtcccaggcgccggtctggcgcgacggcgaggccggcgtcggcctgcagtcgcgggccatcggcatgcgcgtgttcgccgtcgccgccgccgacggccgctactgggtgatgcccggcggtctgacccgcgtagcctcggcggcggatgccgaggtggtgtcgatgcaacgcggcggcgcgagcaaggacacctgggtactggccgagcgtgcggtcggcggcgagccgtggcggccgcgccggctcggcgtgcgcgacctggtccgcgaggatccctacctgccgtcgcgggtggtggaaaacctgttctggtacggccgctatgccgagcgttgcgacgaccacgcgcgcctgctgcgggtggtgctgtcgcgctacgtggatgccgatggcgacgaagaggcgctgcgcagcgccctggccctggccggcggcatcggcctgctgcccggggatggcgagccgttggaaaggtgcctgttgcgggcgttgctcgacgagcactggccggcgagcctgtgcgccaacctgcggcgcctgcactgggcggcggcgcaggtgcgcgggcgcttgtccggggagaactggctggccttgctggagctgcaacgcgacatgcaggcgctcgatccggcacgcaccgacctcggcgaagcgctggacttcctcaaccggctagtgatgtccctggcagccttgtccggtttcgccctcgacgacatgacccgcgacgacggctggcgtttcctgatgatcggccggcgcatcgagcgcgtgcgcttcttcgccgagagcatcgccgccttcctcgacggcggtag

SEQ ID NO: 16454 - DNA, 1251 bp, Pseudomonas aeruginosa
cagcggcatcacctaccgctcgcgctacctggcgtcgccgcaactggtcccggtgctcgacctgctcctgttgcacgagcagaacccgcactcgctgcgcttccagttgcaggccctggagcgttcgctggagcgcctgcacgaggagttcggcgcgccacgcgagcgggaactcaggaccctgggcgaacgcctgcgcagcttcgatctggcggccctggaaagcccgctgttcggcgcggcaggactcgacgaggtgctcgtcgggctggcgcgactgctgcgcgacatcgccgcctgcgccggacaggtctccgatcggctaggcttgcgctatttcgcccatgtcgacgatgtcagccagagaacggtatccacctgatgtccgcacccgcgcttcgctccgttccgctccagggcgcccgctaccaggtgctgcacgacacccattaccgctatgcgacgccggtctcgctgtcgcggcaactggcgcatctctggccacgcgaatgcgcctggcaggcctgtcatgagcgggcaattgctgatcgagccgggggccgagcccggccgcgaggatgcccacgacgcattcggcaatccgctgagccgggtggccttcgagcgtccccacgaggcgctgcgggtcagcgcgcgactgcaggtcgaagtgttcgcccatgcgccggcgcaactgaccgcgtcgccggcatgggaaaccgtcgccgccgggctggcattttccgggcgggcgctgtccgccgccgagctggaagcctgccgctatcgcgtcgagtcgccctatgtgcgcatccagcggcgattcgccgagttcgccgccgactgcttcccgcccggacggccgttgctggtggcggcggcggcactgatggagaagatcttccgcgagttcgccttcgatgcgcaggccacccaggtggcgacgccgctggacgaagtgctggagcgccgtcgcggggtctgccaggacttcgcccacctgatgctcgcctgcctgcgcgcgcgcggactggcggcgcgctacgtcagcggctacctgttgacccgcccgccgcccgggcaggcgcgactgatcggcgccgacgcctcgcatgcctgggtctcgctgtattgcccggagaacggctgggtggatttcgacccgaccaacgacctgttgcccgacctggagcacatcaccctggcctgggggcgggatttttcgcgatgtgtcgccgctgcgcggggtga

SEQ ID NO: 16455 - DNA, 966 bp, Pseudomonas aeruginosa
cttttccagaatccgctacggacgttgtcgggccaagggccggagcctgcctttccggtgccaggggcggttctcgtacggagccagactccttccttgcgcacggtgagcgatatggatgacacgacgatcgtcaacgtaggtaccgagaagatcaacgcgctctgggcgatggtgtcccagtacgccttcgccttcggcatcaagattctcgcggccatcgccttctgggtgatcggtcgttggctgatcggcttcgccgtcggcatggtgcagaaatccctcgagcggcaaaaggtcgatcccaccgtgctgcgctacgtgggttcgttcatcacggtgaccctgaacgtgctgctggtggtgggcatcctcggtttcttcggcatccagaccaccagcctggcggcgctgatcgcggcggtcggcctggccatcggcatggcctggtcgggattgctggcgaacctggcggccggcggcttcatcatcgtcctgcggccgttcaaggtcggcgacttcatctgcgccggcggagtgaccggcacggtcaaggagatcggcctgttcaccacggcgatcaacactccggacaacgtgctgaccatggtcggcaacaacaagatattcggcgacaacatccagaacttcacccacaacccgttccgccgggtcgagttgaaggcgcagctttccggtgccgccgactaccaggcggccatcgccctgctcaagcagcgcgtcgcggcgattcccaacgtgctcggcgagccgccggtggacgtggagatcctcgagttcaacctggtcgggccggtgctggcggtgcgcccgtattgccacaacgaccattactggcaggtctatttcgataccaacaaggtgatcaaggacgccctcggcgccgacttcccggcaccgatgccggcgcagacggtgatcgtgcagcagtccgccggcgcctga

SEQ ID NO: 16456 - DNA, 753 bp, Pseudomonas aeruginosa
tgcgggcctgcaaccgtcgccgcagccggccgggtttcatcgggaaaaggattccgtgtgttcttcagattgctcttgatcgccgtcctgctggcggtatccgcgtgcagctccaaggctcccggcccgggggcgtcggtgccgaaggtcgtgcgcggcgagtatcgcgtcaagcgcggcgacaccctctattcgatcgccacccggcacggctggaactacaaggacctggcgcgcgccaacggcatccgcccgccctacgcggtcaaggtcggccaggtagtgcgcttcgacgggcgcaagtcgacctacgtcgccagcagccgctcctcgtcgagcagccgtgcgcgcaagccgccgcctccgccgccgtcggtgaccctgcgcggctggcagtggccgatgaaggggccggtgatccgccgcttctcaagttccgacaagctcaacaagggcatccgcatcgccggcaccctgggccagccggtacaggcctcgctggccggcaaggtggtgttcgcggtgaacaacatgcgtggctacggcaacctggtgatcatccagcacggtacctcgtacaccagcacctacgcgcacaacagccgcttgctggtgaaggaggggcagatggtcagcaagggccagaagatcgccgaggccggttcctcggatgccgaccgggtgcaactgtacttcgagatccgccagaacggccggccgctcgacccgctgagcctgctgccgccgtcctga

SEQ ID NO: 16457 - DNA, 378 bp, Pseudomonas aeruginosa
agggctggcggtaccggaggcctggtgcctgccggaagtgaaggacgaactgcactgctatggcggcgaacgccaggcgggctgaagagaggagtgacgatgagttcagcggaagtattggccagcgtggatatcgtggcgttgcgcctgaaccccgggcacggactggagctgttgctgatccgccgcgcccaggcgcctttcgccggccagtgggccttgcccggcgtgctggtcaacggccgcagcgccgaccacagcctctacgacacggcggtgcgcccccctgcgctaccaggcgcgggctggagccggcttacatcgagcaggtgcccacggtcggcaacgcggtacgcgacccgcgcggctggtcgctga

SEQ ID NO: 16458 - DNA, 252 bp, Pseudomonas aeruginosa
ctgctgcatcacgctgaccgcgctgctggcgcctgcctgcagggcttcgatcatctcgcggatggtttcggtggccttgtgcgtattggtggccaggctgcgcacttcatcggcgaccaccgcgaacccgcgtccggcctcgcccgcccgtgcggcttctatcgcggcattgagggcgagcaggttggtttgctgggcgatgttctggatgacttccagaacggtgctgatttcctcggtcttgttgcgtag

SEQ ID NO: 16459 - DNA, 318 bp, Pseudomonas aeruginosa
gaaagcaggaagcgggtggacagctctacctgttgcaggatgcgtcgtacctcggccaggtacagctcgccggccggggtcagttgcaagcgcttgcgcacccggcggaacagggcgtgctgcagttgctcctcgagttgcgcgacctgcttgctcatggcgctctgggtcaggctcaactcttcggcggcgcgggtgaagctcaggtgccgggctaccgcttcgaagcattgcagggcggtcatcgacggcaggcggcgtttgttcagcatggcgggtttcctggcgcgggtggagcgggcggaacgcgttatatga

SEQ ID NO: 16460 - DNA, 1287 bp, Pseudomonas aeruginosa
tttccaataacaaagataaaaacggaaaggagggctaaagttcttgtggccggccactcaggaaaaaaacgaatggcacgccgcttgctctgcctgttgagcgaaacacaacaacaacatcgtagttacgagcgccaacatcatcctcaggagcaacaccccatgtccaagaagctgttcagaaaaggcatcctggctctcgcggtttcatccgtgatgggtctttccacgcatgcgctggccgacgtcgtgatcggcgtggccggaccgcataccggcgccaacgcctccttcggcgagcaatactggcgcggcgcgtcccaggcggcggaagacatcaacgcggcgggtgggatcaacggcgagaagatcaagctggtcaaggccgacgacgcctgcgaaccgaagcaggccgtggccgtggccaaccgcctggtggaccaggacaaggccatcgccgtggtcggccatttctgctcttcttcgaccatccccgcatccgaggtctacgacgaggccgggatcatcgccatcacccccggttccaccaacccgcaggtcaccgagcgcggactctccgggatgttccgcatgtgcggccgcgacgaccagcagggcgtggtcgccggcgactatatcgtcaacgtgctcaaggccaagaaggtcgcggtgatccatgacaaggacacctacggccagggcctggcggacgccaccagggcgcaactgaacaagctcggcgtgaaagaggttctctacgagggcctgactcgcggcgagaaggacttcaacgcgctggtcaccaagatccgcgcctccggtgccgaggtcgtctacttcggcggcctgcatccggaagccggtccgctggtacggcagatgcgcgaacagggactgaccgccaagttcatgtccgacgacggcgtggtcaccgacgaactggcgaccaccgccggcggtccgcagtacgtcaagggcgtgctgatgaccttcggcgccgacccgcggctgatccccgacggcaaggcggtggtggagaaattccgtgccggcggtttcgagccggaaggctacaccctctactcctacgcctcgatccagtccctggcggcggccttcaacggcgccggcgccaacgatccggccaaggccgccgagtggctgaagtcgcatccggtgcagaccgtgatgggcaagaaggaatgggacaagaagggcgacctgaaagtctccgactacgtggtctacgagtgggacgacaagggcaagtaccaccagttgccctga

SEQ ID NO: 16461 - DNA, 918 bp, Pseudomonas aeruginosa
aaaatggacggcatcttcctccagcaaatgatcaacgggctgaccctcggctcggtctacggcctcatcgccatcggctacaccatggtctacggcatcatcggcatgatcaacttcgcccacggcgaggtgtacatgatctccgcctacctgtcggccatcgcccttgccctgctggccttcttcggcctgcagaacttcccgctgctgatcctcggcaccttgctgttcaccgtgctggtgacctgcacctacggctgggtgatcgagcgcatcgcctacaagccgctgcgcaactccacgcgcctggcgccgctgatctcggcgatcggcatgtcgctgatcctgcagaactacgtgcaggtggcgcagggaccgcgccagcaggggatcccgaccctgctcgacggcgccctgaaattccacgtcggcgacggtttcgtccagctcacctacaccaagctgttcatcctgatcgcttcgctgatcggcatggcggtgctgacctacgtgatccgctacaccaagctcgggcgcatgtgccgggcgacccagcaggaccgcaagatggcttcgatcctggggatcaacaccgaccgggtgatctcctacgtgttcgtcatcggcgcagcgatggccgccctggccggggtgctgatcaccatgaactacggcaccttcgacttctacgccggcttcatcatcggcatcaaggcgttcaccgcggcggtgctcggcggcatcggctcgctgcccggggcgatgctcggcggcctggtgctgggagtggccgaggcgcagttctcggggatggtcaacaccgactacaaggacgtgttcgccttctcgttgctggtactgatcctgatcttccgtccccagggcctgctcggccgcccgcagatcgccaaggtgtaa

SEQ ID NO: 16462 - DNA, 2157 bp, Pseudomonas aeruginosa
ggggacgacgatgagcaacgagacttccatcgatctcaagcagtgcgtcctcgatgccgtgctctccgggttgatcgccctggtggtgttcggccccatcgtcggcgtggtcctcgacggctacggcttcaacctgcattacgagcgggtcggctggatcatcgcgatcgtgatggccgggcgcttcctgctcatcctctacctgcagacccgcggcgggcgcgccgtgctggagcgcttcgagggggctggcagcggcgtccacgtcctgccgccgggctacaagacccgcttgcgctggatcgtgccgctgatcctggtggccgcggtgatcttcccgttcttcgccagcaagtacctgctggcggtggtcatcctcggcctgatctacgtgctgctgggcctgggcctgaacatcgtggtcggcctcgccgggctgctcgacctcggctacgtggccttctacgccattggcgcctatggcctggcgctgggctaccagtacctcggcctgggcttctggaccgtcctgccgctggccgcgctgaccgccgcggtggccggggcgatcctcggcttcccggtgttgcgcatgcatggcgactacctggcgatcgtcaccctgggcttcggcgagatcatccgcctggtactgaacaactggctgtccttcaccggcgggccgaacggcatgccggcgccggcgccgaccttcctcggcctggagttcggccgccgggccaaggatggcggggtgccgatccacgagttcctcggcatcgcctacaaccccaacatgaagttcctgttcatctacgtggtgctgttcctggtcgtgctgctggtgctctacatcaagcaccggctgacccggatgccggtcgggcgcgcctgggaggcgctgcgcgaggacgagatcgcctgtcgcgcgatgggcctcaaccatgtgctggtgaaactctcggcgttcatgctcggcgcctccaccgcgggactggccggggtgttcttcgccagctaccagggcttcgtcaacccgtcctcgttcaacttcttcgagtcggcgctgatcctcgccatcgtcgtgctcggcggcatgggctctacggtcggggtggtgaacgccgccttcgtcctcaccgtggcgccggagctgctgcgcagcttcgccgacatccgcgtgctgctgctcgggatactcatggtggtgatgatgatctggcgggcgcgcgggctgatccgcatcagccgggtgggcttcgccccgcgcaagggggtggcgccatgagcgacaagatcctcagcgtcgagcacctgatgatgcacttcggcggcatcaaggcgctcaacgacgtcaacctcgacgtcgagcgcggttcgatcaccgcgctgatcggccccaacggcgccggcaagaccaccgtgttcaactgtctcaccggcttctacaaggccaccggcggcaacatcctgctcaacacccaggggcgcaccacggacgtcatccaggtgctcggcgagccgttccagctggacgacttcgtcaagccgccgcaactgggcagtcgcctctactacaagatgttcggcggcacccacctggtgaaccgcgccgggctggcgcggaccttccagaacatccgcctgttcaaggacatgtcggtggtggagaacctgctggtggcgcagcacatgttcgtcaaccgcaacctgctcgccggcatcctcaacactcccggctatcgccgcgccgagagcgaggcgctggaccacgcgttctactggctggaggtggtcgacctggtggactgcgccaaccgcctggccggcgagatgtcctacggccagcagcggcgcctggagatcgcccgggccatgtgcacgcggccggaactcatctgcctggacgaaccggccgccggcctcaacccggccgagacccacgccctgagcaacatcgtccgctacctgcgcgaccaccacgggatcaccgtactgctgatcgagcatgacatgggcatggtgatgaacatctccgaccacatcatcgtgctcgaccacggcgacgtgatcgcccgtggcaaccccgaacagatccgccatgacgagaaggtgatcgccgcctatctcggtgccgacgaaaaggagctgtcatga

SEQ ID NO: 16463 - DNA, 1068 bp, Pseudomonas aeruginosa
  unsure (959): Identity of nucleotide at the above locations are unknown.
gcggcagcggcgaagaactgctcggcaaccaggaggtgcgcaacgcctatctcggcggacattgagcgcgccccgcctcggcgctctggccgccggggcgggcgctgtcctgcagcgacggaggaaactcgacttatgcacagcctgcgctttttcagcaacgccgaggtcgccgagcgcctgtcttatccacaactgatcgaggcgttgcgcatcggcctggccaagccttgcagtgcgccgctgcgcagctgccatgccttgccggcgcaggcctcgctgctacagatgccggtgtggcaggccggtgaggggatcggcgtgaaactggtgacggtgttccctggcaatggggcgcgtggcctgccggcggtggccgcggtgttcgctctgttcgacggcgaagacggtcgcccgctggcgttgctggaggcttcggagctgaccgcccggcgtaccgcctgcagctcggcgctggccgccgactacctggcgcgggacgatgcgcggcgcctgctggtggtcggctgcggaaccctggctgcgcacatggtgcgggcccacgcctgcgtgcgcgactatcgccacatcgacatctggggccgcgatccggccaaggccgccgcgctggccgcccggctgcgcgaggagggctacccggcgcgagcggccgacgggttgcgcgcggcggtggaggcggccgactgcgtcagttgcgttaccacctcccgcgaagcgctggtgcgcggcgcatggctgaagccgggcgtccatctcgacctggtcggcgccttcctgccgtccatgcgcgagaccgacgccctggcggtggcgcgcgcgcgggtcgtggtggatacccgcgcaggcgcgctggaagaagccggcgacctgttgcaggcgatcgccgaaggcgccatcgggcgcgaggcgatatccaccgaactgcgcgacttgctgancggggcagggcggcgcggcgatcccggggaaatcaccctgttcaagtcggtgggttatgcgctggaggacctggtccccgcgcgccgggttgtggataacgccgcctga

SEQ ID NO: 16464 - DNA, 609 bp, Pseudomonas aeruginosa
cgaaatacagacgaggtgaacctcatgtgggacaaacgctatgccgccgaagagtatgtctacggaaccgaacccaacgctttcctgaaggagcatgcgcagcggctggccgggccggtgctgagcgtcgccgagggcgaggggcgcaacgcggtgttcctcgcttcgctggggctggaggtgcttggcgtggacggctccaccgtcggcctggccaaggcgcgccggctggccgaggcgaaaggcgtgtcgatcgacaccctggtggtcgacctggcggactacgaaccgccggcagcggcgttcggcgcggtggtgtcgatcttcgcgcacctgcccagtcgcgtgcgcggcagactcaaccgcctgctggagcgttcgctgcgaccgggcggtctcttcctgctggaggcctatcggccggaacaactcggccgcggcaccggcggcccggcggacgtcgacatgctggtgagccgtgcggcgctggaggctgagctgccggagtgcgaagtgctgctggcgcgggaaatcgagcgcgaggtggtcgagggccgtttccacaccggcgcggcctgcgtggtccagttcatcgccaggaagaggtag

SEQ ID NO: 16465 - DNA, 2205 bp, Pseudomonas aeruginosa
tcaaggattcgacgcatgcaatggattttcatgctggtgggcctgatcctcggcggcttcgccggggaatcgctggtcggcgccctcctcggcggcctttccggcctggccctgggacaggccgtctcgctgcagaacctggcgcaacagaacgagcgcctgcgcaagcagatgagcgaattcgccgaacgcttcgagcgcggcaccgaggtcatccaccagcgcttgctgcgcgtggagcgccaggcgcaggaccttcccgaaagcgttcccgagccggccgccggtatcgaccagccgctcgcagacacgcctcccgctcctcccgccgaggttgccccgccgctggactgggacatcgagctgccggccgtcgaggctgcgccgcctccgccttgtccccccgagcccgtccagcccatcgagcgtcagccggcgttccagcctgacgcccagccagcgccgcgccgtgccgcccctccagcgtctccacgcgaaccctcgctggtcgagcgtggcttcgccgcggccaagggctggctgttcggcggcaacacggtattgcgcatcggcgtggtgctgctgttcatcggcctggccttcctcctgcgctatgcctcggaacgggtggcggtgccggtggagtaccgctacgccggggtggcgctggcagcgatggcgctgctcggcgtcggctggtggctgcgcgagcggcgcgccgcctacggcctgatcctgcaaggcaccggtatcgcggtgctgtacctgaccatcttcgccgccatgcgcctgcatccgctgatctctcccggcgcggcgctggccctgctggtggtggtgatgatctgctcggcgatcctcgccgtgctgcagaacgccatgggcctggcggtggtggcggcgctcggcggcttcgccgcgccgatcctgacctccaccggcagcggcaaccatgtagcgctgttcagctacttcgccctgctcaacgccggcatcttcgccatcgcctggttccgcgcctggcggccgctcaacctggtcggcttcgtcggcaccttcggcatcggcttcgcctggggactgcgctcctatacaccggagctgttcgccagcaccgagccgttcctggccctgttcttcctgatgtacgtcgggatcggcctgctcttcgcccgccgcaagctgctggaggccgcgcaggcgcctgccgagcgcggcgaactgctgcgctggtcggcgcgacaggccgactacatcgacgccaccgtgctgttcggcccgccactggtggggttcggcctgcaatgcgcggtgatcggccacatcgacttcggcatggccttcagcgccctggccctggggctcttctacatggtcctggcgcgggtgctgcgcggccatgcttcggccggacgcaccagcctgctggtggaaatctgcctggcgctgggggtggtcttcggcaccctggccattccgctcggcctggacgcgcgctggacctcggccgcctgggccgtcgagggcgccggcatctactggctcggcctgcaccagcaacgccgcctggcgcggctcttcgccctgctgttgcagggcggtgcggcgttggcctacctgaatggcgtgcgcccgggtgagacgacgttgctggagggttcgccgctgggcgcgctgatgctcggtgcagcggcgctgttcagcttctggcagctgcgtcgcgcgccggcgaaagcgctggccgactgggagccggcctgccggccgttgctggcggccgccggcctggccttcctctacctggtcgcaccgctctgcctggccgtcgacggcaccgccatcgcctgggccgtggcccggcctggcgagcttgttcgccggcttgcgcctgggctcgcgtaccttcctgttctgcgccttcgccgtgcaactgctgggcggtgcgctgttcctcctgcatttgcagggcggcgatggccagggtggggtattcgactcgggctggcgtggcttgatgaccgcctcgctgattggcctggcgctgatcggcggcatgctgctggcggcgcgcgacccgctggtgaaggacgacagtcggctgctcatgggcttgagcctggtgctgctggccggtctggcgttcgtcaacctggcagtgctgttcgtcctgccttggcgcagcgccagcgcggtatgggccggtag

SEQ ID NO: 16466 - DNA, 2808 bp, Pseudomonas aeruginosa
cgggctgctgatcatctggctgagcctggtgctgcgccagcgcctgagcttctacttcggcctcgccttgcaggtagtgggcggcctggcgttcctcctcgccgggccgtcgctgttcggctcgctgagcggcgaaggcctgcggcccctggcccattccgggttctggacgccggcagtgctggccctggcggcgctggtcggcgcctggcggctgcgccgcgccggcgagcgcgagcgggcgctgggtatcggtaccctcggcctggccgagctgtcgcacttgctgctgctctggggagccggctggtgggcgctgaccgcgctgtgcgaaaccgtccgcttcgtgccttatggcctgcgcgagcatgcgttgctactggtggccgcggcgacagtggcgtcgtggatgctgctggcgctgcgcgagcgctggcgcgaactggccctgctgtgcctggcgctggtcccggtggcgctgttggccctggccagtgcctggcgtttcgattaccagccgttcggcgaattcggctggctggcctggccgctgctgttcgccacgcacttgctgtcgctgcgacgccttgccccgttgctgccggcgaaggccctgagcgttgcccatgtgctcggttgctggctgttgctaggggtgctggcgctggagctgcgctacctgttcgccctgctcgccgaacagtacaacgcctggcgttggctgggctgggcgttggtcccgagcgcctacctgctgctggtggctggcgggcggagcctgccctggccgctgcgcgacttcccgcgggagtatcggctgctcgccgctgcgccggtggcgctgttgctgctcggctggttctggagcgccaacctgctcagcgacggcgctgccgagccgctgccttacctgccgctggccaacccgctggaactggggctgctgatcgtgctgttcgccctctaccgctggagcgacgccagcctggcctcgctcgtcgatggcaatgccagcgcgcgcctggggcgccaggcgttggccggcgcctcgctgttcgccctgctgaccctggcggtgtgccgcgccgcgcaccacctggccggcgtaccgttccaggccgaggcgctggccgcgtcgatgctggtgcaggcggggctgtcgctggtctggacgctctgtgcgctgggcctgaccatcgccggtacccgtctcggccggcgcgacctgtggatggtcggcgcggcgctggtcggcgtcgtggtggtcaagctgttcttcgtcgagctgggcaacagtggcagcctggagcgaatcatctccttcatcggggtcggcgtcctgttgctggtcgtcggctacttctcacccttgcctccgcgtcgcgccgaggtcgcatcggaggccgagcagccatgacgcgctccttttcgttcagaaccgccggcctgctcctgctgggcgcctgcctgtccctgccgctgtcggcgaaggagtctgccgaaggtttcagccgccaggtggcgctgtcgctgcagggcgaaggtccctggtatcgcctgagcatcccgatgagcgtgcagttgtcggctgcccatgccgacctgcgcgacctgcgggtcttcgatgccgaaggcgaggccttgccctacaccctggtggccggcagcgagcgccaggccagcacgccgcatgaggccgaggtgcggctgttcccgttgcgaggcacgtccgccgccgacgcgacgcaaccgaacctgcgggtgcagcgcaacaccagcggcaccatagtcgaggtgctgccggaaaacgccgggccggctgccgagactttgcgcggctggctgatcgacgcgagcgcggtgacgtttcccctggagcgcctgcggctggactggagcagcccggaggagggcttccagcgcttctccgtggaagccagcgacgacctcgagcattggcaggcctggggggacggacagatcgcccgcttgaccttcaacggcgaacgcatcgacgtcagcgaggtcaagcttcccggccgccaggcccgctacctgcgtctggcctggccggctggggcaaccgcggcagacctccaaggcgcccgcctgcaaggcagcacgcggagcaccgagccggcgccgatgatctggtccgagccgctggccgggcgccaggcgggggacggcgagtaccgctggcagttgccgctggcgttgccgttgcagcgggtgcgggtgtccctgcagcaggcgctgacccacaccatcgtcccggtggaactgtccggccgtgatcgtacggagaacgcttcgccgcgccgggaggccgcctggagcagcctggcacgcggggttctctaccggctgccgatcgacggccgcaacgtacagcagaacgagctggaactgccgggctgggcggtgcgcgagctgcgtctgcaggtggaccaacgaggtaccggcctgggcccggaggtcccgtccctgagtgtcggcctgccggccagcgaactggtgttcctggtgcgtggcagcccgccgtaccggctggcgttcggcaagcctggcgcgcagtcggcggcgctgccgctcggcgtactgattcccggctataccgagagcaagcgcgccaccctgggtagcgccagcctgggcgaaccgctggaggtggccatggcggtcgcggcgccggcaccgggtagcgactggaagaagatcggcctgtgggcggtacttctgctgggggtcgctctgctggtaataatggcaatgagcctgctgcgttcctcgccgaacaagccatga

SEQ ID NO: 16467 - DNA, 2052 bp, Pseudomonas aeruginosa
gccggttccgcgctatgctgttcggctgaggaggctttacgacgggccccggggcgcatgccgacgacgcggcggcccgacaataaaaacaaatcacggagtaagagaatgatcagaatggcgctcaagccactggtagcggcctgcctgctggcttcgctgtccaccgccccgcaggctgctccttcgccttattcgacgctggtggtgttcggcgacagcctcagcgatgccgggcagttccccgatcctgccggccccgccggaagcacctcgcgtttcaccaaccgggtcggcccgacctaccagaacggcagcggcgagatcttcggaccgaccgcgcccctggggctcggcaatcagctcggcatcgcccccgggcgacctgggtgcctcgacttcgccggtcaacggcccagcagggcatcggccgacggcaacaactgggcggtgggcggctaccggaccgaccagatctacgactcgatcaccgcggccaacggctcgctgatcgagcgcgacaataccctcctgcgcagccgcgatggctacctggtggaccgtgcccgccagggcctgggtgccgatccgaacgcgttgtactacatcaccggcggcggcaacgacttcctccaggggcgcatcctcaacgacctccaggcacaacaggccgccggtcgcctggtggatagcgtgcaggccctgcagcaggccggcgcgcgctacatcgtggtctggctgttgcccgacctgggcctgaccccggctaccttcggtggtcccttgcagcctttcgccagccaactcagcggcacgttcaacgccgagctgaccgcccagttgagccaggccggcgccaacgtcattccgttgaacatcccgctgctgctcaaggaaggcatggccaacccggcttccttcggcctggccgccgaccagaacctgatcggcacctgtttcagcggcaacggctgtaccatgaacccgacctacgggatcaacggcagcacgcccgacccgagcaaactgctgttcaacgacagcgtgcacccgaccatcaccggccagcgcctgatcgccgactacacctattcgctgctgtcggcgccctgggagttgaccctgctgccggaaatggcccacggcaccctgcgtgcctaccaggacgaactgcgcagccagtggcaggcggactgggagaactggcagaacgtcggccagtggcgcggcttcgtcggcggcggcggccagcgcctggacttcgactcccaggacagcgccgccagcggcgacggcaatggctacaacctgacccttggcggcagctaccgcatcgacgaggcctggcgcgccggggtcgccgccggtttctaccggcagaagctggaagccggcgccaaggattccgactaccgaatgaacagctacatggccagcgccttcgtgcagtaccaggaaacccgctggtgggccgacgcggcgttgaccggcggctacctcgactacgacgacctgaagcgcaagttcgccctgggcggcggcgagcgcagcgagaaaggcgacaccaacggccacctgtgggcgttcagcgcgcgcctgggctacgacatcgcccagcaggccgacagtccctggcacctgtcgccgttcgtcagcgccgactatgcacgggtcgaggtcgacggctattccgagaagggcgccagcgccaccgcgctcgactacgacgaccagaagcgcagctcgaagcgcctgggcgccggcctgcaaggcaagtacgcgttcggcagcgatactcagctgttcgccgagtacgcccacgaacgcgagtacgaggacgacacccaggacctcaccatgtccctcaacagcctgccgggcaatcgctttaccctcgaaggctacaccccgcaggaccacctcaaccgcgtctccctcggcttcagccagaagctggcaccggagctgtcgctgcgcggcggctacaactggcgcaagggcgaggacgatacccagcagagcgtcagcctggcgctgagcctggacttctga

SEQ ID NO: 16468 - DNA, 603 bp, Pseudomonas aeruginosa
taccccgctgttactcgccgcccggtcgaccgccatacactgccgatccgtttcgttcgagggaatcgcccgatgagtttcaacaccgaagtacagcccggcatctgcatggagccggacgccatcacccaggaatatgtgttcaaccacaccatgttgcgggtcaaggatccgaagcgctcgctcgacttctactcgcgggtgctcggcatgcgcctgctgcgtcgcctggatttcgaggaaggccgcttctccctgtatttcctcgccatgacccgtggcgaagaagtgcctgatgcggtcgacgagcgccagcgatataccttcgggcgccagtcggtcctcgagctgacccacaactggggcagcgagagcgacgacagccagtaccacaacggcaaccaggacccgcgcgggttcggccatatctgtttctcggtgcccgacctggtggcggcttgcgagcgtttcgaaacgctcggggtgaacttcgtcaagccgctggaccgaggcatgaagaacgtggccttcatcagcgatcccgacggctactgggtggaaatcgtccaggccagcctgaacggcgagatggggtgcggctga

SEQ ID NO: 16469 - DNA, 1125 bp, Pseudomonas aeruginosa
accgcgccgccgccgccgatctccaaccggcggttgcgcggagtcaagcgtgaccgccaattccgcgttaaactgcgcgggttttttcctctctccggagccatccatgtcccgcgttaccctgagccgctatctgatcgagcagacccgcagccacaacaccccggccgacctgcgcttcctcatcgaggtcgtggcgcgtgcctgcaaggaaatcagccatgcggtgtccaagggcgcgctgggcggcgtgctcggcagcatgggcaccgagaacgtgcagggcgaggtgcagaagaagctggacgtgatgtccaacgagatcctgctggaagccaacgaatgggccggcaacctggccggcatggcctccgaggagatggaccacccctaccagattccggggcgctatccgaaaggcgcctacctgttggtcttcgacccgctggacggctccagcaacatcgacgtcaacgtctcggtcggcaccatcttctcggtgctgcgctgccccaacgagtacctgaaccagaacgataccctgcgcgaggaagccttcctccagccgggcaccacccaggtcgccgccggctacgccatctacggcccgcagaccatgctgatgctgaccctcggcaatggcgtcaagggcttcaccctggatcgcgagctgggcagcttcgtcctcacccacgacaacatcagcgtgccggaaagcaccgccgagttcgccatcaacatgtccaaccagcgccactgggaagcgccggtgaaacgctacgtggaagaactgctggccggcaaggaaggcccgctgggcaagaactacaacatgcgctggatcgcctcgatggtcgccgacgtccaccgcatcctgacccgtggcggcgtcttcatgtacccgcgcgacgcccgcgagccggagaagcccggcaagctgcgcctgatgtacgaagccaacccgatgtcgttcatcatcgagcaggccggcggcgccgccaccaacggcacccagcgcatcctcgacatcaagccggagaacctgcaccagcgtgtcgcggtgttcctcggctcgaagcaggaagtcgagcgcatcaccggctaccacgcggagtaggccgatga

SEQ ID NO: 16470 - DNA, 789 bp, Pseudomonas aeruginosa
actcacttcatcgacgcctcgacaaggagtctctccgtgacgtcctcttcctccgatcgttccccgctggcctcgcaactcggcgaggtaccggcgccgctctacgcgcgggtcaagcagatgatcgtcagccagatccagtcgggcgcctggccgccgcaccaccgggtgccgtccgagagcgaactggtcagccagctcggcttcagtcgcatgaccatcaatcgcgccctgcgcgaactgaccagcgacggcctgctggtgcgcatgcagggggtaggaaccttcgtcgccgagcccaagggccagtcggcgctgttcgaggtgcacaacatcgccgacgagatcgcggcccgcgggcatcgccatcgttgccaggtgatcaccctcggcgaggaggtcgccggccccgagcgcgccctggcactggacgtgcgcgaaggccagcgggtgttccactcgctgatcgtgcactacgagaacgatatcccggtgcagatcgaggaccgctacgtgaacgccgcggtggcgccggactacctcaagcaggatttcacccggcaaacgccctatgcctacctgacccaggtggcgccgctcaccgagggcgagcatgtggtcgaggcgatcctcgccgagccggccgagtgcaagctgttgcagatcgaacgcggcgagccgtgcctgctgatccgccgccgcacatggtccgggcgtgtcgcggtgaccgccgcgcggctgctgcacccgggttcccgccaccgtctggaaggacgtttcagctcatga

SEQ ID NO: 16471 - DNA, 846 bp, Pseudomonas aeruginosa
tcggcctgcctgtacggcggttgggcactgctcgccagccagtatgagcgctggggttggccggtactggcgggactggtgccgttcgcctccctctacatgtcgttgcagcatgagctgatccatggccacccgacccgctggccgaggttcaacgccatgctcggctacctgccactggccgtctggtatccctatccgctgtaccgtgacagccacttgcggcaccacctcgacgagcaactgacctacccggggctggaccccgagagtcgctacgtcagtctgtccgagtggccgcgcctgggctcctggcggcggcgctggctctgcctggacaagaccctgcttggtcgcgccaccctcggcccgctgctggccctggcggcgatggcgcgcctggagggttcgcggttgcgccggggagagggcgccgcctggcgcctgtggggcctgcatgccgtgctgctgggcgggttgctggccgggctttggcgctgggcgggcatcccgccctggctgtacctgccggcggtggcctatccggccctcggcctgagcatgctgcgctctttctacgagcaccgtccggcccacgagccggcgcagcgcagcgtgctggtcgaggcggggtggccgtggcggctgctgttcctcaacaacaacttgcatctggtccaccacgatctgccgggcctgccctggtacctgctgccgcgcgtgtatagcgcaagccgccgtgcctaccggcgacgcagtggcgatttccacctgcccggctatggtcgtctatggcggcgccacggttggcggccggtggatgcgccggtgcatcccgagcattga

SEQ ID NO: 16472 - DNA, 816 bp, Pseudomonas aeruginosa
aggcaggcggacgagagcatgatcgataccccggtggtggcggcgctggacatgtatgtcgagccggactgcgtcaggcaggccggcgcaatcttcatcggcgaggtctgccggcgcctgggcgtgcgccgttacgcgtcggccgccaccgatctggcggtgcagtggcgacagcctaacctgttgttcgcgcagacctgcggctatccgctgatgacccagttgcgcggccaggtggcggtgctcgcggtgcccagctacgacttgcccgattgtgctcccggcgagcattgcagcctgttcgtcgccgccgaaggacaggcgcgccagcgcctcggcgacttccgcaatacccgcctggcgctcaacgaccacgactccaacagcggcatgaacctgctgcgccatgcgctggcgccgctggggcgagactcggcgttcttcgccgaggtgcacatcagcggcggccacctgcgcagcctggcgatggtggccgcgggtgaggtcgagctgacctcggtggatgcagtgaccttcggctacctgcaacgccacgcaccggagcgcctggccggcctgcgcgtgctcgggcgcagcgcgccgagcccggccttgccgctgatcacctcgctgcactggagtgcggcgcaacgccgcgagctgttcgaagcgctgaacctgacgctgatcgagtgcccgcacctggccgcgacactggcgctgaaaagcttcctcccggccggcgaggagcattaccggattctcctcgactacgagcgtcaggcgcagggctggggttacccgcaattgcgctga

SEQ ID NO: 16473 - DNA, 1173 bp, Pseudomonas aeruginosa
aatccgcgccccgcgcggcactacgctgaccgccaagagctggctgaccgaagcgccgctgcgcatgctgatgaacaacctcgacccggaggtcgcggagaaccccagggaactggtggtttacggcggcatcggccgtgccgcgcgcaactgggagtgctacgacaggatcgtcgagaccctcaagcaactgaacgacgacgagaccctgctggtacagtccggcaagccggtcggcgtgttcaagacccacgccaacgcgccgcgggtgctgatcgccaactccaacctggtgccgcactgggcgacctgggaacacttcaacgaactggacgccaagggcctggcgatgtacggccagatgaccgccggttcgtggatctacatcggcagccagggcatcgtccagggcacctacgaaaccttcgtcgaggctggccgccagcattacgacggcaatctcaagggccgctgggtgcttaccgccggccttggcggcatgggcggcgcccagccgctggcggcgaccctggccggcgcctgttcgctgaacatcgagtgccagcagagccgcatcgacttccgcctgcgcagtcgctacgtcgacgagcaggccaaggacctggacgacgccctggcgcggatccagcgctacaccgccgaaggcaaggccatctccatcgccctgctgggcaatgccgccgagatccttccggaactggttcgccgcggcgtacgcccggacatggtcaccgaccagaccagcgcccacgatccactcaacggctacctgccggccggctggagctgggaagagtaccgcgaccgcgcgcagaccgacccggccgccgtggtcaaggccgccaagcagtccatggcggtacacgtgcgggccatgctggcgttccagcagcagggcgtgccgaccttcgactatggcaacaacatccgccagatggccaaggaagagggggtggccaatgccttcgatttccccggcttcgtcccggcctacatccgcccgctgttctgtcgcggcatcggtccgttccgctgggccgcgctgtcgggcgacccgcaggacatctacaagaccgacgccaaggtcaagcaactgatccccgacgatgcccacctgcaccgttggctggacatggcccgcgagcgcattag

SEQ ID NO: 16474 - DNA, 1698 bp, Pseudomonas aeruginosa
cgacgaggccgccgaacgcatcgcccgcgtgctgaccaacgacccgggtaccggggtgatgcggcacgccgacgccggctaccaggtcgccatcgattgcgcgaaggagcagggcctgaacctgccgatgatcaccgcccagcgctgacctcgaaaaccgcctccacgccggcggggcgtgggggcggccgcccactgtcccgaccaggccacaacaagaatggcggcgcgcgagccgcagcggagtacagcagcatgacccagggcagcgacagcaagccactgatcgaacggcgctcgatcgactacatcccggcgaacgagcgccacggccgcctctacagccagttcaccctctggctgggggccaacctgcagatcaccgccatcgtcaccggcgccctcgccgtggtcctcggcggcgacgtgttctggtcgctggtcggcctgctcatcggccagctcctcggcggcgcggtgatggccctgcacgccgcgcaggggccgcgcctggggctgccgcagatgatttccagccgggtgcagttcggcgtctacggcgcctgcatcccgatcgcactggtgtgcctgatgtacctgggcttcaccgccaccggcacggtgctttccggccaggccatcggccagctcaccgggctcagcgacagcaccgggatcttcatcttcgccgccttcatcgtcctggtgacggtgctcggctatcgcgtcatccacatcatcgggcggatcgccagcgtcctcggcatcatcgccttcgcctacctgttcagccgcctgatgctgctcagcgacatcggcgacctgctcgccatccgccatttcagctgggcctcgttcctcctcgcggtgtcgctggcggcgtcctggcagatcgccttcggcccctacgtggccgactattcacgctacctgccggcgtccacctcgtcgtggaagaccttcctcgccgtcggcctcggctcggtgctcggcgcccaggcctcgatggtcctcggggtgttctccgcagccctggccaacggccagttcgccggccgcgaggtggcctacatcgtcggcctgggcagcagcgggaccgtcgccgcgctgctctacttcagcatcgccttcggcaaggtgaccatttccacgctgaactcctacggcagcttcatgtgcatcgcgaccatcatcagcagcgtacgcggccaactggagatcacccgcgtgcaacgcctgttcttcgtcctcgcgatcgtcggcgcctcgacgctcatcgcgctgctcggccagcactcgttcctcgctgcgttcaagtccttcatcctgttcctgctgaccttcttcaccccgtggagcgcggtgaacctggtcgactactacttcatcacccgcgagcgctatgacgtgcccgcgctggccgaccccgacggccgctacggtcgctggaacctgccgggaatcgccgtctataccctcggcgtgctggtgcagatgccgttcctggcgaccacgctgtacaccggaccgatggtcgagcacctcggcggcgtggatatctcctggatcatcggcttgctggtgccggcggtcctctactacctggtggcgcggcgcaaggccacgcgccaggccccggcgcgaatgatcctgccggccgatcccggcgccttcgaacgtcccgcgcacggggcctga

SEQ ID NO: 16475 - DNA, 1548 bp, Pseudomonas aeruginosa
gacgaatttccagggcggcgcggccgccttcaatcccatgaaacgccgccggcggacggcgctgccgagcccgccgaaccgaacaaggagccttcgatgagcctgcatctgaaacccggccagttgaccctggccgacctgcgccaagcatacctggcccccgtgcgcctgagcctggatcccagcgccgacgcgctgatcgccgccagcgtcgcctgtgtcgagaacatcatcgccgagggccgcaccgcctacggcatcaacaccggcttcggcctgctggcctcgacgcggatttccccggccgacctggagaagctccagcgttccatcgtcctgtcccatgccgccggcgtcggcgaggcgctggacgacgccatggtgcggctggtcatgctgctcaaggtgaacagcctggcgcgcgggttctccggcatccgccgcaaggtgatcgacgcgctgatcgcgctgatcaacgccgaggtctatccgcacatcccgctgaaaggctcggtgggtgcgtccggcgacctggcgccgctggcgcacatgtcgctggtgctgatcggcgaaagccgggcgcgccatcgcggtgagtggctgccggccgccgaagcgctggcggtggccgggctggagccgctgaccctggcggcgaaggaaggcctggccctgctcaatggcacccaggtgtccaccgcctacgcgctgcgcgggttgttcgaggccgaggacctgttcgccgccgccaccgtctgcggcgggctcagcgtcgaggccatgctcggttcgcgggcgccgttcgatgcgcgcatccatgccgcgcgcggccagcgtgggcagatcgacgtggccgcggcctatcgcgacctgctcaccgccagcagcgaggtggcgcgctcccatgagaagtgcgacaaggtccaggacccctattcgctgcgttgccagccgcaggtgatgggcgcctgcctgacccagatgcgccaggccgccgaggtgctggagatcgaagccaacgcggtgtccgacaacccgctggtattcgccgccgagggcgacgtgatctccggcggcaacttccacgccgaaccggtggcgatggccgccgacaacctggccctggcgttggccgagatcggttcgctgtcggaacggcgcatctcgctgatgatggacatgcacatgtcgcagttgccgccgttcctggtggccaacggcggggtcaactccggcttcatgatcgcccaggtcaccgccgccgcgctggccagcgacaacaaggccctggcccatccggccagcgtcgacagcctgccgacctcggccaaccaggaagaccatgtgtcgatggcgccgaacgccggcaaacggctctgggcgatggccgagaacgtcccgcgggattctcgccgtggagtggctgggcgcctgccagggcctggacttccgcgagggcctgaagagttcgccgaagctggagcaggctcgccgcctgctgcgcgacaaggtgccgtactaccaggaggatcgcttcttcgcccctga

SEQ ID NO: 16476 - DNA, 846 bp, Pseudomonas aeruginosa
tatcgaggccgccagccagttgctcgccagcggttgcctgaacgcgctgctgccggcccggctgttgccgagtctttgatacccgcccccggccgctcggccggggcgctccagcaagaacaacaagaggagagccgagggatgacgcacgacacggggcttcggcgcggactgaacgcccgtcatattcgtttcatggcactggggtcggcgatcggcaccggcctgttctacggttccgcatcggccatccagatggccgggccggcggtgctgctggcctacctggtcgccggcgcggcggtgtacatggtgatgcgcgcgctcggcgagatggcagtgcacgagccggtgtccggctcgttcggccattacgccagcagctatctcggccccctggccgggttcgtcaccggctggacctacgctttcgagatgatcatcgtctgcctcgccgatgtcaccgcgttcggcatctacatggggttctggtttcccgacgtgccgcgctggatctgggtactgtccatcgtgctgttcatcggcgggctgaacctctgtcatgtcaaggtcttcggcgagctggagttctggctgtcgctggtcaaggtcggtgccatcttcgcgatgattctccccgggctcggcatcttgttcttcggcttcagcttgggcggcggcggcgactcccgccaccggcgtgcacaacctttggcagcacggcgggttcctgcccaacggctgggcccgggctggtcgcctccctgtcgctggtggtattcgccttcggcggcatcgagatcttcggcatcaccgccggcgaggcgcaggacccgcagcgggtga

SEQ ID NO: 16477 - DNA, 846 bp, Pseudomonas aeruginosa
tcgaccgcatcacccaggcctatggccgttcccggcacgagacgagcaaatgagcggtgcgcagatgaacaagatcgaagtgaagaacgtgttcaagatcttcggcccgcgcgccgatgccgcgctggcccttatccgccagggacgcagcaagggcgaagtgctggcgcagaccggctgcgtggtcggcgtcaacgacctgtcgctgaccatcggtgctggcgagatcttcgtgatcatgggcctgtcgggttccggcaagtcgaccctggtgcgccatttcaaccgcctgatcgaccccaccagcggcgagatcctggtggatggcgaggacatcctgcgctacgacatggaagccctccggcaattccgccggcgcaagatcagcatggtgttccagagtttcggcctgctgccgcacaagagcgtgctcgacaatgtcgcctacggcctgaaggttcgcggcgaaagccgggcgcagtgccacgagcgggccctgcactggatcgccacggtgggcctgaagggctacgagaagtcctatccgcaccagctttccggcggcatgcgccagcgtgtcggcctggcccgcgcgctggccgccgacaccgagatcattctcatggacgaggccttcagcgccctcgacccgttgatccgcgcggacatgcaggaccagttgctggaactgcagaaaaccctgcacaagaccatcgtcttcatcacccacgacctcgacgaggcggtacgcatcggcaaccgcatcgcgatcctcaaggacggccaactgatccaggtcggcacgccacgggaaatcctccaccagccggccgacgactacgttga

SEQ ID NO: 16478 - DNA, 1563 bp, Pseudomonas aeruginosa
ccgcttcgtccagcggcgggtggcgaacctatgagcgacctaccgagcgtcgtgttcggcgacggtccgctgcgttggcaggaactggtcgcggtggcccggcacggtgcgcgcctggaactgtcggcggcggcctgggcacggatcgacaacgcccgcgccatcgtctgccgtatcgtcgccaacggcgagcgtgcctacggcatcagtaccggcctcggcgcgctgtgcgacgtcctgctggaaggcgagcagctcgccgagctgtcgcgcaacaccttgctcagccatgcctgcggggtcggcgagccgctgcgcgacgaacagacccgggcgatcatctgtgccgccgtcgccaactacagccagggcaagtccgggctcgaccgttcgctggtggaaggactgctggcgctgctcaaccacggcattaccccgcaggtgccggcccagggctcggtgggctacctgacccacatggcgcacgtcggcatcgccctgctcggcatcggcgaggtcagctaccgcggcagcgtcgtgccggccgccgccgcgttggcggcggaaggcctggcgacggtgcgcctgggagccaaggacgggctctgcctggtcaacggcacgccgtgcatgaccggcctcgcctgcctggccctggacgacgcgcagcgcctggcgcagtgggccgacgtgatcggggcgatgagcttcgaggccctgcgcggccaactggcggcgttcgacgccgagatcgttgcgctcaagccgcatcccgggatgcagcgggtcgccgtcaatctgcgagccttgctggctggcagccaggtactggagaacgcccgcggcatccgcacccaggatgccctgagcatccgctcgataccgcagatccatggcgcctgccgtgaccagttggcccacgcggcgcggcagatagagaccgaactcaactcggccaccgacaacccgctgctgctgggtacgccggaagcctaccgggtggtatcccaggccaatccccacggcgaatcggtggcgatggccgccgacctgctggcgatcgccgtggccgagctgggcggggtcgccgagcggcgcctggatcgcctggtcaacccgctggtcagcggcctgccggcgttcctggtgggcaagccgggagtcaactcggggatgatgatcacccagtacgtcgccgcctccctggctggcgagaaccgccagctggcgcagccggcggtggtcgacaacttcgtcacctcggcgctccaggaggaccacctgagcctcggcaccagtgccgcgctcaagcttggcagggccctggagaacctccggcggatcctcgccatcgagtacctgctggccgcccaggccttcgaattcctcgccccgcaacgcttcggccagggcaccgcggcggcctggggcatcctgcgcgagcgcgtgcccgcgtacgacaccgaccgctggctggctcccgacatcgccagcgcggcggccatcctcggcgagcggaagagtctcgcccggctggccgcgagcataggagacctgcaatga

SEQ ID NO: 16479 - DNA, 312 bp, Pseudomonas aeruginosa
cggcgctggagatcaagtccggctacggcctcgacctggccagcgagcgcaagatgctacgagtcatccgccgcctcggcgaacgcctgccggcgaccgtgcgcagcacctgcctggccgcccatgcgctaccgccggaatacgccgggcgcgccgacgactacatcgagcatatctgctcgacgatgctccccgcgctggccggagagggactggtggacgcggtggacgccttctgcgagcacctggcgttttccccggcgcaggtcgagcgggtattcatcgccgcccgcgagctgggcctgccggtga

SEQ ID NO: 16480 - DNA, 996 bp, Pseudomonas aeruginosa
ccccggaggaggcgctggccggtgtcaccctgcacgccgcccgggcgctggggctggaagccagtcacggcagcctggaggtcggcaagctggccgacttcgtcgcctgggacatcgagcgtccggcggagctggcctactggctgggcggcgatctgccgaaacgcgtcattcgccacgccgaggaggtataccgtggatgaagtcctgagtttcaagcgcggccgtgtgccgctactgatcagcatgccgcaccccggcacgcgcctgaccccggcggtggacgccggcctggtggaggaggcgcgggcgctgaccgataccgactggcacattccccggctctacgatttcgccgaggaactgggcgccagcaccctggctgcccactattcgcgctatgtggtcgatctcaaccgcccttccgacgacaagccgctgtacagcaccgccactaccggcctgtatccggacaccctgttcgacggccggccgctctaccgcgaaggcatggcgccgtccgccgaggaacgcatgcgctacctggctgaagtgtggacgccctaccaccggaccatcgccgaggaactggcgcggctgaaggccgagttcggctacgcgctgctctgggacgcccactcgatccgttcccacgtgccgcacctgttcgacggccgactgcccgacttcaatctcggcaccaacgccggcgccagttgcgatccagcgctggcggcccgcctggaggcggtctgcgctgccgccgaaggctacagccatgtgctcaacgggcgcttcaagggcggccacatcacccgccactacggccagccggagcagcacgtccatgccgtccagctggagctggcgcagtgcacctacatggacgagcaggccccgttcgcttaccgcgcggacctcgccgaagcgacccgcgcagtcatccgcgaactgctggaaagcctcctcgcctggggtcgcgagcgctacgcctga

SEQ ID NO: 16481 - DNA, 2373 bp, Pseudomonas aeruginosa
atgttcgcccccgccaaccagacgcacttcagccttcgcatcgaaaacctccggcacgacttccaggtactcgccttccgcggtcgcgaagccatcagccagccctttcgcttcgacctggagctggtcagcgagcgatccgatctggacctcgacgcgctgctgcaccagccggccttcctgatcctctcgccgagcgggcaaggggtccacggacagctcaccagcatcgcccagggggactccggcaagcgcctgaccggctatcgcgcgaccctggagccgcgcctggcctacctggggctgtgcagcgaccaacgcatcttccagcgcctcagcgtgccggaaatcatcggccgggtgctggagggccacggcattctcgccgacgcctaccgcttccagctgggcccgacgccgtacccggcccgcgaatactgcacgcagtacgacgaaaccgacctggcgttcctcagcaggctctgcgaggaggaaggcatccattaccaccatgagttttctgcccagggccatgtgctggtcttcggcgacgaccagacctcctttccgcggctgcaacgccccgtcgcctacgtgcaggacgccgggctggtcgccgaccagccggtggtcaagcgcttcggcgtgcgcttcgacacccgtgccagccgggttacccggcgcgactacgacttcgagcaacccgcgttgcagatgcaggccgcccatggcccgcagcccggggcgcagcaaccggacctggaggactacgactatcccggccgcttcacccaccgcgagcgcggcaagcacctgagccggcgcgcgctggaacggcatcgcgccgactacctacaggccaggggcgaaagcgacgaaccggcgctgctcagcggacacttcctgacgctgtccgcgcatccccgcggcgaatggaacgatctctggctgcttaccgaggttctccacgaagggcggcagccgcaggtactggaagagtcgatcgacagcgacgtcgcgcagggccggggcgatttccgccagggctatcgcaaccgtttcgtcgccactccctggagcgcgcatttccggcccccgctggagcatcccaggccacgcctgctgggctgccagacagcggtcgtgaccggccccgccggcgagaccatccactgcgaccaatacggccgggtcaaggtgcagttcttctgggatcgcctcggccaggccgacgacaacaccagttgctggttgcgcgtcgcctccaactgggcgggcaaacgctatggcggcgtcgccatcccgcgggtgggcatggaagtcctggtgggtttcctggagggcgatccggatcagccgctggtcaccggctgcctctaccacagcgaaaaccgggtgccctacgagctgccgcagaacaagacccgcagcgttttcaagaccgacagctaccccggcggcggcggtttcaacgaactgcgcatcgaggaccgcaagggccaggaacagatcttcgtccacgcccagcgcgactgggacgagaacatcgagcacgaccagaagatccgcgtcggccacgagcgccacgacacggtcgagggcgatagctacagcgagttcagggccgaggaacagcgcacggtccatgccgaccgcaaggtcgaactgaaggcggccgaccacctcagcgtcgccgacgcgttgcacctgaggatcggcaccggccagttcgtcgaggcgggcgacgagatccatttcaaggccggcgacaaggtagtgatcgaggcaggcatggagttgaccctaaagggcggtggcagcttcgccaggctcgacccgggcggtgtcacccttgacggcgcccaggtgatgatcaacagcggcggcagccccggcatcggtagcggcgttcgcgcgctgtcgccgctgcaaccgctcgcggccgacgccgcggcggcgggaggcgccttgttgggagccatcgcccagaaggtcggcgaagcgccgcagaaactcctgcgtttcgaactcagtccgttgcccggtgtgccatcggcggccaggcaaccgtatcggctctacgccaatggtgccttcaaggaggagggcatcgccgacgaaggcggcgcaatcagcttcgaaccgctgccgggcgaacgcacctatcgcatcgagaccgccaatggccacgcctacgaagtggagatggtcgaccagccggacgcactgcaggccgacgatcggctcgcccagcaggggttccgcgactaccgggcggaaatgccccagcacaagccgcgttccgccccggacgcctaccggcgcgacgcctcgcggcccggcgccgccgacaaggatgagcccacgccatga

SEQ ID NO: 16482 - DNA, 654 bp, Pseudomonas aeruginosa
tcaatggccaggcggccttcgacgcggtgcatgcggcgatggaggcggcccggcacagcatcgacatcatcacctggggcttcgacccggccatgcgtttcaaacgccccgacggaccgcgaatcggcgaattgctgcagacgaagggccgcgaaggagtgcaggcgcgagtgctggtctggagcaaccaactcgccaggctcaaggaaaacaccatccccggggccggcgtcggcggttccggcggcacctgggcgggctcgggcgtcgccagcggcagcgcggtggacaacgaggtgctgcgactggagcagcggcgccagcataacctcaacctcatcgcgcggcagcaggaagccctggagcgctcggaacggctgcaccgcgaaggcaggctgccgagcttcgacccgcggggcgccgcccacgcgcgggcgcgcatcgccgagctggaggcggagaacgccgagatccagcgcactctcgacagcagcgaggcccagggctacggcggcaagcgcggttccggcggcacccgccaggatccctgggggcagatattcacccgcgactggttcaaggcggtacgcggcggtgggttgcagaacgtcgagttccgtacccgcgacttcgagcagacggccagaccggtga

SEQ ID NO: 16483 - DNA, 945 bp, Pseudomonas aeruginosa
ccccttgccaccccaccccgtccagggctacgacgcagctcgacccgactggaagccgggtcagtgattcggctaatggctattggaatatgggctgtactttgtctcgcagcagttcccgctatggctgacagcaagccttttgtctgcgttaacgaaaaggaccatctaccccctctggacccgcaggccgatgcttggtatcgcgaagcggcgaccctggccaagcccgataccttgcgtccgtggcctcgtatcgtcgggttgtacagcaaggcggccgagcgcggccactggaaggccatgcacaacttggcgaatctttatcgtacagggtggcccggaggagtagaaaaagatacgcagaaggcattggatctctatcaaaagatgatagatctggatgtgcctcaggggttctatgatatgggagcaatgattggaaatcgcgccggggttaaaaaccctgcaactgacggacttacttttcttgataaggctgctagcctaggaaatccgccggcactaaccgagctaggtaagctctatatatatgtggccaaaaaaaaggatttggggttggcgtatactcactgtgctgctagccagggccatgcgccggctagttatgagttgggggcgtattacaagatagtagagcataattttccaaaagcattgggttattatcaggcgtcagtctctcagggcggaaagagtgcggctttatttatctccggtgtttttgataaagccagtcctgatgtcgatagaatgtggtacgcccccgatgagaagctgcacaaactatatgatggtatttacgatcaacttgccgctgatcctgatttgcgttttcccaatttgataaaggaccatcctctgcctcctcacccgacccaaggctacgacgtggaccgcccagactggaagccggagcggtaa

SEQ ID NO: 16484 - DNA, 1347 bp, Pseudomonas aeruginosa
cctggatttataccctggccatctttattcattgtcctaccgctgtcatccgcgcctatcgtcgaagtcctggaaaacacctggataacgattgtcatggctcagcgggtttgcatcatcggcgccggcgtggtcggcctggccacggcctacgccctggttcgcgaaggattcgacgtgaccctggtggaagcgcgcgagcggggcgggctggaaaccagctacgccaatggcgggcagttgtcctatcgctacgtggcgccattggccgacagcggcgtgccggcccaggcgctcggctggctgctgcgcaacgatgcgccgttgcgcctgcggccgcgtcttgatccggcgcagtggcgctggctgctgggcttcctcgcggcctgccgcggctcgctgaaccgccgcaatgccgcgcacctgctgcgcctggcattgctcagccagcgcaccctgcaggactggcgcgaggaggatggcctcgatggcttcgactggcggcgcaacggcaagctggtggcgtttcgccaaccggccagctttgcgcgggcccgccagggcctggccgatccttcggcgcaattcgtcctgaccgccgccgagtgcctcgcgctggagccggccctgtccgccgcgcccttcgtcggcggcatccacacgccggacgaggaggtcgccgactgccatgccttctgcgtgcaacttgccgagcgcttgcaggcttccggacattgccggcaactgcatggccgcagggtgacgaagatcgtcgagggcggcgcggcggtgcgtggcgtcgaggtcggcggcgatctcatcgaggccgatcatgtggtgctggccgccggctaccgcagcgccgaattgatgctgccgggcctgcgcctgccgctatacccgctcaagggctatagcctgaccctgccggtcggcgcgcagcaccgcgcgccggataccagcatcaccgattacgaccgcaagatcgtctacgcgcgaatcggcgagcggctgcggatcgccgcgatggtcgacatcgtcggcttcgaccccggcctcgagcccgcgcgcctggcactgctgcgccagcaggcgcgagacacgttcccgcagggcggcgattttgacgccgccgtcgaatgggccggcatgcgcccggccacgcccaccggggtaccgctggtgggcaacggcggctaccgcaacctctggctcaacctcggccacggcgcgctcggcttcaccctggcctgcggcagcgggcgcctgctggccgagcagatcggccgccgcccgccgagcatcgatacctctggcctgcttccgcgcggcgcgctggctggctga

SEQ ID NO: 16485 - DNA, 1248 bp, Pseudomonas aeruginosa
atgtcgccgccgacctcgtggcggaccagcaggatgcgttgctccaccaccagcaggccggcggcgcggatacggtgtcgcaaggcctcggccatgctcgttctcccggcgccaggcgccgttgcttggattgatggtttcccctctaccggggcggacatgaaagccgctcggtttttttcccggcgccgaagtatcatgcgcggcagagcaaaggacgggccccgctgtcgacgtttgcgccgggggccgaacacatcgcctcgggagcgcatcatgctagttctgtatccggaaattaaaccctacgctcgccacgagctggccgtcgacgaaccgcatgtgctgtatgccgacgaaagcggttcgccggacggactgccggtcgtcttcgtccacggcggccccggctccggttgcgatgccctgtcgcgtcgcttcttcgatcccaacctctaccgtatcgtcaccttcgaccagcgcggttgcggccgttccacgccccacgccagcctggagaagaacagcacctgggagctggtggcggacatggagcgcctgcgcgagcacctgggtatcgagaagtgggtgctgttcggcggttcctggggctcgaccctgtcgctggcctacgcgcagacccatcccgagcgggtccatgcgctgatcctgcgcggcatcttcctttgccgtccgcaggacatccactggttctaccaggaaggcgccagccgcctgttccccgactattgggaagactatgtcgcgccgatcccgccggaagagcgcggcgacctgctggcggccttccacaagcgcctgaccggtagcgaccagatcgcccagatgcacgccgccaaggcctggtcgacctgggagggccgcaccgccacgctgcgccccaaccccatggtggtggaccgcttcaccgagccgggcagggcgctgtcgatctcgcgcatcgagaaccacttcttcgtcaaccagggcttcctcaggcccaaccagttgctcgaggacatgcaccgcatcgcccatctgcctggcgtgatcgtgcatggccgctacgacgccatctgtccgctggacaatgcctgggccctgcaccaggcctggccgaacagcgaactgcagatcatccgcgacgccgggcataccgccagcgagccggggatagtcgatgcgctggtgcgcgccaccaacgagatcggccggcgactgctcgacctgccgccggaggccgaatga

SEQ ID NO: 16486 - DNA, 2616 bp, Pseudomonas aeruginosa
gcgaaacctggagctatcagctgcctgccgatgaataacccatccactacgaaagcaccgctggccgactacctcgctcatcttcccctggcggaagaggagcgggagcggcttggcgagtccgcttccttctccgagctgcacgctcgcctggcgggagcggaaggcgccgctgccgatgccgggggcgatcccgccctggcctcggtacgcgcccgcctgcagctgggcacccctgagctggacgacgccgagatgttcggcgtcgacgcccagggtcgcaccttcctcaagatttccccgccgatccgccgtaccaaggtgattcccgagccctggcgcaccaacatcctggtgcgcggctggcgtcggctgaccggacgcagcaacccgcccaagcccaagcgtgccctgccgcgggcccgctggcagcgggtcggctcgctgcgccggttcatcctgctgttgttgatgctggcgcagacctcggtcgccacctactacatgaaaggcatcctgccctaccagggctgggccttcgtcgacctggaggagctggcccagcagagcctgctggataccgtccagcaggtgctgccctatgtcatccagttcggcatcctggcgctcttcgcgatcctcttctgttgggtctcggccggcttctggaccgcgctgatgggcttctgggagctgctcaccgggcgtgaccgctaccggatctccggcagcagcgccggcagcgagccgatcgccgccgacgcccgcacggcgatcgtcatgccgatctgcaacgaagacgtgccgcgggtattcgccggcctgcgggcgaccgtcgagtcgatggccgccaccggcgagatggagcgcttcgacttcttcgtcctcagcgacaccaacgacccggatatcgccgtcgccgagcagcaggcctggctcgagctgtgccgcgagaccaagggcttcggcaagatcttctaccgtcgccgccggcgtcgggtgaagcgcaagagcggcaacatcgacgacttctgccggcgctggggcggcgactaccgctacatggtggtgatggacgccgacagcgtgatgagcggcgactgcctggccaagctggtacgcctgatggaggccaatcctgaggcggggatcatccagaccgcgccgaaggcgtccggcatggacaccctgtatgcgcgcatgcagcagttcgccacccgcgtctacggcccgctgttcaccgccggcctgcacttctggcaactcggcgagtcgcactactggggccacaacgcgatcatccgcatgcagcccttcatcgaccactgcgccctggcgccgttgccgggcaagggctcgttcgccggcgcgatcctgtcccacgacttcgtcgaggctgcgttgatgcgccgtgccggctggggcgtgtggatcgcctacgacctcgacggcagctacgaagaactgccgccgaacctgctcgacgaactcaagcgcgaccgccgctggtgccacggcaacctgatgaacttccgcctgttcctggtcaagggcatgcacccggtgcaccgcgcggtgttcctcaccggggtcatgtcctacctgtcggcgccgttgtggttcttcttcctggtgctttccaccgcgctgctggcggtgcaccaactgatggagccgcagtacttcctggaaccgcggcagctgttcccgatctggccgcagtggcatccggagaaggccatcgcgttgttctccaccaccctgaccctgttgttcctgcccaagctgctcagcgtaatgctgatctgggccaagggcgccaagggtttcggcggggtgatccgggtgaccctgagcatgctcctggagatgttcttctcggtgctgctggcgccggtgcgcatgctcttccacacccgcttcgtgcttgccgccttcctcggctggtcggtgcagtggaactcgccgcagcgcgacgacgacgccacgccctggagcgaggcgatccgccggcacggcatgcagactctactgggtatcgcctggaccctgctggtggcctggctcaacccgcgcttcctgtggtggctgtcgccgatcgtcggttcgctgatcctgtcgatcccggtatcggtgatctccagccgggtgaagctgggcctgcgcgcccgcgacgaaaagctgttcctgatcccggaggagtacgacacgccgcgcgagctgcgcgccaccgacgagtacacctacgagaaccgctggcatgcgctcaaggatggcttcctcaaggccgccgtcgatccgttgctcaacgccctggcctgcgccatgggcacggctcgccacaaccgtgcgcaagccatcgagacggtgcgcggcgagcgtatcggcaaggccatcgataagggcccggaacagctcgacggcgccacgcgcctggctctgttgagtgacccggtagcactttcgcgcctgcatacgcgggtctgggaagaggaccgcgacgactggctcggccgctggcgcaaggccgaggcggacgacccccacgccgccagcgtaccgctggcccaggtagtgcccggcgacgccggcctgctgcccgccgcccagtcctga

SEQ ID NO: 16487 - DNA, 1038 bp, Pseudomonas aeruginosa
tcccatgcccccggcggaacgccgccgggggcatggtctgtttcttgcctgttttccccgtgcggcgctgctgttaccctgcgccggcaatccagaaagtctcgtatcgttcgccagctgaggtactatcggccgccttttgcgcagccggtcatggcctgctgcccgcccgggacggcgacacgacgagagcatccgttcgacgactgtgtttctaagactgctggggattggggaatgaaaaagtatcttgcttcattggttctgggcgtctgcgccctggtgggcgtggcttcggtccaggcggccggcgcggtggaggacgcggtcaagcgcggcaccctgcgggtcggcatggacccgacctacatgccgttcgagatgaccaacaagcgtggccagatcatcggcttcgaagtcgacctgctcaaggccatggccaagtccatgggcgtcaagctggagctggtctccaccagctacgatggcatcatcccggcgctgctgaccgacaagttcgacatgatcggctcgggcatgaccctgacccaggagcgcaacctgcgcctgaacttctccgagcccttcatcgtggtcggccagaccctgctggtgcgcaaggaactggaaggcaagatcaagtcctacaaggacctgaacgatccgcagtacagcatcacctcgaagatcggcaccaccggtgagatcgttgcccgcaagctgatcagcaaggccaagtaccacggcttcgacaacgagccggaagcggtgatggacgtggtcaacggcaaggccgacgccttcatctacgactcgccctacaacgtggtggcggtgagcaagttcggcgccggcaagctggtctacctcgaccagccgttcacctacgagccgctggcgttcggcctgaagaaaggcgactacgacagcatcaatttcatcaacaacttcctccatcagatccgcgaagacggcacctatcagcgcatccacgacaagtggttcaagaacaccgagtggctgaaggaaatggaatga

SEQ ID NO: 16488 - DNA, 360 bp, Pseudomonas aeruginosa
cccgccactgggccgccggcccactgctctggggcctgtggaccaccctctggctatcgctggtgtccggtgccatcggtctggctatcggcctggtcgccggcctctgccggctgtcgaagaacccgaccctgcacggcctgtcgacgatctacgtcgagctggtgcgcggcacgccgttgctggtgcagatcttcatcttctacttcttcatcggcaccgtgctcaacctgtcccgcgagttcgccggggttgcggcgctggcgctgttcaccggcgcctacgtggccgagatcatccgggccggcgtgcagtccatcgcccgcggacagaacgaggccgcccgctccctgggcctga

SEQ ID NO: 16489 - DNA, 786 bp, Pseudomonas aeruginosa
acctgcccctttcgcacatggcatcccgactggagcggaggctcggacaaagtgattgaagtacgcaacctgctgaaggtcttcgatacccgcggccaggtagtgcgcgcggtggacgacgtgagtacccgcgtggccaggggcgaggtactggtggtgatcggtccgtccggttccggcaagtcgaccttcctgcgctgcctgaacggcctggaggagttcgacgaaggctcggtgagcatcgacggcgtcgacctggccgacccgaggaccgacatcaatgcctaccgccgcgaagtcggcatggtgttccagcatttcaacctgttcccgcacatgaccgtgctcgagaacctctgcctggcccaacgcgtggtgcgcaagcgcggcaaggccgagcgcgaggccaaggcgcgggcgctgctggccaaggtcggcatcgggcagaaggccgacgaatatccctcgcgcctgtccggcggccagcagcagcgcgtggcgatcgctcgcgcgttgtgcatggaccccaaggtgatgctgttcgacgaaccgacctcggcgctcgatccggagatggtcggcgaagtcctcgacgtcatgaagaccctggccgtggaaggcatgaccatggtctgcgtgacccacgagatgggctttgcccgcgaagtggccgaccgcgtgctgttcttcgaccacggcaagctgctggaggacgcgccgccggcgcagttcttcgacaatccgcaggacccgcgggcccaggccttcctccgccaggtcctctag

SEQ ID NO: 16490 - DNA, 1620 bp, Pseudomonas aeruginosa
acggcttgcggctctgcagcgcgttggcgagcgtcgcataggcgtgcggctcttccacctcgcggaggaaatcctgcatcagtcccagcgactgggtggtgctcagcgggtcgatcagcagcaggcgttccggctcgttttccagcaatgcgtccagttcgggatcgggcgcctcggcggagatcagcagcaccttgccgctgtacaggtcgaggtagtggtcgattcccggggtatccagggcgaaggccagttcgtcgatatcgatggtcatcgggcgcatggcgtcatctcccaaaaggcgaaagcctgatcctacgcaaaggtgcccctcctgtccgctttcgatggacgggaggggctgccgatgcaaggaggatcctctcgggatgttacaggcggaagcgtcccacctgtgcctgcaactgcgtgcccaggcgcgccagctcgccgctggaggcggcggtctgctcgctggcggcggccgactgctcggcgacgtcgcgtacgctgaggacgctgcggttgatctcctcggccaccgtgctctgttgctccgcggcagtggcgatctgcaggttcatgttctggatgtcggagacggtgcgggtgatgctgtccagcgcggcgcccgcgcggcgcgccagttccaccgtgctggcggtcagcgagcggctgttctccaggcgttcggcggcttcgccggcgccctgctggagacgctggatcaggccctcgatctcggcggtggactgctgggtgcgctgggccaggccgcggacctcgtcggcgaccaccgcgaagccgcgtccggcgtcgccggcgcgtgccgcttcgatggctgcgttgagcgccagcaggttggtttgctcggccaccgacttgatcacgtcgaggacgctgccgatctgctcgctctcgttcttcaggcgcgccatggcttcgctggaaacgtccatttcgctagccaggcgctcgatgcgggtcaccgcctggtcgaccaccgcgtcgccctggcgcgcctcttcgtcggcctggcgagcggcctgggaagccagttcggcgttgcgcgcgacgtcctgcacggtggcggccatctcgtgcatggcggtggcgacctggtcggtctccactttctggctgttgaccccggcgcgggtctgctcggtgaccgccgagagttcctcggcggagctggccaactggctgacgccgtcgccgatccgcccgaccagctcgcgcaggctgtcgcccatgcgctgcatgactcgctgcaattggcccagttcgtcgcggcgctggagggtcaggggattctgcggacgcttgccgaggtcgccggcggcgatggcctcggcctgcgcgagggcttcgtccagcggccggacgatctgccggttgatcgcccagccggcgacgcagccgaaggccagggccagcgcggcgatcagccagaggctggcgcggtcgcggctggcggtgctctcgcgcaattggcgaccggcttcggtgagggtccggccggcccgggccatatcctgggtgctgctttgcatcgcttgctgcgcctggcgcgtgcggatgacgccggcacggaactgctcgatcccgccacgatag

SEQ ID NO: 16491 - DNA, 1173 bp, Pseudomonas aeruginosa
tggctcagcgtcgtcgcgtccggcgtgcgggcgcggagggccggtacgtggccggcgggcgaggtcttatggttgtcgtgcggagccctgcgcgacagaggatgtcggccgggcggggaaaaccttcagtcttttaccggagttttttcagaacaaccgcgcaagcagggcgctgaccgcggtttccacgcgcaggatgcgttcgccgagctgcaccggatgcagtccggcttcgcgcagcttgtcgacctcgtagggaatccagccgccttccgggccgatcgccagggtcaccggcttctccaccgcgcgcggacaggccggccagggaccgggatggccgaccaggccgaggctgccggcggccagggccggcaggcggtcttcgacgaagggtttgaagcgcttctcgacgatgatttccggcagcaccgtatcgcgggcctgctccaggccgaggaccaggttctcgcggatcgccgccgggtcgaggaacggggtctgccagaagctcttttccacgcggtagctgttcagcagcaccagcttcggtacgcccatcgcggcgatggtctgcaacacccggcggagcatcttcggtcgcggcaaggccagcagcagggtgatcggcagcttggccggcggcggctggtcaaagcgcacttccagggtcgcctcgctggcgtcgagcttcagcaggcgaccttcgcccatccagccgccgaggcggccgacccgcagggtgtcgccgttctcggcgcggtgcacttcgtgcaggtgcttgaggcggcgatcgtgcaggaccgcacgatccgccgacacgaagtcggcgtcgtcgaggagcagcaggttcactggcgggtggccggaggctggtcgccgtcgctggccggttggtcgtccggatgctcgccgcgcttgcgtaccaggcggccgaacagcaggccgatctcgaacagcagccacatcggcaccgcgagcatggtctgggagaagatgtccggcggggtcaggaccatgccgaccacgaaacagccgatgatcacgtacgggcggatctacttcaggtactcgacgtcgaccactccgatccagatcagcagcaccgtggccaccgggatctcgaaggcgacgccgaaggcgaagaacagagtcaggacgaagtccaggtag

SEQ ID NO: 16492 - DNA, 1557 bp, Pseudomonas aeruginosa
caggcgttcgagggtgtcgcgggccatttgcgacaggtgcggcacctgctcgacctgttgctggaaattgcgcagcaactgcttcgggctgacccgttcgcgcatccagcgctccaggaacggctgggcggtggcccacaggtcgagttccgggtagagctggcggccgaggccttcgatgttcagcagggtcttctgcagcagcaccagttgcggctggatctccatgttgaaacgacgcgcggtctggaacaggcgcagcaggacctggccgaaggagatgtccttcagcggcttctcgaagatcggttcgcagacggtgcggatcgccgcctcgaagtcgttgaccttggtttccgccggtacccagccggagtcgatatgcagttgggcgaccttgcggtagtcgcgcttgaagaaggcgatcaggttgcgcgccaggtagtcctggtcctcgtcggtcaggctgccgacgatgccgcagtccaccgcgatgtattgcgggctccagggcgcgcgggtgctgacgaagatgttgccggggtgcatgtcggcatggaaaaagctgtcgcggaacacctgggtgaagaagatctccacgccgcgctcggccagtgccttgaagtcggtgcgctggtcgcgcagggtttccaggtcggtcaccgggatgccgtagatgcgctccatcaccagcaccttgggccggcaccagtcccagtagacctgtggcacgtagagcagcggcgagccttcgaagttgcgtcgcagctgcgaggcgttggccgcctcgcggagcaggtcgagttcgtcgacgatggtcttctcgtagtcgctgaccacttccaccgggtgcaggcgccgcgcctcgctggagacccgctcggcgaggcgggcgaggatgaacagccaggcgatgtcggagcggatcaccggttccaggttcggccggatcaccttcaccaccacttcctcgccgctcttcaggcgcgcggcgtggacctgggccaccgaggcggaggccagcggttcgcgttcgaagcgggcgaagacctgttcgatcttcgcgcccagctgttcctcgatgcgcttgaccgccagctccggcgggaagggcggcaccttgtcctgcagccaggccagttcgttggcgatgtcgtcgggcagcaggtcgcggcgggtggagagaatctggccgaacttgatgaagatcggtccgaggtcctgcagtgccaggcgcaggcgcgcgccgcgggtcagttccagcttgcgccgcggcagccagcgccagggcagggtggcaccgagcaggcgcagccaccagggcagcatcggcagttcgaggatcaggtcgtccaggcggtagcggatgacgacgcgctggatgcgcaggaggcggcggacagcgaggagcttcatgcgtcgggcttggtcttttggctgaggcgtccgacgcgcgcgtcgagacgatcgagggccagcttcagctggtccagttcggcgaagcgtgcttcggcttcgtgctggccgaccagcgtacggctttcctcggcaaggtag

SEQ ID NO: 16493 - DNA, 1311 bp, Pseudomonas aeruginosa
ccaagcagatcgagaaactcaccggcgtcagcgtcaagccggcggcgaaggcagcggccaagcctgcggcgaaaccggctgccaagcccgcggcgaaaaccgcagcggccaagccggcagctaaaccggcagccaaggccgccgccaagcctgcggcgaaacccgcggcgaaaaaacccgcggcgaaaaccgcggccgccaagccggcagccaagcccgccgccaaaccgactgcgaaggccgcagcgaaaccggcgaccaagccggcagccaaggccgcggcgaagcctgctgcgaaacctgccgcagccaagccggccgctgcgaccgccgccaagcccgcggcgaaacctgccgccaagccggctgcgaaaaagcctgcggcgaagaagccggcagccaagcccgccgcggcgaaaccggccgctcccgccgcgtcttcgagcgcgcccgctgcccccgccgccacaccggctgccagcgctccggcagcgaacgctccggcgacgccgagcagccagggctgagtcctggcggcaaggcacacgcccggcactcgccgggcgtttttcattccggtcccaggtagcgctgcgccaggctttccgccgagcgttgggcctcgctgcgcagatgcggggcgaccagcatcatgatctggtagaccaccgtgcgcacctcgcccttgctgcccagtacccgctgataatccagggagaacagcagggtcagggtgatctgttcgaccagttgcccgagtgccggcgcgtcgctgcgcaactgccggtcggccttgaggcgggccagcagggtggccagggtccgcttcagcgcgccgagccaggtacggatgccgcgagccagccgtggcaggcgcccggtcaggttggacaggtcctggaacaggaagcggtagtgggcgaggcgctcgacgatcaggtgcaggaacagccagtagtcctccgcgcccaggcgcacctcctcgggcggatcgagcagcggcgccaactcggcctggaaccgctcgaacagcgccatcaccagcggttccttgccatggaagtggtagtagagattgcccgggctgatgcccagttcgttggcgatctccagtgtcgagacgttgggctcgccctgttcgttgaacagcaacagcgagcattcgaggattcggtcgcgtgtcttcatccggacttcttctggggatggaggtgcccggctccaggcgcccgggccggatctttcagcgtatatgcacgtaggtgcccggggccgcttcgaggggcggatgcgcggcgctgccaaggttga

SEQ ID NO: 16494 - DNA, 1725 bp, Pseudomonas aeruginosa
agatcagcagcggagtgcttccttccttgcccggccgcactgcggtgcggatggtctggccgtcgaggtcgatggtccggaagacgaagggctggggcatgctcggggtcctcggcggcgcagccgcgggctcggcgatacggggcctggccggcttccgcgcggcacggggccgcgccggaggcgctggcggggtttcgtcggcggaggccgcggatcgctcctgcggctgttcttcaggctggtcgcttttcatcgttcatgcacgtaggttccgggcgcggcttcgccggccggataggtcttgttgcccaggctggcgggcgccttgcgggtcttgccggagcgttcggccagccattgctgccagtgcaaccaccacgagtcggcgtgcttgccggcctgttccagccaggccttgggctcggcgggcagttccggattggtcatgaagcgtgccttggggttgcccggtgggttgaggatgctctggatgtgaccgctgttggagaggatgaactcgcacttgccacccagcagcctggccgacttgtagcacgactcccagggggtgatgtggtcgttcagaccggcgacacagtagaagtcgcaagtcacctgcttcaggtcgatgggcgtgccggagacctccagggcgccggggcggttcagcgggttgctcttgaacagttcgacgaactcgccgtgcagcgcggcgggcaggcgcgtggtgtcgttgttccagtagaggatgtcgaacgccggcggctggttgccgagcaggtagttgttgacccagtagttccagatcaggtcgttggggcgcatccaggcgaacaccttggccatgtccttgccctccagcacgccggactggtaggagcgacgcttggcggcctccagggtcttctcgtcggcgaacagcgcgacctgggtattcagttcgaagtcgagcacgctgaccagttgggtgaaggcgttgaccttcttctcgccgctggccacgtagtggccgaccagggtcgcggtggtgatcccgccggagcaggcgccgaggaggttgaggtccttgctgccggtgatcgacaggactacctcgatggcctccttgagcgcctcgatataggtggtcaggccccattcgcgctgcgacttggtcgggttgcgccagctgacgatgaaggtctgcacgccgttgcgcaggcagaagcgcgccaggctcttgtccggcgacaggtcgaagacgtagaacttgttgatctgcggcggcaccaccagcagcgggcgttcgtgcaccgactcggtgatcggccggtactggatcagttccagcacgtcgttgcggaacaccacggcgccctcggtggtggccaggttcttgcccacctcgaaggcgtccatgtccacctggctcggcatcccgccgttgttcaccaggtccttggccaggtggccgaggccgtccagcaggctcttgccgccggtctcgaagaagcgcttgaccgccgccgggttgctcaggctgttggtcggcgacatcgcctcggtcagcaggttgatgacgaactggccacgactgatgtcctgcggcgacaggtcgctgtggctgatccagctgtgcagctccttgcgccaggccaggtaggtctgcatgtagcgcttgtacagtggattctggctccaggccggatcggaaaagcgtcggtcgtcatcgcctgggcgtag

SEQ ID NO: 16495 - DNA, 1014 bp, Pseudomonas aeruginosa
ccggcatcgatcaggatcggcttgtcgctatgctcgctggccaggtcggcggcgctgaacgagacctcttccagcagccgctcgagcagcgtatgcaggcggcgggcaccgatgttctcggtcttctcgttgacctgccaggcgatctcggcaaggcgcttgatgccgtcctcggcgaactcgatggccagcccctcggtcttcagcaactcgcggtactgctcggtgagcgaggcatgcggctcggtgaggatgcgctcgaaatcgttcggactgagggccttgagctccacgcggatcggcaggcggccctgcagctcgggaaccaggtcgctcggcttgctcaggtggaaggcgccggaggcgatgaacaggatgtggtcggtcttgaccatgcccagcttggtgttcaccgtgcagccctcgatcagcggcagcaggtcgcgctgtacgccctcgcgggagacgtcggcgccgccggcgttggcgcgcttggcgatcttgtcgatctcgtcgatgaagacgatgccgtgctgctcgaccgcctccagggcgcgtgccttgagctcttcctcgttgaccaggcgcaccgcctcttcgtcgcggatcagcttcagggcctcggcgaccttcagcttgcgggtcttcttcttgcccttgctcatgccggagaacaggttctgcaactggttggtcatctcctccatgccgggcggggccatgatctccacgccggccgggttgtcggccacctcgatgtcgatttccttgtcgtccagctggccttcgcgcaggcgcttgcggaacagctggcgggtgttgctgtcctcgcgtgccggctcgtcgccgaagcccatggcgggacgcgcggccggcagcagggcatcgaggatgcgctcttcggcggcgtcctcggcgcgatacttgaccttctggatctcctgttcgcggagcatcttcaccgcggcgtcggcgagatcgcggatgatcgactcgacgtcgcgtccgacatag

SEQ ID NO: 16496 - DNA, 984 bp, Pseudomonas aeruginosa
ccgacctcggtgaacttggtcgcctcgaccttgatgaacggcgcgttcgccaggcgcgccaggcggcgggcgatctcggtcttgccgacgccggtggggccgatcatgaggatgttctttggtgttacctcggcgcgcagctcggccggcagttgcatgcgtcgccagcggttgcgcagggcgatggcgacggcgcgcttggcgtcgtcctggccgatgatgtggcggttgagttcgtggacgatctcgcggggcgtcatggacattcgtttactccagcgggggacgagcgcttcagacggcgctgtccagctcctcgatggtcaggttctggttggtgaagacgcagatcgagccggcgatgttcagcgcggtctcggcgacttcccgagcgctcagctcggcgttgtgctgcagcagggccagggccgcggcctgggcgaagccgccgccggagcccatggcgatcaggccgtgttcgggttcgaccacgtcgccgttgccggtgatgatcagcgaggcatccttgttggcgaccgcgagcatggcttcgaggcggctcagggagcggtcggtgcgccagtccttggccagttcgacggcggcgcggaccaggtgcccctggtgtttctccagttgctgctcgaagcgctcgaacagggtgaaggcatcggcggtggcgccggcgaaaccggccagtacctgaccgtgatacaggcgccggaccttcttggcgttgcctttcatcacggtgttgcccagggaaacctggccgtcgccgcccatgacgactttgccgttgcggcggacagatacgatggtggtcaagggggaaatctccacactgcggggccgaatgcccggaatgctgggagatataggggcgatccgcggcttttcaaccgcacgcaccgccgtgcgtcggaacgcacggcgtggcccgcgttcagcgggccttgcgttgctgtaacagcaggttgctga

SEQ ID NO: 16497 - DNA, 408 bp, Pseudomonas aeruginosa
tctgcgcgcgcacgcggtcggcgtcggactgcttgcggaacgagccggcctgcaggaagaactgcgtgctggcggcgaccaccgctttcggcagcggcggtggcacctgcccggcgagtgcggccttggcccgcgcttcgtcggccttggccagttcggcgggggtgggcggcggcggggccttctccggtaccgcttccggcggcaccacgacctcggactccggcagcagggtgtagaactcgtacttcggcttggcctgggccggcgtctgcgtttgcgcgggctgctgggcctggccgttctgctgcggctgcttgccctgcacggcggcggccgggcgctgggcgtccgggcgttcgcgctggacgtccttgcgcccgggttcgagcttcatcaggaacatga

SEQ ID NO: 16498 - DNA, 219 bp, Pseudomonas aeruginosa
atcatgaaagcggacatccatccgacttacgaagctatcgaagctacctgcagctgcggtaacgtcatcaagacccgttccaccctgtgcaagccgatccacctggacgtgtgctccgaatgccacccgttctacaccggcaagcagaaggtgctggacaccggcggccgtatcgaccgcttcaagcagcgtttcggcgtattcggcgccaccaagtaa

SEQ ID NO: 16499 - DNA, 465 bp, Pseudomonas aeruginosa
catggaactggaagccgatggtctcggcgctcagtacctggcccgcgccggctacgatccgacggcgatgatccaggtggtgcgggtgctgaagaaccaggaggacttcgctcgcgaagaggctgcgcgcaatggccaggcggtacaggccggcggctaccacgggttgttcgatacccatccggacaacgaccggcgtctgcaggaagtggtcggcccggcccggcaactggccaacggacagcaggaagtggggcgcgaggtctttcttcgccatctggaaggcatgccgttcggcgactcggcatcggccggggtgcgtcgcgggcagaacttctaccatgccgagctggacttcaccctgagctatccggcgggctggaagatcctcaaccagcccagtgccctgcttggctatccggcggacgagcagtcgttcatcggcatgaagctggtgccccatga

SEQ ID NO: 16500 - DNA, 2280 bp, Pseudomonas aeruginosa
aatcggtggacgacgtcttcaacggctgatcgatcgatccgccggataaaaagaaaccccgccttggcggggtttctttttgcctgcgcctcgcgctcccgtcgtcgccaacgaagcgcaggcgccggttcagaacaggtcgatcggcgcgccttcgtcatccggcagcgggctgccagggaagctgcctggcggcagttcgttgaccgagggcggggtgtcctcgttcttgaacatctcgaaataggcgccgggagtgcccggcgcggccgaacggccggtcaccgggtcgatgcgcaggctgacgatgcctggcggttcggccatggtgtgcatcggcttgtccttgagggcgaagcccatgtacctgatccagatcggcagcgcgacggtaccgccgtactcgcggcgacccagggtctccggctggtcgaagccgacccagacgcaggtcacgtagtcggagttgtagccggagaaccagccatccttggaatcgttggtggtgccggtcttgccggccaggtcggtgcgcttcagcgccagggcgcgacgcccggtaccgcgcttgatcacgtcctgcagcatgctggtcatgatataggcggtacgggcatcgatgatccgctcggccggggtcggctcgaaggtggtctgggccttggcggcgatttgctgggcttcgatcgaaccttcgccttcggcgctctccggatgctcggggtcaccaggattcccggcgtcttccgcatccggcgcagcgacctgttcttccaccggcacgcggggcggattggcctggtacagcacctgtccgtcgcggctctcgatgcgttcgatgacgtacggattgaccttgtagccgccgttggcgaatacgctccaggcgccggcgatttccatcggtgtgactgtcgcggtacccagggccagggagaagttgcgcggcagttcgtcgcgctggaagccgaacttggtgatgtagctgatcgcccgctcgatgcccaggccctgcaggacgcggatcgagaccatgttgcgggacttgtacagggcttcgcgcagcgggatcgggccgaggaaggtgttggtgtcgttcttcggtcgccagaccttgtccaggtactcgtcgacgaacacgatcggcgcatcgttgaccaggctggcggcggtgaagccgttgtccagggccgcgctgtagatgaacggcttgaaactggagcccggctggcgcttggcctggatcgcgcggttgtagttgctctgctcgaaggagaagccgccgaccagcgagcggatcgccccgtccttcgggtcaagggagatcagcgcgctctgtgcggcgggaatctgtacgaagcgcagggtgccgtcttcctggcgctgcacgcggatctggtcgccggcctgggccacgtcggcgggctggcgcggcatcgggcccatgctgttgttgctgaggaaggggcgtgcccatttcatgctgtcccaggtcacggcttcttccttgccgtcgcgggtcatcaccatgatcccgctcttttccacctgggtgacgatcgccggctccaggccgccgatgctgcgctgctggcccaggtgcttgagccaggcgtcgcgggtctggcccggcaggcgggtctccgggccgcggtagccgtggcgctggtcatagtcgatgaggccgtcgcggaccgattggctggcggcgttctgcaggtcgctgcggaccgtggtgatgaccttgtagccctcggtataggcctcgctgccgtagcggccgaccatctcggcacgggccatctcggcgatgtagggcgcattcagttcgggggtctgcacgtggtaggaggcgttgatcggctcctcgacggcggcctggtagcgttgctggtcgatgaagccgagcttgagcatgcgctcgaggatccagttgcgccgctccgtactgcgggtcgggttgaccagcgggttgtagcgcgagggcgctttcggcaggccggcgatcatcgccatctcggccaggctcaagtctttgatcggcttgccgtaatagacctgtgcggcagcctcgatgccataggcacggttgcccaggtagatcttgttgacgtagagctcgaggatctcgtccttggtcagctgtcgctcgatctgcagggccaggaggatttcattgatctttcgcgagaagcttctttcattggtaaggaagtagttcttcgctacctgcatggtgatggtgctgccgccagtctggatgtgaccgcttttcaataa

SEQ ID NO: 16501 - DNA, 897 bp, Pseudomonas aeruginosa
ctacgacagcgaagttctgcgtccgttcaaggacgccgtggtgcagcaggtttcccgctcgctgcagttcttcttcgccgccggacagttcaacgacgtcgactacatcgtcctggcgggcggtacggcgtctatccaggatctcgatcggttgatccagcagaagatcggcaccccgaccctggtcgccaacccgttcgccgacatggcgctgaacggcaaggtgaatgccggcgccctggccagcgacgctccggcgttgatgatcgcctgcggcctggcgttgaggagtttcgactgatggcacggatcaaccttctaccctggcgcgaagagctgcgcgagcagcgcaagcagcagttcctggtgattcttggcggcgtcctggtggcatcggctgcgctggtattccttggcgaccagtacttcaccgcggccatcgagaaccagaacgcccgcaacgacttcctgcgcaaggaaatcgtcgtactcgacgcccggatcaaggaaatcagcgaactgaagtcgcggcgccagcaattgctcgagcggatgaagatcatccaggacctgcagggcaaccgtcccatcatcggacgggtgttcgaccagctcgtgcggaccttgcccgacggcgtgtatttcaccgacctgaagatgaccggcaagaacatcgccatcgccggcgcggccgagtccaacaaccgcgtttccaatctcatgcgcaacatggacgcgtccgagtggctgaccgccccgaccctgaacgaggtcaaggcggtgacccagggcgcggtggaccaggccaacgtgttccaactgaccgtgcagcagacgcagcccggcgaggaagacgccaaggcgaagcatggggttgcgcaaggagccaagaaatga

SEQ ID NO: 16502 - DNA, 2256 bp, Pseudomonas aeruginosa
cggagaggggaactggctggagcgtccgcgcagcctgactctcaaggaacgctcctgagggcggggaaaaacatgcataaccaacagcagtctgtacaacggagtcggacgatgaacagtggcctctcgcgcctcgggatcgctttgctggccgccatgttcgcgccggcattgctcgccgcggacctggagaaactcgacgtggcggcattgcctggcgaccgggtcgagctaaagctgcagttcgacgagcccgtcgccgcgccgcgtggctataccatcgagcagccggcgcgaatcgccctcgatctgccgggggtacagaacaagctcggcaccaagaaccgcgagctgagcgtgggcaatacgcgcagcgtcacggtggtcgaggcgaaggatcgcacacggttgatcatcaacctgaccacgttgtcgtcctacaccacccgggtggaaggcaacaacctcttcgtggtggtcggcaattcgccggccggcgccagcgtcgcttccaccgctccggtcaaggctagcccggctccggccagctatgcccagccgatcaagcccaagccgtacgtgccggcgggtcgtgccattcgcaacatcgatttccagcgtggcgaaaagggcgagggcaacgtggtcatcgacctgtccgacccgaccttgagcccggatatccaggagcagggtggcaagatccgcctggacttcgccaagacccagttgccggatgcgctgcgggttcgcctggacgtcaaggacttcgccacgccggtgcagtttgtcaacgccagcgcgcaatccgaccgtaccagcatcaccatcgaaccgagcgggctctacgactatctggtctaccagaccgacaatcgcctgaccgtcagcatcaagccgatgaccacggaagacgccgagcggcgcaagaaggacaatttcgcctataccggtgagaaactgtcgctgaacttccaggacatcgacgtgcgttcggtactgcagctgatcgccgacttcaccgacctgaacctggtggcctcggataccgtgcagggcaatatcaccctgcgcctgcagaacgtgccgtgggaccaggcgctggacctggtgctgaagaccaagggcctggacaagcgcaagctcggcaacgtgctgctggtggccccggccgacgagatcgccgcccgtgagcgccaggagctggaagcgcagaagcagatcgccgagttggcgccactgcgtcgggaactgatccaggtgaactacgccaaggccgcggacatcgccaagctgttccagtcggtgaccagcgatggtggccaggaaggcaaggaaggcgggcgcggctcgatcaccgtcgacgaccgcaccaacagcatcatcgcctatcagccccaggagcgactggacgaactgcggcggatcgtttcgcagctggatattccggtgcgccaggtgatgatcgaggcacgcatcgtcgaggccaacgtcggttacgacaagagcctcggtgtgcgctggggcggcgcttatcacaagggcaactggaacggctacggcaaggacggcaatatcgggatcaaggacgaggacggcatgaactgcggcccgatcgccggcaactgtactttccccaccacgggaaccagcaagtcgccgtcgccgttcgtcgacctcggtgccaaggatgctacctccgggatcggcatcggcttcatcaccgacaacatcatcctcgacctgcaactgtcggcgatggaaaagaccggcaacggcgagatcgtctcccaacccaaggtcgtgacctcggacaaggaaaccgcgaagatcctcaagggctcggaagtcccctaccaggaggccagttccagcggcgctaccagcacctcgttcaaggaagccgcgctgtccctcgaggtgaccccgcagatcaccccggacaaccggatcatcgtcgaagtcaaggtgaccaaggacgcgccggattaccagaatatgttgaacggcgtacctcctatcaacaagaacgaggtcaacgccaagatcctggtcaacgatggcgagaccatcgtcatcggcggcgtgttcagtaacgagcagagcaagtcggtggagaaggtgccgttcctcggcgaactgccttacctggggcggctgttccggcgtgataccgtcaccgaccggaaaaacgaacttctggttttcctgacaccgcggatcatgaataatcaggccatcgcaatcggtcgctga

SEQ ID NO: 16503 - DNA, 1278 bp, Pseudomonas aeruginosa
tggcgctgcgcgatccgctctaccgcgaaatcgccgatgtggtggtggagaccgacgaaaggccgccgcgcctggtcgtccaggaaattctcgaacgcctgcgcaagttgccgccccgctgaggcgcggcgaattgcgttatcctattgccctttcctgtctgggggcctcatgcgcacacttcacgtcgatctaggcgagcgtagctatcccatttacatcggtgaaaacctgctgggcgacgcccgctggttcgcgccacatatcgtcggtcgccgggtcgcggtgatcagcaacgaaacggtcgctcctctctatctggaaaccctgctcaaggcactgcaaggccatgaggtcacccctgtggtgctgcccgacggcgaggcctacaagcagtgggaaaccctgcaactgatcttcgatgccctgctgaaggagcggcatgaccgcaagactaccctgatcgccctgggcggcggcgtcatcggtgacatggccggtttcgccgcggcctgctaccagcgtggggtcaacttcatccaggtgccgaccaccctgttgtcccaggtcgactcctcggtgggcggcaagaccgggatcaaccatccgttgggcaagaacatgatcggtgcgttctaccagccccaggcggtggtcatcgacaccgcgtcgctgaagacgctgccgtcccgcgagctgtccgccgggctggcggaggtgatcaagtacggtttcatttgcgacgaaccgttcatcacctggctggaagagcacatggatgccttgctggcactggagccgaccgttgtcaccgaggccatcgagcgctcttgcgcggcgaaggcccgcgtggtgggcgccgacgagcgcgagtcgggcgtgcgtgccacgctgaacctcggccataccttcggtcacgcgatcgagacccagcagggttacggcgtctggttgcacggcgaagcggtaggggcgggaaccgtgatggcactcgagatgtcgcatcggttgggttggctgagcgccgccgagcgcgatcgcggtatccgtctgctgcgccgggctggcctgcccgtggtaccgccggccgagatgacggcggaagattttatggaacacatggccgtcgacaagaaagtgctcgatggccgcctgcgtctggttttgctgcaaggactggggaatgccgtggtcaccggcgattttccccgtgagatcttggacgcgaccctgcgcaccgactatcgggccttggccgaccagcttggagatgaatga

SEQ ID NO: 16504 - DNA, 1587 bp, Pseudomonas aeruginosa
ggtcccatgaccagcttgcatgccgatgaggccttcctgggccactaccaattcagtcacgacccgttcgcgccgcgcgttccgggtttcaagttcttcccggcgcagcgcaagccggtgctcggccagttgcaccatctggcccgctacagccagctcctgctgctggtcaccgggcccctgggcagcggcaagaccctgctgcgccaggcgctggtggccagcaccaacaaggatgcggtcctcagcgtggtgatctcggcgcgcaccgccgccgacgagacttcgttgctgcgccaggtggcgcagggcctgagcatcaaccaggcgagcctggaggcgatcctgaccaaggtggcgcagctggcgatcaccgggcaggacgtctacctgatggtggacgatgccgaacagctccaggacagcgcgctggaagtgctgttgctgctggcttccggcaccaacgagggacgcctgcatgtattcctgttcggtgagccgtcgttgctgccgcgcctggaggtgttttccgagggtgaggagcgcttccatgccatcgaattgcagccatacagcgaagaggaaacccgcgactacctggcccagcgtctcgagggcgccgggcagggcatcgagctgatttccaacgacctgctggtggacatccacgagcagtcggaaggctggccgggagcgatcaaccaggtcgcccgcgatgccctgatcgaagcgatgctggccaatcgtggcgcagcgcgcaaggcaaccggagggtctttcaacttgcccaagaagcatctggtgattcttgcggtcgtggccatcggcgtgatcgccgcctggttcatgcaaggcaagagcaagccggaggcgccgcagaccgcctctaccgaattgtccatgaatggtggtacgccggcccaggcccagcagccgggcagcggcccggccgtggagttcaacggctccagccagccgttgccgctaccgttggtcggcgagtcgcagccggtcattcgcgagccgctggcccaggccgccgggcaaggtggcgacgacgaaggcggcctgccgttccgccgcggtgccgcctaccgtttccagctcgggtcctcccgggtgacgccgctggccaacaacggcgtcacgccgatgcatccgggtgcccccggccccgaccgaaccgaccgcccctgcggagacccccgattccgggggcaggcccccgacaccggcccgggccggtcgccaagggccccggccagcaagccggccccggccccgtttcaggcccaagccgggggcgagcaagccggccaccaccgccgggggggaagccggccccggatccggccgccaagccggccagcggtggcggtgcgggaagtcagtggtatcgcaaccagtctggtggtaacttcgccctgcagatcctcggtaccggctccgaagccaatgcccaggcgttcattcgccagcagggcggcggcgatttccgctacttcaagaaaaccctgcaaggcaagccgttctacgtcgtcacctatggcagcttcccgaaccgtgccgccgccctggccgcagtga

SEQ ID NO: 16505 - DNA, 1365 bp, Pseudomonas aeruginosa
ctgcggatttggcctgatcgcccatatgcagggcgagccgagccatcaacttctgcaaaccgcaatcgaagcactgacctgcatgacccaccgcggtgggatcaatgccgatggcaagaccggggacggctgcgggctgctgatccagaagcccgacctgttcctgcgtgccgtcgccagggaagccttttctgtcgacctgcccgagcaatacgcggtgggcatggtgttcttcaaccaggacccggtgaaagccgaggcggcacgcgagaacatgaatcgcgagatcgtcgccgccggactggagctggtcggctggcgcaaggtgccgatcgataccagcgttctcggccgcctggcgctggagcgtctgccgcagatcgaacaggtgttcatcggcggcgccggcctgagcgaccaggacttcgccatcaagctgttcagcgcacggcgccgctcgtcggtggccaacgccgccgacagcgaccactacatctgcagcttttcgcacaaaaccatcatctacaagggcctgatgatgccggccgacctggccgccttctatccggaccttggcgacgagcgcctgcagaccgcgatctgcgtattccaccagcgcttctccaccaacaccctgccgaaatggccgctggcgcagccgttccgcttcctcgcccacaacggcgagatcaacaccatcaccggcaaccgcaactgggcccaggcgcggcggaccaagttcaccaacgaactgatccccgacctggaagagctcggcccgctggtgaaccgcgtcggctccgactcgtcgagcatggacaacatgctcgaactgatggtcaccggcggcatggacctgttccgcggcctgcgcatgatcatcccgccggcctggcagaacgtcgaaaccatggacgccgacctgcgcgcgttctacgagtacaactcgctgcacatggagccctgggatggccccgccggcgtcgtgctgaccgacggtcgctatgccgtctgcctgctcgaccgcaatggcctgcgcccgtcgcgctgggtcaccacgaagaacggctacatcaccctggcttcggaaatcggcgtctgggactacaagcccgaggacgtcatcgccaaggggcgcgtcggcccggggcagatcctcgcggtggacaccgagaccggccaggtcctgcacagcgacgacatcgacaaccgcctgaagtcgcgccatccctacaagcagtggctgcggcagaatgccctgcgcatccaggcgaccctggacgacgaccatggcgtggccagctacgacgccgaccagctcaagcaattcatgaagatgttccaggtcaccttcgaggagcgtga

SEQ ID NO: 16506 - DNA, 660 bp, Pseudomonas aeruginosa
ccaggtgctgcgtccgctcggcgagcagggccaggaagcggtgggctccatgggcgacgatacgccgatggcgatcctctcccggcgcatccgctctccgtacgattacttccgccagcaattcgcccaggtcaccaacccgccgatcgacccgctgcgcgaagccatcgtgatgtccctggaaacctgcctgggcgtcgagcagaacatcttcgaggaagccccgcaccatgccaaccaggcgatcctcaccactccggtgatctcgccggcgaagtggcggaccatcatgaccctggaccgcccgggcttcgaccgccacttcatcgacctcaactacgacgagtcgatgggcctggaggccgcggtgcgcaacatcgccgaccaggccgaggaggccgtgcgcggcggcaaggtgctgctgatcctcagcgaccgccatatcgctcccggcaaactgccggtgcatgctgccctggccgtcggtgcggtgcatcaccgcctggtgcagaccgggctgcgctgcgactccaacatcctggtggagaccgccaccgcccgcgatccgcaccatttcgcggtgctgatcggcttcggcgcctcggcggtctatccgttcctcgcctacgaggtgctggccgacctgatccgcaccggtga

SEQ ID NO: 16507 - DNA, 2382 bp, Pseudomonas aeruginosa
agtgctgggcgacctctacgaggtgttcaagtactaccgcaaggggatctccaagggcctgatgaagattctctcgaagatgggcatctccaccgtcgcgtcctaccgtggcgcgcagctgttcgaggcggtgggcctgtccgacgaggtcaccgacctgtgcttcaccggagtcgccagccgcatccagggcgcgcgcttcgtcgatatcgagaacgagcagaagctcctggccgccgaggcctggagcaaccgcaagccgatccagcagggcggcttgctgaagttcgtctatggcggcgaataccacgcctacaacccggatgtggtgaataccctgcaggctgccgtgcagcagggcgactacgagaagttcaaggaatacaccgcgctggtggaccagcgcccagtgtcgatgatccgcgacctgttgcaggtgaagaccgccgcgcagccgctggcgctcgacgaggtggagccgctggaagccatcttcaagcgcttcgatgccgccgggatttccctcggcgcgctgtcgccggaggcccacgaggcgctggccgaggcgatgaacaccctgggcggtcgctccaactccggcgagggcggcgaggacccggcgcgctacggcacgctgaagagttcgaagatcaagcaggtggctaccggccgcttcggcgtgaccccggaatacctggtcaacgccgaggtcctgcagatcaaggtggcccagggcccccatgccccggcgagggcggccagttgccgggcggcaaggtcaacggcctgatcgcccgcctgcgctatgcggtgcccggcgtgaccctgatctcgccgccgccgcaccacgacatctactccatcgaagacctggcgcagctgatcttcgacctcaagcaggtcaacccgcaggcgctggtatcggtgaagctggtatccgagccgggcgtcggcaccatcgccgccggcgtggccaaggcctatgcggacctgatcaccatctccggctacgacggcggtaccggcgcctcgccgatcacctcgatcaagtacgccggctcgccctgggaactgggcctggcggaaacccaccagaccctgcgcggcaacgacctgcgcggcaaggtccgggtgcagaccgatggcggcctgaagaccggcctggacgtgatcaaggcggccattctcggcgccgagagcttcggcttcggcaccgcgccgatgatcgccctgggctgcaagtacctgcgcatctgccacctgaacaactgcgccaccggcgtggcgacgcagaacgacaagttgcgcaaggaccacttcatcggcaccaccgcgatggtgatcaacttcttcaccttcatcgccacggaaacccgcgagtggctggcgcgcctcggcgtgcgcagcctgggcgagctgatcggccgcaccgacctgctggagatcctccccggcgagaccgccaagcagcagaatctggatctcgctccgttgctgggcagtgagctgatcccggccgacaagccgcagttctgcgaggtggagaaaaacccgccgttcgaccagggcctgctggccgagaagatggtcgagctgtcgaaggccgccatcgaaggcctgagcggcggcgagtacgagctggacatctgcaactgcgaccgatccatcggcgcgcgggtatccggcgagatcgcccgcctgcacggcaaccagggcatggccaaggcaccggtggtgttccgtttcaagggcaccgcgggacagagcttcggcgtgtggaacgccggtggcctgcacctgtacctggaaggcgacgccaacgactacgtaggcaagggcatgaccggcggcaagctggtgatcaccccgcccaagggcagtccgttcaagacccaggaatctgccatcgtcggcaacacctgcctgtacggcgccaccggcggcaagctgttcgccgccggaaccgccggcgagcgcttcgccgtgcgcaactccggttcccatgcggtggtggaaggtaccggcgaccactgctgcgaatacatgaccggcggtttcgtctgcgtgctgggcaagaccggctacaacttcggctccggcatgaccgggggcttcgcctacgtcctcgacatggacaacactttcgtcgaccgcgtgaaccacgagctggtggaaatccagcggatcagcggcgaggcgatggaggcctatcgcagccacctgcgcaaggtcctggtcgagtacgtgaacgaaacggcaagcgagtggggcgcgaacatcctggaaaacctggatgactacctgcgtcggttctggctggtgaaaccgaaggcggccagcctcggttcgctgctgaccagcacccgtgccaacccgcaataa

SEQ ID NO: 16508 - DNA, 543 bp, Pseudomonas aeruginosa
cgaagaaaacatgccgggctcgcgcaaggaagtgaagaacgccaaggaagagggcgtgaagttcctcttcaaccgccagcccatcgccatcgtcggcgaggaccgggtggaaggcgtgaaggtggtcgagacccgtctcggcgagccggacgcccgcggccgccgcagccccgaaccgatccccggttccgaggagatcatcccggcggaagccgtgctgatcgccttcggcttccggccgagtccggcgccgtggttcgagcgcttcgagatcgccaccgacagccagggccgcgtggtggctccggcgcaggcgcagttcaagcaccagaccagcaacccgaagatcttcgccggtggcgacatggtccgtggttccgacctggtggtgacggcgatcttcgaaggacgtaccgcggccgaaggcatcctcgactaccttggcgtctgatccgcggcgccaccggcgctgcgacaaatcaccgcgatagacaaaaggcacggcccccgccgtgccttttgttttgtgctttgcgacaatag

SEQ ID NO: 16509 - DNA, 1080 bp, Pseudomonas aeruginosa
tcggatgccgttatgactgccctgaagaacgaccgcttcctccgcgccctgctcaagcagcccgtcgatgtcacccccgtctggatgatgcgccaggccggtcgttacctgccggaataccgtgccacccgtgccaaggccggcgatttcatgagcctgtgcatgaacccggagctggcctgcgaagtgaccctgcagccgctggaccgttacccgcagctggacgccgcgatcctcttctccgatatcctgaccattcccgatgccatgggccagggcctgtacttcgagaccggcgaaggcccgcgcttccgcaaggtggtctcgtcgctggccgacatcgaggcgctgccggttcccgatccggaacaggacctgggctatgtgatggatgccgtgcgcaccatccgccgcgagctgaacggccgcgtaccgctgatcggcttctccggcagcccctggaccctcgccacctacatggtcgagggcggctcgagcaaggacttccgcaagtccaaggcgatgctctacgacaaccctcaggccatgcacgctctgctggacaagctggcgcaatcggtgaccagctacctcaacgggcagatccacgccggcgcccaggcggtgcagatcttcgactcatggggcggcagcctgtcggcggcggcctaccaggagttctccctgacctacatgcgcaagatcgtcgatggattgatccgcgagcacgacggacgccgggtgccggtgatcctcttcaccaagggaggcggcctgtggctggagtcgatggccgaggtcggcgccgaggcgctgggcctggactggacctgcgacatcggcagcgcccgggcccgtgtcggtgagcgcgtagccctgcaaggcaacatggatccctcggtgctctacgccaatccggcggcgatccgcgccgaagtcgcgcggatcctggcggcctacggcaagggtacggggcatgtgttcaatcttggccacggcatcaccccggaagtcgacccggcccatgccggcgccttcttcgaggcggtgcacgagctgtcggcgcagtaccacggctga

SEQ ID NO: 16510 - DNA, 1287 bp, Pseudomonas aeruginosa
gccggaacgaaagaaggggagccgaggctcccctttttcatgcgcgggccgacggccctccggcgcgttggctggcggggtcgcgccggtggcgtacccgccctacgcaacccgcccggctcaactgcttaccttgccggtgcggtcgttgatcacgaacagcttgccgttggcgtcgcgcacgaggatttccgcgcccggctggccatccatgtcggccaccgaatcgatgctgtagttgacgtcgccgatgcggtagtcgctgctggcgccgctggcgtggtggatgacccgcaccttgccctgcatcaccacgatcagctcgttgcccggcttgccgtcggtgtccgcggtgccgccatagagtgcccaggcgctggcgccgatgttgtattccttgcgggaactggcgttgctgatcacgtagatgccggtgctggtgcggccgatgatctccgcgccgggctggccgtcgaggtcggcgatctgtgcgagcgcgtggtagccgctgaaggtgaagtccttggcgccaccggtgcgcgggtcgatgaccttgacgccgttgcccatgttcagcaccagttccttgcccggcgcgccgtccacgtcggcgacgtcgaacaggccccaggtgccgttgtagctgaaggtggcgtcgcgttgcgtacgggtgcgatcgaatacggtgcgcacgccgttgccgatgctgaggatgacttcgtcgccggcgacgttgtcgacgtcggtggcgcgcatgatcgcccaggagacgttgcctaccgggtacttgcgctgggtggtgctggcgtgggaaacgatcaccaggtcgggaccggccttgaccaggatttccgcgccgggctggccgtcggtatcggtggcgccgaagaccgaccagaccacgttgccgaagctgtagttgcgggtgctgccgccttccaccacctgcaggttggcgccgtcgcggtagaccgcggcgagctggccgttgccccgcaggtcccaggttcctaccagaacgccggccgcctgggctgcgctggcgcagagggagaacagtgccgtgccgagcaggcaggcgcgcttgatcgctggtttcataaagtccctttcatatcgctgtcgaggccggccggatgccggccgcagcagcataggacagcgcttgccgcgctcaagggaaacgcgagggatttgtcgagcgcttggcatttgttcgtgaaactggttgcccgcccagcaggcgggcgcgggtgtcgctcggcggctcgccggtccagcgcttga

SEQ ID NO: 16511 - DNA, 1383 bp, Pseudomonas aeruginosa
tggtcggtgcgtcggagtccgtgcggcggctcatgctggcgtgtcctggcccgaaatgatcggcagtctggcgcgagcgcgtctgccgctgcattggctggtgccgcgatactgcccggcaacgcagtcaagcggagaacgagcgatgcatccctgggcacgacgcaacattccacaactggccgggcgcctggcgctggtcaccggcgccaacagcggcctgggttggcaggcggcgcgcacgctggccggcaaaggggcgaccgtggtgatggcctgccgcaatcgcgaacaggcggagcgggcgcggcgggcgatcctcgacgagtatccccaggcacgcctggagctggccgatctcgacctggccgacctcgcctcgatccgcgcctgcgccgccggtttccgtcagcgccacgaacgcctcgatctcttgttcaacaacgccggagtgatgttcctgcccctgcggcgtacccgcgacggtttcgagatgcagatgggcaccaatcacctcggccacttcgcccttacgggactgctgctggagtcgttgctggccgctccacggcccagggtggtgggcatgaccagcggtttcaaccagttcggccggctgccgctcgacgacctcaacgccgagcgcggctacaaccgctatctcgcctattgccacagcaagcaggccaatctgctgttcagcctggagttgcagcgccgcgccggccagcggggcgtgcttctgcagagcctggcggcgcatccgggctacgcggcgaccaacctgcagtacgcggcgccggcgatggccggttcgcgcctgggacgctgggcgatgaaggtggccaacggagcgttcgcgcaatcggcggagatgggggcgttgccggcactttccgcgctgaccgaacagcgctggtatggcggcgcctatgtcggcccggatcgctggttggaaacccgcggttatccggcggcggcgcggattccgcggaatgcgcgcgacctggggctggccgcgcggctgtgggcgcgatcggaggaactgaccggagtacgcttctggtcggagtgaaggcgccgggagaccggcgctcgaactcagtgggcggcctgcgccagggtgttgccaggcagggccggcaggcgcgccaggtgcagcgagaccaataccgcgaccaccagcagcgagccgatgaacagcccgatgccgttccagccgtagtaatgccagaacaccccgccgagggtgccggccaggctcgagccgacgtagtagctgaacaggtagagcgacgaggcctggcccttggcgcgcagggcgcggcgcccgatccagctgctcgccaccgagtgcgcgccgaagaagccgaaggtgaatag

SEQ ID NO: 16512 - DNA, 888 bp, Pseudomonas aeruginosa
cagcaggccggcgagcatcagcgggatcggctcgaacagggtcagcagcaggccgccgagcatcagcaggatgaccgcccagagcaccttgcgtcgccccagcttgtcggccagcgaaccgacccaggccgagctgtagatgcccgagaggtaaaccaccgagagcacgccgaccaccgcctggctcatgtggtagggctcggccagcaggcggtagccgatgtagttgaacagggtgacgaagctgcccatcagcaggaagccgatcaggaacagccagggcagtccggcgtcgcggaagtgcaggcggtagccgttgagcagggtcgccggcttcagcggtgccggccggaagtgtttcgattcgggcagcacgcgccagaacaccagcgcggcgaccagggccaggccgccgaggaccgccagtgcggcatgccaggagatgaaatcgaccaggacgccgctgatcaggcgtccgctcatcccgccgatggcgttgccgccgatgtacaggcccatcgacaagccgatgtgctgcggatggatctcttcgctgagataggtcatcgccaccgcggccaggccgctcaaggacagcccgaccagcgcgcgcatcagcagcacgccatgccaggtgggcatcaccgcgctgccgagggtgaacagcgcggcggccagcagcgagacgaccatcaccggcttgcgaccgatcgcgtcggagatcgggccggtgaccagcaggccaagggcgagcatggcggtggcgacggacaatgccaggctgctttccgcggcgctgatggaaaacgccttggacagcaccggcatcatcggctggatgcagtagagcagggcaaaggtggcgaaaccgccggagaacagcgctag

SEQ ID NO: 16513 - DNA, 1533 bp, Pseudomonas aeruginosa
ttggaggggccgcgtggaactcaggcacctgcgctatttcatcgccgtcgccgaggagctgcacttcggccgcgccgccgagcgcctggggatctcccagccgccgttgagccagcagatccaggcgctggaggaggaaatcggtgcgcgcctgttcgagcgcaccaaccgccgcgtcgaactcaccgacgccggccggctgttcctcgacgagtcccgccaggtgctggcccaggtagacaaggcggtgttgctggcgcgtcgggcccacctgggggaactgggcgagctgaagatcggtttcacttcctcggcacccttcacctcgaccatacccagcagcatccatgccttccgcaaggcctatccggacgtacacctcgacctgcaggaaatgagcagccgccaggtactcaaggcgctgctcgaggaaagcctgcaggtgggcgtgatccgcccgctggcgctgccggatgcggtgcattgggtggagttgttccgcgaaccgctggtggcggtgctgcgggccgaccatccgctggcggccggcagcgaggatggcctggccatcgccgccctggccgaggagcccttcgtgttcttcccgcgcagctacggcaccgggctctacgaccaggtcatcgccctgacccgacaggccggcttcagcccgcgcatcgcccaggaggccagcgaggcgatgaccatcatcggcctggtctcggccggactgggggtgtcgatcctgccggcgtcgttccgccgcacccgggtcgacggcgtggtctaccgcaccctgagcgatcccgaggcgacgactgcggtatggctggtccgtcggcagaacgagggctcgccgctggcgctgtccttcatcgacctggtgacccgcgaggcggccagcctgcgccggcgctgaaccgctctacgtcaggaccgagacggcgctcgcgcttgcccgcggctttgcctatcatccgggatcaggctcggctcacggagatttcccatgcggcgcgtggtgttcaatcagaaaggcggggtaggcaagtccagcatcgcctgcaacctggcggcggtcagcgcggcggagggctatcgcaccctgctggtggacctggacgcccaggccaactccacgcactacctgaccggactgaccggcgaggacctgccggtggggatcgccgacttcttcaagcagaccttgtcttccgggcccttcagcaagaagggcagggtcgagatctacgagacgccgttcgacaacctgcacatcgtcacctccagccccgaactggccgacctgcagccgaagctggagtcgaagcacaagatcaacaagctgcgcaaactgctggacgaactggacgaagactacgaccggatctacctggataccccgccggcactgaatttctacacggtatctgcgctgatcgctgccgatcgctgcctgattcccttcgattgcgacagcttctcccgccaggcgctgtatggccttctccaggagatcgaggaactgcgtga

SEQ ID NO: 16514 - DNA, 474 bp, Pseudomonas aeruginosa
ccgggttcgaggacttccgccctgagtccgctgcgctggacgaaggcgatcttttcttcggtcaggtgcctggcgagttcggtgggcagtggcatggcgctctccatgtcggggatcccagccagactagccggccggccaggccgggcaaggaccgaaacgctcgcccggactgaccgatccgctcagcgtgcggcggcggccagggcctggtcgaggtcggcgaggatgtcgtcgatgtgctcgatgccgatcgacagccgcaccatgtcgtcggagactccggcgcgggccagttcctccgcgttcaactggcggtgggtggtgctcgccgggtggcaggccagggacttggcgtcgccgatgttgaccagccgcaccaccagcttcaaggcgtcgatgaagcgcgcgccggcggcgctgccgccctggatgccgaaggacaggatcgccgccgggcggccccccaggtag

SEQ ID NO: 16515 - DNA, 531 bp, Pseudomonas aeruginosa
cggcgtttccacagcagcgcggcgatcagcaggaacagcggcaggaacagcagcggccgatcgaccaggccttcgcccagttcacgcaccccggagccccaggggatctcggtgagctggttcttcagcagggtcggggtcatcttgaaccaggacaggtcgagcggctggttgctgggaatccagaacatctgctcgtcgagggtggtgcgcaggctctcgctggtggaaagcaactgtttctggttcaactgcaaggtgatcgcttcgttgagcagcgcgttgagttcgtggttgagccgttcgagcaactcggaacgggttgccaacagggtgtcgagatccttgcgcagttccggcgtgacctgctcgctgggctgctgggcgagcaggtcgtccaggtattgctgcggggtcgccagcttgtcgcgttcctggttcagttcgaactggccgaggcgcaggtcggcgatctcgtcggccaggctctggtcggccttgatcttgggcagcgcctgtttctgcttgtag

SEQ ID NO: 16516 - DNA, 1878 bp, Pseudomonas aeruginosa
atgcaggttagtggtggctccgaggcgccgcaaggcgcctcggaacgggaattcgacaggaaatcagaggaaaagtccgggccctgggcggccttccggaaacttcacgccgaccttgcggatacggttgccttccagggcggccacggtccaggtcaggccgttccactccacctggtcgccgatcaccgcttcgccgccgatctcgtgggcgatgaagcggcccagcgcttgctcgccgtcgatgccgtcgagcttcaggccgtagagcgaggccaccgccgacagctgggcatcgccttccagcacgaagtcgccgaagaagcgcgcgccgaggccccggtcgggcgcctggctgaacagcttgccgagggccggcaggtcgtgttcgtggccgatcacgcagagaatgtcgtcggcctcgaggatggtgctgcccgacgggtggagcagttcggtgccgcggaacagcgcggcgatccgggtcccgccgggcatcttcagctcgcgcagggcggcgccgatgcaccacttttccttgttcaggtggtagacgaacagctcccactcgctggtcgggtggatctccaggccggcgcgggatatcggtgccggatccggcggcaccaccacccgcagcagcctggccgcccagggcaggctggtgccctgcaccagcagcgagaccaggacgatgaagaaggccacgttgaagaacagctgggcgttcggcaggccggccatcagcgggaacaccgcgaggatgatcggcaccgcgccgcgcaggccgacccaggcgatgaaggctttctcgcggtcgtggaaggcgcggaacgggatcagtccgatcagtaccgacagcggtcgtgccaccaggatcatccacagcgccagggccagtgccggcagggcgatcggccacaggtcgtggggggtgaccagcaggccgaggaccaggaacatgccgatctgcgccagccaggccatgccgtcgagcatgtgcaggatgccgtggcggctgcggatcgggcggttgccgaggagcaggccgcacaggtagatggcgaggatgccgctgccgccgacggcgttggccagggcgaacaccagcaggccgccgctgatcaccagcaacgggtagaggccgccggccaggtgcatgcggttgatcagttgcagcagcaaccagccgccgccaagaccgagcagggcgccgagaccgaactgctgcaccaggtgcagggcgaagccccagctgaggccggtctggccgctggcgagcatctcgatcagggtcacggtgaggaacaccgccattgggtcgttgctgcccgattcgatttccagggtcgcggtgacccgctcgttgagacctttgccgccgagcagggagaacaccgcggcggcatcggtggagccgacgatggcgccgatcagcaggccttccatccagtgcaggtcgaacagccaggctgccgcgatgccggtcaggccggtggtcaccagcacgcccagggtggccagcgacaatgccggccagagcgccacgcggaagctggagacgcgggtgcgcaggccgccgtcgaggaggatcacggcgagcgccaggttgcccaccaggtaggccatcggatagttgtcgaagacgatgccgccgaccccgtcgttgccggcgatcatgccgacggcgaggaagatcaccaggatcgggatgcccaggcgggaggacagcgagctgacgaggatgctcatgccgaccagcaccgccccgatcaggaagaaattattgacggtgacggcgtccaaggtcggcctcctcgcggcgggacagggggaaggcgacgctacgggtcggttttacgtaggggaattacgtag

SEQ ID NO: 16517 - DNA, 1458 bp, Pseudomonas aeruginosa
gacagcgacagcggcagcatcaggcgcggctggaaggccttgccgtcccataccggctgcatggtcgccttggacacaccgaggatcgccacttccggcgcgttgacgatcggcgtgaagccggtgccgccgatgtggccgagactggagatggtgaagcaggcgccctgcatggcatcggccgagagcttcttgttgcgggccttgtcggccagctcggcggcctcggcggccagttgcaggaggctcttccggtcgacatcgcggatcaccgggaccagcaggccgtccggagtgtccacggcgaagccgatgtgtacgtacttcttgcggatcagcgccttgccgctgggggccagcgaactgttgaagtccggcagttccttgagcaggtgggcgcaggccttgagcaggatcggcagtacggtcagcttgaccccggccttctccgccgcggccttctgggcaacgcggaaggcttccatgtcggtgatgtccgactggtcgaactgggtcacgtgcggcacgttcagccagctgcgatgcaggttggcggcgccgacctgcatcaggcgggtcatcgccacttcttccacttcgccgaacttgctgaagtcgacttccgggatcggcgggatgccggctccgccggtggcgccggcaccgccggacttggcgcgctgcagttgctccttgacgaagacctggacgtcttccttgaggatgcgacccttgggaccgctggctttcacttcgctcagctcgacgccgaactcgcgcgccagcatgcgcaccgccgggccggcgtggaccttggcgccgtcgcggctgggtgcgccgaccggagccggggtatcggccttggctggcgcaggggccgccgcggcgggcttctgctcggcggcgggcgccgcggcctgggccggagcggctgccggttgctcttcggctgccggagcggcgccttccaccttcagcttgaggatcaggtcgccggtgccgacttcgtcaccgaccttgatcgagacgctttccaccaccccggaggccggcgagggaatctccatgctggccttgtcggattccagggtgatcagcgactggtcggcctcgaccgtgtcgccggccttgaccatcacttcgatgacgttggccttgccggccgagccgatgtccgggaccttgatgtcctggacgctggccgcggcgggggcggccggcttgctctcgctcggggcgggagcaggcgcttcggctttcggcgcttccggttgggcgggcgctgcctcggccttggcttcggcaggctgttcgccgccttccacttccagctcgaggatttcgtcaccttctttcaaggtgtcgccgaccttcgccttgatgcttttcactaccccggccttgggactggggatttccatgctggccttgtcggattccagggtcagcaggctctga

SEQ ID NO: 16518 - DNA, 960 bp, Pseudomonas aeruginosa
gaaacagccctctggatacaatttttagtagtaaaactacatttcgattgtcgctgtcaggctataaggcccgatgtagagccttttcgacgttgtgcgtcgagcctgtggtcttcggtcggaagcccaaacaggatagaccatgagcctgccttcgctggcgaatctgccggccaccctgctgcccgccgccgaacgcgccgggactgccctccgctccgctgtcgccgccctcgatgccgccgccctggcccgcctggaggcctggcccgaggagcgcctggaggatttccgacgggtcgccgcggccagcgatttcgtcgccgagcaggcagtgcgcgacccggcgatgctgctggatctggccgaacgcggcgagctggagaacccccacgcgcccggcgaattgcgcagccagttgcaggcgcggctggaggattgcgccgacgaggacgaactcggtcggcgcctgcgacgtttccgcacacgccagcaactgcgcatcatctggcgcgacctgacccgccgcgccgcgctggcggaaacctgtcgcgacctgtcggccctggccgacgcctgcatcgacctggcttgcgagtggctccatcggcgccagtgcgagcagttcggcacgccgatcggccggcgctccggcgaaccgcagcggatggtggtcctcggcatgggcaagctgggcgcggtggagctcaacctgtcgtcggacatcgacctgatcttcggttacccggagggcggcgagaccgagggggcgaagcgttcgctggacaaccaggagttcttcacccgcctggggcagaagctgatcaaggcgctggatgcgatcaccgtcgacggcttcgtcttccgcgtcgacatgcgcctgcgtccctacggctccagcggaccgctggtctacagcttcgccgcgctggagcagtactaccaggaccaggggcgtga

SEQ ID NO: 16519 - DNA, 1383 bp, Pseudomonas aeruginosa
ctgggagcgctacgcgatgatcaaggcgcgggtggtcggcggcgaccagcaggcaggcgagcaactgctcggcatgctgcggccgttcgtctatcggcgctacctggacttttccgccatcgaggcgctgcgcaccatgaagcagctgatccagcaggaggtccggcgcaaggggatgtcggaaaacatcaagctgggcgaaggcggtatccgcgaggtggagttcatcgcccaggccttccagttgatccatggcgggcgcgacctgagcttgcagcaacggccgctgctgaaggtgctggcgaccctggaggggcagggctacctgccgccggcggtggtcgaggagctgcgcggcggctacgagttcctgcgctacgccgagcatgccatccaggcgctggccgaccggcagacgcaaatgctgcccagcgacgaatacgaccgcatccgcgtggccttcatcatgggcttcgccagttgggccgcattccacgagcgcctgagccactggcgggcgcgcatcgactggcacttccgccaggtgatcgccgacccggacgaggacgaaagcggcgaggcggcctgcggcagcgtcggcgccgagtggatcccgctgtgggaggaggcgctggacgaggagtcggccagccggcaactggccgacgccggcttcgtcgatgccgaggcggcctggaagcgtctcagcgatctgcgccacggcccccaggtacgagcgatgcagcgtctcggccgggagcgcctggatgccttcgttccgcgcctgctggcgatgaccgtggaaaacccccagccggacctggtgctggagcgggtcctgccgctggtggaagcggtggcgcggcgttccgcctacctggtgttgctgaccgagaaccccggcgcgctggagcgcctgctgaccctctgcgcggccagcccgatggttgccgagcagatcgcgcggttcccgattctgctcgacgagctgctcaacgaggggcgcctgttccgtcctccacaggccgccgagctggccgccgagctgcgcgaacggctgatgcggattcccgaggacgacctcgagcagcagatggagacccttcgtcacttcaagctggcccacgggctgcgggtggcggcctcggagatcgccggcacgctgccgttgatgaaggtcagcgactacctgacctggctggccgaggcgatcctcgtcgaggtcctcgaactggcctggcggcagttggtgcagcgtcacggccggccgttgcgcgccgacggcacgccgtgcgatccggacttcgtcatcgtcggctacggcaaggtcggcgggctggagttcggccatggctcggacctcgacctggtgttcatccatga

SEQ ID NO: 16520 - DNA, 1623 bp, Pseudomonas aeruginosa
ccgccaggcggcgctcgacaagttcgccctgagcctggaccgcccggtgctggcgctctgtcccggcgccgagttcggcgaggccaagcgctggccggcggaacactacgccgcggtcgccgaggcgaagatccgtgccggctggcaggtctggctgttcggctcgaagaacgaccatcccggtggagaggagattcgccagcgcctgattccggggttgcgcgaggagtccttcaatcttgccggggagacttcgctggccgaggccatcgacctgatgtcctgcgctggcgcggtggtgtccaacgattccggcctgatgcacgtggcggccgcgctggatcgcccgctggtgggcgtctatggctccacctcgccgcagttcaccccgccgctggcggaccgggtggagatcgtccgcctcagtctcgagtgcagcccgtgcttcgagcgcacctgtcgcttcggccactacaattgcctccgcgagctgccgcctggcctggtattgcaagccctggagcggctggtcggcgaccctgccgaggtcgccggatgagggtactgctggtcaagacctcgtccctcggcgacgtgatccacaccctgccggcgcttaccgacgccgcccgggcgattcccggcatccagttcgactgggtggtggaggaaggtttcgccgagattcccgcctggcatccggcggtggcgcgggtgatcccggtggcgatccggcgctggcgcaagaacctctggcagaccctgcgcaacggcgaatggcggcgcttcaagcagcgcctgaaggaagtcgactatgacctggtgatcgacgcccaggggctgctgaagagtgcctggctgacccgctacgtgggcaagacgccggtcgccggtctcgatcgcgactcggcgcgcgagccgctcgccagccgcttctatcgccgtgcctatccggtcgcctggggacagcatgcggtggagcgcacgcgccagttgttcgcccaggcgctggactacccgttgcccgagtcggtcggtgactatggcctggaccgcgagcagttggccgacgccgaccctggcgcgccgtacctggtgttcctgcacggtactacctgggacaccaagcattggccggaagcctactggcgcgaactggccgagcgcatgtgcgagcgcggctggtcggtgcgcctgccctggggcagcgccgccgagcgggagcgggccgggcgcctggcggcggggttggaaaatgccgcggtactccccagattatccctggccggcatggccaaggtgcttgccggcgcgcgcgcctgcgtggcggtggataccggcctcggtcacctggcggcggcgctggacgtgccgacgctgtcgctgttcggcccgaccaatcctggcttcaccggcgcctacgggcgctcccaggtccacctgggcagcgacttcccctgtgcgccgtgcctgaagaagacctgtacctaccagccgaccgaagaggaccgcaaactgttcgatctcaagcgtgagcagccgctgtgcttcacccggctgaatccccagcgcgtggccacccagctggaggccatgctgctggccccggagaccctccgatga

SEQ ID NO: 16521 - DNA, 930 bp, Pseudomonas aeruginosa
caaggatctggcggcattgtatttctctgcgctggacatcggactgacgcgtcgcgacaagctacgcttcctgcgcacctatttccgccggccgttgcgcgagatactgcgcgacgaggccggcctgctggcctggatggaacgcaaggcggaaaaactctacgaacgcaagcagcgttacggagacctgctctgatggcggggtggaccctcgaacccgattaccgtcacctggccgccgacttcggtagcctcgatagcgtgttcgccctggagggcgagcgcctgacccgcgacccgttgtccgaagtcatccgcatcgagcgcgacggcgtgcgttactacgtcaagcgctaccgcagcgccggcaagggcctgcgccgctacctggcgcgaccgcggatcaaggccgagtggcagaacctcaagcgcttcgagaagtggggcattcccaccgccgaagtggtcgcctgggggctggagcgcaaggccggcgccttccagcgcggcgccatgatcacccgcgagctgccgggcaccgaggacttgtcggtgctcgcctgcaaccgggatccgcgcctgaaggacccgcgctgggtggacggcgtcagccggcagatcgccaaggctacgcgcctgatgcatgaccagcatttcacccataacgacctgaagtggcgcaacctgctggtggacgaccagccgctggtgtatttcatcgactgcccgaacggcgcgttctggtggagcttcatgctgcgctatcggatcaccaaggacctggcctgcctggacaaggtggccaagtaccacctgtcgcgcacccagcgcctgcgcttctacctgcaatatcgccgtcgccggcacctgaacgaatccgacaagaagcgtattcgccaggtggtggctttcttcgaggggcgcgaatga

SEQ ID NO: 16522 - DNA, 552 bp, Pseudomonas aeruginosa
tcgacctggagaagacccgcccgatctggttcggccgccgcgaccaggtcaaggacctggagccgatgctgcgccgtgccccggactggagcgaagcggacgtgcacgaattcatctccgcctatgtcgacgaacccctcgactcggccgaggtcgagcagtggtatcgccttctcgaccagcgccgtcggcgcaaggagtcgcgccgatgagactggccgaactgcaagccgccgggcgccacccgcaactgccattgcgggtgaccctggcggatggcgctggcgctgccgaactgcgcctggacagtctgctgcgggtgctgcccgggcagcgctacgtcggtgccggcgaatggcgtgggcgcaaggtgctggccaagctgctggtgggcggcaaggccgcacggcatttccagcgcgaactggaaggggcgcgtctgctcgcggcccaggggctgaccaccccggcgctgctggccgacgggctgcagcagggcgagggcggctggctgctgttcgactacctcgacgcggcgcagagcctcggtga

SEQ ID NO: 16523 - DNA, 441 bp, Pseudomonas aeruginosa
aggagctgttcgtccagccggcggccagcgacgccggcaccgcggtcggcgcggcggcctacgtgtcgcaccagcgcggcgtgccggtggagaagatggagcacgtctacctcggcccggagtattccaacgaggacgtcatcgccgcctgcgcccgtcacgaggccaggccgcagtggcagaagatcgacaaccgcagccggcgtatcggcaggatccttgccgacggcaacccggtggcctggttccagggacgcatggagttcggtccgcgtgccctcggtggccgctccattctcggctgcccgagcgtgccgggcgtggccgaccggatcaatgcgcagatcaagttccgcgagcgctggcggcccttctgcccgtcgatgctggataccgtcggcccgcagatgttcaagatcgaccacccggccccgttcatga

SEQ ID NO: 16524 - DNA, 1155 bp, Pseudomonas aeruginosa
aggagggcgtggactggtatgactcggtcggctgaacctcgcgtcctgcagttctgtcacggctacgacgggcctttcctcgactgtgcccgtcagtacgccagcctgttcgccggaaccccgtacaaggtcaccacggtgttcctcaccgggcgttccgatcctgaggtggcggcgcgttgcgcctccgacgaggtactgttcctcgagtacggctccagggacatccgtggcctcaagctgaaggcgatccgcgacttgcgcgagatcgcccgttcgcgcgacttccgcttctgcatcgcgcaccgcttcaagccgatctggatcgccagcctggccactcgtctgccgatcgttggcgtgcaccacgccttcggcgattaccagcggttgtcgcgcaaggtcttcgccggcctgatgagcaagcgcctgagcctgctggcggtgtccgacgcggtgcgcgacgatatccgccgttgcctgccgaagtggccggcggagcggatcgagacgctctacaaccgcatcgacgtcgctgcgctgcaggccgagcaggtcgagcgcctgagtgcgcgccggcaactgcgcctgcccgacgaggcctgggtggtcggcaacgtcggccgcctgcatccggacaaggaccaggctaccctgctgcgcggctttgccgccgcgctgccgcgcctgccgcagaacagcctgctggcgatcctcggcagcggccgcctggaagagcagctcaaggacctggcctgcgaactgggtatcggcgagcgcgtgctgttcctcggccaggtcgaagaggcacggcgctacttcaaggcgttcgacgccttcgccctgagttccgaccacgagccgttcggcatggtcctgctggaggccatggttgccggtgtaccgctgatcgccaccgcctgtggcggcgcccgcgaagtggtggaaggggtcggcatcctcttcccgctgggcgacgagacggccctggccgagggcctgacccacctggcggcgcttgaccgccgccagcgcgaggcctgtgcgcggctcatgctcgagcgcctggagacacgcttctccgacgctgcggtgcgccgcgaattctggcgcctgccgacgattgccggcttcgcttcggagtctgcatgctga

SEQ ID NO: 16525 - DNA, 906 bp, Pseudomonas aeruginosa
aggacaggtaaggttgtagttatggcgctcgtcgatgatggttcgcagccattggtttccgtgatcatcgcttcctataaccacgaaaagtacatagaagcgagcattgccagcgtggctgcgcagacataccgcaacgtggaactgctggtggtggacgatggttccagcgatggcagcgtcgagcttttgcgcgggctccaggcgaagtacggcttcgacctcagggtccagcagaaccagggactgtcgagaacgctcaacgaggcgatcgccagggcccggggaaatctcatcgtgcctttcggttcggacgacatcatgttgccgcaacgcctggagaaacaggtggcacacatgtgggacaagcccgaggtaggtatctgcgcgggcaatatcgagatcatcgactccaatggccgggtcatgccgggaaaggagcagcgcaaacgcgacctgcctttccgccgtctcgacttcgatgacctgttcctggaccgcaagccgggcccgatggcgcccaccttgatgttccggcgggaagccctggagaaggtcggcggtttcgatccggacatacgcctggaagatgtctatatcgaactggcggtgaccaaggctggctacgtcatcgacattcttggcgaggtcctcgcccagtaccgcaagcatcccaccaatacgtacaagaacgcccgtttcatggtggacaacgtattcaagacgtacagccagttcagcgatcaccccgattacgagcaggtgatcatgcgcttccgcaattcgatgttcctcaagtgctcgaaccgggacaaggtactggcccgggagctgctctccggcttgccgctgaagtactggaacgagaagaccttccgcggcattgcgcggctgtttttctcctga

SEQ ID NO: 16526 - DNA, 1344 bp, Pseudomonas aeruginosa
gcgctgcccatgcggcggcgcatgatccgggcatcccatcctgcgtggagcaagatgcccatgagcaccgatgtacagggccgtgccctggctgtactgaaccgtgtcgcccaggccgactggccggatcgcttcaatcttcgcaaacccttcgaaaaactgctctacagcggcagccgtaccggcttccgcctggccagcgagcgttcggcgaagcaggcgaagggaccgcgcaaggccgatccggacgggttgttcgacctgtcgttctccgacgaccagcagatgctggtggacatgctcgaaggcttcgccctggaggtgttgcgtccgctggctcatgacgcggatgccgaggccagcctgccggcggaactgctcaaccaggcgctggagctgggcctgacccactatggggtcggcgaggtgcacggcggcatggccggtgagcgcaccacggtgaccacggcccttatcgccgaggccctggccaagggcgacctgacgctggcggcggccctgctggtgccgttgtcggcggccaactgcatccgccgctggggcagcccctcgcagcaggcgcagtggctgccggcgttcgtcagcgaagagggggcgccgctcaccgccatcgcggtcaacgagccgagtctgctgttcgacccgcagaaactggcgacccgcgcccggcgcaagggcagtcactacctgctttccggagagaaatgcctggtcctgcgcggcctggaggccagccgcctgatcgtcgcggcgaagaccgacgaggggcctgcgctgttcctggtggaagcctccgccaagggcgtcgagcgacgtgccgagccggcgatgggactgaaggccggcggcaccgcccggttgcgcctgaagagcgtcaaggtgccggcggacaaccgcctggccgccgagcatttcgactaccgggccttcctcgatcacgcggccctggcctggtgtgccctggcgctgggcaccgggcaggcggcgctggactacgtgatcgcctactgcaacgagcgcgaggccttcggcgagccgatcagccatcgccagggggtcgccttcatggtcgccgacatcgccatcgaactggacgccatgcgcctgatggtctggcgcgcctgcgccctggccgagcgcggccagccgttccagcgcgaggcttacctggcgcgtctgctgtgcgccgagaaggcgatgaagatcggcaccgacgccgtgcaactgctcggcggccacggcttcaccaaggagcatccggccgagcgctggtaccgcgacctgcgcgcggtagcgctgatggccggcggcctgcacctgtga

SEQ ID NO: 16527 - DNA, 1257 bp, Pseudomonas aeruginosa
acccgagcgagtgcgcggtccgccgcgacgagtgaacgaggaatcgacatgtacctggaaaccccgaagaaattccgcagcctggccaaccaggcgcatcaggtcgcggaaaactatttccggccgatctcgcgcaagtacgacaaggccgaacacgcctatccgaaggagctggacctgctcgcggccttgctggacggcatgaacagcggctcgcccgaggctgtcggcgcgacctcggcgagcaagcgcgccggcaagcaggtagaggagggcatcaagaacggcggcaacctgtcggcattgctcggcgtgatggaactgtgctggggcgacgtcggcctgctcctggccatgccgcgccaggggctgggcaacgcggcgatcgccgcggtggccaacgaggagcagttgcagcgcttcggcggcacctgggcggcgatggcgatcaccgagccgggctgcggctcggactcggcggcgattcgcaccaccgcgacccaggatggcgaccactatgtactgaacggcgagaagattttcgtcacttccggcgagcgggccgatgccgtggtggtctgggccaccctgaaccgcaacctggggcgggcggcgatcaagtccttcgtggtcgagaagggcacgccggggatgaccgtgacgcgtctggagaagaagctcgggatcaaggcttcggataccgcttcgatcagtttcaatgattgccgggtgccggccgcgaacctgctgggcaacgccgaggtcgacgtgcagaaggggttcgccggggtcatggagaccttcgacaatacccgcccgctggtggccggcatggccgtcggggtggccaaggcggcgctggaccggacccgcgaattgctgaagaaggctggctgcaagttcgactacaggaaaccgctgctgaccgtcagccacgccgaggccactctctatcgcctggaggcggagtgggaggcagcgcgcctgttgaccttgaaggcggcatggatggccgacaacaagctgcccaactcgaaggaagcgtccatcgccaaggccaaggctggacgggtggccaacgagatcaccctgaagtgcgtggagctggctggcgccctcggctacgccgaggatgagctgttggagaagtgggcgcgggactcgaagatcctcgacatcttcgagggcacccagcagatccagctgctcatcgtcgctcgccgcctgctcggcaagtcttccagccagttgaagtag

SEQ ID NO: 16528 - DNA, 1617 bp, Pseudomonas aeruginosa
aaagggcggcaaagcccgcccggttcaggcgctggcgcggtcgcgcccaccgccggcctggtcgccgttgctggatggccacagtgccagccagtcgcggaaacggatgcgttcctcatgcaccagccagccgtcctgtacggcaaagctctcggccaaccacaggccgcgggtggccgcagggcgcaactggcccttgcgcagggtgaacaggtcgccggtggggcgcccctggtccagcggcagcaggtagagatcggggcgccgacggtccagacgcgccaccagcggaccgctctcgagccgctcgtcgacatggtagaggctcggctcgcgcgcatcgcgcggcagctccaggcgcatgtcgtagaccagttgcagcgaggccgtgggcaggtgtacgtaggcgcgtgggcgctccagcaagcgcaggctgccggcttgcaccggacgggcggcgccggacagcggggtgaggacgaagtggctgttctcccggtagcgcagcgaaccctggtagggcgtcggcagccaggtgtcgccgaagcgcccgccgagccagccgccggcggtctccaccaggcattcctcggcgacttcctggatcgccgtgagcagcggcaggttcagttcgtgggccggtacgtagccggagatcagcttgagcacggtatcgccgcggtccagccggcgctgacggaccagcacccagtagtcgcggccctgccagttcagggtcaagcgcaccgagacccccaggttggccagctcggcgacgaagcgctgcgggtcggctacctccatgcggcggcggcgtacgagcatctgctggaagttcagcggcaggccgagggcctggtagaccagcccgtccggggaggcctccaccagcagcggcagggtcttgaaggcggacggatccttgcgggcgagcatacggggcatacggggctccttgtcgggtcatcgcgccggggcgggacggaggctcacgttcgatgcaccggccaccggaggcgagggcggcaggcaggatacggctcgttcgggaggaacatggcagcggaatgcaccgcgggtgtcaacccgcggatgttgcagccgatgtatggttcaggcctttttcagggcttgcgcggccatcgcgacattatgggccaggtgcagcggattgatggtgccgacgatggcggcggcgacgcccggctggtcgaagaccagttcgaagctggcacgcaccgggtcctgtccggcgcccaggcaggcatgcccgctggccagcgccttcttcaccaggatgcccttggcatgggccgcggcgtactcgatgaccgggcgctcggcgcgctcgttcaggttgtaggtgaccatcgcgcaatcgccctcgcgcagggcgcgcaggccaccttcgacggtcttgccggagagtccgtaggcgccgatcaggccctcgcgcttgagcgcggcgagagtcgggtagacctcgctgttctcgaggatatccaggtcgttgccatcggaatgcaccagcaccagctcgatccggtcagtctccaggcgcttcaggctgcgctcgacggagcgccgggtatgcgcggcggagaagtcgaagactga

SEQ ID NO: 16529 - DNA, 1908 bp, Pseudomonas aeruginosa
  unsure (872),(886): Identity of nucleotide at the above locations are unknown.
ctggccgtcgacgaactcttcgccgaccttgctgacgatcacccaatgttcgcgctggccgcgcagcagcgggccgaggcgttcctcgctgcggccgtaggccggggcggtgtcgatcaggttgatgccgaggtcgcgggccagggccagcaggtcggcggcttcgcggtcgtcggggatggtgaagccggaagggtacttcactccctggtcgcggccgaacttgacggtgcccaggcccagcggcgaaacggccaggccggtgtcgcccagcgggcggtgcaggtcgtggagggtatccctgatcatgcgaaggccacctcccaggccggttcggcgagcggcggacgcggcagttgcggcagcgcggcatgttcgctggggcggatgccgtcttcttccaggcgggcgcagacccggtcggcgaagtcaggggccagcgccagcttggtcggccagccgaccagcaggcgtccctgttcggcgaggaaggcgttgtccgggcgcaacaggttggactgtgccggctcggcgcgatccacccgcaaggtggcccactgcgcctggccgaggtcgatccagggcagcagctttgccagttcgcgacgcgcttcggcgatctgcgcggcttcgtcgcgggccacgccatcggcttcggcgatgtcgccgccgaggtaccagaccgactggccgtcgcgggtcggatgggtggtcacggtgatccgtggcttcggccctgcccccaggcagtgggcgtacagcggtttcagggtcgccgccttgaccatcaccatgtgcagcggccgccgctgcatggccggttgttccaggcccagttcgcggagcagcgcttcgttgcccgccaccggcantgagcaccacgcgntgggcacgattctcccggccgtagacgcacaggccggccagttcccggcattcgcgcagcggttcgatgcgttcgccggcgagcaggctgtcgccggccagttccgccaggcggcgaatcaggtcggggacgtcgaagacgatttccgtgaggcggtaggccttgcccttgaaccccttgtcgcgcagcgccggaggcaaatcttcgcccttggcctgctcgacccgactgcgcacagccttgctggcgaagaagctggtaaggctgccggccaggccgcccggcgaccacaggtagtgcgcctcggaaagcaggcgcacgccccgcaggtcgagttcgccgtcgctgccgagacaggcgcgccagcgccgcggcatgtcggcgatggcttcggaggcgccggtcagggcaccatgcagggcgtacttggcgccgccgtggatgatcccctgcgacttcacgctctgtccgccaccgaggctggcgctttccaccagcacggtggcgtagccggcccggcgcaagcgggcgttcagccagaggccggcgataccgccgccaacgatgaggatgtcggtggaaagggcttggggcatggggctgccttatcgggaacggaaagggcgcagtatacaacctgcgcccgcgacggtcgttcagtgccccgaagcgcgggagaacaactggatcaccagcacgccggcgatgatcaggccgatgccgaggagggcggcggggtccaggcgctggccgtagacgaacatcgccaccaggctgaccaggacgatgcccagtccggaccagatggcgtagaccacgccgaccggcagggtgcgcatgaccagcacgagcatgctgaaggcgagcacgtagccgcccaccaccagcagcagcggcagtggcttgctgaatccggcgacggctttcagcgaggtggtggcgaccacttcggcggcgatggcgatggagaggtagagatagttggtcatggcggggtcctccggaaactgcggccattctag

SEQ ID NO: 16530 - DNA, 888 bp, Pseudomonas aeruginosa
gttatgcagtggaacctggagcagatccgcctgttcgtcagcgtcgccgagcgccagtcgttctctgccgccgcccgcgaactgaagcgggtgcaatcggcggtgagcaacggcatcgcgctgctggaggcggacctcggcgtcaccctgttcgaacgcagcagcggacgccagccgcgcctgaccgacgagggccgggtgctgctggcggaggcgcgcgaggtgctgcgccagtgcgagcgcctgcaggggcgcgcgctggggctggcgcgcggcgaggagccgcggctgcgcctggcccaggacgaggcgatgccctaccagccggtgctggacagcctggaagcgctggcgcagcgctttcccagtctggaggtgcaggtgtccagcggcggccagggtgacgtcacccgtcgtttgctcgaggagcaggctgacctcggcctgctgttccaccatgagcgcatgcctgagtcgctggagcggcggcgcctcggcagcgtcgagatggtcacggtgtgcggtgccggccacccgctggccgggctgcaacgggtcagtcgccgcgagctggcacagcaccggcaacttttgatcgtgccccagcagagcggctatccgggcggcgagcagatcagcccgcaggtctggcggctggacagcttctattccatggccgagctgctgatgcgcaacctcggctgggcctggctaccgcggcacgtggtgcagtaccccacctacgaccggctgatggtggagctgaccagcgactggacgccgccggcgctggtggtcgaactggtctggcggcgcaacgaggtgctcggcccggcggcggcctggctcggcgaaaccttcacccgccacctgcgcgccatcggctga

SEQ ID NO: 16531 - DNA, 1365 bp, Pseudomonas aeruginosa
acaggtgcgggaaattcacggttggcgtccttcttgttgttctcgcggcgcgcttcagaaacaggatatgaatttaccatcagtaaaaaatcaacttgtttttttaaaatcgactggatagtttctgtcccgtggccgcttcccggcggctcgctgcgatccactccacaacaagaacaagaggagacgcacatgaaccgttcctttccgttgcgccgcgcggccagcgcccgtccgcacccggtttttccttgccgcgtcctgctcggcgccgtcctgctggcgttcggcggcctcgcgccggtccaggccgatgatggcctggtggtggtcggctacggcggcgccggacagaaggcccaggaggtggcgttcttccagccgttcacgcagcagaccgggattcccgtggtgcagagcgagtacaacggcgagatggcccggatcaaggtgatggccgacaccggtcacgccgactgggacctggtccaggtcgaggggccggacctggcgcgcggttgcgacgacggcctgttcgagcgtctggactggcaggccatcggcggcaagcagcagttgatcgccaatgccgcccaggaatgcggttccgccgcgctggtctggggcgtggcgatcggctacgacgccgaccggctgcaacagccgcctgcgtcctgggccgacttctgggacgtccagcgcttccccggcaagcgcggcctgcgcaagcgggcgatctacaacctggagttcgccctgctcgccgacggcgtgccacgcgagcaggtctatccgctgctggcgacccgcgccggtgccgaccgtgccttcgccaagctgggccagctcaagccctacatccagtggtgggaggcgggagcgcagccggcgcagtggctggccgccggcgacgtggtgatgacgtccacctacaccggggcgcatcgccgacgcccaccgcgcggggcgcaacctggccctggtatggcagggcagcctgtacggcatggactactgggcggtggtcaagggttcgaagcgcggcgccgaggcgcgtcgcttcatcgccttcgccaatgccccggatgcccaggtgcgctacgtcgagaacattccctacgggccgaccaaccgccaggccgcccagcgtctgcccgcgcaactggcgagctgggtgccgaccgcgccggcgaacctggagcagggcctggcgatggacgacgaattctgggtcgagcacggcgaggagctggaggagcgcttcaacgcctgggccagccagtgagacgggcgccacgtaacctgcgatcatcggggctgcccgccggtggtcgcgggcgacgagcaggagccgcgaaaggatga

SEQ ID NO: 16532 - DNA, 354 bp, Pseudomonas aeruginosa
tactggcctaccgcacgcccgcgcgcgatcgcgacctggcgttttccgccgagccggtgctgcgcgaggacgtggcgatcttctacaaccgccagcggccggtgcgcatccaatccctcggcgacctcgccggctatcgcggcgggctgttgttcggcgaaagctacggggcggacttcgaccgcttcgtcggccgccacggcaacgtcgaatgggtttccgacagccgacagaacttcggcaagctggtgcgccagcgcatcgactacatcgcccacgaacggcgcaccggcacgctgttcgccgagcgcctggccggcggcgagaacatccgtgcgctgcccgaaccgctga

SEQ ID NO: 16533 - DNA, 468 bp, Pseudomonas aeruginosa
cggccatcgcggcgccgagcagttcctgcgccaggtgttgaccaacctgctgggcaacgcggtgaagttcaccgaggccggcgaggtgcgcgttcgcgtcgagcggctggcgcgcagcgcaggaagcgagcgcctgcggctgagcgtcgcggacgatggaatcggcattcccgaggaaatgcgcgaacgcatcttcgaacgcttcacccagggcggcgacgccgtgacccgccgttacggcggaaccggcctgggcctggcgatcagcaagcggctggtggaagcgctggggggacggatcggcgtggaaagccgggtcggccagggcagcacgttctggttcgagatcgagctggcgctggcgagcttgtccggcgcgacgccgccggcggcatcggtgtctgcgctggaggtgctgctggtggaggacgtggcgctcaaccgcgaggtggcccagggcctgcttga

SEQ ID NO: 16534 - DNA, 615 bp, Pseudomonas aeruginosa
gcgggacggccaccgggtgatgctggccgaggacgcggggccggccctggcgttgtgccggcagcggcgcttcgacctgatcctgctggacatgcacctgccggggatggctggcctcgagctttgcgccgggattcgccggcagctcgacggcctgaaccgctccacgccgatcttcgccttcaccgccagcatccagccggacatggtgcgtcggtacttcgccgcgggcatgcagggcgtgctcggcaagcccctgcggatggacgagctgcgccgcgcgctgggcgaggtcggcaccagcgtgcctgcgcttgcggtggaggccgcgctggaccggcaaatgctcgagacccaccgccgcctgctggggcggcacaagctcgccggactgctgggcaacctgctgggaagcctggacgagcagttgccgctgctggccgaagccctggaccaggcggacctggccgaggcggcgaacatcgcccatcgcctgtccggaagctgccactccatgggcctggtggcgctcggcgccggcctgggcgagctggagcgcgaggccctgggcgcggccggggtcgacccgcgagcctggggcgcacgcctgggtag

SEQ ID NO: 16535 - DNA, 264 bp, Pseudomonas aeruginosa
cctgcgccgcgacggcgccgaagccctgcgccgcgccggcttcctcggcgaagccgactcagcggccggttgagcggcgcggcgaacaacttccttacagctttttacatcttcgatccgcgcgttcaacggcgtcttacatccgccgccaataatccgctcatccgtgcgcaagacacggcctctgacagagtggagacaagaataatgagccatctcgaagacccctgtgcgtaccctcatccggaggtgcgccatggctga

SEQ ID NO: 16536 - DNA, 1599 bp, Pseudomonas aeruginosa
cggcaaggaaaggctgcaactcacccgggccctggcgagccgccacatcttcatgctgtccctcggcggggtgatcggcaccggcctgttcatgggctccggcgtgaccatcaaccagggcggcccggccggcgcggtgctggcctacctggtggccggggtgctgatgtacctggtgatggtctgcctcggcgagctgtcggtgcagatgccggtctccggttcgttccaggcccacgcgacgcgtttcatcggcccggcgactggcttcatgatcggctgggtctactggatgagctgggcctccacggtaggcctggaattcaccgcggccgggatgctcatgacccgctggttcccggaggtgcccgtgtggctatggtcgggtttcttcgtggtcgtgctgttctctctcaatgccctggcgacccgcgccttcggcgaggccgagtactggttcgccgggatcaaggtggcggcgatcctggtgttcatcgtggtcggggggctggtgatcttcggcggtatcgaactgaagagcggtgcgccggcgccgatgttctccaacctggtcggcgagcggctgttccccaacggcctgtcggcggtgttcgcggtgatgatgacggtggtctatgccttccagggttgcgagatcatgggcgtcgccgccggcgagaccgagcgaccggagaagagcatcccgcgggcggtgcgcaacgtggtgttccgcgtactgatcttctacgtgctggccatcgtcgtgctttccgccatcattccctggcaacaggccgggctgatggaaagcccgttcgtgcaggtgttcgacatggtcgggattccctacgcggcggacctgatgaacttcgtcatcctcaccgccatcctctcggtaggcaactcgggcctgtacgcctcgacgcggatcctctgggcgatgtccaggaccggcatggccccgcgcggcctgtcgaagctcagcgcgcgcggcgtaccgctctacgcgttgctgatcaccctgtgcttcgccctgctctcgttgctgaccagcgtggtcgccgccgacaccctgttcatggtgctgatggcggtgagcgggatgtccggcaccgtcacctggatcgtcatcgcctacgcccaataccgcttccgccgcgagcacatggccagcggcggcacggtcgccggactgaaatatgccgcgccgctgttcccgctggtgccgctggcctgcatcgccgtgtgctgctcgctgttcgtcttcctcgccctcgatcccacccagcggccgtccttgtactggggcttcggcttcatcgccgcctgctacctggcctattacgtggttcgtcgccggcagccgcagggactgggcgaccccgccctgggacgggccggctgaacggccattcgcaggacccgacgcccgccgcatccggcgggcgttttcgttttcgcctggttggtttgttcgaagttgtaacagccggctcgcgcgggccttcgccgcttttcggcggatcgcatggcgtgtggctttgcgcctgccgcagggccgttacatacacccgaatgggtggattgtggtcttattga

SEQ ID NO: 16537 - DNA, 1395 bp, Pseudomonas aeruginosa
gacggtcggcgccttcgctgcgcgtctcgccagcggcccgaccttcgccttcgcccagaccaagcgcctgctgcgcgacggcgccgggcgctcgctggccgagcagttgcgtgccgagcaggccgccgggctgctctgcgggcgcagcgaggatgccgccgaggcgctgcgcgccgtggccgagaaacgttcccctcaattcagcgggcgctaggcgccgagcaggtgattcccatggatttcaggctgacccaggaacaggacatgctggtcgaggcggtgcgcagcttcgtcgagaaggaactgctgccccacgaggacgatgtcgaccgcgccgacgcggtgtcgccggagctggccgcacagattcgcggcaaggccctcgccgccggtttctatgccttcaacatgcccgaggaagtgggtggcggcggcctcgactacctgtcccaggcgctggtcgaacgcgagctgtcgaaggtctcctgggccctccacgtattcgtcgcgcggccctcgaagatcctcatggcctgcaccggagaacagctcggcgactacctgttgccctgcgtgcagggcgaaaagaccgattgcttcgccctcaccgagccgggcgccggctccgacgccaattcgatcaagacccgcgcggtgcgcgacggcgacgccttcgtgatcaacggtagcaagcacttcatcagccacgccgggcacgccgacttcgccatcgtcttcgccgtcaccgacagctacgagcacaacggccgcaagcgcaacgcggtgaccgccttcctggtggacaagggcacgcccgggatgaccgtgcgccgcgggccgaaatgcgtgagcaaccgtggctaccacacctacgagatcttcttcgacgattgccgggtgccggcctccaaggtgctcggcgaggtcggcaagggctgggaagtggccaacgcctggctcaccgccggacgggtgatggtcgccgccaactgtgtcggccaggcccagcgcgccctcgacctgtcgctgcgctgggcggccgatcgcaagcagttcggccagccgatcggcagctaccagggcgtttccttcaagctcgccgacatggccacgcagatccgtgccgccgagctgatgaccctgcacaccgcctggaagatggaccagggcaccatgaccgacggcgaggccggcatggccaagctgttcgccagcgagaccctcggcaaggtcgccgacgaagcggtgcagatcttcggcggcatgggcctgatggatgaaggaccggtcgagcgcatctggcgcaacgcgcggatcgaacggatctgggagggcacttcggaaatccagcggcacatcgtttcccgcgaactgctgcggccgttgctgcgttga

SEQ ID NO: 16538 - DNA, 2157 bp, Pseudomonas aeruginosa
agtcctggctcccctcttcctccaggggagaggggaaggctgccatgttccgaatcgagaaccgacatgaatcgtgaaaacctcaagcgcctgctggcacccaggcatctcgccttcattggcggccgtggcatggcgcgtgccctgaaacgctgtgccgaaggcggtttcgccggccagttgtggctggtcaatccgcagcacgccgaactcgaaggcgtaccctgcgtggccagcgtcgccgacctgccgtgcggcccggacgcggcgttcgtcgccaccaaccgcgaactgaccctcgacgcggtcgccgcgctcgccgccaaaggcgccggcggggcgatctgctatgcctccggcttcgccgaaaccggcgaacagggcctggccgtgcaacgccggctgctggccgccgccggcgaaatggcgctgctcggcccgaactgctacggcttgctcgactacctgcacggcgccgcgctatggccggtggcacatggcggtcggcaggtggagcggggcgtcgcggtgctgacgcagagtggcaacttcgcctacaacctgtcgatgagcgaccgttcgctgccggtggcctatatggcatcggtgggcaaccaggcgcagctgggcatcgccgagctgatggacgtgctgctcgacgagccgcgggtgactgccatcggcctgcatctggaagggctgaagaacgtcccggggttcgcccgcgcagcctacaaggcgttgcagaaaggcgtgccggtgatcgccctgaagaccggggtgtcggagatcggcgcggccctcgcgctcagccacaccagttccctggccggttccgacgcgctatacgacagcctgttcgagcgcctcggggtgatccgcgtgagcggcccggtgagcttcgtcgaaaccctcaaggccgccgcctgcggccacctgcctggcgggccgagcctggtcgcgctggcctgttccggcggcgacgccgggttgatcgccgattacgccgagcgcaacggcctggggttgccgtctttcgacgccgaacagcgcgacgaactggccggggtgctgcccgactacgccaacatcgccaacccgctggacttcaccaccgccatctggggcgatgccgcggccctggaggaaatgctcgacagcgctttgcgcagccctgccgacgccgccctgctggtgctcgactatccgggcgaggaaaccggcgagcggccgcagtgcgacctgcttttgcaacgctactgcgcggcgctgaagtgccacggaaaagtcggcttcatcgcctcggcgttcccggaattgctgccggcccgggcccgcgagctgttgcacggcgagggcgtcgccgcgctgcagggcgtcgaggatggtctcgccgcctggggacggatcgcccgctaccgccagcgccgcgcggcgctgctggagcgcggtgaggcggcgttggtgccgatctgcccagggccgctggcgggcgacggctacctgctcgacgagtggcaatccaagcaggcgctgaaacccttcggcctgccactgccccagggggtgctgagcacccccggccaggcccgcgaagcggccctcgacctcggcttcccgctggtgctcaaggcggtcagcgccgcactgccgcacaagaccgaggccggtggcgtggcgctcggcctacgcaacgaggcggcgttggaggcggcattgttcgacatgcgcgaaagcctggcccggcacgcgccgcaactggtcttcgagcgtgttttattggagcgcatggctggcgcgccgctggccgagctgatcgtcggggtcaagcgcgaggagggcttcggcctggcattggtgatcggtgccggcgggatactcgtggagctgctgcgcgacagtcgcagcctgctcctgccaaccaccgacgcggcgatccgcgatgccctgctgagcctgcgcagcgcgccgttgctcagcggcttccgcggtcgcccggcagtgtgcatggaggccctggtggcggcgatccgcgcggtcgccgaattcgcctgcgaacatgccgagcgcttgctggagctggacgtcaatccgttgctggcggatgccgagggagcgctggcggtggatgcgttgatccggctggccaatggctga

SEQ ID NO: 16539 - DNA, 1233 bp, Pseudomonas aeruginosa
tcgaactgcggcacgcctgtgcgcgctgaccgccggacaaggagagcatccatgcgctattccgacttcactcaacgtatcgccggcgacggcgccgctgcctgggacatccactatcgcgcgctggcgcgggtcgagcagggcgaggaaatcctcctgctgtcggtcggcgaccccgacttcgataccccggcgcccatcgtccaggcggccatcgacagcctgctggccggcaacacccactacgccgacgtgcgcggcaagcgcgccctgcgccagcgcatcgccgagcgccaccggcggcgcagcggccaggcggtggacgcggagcaggtggtggtgctggcaggtgcccaatgcgcgctgtacgcggtggtgcagtgcctgctgaatccgggcgacgaggtgatagtcgccgagccgatgtacgtcacctacgaagcggtgttcggcgcctgtggcgcgcgggtggtgccggtgccggtgcgctccgagaatggcttccgcgtgcaggccgaggaggtcgccgcactgatcaccccgcgcacgcgcgcgatggcgctgaacagcccgcacaacccgtccggcgccagcctgccgcgggccacctgggaagccctggccgagctgtgcatggcccatgacctgtggatgatctccgacgaggtctacagcgaactgctgttcgacggcgagcatgtcagcccggccagcctgccggggatggccgaccgtaccgcgaccctcaacagcctgtcgaaatcccacgccatgaccggctggcgggtcggctgggtggtcggtcccgcagcactctgcgcgcacctggagaacctcgccctgtgcatgctctatggctcgccggaattcatccaggatgccgcctgcaccgcgctggaagcgccgctgccggagttggaggcgatgcgcgaggcctaccgccgccgccgcgacctggtaatcgagtgcctggccgacagccccggcctgcgtccactgcgcccggacggcggcatgttcgtgatggtcgacatccgtcccaccggactttccgcccaggccttcgccgaccgcctgctggaccgccatggcgtatcggtgctcgccggcgaagccttcggcccgagcgccgccggtcacatccgcctcggcctggtgttgggcgccgaaccgctgcgcgaagcctgtcggcgcattgcgctgtgcgccgccgagttgctcggccaggcctga

SEQ ID NO: 16540 - DNA, 693 bp, Pseudomonas aeruginosa
tcgtccacgcccacaacgaaccgcaatccttcacccgcgcgctctgtgaccaggcatgcgagaccctggcaggccaggggccacgcggtgcaggtctcggatctctacgcgatgaactggaatccggtggccagtgccgccgacttcgccgagcgcgccgatcccgactacctggtgtacgccctggagcagcgcgagagcgtcaagcgccagagcctggccgccgacatccaggccgagctggacaagctgctgtgggccgacctgctgatcctcaactttccgatctactggttctcggtgccggcgatcctcaaggggtggttcgaccggatactggtgtccggggtctgctatggcggcaagcgcttctacgaccagggtggcctggccggcaagaaggcgctggtcagcctgaccctgggcgggcgccagcacatgttcggcgagggtgccatccacggaccgctggaggacatgctgcggccgatcctgcgcggcaccctggcctatgtcggcatgcaggtgctggagcccttcgtcgcctggcacgtgccatacatcagcgaggaagcgcgcggcaacttcctgcgcgcctaccgggcgcggctggaaaatctcgagcaggatgtacccctgcggttcccgcggctggagcagttcgacgcgctgctccagccgctggcgcgctga

SEQ ID NO: 16541 - DNA, 906 bp, Pseudomonas aeruginosa
cgcggtctgcgtgctgccctacgacccgcagcgcgattgcgtggtgctcatcgagcaattccgcgtcggggcgatgcagaagctcgccaacccctggctgctggagctggtcgccggcctgatcgacaaggacgagcaaccggaggaagtggcccatcgcgaggcgatggaggaggccgggctgaccctcggtgcgctctggccgataacccagtacctgccgtcgccgggcggcaccgacgaggtggtgcacctgttcgtcggccgttgcgacagcgaaggcgtcggcggcgtgcatggcttgccggaggagggcgaggacatccgcgtccacgtctggccgttggaagatgcgctgcaggccgtgcgcgacgggcggatcaacaacgcggcgagcatcatcgccctgcagtggctggccctgaaccgggccgaggtgcgtgggctatgggcctgaacctgctgcgcgagcgctaccgggtcgacctggccagcctgcaggcgacctgcgaagcgaactacgcgcggctcatgcgcctgctcccggacatgcgcgaggcacaggcctcgcgccgggtcgcgctgagcgaaggggagcggctgctcggcgtcctggcgctggaagtgaccgaggcctgcccgtacaccaccaccctgcaggtgcgccaggaactgggcctgccctggttgccggcgccgcggctggaagtgcgggtctaccacgatgcacggatggccgaggtgatcggcgccgaacaggcgcggcggctgatggcgatctatccctacccgaaccaggcgatgcaccagcccgacgagaagaaccagctcaacctgttcctcggcgagtggctcgcccactgcctggcctgcggccacgagatggtgccggtggcccagcgctga

SEQ ID NO: 16542 - DNA, 972 bp, Pseudomonas aeruginosa
gcggttgcaggcaaaaggccagttgaatggcatcaagccaaaagtagtcctcgcaactgtgatctgttccgctttccgggtttgccgccactttcgtcggtcaccataatcaccccattcaccgcggacgcctcgccttcaggagacggccccttgtcacgccattcgaacactcccgccaccgacgcctccgtactgctggtgcagctttcggacagccacctgttcgccgaggacggcgcgcgcctgctcggcatggacaccgcccatagcctggaaaaggtggtcgagcgggtcgcccgggagcaaccgcggatcgacctgatcctcgccaccggcgacgtctcccaggacggcagcctggattcctacacacgcttccgcaggttgagcgcgccgctggccgcgccgttgcgctggttcgccggtaaccacgacgaacgcgagccgatgcagcgggcgaccgagggcagcgacctgctggagcaggtcgtcgacgtcggcaactggcgcgtggtgttgctcgactcgagcattcccggcgcggtgccgggctatctcgaggacgaccagctcgacctgctgcggcgtgccatcgacagcgccggcgaacgcttcctgctggtttccttccatcaccacccggtgccgatcggcagcgactggatggaccccatcggcctgcgcaacccgcaggcgctgttcgacctgctggcaccctatccgcaggtgcgttgcctgctgtgggggcacattcaccaggagttcgaccgccagcgcggcccgctgcgcctgctggcctcgccgtccacctgcgtgcagttcgcccccggcagcagcgacttcaccctcgaccgcctggcgccgggctaccgctggttgcgcctgcacgacgacgggcgcctggaaacggggatctcgcgggtcgacgacgtcgtcttcgaagtggactacgacaccgccggatactga

SEQ ID NO: 16543 - DNA, 753 bp, Pseudomonas aeruginosa
catgccccccggccgcgggatgccgcggccgcgtgcgtcgttgccgatcggcgcgcaggctggaagatgaagcctggaagctggtaccgttcggctttccctaccgagttgaagcccattagcccgttcccgatgactgcgaccagcccatccctgctgtatatccacggcttcaacagttcgcccgaatcgcacaaggcgcgccagctgcaggcggccttcggccacttgggcctggccgaaggcctgcgcgtcccggccctgcaccatcacccacggcaggccatcgcccagttggagcgggccatcgccgagctcgggcgaccggtgctggtcggcagctccctgggtggctactatgcgacccatttggcggagcgccatggcctggcggcgatcctggtcaatccggcggtcgccccgcatcgctccttcgacggctacctgggcgcgcagaccaaccactacagcggcgagacctgggaactcaccgaggaccacgtggcggcgctggccgaactggaagtcacgcgcctgcaacgtcccgaacgctaccaggtatggctgcagaccgccgacgaaaccctcgattatcgcgccgcgcaggccttctaccgagcctgcgcgctacgcatccaggccggcggcgaccacggcttccagggcttcgcccggcacctgccggcgctgctggcgttcgccggctacccgtcggcgctgtggcgcgacaccgatttttcgacttttgactga

SEQ ID NO: 16544 - DNA, 1341 bp, Pseudomonas aeruginosa
ccgcctgtatcgcctgcaaccctcggccgaaggctccgaccagccctggcaggccgaggccgagagtttcatcgctccgaccccgccggacagcgggttgccctggggcatgagcacgcgggtctggctcagtggcctggtgcgcggcggcaacctcgacttcgaaggcatcgcctgcgatgccgccggcaatcgctacctggtcagcgaggcgcacgcggcggtcctgcaactgccggtgagcggcgcgccgaactggctgcgcctgccgcccggcctgctgtcgcaagcgcgggccagcggcatgctgatgaatttcaacgcgctgttcgaagggatcgccgtcgaccccgagggcaagcgcctctggctggctgccgagcgcgagcgccgcggcctgctggtggcccaccgcgacaacagtgcctggcgctgcgagggcagctgcgtactgctcgccgagggcggcaagatcgagccgccgccggaactgggcagcgcgcgcaagctgccgaaggatttctccgacctcgccttctaccgcggcaagctgttcaccctggagcgcctggcgcatcagatctgtcgccgcgacctggcccaggccaaggtcgagcgctgctggtcgttcgcctcggcggtcctggcgccggagcgtcgctacgagctgccttatggcgtcgcggaagccctgtcgctggacgacaagggcgcctggctgggcatcgacaatggcgaccatgcgcgcgccgatggcgacgtgcggcccttcgtcctgcgcttcgccgcgcccgccggcggctggttgggggacaagtgacgcaacgggcgcccggtcagcggctgggacggatcatgctggtgctggcctggatcgccgggctggcgctggcgacgcgctatttcggcgtctgggaagatcgacagcgcaacccgaaccaggcgccgcaatcgatccatggcgacggctacgtcgagttgcgcctggccagcagccggcagggccattacctgctgaacgggcagatcaacggccagggcgtgaccttcctgctcgataccggggcgacccaggtggcggtgccggaagccctggcggcaagactcgcgctggagcgcggcgcgccgatcaccctgagcacggccaacggccgcgccacgggctggcgcacgcggctggaccagctgcaactcggcgatatccgcctgtccggggtcgcggcgctgattgcgccgggcatggacggcgatgaggtgctactcggcatgagcgccctgaaacaactcgaattcacccagcgcgacggcaccctggtgctgcgccaaaacacttctccgtga

SEQ ID NO: 16545 - DNA, 1290 bp, Pseudomonas aeruginosa
cttcgacggcaccctggacgagccggccgtgctgccggcccgcctgcccaacctgctgctcaacggcaccaccggcatcgcggtgggcatggccaccgacgtgccgccgcacaacctgcgggaagtcgcgtcggcctgcgtgcgcctgctcgaccagccgggcgcgacggtcgccgaattgtgcgaacacgtgccgggcccggacttccccaccgaagccgagatcatcaccccgcgcgccgacctgcagaaggtctacgagaccggccgcggttcggtgcgcatgcgcgcggtgtaccgcgtcgaggacggcgacatcgtcatccacgccctgccgcaccaggtgtccggttccaaggtgctggaacagatcgccgggcagatgcaggccaagaagctgccgatggtggccgacctgcgcgacgagtcggaccacgagaacccgacccgcatcgtcatcatcccgcgttcgaaccgggtcgatgtcgaagagctgatgacccatctgttcgccaccaccgacctggaaaccagctaccgggtcaacctgaacatcatcggcctcgacggcaagccgcaggtcaaggacctgcgccagttgctctcggagtggctgcagttccgcatcggcaccgtgcgtcgacgcctgcagttccgcctggacaaggtcgagcgccgcctgcatctgctggatggcttgctgatcgccttcctcaacctcgacgaggtgatccacatcatccgcaccgaggaccagcccaaggcggtgctgatggagcgcttcgaactcagcgaggtgcaggccgactatatcctcgacacccgcctgcgccagttggcgcgcctggaagagatgaagatccgcggcgagcaggaagagttgctgaaggagcagaagcgcctgcagaccctgctcggcagcgaggccaagctgaagaagctggtgcgcgaggagctgatcaaggacgccgagacctacggcgacgaccgccgttcgccgatcgtcgcccgcgccgaggcccgcgcgctgtcggaaaccgagctgatgcccaccgaaccggtgaccgtggtgctctcggacaaaggctgggtgcgttgcgccaagggccacgacatcgacgccgccggcctttcctacaaagccggcgaccgctttcatgccgccgcgccgggacgctcgaaccagtatgcggtgtgcatcgactccaccggggcgcagctactcgctgccggccccactgcctgccgtccgcgcggggccagggcgagccgctcaggcggcccggctga

SEQ ID NO: 16546 - DNA, 765 bp, Pseudomonas aeruginosa
aattcaagtcttgcatcagtagtgccgatcttcggcgaaatacggtggttctcgatgagcgcgtggcgcgtcttcgcatgtctttccctcgtcagcctgctcgggctgacgggttgtgcggtccatccgccggcccagctctaccagttggacgtcggtgccgctgcggtaccgaaaaaggacggcggtgcggccgtcctgctcgggccggtacaactggccgactatctcaagcgcgatgtgatggtgcagcggcaggccgatggtattctcagtctgtccaccgaagcgcgctgggccggcaacctggagaccaatgtcagccagcaactgctgcggcagatgtccagcgagctgggcagcagccgcctggcgctgttcccggaaaaacccggtttcaccccccaggtccaggtgatgctgaccatcagtcgcctcgactccggccccaagcagccggcagtgatcgaggcgcgctggcgcctgttggaccagaagggcgacctgaaggacagccgggtgttccacgaggaagaacagcatcagggcagcatcggcgaccagatccgtgcccagagcgacctgctcaagcgcctggcggcgcagttggccaaggacgtcaagccgatcgccgtggcggccgaggcgccgccgccggcgaccgcgcgcaagccggtggccaagccgaaggtcaaggaagaggaaggtccgaaaatgccactggtggtgccgattcgcaccgacgccgaggtctatcggttctga

SEQ ID NO: 16547 - DNA, 585 bp, Pseudomonas aeruginosa
cgttgcaggagatccaccaggcggctgcgcggcaaccggcgcaactgttcctgggcgccgagctggatcgccagcaccgcactgtgttgcggttcgcgcgcagcggcgggcgctgcgggctgttccccggcttcggctccgttctcgtcgaaggcgtcctggtccagcgggtcttcgtcgatggaggtgaattccaccggcttggtctcgtccagcagggcgtcgcccagcggaatgtcgtcttcctcgaaggccgaggcctcgaccttgcggctgcgcaggtcggcttcgtcgtcttccagcaggatgtcgtcgaagttctgcggcagcggtgcttcttccggctccggcgccggcggcttttccggcaccaggcgctcttccaggtcgcgcgccaggtcgcccagctcgttctgcagttcggcgccgggggccggattgtccggatcacgcaaccagacacgcaattgcaacaagggtgtggaaatctgccgccccaggcgcaggctgaaatacagggcgaggatcagcaggatcaggctgatcaggcccatgctctgcaggctgatcatcatcggctgctga

SEQ ID NO: 16548 - DNA, 1296 bp, Pseudomonas aeruginosa
tggcaaatgcccggctctgcgtctctcgggtgtgcgggaaagcgggtagaatggcgtcttttacctggcggagcttacgccttgcgcgaaattgtcctgatcaacatcaccggggaagaccgccccggtctcaccgctgccatcaccggcgtactggcccagggcggggtgaacatcctggacatcggccaggcggtgatccacgacaccctgtcgttcggcatcctggtggaaatcccggataccgaggccggttcctcggtcctcaaggacgtgctgttcaccgcctacaagctggaccagcaggtgcgcttcaccccggtctcggaagaggactaccggcaatgggtcgacggccagggcaaggcgcggcacatcgtgaccctgctcacccgccgggtgactgccgagcaactgcagagggtcagctcgatcaccgccaagtacgcgctgaacatcgaccacatcgaccgtctctccgggcgcatgccgctggacatgcccgccgaccagggcaagggctgcatcgagttctcggtacgcggcgaaccggccgatccggcggcgctgcgtgcggaattcctcagcgtcgcccaggaattgaacgtcgacatcgctttccagcaggacagcgtgttccgccgcaaccgccggctggcggtgttcgacatggattcgacgctgatcgaggcggaagtcatcgacgaactggccaaggccgccggcgtcggcgagaaggtcgccgcgatcaccgagcgggcgatgcgcggtgaactggacttccgcgccagcttcaaggagcgcctggcgctgctgcaggggctgtcggaagacgtgctggaggagatcggcgcctcgctgcgtctgaccgagggtgcggaaaccctgttcgccgaactcaagcgcctgggttacaagaccgccatcctgtccggcggcttcacctatttcgcccgtcaattgcaggcgaagctggggatcgactacgtgttcgccaacgagttgcagatcgtcgacggcaaggtcaccggggtggcggtcgagccgatcgtcgatgcccagcgcaaggccgacctgctgcgcgaactggcggcgaaggaaggcctgagcctggagcagaccatcgccgtcggcgacggcgccaacgacctgccgatgctcggcctggccggcctgggcgtggcgttccgcgccaagccgctggtcaagcagtcggccaagcaggcgatctcgaccctgggcctggacggcatcctctacctgctcggctaccgcgaccgcgaaggacgagcctga

SEQ ID NO: 16549 - DNA, 1626 bp, Pseudomonas aeruginosa
gtgatggcgtcgaccgagctgtcgagcagcaactggcagcgtttttccgcctcgcgcagggcgagttcggcggcgcggcgcgcgcggcgttcggcgaggccggccagctcgcggttggcgaccagcaccaggcgctcgtcctcgccttgcggcagggcgtcctgggcgccgagcatcaaggcgtcggtgatggcgtcggagctgttgtcggccaccagctggatgaacgggatgtcgcgcgactggcggcgcaaggtggcgagcgcctcgccgggctcgagacactcgctggtcggcgcggcgatcagcaggtcccagctttgctggagggtttcggcgaggtcctcgggagaggtcagtcgatgtacgcgggtcgcgtggccggcattgcggaacagactgaccaggcgttcggcttcgttctgcgagtcttccagaatcagcaggcggatggttttcttttcgatggccatggaaagggctcagtccgcgtccgggcaggcgcgaaaagacggcgaatggaggggtcggggcaatctacagagacttccagagcgagtcaaaatcttcctcccccgcaggcggccgggccactggcgctgtgaccggcttatcgctcggggtgttcaccggttccgccgagcggtattcgaactggctgaagctgccggtcgaggcctgccggcgattcagcaccgcgcgccgctcctcgccgtgcaggttgatctgcacccggctgccctcctggaacggcaggcgcggggtgatcaccgtcgccggccgcgagatcgcggcgatcgccggcagcagcagggcgcgcaggtagtggctgctctgctcggtcttgcgcagcagttgcaggccgcagggctgtgccgccggggcgatcatctcgatgcccatctgcgtgccgccattgcgtacctggcggatccagcgcaccaccgcgatgctccacgcctggcctggaaggtcctgcaggccgaccagttcgcccgcctgcagttgggcgggcacctccttcggccagctcaggcaatagccgccggggctgtggttgacgatgggcagggcgtaggtcgggtagtcctcggtggcgtcagcctgtgcgtgggcctgcgggtgcccgggttgcacactgcggggcgactggtgcgggcggtactcgatttcctccagcggcatgccgggctgccagtcggtgaccttctgtgcatcgaaggcgccggcccaggcgtcctggacgtcggccttgaagcgaggcgcctcgggcgcttcctggatctgcaggacctcgttgaacgggcggcgcccggcgaggaagtagtgcagggcgctcatgccgatgcacagggtcaactggccctggccctgggtgcgctggaaggtacgttcggcgatgtcaccccaggccgaggagagatgttgcagcaggtccagggtcaccccttcgatcagcggcaggcgtgctttcgcgcgttcggcctcgggctgcagcaggtattcgcggatcagctcgaccagcggctgggtgtcgatgcccagggcattggccagttgggtctccgggtacagcgaacggtagcgcggcgggccgtcgatctgcggcacggcgatgaacagtga

SEQ ID NO: 16550 - DNA, 1611 bp, Pseudomonas aeruginosa
cagcatcgaaatggacccgcagccttcggacgccacgatcccgccgggaggttccggcggcggggagagacgggacggaggcgctcggggcgctccgccccggcgaggtcaggactgtttcggcagggccaggcattcgcccatgcgcaccgggctcgctgccccgaggccgtcgttgaacgcgacctgctgcgggccgaacaggacgatggcggtggagcccagcttgaagcgaccgagctcggcgcctttttccaggcggatcggcgcacgggcggcttcgtcgtagcggaaggtcttcagttcgcgcttcggcggcgtaacgaggccggcccagacggtttcgatggaggctacgatcatcgcgcctaccagcaccacggccatcggaccgcgctcggtgtcgaacaggcagaccacccgctcgttgcgggcgaacagctcgggaacgttttccgcggtggtctggttcaccgagaacagccggccgggaacgtagaccatctcgcgcagggtgccggccagcggcatgtgcacgcggtggtagtcccggggggacaggtagacggtggcgaagtcgccgcccatgaagggcgcggccagttcggcgtcgccgccgagcagttcggccaggctgtagctgtggcctttggcctggaagatccgcccgtgctcgatcgggccgagctggctgatcgcgccatcggccgggcagagcaccgcgccgggctcctgggccagcgggcgggcgccatccttcagggcgcgggtgaagaaggcattgaaatgttcataggcctgcaggtcctcgacctgcgcttcgcgcatatcgacctggtagcgccgggcgaaccaggcgatcaggcggtccttgaaccaggtcgcccggcagtcggcggcgaagccgatcagccgggacagcaggtggtgcggcagcaggtactggctgcagatgaacagacgatctttgaacgacattcctcaaacctctacaggggtatcggggtggttgccccattccgaccaggagccggcgtagcctttgacccgcgggtagcccagcgccttggccaccaggtaggtgaagccggagcgatggtgggtctggcagtgggtgatcacttccttgtccggcgtgatgccgaggtcctccaggacttcggcgatatccgcgcggatgcgcagggcgcgagccgggtccatgccggcggtccattcgaaattgatcgcgccgggcacatgcccggccttcgcggcgagcaccttggtaccggcgtattcgctggggttgcgcgcatcccataccgccaggtcggcggcgccgaggcggctttgcaggtattcgcgggtcgcactgggctcgtcgtgcaacgtcagcggctgcgggccgccgacaggcgccgggacctcgcggtcgagcgcctgggcgtcggcgatccaggccggcaggccgccgttgagatagtggtagtggtggtggccgatcacgtccagcagccagatgaagcggcccgcccagccgccgccttcgtcgtcgtagaccacgtaggtcgcctccgggcggtggcccagctcgccgaacagggcttccaggtcggccttcgccggtag

SEQ ID NO: 16551 - DNA, 693 bp, Pseudomonas aeruginosa
tggcgttcttcctggtgctctggctgctgtcttcggccaccccggagcagaagaaggcgatttccggatacttccaggaccccatcggtttcagcgaaagcgccagcccctacgtcatcgacctcggcggcacgccgacgccggcgccggacaagaccctcaatccgcaggttcaggcccagccggactccaacgaaagccggatcagccccgagcaggaccaccaggtcaacgccgatcaggccgagaacctcgccgagcaggttgagcgagagcgtctggcgctgctgctgcaggagttgcagaacaaggtcgacgaaaatccgatgctcaaggacttcaaggaccagatccacttcgagatcacccgcgacggcctgcgcatccagatcgtcgacgccgccaaccggccgatgttcgacctcggcagcgcgcgcctgcagccgtatttcgaggacatcctgctggccatggccgagaccatccgccaggtgccgaacaagatcagcatcagcggccacaccgacgccaagccctatgccggcaacggcgacttcggcaactgggagctatcggccaatcgcgccaacgccgcgcgccgtgcgctggtcgccggcggctatccggaagggcagatcgcccaggttgtcggctatgcctcggcacgcctgttcgacgacaaggacccgctga

SEQ ID NO: 16552 - DNA, 360 bp, Pseudomonas aeruginosa
ctggccatgcgttgcggcatgatgcgcccgtcctccaaggcctggagcagggcgcaacctggttcacggtcgtgcttgcagtcgcggaagcggcaatgtccgagcaggtcgcggaactcgatgaaaccggcctcgacatcgtctcgcgacacgtgccccaggccgaactcacggatgccgggcgagtcgatcaggtcgccgccgccgggaaaatggaacagtcgcgcggtggtggtggtatgggtgcccttgccggtcaccgtggagaggtcgccgacacgtgtgtcgacacctggcaacaaggcattcaccagcgacgacttgcccaccccggactgcccgacgaagacgctcacgtga

SEQ ID NO: 16553 - DNA, 312 bp, Pseudomonas aeruginosa
agatcgggctgttcactggcgatgcgccggcacgggtcggcgagctggtgttcgacgaactcggtagcgacgccgtcgtgctgcaagcgctccagccccgggctcgccgcctggcgcgaaatgcccctgccgaggctggcagcgcggccgcggaccgcacacaaggggctgttcggccacctgctggtggtcggcggcgacaccggcatgggcggggccgtgctactggccgccggaaagcgcccctgcgctgcggcgcccgggctggtctcggcggcgacccgcggtcgaacatgtgccgggcgttgttga

SEQ ID NO: 16554 - DNA, 762 bp, Pseudomonas aeruginosa
agaccctggcgcccttggcccgggcgggttgcacgagaagaacatcaccctgtcgatcgctcgcgagctgcaacgccagatcaaccaggtgcgcggttaccgggccgagctgacccgtaccggcgactatttcatcccgctgcgcaagcgcaccgagatcgcccgcaagaagggcgccgacctgttcgtctcgatccatgccgacgccgcgccgagccgcagcgccttcggtgcctcggtgttcgccctgtccgaccgcggcgccacttcggaaaccgcgcgctggctggccgacagcgagaaccgttccgacctgatcggcggcgatggcagcgtcagcctcggcgacaaggaccagatgctcgccggcgtgctgctcgacctgtcgatgaccgccaccctctcgtcgagcctggatgtcggccacaaggtactgaccaatgtcggccgcatcacttcgctgcacaagcgtcgtgtcgagcaggccgggttcatggtgctgaagtcgcccgacatcccgtcgatcctggtggaaaccggcttcatctcgaacgtcaacgagtcgcgcaagctggccagcgccagccatcagcaggccttggcgcgttcgatcaccagcggcatccgccagtatttccagcagagcccgccgcccggtacctacatcgcctctttgcgcgcccagggcaagctctccatggggccgcgcgagcacgtggtgcggcccggagagaccctggcgatgatcgcccagcgctatga

SEQ ID NO: 16555 - DNA, 1980 bp, Pseudomonas aeruginosa
cagcaacagcctgtccagcgacaacctgaaagtcggccaggccctgtccatcccgagcaccgccctggcggcccagtgatgagtgaagcaccgcgtatccagctgctgagtccgcggctggcgaaccagatcgccgccggtgaggtggtcgagcgtcccgcctcggtggccaaggaactcctggaaaacagccttgacgccggttcccggcgcattgatgtggaggtcgagcagggcggcatcaagttgctgcgagtgcgcgacgacggtcgcggcatccccgccgacgacctgccgctggccctggctcgccacgccaccagcaagatccgcgagctggaagacctggagcgggtgatgagcctcggcttccgtggcgaggcgctggcctcgatcagctcggtagcgcgcctgaccatgacctcgcgtaccgccgacgccggcgaagcctggcaggtggaaaccgagggccgcgacatgcagccgcgggtacagccggcggcgcacccggtggggaccagcgtcgaggttcgcgacctgttcttcaacaccccggcgcggcgcaagttcctgcgtgccgagaagaccgagttcgaccatctgcaggaggtcatcaagcgcctggcgctggcccgcttcgacgtggctttccacctgcgccacaacggcaagaccatcttcgccctgcacgaggcgcgagacgagctggcccgcgcgcgccgggtcggcgcggtgtgcggccaggcattcctcgagcaggcgctgccgatcgaggtcgagcgcaacggcctgcacctgtggggctgggtcggcttgccgaccttctcccgcagccagccggacctgcagtacttctatgtgaacgggcgcatggtgcgcgacaagctggtcgcccacgcggtgcgccaggcttatcgcgacgtgctgtacaacggccggcatccgaccttcgtgctgttcttcgaagtcgatccggcggtggtggacgtcaacgtgcacccgaccaagcacgaagttcgcttccgtgacagccggatggtccatgacttcctctatggcaccctgcatcgtgcgctgggcgaggtccgtcccgacgaccagctcgcgccgcccggggcgaccagcctgaccgagccgcgtccgaccggcgctgccgccggcgagttcggcccgcagggcgagatgcgcctggccgagagcgtgctggagagtccggcggcacgggtgggctggagtggcggctcatcggcctccggcggctcctccggctattccgcctatacccggccggaggcgccgccctctctggccgaggccggtggcgcctacaaggcctacttcgcgccgttacccgcgggcgaggcgccagccgcgttgcccgagagcgcccaggacatcccgccgctgggttacgccctggcgcagctcaagggcatctacattttcgccgagaacgcccacggcctggtgctggtggacatgcacgcggcccacgagcggatcacctacgagcgcctcaaggtggcgatggccagcgaaggcttgcgtgggcagccgttgctggtgccggagtcgatcgcggtcagcgagcgcgaggcggattgcgcggaagagcattccagctggttccagcgcctgggcttcgagctgcagcgcctggggccggaaagcctggcgatccggcagatccctgcgctgctcaagcaggcggaggcgacccagttggtgcgcgatgtcatcgccgacctgctggaatacggcaccagcgaccgtatccaggcgcacctgaacgagttgctcggcaccatggcctgccatggcgcggtgcgcgccaaccggcgcctgaccctgccggaaatgaacgccctgttgcgcgacatggaaatcaccgagcgcagcggccagtgcaaccatgggcgtccgacctggacccaactgggcctggacgagctggacaagctcttcctgcgcggacgctga

SEQ ID NO: 16556 - DNA, 618 bp, Pseudomonas aeruginosa
gccttgcagcttcgggcgcaaagcccgaagctatgcgctttgtccaagagcgttccgatgtcttccctgcctcccgccatctttctcatggggccgaccgccgccggcaagaccgacctggcgatggcgctggccgatgcgctgccctgcgagctgatcagcgtcgactcggcgctgatctaccgcggcatggatatcggtacggccaagccttcccgggagctgctggcgcgctatccgcaccgcctgatcgatatccgcgatccggcggagagctattcggccgcggaattccgcgccgacgccctggcggcgatggccgaggccaccgcgcgcggcaggattcccctgctggtggggggcaccatgctctattacaaggcgttggctcgagggcctggccgacatgcccggcgccgatcccgaggtgcgcgcggcgatcgaggccgaggccctgtccaaaggttgggacgcgctgcaccggcaactcgccgaggtcgacccggagtcggctgcgcgcatccaccccaacgacccgcagcgactgatgcgggcgctcgaggtgtatcgcctcggcggggtgtcgatgagcgacctgcgtcgccggcaaagcgctga

SEQ ID NO: 16557 - DNA, 381 bp, Pseudomonas aeruginosa
cctgaaggcgtatcgcgaaagcttcgccgagaagcgcgacgtactggtgctcgatccgagcagcgagttcttccgctatctgaacaaggccaacaagtaatactcggttctccggcgggcggcagcgcccgccggagaaatcgtgttatgatgagccagccgggaaatcccggcttttttgcgtccgcgagaatcatgtggcaggaattcggcatcgctttttgtctcgtgctggtgctggaaggcatcctgccgttcctgtgtccgcgacaatggcgcgaggcggtcaccggcatcggccggctgagcgaccgtcacctgcgtctcgtggggctgggcagcatgctgctcggcaccctgcttctttactggattcactga

SEQ ID NO: 16558 - DNA, 2739 bp, Pseudomonas aeruginosa
agaagaaaaggtgacctacctctaatggccgattggcaaaacctcgatcccgaggccgctcgcgaagcggaaaagtacgaaaaccccatccccagccgggaactgatcctggctcacctatccgagcggggcgctccggcgactcgctcccagttgctcgacgagttcgggctcgccggcgaggagccggaagaggccttgcgtcgtcgcctgcgcgccatggagcgcgacgggcagcttatctatacgcgtcgtggcgcctatgcgccggtggacaagctggacctgatccgcggccgcatcagcgggcaccgcgacggcttcggcttcctgatccccgacgatggcagcgacgacctgttcctcagtcccacccagatgcgcctggtgttcgacggcgaccgcgccctggcccgggtgtccggccatgaccggcgcggacgccgcgaaggccagctggtcgaggtgatcgagcgggcccacgagatcgtggtcggccgctacttcgaggaaagcggcatcggcgtggtggtcgcggacaacccgaagatccagcaggaagtcctgatcccgccgggcaaggccggcaaggccaggcacaaccagttcgtccaggtgcgcatcgagcaatggccgagcatccaccgccaggcccagggcgagatcgtcgaggtgctcggtgactacatggcgccggggatggagatcgaagtcgccctgcgcagctacgatatcccccacgtctggccggccgcggtggagaaggaagcggccaagctcaagccggaagtggcggagaaggacaaggaaaagcgtgtcgacctgcgccaggtgcccttcgtcaccatcgacggcgaggatgcccgcgacttcgacgacgcggtgtacgccgaggccaagcgcggcggcggctggcgcctgttcgtggcgatcgccgatgtctcgcactacgtgaaggtcggttcggcgctggacgaagaggcggccaggcgcggcaactcggtgtatttccccgagcgggtgatcccgatgctgccggaggtgctgtccaatggtctctgctcgctgaatccgctggtcgaccggctggccatggtctgcgagatgaccctgtccaaggctggcaagctgaccggctaccagttctacgaagcggtgatccactcccatgcccgcctgacctacaccaaggtcagccagttgctcgagcatcccgacagcgtcgaggccgagaacctgcgccagcagttgcccggcgtggtgccgcacctgcagcagctgtatgcgttgtataaagcgctgctggccggccgccatgtccgcggcgcgatcgatttcgagacccaggaaacccgcatcgtcttcggcgccgaccggaagatctcggaaatccgcccgacccagcgcaacgatgcgcaccgcctgatcgaagagtgcatgctctgcgccaacgtggcgaccgcacgcttcctgcagaagcacgccatcccggcgttgtaccgggtgcatgacggcccgccgcaggagaaactcaacaacctgcgccagttcctcggcgagctggggttgagcctcggccgcggcaaggccgcgccgaccccgggcgactaccaggagttgctggagaagatccacgaccgcgccgacttccgcctgatccagacggtcatgctgcgttcgctcagccaggcggtgtacagcccggacaacaatggccacttcggcctcaactacgacgcctacacccacttcacctcgccgatccggcgctacccggacctgctggtgcatcgtgcgatccgcagtgtgatccgctccaaggcggagactccgcacgtgcagcgggccggcgcggcgagcatgcccaaggcgcgtatctatccgtacgacgaattgcgcctggaccagttgggcgagcagtgctcgatgaccgagcggcgtgccgacgaggccacccgcgacgtgaccaactggctgaagtgcgaatacatgcgcgagcgggtcggcgagaccttccctggcgtaatcactgcggtcaccggtttcggtctgttcgtcgagctgaccgacatcttcgtcgaaggcctggtccatgtgaccgcgctgcccggcgactactatcatttcgacgccgtgcaccatcgcctcagcggcgaacgcaccgggcgcagcttccgtctcggcgacaccacggaagtggtagtggcgcgggtcgacctggacgagcggaagatcgatttcgagctggccggaaacgtgctgagcgcgccgatcggacgcaagaagcgcaacggcgacaagtcggcgaacgccggcaaggcgccgaaggggcgcaagggcgcatccgtgcccgaggtcgacctggagccggcgctggccagtcccgacgccgcggtggtgccgcggcgcaaggccggcaaggtgcaggcgctgccgccggtcgcgccggagctgctggcgcaggccgcggagatgctcggcaacaccgacgtgcgcaagagtcgcgaggtgaagcaggcgctgctcgccgaggcgcgtgtcggcggcaaggacaagggcgggaagaagggcaaggtcgttcctgcgggcaagagcgcgaagggcaaggccaaggacggcaagcccgccgctgccgccaagccgggcaagccgaccaagcatcgcaaggggccttccaagccgaaggccgacaacgctccggccgccaccggggcgcgcaaacgtaaggccaagtcatga

SEQ ID NO: 16559 - DNA, 429 bp, Pseudomonas aeruginosa
ggagcatttatgcgtcattacgaaatcgtgttcctggttcacccggaccagagcgaacaagtcggtggcatggtcgagcgttacaccaaggccatcgaagaagacggcggcaagatccaccgtctggaagactggggccgtcgtcagctggcctacgccatcaacaacgtgcacaaggcccactacgttctgatgaacgtcgagtgcagcgccaaggccctggctgagctggaagacaacttccgttacaacgatgccgtgatccgtaacctggtcatgcgtcgcgacgaagctgtcaccgagcagtccgagatgctcaaggctgaagaaagccgcaacgagcgtcgcgagcgtcgtgagcgtccgaacgataacgctgaaggcgccgatggcgacgacaacagcgatagcgataacgctgacgagtaa

SEQ ID NO: 16560 - DNA, 1227 bp, Pseudomonas aeruginosa
ccatcgcctgatcttccgcgccatctacaagctggccgaggccaaccagccgatcgacgtggtgaccctctccggagcagttggagaaggaaggacaactggcccaggtcggcgggcctggcctatctcggcgaactggcgaagaacattccctcggtcgccaacatcaaggcctacgcgcagatcatccgcgagcgcgccaccctgcgccaactgatcggcatcagcaacgagatcgccgacagcgccttccacccggaagggcgcggcgccaacgagatcctcgacgaggccgagcggaagatcttcgagatcgccgaagcgcgaccgaagactggcgggccggtagggatcagcgatatcctggtcaagaccatcgaccgcatcgactacctgttcaacaccaccgaggcgctgaccggggtgtccaccggtttcaccgacctcgacgagaagaccagcggcctgcagccggccgacctgatcatcgtcgccgggcgtccgtcgatgggtaagaccaccttcgccatgaacctggtcgagaacgcggtgatgcgcaccgacaaggccgtgttggtgtactccctggagatgccctccgactcgatcgtgatgcgtatgctctcgtcgctcgggcgtatcgaccagaccaaggtgcgttccggcaagctcgacgacgaggactggccgcgcctgacttcggcgatcaacctgctcaacgacaagaagctgttcatcgacgataccgctggcatcagtccctcggaaatgcgcgcgcggacccgtcgcctggtgcgcgagcacggcgacctggcgctgatcatgatcgactacctgcaactgatgcagatacccggctccagcggcgacaaccggaccaacgagatttccgagatttcccgctcgctgaaggccctggcgaaggaattcaactgcccggtgattgccctgtcgcagctcaaccgctccctggagcagcgacccaacaagcgcccggtgaactccgacttgcgcgaatccggggcgatcgagcaggacgccgacgtgatcatgttcgtctaccgcgacgaggtgtaccacccggagaccgagttcaagggcgtcgccgaaatcatcatcggcaagcagcgtaacggtccgatcggtacggtgcgcctggccttcatcggcaaatacacgcgcttcgagaatcttgccgccggcatgtacaacttcgaggacgaatga

SEQ ID NO: 16561 - DNA, 1905 bp, Pseudomonas aeruginosa
gcaaggtcacggctcgggttccgcgacgctacagccactgattcaggagatacgctccggtgccagggcggtcggccaggggagcgccggcgcggtctcgcgttcatcgtcggcagccatcgcatagccggcgcgcccggcgcccttgacccggtacagcgcctggtcggcggccttgtagagtttgccgaactgcagggcgtcgccgggaaacagggcgacgccgatgctcggtgtgatcaccagccactgcttggcgaactccaccggtttcgccagttctcgcagcaggcgttcggcgatgtcgcgggcatgctgctcggcattcgacccgccgaccagcacggcgaattcgtcgccgccgaggcgcgccacgcaatcctcggtgcgcacgcaatggcgcagccgctgggccacgttctgcaggacgaagtcgccggcatcgtggccatgggtatcgttgatcggcttgaagtgatccaggtcgatcagcagcagcgccatgctgttaccgtggcggcgcgcgtcgtccagggcgctttcggcgaactccatcaggtgcctgcggttgccaagcccggtcagcgggtcgtgatgggcggcgtactgcagttgcgcttcgcgcatctgcaactggcgattggcctcgctcaactcgttggtacggacttccacggcgcgtgccaggtcgcgctgggcgctgtgcagcagggccaggcgcgcgttcttttcctggtcggcctggtccagggccagggccctttcctgcttcagatcctggatgcgcgaggcgagcgccagggagaacagcagggcctccagggtcagcgccagcgggaagaccatggcgttggccgaggtcggctggaccagcgcggtggcgcgcatcacgccaaggctgacgctgccgagcaccaggccgaagccgaccaggtacaggcgcgccgtggccgaaccctggcgccagcgctgcactgccaggccgatggcgatcggcaggttggccagcagggtcagcgccagcacgccggccgcctgccagcgccagccggcggcgttgaacgccaggcaggcaaggaacagcaggcaacaggcgttcagcaggtgatgggcccagcgtgcgtgctgccggctttgcagcaggttctggctgaagcggatcacgcagatgccccagatcgccagcagcgccaggcggtcaagccaccagggcaccgcccgctcgggccagaaatactcgaaaccatggccgctgatgctcagggtcagcaccagcgcgctggcagcggtcagcacgtaccagaaataggcgcgatcgcgcaggctggtgaagaggaacaggttgtacagcagcagggcgaggatcagcccgtaggccatgccgaacagcaggttgccctggctgcggtattccagcagttcgtcgtggctccagagcctcagcggaaaggcgttgccgccgggatcgtagctgcgcaggtagacgcgcaacggcccatcgccgggagggatccggaacagcggatgacggtaggcgtggtcgcggccctcggcgaagggcaccgcttcgccgctgcgatgttcacggaacccgccgcgctcgtcggggaggtacaggcgcaggtcgtgcaggctggcgctggcgacttccagccaccagccgccggataccgcctcgcgtctcggcaggtcgaggcgcagccaccaggcgctgcggctgaggccgacgctggtgcggccggcggcggcgacgaagcggccggcctgctccgcttgttcgaggtcctccaccgccaggttgccatcggggtcttcgagcaggtccagcgagccgttcaaccaggcgccgctggccggaggcgccggaaactccggcgcggcgcgcgaaacggcgctggccagtag

SEQ ID NO: 16562 - DNA, 2265 bp, Pseudomonas aeruginosa
agataccccctggtgcccgtgatgcaagccgccaagccgctgttcgactatcccaagtactgggccgagtgtttcggtccggcgcccttcctgcctatgagtagggaagagatggatcagctcggctgggactcctgcgacatcatcatcgtcaccggcgatgcctacgtcgaccacccgtccttcggcatggccatcatcggccgcctgctggaggcccaggggttccgcgtcggcatcatcgcccagccggactggcagtcgaaggacgacttcatgaagctcggcgagccgaacctgttcttcggcgtggcggccggcaacatggactcgatgatcaaccgctacaccgcggacaagaaggtccgttccgacgacgcctacacccccggcggcctggccggcaagcgcccggaccgcgccagcctggtctatagccagcgctgcaaggaggcctacagccatgtgccggtgatcctcggcgggatcgaggcctcgttgcggcgcatcgcccattacgactactggcaggacaaggtccgccgctcgatcctgatggacgccacggccgacatcctgttttacggcaacgccgagcgtgcggtggtggaaatcgcccagcgcctggcccagggcgaactggtgagcgcgatcaccgacgtgcgcggcaccgccttcgtccgtcgcgacaccccggagggctggttcgagatcgattccacgcggatcgaccggccgggcaagatcgacaagatcatcaatccctacgtgaacacccaggacaccgccgcctgcgccatcgagcaggaaaagggcgcgcaggaggacccgcaggaagccaaggtcgtgcagttgctggcgaaccccaggctgacccgggagaagaccgtgatccgcctgccgtctttcgagaaggtgcgcaacgacccggtgctctatgcccacgccaaccgcgtgctgcacctggagaccaacccgggcaacgcccgtgccctggtgcagaagcacggcgaagtggatgtctggttcaacccgccgcccattccgatgagcaccgaggaaatggactacgtgttcggcatgccctatgcccgcgtgccgcacccggcctacggcaaggcgaagattcccgcctacgagatgatccgcttctcggtgaacatcatgcgtggctgcttcggcggctgcaccttctgctcgatcaccgagcatgagggacggatcatccagaaccgctcgcacgactcgatcatccgcgagatcgaggagatgcgcgacaaggtgcccggcttcaccggcgtggtctccgaccttggcggaccgacggcgaacatgtaccgcatcgcctgcaagagcccggacatcgagcggcactgccgcaagccatcctgcgtgttccccggcatctgcgagaacctcgataccgaccacagctcgctgatcgagctgtaccgcaaggcccgggcgctgccgggggtgaagaagatcctgatcgcctccggcctgcgctacgacctcgccgtcgagtcgcccgagtacgtcaaggaactggtgacccaccacgtcggcggctacctgaagatcgccccggagcacaccgagcgcggtccgctggacaagatgatgaagccggggatcggcacctacgaccgcttcaagcagatgttcgagaagttctcgaaggaagccggcaaggagcagtacctgatcccgtacttcatcgccgcccatcccgggaccaccgacgaagacatgatgaacctggccctgtggctcaagcgcaacggcttccgcgccgaccaggtccaggcgttctatccttcgccgatggccactgccaccgctatgtatcactcgggcaagaacccgctgcgcaaggtcacctacaagagcgatggcgtgaccatcgtcaagagcgaccagcagcggcgcctgcacaaggccttcctgcgctaccacgacccgaaaggctggccgctgctgcgcgaggcgctggagcggatggggcgcgccgacctgatcggcaatggcaagcaccacctggtcccgacctaccagccggataccggcgaataccagagcgctcggcggaagaactcgacgccggccggcagcaagaaggccggcaagctgctgacccagcataccggcctgccgccacgcgccagcgacggtggtaagccgtggagcaagggtcagcagaacaaggcgacggccttcgccaagggcaagaagaagtcgcgccagccgaacatcccgcgctga

SEQ ID NO: 16563 - DNA, 2526 bp, Pseudomonas aeruginosa
ccgcaaccccagccccgcgagccttcgatgcccgagctgcttgcccactatccgttcaccgatacggcctaccacgagttgctcgatcgccagggcggcgtgcgtccccattggcagcggctgttccgccaactggagcgcagcagccctgagcaattgcgccagcgccaggccctggtggaacggcagatccaggagaacggcgtcacctacaacgtttacgccgatcccaagggcaccgaccgcccctgggcgctggaccttctgccgaacctgctgtccgccgccgagtggcagccgatcgccgctggtgtggcgcagcgtgctcggctgctcaatgcgctgctggccgacctgtacggcgaccagcgtctgctcgccgaagggctgctgcccagcgaactggtcttcggccatccgaacttcctctggccggcgctcggcatccggccgcccggcgggattttcctgcacagctatgccgtggacctggcgcgcgatgccgacggacgctggcaggtccttgccgaccgcacccaggctccgtccggcgcgggctatgcgctggagaaccggcagatcgtctcgcgggccttgccggaactctatcgcgacctgcgcgtgcagcatctcgccgggtatttccgcaccctgcaggagaccctcgccagccaggccgccggcgacggcgagacgccgctggtggtgctgctgactcccggacgtttcaacgaaacctacttcgagcatctctacctggcgcgccagctcggtttcccgctggtcgaggggcacgacctgacggtgcgcgacgccaccctctatctcaagaccctcggcggcctgaaacgggtgcacgcggtattgcggcgtctcgatgacgacttctgcgacccgctggaattgcgtaccgactcggcgctgggcattcccggcctgctcgaggcggtacgccaggggcgcgtactggtggccaacgcgttgggcaacggggtgctggaatcgcccggcctgctcggcttcctgccgcaggcctgtcgccgcctgctcggcgaggagttggcgctgccctcgctcgacacccgctggtgcggcgagccgcaggcactcgaggcgatactcgcggcactgcccgacctggtgatcaagccggcctttcccggccagcgctgcgaacctctgttcggccacgccctcgacggtgccggcctggcgtccctcggcgagcgcttgcgcgagcgcccgcaggcctacgtggcgcaacgcctggcgcagttgtcccaggcgccggtctggcgcgacggcgaggccggcgtcggcctgcagtcgcgggccatcggcatgcgcgtgttcgccgtcgccgccgccgacggccgctactgggtgatgcccggcggtctgacccgcgtagcctcggcggcggatgccgaggtggtgtcgatgcaacgcggcggcgcgagcaaggacacctgggtactggccgagcgtgcggtcggcggcgagccgtggcggccgcgccggctcggcgtgcgcgacctggtccgcgaggatccctacctgccgtcgcgggtggtggaaaacctgttctggtacggccgctatgccgagcgttgcgacgaccacgcgcgcctgctgcgggtggtgctgtcgcgctacgtggatgccgatggcgacgaagaggcgctgcgcagcgccctggccctggccggcggcatcggcctgctgcccggggatggcgagccgttggaaaggtgcctgttgcgggcgttgctcgacgagcactggccggcgagcctgtgcgccaacctgcggcgcctgcactgggcggcggcgcaggtgcgcgggcgcttgtccggggagaactggctggccttgctggagctgcaacgcgacatgcaggcgctcgatccggcacgcaccgacctcggcgaagcgctggacttcctcaaccggctagtgatgtccctggcagccttgtccggtttcgccctcgacgacatgacccgcgacgacggctggcgtttcctgatgatcggccggcgcatcgagcgcgtgcgcttcttcgccgagagcatcgccgccttcctcgacggcggtagcgcctgggacgccggcgcgctggaatggctgctggaactgggtaacagcggcatcacctaccgctcgcgctacctggcgtcgccgcaactggtcccggtgctcgacctgctcctgttgcacgagcagaacccgcactcgctgcgcttccagttgcaggccctggagcgttcgctggagcgcctgcacgaggagttcggcgcgccacgcgagcgggaactcaggaccctgggcgaacgcctgcgcagcttcgatctggcggccctggaaagcccgctgttcggcgcggcaggactcgacgaggtgctcgtcgggctggcgcgactgctgcgcgacatcgccgcctgcgccggacaggtctccgatcggctaggcttgcgctatttcgcccatgtcgacgatgtcagccagagaacggtatccacctga

SEQ ID NO: 16564 - DNA, 885 bp, Pseudomonas aeruginosa
tgtccgcacccgcgcttcgctccgttccgctccagggcgcccgctaccaggtgctgcacgacacccattaccgctatgcgacgccggtctcgctgtcgcggcaactggcgcatctctggccacgcgaatgcgcctggcaggcctgtcatgagcgggcaattgctgatcgagccgggggccgagcccggccgcgaggatgcccacgacgcattcggcaatccgctgagccgggtggccttcgagcgtccccacgaggcgctgcgggtcagcgcgcgactgcaggtcgaagtgttcgcccatgcgccggcgcaactgaccgcgtcgccggcatgggaaaccgtcgccgccgggctggcattttccgggcgggcgctgtccgccgccgagctggaagcctgccgctatcgcgtcgagtcgccctatgtgcgcatccagcggcgattcgccgagttcgccgccgactgcttcccgcccggacggccgttgctggtggcggcggcggcactgatggagaagatcttccgcgagttcgccttcgatgcgcaggccacccaggtggcgacgccgctggacgaagtgctggagcgccgtcgcggggtctgccaggacttcgcccacctgatgctcgcctgcctgcgcgcgcgcggactggcggcgcgctacgtcagcggctacctgttgacccgcccgccgcccgggcaggcgcgactgatcggcgccgacgcctcgcatgcctgggtctcgctgtattgcccggagaacggctgggtggatttcgacccgaccaacgacctgttgcccgacctggagcacatcaccctggcctgggggcgggatttttcgcgatgtgtcgccgctgcgcggggtgatcctcggcggcggtag

SEQ ID NO: 16565 - DNA, 1224 bp, Pseudomonas aeruginosa
aaaagcccggccgctgccgggctttttcatgggcgcgcgccgggctcagcgcgcgtagcgtgccgccatcgcctcgccggccagttggtgcacgcgccgggtcggatgccactcgtcccagaagtagtactggtccgggttggcgcaggccgggcggacgctgggctgggtcggctggcagggcgcgtccagctccaccaggccatagcgcgccgggttgcgccgcaagtggcggctgaaggtgagatggtcgaaccagctcagctccaggccgcgggtcttgcgcagggcggcgagctggatcggcaggctggcgttgactgcctgcaggtagcgctgcgcccgctcgacccggttaccggcgaccaccgccgggaccacgctcaggtcggtcgaactgaccaccaggaagcgtcgtgcgccggcctctccgagacgctgcaccgcggcgcggatgttcgccacgctgctgccggccagttgttccaggggctgctcgccggcgaaatcctcgtgctcgaagaaatcgttggcggagacgaagatgaagtgcagcgcctggccatcgaccggcttgccgtccagcgtggcgaggtaggcgtcgacctggccggcgaggccggtatggcggtaggcgctcatccagccgtagtagttgtccgctccgctcttggcgccgcccaccgcatggtcggccagttgcgcaccaagctggcgggcgagcacctcgacggcggtcgggccgttgctccagcggccctgccagtagacttcgccgggcaatgcctgggcgccggcgatgcccttggcgagcatctcgcgggtcagtcgctggctttcgccgttgtccgaatagctgtcgccgaaggcgtggaactgccgtaccggcgcgagcagcggggatgtgtgtccgcaggcctggccggccagcaggacaccgaggagcagggcggggagacgggtgcgcatggctggccttcgcagggatacagcttccttctagcgcgccgccgcgcggacttgaagacctggttgcgacaggcacattcccgcccgcgacaaaggcccgtcgacgacgggcctgccgcacggaccgggaggctcagggcgccttcggcagttcgcgcttgtgctgggtcttgtggtaggtgtcgacgatcacccgcgcagcttcctcgcgcagcggctggccgtgcaggaaggcgtcgatctcggcataggtga

SEQ ID NO: 16566 - DNA, 657 bp, Pseudomonas aeruginosa
aataagtcgtcaagcacttgtactacaaaatttccgcagtggaaggtattttctatgcgtgatgaaataagttaccggattcgccgactgcctgccgggatgagcggcggacgcgcccccgacttcgccctcgcggtctacggtggggcgttcgacccgccgcaccccggccatgagtcggtgatccgccgggcgctgctttgcgccgaacgggtcgccctggtgccgagccaccgccacgccttcggcaagcgcatgggcgatttcgagctgcgctgccgctggctggcgcggctggcccggcggatcgatccgcggcgggtgtattgcgaaccgatcgaagcaggattgatgcctgattgtccggcggtctacagcatcgacctgctggaagcgctggccgcgcgtagcggcctggcgtcaccgcggatcgccctgctgatcggcgccgacaacgaggcggagctgccgcgcttcgaacgcgccgccgaattgtgctggcgcttcggccggctggtggcggaggagcggctgccgctgcacagctcgatgatccgccagcgcctgcgtgaagggctggcggtaccggaggcctggtgcctgccggaagtgaaggacgaactgcactgctatggcggcgaacgccaggcgggctga

SEQ ID NO: 16567 - DNA, 666 bp, Pseudomonas aeruginosa
tccgccgcgcccaggcgcctttcgccggccagtgggccttgcccggcgtgctggtcaacggccgcagcgccgaccacagcctctacgacacggcggtgcgcccccctgcgctaccaggcgcgggctggagccggcttacatcgagcaggtgcccacggtcggcaacgcggtacgcgacccgcgcggctggtcgctgagcgtgttctacctggtgctggtcggtccggacacccggatggaggacgacgacctcgacttcgtgccgctgcgcgacgttcgcagcgagcgcttcgccctgccgttcgaccacgcccaactggtacagcaggcctgcgagcgcctggcgagcaagtcggtgtacagcgccctgccgctgttcctgctggcgccgcgcttcaccgtggccgaggcgctgaaggccttcgagtgcgccatcggccaggaagtccagcattccagcctgcgcgggcgcctggagcggatgaaggaggctggctgggtcgaggacaccggcgaacgccagcgtccgcccatggggcgcccgcaacacgtcctgcatttcaccccgaagccgggcggcgccttcgttttcgaccgcagcctgctggcgtcctgacaaacgggtgcggcagggccggtgaggccgctccctgccgcgcttgctag

SEQ ID NO: 16568 - DNA, 1074 bp, Pseudomonas aeruginosa
acggtgaagcgctggatctgctgctccagtccgtttgccagtttcgccagctcgacactggaggtggaggtcttcaccgcgccctcggcgacttcgccgatactggcattgagcgagtcgatgttctggctgacctcgctcgcggtggcggtctgttcttccgtcgccgtggatatctgcgcgttgctctgggcgataccttcgaccgcctgggcgatgagaccgagcgcctttcccgcctcgtgggcgcgctggacgctgacctgggcctgctcgcgtgactgctgcatcacgctgaccgcgctgctggcgcctgcctgcagggcttcgatcatctcgcggatggtttcggtggccttgtgcgtattggtggccaggctgcgcacttcatcggcgaccaccgcgaacccgcgtccggcctcgcccgcccgtgcggcttctatcgcggcattgagggcgagcaggttggtttgctgggcgatgttctggatgacttccagaacggtgctgatttcctcggtcttgttgcgtagcgtgtcgatgacggctcccgcctctccgaccatgaccgacaggccctggatggcgtcgaggttcgcatgcacgagtccggttccggtgtgcgcctcgctgttcgccgattccgcgctggctgcggcggcctgggcgttccgcgccacgtcctggaccgccatgctcatctggtgtaccgccgtggcgaccatgtcggtctggtcgccctgggacgtggcgacatggctgacctggttgctgatggcactcatctcgtccgaggtgatggtgagcttcctggctgtctcggcgagatgccgaagcagcgcctgctggctttccagcatcatattgaaggcgcgcgccgtatcggacacttcgtcgcgcccgcgcgcatcggcgcggagcgtgagattcgaggagtcctgcacgcggcggatcaccccgcgcagatcggaaagcgggcgcatgatcgacaggctgatgaaccaggccgcggcgacgatgaggaccagggctgcggcgccgatgagcaggaaggtggtgcgcatggagtcgtag

SEQ ID NO: 16569 - DNA, 786 bp, Pseudomonas aeruginosa
aatggcgcaccttggggacttccgcggcatgctcgggataggccaggtagtaggcctcctggctgggcagggcgtgcggccaggcgatcgccagcttgccttcggcgagttcctcctcgaccaggaagcgcggtagcagggctaccccgcaaccggcctgggcggcgcggatgcacatgtagaaggtgtcgaagcgtggaccgtggtagcaaccctggcaatttcgctccaggctggcgaaccagtcgtgccaggcctccgcgcggctggcgttctgcagcagcaccagctccgccagttgggtcggttcgtccagtccgccggccggcaacagggatggcgcgcagaccgccaccagttgttcgccgaacaggcggatgcactcggcgcccggcagggtgccggggccgaagaagaacgccaggtcgcaatggccctggcgcaggtcgtccggttccagttcctggcgcaggtcgaggtggatgttcgggtggcggtggcgccagccgttcagttgcgggatcagccagcgcgcgccgaaggtcggcggggtcgccactcgcagcacttcggtctcgccgccgtaggaaagcaggaagcgggtggacagctctacctgttgcaggatgcgtcgtacctcggccaggtacagctcgccggccggggtcagttgcaagcgcttgcgcacccggcggaacagggcgtgctgcagttgctcctcgagttgcgcgacctgcttgctcatggcgctctgggtcaggctcaactcttcggcggcgcgggtga

SEQ ID NO: 16570 - DNA, 420 bp, Pseudomonas aeruginosa
tcggcgtggccggaccgcataccggcgccaacgcctccttcggcgagcaatactggcgcggcgcgtcccaggcggcggaagacatcaacgcggcgggtgggatcaacggcgagaagatcaagctggtcaaggccgacgacgcctgcgaaccgaagcaggccgtggccgtggccaaccgcctggtggaccaggacaaggccatcgccgtggtcggccatttctgctcttcttcgaccatccccgcatccgaggtctacgacgaggccgggatcatcgccatcacccccggttccaccaacccgcaggtcaccgagcgcggactctccgggatgttccgcatgtgcggccgcgacgaccagcagggcgtggtcgccggcgactatatcgtcaacgtgctcaaggccaagaaggtcgcggtga

SEQ ID NO: 16571 - DNA, 1338 bp, Pseudomonas aeruginosa
tcttccgtccccagggcctgctcggccgcccgcagatcgccaaggtgtaaggggacgacgatgagcaacgagacttccatcgatctcaagcagtgcgtcctcgatgccgtgctctccgggttgatcgccctggtggtgttcggccccatcgtcggcgtggtcctcgacggctacggcttcaacctgcattacgagcgggtcggctggatcatcgcgatcgtgatggccgggcgcttcctgctcatcctctacctgcagacccgcggcgggcgcgccgtgctggagcgcttcgagggggctggcagcggcgtccacgtcctgccgccgggctacaagacccgcttgcgctggatcgtgccgctgatcctggtggccgcggtgatcttcccgttcttcgccagcaagtacctgctggcggtggtcatcctcggcctgatctacgtgctgctgggcctgggcctgaacatcgtggtcggcctcgccgggctgctcgacctcggctacgtggccttctacgccattggcgcctatggcctggcgctgggctaccagtacctcggcctgggcttctggaccgtcctgccgctggccgcgctgaccgccgcggtggccggggcgatcctcggcttcccggtgttgcgcatgcatggcgactacctggcgatcgtcaccctgggcttcggcgagatcatccgcctggtactgaacaactggctgtccttcaccggcgggccgaacggcatgccggcgccggcgccgaccttcctcggcctggagttcggccgccgggccaaggatggcggggtgccgatccacgagttcctcggcatcgcctacaaccccaacatgaagttcctgttcatctacgtggtgctgttcctggtcgtgctgctggtgctctacatcaagcaccggctgacccggatgccggtcgggcgcgcctgggaggcgctgcgcgaggacgagatcgcctgtcgcgcgatgggcctcaaccatgtgctggtgaaactctcggcgttcatgctcggcgcctccaccgcgggactggccggggtgttcttcgccagctaccagggcttcgtcaacccgtcctcgttcaacttcttcgagtcggcgctgatcctcgccatcgtcgtgctcggcggcatgggctctacggtcggggtggtgaacgccgccttcgtcctcaccgtggcgccggagctgctgcgcagcttcgccgacatccgcgtgctgctgctcgggatactcatggtggtgatgatgatctggcgggcgcgcgggctgatccgcatcagccgggtgggcttcgccccgcgcaagggggtggcgccatga

SEQ ID NO: 16572 - protein, 79 aa, Pseudomonas aeruginosa
  UNSURE (1),(2),(16),(20),(21),(28),(29),(33),(74): Identity of amino acid at the above locations are unknown.
XXLSTCSMNMPSPFLXGPQXXLNSSGKXXLVPXSFFKIKRCNLLVQAHWAKSIKQLAYHGLHVFSGGFTGGKAXMNMCD

SEQ ID NO: 16573 - protein, 110 aa, Pseudomonas aeruginosa
PARPGSCSRSDLYHEQRILKAGVIPAEQVLANDQYQLAMQGLDLPGNVYAHIAGVDLVRDGSGNYYVLEDNLRTPSGVSYMLDNRKMMMRLFPELFVRQRVAPIDHYPDL

SEQ ID NO: 16574 - protein, 82 aa, Pseudomonas aeruginosa
  UNSURE (71): Identity of amino acid at the above locations are unknown.
GCAVRGRDRIESMSLDVQVKLLRLLQERVVERLGSNQLIPLDIRIIAATKEDLRQAADQGRFRADLYYRLXVARLASAREGS

SEQ ID NO: 16575 - protein, 67 aa, Pseudomonas aeruginosa
  UNSURE (52),(57),(59): Identity of amino acid at the above locations are unknown.
RSDANARKGSRIWENGRITGDSGAEICYRVRRRGLCRQSVDRDTMVIVGWAXLISPXDXYYESPVVG

SEQ ID NO: 16576 - protein, 144 aa, Pseudomonas aeruginosa
MRLISLRWWFAACFGAGCASALVSWGPFCVLSLPFCLSWACSWFASGLPVPCCSRSASSRGCWPGSCFSCCWLPCARFSPWACACLCSSACCSGLSCFSPLISRGAAAWRASCCCGLCVSPLRFSSIRPVCGSSRPSGLCLSGC

SEQ ID NO: 16577 - protein, 170 aa, Pseudomonas aeruginosa
  UNSURE (160),(162),(164),(165),(166): Identity of amino acid at the above locations are unknown.
PQPERQSPEGRDEPQTGRIDEKRSGETQSPQQQDARQAAAPREINGEKHDKPEQQAEEQRQAQAQGEKRAQGSQQQEKHEPGQQPREEADREQHGTGKPEANQEQAQDRQKGRDRTQNGPQETRAEAQPAPKQAANHQRSEIKRIYRERPPLPGSTAALXQXQXXXTATS

SEQ ID NO: 16578 - protein, 159 aa, Pseudomonas aeruginosa
  UNSURE (159): Identity of amino acid at the above locations are unknown.
RSQKGRARKGATNRRRDESTKSAAARRRARSNRTHARRPRRERSTARSTTNPNNKPRNRGRRRPRAKNGRRAASSRKSTNPASNHGRKRTANNTGPASRRRTRSRPRTGRKEGTGRRTDPRRPGRKRNPRRSRRRTTSGARSSASTGSDPRFRARLPLX

SEQ ID NO: 16579 - protein, 169 aa, Pseudomonas aeruginosa
  UNSURE (159),(161),(164),(165): Identity of amino acid at the above locations are unknown.
AARKAEPGRARRTADGTNRRKAQRRDAEPAATGRTPGGRAARDQRREARQTRTTSRGTEAGAGPGRKTGAGQPAAGKARTRPATTGGSGPRTTRDRQAGGEPGAGPGQAERKGQDAERTPGDQGGSATRAEAGGEPPAERDQAHLQGATPASGLDCRFXPXAVXXDSDV

SEQ ID NO: 16580 - protein, 157 aa, Pseudomonas aeruginosa
PATRERVGTQVGKYENTQQIRQQDRQSKSGAKARKTGVSGKSAGPRQARRPHKGQEHGEQPEKRAGRAAKRSTRRGEKPNRGTATGKNRKRNPAASEPASARPDKRERQAAQTKKEQKESKEEEQRKARRQRGNPTTAENKATETQDAPDERTLNVP

SEQ ID NO: 16581 - protein, 153 aa, Pseudomonas aeruginosa
QPLASESEPKSANTKIRSRYASRIDKARAEPRRERQESAAKAQDQGRRDAPTRGKSTGSSQKNGQAAPRRGARGAGRNRIAERPQAKTESETQQPANQRALDQINEKGKPLKQKKSRKRAKKKSSEKPGGKGGIPPQPKIKQRKLKMHPTNEP

SEQ ID NO: 16582 - protein, 77 aa, Pseudomonas aeruginosa
  UNSURE (34): Identity of amino acid at the above locations are unknown.
STTRFPSPISQSGRPACSRSTNSNSMGWGATADXDVRISETIGEDVGAEMLRRIVPEKVEEGWVEEFHGCSEVDFQE

SEQ ID NO: 16583 - protein, 138 aa, Pseudomonas aeruginosa
RRSGRWPPPSASPSALRPSSSCSPAVRSPPPAPTRLAMPTRTRIRRSPPTSPCASTTACTRAALGCTTAASPSTSACSPAVAFASRMAKWSPPAMTRRCRNTSSAAFARTSTASMRRIASSCWIARSGSFDLVSLRGY

SEQ ID NO: 16584 - protein, 78 aa, Pseudomonas aeruginosa
DGRIEARLRPLGPLIGVVGALFAFCRFSALGEDAFVPLSVSDCAALFALEDWLLCDRLDLCFGARLELSRVDPDALGF

SEQ ID NO: 16585 - protein, 66 aa, Pseudomonas aeruginosa
RFAEIDGSLSFSSGCLSSGAVFLLTPIWSLAASLCFSERAPTFFELFACGPLAASGSYEVGDADAD

SEQ ID NO: 16586 - protein, 246 aa, Pseudomonas aeruginosa
IPPERYQVERAGTGYPAGGSDPAHRRRRSPRERRRRGIPAAPSHRRRRPLRHPRSEGDRRRAGRSRRRSGSSTPQRCPCARRSRSAGRGRRRPPNPSPRRHRQPRRSRRRRADRRRTARRRSERARRSRGRRPATRSASARTPRRRTGSRRRSSENRRSRRSARSPRRRGPRGRAPGGRRSRGRGGRRATNPPGRTARRSRKPRAARRHPRRGRRSGRRRTARRPPRSAGRAGGGGPRCGRPSLRS

SEQ ID NO: 16587 - protein, 254 aa, Pseudomonas aeruginosa
YPRRDTRSKEPERAIQQEEAILRIDAVEVRANAAEEVFRQRLVIAGGDHFAILEAKATAGEQAEVEGEAAVVHPNAALVHAVVEAQGEVGGDRLILVRVGIANLVGAGGGERTAGEQLEEGRSALGEAEGGGQRPDRRQQEHRAGGQAAGGEAQRTVDLGEALEAQGVGVHAGELQAGAEAEVEAVAEQPILQGEQRGAVGNRERHEGILAEGGEAAEGEQRADHPDQRAERAEAGLDAAVLAFVLESGDTRDI

SEQ ID NO: 16588 - protein, 134 aa, Pseudomonas aeruginosa
  UNSURE (10),(11): Identity of amino acid at the above locations are unknown.
RLAERAGHAXXGPRHDHRRLPDPRIRPRRHLQRAQAQRMGRQCLQLAVRQLLRRVPGPAQEAHAPPRRPRPANHGQLVRASLGQARALGEVEAECDGRILLWQFIPDSAEARVLARCRDATASLRGERAAARAC

SEQ ID NO: 16589 - protein, 160 aa, Pseudomonas aeruginosa
  UNSURE (35),(36): Identity of amino acid at the above locations are unknown.
LPNTLAILYTALAYGGGLALLFAGNGWLNALGTLXXAHGMIIAAYLIHEFAHGAIFSVPKHNEWAGNVCSWLCGSCYAEFQDLRKKHMRHHVDRARPTMGNWCAPAWGRRGPSARWRRSATDASCSGSSFPTAPRPGCWRAAATPPPACAASARRRGPAD

SEQ ID NO: 16590 - protein, 211 aa, Pseudomonas aeruginosa
FFPSPCSALPADVPLRPVSTFAPAALSRRFSVAPLMVWSVRLCRFFLRLLSRLSLLFSEMVSSGALLLGDRLRFLRFDDCELPLALLLGGCVPADLAACARMADDAGFDEVFLFVGCPCVRVLLFLIGACLLGLPALVADCLLAMLDAVDIAVTVYSPLRFLRARLLSRSLLFRPPGSPMPAAGSSSCFPGSPSSLGSPPWISPRFPRCPS

SEQ ID NO: 16591 - protein, 209 aa, Pseudomonas aeruginosa
QRSGKQSRPKKPKGRIHRHRNIHRIQHRQQAVSHQRRKPQQAGADQEEQDPYAGAADEEEDLIEAGIIRHPRAGRQIRRHTAAQKQRQRELAIVEAEEAQAIAEQQRAGGDHLGEEQGETGQQAQEEAAEANGPDHQRRNGEAAREGGGGEGRYRAQRDIGRESGAGRGKKSGKEEEEGREERAREKASKSRGRREAEKIISQPSIRHL

SEQ ID NO: 16592 - protein, 240 aa, Pseudomonas aeruginosa
EGQRGNLGDIQGGEPKEEGDPGKHEEDPAAGIGEPGGRNSRDRESSRARRNRRGEYTVTAISTASSIANRQSATSAGSPNKQAPIKKSRTRTQGQPTKRKTSSKPASSAIRAQAARSAGTQPPRSSARGSSQSSKRRKRRRSPSSNAPEETISEKSKERRDNRRRKKRQRRTDQTIKGATEKRRERAAGAKVDTGRNGTSAGRAEQGEGKNQERRRRRGGKSELERKRARAGAGGKPRRL

SEQ ID NO: 16593 - protein, 191 aa, Pseudomonas aeruginosa
GNQADEIAEIGKAVAPEETEGENTPSPQYPPHPASPTGSQPPAPEAPTSRRRSRRAGPVRRGSRRRGRPHRSRHHPPSARRPPDPPAHSRPEAAPEGARNRRSGGSAGDRRAATRRRRPSRRRARRDGTTGAGRSGRGERTRPSKAQRRSGERGRRGRRSIQGATGHRQGERSRAREKIRKGGGGGAGRAS

SEQ ID NO: 16594 - protein, 239 aa, Pseudomonas aeruginosa
SFPADRRTWRRLHRPGSLHADPAAGPVPQVRPPGDQHPPQLPADPPLVGTGEGVRLVAEYLAVEQVLRQAAAVQRDEGMLVAPAIVVEATRHQLLARAGLAEDQHVGRGVADVGDQLAQRLDRRRAADDPLRQVLAAGQLATQRADLAGQPALLHGAAGELDQACRREGLLHEVVGAGVHRLYRHGDVPVTGDQHHRHARGQRPLKRPSQVRASMPGDAGCRRPTKPGEIPGSNRWQAP

SEQ ID NO: 16595 - protein, 112 aa, Pseudomonas aeruginosa
ILYPWRVTCIPYLHGPVDPQDKQPAFDEVSRLIDEHGADCIVLARYMQILPPDLCRKYAHQVINIHHSFLPIRRLLAPVKACASWPNISLSNRFSGRPPQFSATKACWWRRL

SEQ ID NO: 16596 - protein, 126 aa, Pseudomonas aeruginosa
PGWGVSRAFDPEHAGGADHRSRGHLHGGTGDARRRLRLHGEALLSGTPGRVRPPRHGAARAGPRGQRAASPVGRPPGPGATDHRPLAGDPGVARADRQRRRHLGQRADPRRDRHGQGAGGALPPRL

SEQ ID NO: 16597 - protein, 221 aa, Pseudomonas aeruginosa
GRLPTVGPGNFAGLRWSATSRIPGHRCPDLAGAFQGPLTPSMPVVLITGHGDISMAVQAMHAGAYDFMEKPFSPARLVEFARRAMEQRGLAREVSALRRQLAGRQDLAQRIIGRSPAIQALRELIANVGDTSANVLILGETGTGKELVARCLHDYSRRHQHAFVALNCGGLPENLFDSEIFGHEAHAFTGANKRRIGRKLWWMLITWWAYLRHRSGGRICM

SEQ ID NO: 16598 - protein, 246 aa, Pseudomonas aeruginosa
  UNSURE (3),(4),(5),(8): Identity of amino acid at the above locations are unknown.
GRXXXLSXPFGEDPFAEGNTEQAFGVGRDVGEAVLLEAHFPGDGIQAFHQSPVVLFAVAQFALQLPPATHLFRIELGEVEARLMDLEGIREAAALALDGQLVAYLVAEGGEDETRQPALRERIRTALRASLPDYMVPSHLLFLERMPLSPNGKLDRRALPKPDAGLMQHDHMAPASALEKDVAAIWGELLGVERVGLTDNFFELGGHSLLATRLVSRIRQDLGIEVSLKSLFEQPVLQGFVKSLGR

SEQ ID NO: 16599 - protein, 111 aa, Pseudomonas aeruginosa
RAFSSSRSCRDSSKAWADKPANVPPIMPVTRKQPLPLFYCPERQWVPLAIGTGKAGLIKFPPPGLGPGGPMFPAYKAFSKAPQKVPNFWGSPFPQKRARFPSRCGITQRRF

SEQ ID NO: 16600 - protein, 126 aa, Pseudomonas aeruginosa
  UNSURE (119),(122),(123),(124): Identity of amino acid at the above locations are unknown.
RCADTLAQSRLASLVLAPLSHQVGHQLTVQRKSRRFAYSLQVHEAGFDLPQLDAEEVSRRRQLERELRDSEQHYRGLVESLNAIAWEMRLEENRFTYVSPHAERLLGIPLGEWVFTKGXGKXXXPP

SEQ ID NO: 16601 - protein, 98 aa, Pseudomonas aeruginosa
  UNSURE (3): Identity of amino acid at the above locations are unknown.
SPXTVDGPYGRTCRGAEKPARGRRKFLLDLLTNRVPPGVDEAAYVKAGFLAAISKGEAKSPLLTPEKAIELLGTMQGGYNIHPLIDALDDAKLAPIAA

SEQ ID NO: 16602 - protein, 160 aa, Pseudomonas aeruginosa
ALSHTLLMFDNFYDVEEKAKAGNEYAKQVMQSWADAEWFLNRPALAEKLTVTVFKVTGETNTDDLSPAPDAWSRPDIPLHALAMLKNAREGIEPDQPGVVGPIKQIEALQQKGFPLAYVGDVVGTGSSRKSATNSVLWFMGDDMPHVRKQTRRGVWCLGG

SEQ ID NO: 16603 - protein, 172 aa, Pseudomonas aeruginosa
ETSTFDCPVHPRLPIVLKEDWCQFYPPRHHTPRRVCFRTCGISSPINHRTELVADLREEPVPTTSPTYASGKPFCCRASICLIGPTTPGWSGSIPSRAFFSIASACSGISGRDHASGAGERSSVLVSPVTLKTVTVSFSASAGRFRNHSASAQDCITCFAYSLPAFAFSSTS

SEQ ID NO: 16604 - protein, 122 aa, Pseudomonas aeruginosa
VQSRGPKFQLRDVDFRLPSAPASSHRVKGRLVPILPPEAPYPPPRLFPHMWHIIPHKPQNGVSGGFTRRTRTHNVTDVRQRETFLLQSFDLLDRTNNTRLVWLNTFTGVFQHRQRVQWDIRA

SEQ ID NO: 16605 - protein, 140 aa, Pseudomonas aeruginosa
PRIRCRRKVIGVSFASDFEDSNGQFFSQRRAIQEPFGIRPGLHNLLRIFVACFRFLFYVIEVIEHQQRVRKCLGSNRCQFGIIQRVDQRMNVVTTLHGAQQFDGFFRSQQRGFGFAFRDSSQEACFDIGGFIDAWGNTVG

SEQ ID NO: 16606 - protein, 71 aa, Pseudomonas aeruginosa
RDTVEASLYLIRSAWRVGASYEGLLPGLGQDLAVRVGQAADDDLGLLRRPVRRCLGWPRIPLPTWYPRMLV

SEQ ID NO: 16607 - protein, 138 aa, Pseudomonas aeruginosa
MSLTRVSVTAVRNLHPVTLSPSPRINILYGDNGSGKTSVLEAIHLLGLARSFRSARLQPVIQYEEAACTVFGQVMLANGIASNLGISLKAQGNSTIRIDGQNARSAAQLAETLPLQLINPDSFRLLEGNAEKSPTVSR

SEQ ID NO: 16608 - protein, 131 aa, Pseudomonas aeruginosa
  UNSURE (129),(130): Identity of amino acid at the above locations are unknown.
PKRGSGTFRLADEHRFFSLRGETLERRFTRKGDDSTAYDLQAWYGTTYNKAVVKAEGDIAKGKLEESRTELLWGHAVAPYWDTQLGVRVDNGEGPSRQWLAFGIQGLAPYWFELEATGYVSSPRVRAKXXP

SEQ ID NO: 16609 - protein, 110 aa, Pseudomonas aeruginosa
  UNSURE (1),(2),(3),(4),(5),(6),(7),(8),(9),(10),(11),(12),(13),(14),(15),(16),(17),(18),(19),(20),(21),(22),(23),(24),(25),(26),(27),(28),(29),(30),(31),(32),(33),(34),(35),(36),(37),(38),(39),(40),(41),(42),(43),(44),(45),(46),(47),(48): Identity of amino acid at the above locations are unknown.
XXXXXXXXXXXXXXXXXXXXXXXXXXXXXXXXXXXXXXXXXXXXXXXXISSTAMGLIVRLSLIPEGRLDDMSVRLECVLSEYDPRARDLAVDLHVFNPRAEAIELGRQLE

SEQ ID NO: 16610 - protein, 83 aa, Pseudomonas aeruginosa
RLSEGREFITIDGQNRHVLSYLGDFLFSPQRARTPVKALSGGERARLLLAKLFTGGRRRRHGRCGTRRHRRRTSRMPGRRPAR

SEQ ID NO: 16611 - protein, 115 aa, Pseudomonas aeruginosa
RRCPAASARACCWPSCSLADGGEGTVDAVLAATAGERRECRVEGPLGEPTLAHWGWLDDATAVIEMASASGLHLVPRDRRDATRSSSRGTGELIRAALDAGARKIILGLGGSATN

SEQ ID NO: 16612 - protein, 158 aa, Pseudomonas aeruginosa
LVALPPRPRIIFRAPASSAARISSPVPRLLLRVASRRSRGTRCKPLAEAISITAVASSSQPQCARVGSPSGPSTRHSRRSPAVAASTASTVPSPPSASEQLGQQQARALAAGQRLHRGAGALRTEQEVAEIAEHMPVLAVDGDELAAFGESSPRRRRV

SEQ ID NO: 16613 - protein, 96 aa, Pseudomonas aeruginosa
RPGNGYAQATQALPSDWLTALRALEGSAWAREALGEDFLKIYLAIKQAEYRAFMGEVGEQDWRWYMFGALWLLPALARFLINPAKLQARKASLFAH

SEQ ID NO: 16614 - protein, 60 aa, Pseudomonas aeruginosa
PTLTFLGAGSAVWGVVEQMLAGKQLEGVKEARARRRIHLLHGRVMVAAHMSNGIDLRHGE

SEQ ID NO: 16615 - protein, 164 aa, Pseudomonas aeruginosa
VAAQPMCVNTAGSLSYQDKHSFMDHYERKTSVYYGILEFDLNPDTMLTVGADYQDNDPKGSGWSGSFPLFGSWQLRYDFDLRSVGVPGLSFMTRYVNGDHIRLANGDEGNEWERDIELKYVVQSGRFKDLSLRLRNATYRTDFERSARDVDEVRLIASYNLSLF

SEQ ID NO: 16616 - protein, 74 aa, Pseudomonas aeruginosa
IARPSAGRAPAGPNTFPVSQKGVPKQCGYRGWGSSGLFLLSGAPLDGPSQLDLTLCLALPGALTAELRRIFPEV

SEQ ID NO: 16617 - protein, 171 aa, Pseudomonas aeruginosa
IPRRPVLEELWRTAPPALLGRGQGKTADEPYPRGLAERFPDFEMWRVLPLAYTARSLALTAYRLRCAAWLLATGIFLLLAGCSEAKAPTALERVQKEGVLRVITRNSPATYFQDRNGETGFEYELAKRFAERLGVELKIETADNPLSAQAEYLARKLKADDNAYKDIKAKG

SEQ ID NO: 16618 - protein, 74 aa, Pseudomonas aeruginosa
GWGGGIWPRAWTLPDERRDAERRPMEYAPAGMCASLYIHPQVDRSIGIIAAYDSFPAQVSFLREDQTREQGWGI

SEQ ID NO: 16619 - protein, 96 aa, Pseudomonas aeruginosa
PITGPFRKEIPKLDEEIINSPLSRFDMNVKDLADLDSVKAEVDGELILIFKQVVVQNTLVTHDNQLEHGEDNVVVYHTEFAQRYIDPVYTRVKQKI

SEQ ID NO: 16620 - protein, 249 aa, Pseudomonas aeruginosa
PSRGGPPASGGNGRAGFGQDALEQGLLAWHQQRTLAAVLFGIGHRGLLLRLVRRRLSQRRWIGSARRVARAQQPPGAAADRQEHGGRGGGDQRRAAAAGTRLRRWQRRRRGRWRFRRLRWRRRGRRGAAGAGRDRRQLDRYRLHAAEVGGRHGRGFGRRRVARSRRALRRRQRTDLGGFQGARRQAVEGGDQRAGGWETLGRVLGQQLAQDVLVTTLFRSALPGNGSVEVGHRLGINESFALFKGTLPG

SEQ ID NO: 16621 - protein, 213 aa, Pseudomonas aeruginosa
QAGAGRQPRAEMAAPGLVRTRWNRVFLPGISSGRSPPSCSASATGVCCCGLSAGVCPSGAGSAALGASPEPSSHQAPPPIARSTAAAAAAISGVRLPPARGFAGGSGGGGGDGGFAACDGGGGGGVAPPALGVTGGNWIDTGCMPPRSAGGMGAGSAGGGLLARGEPCGVASGRIWVASRALGAKRSKAAISAPAVGKRSAGSLGNNWPKMSW

SEQ ID NO: 16622 - protein, 319 aa, Pseudomonas aeruginosa
  UNSURE (34): Identity of amino acid at the above locations are unknown.
SFSGPKGTGVFWNFGLPQFDGGPNPVYPSSGFPXAPPKKLTPGPAPRARNRKPGPNLITRWGVVVLEISLTRQGALKKGKGFVYPQAMAHLNRAVAGKCRSKQGGYQDILGQLLPKDPAERFPTAGALIAAFDRLAPSALEATQIRPLATPQGSPRASNPPPAEPAPMPPADLGGMQPVSIQLPPVTPSAGGATPPPPPPSQAAKPPSPPPPPLPPAKPRAGGSRTPLIAAAAAAVLLAIGGGAWWLLGSGDAPSAADPAPLGQTPADKPQQQTPVADAEQDGGERPLLMPGKKTLFQRVLTKPGAAISARGWRPAPAW

SEQ ID NO: 16623 - protein, 242 aa, Pseudomonas aeruginosa
KGQRIRLSPGDGPPQQSRCREVPIETGWLPGHLGPVVAQGPGRAFPNRRRADRRLRPLGAERPGSHPDPSAGDAAGLAASEQPAAGRTRAHAARRPRRHATGIDPVAAGHAQRRRRHAAPASAIASGETAIAPAASAATGEAACRRQPHAADRRRRGRRAPGDRRRRLVAAGLGRRAERCRSSAAGTDAGGQAAAADPGGRCRTGRRRASAADARQEDPVPARPDQTRRGHFRPRLAARPGL

SEQ ID NO: 16624 - protein, 86 aa, Pseudomonas aeruginosa
  UNSURE (69): Identity of amino acid at the above locations are unknown.
DLVHGASYGYRPVGCRATRRWPRPQPCLVGNNVPQNRRALLYNLHKHRSSHLWDLGQTLYKPDRDISCXSRLCTEMRGHPHGLHRR

SEQ ID NO: 16625 - protein, 264 aa, Pseudomonas aeruginosa
IFLPAKRAVSTSMSAASRTTSAAAMSAGSSGLRAPTEPWVSTCNAKPSCPAASCNASAAMKVCATPVGQAVTATIRGAAPASGATRAGLVPGDLHARQGGGPAWKKAPRIGQRPPGETAPIHRVGQENARRPGFQPQPTGTLRVPGNFLGPHSPPGAPNRVFPQTGVSHPQALRGPPPMGAGEKPRGNVPPRGRGEKRVFFPRGPPPMGGGKKTPSSYAKGGGCSLNRTPIGGPPPCGKRGVAQNTPLPGGPRVEGFIICGARG

SEQ ID NO: 16626 - protein, 170 aa, Pseudomonas aeruginosa
KCAPRRSDRRSPRQSAVPLRPPAQPGPGSSPATSTLARAGGPLGRKRPGLANGPRGKPRRYTGLAKKTPAAQGSNPNLREPFGFREIFWGPILPPGPQTGFSPKPGSPTHRPSGGPPPWGPGKNPGGTFPPGGGGKKGFFFPGGPHQWGVAKKPLLLMPRGGGVLSTAPP

SEQ ID NO: 16627 - protein, 382 aa, Pseudomonas aeruginosa
NLGENWVGDGIGDVTGEHRHHQDESRVADRPQHRRQAARLLVGIDAEGQRQGDQQAARDHHRQHERHPGQQVLVHPALLVPGDHRAGCARALDLPFRQRPLERRAGLLEGHAGAATVDLLAGETGRVHVDVGGQQDHVGGGDVRRVERVARADRALGLDLQREAQLPRRELQRLGGHESVRHAGRTGGHRDNPRCRSGLRRNQGRARPRRPPRSPGRGARLEESAPDWPTAPGGNRADTPGWPRKRPPPRVPTPTYGNPSGSGKFFGAPFSPRGPKPGFPPNRGLPPTGPQGAPPHGGRGKTPGERSPQGAGGKKGFFSPGAPTNGGWQKNPFFLCQGGGVFSQPHPHRGSPPMWKKGGGTKHPPPGRPPCGRVYYMRREGV

SEQ ID NO: 16628 - protein, 367 aa, Pseudomonas aeruginosa
PPRAAYNKPFHTGAAREGGVLCHPPFSTWGGTPYGGAVERTPPPLGIRRRGFFATPHWWGPPGKKNPFFPPPPGGNVPPGFFPGPHGGGPPEGLWVGDPGLGENPVWGPGGRMGPQKISRNPKGSRRLGLEPWAAGVFLANPVYRRGFPRGPLANPGRFLPSGPPALASVEVAGDEPGPGCAGGRSGTADCRGDRLSDRRGAHFHGRRGVAARGGATGLRVAGRDPGLGRRAQPARPGGHRRRRRGPAGRRHRRGHGPFRRQEDLPLRHRRGPQAGPRDARAGAGGRAGRERGRSQRGGRQGREARGVQAPADRGVVHVADGGRGRPADRPVAGLRHRCLQAAGQPGGGAEDGRRHGFRPDGADARR

SEQ ID NO: 16629 - protein, 334 aa, Pseudomonas aeruginosa
EEGVFLPPPIGGGPRGKKTLFSPRPLGGTFPRGFSPAPMGGGPLRACGWETPVWGKTRFGAPGGEWGPKKFPGTRRVPVGWGWNPGRRAFSWPTRCIGAVSPGGRWPIRGAFFQAGPPPWRAWRSPGTSPALVAPEAGAAPRIVAVTACPTGVAHTFMAAEALQLAAGQLGFALQVETQGSVGARNPLDPADIAAADVVLLAADIDVDTARFAGKKIYRCGTGVALKQARATLERALAEGQVESAGAASAVVARDEKRGVYKHLLTGVSFMLPMVVAGGLLIALSLAFGIDAYKQPGSLAAVLRTVGDTAFVLMVPMLAGNIAYSIADPVFTKV

SEQ ID NO: 16630 - protein, 77 aa, Pseudomonas aeruginosa
IFPVPWADIYGRTSSRLVDFAYTTPDLSLFTVGQISLAIVGHVNNPVDASIQGNYRPTMYYENHVQASMLGVLVSAP

SEQ ID NO: 16631 - protein, 95 aa, Pseudomonas aeruginosa
WRRIHSGSFPAHPEPVHVSWVIQPSWSFPATCRPRARSPKAGFPPCRPMSQGEHQYRRRTVPQGRVRAQHHAVGANDRIPRMQAEVPHLSDEQGD

SEQ ID NO: 16632 - protein, 68 aa, Pseudomonas aeruginosa
GLSRASLFVDDKTRDRPHPCERMVHTQAGSPGWNQNIWAFTYSHHSSPLILNQARDIHHRSVVGHGLT

SEQ ID NO: 16633 - protein, 83 aa, Pseudomonas aeruginosa
RRRELVHRAETHEGVAGLWFPRPDVWGRGLAAGYSPCGGVSPPYLYRSRRFLPICPRVEGGIATDPGFRRVGESCAVGDLPLL

SEQ ID NO: 16634 - protein, 502 aa, Pseudomonas aeruginosa
LPYPRRGHHVHLADQAHRYRLQVAIKDVAGQVGDRPADRHRVLALLHAGPVGDVNGRLGRAIKVIEAGLRQLGEHLLLGVRRQRLAAANDAFQAGAGGDVFVLQERLQHRRHEVQRVDPFAIDQLHQLRRIAMVARRGHHQTCPAHQRPEELPDRHVEAERGLLQHRVTDAQAIGLLHPAQAVAQRRMAVAGALGLAGGTGGVDDIGEVLAIEMNIRVRLTVILEPGRTAIQVDPLHTLRQRQLQVRLAEQQLHTAVLQHVGLALLGILRVHRHVGAAGLEDRHQGHDHLDGALHGHAHQAVRTDPALDQGMRQAVGPAVQLGVVQALLAEGQRRRRRRALDLLLEQPVHAALQRVLGSSGVPAFQQLATLLGIEHRQRVDAGLRVLQHAAQQVLPMPRHALDGPRLEQVGRVGQRRPKAVRGFPGIEGKVELCGSTVPGKTLDVQTIDLGILPLAALVVIHHLEQRAVAEIAFGLQGIDQLLERQILVRLRAQRRLAHAAQ

SEQ ID NO: 16635 - protein, 455 aa, Pseudomonas aeruginosa
WHRQRHVQTLPASAGLGRAHPVGGQFQDRLLGAQALTPVIQLPRALAAVQPGAMPGSIVGVLQRQWRQRRLFAAPRRGIGLEQFVDHHLHRPTVGHDMVLGDDQHMLLPSQRQQTHAQQRPTSQVEWLADFLGHPLAQRCFARPGAILQDNAQRHVRQDRLARLTVDLLEAGAQGLVAQHQPIEGLLQRRLVQDATHVQYAGEMIGRAFRLQFPEEPHALLSMRQRQLGDSRQYLQHRGNARRLGLQGSGEVCQDRPLEQDAQGYVQLQILAQARDHPGGAEGVTAEFEEVLVAGDALDTEQRLPDRCDRTFEPLPRRLSGLVAGSRVHLRQRLAIQLAVGVQRQAGQHLPSRRLHVRRQASGQPGAQLRQKVLTPHSVTPHQVGRQQRTTDAILRHDRCFRHIRVCKQLALDFADLDAETTDLDLLIGPAEIFDLTVDAITRQVPGAIQALART

SEQ ID NO: 16636 - protein, 1227 aa, Pseudomonas aeruginosa
IEDSHRVPLHLIRQMLRAPLSGVAEQDPGSCQQGYEELFGSGIETDRGELQLAVPRADAVGACCRLAVRDERRLADRHSFWLAGRAGRIDHVGQRLASYLRQRPRICTRRPGGGFQRQPLDLCRAGQPLRQGFLADQPARAAVAQHVRQALRGVVRIQRQVAGTDLEDAQQADDQVEGALGSDRHQRFRGHAARPQATRQTLGAHIQFGIAEILVAAYQRDRLRRRRCLMREGRRDAAPRQRLERCLPIPQRLLAFPGVEQGQLAQRCLGGLGHPLQQMQQMTVQFGDVRCVEIAPRIDVLQAQALTQGDTQRQGVVGLLVVAWRGELQIGGSLAQSLGHGEVLEHQDAIEQSLAAMPGPALDVVQRRMLVFAQRQVERLHPLQVFRDALLWLRRGDHRQGIDKQTDLRLDAWQFRRPSGHGGAEGYRLLPAVPLQEQRPGRLHQGVERDLLTLGEGRQLAGRLRIQFAQMLTLARLLRPRLARQACRHLQGGQPIAPEELGCHRIAALQPTDVVAVTPNGSGYLLPRIALQYLGEQLGVAPAIHQDVVIGIDEVHPPIRQRHQHQALQRRPGRVETGFALSLCLPLRITAWRGQPQLQRRLLEYHLQRLRPAVLPEESAAQDLMGIEGGLPGCAEAIRVQSADIHAQLVDIVAFRSMKTVKQHALLHRRQRIDVPHRIRIQGQFIELRLGKPGQREVRRRHTPMPRVETMLDQRVQLPRVVIDQALDGRLGEHFPAEAPVQAQLAAVDLAFDAQPVGQRGARILGGAGAFRGRYQQRRSIELTVEPAQVIEGDPRLRQCGQAGRSLLSSQVAQQAVADTLVRHAAQLLLDRLQRLAEVRGRGQAQREQAGEPAHRAAQVDGLAEVLAAVPFELHQHAGVAAPAAGRAGQGGQQQVVDLSPVGRRGFLQQLPGTLGVQGQDELALMAVFQGALRVFAWQRMRSVVQLRLPVVEFVQARAGLFVQVPAPGLVGTATRPEIGVEVGIKTLQVFQQDTPGHPVHRQVVDDQQQALAAVGHVHQQRTQQRPLFEVKAALGFFAKRQQRLLGPRLPAPQRLAGLLGVGLVPGAALFAETQAQGIVLRLQAFQGTPQPVAVERLARLQQERLVPVLAVGNRPLEEPALYRRQRHLAACRPLFRRSRTRLGRQGQAADVLVLEQVARAQLQSGLARTADYLDRDDRVAAEAEEVVVQADPLNAQQVLPDFRQGSLHCVARCAVACLRHAYFRRR

SEQ ID NO: 16637 - protein, 99 aa, Pseudomonas aeruginosa
PLRRHHVFRQACRQVRGQRFAPVAALALQHHVADQLPAVHRQHRRLAHPRMLQQARLDLAQLDAQAAQLHLVVDPPGVLDHPVGAVARQVAGAVHPLPS

SEQ ID NO: 16638 - protein, 189 aa, Pseudomonas aeruginosa
GSPSGPRPSRWSAPWPRPPGGPHRPRARSGHAPGGWPGGSARRSPGAPRRRPAPAPSACARPAPRTTGARRVAAGTRQQWRSSLPATGHAPRHRASAASRRWPAGSPACRAAGSANAAPCARRSAPRTGRSRRSAPPQGRPGFPRYRGQGRTVRQHRPRQNSRCANHRLGHPAARRSGGYTSPGTTGCG

SEQ ID NO: 16639 - protein, 178 aa, Pseudomonas aeruginosa
PTHAPAQPAPADARAAAAHEPGRMAGGFPRPPAGATLLRSPRRNPPGQCATACSPGSSGAPDRRPPRSGCARSRGAAPANRRPAATPPGPGRHARAVRWGDDRPRFQAPVSRGTTCVAEHATKAARRLAAILAAQGQRSPPGTPGKRRSLPGPAARTGCARVRPAPDPGAGARPPGWR

SEQ ID NO: 16640 - protein, 95 aa, Pseudomonas aeruginosa
GSDRRVRRSARRGRCPRHRAAPPRSLRPNVRAPPAEALRPGGGQPRPPSAAPCDPACRWRSAASWTAPAKPSVACTQASVRPARCAAPPEGPHPA

SEQ ID NO: 16641 - protein, 160 aa, Pseudomonas aeruginosa
RSCRPGRPAQRPAGPARFPPGFAPLRCAVRCSLPAPRLLQAPVAPCDPACRSDSAASAPALATAPAPCIPAGLSPGARPALRASRRSRSPAPRSRPTACRPPPAPPPRAPTDAPAGAPRSRPARCAGRAASPGGRSARRTRSPRRRGSAPGRRCGTSAPQ

SEQ ID NO: 16642 - protein, 2509 aa, Pseudomonas aeruginosa
AGERMYRTGDLARYRADGVIEYAGRIDHQVKLRGLRIELGEIEARLLEHPWVREAAVLAVDGRQLVGYVVLESESGDWREALAAHLATSLPEYMVPAQWLALERMPLSPNGKLDRKALPAPEVSVAQAGYSAPRNAVERTLAEIWQDLLGVERVGLDDNFFSLGGDSIVSIQVVSRARQAGLQLSPRDLFQHQNIRSLALAAKAGAATAEQGPASGEVALAPVQRWFFERAIPNRQHWNQSLLLQARQPLDGDRLGRALERLQAQHDALRLRFREERGAWHQAYAEQAGEPLWRRQAGSEEALLALCEEAQRSLDLEQGPLLRALLVDMADGSQRLLLVIHHLAVDGVSWRILLEDLQRLYADLDADLGPRSSSYQAWSRHLHEQAGARLDELDYWQAQLHDAPHALPCENPQGALENRHERKLVLTLDAERTRQLLQEAPAAYRTQVNDLLLTALARATCRWSGDASVLVQLEGHGREDLGEAIDLSRTVGWFTSLFPLRLTPAADLGESLKAIKEQLRGVPDKGVGYGLLRYLAGEEAATRLAALPQPRITFNYLGRFDRQFDGAALLVPATESAGAAQDPCAPLANWLSIEGQVYGGELSLHWSFSREMFAEATVQRLVDDYARELHALIEHCLDPRHRGVTPSDFPLAGLSQTQLDELSLDPDSVRDIYPLSPMQQGMLFHSLHGTEGDYVNQLRMDIGGLDPDRFRAAWQATLDAHEILRSGFLWKDGWPQPLQVVFEQATLELRLAPPGSDPQRQAEAEREAGFDPARAPLQRLVLVPLANGRMHLIYTYHHILMDGWSNAQLLAEVLQRYAGQEVAAPVGRYRDYIGWLQSRDAMATEFFWRDRLASLEMPTRLARQARTEQPGQGEHLRELDPQTTRQLASFAQGQKVTLNTLVQAAWALLLQRHCGQETVAFGATVAGRPAELPGIEAQIGLFINTLPVIAAPQPQQSVAEYLQGMQALNLALREHEHTPLYDIQRWAGHGGEALFDSILVFENFPVAEALRQAPADLEFSTPSNHEQTNYPLTLGVTLGERLSLQYVYARRDFDAADIAELDRHLLHLLQRMAETPQAALGELALLDAGERQEALRDWQAPLEALPRGGVAAAFAHQAASAPEAIALVCGDEYLSYAELDMRAERLARGLRARGVAAEALVAIAAERSFDLVVGLLGILKVGAGYLPLDPNYPAERLAYMLRDSGARWLICQETLAERLPCPAKVERLPLETAAWPASADTRPLPEVAGETLAYVIYTSGSTGQPKGVAVSQAALVAHCQAAARTYGVGPGDCQLQFASISFDAAAEQLFVPLLAGARVLLGDAGQWSAQHLADEMERHAVTILDLPPAYLQQQAEELRHAGRRIAVRACILGGEAWDASLLTQQAVQAEAWFNAYGPTEAVITPLAWHCRTQEGGAPAIGRALGARRACILDAALQPCAPGMIGELYIGGQCLARGYLGRPGQTAERFVADPFSGSGERLYRTGDLARYRVDGQVEYLGRADQQIKIRGFRIEIGEIESQLLAHPYVAEAAVVAQDGVGGPLLAAYLVGRDAMRGEDLLAELRTWLAGRLPAYMQPTAWQVLSSLPLNANGKLDRKALPKVDAAARHQAGEPPREGLERSVAAIWEALLGVEGIARDEHFFELGGHSLSATRVVSRLRQDLELDVPLRILFERPVLADFAASLESQAASVAPVLQVLPRVAELPLSHAQQRMWFLWKLEPESAAYHLPSVLHVRGVLDQAALQQAFDWLVLRHETLRTRFEEVDGQARQTILANMPLRIVLEDCAGASEATLRQRVAEEIRQPFDLARGPLLRVRLLALAGQEHVLVITQHHIVSDGWSMQVMVDELLQAYAAARRGEQPTLAPLTLQYADYAAWHRAWLDSGEGARQLDYWRERLGAEQPVLELPADRVRPAQASGRGQRLDMALPVPLSEELLACARREGVTPFMLLLASFQVLLKRYSGQSDIRVGVPIANRNRAEVERLIGFFVNTQVLRCQVDAGLAFRDLLGRVREAALGAQAHQDLPFEQLVDALQPERNLSHSPLFQVMYNHQSGERQDAQVDGLHIESFAWDGAAAQFDLALDTWETPDGLGAALTYATDLFEARTVERMARHWQNLLRGMLENPQASVDSLPMLDAEERGQLLEGWNATAAEYPLQRGVHRLFEEQVERTPTAPALAFGEERLDYAELNRRANRLAHALIERGVGADRLVGVAMERSIEMVVALMAILKAGGAYVPVDPEYPEERQAYMLEDSGVQLLLSQSHLKLPLAQGVQRIDLDRGAPWFEDYSEANPDIHLDGENLAYVIYTSGSTGKPKGAGNRHSALSNRLCWMQQAYGLGVGDTVLQKTPFSFDVSVWEFFWPLMSGARLVVAAPGDHRDPAKLVELINREGVDTLHFVPSMLQAFLQDEDVASCTSLKRIVCSGEALPADAQQQVFAKLPQAGLYNLYGPTEAAIDVTHWTCMEEGKDAVPIGRPIANLACYILDGNLEPVPVGLVGEMYMVPTPGIRE

SEQ ID NO: 16643 - protein, 166 aa, Pseudomonas aeruginosa
ACSTSMRGAISTQRTSPNWTVICCICCSGWPRPPRQRWASWPCSTPGNARRRCGIGRHRSRRCRGAASRRPSRIRQRRRLRRSRWYAATSISAMPNWICAPSVWRVACGRAAWPRKRWWRSLPSAPSTWSSACWASSRSVPATCRWIRTTPRSAWRTCCATAARAG

SEQ ID NO: 16644 - protein, 162 aa, Pseudomonas aeruginosa
AGRPGRQLLQPRRRLDRLDPGSQPCAPGRIATEPARPVPAPEHPQPGPGGQGGCGYGGTGAGKRRGGAGAGTALVLRAGDSQPPALEPVSLVAGAPAARRRPAGACPGTPAGAARCPAPAFPRRARRLAPGLRRAGRRAAVAPAGGVRGGVAGALRRSPAQP

SEQ ID NO: 16645 - protein, 239 aa, Pseudomonas aeruginosa
PPERRAAGCPSRWFAHREFCLGRCCRTVRPCPRYLGNPGRPWGGADLRDRPVRGADRRAHGAALAEPAARHAGEPAGQRRLAADARCRGAWPVAGRLERHCCRVPAATRRAPVVRGAGRAHADGAGAGLRRGAPGLRRAEPPGQPPGACPDRARGRCGPPGGRGHGALHRDGRGPDGDPQGRRRLRAGGPGVSRGAPGLHAGGQRCAAAAQPVAPEAAAGARCAADRPGSRCALVRGLQ

SEQ ID NO: 16646 - protein, 154 aa, Pseudomonas aeruginosa
SACWPTAGASSMRRTVTTTMSPPCSRPPRPGSRHAPGWSATGASCVATASATCVRRRCRSPRTCAAAISSAGPAWISWQGAAASTRPAWPPPSPNTTATPARAATQSSAAAARHSTASRATRRIRGRIPASPPSNADRTTRCRSSPAASAPSPG

SEQ ID NO: 16647 - protein, 376 aa, Pseudomonas aeruginosa
PSATSPAAISPAPSATSRSKRSAVERSSGRSGLNRQAFLRNPSMSAAPPDIPALPAGLCYVYDRQPGIRRRRQGKRFVYFDADGQRIGDAEEIRRLDKLAIPPAYREVWICPDPNGHLQATGRDARGRKQYRYHPRWREVRDADKYERLLRFGQALPGLRRHIDAQLRLPGLGRDKVVALAVALLDATLIRVGNHRYARDNRSYGLTTLRTRHVDVNGSRIRFRFKGKSGIEHDVSLEHPRLARVLRRCLELPGQDLLQYLDEDGQPHRIGSHDINEYLRRHTGEDFSAKDYRTWAGSALALERLRRAEADGLGAVVAEVAAELGNSVAICRQCYIHPAIIEAYQAGQLGQLRRARKRRWLSAEEATLLAFLDTPG

SEQ ID NO: 16648 - protein, 66 aa, Pseudomonas aeruginosa
SIWSKKLAPEAYTEITKTKPEGLTMSDVTQYDRACRTPACLQPAPTHRTGTRHPPSPPLRAPFARF

SEQ ID NO: 16649 - protein, 414 aa, Pseudomonas aeruginosa
STAGCRAPPACSRTSMQNCRSTCAGNARSSGYECHEPATRERPDGHQHDHDPGAALGDGHHARARRRRGGIRPGRRLLRRRVPLHRRPAEEIRHLAGVRCADLRERHHRRRGRHGCLRPAPGGGDPVRRLRLPGLRPVDLRGGAPALSLGRRLHRADDRTHALWRRHLRRADAQPEPGGDVHPGLRPAHGDAVQPLRRQGPADRLHRERRPGDLPRAQAPLQRPVRWPPRPPGDALVQASGQPGAGRLLQGAAGQGGDRPPRRGADRADLRHHGLRGPGRGRRDRPGRRDHRPAQPLAAGPGNHRRLGEEDRPLRHRPRGDPHLRVRRRADVAGAGALLPPPGGADRARHRLGHPLPACPGVGVFPRPRARRRGIQACDGGLNGYPCDQDAGHRGRHRRGRTGGVACPGRRLGQ

SEQ ID NO: 16650 - protein, 144 aa, Pseudomonas aeruginosa
RPGPRRGDDRQGHGGDSLAGGRTHPRPRRPAGPGDGGGRRTDPPGGGRCRQPRRESGRGDAGRARRRHPGETEGSPGRGAESRRRSRRAPCGTARRHGSGASPANARWPPPRCASAPATWASSCSSCRAAVPPDASSTRTSMPT

SEQ ID NO: 16651 - protein, 220 aa, Pseudomonas aeruginosa
GARLPRLCRRPARGHPARAAGTLLAGLRPALPASLRPRLRASGAAADRRAPAQRLSQARDQPGSVGKELRHRPVRPGRHRRRIQPPRPRGPRPRVRPRRHGIQPQAGRPGVSGAESLRRPHRTRTVLRGAGRARLLRHLRRAEDRRPGPRAGRRRAADPRPVRGGRGHGEPVRRPLSLRRHQPGAGADLRLHRRPPYRRRPRLRAGASAARLNVPAGAAA

SEQ ID NO: 16652 - protein, 144 aa, Pseudomonas aeruginosa
AQRHRISPPCPPASATSTTASRASVDAGRASASSISMPTASASATPRRSAGWTSWPFRRPIARSGSVPTPTAISRPPAATPVGASSTVTTRAGARYAMPTSTSACCASARRCRGCAGTSTPSCACPASVATRWWPWRLRCSTPP

SEQ ID NO: 16653 - protein, 144 aa, Pseudomonas aeruginosa
TAVASGSASRARAASSTTSAWSIRAWRGCCGAAWNCPARTCCSTWTRTASRTASAPTTSTSTCAGIPARISAPRTTVPGPAARWRWSVCDVPKPTGLARWWRRSPPNWATAWRSAGNATSTRRSSRPTRPGNWASSGAPASAAG

SEQ ID NO: 16654 - protein, 482 aa, Pseudomonas aeruginosa
LPGGLRRLRVGRRARPAQPRAEPDRMGHLPRRPALDFGRPVQVPPRRRLDQLPAGRPDRPPEAAHDRPRHLVGGTARSHPQGPRSRSTGRAETGGEPWHPDRRPGAERRQHVRGRLCRTAGAPAPATPGARGMNAMNPQHENAQTVTSMTMIQALRSAMDIMLERDDDVVVFGQDVGYFGGVFRCTEGLQKKYGTSRVFDAPISESGIIGAAVGMGAYGLRPVVEIQFADYVYPASDQLISEAARLRYRSAGDFIVPMTVRMPCGGGIYGGQTHSQSPEAMFTQVCGLRTVMPSNPYDAKGLLIACIENDDPVIFLEPKRLYNGPFDGHHDRPVTPWSKHPASQVPDGYYKVPLDKAAIVRPGAALTVLTYGTMVYVAQAAADETGLDAEIIDLRSLWPLDLETIVASVKKTGRCVIAHEATRTCGFGAELMSLVQEHCFHHLEAPIERVTGWDTPYPHAQEWAYFPGPARVGAAFKRVMEV

SEQ ID NO: 16655 - protein, 977 aa, Pseudomonas aeruginosa
MGTHVIKMPDIGEGIAEVELVEWHVQVGDSVNEDQVLAEVMTDKATVEIPSPVAGRILALGGQPGQVMAVGGELIRLEVEGAGNLAESPAAATPAAPVAATPEKPKEAPVAAPKAAAEAAARLAGQRGATAAAPARRTPGGLPRGAPARPRPGHRVAVRAGQRSRRTRPPRGPRCLPDPGWQRRAQRRRRAGVCRATRRTGGAGDRPASQDRPEDAGRQATHPAFQLCRGNRRHRSGSPARPSQPEMGWPARQANPAAVPGPRHGRGAARLPAVERALRRRGRGGHPLRRGARRHRHPERQRPDGAGAAPRRIARPLGQRQRSGAPGRSRTQRQGATPGAVRLDHHPEQPRRARRDRQHTGDQPSGGGHRRRQPHRRATDGGRRQHRRAQDDEPLLLLRPPGGRRDGRGGLHPGRARPARTSCHPVPGVSDEPDPEDFPADRRRRSRRLRRGDPCRATGHSHRTGGGRRPRRHLPERRLHPVEGADPRRRGIPQGPPLCRPVGAGHPGTGAEHRHRPHRGMEGRHRRPPHQRRRRAAEETRGRCRPGLGEDPRRQKRGGRTRRRRQPAHRVRAPAAGRRLAERRATDPAAGRQGDLLHRGAGARQPAQAPGGGRRRLHRPGAGYRLPQARRRGGGGGSATAHPAGLRRRTDQAGGPGLAQAGRRAVPRAQPAGPERERRAGPRRRRRGARDRRRPGTGGGRPQAAQRRLEPGKPGPGHERPGGEGRRPVPHLDAQCLGHRRSRRRADARAPGHGPGRDGRRADRRQASPVRPGGDPRGVLHRSGSGGRRVVPGAGEGCRPGLPGGELPVRRQRPRHDPGGQRRLRPRGGASRQPPGRRLAGGGQGGLGTVHGLRPVAGDGRPPGRHRRHHPRPSDPRRSGPGSRPARAGTRPAHLIPANLGSRPTTGAHYPLARRARGLFSWPRTGSSAGLTALRDPPPLTPSPATHAASSPPPGAGEYPRRSADRPGGTGAPGGRR

SEQ ID NO: 16656 - protein, 146 aa, Pseudomonas aeruginosa
GSATRSRSGTPGPATGRPRRDSGNAPTPPPARRYCWCAPGVPGARRGTRRPPRRDAPGRAGCCLAPTCSWHIRSSSRSSGPGRRPRRAAVAAAATAGRCWAGAAGRWCGRRSGGRTARAASPARSPRRRRSRRSACGCTASAGSGR

SEQ ID NO: 16657 - protein, 325 aa, Pseudomonas aeruginosa
NAQRFPFRKSPHRPDRRPGCLLHDPFAFRPVPPLRPHVRRIQGIAARPGRPAQFLPGPDAEPRRPGRRRQHRRGRHRRDPRRSGGGVLDVGHRAGRHVQQLLRMHPGPGLQAQRRRRPVSRRPVLLHPARPEAALDGGGLRGTPAGDLRLRLQRPAVLHRHPFAAERLRLRPAAHRDRPGGAARRGLHRRHQAHRRGLRPAGADQDPGLHRRHPVRHRQPDRARPGNAGNHRQERLRPRPGVRRPARQRHRDGRQAWRLRQRGRPGQRAERRRGRRRAPSGGTGRGPGLQRVPRHLRDLHLHRPADPALGLLHPGLRRRRHRLHP

SEQ ID NO: 16658 - protein, 253 aa, Pseudomonas aeruginosa
TWAARSRVPHGDGETGHFPHIIERGKPGVIGVLANGRRFVNEAHGYHDYVAALLEATPPGQPARSWLVCDRRFLRRYGLGYVRPAPLPIAAHLRSGYLKRGTSLDQLARSCGIDPSGLAATVAEYNRHAREGRDPEFGRGGTAFNRKQGDPAYPGPNPCVAPIERGPYYAVQVEPGCFGTFAGLKTDAQARVLDGGGQPIPGLYAAGADMASLFAGHYPSGGINLGPALTFGYIAGRHIAGALGYEQEQAQRG

SEQ ID NO: 16659 - protein, 450 aa, Pseudomonas aeruginosa
TFQRAQRPKQASFPSEPKHERSATGYPRPARRPLLRLRPPAGHPSTPAGQALRLFRCRRPAHRRRRGDPPAGQAGHSAGLSRGLDLSRPQRPSPGHRPRRPWAQAVPLPPALARGTRCRQVRAPAALRPGAAGAAPAHRRPVAPARPRSRQGGGPGGCAARRHPDPRRQPPLRPRQPLLRPDHPAYPARGRERQSHPVPLQGQERHRARRQPGASAPGAGAAALPGIARPGPVAVPGRGRPAAPHRLPRHQRVPAPAYRRGFQRQGLPYLGRQRAGAGASATCRSRRAWRGGGGGRRRIGQQRGDLPAMLHPPGDHRGLPGRATGPAQARPQAPLAECRGSDPAGLPRHARLISCPGADRCRAGAAGRAGGQSRSGRLPVPCAGCVRGAAAPASRVRVRRAPHGGSAARAPCRNARRRGPLRPCARGIRASAGRPTWPCRSAWARVCWLS

SEQ ID NO: 16660 - protein, 464 aa, Pseudomonas aeruginosa
RHPVRPRLPYPGMPATRPHPQDGNPPSAQSAASSAVRPFLISPTVWPGPGRRPVMSDYEPLRLHVPEPTGRPGCKTDFSYLHLSPAGEVRKPPVDVEPAETSDLAYSLVRVLDDDGHAVGPWNPQLSNEQLLRGMRAMLKTRLFDARMLTAQRQKKLSFYMQCLGEEAIATAHTLALRDGDMCFPTYRQQGILITREYPLVDMICQLLSNEADPLKGRQLPIMYSSKEAGFFSISGNLATQFIQAVGWGMASAIKGDTRIASAWIGDGATAESDFHTALTFAHVYRAPVILNVVNNQWAISTFQAIAGGEGTTFANRGVGCGIASLRVDGNDFLAVYAASEWAAERARRNLGPSLIEWVTYRAGPHWTSDDPSKYRPADDWTNFPLGDPIARLKRHMIGLGIWSEEQHEATHKALEAEVLAAQKQAESHGTLIDGRVPSAASMFEDVYAELPEHLRRQRQELGV

SEQ ID NO: 16661 - protein, 354 aa, Pseudomonas aeruginosa
SAWRWKVPATSPRVRPRRRRPRPSPPPRRNRRKPRSRRRKPPQKPPRALRDSEAPRQRRQPGERPVASPAVRQRARDLGIELQFVQGSGPAGRVLHEDLDAYLTQDGSVARSGAAAQGYAERHDEQAVPVIGLRRKIAQKMQDAKRRIPHFSYVEEIDVTDLEALRAHLNQKWGGQRGKLTLLPFLVRAMVVALRDFPQLNARYDDEAEVVTRYGAVHVGIATQSDNGLMVPVLRHAESRDLWGNASEVARLAEAARSGKAQRQELSGSTITLSSLGALGGIVSTPVINHPEVAIVGVNRIVERPMVVGGNIVVRKMMNLSSSFDHRVVDGMDAAAFIQAVRGLLEHPATLFLE

SEQ ID NO: 16662 - protein, 465 aa, Pseudomonas aeruginosa
AMSQILKTSLLIVGGGPGGYVAAIRAGQLGIPTVLVEGAALGGTCLNVGCIPSKALIHAAEEYLKARHYAGRSALGIQVQAPSIDIARTVEWKDAIVDRLTSGVAALLKKHGVDVVQGWARILDGKSVAVELAGGGSQRIECEHLLLAAGSQSVELPILPLGGKVISSTEALAPGSLPKRLVVVGGGYIGLELGTAYRKLGVEVAVVEAQPRILPGYDEELTKPVAQALRKLGVELYLGHSLLGPSENGVRVRDGAGEEREIAADQVLVAVGRKPRSEGWNLESLGLDMNGRAVKVDDQCRTSMRNVWAIGDLAGEPMLAHRAMAQGEMVAELIAGKRRQFAPVAIPAVCFTDPEVVVAGLSPEQAKDAGLDCLVASFPFAANGRAMTLEANEGFVRVVARRDNHLVVGWQAVGKAVSELSTAFAQSLEMGARLEDIAGTIHAHPTLGEAVQEAALRALGHALHI

SEQ ID NO: 16663 - protein, 401 aa, Pseudomonas aeruginosa
TSMLEMLNDFLSGKVLIVLIVGLGAYFTIRSRFVQFRHFGHMFGVFRESLRGQAGQLSSFQALMLSLAGRVGAGNIAGVGIAVTLGGPGAVFWMWVTALVGMSSSFFECTLAQVYKRSDGDGLYRGGPSYYIQHGLKLRSMAVVFAVLLLVTYGFAFNGLQSYTVTHSLQNAFGFAPQHTGIALAVLLGVVFIGGIKRIAAVSDLLVPIKTLAYIGVTLYVIASQIEHVPAMLETIVKSAFGLDPAFGGLLGSAIVMGVKRGVFANEAGLGSAPNVAAVAAVRHPAAQGVVQAFSVFLDTFVICTCTALLILLSGFYTPGFEGDGIVFTHNSLVAVVCDWGRVFVSVVLCLFVVRPAARLLLLVPHPLFFFRCYRLGGDRVSVLCGWPWALLGFRSWTCSS

SEQ ID NO: 16664 - protein, 250 aa, Pseudomonas aeruginosa
STPRGSPPGRTGDACRRSARRPSRPGPWPGARASARRRDRLWPRHCASRCGTGRRPSPPGRSCPGPGFPGSSLRCAACGRPPPVPGRRRSRAPRRRRRGPARRSRSGPAGCARGTARRPACARPGPPAWSVLRRSPAGCAVALPPPPPRRRACGRRYPAPGRCSRRRPPPGAWAGCRAPAPRWRRSPCRPAAGSVARRSASRRPAAGARTRCAGCRRRRVRPPRFCRRGSSPSPGRHRPRVSSAARRRRW

SEQ ID NO: 16665 - protein, 251 aa, Pseudomonas aeruginosa
NAGCVAWRPASSGRSCDAGRSPAPPVRRVARHTPARRRRCARRCHPGSGRHRGPRGGRVRRDRCPARTATRCPGRGRAGAPRGRPPGVRRAGAAAVAPRCPARRAAASAAAFGAATGASFGFSGVAATGAAGVAAAGLSARLPAPSTSRRISSPPTAITWPGWPPRARMRPATGEGISTVALSVITSARTWSSLTESPTWTCHSTSSTSAMPSPMSGILITWVPIQTSITRLNAAPTRAGPGKYAHSWACG

SEQ ID NO: 16666 - protein, 107 aa, Pseudomonas aeruginosa
LRNVTQMEAFMKASKPGPKPSGKAKSAAQRMREYRARKAEEALGAEHSDKERERQIRREARAELERVKLEQQRREHTLRKELEACQTEIGRLLGLLRRHGIDPHPGN

SEQ ID NO: 16667 - protein, 385 aa, Pseudomonas aeruginosa
AEGALDDGFQHCRDVLDLAGDDVQGDADVGQGLDRHQQVGDRGDALDAADEDHAEQHRQGDPGVLRGEAEGVLQRMGDGVGLQAVEGEAVGHQQEYREDHRHRAQLQAVLDVVGRAAAIQAVAVAALVDLGQGAFEEAAGHADQRGDPHPEHRPRTAEGHGDADPGDVAGADPAGEAQHQGLEGTELAGLAAQRFPEYAEHVAEVAELDETRTDREVGTQADDQDDEDFSGKEIVEHFKHGGLPRFLFWYRRALRQRLGARRMVGHDAPGYNFAGCSCLMRPDARIASIASVLEPSMSEHLGANLKLLCSHYRSISEICRQLAINRAQFNKYLSGQSQPTPYNRKRIGDFFGVEDYELGLPPEQFARLIGARTSAQPRQPSNDPL

SEQ ID NO: 16668 - protein, 182 aa, Pseudomonas aeruginosa
RLLQPLRAEAGDLGRYCGYYFEYANCMSVPGSILLSLVHLYEEDGVFLFERQERQERTSSTDVQAEEWARCRYLGAAFQLQDRVFLIDYESLTLNEMSQTILIPSFKSRITRLNGLKMGVSSGDRRTPACSRVVWEYLGAEINRINAYRQVRLYRPDDPRIDEDIRQRLAAGSLRHGLLETE

SEQ ID NO: 16669 - protein, 345 aa, Pseudomonas aeruginosa
DLLTTRFAATKKAPLPDGQGGNVRRWLAGYRGSRESDVQGVSQRAQGGFLDRFAEGRMGVDGAGDVFQAGAHLQRLGEGRGQFRDRLAHRLPADDQVVVATRHHADEAFVGLQGHGAAVGGEREARHQAVQAGILRLLRGQPGDHHFRIGEAHRGDRHRGELATLAGDQLGDHLALGHGPVREHRLAGEIAYGPDIAHRGAALVVDLHRPAVHVQAQAFQVPAFAARLAADRHQYLVGGDLALLAGAVADPHAVLARAQQAVPEVQLDAQLAQGLGHRLGQFFVVARQDARLRFHHRHLDAELAVGGTQLQADVAAADHHQALGQAAGRQRLGGGDHLAAQRQDR

SEQ ID NO: 16670 - protein, 330 aa, Pseudomonas aeruginosa
LDALRAGGQQQVLALDALAAAAGEFDRHAFAVEDPRPALDDIDPVFLQQRGDAAGEAVDDGVLPFHGAGDVDARRLYLDAQRRPAGIVAGLEVFLGGVDQRLRRDAADVQAGAAEGGALHQYGGNAQLPGTDRRDVAAGTAADDQQGSLQDLAHRLLQEQGGRMFEQAAHGLDEGRRVHPVDHPVVEGGGEVHHLAHDDVAADHHRSLDDAVDADDGHLRMVDHRCADDPAERAEAAQGDGRAGQLLALRLAAACGFGQARHFAGVAPEVARFGVAQHRHHQAVVALGGDADVHRAVAGDHLGLVVVARVQLREVAQRHDHGADQERQQG

SEQ ID NO: 16671 - protein, 222 aa, Pseudomonas aeruginosa
LAALATPFLVEMGAQGFQIGDVDFLDIAEMRDASLGVLHLLGDLATQADHRHRLFVVSLGIPLRGGAAARDAAILGQVGIEVLVEDASGGTAALHELQLDAQVAGALAHRGGGHRAFAGLAPLPWRLAVPQGARRLLRRLSAPRPGLPSVSPGWRRRARPASPRPDSRRGCRHLPPPGGSVRRPPPSPGPAGRRGRGCVRPPARESPPWPCRSSPRRGPGLH

SEQ ID NO: 16672 - protein, 159 aa, Pseudomonas aeruginosa
QEKQRTMAELDRIDLKILRALADDGRLSWRDLAQKVGLSLTPTLRRVRRLEEEHYIQGYFARLDEERLSGAMSVFVSVSLEKQTGDYLARFEERIVDAPQVMSCFQMTGDADYMLRVVVKDLAAYQAFLTNTLTCIPGVAGIKSAFALKSVMLRSAPPL

SEQ ID NO: 16673 - protein, 281 aa, Pseudomonas aeruginosa
RPGSRPRKKPPCPTGKGVMCAGGWPATEVRGNQMCRACPSARRAASWTASPRVGWAWMVPAMSSRRAPISSDWAKAVDSSETALPTACQPTTRWLSRRATTRTKPSLASRVMARPLAANGKLATRQSRPASFACSGDNPATTTSGSVKHTAGIATGANWRRLPAISSATISPWAMARCASIGSPARSPMAQTLRIEVRHWSSTFTARPFMSRPRLSRFQPSLRGLRPTATSTWSAAISRSSPAPSRTRTPFSLGPSRLCPRYSSTPSLRKAWATGLVSSSS

SEQ ID NO: 16674 - protein, 160 aa, Pseudomonas aeruginosa
PPGPPPTISREVFRIWLIAYSRNRVAGCSSRPRTAWMKAAASIPSTTRWSKEEERFIILRTTMLPPTTIGRSTMRLTPTMATSGWLITGVLTIPPSAPRLLRVMVEPDSSWRCALPLRAASARRATSLALPQRSRDSAWRSTGTIRPLSLWVAMPTCTAP

SEQ ID NO: 16675 - protein, 542 aa, Pseudomonas aeruginosa
ASRSSWRTRPAGPLPCTNCNSMPRSRARWRTAGEATGRSPGWRRCRGASLSRKARGGFCGGFRRRDRGFLRFLRGGGDGRGRRRRGRTLGEVAGTFHLQADQFAAHRHHLARLAAEGEDASGHRRGNLHRGLVGHHLGEDLVFIDRVADLDMPLHQFDLGDAFPDVRHLDHMGTHSDLHHTLECRADARGAGEIRPLLGMRVGGVPTGDALYRRLQVVEAMLLHQRHQLGAEPAGAGRLVGDDAAAGLLHRGDDGFQVQRPEAAQVDDLGVQAGLVGRGLGHVDHGAVGQHGQRRAGADDRRLVQRHLVVAVRHLAGRMLGPGRHRAVVVAIERAVVEALGLEEDHRVVVLDAGDQQALGVVGVGRHHRAQAADLGEHRLRALAVRLPAVNAAATGHAYGHRHDEVAGRAIAQARRLGDQLVGGRVDVVGELDLHHRAQAVGTHADRGADDAALGDRRIEHPRGAVFLLQAFGAAEHAAEVADVLAEYHHVVVALEHDVHRRAQRLDHGHAGDRLGVLVLRVHGIHTPSSWRCRRRCSGSSA

SEQ ID NO: 16676 - protein, 209 aa, Pseudomonas aeruginosa
SGTGCDCRSRPRAGYAGWSGRRSGCRGRSGGCRRGSGWRRAAQPPGPPPCRDRGRAGATGRRCAGAAPAAPGRSAAGARTCRHRVPRASAGGNGTACAHGRRGRWPGDGRWGRDRSRPRDRPAEWPACPAGGSPRRRRCAGRRHRNRRSACPAGVDGCPAGGRRRSRGRRAGRGYPVALRSCLGSEGKLACLGRCARWNVQPRCACSCS

SEQ ID NO: 16677 - protein, 135 aa, Pseudomonas aeruginosa
AFLRDLQQVRRHRRRRLRQHPGDPETGRPPGQVRRAGLSLAACPFAGRPLSPSIKPCRCRNACCPGWRCAPAPPFWLRPRFPRPASSNWPPIPTGSPSATTNAASSAVGAATSTTSGSSSPTTARATRTPNWRPR

SEQ ID NO: 16678 - protein, 207 aa, Pseudomonas aeruginosa
RRSIFARHCALPPIRCLDTPVAFRKAHGVAGPLQMAPIHLKREQTMKRILLGTLFAAASFNAFADAPGGAGCGWGNMLFKGQRGVATHVVAATTNGTSGNNTFGMTTGTNGCHTNGALSYGGKPLLVLGSMMDELSEDMAKGNGEALTTYAVVLGVQPQDREHFAAVTHEHFSEIFNKSDATAADVYANTQAILKQDARLAKYAEQA

SEQ ID NO: 16679 - protein, 887 aa, Pseudomonas aeruginosa
ARAVLLRRGLVLRHDGLFLRRFVLFLVVLFHAEFGYLLQARHDQIVHAAFREASLLVLATDRLAHQQRQRLVHLAHRVYVELPGAHRLQHALVEHQGSDVGARDDHTLLAGQAARFAEAEEALDLLVDAADRLHLAELVDRAGNGEALLQGRPRQRRDQRADLAQRGAVGVHVAVGLFQGDAGGDFQGELLGVAATQVAGKDHHALGVDRLAEVDFALDIDDAAAARIDGRGNPRRHAEHRVAHLQHGQSVALADRGASGVDQDDPRQHVVEDPRRHSSGAGLLGLEGTLDVAELDHLLVRQLTDEIGFADQLEQVADPCRKPPLVLGQARAVGRQSRHRRAAEGRHALFRGARLEQLGELFEAVLAQRDVLVEVHQHPEHLLEVRVEVLQGVVDLPRADDDHLQLQRDHLGGQGNRSQAAEFGQRRLHLQLARLQGTLERVPDERLAKHLFRFQDQEAAVGPVQRPRTQLPVAGVERPLVRAVLDAAEQVVVGRVRLEHHRRAAGRVVDDGLVRRVLLDQPLLALGVGAAVVDQLVDHGLQQVQLHRLQVGADARVVVVLLHQRRQQGLQGQGDGFLVELAQLVARLALPLRQARQFLVEVLLEGGDILVETLALGFGQLGEFGLIEGLAVLHRGEGDVGAVAVQRHVLLQGAPLHRVQGAVVALVESAVDGVLLLLVGRMLEDRREGRHQVVDQTVDVGAEFGRAARRQLDHPRFARLVEIVQVDPVGGRGDALALGLQIAFDEGEASGPRLAHDEYVVTRTRHRHTELQRLDRTLLAQHAAEGLQVIGGVEGELLGSERAGQFFWRQAQAGSDGIGHRESLHRAADRRGVSSPAFSPQPRATDKARMALSHRCTRSAQRRQYSAAGRAARRAGSIASPQRSHWP

SEQ ID NO: 16680 - protein, 570 aa, Pseudomonas aeruginosa
ALPMPKRLLPWMALCACSPLLAAPTVPEARLQQLAADPYWIALGHYERGKLGGWRSYVDDERFFLADNGESHPDAELAATLKALYASPSLGDKHAQCVYPARTRWLRQQLQLDDLPQPQCGEYDNWYRDINPHSAVLVFPAAYLNSPSSMFGHTLLRIDQADVTSNNTALLSYALNFGAYIEGMDNSILYAWKGLMGGYPGLFALVPYREKLAEYSRLENRDLWEYKLNLTPEETGRMVEHVWELKQVRFDYYFFDENCSFRLLELMEIARPGIELTEQFPLTAIPTDTVRAVKNAGLIERIDYRPSREKELLARAEPLDHAERDWAKRLADDDSLLDAPDFKALPMPRQALIQDAAFRLVRYRATGQARDSGIASRSYNLLRAINRNPPPDLQVERPGQPEDGHESRTWQFGVGSRDDRAFAEYGLRMAYHDLADNAYGFPLGAQIEIGQLKLRQYEGNRWQLQNLDLVTIRSLTPRNQLLKPLSWQVAGGLERVPGEDGDENLVSHLNGGAGGSWIRPCKNAASDGDQLLSDFLSPRRPWEAQSGAIGDSDCMGTSGFGAPVERGQES

SEQ ID NO: 16681 - protein, 430 aa, Pseudomonas aeruginosa
GRIRPVARSRARAFPQGYRRPRGVPQRGTGEPAAVEARVEQPVARAQRGNHHPGPAAPAGASGGEVQQQPGRLRLPAGDATEPAEDRGRPTGRRQPHRRPAQARADRAVRAEPGHRPPRDQRRAGGVRVAPDLRQPVRPHRVQLGPGGALHQLPAVASGGAAPGQRRLPDPGSGKDAWRAVRLGRAQACPAVAPVEDGVAAGRTRPPGCGFPDPPGDPAATEGDHHRLAADLLHPAGPRPGLPGDVPGAGGLRRGHPAGRGQPRTVRPVAQDAHLGRGHGAPQRRGGGATGDLQRAPGRAPGAAFGTDRRPVPVGQRSRFHPSAGERGGDPARPHRACPQGQADPHRTSVGADPRRHAGGDHPDRHRWRRGRQVQRTDRAGGGRLGVRRAGADFRDRLSGQQRHRRYRARSQPRPADPLQGRDDPYRLPG

SEQ ID NO: 16682 - protein, 195 aa, Pseudomonas aeruginosa
PLRPGVPPGNLRQHRPGTILRLRGRRQRLAGRGLHADLGAVADALEAVLRHYRLDQPVRRGAGGRRRQREDRGLLPPLRSARPDRRAGCDHPARQRHYPDARRARVAGGARRAVPRIRGARGGRGAGAAGGQAGRWPGREGTLPERQRERSGRGALAGDIRTRHGRGRQGKGQTGGERDRRGEGQGRGEEGLRVP

SEQ ID NO: 16683 - protein, 182 aa, Pseudomonas aeruginosa
GGSEPSGAGQRRRELFGMPPGCQGTEWVAARNAGRKLTGVSGNPLGTVQTWESSGRSERNRPWSAVPHAGGGYERFRPRYRPGNPGDRVRGTRRGDPPGPGAQPFAGLCRAGGAAPERRSARRPARRGGGGDAPGRPGPPAPGGRSLRPVRALWRGYRTGAPGRPACGGILPALRRPGTSVR

SEQ ID NO: 16684 - protein, 851 aa, Pseudomonas aeruginosa
RHPRLVSGARLGGECGRRHPAAICRPMQGFPMPDSVAAGLRLAPEELTRPFAPEQFAFDTTDDLEPFRGVLGQERAVEALQFGVAMPRPGYNVFVMGEPGTGRFSFVKRYLQAEGKRVATPSDWVYLNNFDEPREPRVIELPPGSATEFSADIDRLIDNLMSTFPAVFEHPAYQQKKNAVDRAFNQRYDRALDSVERRALEKDVALYRDSANVAFTPMKDGKALDEAEFAQLPEAERERFHKDIAALEEYLNEELASLPQWKRESSNQLRELNEETITLALQPLLAPLVEKYNNNPGVCAYLQAMQLNLLKTVVDQLVDDSRTDAQRKQGLIEQYAPNQAIVHHATSGAPVVFESHPTYDNLFGRIEYSSDQGALYTSYRQLRPGALHRANGGFLILEAEKMLGEPFVWDALKRALQSRQLKMESPLAELGRLAAVSLTPQVIPLQLKVIIIGSRQIYYTLQDLDPDFQEMFRVLVDFDEDIPLGEDSLEQFAQLLKTRTSEEGMAPLSGAAVARLATYSARLAEHQGRLSARIGDLFQLVSEADFIRQLANEEVIQLGHIERALKAKQTRTGRVSARILDDMLAGIILIDTAGAAVGKCNGLTVLEVGDSVFGVPARISATVYPGSSGIVDIEREVNLGQPIHSKGVMILTGYLGSRYAQEFPLEISASIALEQSYGYVDADSASLGEVCTLISALSRTPLKQCFAITGSINQFGEVQAVGGVNEKIEGFFRLCEARGLTGEQGVIIPRANVTTLMLDERVLQAVRAGQFHVYAVREVDEALALLVGKPVGGQDEKGRFPKGSVNDLVVARLQEISELGMEEDDKEKDKPAEKETVVAKDKAAAKKDCAC

SEQ ID NO: 16685 - protein, 164 aa, Pseudomonas aeruginosa
SRFCAPKGGLRGGRGRPVWAKVISSNNAAKNEYRCPAGQSLIWRFSSVEKGLKLHRYWSSHCQGCALKEHCTPSSERRVSRWEHEAVLEAMQSRLDQAPEMMRIRRQTVEHPFGTLKSWMGATHFLTRTLDRVSTEMSLHVLAYNLKRVLTMLGSGALMAAMKA

SEQ ID NO: 16686 - protein, 220 aa, Pseudomonas aeruginosa
CLGKGACPRTGRRRGSGLLGVLGQAGVLFQDRLGVGVDVGGGGVGLVEDLGEMLMGDGGEVLAVLRLHAQHHGIGGQRFAIALGHVFGQLVHHAAEHQQGLAAIGQRAVGMAAVGAGGHAEGVVAGSAVGGRRDHVGGHAALAFEEHVAPAAAGAAGSVGESVEGGGGEQGTEQNPFHRLFSLEVDRSHLERASDAVSFSECHRGVKAPNGWQRAMPGEN

SEQ ID NO: 16687 - protein, 143 aa, Pseudomonas aeruginosa
PASAAIRLEPSRLGKVLVGLSETGLGQPFLMQEVDMSAFDPATALETLATEYAARAAAIRRDLARSHSPDFAEQAVQRQNDEVLEGLLAEAEAGMRQVGLARLRLAEGRYGQCERCGEAIEPARLAALPAAEYCLRCADLVHR

SEQ ID NO: 16688 - protein, 82 aa, Pseudomonas aeruginosa
KAPRPTMPISWSGNGWEGTVLLRVHVLASGSPSEIQVQKSSGREALDQAAVKAVKRWSFVPAKRGDKAEDGWVSVPIDFKLN

SEQ ID NO: 16689 - protein, 164 aa, Pseudomonas aeruginosa
PPRSNPSNAPSSGCWSAFPWSPGAWPWSRACSSPGRSARTASSRSSSGAPPASTPPASRRRTSRAPAPAWPRPASPRSRCRTTASPTWPSRSTTRTVSNAPCASRSSASGVPWSRAWRCSPRSARPRPSSACSAPSGASWRHSRGSARPARRAWRPWPGRSAAR

SEQ ID NO: 16690 - protein, 138 aa, Pseudomonas aeruginosa
RRRPDMAFSTQDSDEVLSEINVTPLVDVMLVLLVVFIVTAPLLTNSIPINLPKTESVAPPEQKDPLVVSIDGAGKLFVNKDEIQPELLESNLAAAKAKDAEVRVQLQADEGVNYGQVAKAMASIERAGITRLAVITAR

SEQ ID NO: 16691 - protein, 818 aa, Pseudomonas aeruginosa
RRGAAARTPGRRAGGADRAGRSGGAGRQQPEAGGFPLPFAGAGRSRQAARPAHDHAQRRPPGASRPVRTGHRAQARLLLLRPAELAHRPVARRRPAGDRRDPHLHRAVRAAGGRPDPQRGAGRRFRRRPRRQRVHRAEHGRHPGAGGAHRVQRRHRHRPGQPYRRRPARPAASGYPGVLGGLRGRGRPAVLHRAAVHPRPAPHQAGPRADGDDGDPRHLPAAQRAVAEPRHRLQHRGHRADPADLRRVPRPEGQDLPTLDPQPAPDPYPRHRERLGRERALLRHRAGHGGLHRPASRRVLHRSRRLAAFQSDVLPTGRTIRRRPVHRRYPPGRRRRPFLHRHPRTPGRLRRRPEHGPRPARPAPLDAGLAGHAGRTRGLAGARQEAGGADGRDLPGRRQADLRRASRRAGGGAPDRHAAGAGDDLWRRRHPCAHRGRHRLPVQGALPGGTPGDDRGGGGDQSDRPAPRSARDPADAPRRADRAARGPRHPPHRRLARAAGGEEHRRAGRVVRRAVPAAGAFQELVMNAIANLAATPCADLGECLADLAVDALIDEAELSPKPALVDRRGNGAHADLHLGLMQASALSLWPCFKEMADAAQRHGRIDARLRGVLGQLGRDGEAAMLRTTEGVNTHRGAIWALGLLVAAAALEPRRTQAGEVAARAGRIALLDDPAAAIGDSHGERVRRRYGVGGAREEARLGFPRAVRHGLPQLWRSREGGAGEQNARLDALLAIMSVLDDTCVLHRAGRVGLAAMQDGARAVLAAGGSASLAGRRRLCELDRRLLALNASPGGAADLLAACLFLDRLPAVSGGWAGSL

SEQ ID NO: 16692 - protein, 92 aa, Pseudomonas aeruginosa
WSPVASSTASRRCSPPSKVLSRAAALAKSAERRSPARWSWPPRTIATAFRPGPCCCWKPVACACRKPTSDWRRSPRSRRPSSICSATSRWWR

SEQ ID NO: 16693 - protein, 273 aa, Pseudomonas aeruginosa
PRAASRRSCFVARRRCRAGRLPGAFPGRRARSRQSVPARSPGRGRAARGLGPGRRRRRGAGGRPRGATQARAAGHRRRAEPGLRPPRGGPGYPPGAGRGGGCLRPRPTRRASADRPAGGQGDVRRVPRPRLPGQPPDRLARSGGDGPRHGQGRRRADHPAQRRGTGGVGGEGAADGLRHRQLRVARPALEDPSGGDRRGAVDGGPGAGPHLPGRGPGRYPRRPARPRRPPRRGQPRGVGAGAPAAARAVVNSGASRGHREQLTAGLQPATARS

SEQ ID NO: 16694 - protein, 138 aa, Pseudomonas aeruginosa
LAPGHGAGAFAGECSGLGLRGTEGRLAGGGAPCAGRSCAGGHRRARPGAGAALGRLDAVGGNHPALAPGSAGPARAGDAARSAGLACLARPACAAERAGTGLGRDRRRRFRAGQRGRRAASGQRPRPAAAHPAPVPAR

SEQ ID NO: 16695 - protein, 172 aa, Pseudomonas aeruginosa
  UNSURE (134): Identity of amino acid at the above locations are unknown.
RAAPAAVLRAVSLPDRPATADPGGRRGPARMGRGSAPGAGERHRGAAVAGRPLADRGCRGMSVLFAYPGQGAQRPGMLAALPDEPPVRACLEQAADCLGQAPAELESADALGGTRAVQLCLLIAGVAASRLLEXRGHPPGLVPGLSIGAYPAAVVSRALDFDDPLLLVAPPC

SEQ ID NO: 16696 - protein, 274 aa, Pseudomonas aeruginosa
TESAASRGASRHESVNHPARIRRMRRHLAAGRLFRGHLGPGPGQGRAVRPAEAPGPPVPEAVLERHQPRLRRRAGAGQAGRRRPRGPGRLRRDPGAGQRPARPGPVDQPPGPSRTRPAPADPARAAFPGVGPGGARLDRLDLALHRPVRHRLGHHGGTQGDQRGRLGEPGDRGRADRQRADRHRRGNRRRGAGGAGLQLLPAAPEADRRRPRRLRPRLLQPGAEERVPRHRPSHRRAPGRQPLAQREGGVLTWPSRPRTATKSFPKSTSPRWST

SEQ ID NO: 16697 - protein, 575 aa, Pseudomonas aeruginosa
LNRPGGLPNVAPHDSVKPGADMTTPISPPPQWSRRRQEKQRRLERVRGLADGAVLPRERLVAALEALIAPGDRVVLEGNNQKQADFLSRSLARVDPGKLHDLHMIMPSVGRPEHLDLFELGIARKLDFSFSGPQSLRIGQLLEDGLLEIGAIHTYIELYARLVVDLIPNVALVAGFVADREGNVYTGPSTEDTPALVEPTAFSDGIVIVQVNRIVDDPRDLPRVDIPASWVDFVVEADQPFYIEPLFTRDPRHIKPVHVLMAMMAIRGIYQRHNVQSLNHGIGFNTAAIELILPTYGESLGLKGKICRHWTLNPHPTLIPAIESGWVESVHCFGTELGMEGYIAQRPDVFFTGRDGSLRSNRMFCQLAGQYAVDLFIGATLQVDGDGHSSTVTRGRLAGFGGAPNMGHDPRGRRHSTPAWLDMRGEPEALLERGRKLVVQMVETFQDGGKPTFVERLDALEVARQTGMPLAPVMIYGDDVTHVLTEEGIAYLYKARSLEERQAMIAAVAGISPIGLRHDPRETQRMRREGLIALPEDLGIRRTDASRELLAAKSIAELVEWSGGLYQPPARFRSW

SEQ ID NO: 16698 - protein, 131 aa, Pseudomonas aeruginosa
TLRPAAPPTCWPPVFSSIACPPCPVGGLGVSEMETLTFEFPAGAPARGRALAGCVGSGDLEVLLEPAAGGALSIQVVTSVNGSGPRWQQLFARVFAASTAPAASIRIHDFGATPGVVRLRLEQALEEAGHD

SEQ ID NO: 16699 - protein, 169 aa, Pseudomonas aeruginosa
RGQLPRVARSLRRRAVALAGTTGHRAPGRRWGSGRPWPPRRPAGGARRHRRCFPGRQPWRSQRSEDRRRAGAGRRGQSQRRSDPGPAVAGNRWRAPAGSQPRTGGDRRDPGGHRRSAALPAGGGGDCRAGRLLRRHVHRRRAVQLRAGDPRDAPRLERSAGDRTGGRHR

SEQ ID NO: 16700 - protein, 324 aa, Pseudomonas aeruginosa
GTHLGTRVFRQGPAGTAALPPRRGLPAAAGRPRYRRATGCRRRAPAVPGAGPRRCNMSQPFASRGLAWFQALAGSLAPRPGDPASLRVADAELDGYPVRFLAVVPDPDNPFPRARQGEVGLLEGWGLAAAVDEALEADREAPRKRALLAIVDVPSQAYGRREEALGIHQALAGAVDAYARARLAGHPLIGLLVGKAMSGAFLAHGYQANRLIALHDPGVMVHAMGKAAAARITLRSVEELEALAAKVPPMAYDIDSYASLGLLWRTLPVETVEVPSTADLVRVRTCLGEALADILGGPRDLGGRLGAANREASARVRRLLREQW

SEQ ID NO: 16701 - protein, 235 aa, Pseudomonas aeruginosa
IQERAVVIANSSQRGSSRRRLAPDPMRRRAGPEPHDLLLGMAPAHLPENAPAWVCAALKAGWPVVVRRAPADPARVAIGVRGLAREQRWAGWMPLAAITRRLRPEALGQREPAMLRDLPAWRALRDLRAPLNALGLAWGVTGGAGFELASGVAVLHPDSDLDLLLRTPRPFPRDDALRLLQCFEQCPCRIDLQLPTPAGGVALREWAEGRPRVLAKGTEAPLWLEDPWRIADVEA

SEQ ID NO: 16702 - protein, 360 aa, Pseudomonas aeruginosa
FDNPDGFSVPPAWVAVDDDEYSEWLHGLKSAEAYHANFLVWEWLGGHRAVAGACPRQRQPERDPGAEVERTRSPRPGRGESGQALVLRSRQARRQGRGRLGQRTDRFQVELNLQRHEEHPVMSLLTTPLESVECAVIWLLVGFSVVTWGLALVKGVQFARQKRQDRQFQKQFWSATSLDSAGEQAQDKQGAGARVAQAGFAAIQVQDNGQPDLAQSINHQDRLERALRQQIQRERRSLESGLAVLASIGSTSPFIGLFGTVWGIMEALKGISAAGSASLETVAGPIGSALIATGVGIAVAVPAVLVYNYFLRRLKLTAADLDDFAHDFYSLAQKSAFRVIVHPTAARQAGNPSRNVKEAS

SEQ ID NO: 16703 - protein, 238 aa, Pseudomonas aeruginosa
HGLLDPGQRRSPFRNQRHPAGRRDAGAAGGVHRHRAAADQLDPDQPAEDRIGGPAGAEGSPGGEHRWRRQAVRQQGRDPAGAAGEQPGRGQGEGRRGPRAVAGRRRGELRPGGEGHGFHRARRDHQAGGDHRTLKRIHAVRRRPGGQRFRPLRSGQGRAVFFIPDGRSSGVSAEAGLANASRTLSGARTSHAWALRPGVPAHPAPWRPPFLRLPIHRPSPRRTVRWDAGCGWRRCRSP

SEQ ID NO: 16704 - protein, 219 aa, Pseudomonas aeruginosa
NCFLFLREKRLRPYTSLVMNFSGGFSMHSERVRYVLVPGWYGSEDAHWQSHWQRALPNASRVEQQDWITPLRADWIAELDAEIRRQPGPVVLIAHSLGCVTVALWAAQAERRVRDQVRGALLVAPADVERESCAEALRNFAPISREPLPFPSVLVGSDNDQACSPQRAMHLARAWGAETVILPEAGHINVKSGHGAWEAGYRHLFRLQYLIDSQARRRA

SEQ ID NO: 16705 - protein, 170 aa, Pseudomonas aeruginosa
RARSADTGPSTRTRPLSPPSRAAGSRACTASAPSWAWRATSPSVPTCSSPVATARCVPIGCSANWQDNTPSTCSSALPSRSTATAIPPPSPADAWPASAAPRTWATTRAAGATRRRPGWTCGANPRPCWSAAGSWWCRWSRPSRTAASRPSSSVSTRWRWRARPACRWRR

SEQ ID NO: 16706 - protein, 342 aa, Pseudomonas aeruginosa
SRCPRTSASAAPTPRASCWRRRASPSWSSGPAGCTSRRRVSGAGDERHREPRGDAVCRPRRMPGRPGGGRPHRRSRTVAQAGPGGPPRQWRACRPAPGPDAGLGAEPVAVFQGNGRRRPAAWAHRCAPARRPWPTGARRRGGDAAYHRRREHPSRSDLGARPAGRGRRSRTAPHAGRRSGRARRTHRPARRSGGRHRRQPRRARPSALRRRRRPRGGASRLPPRSAPRPAAAMAQPRRRRWRAERQARCAAGDHERPRRYLRAAPRRPRRPRRDAGWRPRGARRRRQRQSRRASPPVRAGPPPAGAERFARRRRRPAGRLSFPRSPARRVRWVGWESLRWKP

SEQ ID NO: 16707 - protein, 336 aa, Pseudomonas aeruginosa
TAAARAGNNSSRGSSRRPRRRPRRSASTISAPLPGWSACAWSRHWRRLAMTDVARLLALRSFTELGARQRARALLDAGSFRELLDPFAGVQSPWLERQGIVPQADDGVVVARGLLDGQPAVLAAIEGAFQGGSLGEVSGAKIAGALELAAEDNRNGVPTRALLLLETGGVRLQEANLGLAAIAEIQAAIVDLQRYQPVVAVIAGPVGCFGGMSIAAGLCSYVLVTRETRLGLNGPQVIEQEAGIAEYDSRDRPFIWSLTGGEQRFASGLADAYLADDLDEVRTSVLAYFAKGLPARPRCRRAEDYLRRLGDLDTAEQPDAAGVRRLYQGLGQGDAT

SEQ ID NO: 16708 - protein, 402 aa, Pseudomonas aeruginosa
  UNSURE (96): Identity of amino acid at the above locations are unknown.
FPCPATNQGPFGGDVAQGRSGGAPAAPPRLSGSRGPCSGPGEGLIRKPSGPGARNQLARRRHQKQRVVEVQRAGNHRRRIGADGQPGDQPRRMPAXFQQAAGGDPGDQQAQLHRAGAAQGIGALQFGRRLAETVRRLLQAGAHRRFVGQGREHAGTLGALAGIGEQHAHASTSAIRQGSSSHSGASVPFASTRGRPSAHSRRATPPAGVGSCRSIRQGHCSKHCSRRSASSRGNGRGVRSSRSRSLSGCSTATPLASSKPAPPVTPQASPSAFSGARRSRKARQAGRSRSIAGSRWPSASGRKRRVIAANGIQPAQRCSRARPRTPMATRAGSAGARRTTTGQPAFSAAQTQAGAFSGKCAGAMPRSKSWGSGPALRRIGSGASRRRLEPRCELFAMTTARS

SEQ ID NO: 16709 - protein, 272 aa, Pseudomonas aeruginosa
LRQAVAHCAGEAETRLLAGAADAVAPTDALAVAVADGGRRIVEQGDASCARGHFAGLRAARFESGGRDQQAERPDRSAMGVHAFGGTQHRRLAVAPQLAKDAAQARIDAPMPLGGVGHFLETRPQAQRRGLHQAQVQVGMRAIAAAVHQGRLGRQFGFVDEGVHRQVGQAFAEVGTRRRREVRDGVHHQLLKRAGGWYSPPDHSTSSAMLFAASSSREASVRRMPRSSGSAISPSRRIRWVSRGSWRRPIGLIPATAAIIAWRSSRERALYR

SEQ ID NO: 16710 - protein, 133 aa, Pseudomonas aeruginosa
IITGASGMPVWRATSSASRRSTKVGLPPSWKVSTICTTSFLPRSSKASGSPRMSSQAGVEWRRPRGSWPMFGAPPKPARRPRVTVEEWPSPSTWRVAPMNRSTAYCPASWQNIRLERSEPSRPVKNTSGRWAM

SEQ ID NO: 16711 - protein, 141 aa, Pseudomonas aeruginosa
VWIAPISSRPSSSNWPMRKLCGPEKEKSSLRAMPSSNRSRCSGRPTLGMIMCRSCSLPGSTRASERERKSACFWLLPSSTTRSPGAISASSAATRRSRGSTAPSARPRTRSRRRCFSWRRRDHCGGGEIGVVMSAPGFTLS

SEQ ID NO: 16712 - protein, 103 aa, Pseudomonas aeruginosa
SSASRSHFSAATPGRRKPSAVYLSAGIRYRDRIMAKKFPLHPSHPERICWGCDRYCSAESMGCGNGASRTQHPSELFGEDWAGEWEVEGTEDAKEQDAPARQA

SEQ ID NO: 16713 - protein, 82 aa, Pseudomonas aeruginosa
  UNSURE (15): Identity of amino acid at the above locations are unknown.
APMDSPGTSPGGCPXVSSRRLAATPAISRHNCTARVPPKASALSSSAGAWPRQSAACSRQARTGGSSGKAASMPGRWAPWPG

SEQ ID NO: 16714 - protein, 142 aa, Pseudomonas aeruginosa
ANSTLMPRHPRSARGLPATAAPRCLSPAPGADPRPIRAGPRRPPGSAVAGRSGRDTARSTAAGAARHRAGTGAGCAAAGRGRCPDAARRPRWPARNRRRRSRPRPVPARSAAHAGRARHARPADRAASPARAGPALPGASAG

SEQ ID NO: 16715 - protein, 690 aa, Pseudomonas aeruginosa
SARRRPCPWRGPSPPDRARRSGGWPGSRGRGTRRTSPCPPAGRSADARRVGRGRRHPPPRPAPGGYPGPPRGGRRPGSARRRWPAARACVAPRGRPPAPRRRRRPGPSPRAARPRPGERAGTDCRDRARRPGNAPGSRPARHRRRATKQDRRDAARGYRPAPGTRPGHGKRTVGSCCISLAQPLVQPAHAGGIRLLGGIEVAQPPQVILGAAAARPCRQALGEIREYRGAYLIEVVGQVGVGETAGEALLAAGEAPDERPVARVVFSDAGLLFDHLRTVQAEARLAGHQHVAAQPGGDGHAAEAADRPGNHRHHRLVALQIDDGRLDLGDRRQSEVGFLQAHATGFQQQQGPGRNAVAIVLGGQLQRAGDLRSADFAKAAALESTFDGGEHRRLAVEEATGDHYPIVGLGHDALSFQPGRLHAGEGIEQLAEAARVKQGTGALARSQFGEATQRQQAGDVSHGQPPPVPAPGAGGPPREWRRNRGCGSTRPAPWTPRRPARRVVASAGRCRLPRSPPGCSARLRRPARAAPPGRRSRRSRPGRDRAPERRREIRRSGFPSQRLPAHPPDTAGRRSRKRQAASRSAAPPGEAFSASRRRSSSHRRRRPARLALPPAASTARAPSCIAARPTRPARCSTQVSSRTLMIASSASSLAFCSPAPPSRLRHSCGRPWRTARGKPRRASSRAPPTP

SEQ ID NO: 16716 - protein, 166 aa, Pseudomonas aeruginosa
RRRTRSPWLSPMAAAGSSSRAMRPARAATSPACVRRGSRAAAATSRPSAQIAPRWVFTPSVVRSIAASPSRPSWPRTPRRRASMRPCRWAASAISLKHGHRLSAEACIRPRCRSACAPLPRRSTRAGLGDSSASSMRASTARSARHSPRSAHGVAARFAMAFITSS

SEQ ID NO: 16717 - protein, 344 aa, Pseudomonas aeruginosa
FTPSSACNCTRTSASFALAAARLLSSSSGWISSLLTNSLPAPSMLTTRGSFCSGGATDSVFGRLIGIELVSSGAVTMNTTSSTSITSTSGVTLISERTSSLSWVEKAMSGRLLHVARGVAGLARGGGMDDDAERALLRQAVEVVGEVVEVGGGQLQAPQEVVVDQHRRHRDGDSHAGGDQRAADRPGHGLQARRAGRADPLECLHDAPDGAEQADEGRGRADRGEHRQARLQGTPLALDLLAQGAFETVLVVDRLGQVGLAVVLHLDRGEAGLGHAGAGALLVLRLLAGGVEAGGAPELLLELAVLALLPGELHALDQGQAPGDHGKADQQPDDGAFDGFERGG

SEQ ID NO: 16718 - protein, 345 aa, Pseudomonas aeruginosa
  UNSURE (49): Identity of amino acid at the above locations are unknown.
ALGAGGPESVSKEAPPEAAGRRSPARGKPPPPDRRRWTARGPAPADARXFPAGGWRRPRRSAGTTAPRGCRPRHRRSPVRPAPGRDSPPPAPGRRAPAVRRARPRACRDVGRPGRDRRTARSCLDIRDPPGVFQPQRRLGAFRQHPGPTLGPFAQGHAARRGRQLQVDPAGTLLEALQQAQRVIARERARGAQQQVEVAVRMQHGDPAGQLETGAAGHAPGQSQRVQRRTQVAQGTPGRQIAQHRRLALAQRFRAQAPGDCRQRHPAGPALLPRQAAHADGHPRRICRRTAHHHRPAGLQCRADPGRSILRQMRRRHAQEQVMGFRPCPATHRIRSEPSPAGAPL

SEQ ID NO: 16719 - protein, 311 aa, Pseudomonas aeruginosa
AVRDDHGSLLNSPLLAQQPAHPRRRLAVGRAEAAAEVARAAEDIGQGLAQAGADPHQVRRRRHLDGLHRKGPPEQAERRVAVDVVGHRRHLRRQRLQFLDAAQGDPRGGGLAHGVDHHPRIVQGDQAVGLVAVGEERAGHRLAHQQADQRMPGESGAGVGIHRPGQRLVDTQGLLAAAVGLARHVDDGQQRALAWRLAVGLQRLVDGGGQAPALEQPDLALASARERIVGIGHDGQETHRVAVQLGIGDAQRSRIAGTRREATGQRLEPGQATGSERLAHVASPWPSPWYSRRTPAASGCSAVSRSPSRRR

SEQ ID NO: 16720 - protein, 327 aa, Pseudomonas aeruginosa
RCRSTMAAWISAIAASPRLASCRRTPPVSSNSRARVGTPLRLSSAASSSAPAIFAPLTSPRLPPWKAPSMAASTAGWPSRRPRATTTPSSAWGTMPCRSSQGDCTPAKGSSNSRKLPASSRARARWRAPSSVKLRSASRRATSVMASLLQCLLQAQADHPGSGAEIVDADRRGRRRGRREDPREELLPARAAAVYRGHHLDAQRASGGRLEQHLQVAGADAAGQGATARRSAGGKFEGQGFHLRDSQPTHRTRRAGDRGKDRRPAGRRRRRAKRSAPAGGGPARTGGDARRDWRCRRRRAPRGRHPASRRGRRGRRGAARRYRRGRS

SEQ ID NO: 16721 - protein, 635 aa, Pseudomonas aeruginosa
GRPPPGRPGIRRGRHTASPRGSRWRSSPAPETRRRLVQPAGPLDQLGDALRRQQLARGVGAADAEVLGQRDQPFAAHPLGLARIVAQADRTDPRHRRDHRLAFLQGARLVQVGDAFLGEHMGDVVAIDHHRRQRHAGLARHLQRVETLDEGRLAAVLEGLDHLHHQLPAALQQGLGFAPHVQPGRRRVAPAARVVAHVRGAAEAGQASAGDGGGMAVAVDLEGSADEQVDGVLSCQLAEHPIGTQRAVATGEEHVGTLGDVALHAQLGAEAVHALDPAALDGGDKGRVRVEGPVSADLALQAEGLAVGRQDQLDGRGVEADAVVQRLHVVPLVDAADRHHRHQHVDRLDVARVAGEQRLDVERLVGLDHEVHPGRRDIHSRQVARVVDDTVDLDDDDAVAERGGLHQRRGVFRARPGVHVAFAVGDETGDQRHVGDQVDHQPRVQLDVGVDRADLQQAVFEQLADAQALRAGEGEVELARDAQFEQVEMLRAADAGHDHVQVVQLAGIDPRQRTGEEIRLLLVVAFQHHPIARRDQRLQRGDQAFARQHRAVSQAAHALEAPLLFLAAPRPLRRGRDRCRHVGSRFHAVVRSHVRQAARPVQSSRATNRYAKVNDLEDQARRRAWLSIRYCKRNR

SEQ ID NO: 16722 - protein, 179 aa, Pseudomonas aeruginosa
PAPNPTNSPRGPGTPGPANSYLRVAGTKGARLPGAQGPFGVGQGGPGDHPHPDGAAGAHGDAPLRAPGRGAFGGARGLRSLRAGSAYRRRHAEAGAHRFLRAGVRPGDPIQAAGGQGPRTGDPPACPRHGLATPAGARAPAPGPRPGLAGLPRRRRAGRSAAGGQRRSAVHHVHLGHHR

SEQ ID NO: 16723 - protein, 472 aa, Pseudomonas aeruginosa
AQGYRPRQRWPRGRGALRGPHYLRHAGRRRLVGDLRRRLGGRPLADRLRPADVRLYHGVLRRQAGAHAGRRRLLAGDRRAQGEQPVLRADGDPRDPQGRPAWRTGEALRPGFAAPPVPGRREARQQHPALAGGAHRAAGPRPLVADRDRLAGDRALHRDRRPRPAGRLDQPRGARLPRAGAGRRRPAAGSEPPGRDRHRPAVAAGLRTDPLGRPPALPAGLPGQLSRLLPHRRRRLSRRGRLRLHHGAHRRRDKRFRASPLHRRDGGTRGAAPGGCRVRGDRRAGRTQGPRAAGPGGAQGRCRDRRRATAARAGGAGPRTDRRAGLLPAGGGGQAAAEDPLREDPPRGAAQDRRWRGLRGAIDHRRPDDPWRDRGCAEGAQGGIAKARGTAVGWKTPRPVVLPFRTLRERSCPWPGRSPAARGRGAGWSRRCGRNARRRWSSTRLRRSARRPAPAAGAARSCRRSGTSSGCT

SEQ ID NO: 16724 - protein, 342 aa, Pseudomonas aeruginosa
GVCSWWVPSMGRSQDGLFQIAEKQAIREDSFKGILKMLRYDDLQVFVHTSDSGSLSAAARQLEISPAVASAALKRLESELEVRLFARSTRSLRLTPEGDAFLLHARASLRSLEEGRRLLQGGKDQIAGVLQLSAPSDFGRNLLLPWLDEFQARYPQLSLRLLLGDRVTDLYRQPVDVAIRYGAPADSSLVALPLAPDNRRVLCAAPAYLAERGEPRQPDDLREHNCLLYQLGGRVHDRWAFQRGRRSLTLTVAGDRVCDDADVVRRWALAGKGLVYKSWLDVAEDVRAGRLRLLLPEWQGEATPMNLLCTHRAQLTRPVTLLRAFVCERCDALLAEAPWTRN

SEQ ID NO: 16725 - protein, 391 aa, Pseudomonas aeruginosa
TPSTTWRSTPSARLRCSSAARSASKSGKSRWLWVSTRRMAAGSVAQLELPGDGVQARPVVVLLDRAERQFEGVGGDQRVLLVDRVDLQRHEVEQLGVAEGRHPQAFGPTVGARLEHIEDAFEEYIGSGHQGVGQVAQALEQLLHQAASALAAEHLGMLDDDLAAEVLQRLAEAGGAVVADDQVRPRAEQGDMARRRLQQGFGEAARGVLVVADHRGEALRVELAVDGHHRQAFGDQPGMGIIPGRQATGDDQRVAAARAEQVDHLALGLRLVVGAGDQQLVAARPGALFELLGEAGVAGVFKVREDEAEGAGLPAAQAGGLLVRLVAVFLDHGKHALDGGGADAPLGGLAIDDVAGGGHRDPGQAGDITEFQTDLYWRRRQVGLQGSIIIG

SEQ ID NO: 16726 - protein, 561 aa, Pseudomonas aeruginosa
DGEPFAPEEVSMLELDTRQIRMGQRAADKAEALRLLGAALVADGLAAPGYAEGLKAREAQGSTYLGQGIAIPHGTPDTRELVFSTGVRLLQFPEGVDWGDGQQVYLAIGIAAKSDEHLQLLQLLTRALGEADLGPALSAAASAEEVLGLLQGAPQELALDAQLVGLGQNAEDLDELAWLGARLLKKAGCVENGFAAVLQQTEPLPLGDGLCWLHSEQLVKRPGLAFVTPAQPLQHQGQLVTGLFCLASLGEAHQALLERLCDLLLEGRGAELVRATSSRSVLAALGGELPPDWPSARAVLANPHGLHARPAQALAQLAKGFAGEIRVRLADSEAAPVSAKSLSKLLALGARRGQTLEFSAEPAIAEDALPALLAAVREGLGEEVEALAEEALPDAVGEAEEDARPAPLRAGERLQAIAASPGIASGPAHVQVAQRFEFQPRGESPAHERERLLRAKRAVDEEIVGLVERSTVKAIREIFVTHREMLDDPELAEQVQLRLNRGESAEAAWSRVVEDSAAQQEALHDALLAERAADLRDLGRRVLASSAGWRRRASRSSRTSW

SEQ ID NO: 16727 - protein, 188 aa, Pseudomonas aeruginosa
PSSSSASAIRSAWRGSKRASWCSHWSRRPEMKLAIVTACPGGQVTSVLAARLLRGAAERLGWETCVEANAGSRPEGELSAEQIAEADWVLLVGVEPLAAARFVGKPVYRARPAEALADPRGVPQWAAGLDNLEGRRGPRRAWLPPEAGNGSPDISAGNSLVQTGVVATLPWPSKGFPLPRGGHWGFLF

SEQ ID NO: 16728 - protein, 563 aa, Pseudomonas aeruginosa
PPRIPRIRPGDPAPQGPLTATCGLPGRRGRACPAPRGPSGSARADRGIIHIPMVPQAPMAMLPCARLGAVHSVVLGGFAPYELALRIDDATPKLVLTASCGLEFDRVIQYKPLVDKALELAIHQPAHVMVWQRPQAPARLHPGRDLDWQDCLAAAEPADPLPVASGDPLYIMYTSGTTGKPKGIVRDNGGHAVAVRYAVRTIYGMQAGDVWWGISDVGWVVGHSLIVYGPLMCGCTTVFYEGKPVRTPDAGAYWRVIEEHRVNSLFCAPTAIRAIRKEDPHGERVKRYDLGSLRHLFLAGEKLDSSTQHWLEEHTGRPVHDHWWQTETGWPVTAPCIGIAGHDLRAGSTNRAVPGYHVQVLDDEGRPLGANRQGAIVIALPLPPGCAQTLWGDHPRYLQAYLGNYPGYYHTGDGGYLDEDGFVYIMGRTDDVINVSGHRLSTGEMEERVAQHQAVAECAVIGVRDELKGHVPLGLVVLKDDAGIAAEQLQRELVALVREQIGALACFQRVVVVKRLPKTRSGKILRAVLRKIADGEDYAAPSTIDDPTILGEIEAALRVRKAG

SEQ ID NO: 16729 - protein, 484 aa, Pseudomonas aeruginosa
GGKRRAPWSCRSEPFENDLALGPAALQQRVGAAQVGRVDAAEMLADGGLQHAFVDQPGDPLQQPVLLDHVVGLEHRAGVHELPVQRQALLLQLADVQRRRVVDQRQAALRAQRGDDLFEVLVGVGQAGDVADLGDTDPLQLFGQRLAVVDHMVRAEVADPGLGLCARSGADHVQAGQLPGQLDQDRTDPAGGTDHQQALALVGLAFGDLQALEEQFPGSDGGQRQGRGLGEVEAFRQVPGNALVDPMQLAVATGAGDVPGVPDPIARTEQADLAADRAHHARRVPAQHLGLAGFRLGALADLGIHRVDRDGADLHQQVARARRGLGQFEVEQGVGMVDGQGLVVTDSFHGNSGKRASGEAIELVDLHVLQQGFVAAAEAQEVFGVLVPLQGGVVAPLLDHVEQVGVVAVLVQVVLQATSLGARRGDQGAQFAFQGLGVAGGGGDGGDQGEGCAHGGFLRWGGVRMGYFKSLKNRLSGKTLSKES

SEQ ID NO: 16730 - protein, 164 aa, Pseudomonas aeruginosa
GWRWSPRGRGARGSVPAGGIPRPAAVGPRTAPAGRRGRGVPGSSPGRSRRPRRASSRRAGVAATGAGRPGAAGGAAPGRRGAGRAPRTGHPRPAPGPRPVASSRGRRRAPPGARPPARGCVAAARRGRRRSPGSRGGCGCRPGAWRPAQSRSLSCRGTACRPGR

SEQ ID NO: 16731 - protein, 129 aa, Pseudomonas aeruginosa
ASCSPSARDAARRWSSAPSRRSPRTRCQPCWPRCARGSARRSKRWRRRPCPMPSARRKRMPGRRRCAPASACRRSPRRRASPVVRRMSRWRSASSSSRVASRRPMNASACCGPSGRWTRRSSAWSNAAR

SEQ ID NO: 16732 - protein, 346 aa, Pseudomonas aeruginosa
  UNSURE (274): Identity of amino acid at the above locations are unknown.
PGAAPARGNPAGRPATGDHGRGALCGVARAGAGPRGGLLQRRHQRPDPVHPGYRSRPPESFGPGRRSASGGAATDRHDRPRRPRRGQVGRRLRRTGGRPAGVAAAGRPGSGRAERLGAQHRPGQGRRARTAAGRCARPGPQSPGPGERRRGPGPGGSGGAVMARILTITLNPALDLTVRLRQLELGAVNRSEAVLTQAAGKGLNVAQVLADLGHRLTVSGFLGEDNQPPFTAMFQRRGFADAFVRVPGETRSNIKLAERGGRVSDLNGPGPGGXRASPGGVARTPPPACRGARAGGGRRQPAARGRAGMAGRTAAALAAPRPEGRLRQQWRGPARRCEGCAVDDQA

SEQ ID NO: 16733 - protein, 357 aa, Pseudomonas aeruginosa
GCARRDSKGQGHGGRVENAAPRGPAVQNPSRTILPLARPLSSSAWARRRLVASMRPKCSPTVVFNTPSSISPATRSSSRCCSIMSSVWNIERVYMNSQCSDRLFCFSLPMSSDAGSSISARRPCGRSAATICSRCWSVWVRLATWLTSATPIRFSSSASGLPWSITWCAPRSRTQAWVSAREAVPITFRPVSCRASWTRIEPTPPAAPTTSRLWPWSALPSAICKRSKSSSQAVMVVSGRAAAWAKSRLFGRCPAMRSSTRCSSLLLPGRVMSPAYQTRSPGRNRLTSLPTARTTPAASQPSTLAWPASGWARWRTLVSTGLTEMARTSTSRSRGPGVGSGSSRSSRASGWSMGRDW

SEQ ID NO: 16734 - protein, 416 aa, Pseudomonas aeruginosa
KTGYQGRLFQRNLENAALRRPPGVRPHQRQRLVVRRRAPVGDFPGGGQRGAEAPGKRAGGTPVRPLHPQPAPDSRGRRVPPACPRLVAQPGGGAPVAAGRQGPDRRGTAAFRALRLRPQPAAALARRVPGALSATEPAPAARRPGDGSLPATGGRGDPLRRAGRLQPGRPAAGTGQPASALRRTGLPGRARRAAPAGRPARAQLPALPTRRPGTRPLGVPAGPPQPDPDGRRRSRLRRCRRGAALGPGRQGAGLQVLAGRGRGRARRAPAPAAAGVAGRGDADEPLVYPPRPVDPPGDPLARVRVRALRRIAGGGSMDEELNRAASLAIELADVDSAARLHERLREALALPPWYGCNWDAFWDAISGLVPMPRRLRLQGWSDFARRLPEEAAQLSACLEALRETYPQLAPEVLRDA

SEQ ID NO: 16735 - protein, 268 aa, Pseudomonas aeruginosa
SVPAEQLGGVAAAARRQFLGVDPAQLGEGAADVRQVLRTVALAGMHRWRHVRRIGFQHDGVGRQLRRHLAQAIGLRPGRRAAEAEAEAELEVLAGFLAAAGEGMDDAAALQADALEGGDGRRVGAAHVDQCRQAEFRGQPQLGLEQRLLGVAVEVFQVVVQADLADRAELRLAAQALQPLAQVVQVLRAVPRQVDGVQAERRVQAILGLRQVPDPLPVLAVDAEHHLALDPQRAAALQQRGAVGVEVREVEVVVGVDQAHGGRLSRAA

SEQ ID NO: 16736 - protein, 439 aa, Pseudomonas aeruginosa
GGFHARTRYPADPHGPARRGQGRSPAPARRGAGRRRPGRARLCRGPEGARGTRLHLPRPGHRHTPWDPGYPRAGLQHRCAPAAIPRGSGLGRWPAGLPGHRHRGEVRRTPAAPAIAHPRPRRGRPGTGAERGRQRRGSPRPVAGRAAGTGAGRTTGRPRPERRGPRRTGLARRAPVEEGRLRGERLRRRAPADRTVAAGRRAVLVAQRTIGEAPRAGLRHSGATVAAPGATGHRAVLPGQPGRSAPGAARTPVRPVAGRAWRRAGARHQQPQRTRGARWRAAAGLAQRASGPGQPAWPACPPGAGAGAAGQGFRRRDPGTPGRQRGGPRLGEEPEQAARPRRATRPDAGVQRRAGDRRGRAASLAGRGARGARRGGRSAGGGGLARCRRRGGRGCPAGAAARRRAPAGDRRVAGHRQWSGACPGGAALRVPAAWRVAGP

SEQ ID NO: 16737 - protein, 519 aa, Pseudomonas aeruginosa
TRAPAAGQAGGGRGDRRPGRTQHGEGDPRDFRHPPGDARRSGTGRAGATAPESRRKRRSGLESGGGRQRGATGGAARRAARRARRRPPRPRPAGAGQLCGVEAPREPEQPYILVMDEVGPSDVARLDAQRVAGILTARGGATSHSAIIARALGIPALVCAGAAVLGLEPGTALLLDGEHGWLQVAPSTEQLQQAAAERDARQQRQARADAQRLEPARTRDGHAVEVCANLGDTAGAARAVELGAEGVGLLRTEFVFMNNARAPDLATQEAEYRRVLDALDGRPLVARTLDVGGDKPLPYWPIPHEENPYLGLRGIRLTLQRPQILETQLRALFRAAGERPLRVMFPMVGSLDEWRQARDLALRLREEIPLADLQLGIMVEVPSAALLAPVLAREVDFFSVGTNDLTQYTLAIDRGHPSLSAQADGLHPAVLQLIDMTVRAAHAEGKWVGVCGELAADPLALPLLVGLGVDELSVSARSIALVKAGVRELQLVAARGLARKALGLASAAEVRALVEAEVQ

SEQ ID NO: 16738 - protein, 259 aa, Pseudomonas aeruginosa
  UNSURE (57): Identity of amino acid at the above locations are unknown.
RSAASSAKTTSRRSPPCSSVVASPMRSSGCRAKPAATSSWPSAAGASATSTGPGPEXDERAQAGLLERLHRLAGEHELAVVAGSLPRGVEPEWLGELLRRLRRLGLKVAFDSSGAALREGVKAAPWMIKPNLEELADLCSAPMDDLAAQRQAAERLRQDGVGQVVISQGAAGVNWFAAEGAWQARPPAVEVASTVGAGDSLLAGMLHGLASGWPAERVLRQATAIASLAVTQFEFGIGDPQRLARIEAGVVVQPLVEEA

SEQ ID NO: 16739 - protein, 220 aa, Pseudomonas aeruginosa
  UNSURE (71): Identity of amino acid at the above locations are unknown.
SSTAQPSHLRAGPRHCCRRRPSGRGAASAAAVRPAIPARPRAAGCRRPPPARAPRQAGGGVRATPPGLARXPPGPGPLRSLTRPPRSASLMLLRVSPGTRTNASAKPRRWNMAVNGGWLSSPRKPLTVNRWPRSASTWATFRPLPAAWVSTASLRLTAPSSSWRRRTVRSSAGFRVIVRIRAITAPPLPPGPGPRRRSPGPGLCGPGRAQRPAAVRARRP

SEQ ID NO: 16740 - protein, 120 aa, Pseudomonas aeruginosa
SPVAGRPAGFPRAGAAPGHAPGAIRRGCRPSGTSPAAAAPRRRGTARATGSRGSAVAAGSSGYRAGPDRDSLRGESASTAAACPRRHPGSAPPADVRRGRRAPDGIPLPGSPGPARGRCS

SEQ ID NO: 16741 - protein, 600 aa, Pseudomonas aeruginosa
GCRRPAGRRGGRHRRGRPRPSPGCTAAPARAAPPPRRAGQHPPAEVAEVGGALGEQRVVQRLLLRRAVFHHPTPGRFGAFAAIQAQLHLLGQFRIVEHLPVGDENLADRLHRAAFDQADDLLVHRPLGPQQALAFMGRRLATRLELEALRHLDMRRTTGDARRRGDRLQALAGAQRRRPGILFRLADGIGQGLLRQRFDLLAEPLAHRGQQGWQRVLGDRRLGAELQRLAASRAEGEQLAQALRRDGGRLAVGQAYPDLAGETLGQLRQRLRRAGMQAMRVGQDRSRAGPVRRQLATERREYAAAAGGAHQLGATPFQQQVAQAFEQRLVRFAQAGQAEQPGDQLPLVLQRLRRSDEGQPGALHQLFAVQPAQPVAQRQRFGLLEHGGEAVLHAAGLLQQARAEPGQFVEVLGVLAEADQLCVQRQFLRRALQQAEDFLGAGGRAQRRSQVGLAEGAGEQLQELQVFVGLRRDADGQVDLLAIAPVHSLGELQQAHTGAEDQLAGIRGPMGYGDALAEVGGALCLARLQALGIAGRGQAVGDQRRAEQAQGFGLVRGALAHADLPGIEFEHGNLLRSERLPVSRPDRPAAPRRGRGMCRR

SEQ ID NO: 16742 - protein, 343 aa, Pseudomonas aeruginosa
SLKPNLSSPPVEIGLKLSDIARLAGVSVTTASYVINGKAAQRRISAATVERVLAVVEEHGYQPDQQAAGLRRGQTRTLGFILPDLENPSYARLAKQLEQGARARGYQLLIACSDDEPETERQVVNLFRARRCDALIVASCLPAGDDTHARLVAEGLPVVAIDRQLDPQRFASVISDDQDAARRLTETLLQPAPRHIALLGARADLIISHDRAAGFRQALKDFRGEVIVEHAEVFSRECGRRLMEQLLERLGYLPDALVTTAYVLLEGVFDVFQARADGWPEGLRVATFGDTQLLDFVPLKVNSIYQQHALIAANALELALRAVEENDYRPGLHAVPRQLKLRD

SEQ ID NO: 16743 - protein, 315 aa, Pseudomonas aeruginosa
AGRHAPGRHPQPPRLPGLRRRPRRAAATQPRAGGRAPGGARRLPRELATGLGPGAGRGWPVRGARPAPRLPGAAPPAAPGRPAPVAATPARRDEALRGRRDRPGLLPGTPRPRRPAGAVRGPTAAGRGIPPAGTDPRAPRPRGDHRHPQAHPPGAPRHHPCLRRQPRGSPRVPQARLPPRPRRRADLAAGQSPAQGGGGAAGRRHRAGNRCAGHGAIDASRPAQQSGAPAGHLPRPRRAARGRRRGTGGEQQPQRRRAVRLGLIKRRAGLPAPVAGTSRATPPGRPTAAPLPPAGAGRSRSSLADAIAGASAPGR

SEQ ID NO: 16744 - protein, 369 aa, Pseudomonas aeruginosa
WRPRRHPSCIRTTAATPGPRAGVRASARRCPRPPARWPGSPPGSVPRPWSLRQQCVATLAHERAQEGHRAGQLGAVGTQEVHRRRLALPLRQQQAQAPGAHVLGHVQPGLVDQPLAGQGPAPHHVGIVADAIAGDRQGQAAAAPLERPAVVYPAAELVEQAIVLAQVVRLARLAALGQVGRCGAEHSPVVRCQRQGDQAGVGRRAVADRHVHRLPVEIRHPVAEQQAQAQLRIARLELVEPGQQQVAAEVGGRGKLQYPGDLVLAALQQPAPLLQAAQRGAGMQEERVALGSQAQAAGGAGEQAYLQLAFQALQRRAGHRRGNLQLARGGGQRAAVAGVDEHLEVVVTQHFQDSFERVFPDSLFFSDLK

SEQ ID NO: 16745 - protein, 391 aa, Pseudomonas aeruginosa
  UNSURE (385): Identity of amino acid at the above locations are unknown.
GSLPVVARGWRDPNTNHWCLEPQKRNPQWPPRGRGNPLDGQGSVATTPVWTRLFPAEISGDPFPASGGNQARRGPRRPSRLSRPAAHWGTPRGSASASAGRARYTGLPTKRAAASGSTPTSRTQSASAICSALSSPSGLDPAFASTQVSQPRRSAAPRSRRAASTLVTCPPGQAVTIASFISGLLDQWLHHDARFDPRQALRIADAELELGHRQAGDGGGLTQHPLGRPAAGQAVQHAGQQGIAGAHRAGHFHRRRPRLPGTLGGEPVDPRGALGNHHLAYPVLAQAFGRLALCGQVVHRRRAEVGQFLEVRLDHPRRSLHTFAQGRATAVEGDLQAEAPQAPQQFAQPFRLDPARQAAGDHRQLVLPGKPVEAFEQPRLGSLVXLRARAR

SEQ ID NO: 16746 - protein, 869 aa, Pseudomonas aeruginosa
SSGSAPLLHLRFHQGPDLGGARQAQGFAGQAARSDQLQFAHAGLDQGDAARRDAQLVHSQADQQRQRQRVGRQFAADADPLALGVGGADGHVDQLQHRRMQTVGLGRKTRVAAIDSQGVLGQVVGADAEEVHLAGQHRREQRRRGHLDHDPQLQVGQRDFLAQAQRQVTRLAPFVEAADHREHHPQRPLPGGAEQRAQLGLEDLRSLQGQADTAQAQIGILFVGNRPVRQRLVPADIQGPRHQRTSVEGVEHPTVFRFLGRQVRRAGVVHEDELGAQQANALGAQLHRARGAGGVAKVGANFHRVAIAGPRRLQPLRVGAGLALLAGVALGGGLLQLFGARRHLQPAVLAIQQQCRARLQAEHRRAGADQCRNAEGAGDDRAVRSGAAARREDAGDPLGVEAGDIGGADLVHHQDVRLLRLARRLHPAELASTRRPRSRRSAARSASSASCSASCCAALSSTTRLQAASALSPRFRRSCTCSASSGSSSISRWVTKISRIAFTVLRSTRPTISSSTARLARSRRSRSWAGDSPRGWNSKRCATWTCAGPLAMPGDAAIACRRSPARSGAGRASSSASPTASGKASSASASTSSPSPSRTAASKAGSASSAIAGSALNSSVWPRRAPRASSLLRLFAETGAASLSARRTRISPAKPLASCASACAGRACRPCGLARTARALGQSGGSSPPSAASTLRLLVARTSSAPRPSSNRSHRRSSSAWCASPRLARQNSPVTSCPWCCNGCAGVTKASPGRFTNCSLCNQHSPSPSGNGSVCWSTAAKPFSTQPAFFNRRAPSQASSSRSSAFWPRPTSCASSASSCGAPCNRPRTSSALAAALSAGPRSASPRARVSNCRSCRCSSDFAAMPMAR

SEQ ID NO: 16747 - protein, 296 aa, Pseudomonas aeruginosa
SPPTPSNWRSARSRRTTTGRACTPSPGNSSCATEPAAMRLVDTHNHLDFPDFDADRAALLQRSRALGVERQVVLGVYRENWQRVWDLAQAEDGLYAALGLHPVYLARHRPQHLDDLRQWLQRLRGETKLCAVGEIGLDYYLEHLDRDAQQALFEAQLRLAAEFRLPALIHVRRAHAATIATLKRIRLERRGIIHAFAGSREEAREYLKLGFRLGLGGAPTWPQANRLRKVAAELPADAIVLETDAPDMAPSMHPGQRNSPEHLPDICRALAELRGVDAEELAASSSRNAAELFGWD

SEQ ID NO: 16748 - protein, 210 aa, Pseudomonas aeruginosa
LRPIEGTHHEHTPHPDRHHHRRPRPRRGPGTRIARPGRPVARRGWLPAVRPAPGPPRLPPVLHDRAVARRRRPGAAPEHRTLPALQPRQRSPAAEREDRPTLSPRLRPVSRSSHESCRLLPIPAHRPSRRPARPRTARAHAGPARPAGGGPRHLGQPGGYQGPPARPAGSRPGQGAGLGRGGRGARGRQRGQPVPSWRSGLVRRGHHPPR

SEQ ID NO: 16749 - protein, 175 aa, Pseudomonas aeruginosa
RSRPGGSLPAAGLRRPAPARGSRAPRGWSSRPAGRGRRSRCRARSPASRSRSATNGRGPAARCAPPASAGCCCRASRRPGTGGAANPGRSASPVRHAGLPCGSRGSPSARRTGCSPCALRSPASRRRRPACAPACLRRTPWYSRTSAGRRRSASGRPPSRRRRSPTRRRRPACRR

SEQ ID NO: 16750 - protein, 166 aa, Pseudomonas aeruginosa
GVSPWLQGAGATRTQTIGVWNLKRGTPSGPRAEGETPWTAKEVSPPRQFGQGCSPRRYPGTRFRPPGATRHGVVPGDLPGYPGRRPTGGRRADRPAPRRDARDTPACRRNAPPPAARRRPAGPSRLRRSVRRSVRPRASTRHSPRRRFPSPGARRRPAAGARRARW

SEQ ID NO: 16751 - protein, 486 aa, Pseudomonas aeruginosa
  UNSURE (163): Identity of amino acid at the above locations are unknown.
RSTRSAGQPLARPCSMPASRESPAPTVLATSTAGGRACQAPSAANQLTPAAPWEITTWPTPSWRRRSAAWRCAARSSIGAEQRSASSSRLGLIIHGAAFTPSRRAAPLLSKATFRPRRRKRRSSSPSHSGSTPRGRLPATTASSCSPASRWRRSSNPAWARSXASGPGPVEVADAPAALGQLDVAAGFARHPDERIGEATTLEHGGERRLVVFAEEAADRQPMAEVGKHLGDVQTLAGGLGQHRLAAVNRPQFQLAQAHGEVQRRVQGNRQDPRHYCTSASTRARTSAALARPRALRARPRAATSCSSRTPALTRAMLRAETLSSSTPRPTSSGNASGSAASSPQTPTHLPSAWAARTVMSISCSTAGCRPSAWAERLGWPRSIARVYWVRSLVPTLKKSTSRASTGASNAAEGTSTMIPSCRSASGISSRRRSARSRAWRHSSRLPTIGNITRSGRSPAARNSARNWVSRICGRCRVKRIPRRPR

SEQ ID NO: 16752 - protein, 275 aa, Pseudomonas aeruginosa
GFSSWGIGQYGSGLSPPTSRVRATSGRPSRASSTRRYSASWVARSGARALFMKTNSVRSRPTPSAPSSTARAAPAVSPRLAQTSTAWPSRVRAGSSRCASARAWRCWRASRSAAACCNCSVLGATCSQPCSPSSSSAVPGSRPSTAAPAQTNAGMPRARAMIALCEVAPPRAVRMPATRWASRRATSEGPTSSITRMYGCSGSRGASTPQSWPAPAGRGRGGRRRARRAARRAAPPVAPRCLPPPDSRPLRRFRRDSGAVAPARPVPDRRASPGG

SEQ ID NO: 16753 - protein, 332 aa, Pseudomonas aeruginosa
YPCPAGRRRPAGGGHRPPARPAALRLGDQRRPGRRAPPHRNPVATGAAPYRPARRAGGPDHQPRPRRRLPPGAEGLPRRGHRRACRGVQPRVRTPPDGAIARAPGLPARRPGDHCLCTPRRRLRCVPGARRRLARRLAGGDLRRHPVARLRAAEGQLDLPAARADRRQRPRTGAPRGRGERLPAGPARRPPATQAARLSRPPCAWSTPTTTSTSRTSTPTAPRCCNAAARWGSSARWCSASTARTGNGSGTWRRPRMACTRRSACTPSTWRGTARSTWTTCASGCNACAARRSSARSARSAWTTTWNTSTATPSRRCSRPNCGWPRNSACRH

SEQ ID NO: 16754 - protein, 536 aa, Pseudomonas aeruginosa
STCAAPTRRPSPPSSASAWSAAASSMPSPAAARKPASTSSSASASASAARRPGRRPIACARWRRSCRPTPSCWKPMRRTWRHRCIPASATVRSTCRTSAAPSPSCAGSTPRNWRRAAAATPPSCSAGTDQASRRTSGASCGYVSRNASRQADSCAASSGRRRAKSLQPCRRNRRGIGTRPLMASQKASQLHPYHGGNARASRRRSCKRAALSTSASSMARLAARFSSSSMEPPPAMRRNARTRTRARGSPGGSTGRGGYTRGSSASPRPATPAAAGAGARRARPRPRPARTCRPAPCRPGPSAAPRRHRRRRDRRRPSGSGCGGPAGTPSGRVPGRRVGRAGNCARAGRPAGAARRARPGRPVRRRALAGCPVPAAGRPGWSRPARRSGSPRPPVAGRDPSPGRRAAGAGSVADSAPGTRRARAAAGCGRSRRARKAAVPRRSGPCRPAATGAPPPGCATRRGHAGGTRRPRESGAGCGWSGRTGVPPARFPGASAPRWPPPGKSPTGARRRTTSRCRWCGRTPGGRRNAAFSRFL

SEQ ID NO: 16755 - protein, 117 aa, Pseudomonas aeruginosa
PVFQRFEIAHPDSAPSKEPTMSTPLTLIATITAAPGHAEALERELRALVAPSRAEAGCLQYDLHQDRHDSHLFYMIEQWRDDAALERHQNTEHFLRFSRGNEALLQNVKIDQLYRLA

SEQ ID NO: 16756 - protein, 344 aa, Pseudomonas aeruginosa
GPFPGVPMKAVGYYQSLPIDHPDALLDLELPEPTPGPRDLLVEVRAISVNPVDTKVRQRAQPEAGQAKVLGWDAAGVVRAVGSEVSLFRPGDRVWYAGDITRPGSNSELHRVDERIAGHLPKSLDFAQAAALPLTTITAWELLFERLQIAEGKADQGQSLLVVGAAGGVGSILVQLARQLTGLNVIGTASRAETQAWVRDLGAHHVIDHGKPLAEELKRIGVAEVSHVASLTHTDQHLEQIVAALRPQGRLALIDDPASLDIGKLKQKSLSLHWEFMYTRSMFQTDDMIEQHRLLERVAGLIDEGVLKTTVGEHFGRIDATNLRRAHALLESGRAKGKIVLEGF

SEQ ID NO: 16757 - protein, 565 aa, Pseudomonas aeruginosa
TAGPRGAAFSTLPPCPWPLLSRLAHPQRSLDLAKDRRVVDGRWRRVVLAIGDLAQHRAEDLPGAGLRQPLDHHHPLEAGQRADLFADQRHQLALQLLGGDPGIVLEHHQAQRHVALEFVPHADHRALGNRLVLRHAFLHLAGGEAMPGNVYHVVGAPHDVDEAVLVEIAAVAGVVVAGIVAQVGLQVARVVAPEGLCAARRQRQGDDDRALAVRSQRPAFVVQHLHVVAGHRAVGRAGPQVVAGDPDAGRGHRPAGLGLPPMVVDRPPGVLLQPVLGAAVELLAGQEQVAQRTQVVALHPFAMRVFLADRADRRRRAEQAVHPVLFDHPPVGAGVRRAHRLAFVEHRGTAAHQRAVDDQRVADHPADVGDPPPDVAGLHAVDSADRVAHRDRVATVVADDTLGLTGGARGVHDVQRIAAGHRQRIGRLGGGEAVLPVQVAARVQARGRLRALPDHDVGRLVDRQFEGLVHQRLVLDHPVELQPAGSGEHQLRRGVVDTQSQLVGSEAPEHHRMHRAQARAGEHRHGRLRHHRDVDDPPVRPGRPRRAPGRRAGAPPSSRQPAGSC

SEQ ID NO: 16758 - protein, 438 aa, Pseudomonas aeruginosa
PTSSTWRQRRGRWPASFAGSRAINGSLRHPLISCGATTLASRRGRLTSLRGEDMNMHADGEQITAIDTRERILLTGATGFLGGSVAAQLIAAGHGANLSFLVRAESRQQGLERLRGNLLMHGVDEADCLALRAEQILCGDFLDTSWLARETPRLMQVERVINCAAVASFSKNPTIWPVNVDGTFAFADVLSRSKRLKRFLHVGTAMCCGPQRESPISESWEFPAAEQQLVDYTASKAEIERRMREELPGLPLVVARPSIVVGHRTLGCQASGSIFWVFRMGFALESFTCGLDEQIDVIPVDYCAEALIGLALKPCLGHSLYHISAGHRAACTFGEIDEAFARANGAAPVGERYRKVEVDDLKELAKSFESRIGPANPRLVLRALRLYSGFADLNYLFDNSRLLEEGISAPPRFTDYLDVCVQSSSAVSIPAQMQWDFK

SEQ ID NO: 16759 - protein, 115 aa, Pseudomonas aeruginosa
VRRRGRGCSAPPCRSASGSCGPGRSRTATAARPCRPGWSGGCARSSPRSPPSRPAGWYPWPPSRATSRCRIPCRRRSPAGCRPPGNAWPRRRSPVSRRWARTGYCRLPRRRASRS

SEQ ID NO: 16760 - protein, 366 aa, Pseudomonas aeruginosa
GMPGTIVRGQGDNPMNTLLMHCRPGFEGEVCAEIAEHAATLEIPGYAKSKPASAHVEFVCQDADGAERLMRRLRFADLIFPRQWARGPGFIELPESQRIEVLLAELASYPVCGSLWLEVLDTNAGKEVSTFCRKFEKPLRAALVKAGRLQEDPALPRLLLTFRSGREVFVGLAEPRNSALWPMGIPRLKFPREAPSRSTLKLEEAWHQFIPRSEWDKRLAPDMLAVDLGAAPGGWTWQLVNREMRVTAVDNGPMAENLMYSGLVDHQKVDGYQYRPRQRVDWMVCDIVEKPARTGALIETWIGEGLCREAVVNLKLPMKQRYAEVRKILQRLRESFDARGLKVAIGCKQLYHDREEVTCHLRRLER

SEQ ID NO: 16761 - protein, 107 aa, Pseudomonas aeruginosa
GAASFRPGTGDRPRRMRDNARILLRSFPMTHSVDAILDATGLNCPEPVMMLHNKVRDLAPGGLLKVIATDPSTRRDIPKFCVFLGHELVEQQEEAGTYLYWIRKKAD

SEQ ID NO: 16762 - protein, 338 aa, Pseudomonas aeruginosa
WSDRCGRPGVRPRMSMDMFRLGLVVNPLAGLGGPVALKGSDGVAAEALARGAEPRALERTRIALECLLPLVEKIEFLTFPGAMGGELLERMGFRHRLLGEWQGAVSSAADTRLAIERLQEAGVALILFAGGDGTARDVAGVVREQQPVLGIPAGVKIHSGVYAISPRAAGELARRLVEGGLVRLASGEVRDLDEEALRAGRVAARWYGEMTVPEEGHFMQHVKQAGMESEELVLVDLADWLAENWEDGVRYVLGPGSTLHGLARNLGLETTLLGVDVLENGAVIARDVDEARLFELVDGHPAYLLVTAIGGQGHVIGRGNQQISPRVLRAIRLKRMRV

SEQ ID NO: 16763 - protein, 230 aa, Pseudomonas aeruginosa
SGSIGFPTPTAYEVWQVVAEMEPPGRLAVGHPDSRPWRRGADGQPVHGAHRRTARHPGHRRRALRVSLHGPAPRGRPQASAESAGAVARLLAASPCAGPRDPGRALGPGRQVDGRAHGQPAGRRAGRGCPGLPRLPVLRRRQAGEAAGRAPRRAAHADPDRPGRARRPGQPRGGGGLCAGADDPPALAGRGGPRPQAAEGLRPDPRAAPGGNGAGGGRLPSRAPGPLTVP

SEQ ID NO: 16764 - protein, 565 aa, Pseudomonas aeruginosa
ASRRRCNGTSSDGRCGELPPRGLISAVEALDQGILALRGGGQFLAQFRRAQRLVGGLLGQGGDGADVAVDFLGHRALFLRGGGDLGGHLGDVADRLADADQRAVGFQHPLDPGFGLLQAALHGMYRIVGGVLQLGDQVVDLLGGGRGALRQRAHFVGHHGEAASLVAGPRRLDGGVEGEQVGLVGDALDHIDHAADLVAVLGQATHRGPGLAHRLRQALDGVARLRGDVAAARGQFVGLLCGVGGQLDIVRHFLGGGGHLVDRGGHLFGLCALLFQTGGAVVGQGVGLARLFGEVFGGVLQARQAGLQARVLAEDGHFQARLVAAAVGVHLRDQRVGGGLFGEPHQALQPALLPAQSGQAERNGEQAGEDEAPPGVQPDTDEEADLADQDERQPVEQYRQPAVAPGDRRLAGAEATVEGLGALDLFGGRLDPHRLVADHRALVVDRRDIGADPVVVAVLAAVLDDPHPRAAGFEGGPHVGEHRRRDVGVTDQVVRRGHQLLATEAADVDEGFVAVGDDAFEIGGGDQALFRRIDALVLGDGLIVAHGPSKTSEAFTSASAKTPFT

SEQ ID NO: 16765 - protein, 927 aa, Pseudomonas aeruginosa
KRGGRSHPSARTAAASEHAAQHVVEDAAGLEILDLVEGVDAAEDLEAVLAAVLAGHFHAERHVRLEFAAEAADVQHLLAGQLQALAVLAVLELQRQHAHADQVGAVDALEALRDHRLHAQQVGTLGRPVARRAGAVFLAGDDHQRGAVLLVTHGRVVDRQFLAAGHVQGIAAFLAAEHLVLDADVGEGAAHHHLMVAATGAVGVEVLRFHAVLAQVAAGRAVGLDVAGRGDVVGGHRVAQHRQHPRLLDVGDGRRRLGDVFEEGWMLDVGGVGLPLVGVRLRHLDRLPFLVAGEDLGVLLVEHLGVDLLDRLGDFLLARPDVLQVDRLAVLAGAQRFLAEVDPHAAGQGVGHHQRRRGQPVGLHQRVHAAFEVAVAGEYRGDGQVGLLDGFLDRLQQRAGVADAGGAAVADQVEAEFVEVAGQAGGLEVVGDHLGARRQRTLHPGLALQAFFHRLLRQQAGGHHHAGVGGVGAGGDGGDHHRAVLQAVGLAVVLVVDLAEGGVGADRGAAAALAEQAAFFGAGGMQLQAEELVEGAGDVLQGHAVLRALRSGQAGLDFAHVQVQGVGEHRLVALLAPQALFLAVGLDQLDRAFRTSGQAQVAEGDLVHREEAAGGAVFRGHVGDGGAVRQGQVGQAVAVELDEFPHHALLAQHLRDGQHQVGGGDALAQLAGELEADDLGDQHRYRLAEHGGFRLDAADAPAEHAEAVDHGGVGVGADQGVGEGVGPAILVLGPDRAAQVLQVDLVADAGARRYHAEVVEGVLAPAQEGVAFAVALHLDLDVLFEGRFAGELVDHHRVVDDQVHRRQRVDLLRVAAGLGHGRAHGGQVDHRGHPGEVLHQDSRRAVLDLAVGTALPEPAGEGLEVVAGDGAAVLPAQEVFQQDLQRHRQLAEIAQGPGGFREAVVVVGLAVHSETAKGFQAVQSRHF

SEQ ID NO: 16766 - protein, 337 aa, Pseudomonas aeruginosa
  UNSURE (322): Identity of amino acid at the above locations are unknown.
SPPIPRPAATSPSSACSSATSWSSSRKRRAPISTGSARRPTRPSADPAIPRASAQLLHELVVPHPGGQHRIAEEVAQRHPEVLATGEGVELLQAPAHRLGHDLAHDVAGGYAMPRVALAVPDVVGELAELGDPVHYDAHGATPLELDLHALQAREGALDAWPQLGGDVPRVAARVVGAATEQQAAVGGGAVVIEDEAAIVDRQPLRVDLPCQLAQRPGGNDSAHGREDHPLELPAFELVVDIAGKQDLLRLDPSLAGNHRRPRAVDDIQHLGMFEDQRAEAGRRPGLADAQVERVQVHVAGVLQRAAVQLGLQVGLDAGLVXQDHLVAHAAAHRLLV

SEQ ID NO: 16767 - protein, 135 aa, Pseudomonas aeruginosa
GLQLAHVAGLHRRVQVAMAKVAGDAVLLHPLADDLVAAPAQVPDEVLDLGAQPLAHLLVHRRVAGQAAGDLAAVAPAGAPADAMGLDQGYLVATLGQFDRRGDAGESAADDGDVDRHRAQQGRIVGFLVERGGVV

SEQ ID NO: 16768 - protein, 495 aa, Pseudomonas aeruginosa
PLPSTGAPGSMPSRMPRWDPGEERRGGHVGVGVGAANAVLDMPTGGRAARHAQAHGAVVDAPGLRQRRVSVGLEAPVGVGVGTEQQERVEQAGEHAADRLAQQRRAGGVVAGEQVVALFVGQADVQVHASAGQVVERLGHEAGEHPVLVRDALDQALVADRLVHGGEGVAVVEGDFHLARGIFRDRRACRQALRLAGGIEVGEERLDLLQFAQAVDLGRPWAAAIGVAGRLRAAVGVALTVEQVELQLGGHHRVIALALQRVDGSHQEVPRIGDAGGQALARVHADLHRRRRDLSPGQAHQAAGQGVGAAVDVADVPDQAGVLDVLAVHRQPEDGARQRPAAAVDGQQLVAVQQLAARHAVGVENEQFEEFDVGVGGQEILGFLFAGEVHGALLSVLSGSVATLAAALRRRQRRGTACKRQAGPAVARGRRDIRRDERPADARGGNARAPRRPVREGGRAAPVPASGCACGVDARAFRPGWRKAGRAGCASSVGA

SEQ ID NO: 16769 - protein, 339 aa, Pseudomonas aeruginosa
QALGAPERTGRAPARGDPAAVRDRGRGGGAVVRLQRPADRHPDPGGGCAGACIAADRAFLRALSGHRGAGGDRQYRRVSAATVQLPGRPGPVGPGRQRRAVAFADPAQRPDRRFRFAQPSVGRARVDPARRSRRHAAGAARAGLGDPPDPGGGDEPRRPADLSGDPGRGPRGLARGGGGGDRRGGGVGRGVRRRHAGPCATHRRLPATPDRDPGVPARTAFAADRRDLPRPGRRGPAGAELGRGFAQAKKSPADAGLRSRAGGRSGLLLFLLQGPVQFAAGALDHHLGDRDLPALGVDDGATGVLLRIEGDHAALGGIGVLRIHCPSPHQVYRQSRERR

SEQ ID NO: 16770 - protein, 229 aa, Pseudomonas aeruginosa
NIDRDQLASRPPLHTRCGKLSLKWNRPAGSLSATLILAHGAGAPMDSPFMERIAELLATQGIAVARFEFPYMAQRREDGRKRPPNPQAQLLDCWRRVHAQVRETLDGPLALGGKSMGGRMASLLADELGADALVCLGYPFYAAGKPEKPRVAHLAGLRTPTLIVQGERDALGNREAVAGYALAPTIRLHWLAAADHDLKPLKASGLTHEQHLAATAREVAGFLRGLQGH

SEQ ID NO: 16771 - protein, 393 aa, Pseudomonas aeruginosa
SQRLKRSTREYWLCAVVVSSSLSFAVRSASSEVCSARAAMVLMLRLISSATALCSSAAAAIWVVISVMLLTASLMPTSALSASSTRWTPASACCRPLSMVCTASLAVFCSLAIRWWICSVEAAVRCASERTSSATTAKPRPWSPARAASMAALRASRLVWSAMPLITSTTPPISLLSWARRLTAAPVSPTDSDRRWMALRVSAAMSRPREVSSLAFCVASAVNWTLFATSWVVAAISLTAVATCSVSARCCSRPAELWWARVSAWRACSVRYSAVSCRRVRQVFRRASWLRMAISRRAWSPRLSVYICAISGSEVVCSASRIRRFSPRFCQRSPARPSGTASRPARMKPHQEFSQIPMRKPIWLIRMNGSQSSSTGSQRSRRGIAGLPAPRRR

SEQ ID NO: 16772 - protein, 136 aa, Pseudomonas aeruginosa
PGDAGDRRGQRADGGEPDVFRAGRPPEGRRLPVPPAPAGRLDGLRHRREAGTHRCVDRDLDRRRALPRGGGQPQAADEAALRRGAQDPPAPARELRRARPEGSDRLQAAVSRPRGSDLPSTPPRTLRGGVIPAGDR

SEQ ID NO: 16773 - protein, 269 aa, Pseudomonas aeruginosa
TVLPCRAISARRLTTSKRSICMRGFPVRGEGRGGGSRRGRSGADGTEVRQAGDIPQAFPCAAGPAVPVREEHRGGDQGCDGEADEHRVGVEIAGQQTAEDRAHRTAAIDEAGGGAGGLAGAEVDGGGAADHRVRAVQGQSHHEQQADHYRNAAGGHRRDEQRQADGQRQQADHAGRHAPCAEQLVRGEADQDRAEQAGYLEGGGNDRRADLAERRHAFVDDHRSPQEDRVARRLEQEVGQAQGRAPCGCAPPWRAPARCRRCRRCRLPA

SEQ ID NO: 16774 - protein, 295 aa, Pseudomonas aeruginosa
RSMSVSHAQLKAFHAVAVYGSFTRAAERLFLTQPAVSDQVRKLEERYGVLLFHRNKRSVRLSELGERLLAVTQRLFAIEAEAEELLSASSALQTGTLTLAVDAPVHVLPQIARFCERYPGIAVRVETGNTDESLQRLFSYQADLALLGRDVSDERLLSLTLRNDPIVAFVSLSHPWAGRESIRLADLDDMPLVLREQGSVTRQTLEEEMSRAGLRICPAIQVEGREASREAVVAGIGVGVVSAAEFGADTRVHALPIVDCQRRLTETLVCLREQRSRRIVETFLDLVGEDLPAPS

SEQ ID NO: 16775 - protein, 206 aa, Pseudomonas aeruginosa
WHSTGCCRGGARATAGARHSGRGEDPLRGLCHQSARGRRIGQAPGRGRPGAPGQRRGARPRRRGAARRPRRRALVRRDDSAGGGPLHAAREAGRDGVRGAGAGGPRRLAGGKLGRRRALCARTGLDLAWPGAQPRPGNHPAGRRRAGEWRGDCPRRRRGAAVRTGGRSSGVPAGHRHRRPGPRDRSRQPADQSPGVARHPPEAHAG

SEQ ID NO: 16776 - protein, 166 aa, Pseudomonas aeruginosa
SSAPAANWTGPWSRNRSRPERPPARLRSPASAGLFFACAKPRPSSAPAGPRRPGRGRSRRSAANAVRAGTPGSRSGVAGNRRWVAHGPACRRRTPRPTPPPRRSPPPPPRARPRGPRPGSPDRSAGRRGSSPPPGSGGSPSPARAAPAACRRDRRAGSTRARPTDG

SEQ ID NO: 16777 - protein, 629 aa, Pseudomonas aeruginosa
NLYLKFDKSISFIYPELFPSLHHSAPAPRQPAPAWASATLTQEVKPTPDPSDQAPRHGGAEVLIRTTTRRVPLTPAGTDNKIEVRTMNQRPGTALPSSPVSSFQRWRLQIFAITWLAYAAFYFTRKAFSVAKLGIAEDPGFQLDKMAMADLDAIYLAAYAVGQFTWGVLADRFGPRIVVFGGLLISALAALVMGTFATLPIFATCMVVQGLAQSTGWSGLCKNIGSFFATHERGRVLGLWSTCYAFGGLVASPFAGWWAYSVFGTWHAAFYFSAAVVGGVALLFLLLQRNRPEDVGHPPVEPQAASEAVRYAGFRPEGGNGGNGGSVQVLAKVVRNRTVLCLGPGLLPAQAGALRDPPVGTGDRLRTHAGARQGRRGDRSHRLRGSRPARPDPDRLRLGQAVRRTAHAGLRDQPAGADRLPGAVRPGDDHRQHSDSGRPAVHDGTDPVRPGLDDLRLRRHRLRHQRGRRHRLRLRQWLRFGGRDPRRSVARLFRHLHGVHRLHHRSPDRHRGAPPALEQPARRRTGKPAEYPQPGGLPSHPLLTVRGGNLRRVLLHEPGTPSCISNVSKSSSVGPRWPCTATRSTSAARSQTTPAVTSRTRPARSWRTSTGCSRASAATAARCSRYAYC

SEQ ID NO: 16778 - protein, 477 aa, Pseudomonas aeruginosa
SSSPPARSESTAMTFRPFWLDQALRSEHAAPCPPLAGDTRADLCIVGGGYTGLWTAIMLKEHDPGLDVVLVEADLCGAGASGRNGGCALSWSAKFFTLERLFGLTEAIRLVKASEDSIRAIGAFCQRYDVEADYRLDGTLYTATNPAQVGSTDSVIAALERHGINSFAKRPLADVQRLAGSRRHLEGWFSPAAATVQPGKLVRGLRRVALQLGVRLYEGTPMRGLEHGRPAEVVTPHGRVVAGRVVLALNAWMARAFPQFERSVAIVSSDMLITEPRPDLLQEIGLTSGVSVLDSRIFVHYYHNTPDGRLMLGKGGNTFAYGGRMLPVFDRPSPYLGQLRGSLREFFPEFAEVAIEASWNGPSDRSVTGLPFFGRLDGRDNVFYGFGYSGSGVGPCHMGGQILSSLALGLDNPWTRSPLTQGPLGRFPPEPIRYVGSLMVRNAIRRKEHAEDAGRRPRHLDVRLARFAAAAGKADKG

SEQ ID NO: 16779 - protein, 196 aa, Pseudomonas aeruginosa
WPPSWSSTCSTVSATPTAARNRPATPMAAAHGRPRSTACANWSRSSRSSPTSMPPARRRACRHARRSRNMPRARWKSPSTTATPSPPWTRRSATSAWSRASRTSTGCSPASWPSRSTTWPALACTCTSAWPTNKATTCSPATTPPARRCCARRSAACSPACSTRSCCSVPTPTPTGASRPTDTRRWRRPGASTTAP

SEQ ID NO: 16780 - protein, 118 aa, Pseudomonas aeruginosa
ACACRAARPPVGISSTAFAAPTPTPTWPPRRSSPGSHRGIREGIDPGAPVEGNGYAQAGKRLPTDWLTALDTLQGSEWAREAFGEPFLGVYLAVKRAEYRQFMGEVGEQDWRWYLTQA

SEQ ID NO: 16781 - protein, 381 aa, Pseudomonas aeruginosa
MAGHFLAVVIQLLAADRYLQAARVEALAQALEDLAHLGVALLHRQLEVDHRLAAKPFADPGLDQRTGACRLLDDVADHPVDPLARAVLVAVDLLVVDQPGIHQVLRHRPVVHGGHPHLPVNQLPGPAARRRTEVHGEHVRRQALVPFAARDELVPGFLQLQRRTARRLAGKLQARDAHRPERAVARLGEADEDFPAGAEGQQQARQRRVLLQPPGLHQRRAQRFLELAAEGRHLLAGIGVQHLQPEAAANRITRQFRQQYLDALAFRQFDEAGPARPLAREDQVGETQAAHQALGAVGVLADELDVGAGRLALGVAGNLESGCMLGDFGADFTFEAWPAVHQQGIHGVVSLAAHYSAGHASRELQRPFVGPVYMAGALEPV

SEQ ID NO: 16782 - protein, 171 aa, Pseudomonas aeruginosa
PSRRCCARRAWWGNSSSSTATAWPTCPWRTAPPSPTWPRNTAPPAASSRWTRSPSATCACPDVRKARSSWSRPTARNRACGARRATSRCSPTPCTWTWAKSRPAWPDRSARRTAWPCRTSPAPSTSSSACNCIPPAPKKAACSARAAAAPRSAPTPPSARSTTSTTARPTA

SEQ ID NO: 16783 - protein, 148 aa, Pseudomonas aeruginosa
GRGPPRPASAGGSSAPAHSPPPPRGCPGRRARPGRSGSACAARRGARPAASPACRRRRTGSRGRPGHPRPARRPAGWPCARPSTCRPGPRARPGSRGPAHGLAASSRATAPADSADACGRPRGAGPCRETRSARRRCPGWRAVRRCAP

SEQ ID NO: 16784 - protein, 204 aa, Pseudomonas aeruginosa
TPEWIFTPAGMPSTGCCSRTTPATSRAVPSPPANRIRATPASCKRSIANRVSAALLTAPCHSPSRRWRKPMRSSNSPPMAPGKVRNSIFSTSGNRHSRAIRVRSSARGSAPLARASAATPSLPFKATGPPSPARGLTTNPRRNMSILILGRTPGRPHRSDHYNQKNPAVAGKLARRLQDCYGPWLSRWSGTTSAVCHGGFICAP

SEQ ID NO: 16785 - protein, 358 aa, Pseudomonas aeruginosa
SPHWPRWSWAPSPPCRSSPLAWWSRDWRSPPAGRGCARTSAVSSPPTNAVGCSACGAPATPSAAWSPRRSPAGGRTACSVPGTRRSTSAPRWSAAWPCCSCCCSATARKTSAILPSNRRPRAKPCAMPASGRKAATAATAAACRCSPRWCATARCSALGLAYFLLKPARYAILLWGPVIVYERMPALGKVGAAIVPTAFEVAGLLGPILIGFASDKLFGARRMPACVISLLALTVCLALFVPAMTTGSIPIVVGLLFMMGLTLYGPDSMICGSAAIDFGTSEAAGTASGFVNGCGSVGAILGGLLPGYFDTYTVFIGFTIAALIATAVLLPHWNSRPGGARESLRNIPSLADFRPIRS

SEQ ID NO: 16786 - protein, 84 aa, Pseudomonas aeruginosa
KAHLIHPSACARLFQPLAQFSFMHLPTTRTLPYQPSANPAGTPARLPRKHSRWLELEPLSLPLELAFWALWHCRHARPPDARHA

SEQ ID NO: 16787 - protein, 251 aa, Pseudomonas aeruginosa
ARRQRPPATGPRRRWRPPTGDPGLRPARTGADRAVPRRPLCRLQGAGPAGTHGDLGICPGPGGNHPRPRRRPRRHGPGDPLQAPGQGHRAQARDARLLHGQAVRRPGRHWHAPARQPGRRTRPQPVRQRRPRRHAVAAPGGRRHARQPARLAPAVLSQRQLLPALPGQQIRAAGADLGRRQPHREPARAGRPGLQSAYRAPHLRRRRQPLRGRRGAPRRGPTAASAKASIRVRRWRATATPRPASACPPTG

SEQ ID NO: 16788 - protein, 474 aa, Pseudomonas aeruginosa
  UNSURE (194): Identity of amino acid at the above locations are unknown.
PRPEIPDPPAYGGAPAGRAALEQGIPDERSNPSPSGRGTRAVILRRHAQRGNRLSDPAGRGDGRHRHHRRRIHRRRHGGRTGRAWLQGSPGRDPSHRLGRQRAQRRPGHRQPVRRRGDAQADAPMAGRRGRGLHLAPALARPRDHPPAGGEVRHRLRPSPWPPARGDEGQPHGRAAGLIRGGGAPRHGRPGGPXGQGRRPGPPGDRAVLRRAEEHPQHAPAPAQPVHRRGQGGGRPRRADLRTFRGAGYRPRPAAGGDYPRGKDRGAADPACRRCLPQARTQAAQGDDLPGHGRNRYHPAAGRAGTGDQPAGAGGLRLPLRPRLLPPHRRRPPAVRWRRQLLGPRLAGHHRRAAAMHRAHLPAPEGRGDRVPVELRHGHRNEPDPPARQALRQRLVLPGLLGAWRSHQPHHGRDHGQGDEREPGAVRHLRPLQAPQGAAGRPLRQSDAGRRDVVLPAHGEAALKREGWRGPRKA

SEQ ID NO: 16789 - protein, 774 aa, Pseudomonas aeruginosa
RHPGVRGRRGSRAKPGTIGSTTGLASGRGQARRPRARREEIRNACFGQPENPSQSRCGRQDLPLLQPPGSRPDPGRSRQAADVAEGPAGKPPALGGRQHRHRRRPQGPRRLAQGAPFRPRDPVPPGASPDAGLHRGARGGRPGRHARGHGQGRRRPAEDQPAVAGGPGHRPLGDGRQVRQRIGLRTERRDRDAAQRRTLRLPALGPERLRQLQRGTAGHRHLPPGQPGVPGPHGLDQGRGWQDLRLPRHPGRHRLPHHHDQRPRRARLGRRRHRGGSRHARPAGIDADPRGHRLQAHRQAARGHHRHRPGADRHADAAQEGRGGEIRRVLRRRPGRPAPGGPRHHRQHGPGIRRHLRLLPGGRDHPRLPAPVRTSGKHGQAGRGLQQGTGPVAREGPRAGVHRHPAPGHGRSRGQPGRTEAPAGPRGPAERRQRLQRVPRPATASLQHRRRPPAQRGRRRHRGRRQRRLRRDRLPARRPDPPPEERRGGDRRHHLLHQHLQPQRDDGRRPAGEEGGGKRPATQALGEEFAGAGLQGGHRLLQGRRPDPLPRRTRLRPGRLRLHHLHRQLRPAAGADRESHPAGRPDRRLGTLRQPQLRRPRAPVGEDQLAGLAAAGGGLRPGRQRADQPQRGTAGHRQGRPAGLPEGHLAEPEGNRRGDPEGRHRDVPQGVRRGLRRRREMAGDPGAAVGHLRVAGRLHLHPASTLLRTHRRGAAGHRRRRAGAGAGGAGRLGDHRPHLPCRQHQGRQPGRPLPARARRGTEGLQLLRLPSRQP

SEQ ID NO: 16790 - protein, 566 aa, Pseudomonas aeruginosa
MLHLFWKAHAQQSAHHPARARLSGGTTPDHHHQSQRHHHLLQRSLHRHQRLQSRGADVRAAQPDPSPRRPAGGVRPHVDHPQSRPPVDGDRQEPLQERRPLLGQRLCHADLRPGRGGRLRVGAGQADRRTDPARRGPLPSPRRRQAGDPPARPLAAGTARLAAVHPDQPDRLPHRYLAELLVGLHPRRPARRSARPGRTALAEARAEAPDAARRTDHLRPADRADVHRQPRRPGAPGNGHPQPGRAPEDLPDAPAGHRRIPHRTGAPGRHPGPPQLRRSGTAARRDRTGGHRGQRDGRHHPGSGEQCPVDRRRHTEGQRTDLARPRHRRGDAQRHPAPVGVGGRDRGRGESPGPGQQRDRRRGRCDQGHRRPDQPARPQRRHRGGAGRRPGTRLRRGGRRSALAGATHRGLHRADPPPDRQAAEHRQRCGTYHGERPAAGRSRGPAGAGSRQRAGRHQRGGQQHHRDDHPDRRRRGGTERGGRGNQPQHQHHRRPGRADLRRGAAHGETERGTDHHRAEPVFPGRALQPLRSGRGEEAPRTCRHLKSHCICAGMLTALDDCTQTSR

SEQ ID NO: 16791 - protein, 438 aa, Pseudomonas aeruginosa
STSCCSAAGNSQDSLIGDSRCGPQHIAVPTWRKRFSRFERLSTSAKAKVPSTLTGQMVGFFENDATAAQLITRSTCIRRGVSRASQEVSRKSPQRICSARSARQSASSTPCISRLPRRRSSPCWRDSARTRKDRLAPCPAAISWAATEPPRKPVAPVSRMRSRVSIAVICSPSACMFMSSPLREVSRPRLDARVVAPQLMRGCLKEPLMALEPAKEAGHLPRRCRQVLLVGQAGGLQRLEVVVRRGQPVQADRRRQRIARHRLAVAQGVALALDDQGRRAQPGEVRDPRLLRLAGGVERVAEADQGIRAQLVGQQAGHAPAHRLAAQGQGPVQGLADLRMDSPPAVEQLRLRIRRTLAAVLAALGHVGKLEARDGDALGGEQFGDALHERAVHRRPGAMGENQGGRQRAGRAVPFQRQLATPRMQWGSGSQLIPINIS

SEQ ID NO: 16792 - protein, 105 aa, Pseudomonas aeruginosa
PASWHADCKIAMVHGFRVGAARHPPFVTAVSSALPRLPINLMRRRAMNSQHTDTAKRRVIPFNTQQHTGGAIIDAQGREIPITEVMIQRACRELDRSLEQEQKQA

SEQ ID NO: 16793 - protein, 89 aa, Pseudomonas aeruginosa
RSSSLRTWSETAGWVRNRRSAARVKLPYTATAWKAFNCAWDTDMDLHHSRQDKGFRAMGGAHGDDRSVNFLDPRRARLTDKQVKLIFKI

SEQ ID NO: 16794 - protein, 171 aa, Pseudomonas aeruginosa
SPPRCSSRTGTAGPAAHGKACGISPAWRTSVPSAPDRPRREPPPRPSPRTGNPLMHIERFEVVKRRAEMALHGNTVYIGGQVADDPSGDIQDQTRQILENIDRLLQSVGSDRGQVLSVRILLAHREDYAGLNQVWDQWFPEGRAPTRACSLAELIDPRWRVEMIVVAARPQ

SEQ ID NO: 16795 - protein, 501 aa, Pseudomonas aeruginosa
EHSHDLPTLLAGPGPTLRTCGPLPAAGRGYPRRPVHRRRRLHRPVDRHHAQGARSRARRGAGRGRSLRRRRQRPQRRLRAVLVGQVLHPGTAVRTNRGDPPGQGLRGQHPGHRRLLPALRRRGRLPAGRHPLYRHQPGPGRQHRQRDCRSGAPRHQLLRQAPAGRRAAPGRLAQAPGGLVLAGCRDGATRQAGSRPAPGRPATGGTPVRRHADARTGARPPGGSGHPPRAGRRRPRGAGAERLDGEGLPAVRTQRGDRLQRHAHHRATTGPVAGDRPDQRGQRARLTDLRALLPQHPGRPADARQGRQHLRLRRTHATGVRPSLAVSRTTAWQLAGVLPRVRRGRHRGQLERSVGSLGDRPAVLRPARRPRQCVLRLRLLRQRRRSMPHGRADPFFAGARPGQSLDPFAADPGAARPLPAGADPLCRFADGAQRDPSQGARRRRRPAPASSRRTPGQVRRRRGQGRQGLSRFPGVSSAHSGAPFFFLRFRFRSSKGRKKRI

SEQ ID NO: 16796 - protein, 1037 aa, Pseudomonas aeruginosa
  UNSURE (769): Identity of amino acid at the above locations are unknown.
FTRQPVRGCSNPWPSFPSCTYRRRAPCPTSLPPTRPERPRVYPASTAAGWNWSRSPSLSNWPSGRSGIAATRVRRTLVTPDIPPAPRNGGAGLPLACRSATLPSPERRCERRDATGQDRQESPMNFACEQEAQDFLAANPDIELFELFILDANGVPRGKLLHRDELLAVYRSGRPLPSTILGLTMNGEDVEDSGLVWDVGDIDCRAYPLSGSLVRLPWRQIPTAAVQVSMHPSEGLPASVADPRHLLVRTIDALKSEGYHPVMAAELEFYLLDRERDANGRPQPARDADGGRPRATQVYGLRELEQIEPFLADLYAACKAQGLPARTAISEYAPGQVEITLDHGDALAAMDQAIRYKRLVKGIAHKHGMLACFMAKPFDDLAGTGMHLHVSLADEQGHNLFASDDPAGTPLLRQAVGGMLASLLDSLLLFCPNANSYRRFQANRYAPLAQTWGVDNRTVSLRVPGGPASSRHIEHRICGADANPYVAAAALLAGVPPRHPRRHRSGCAGGGQRLRPGRQAPAHRLADRPRYPARLRVGAGSLRRAVPRRLPGGEARGIPAIHGRGRRAGLALVPDPGLRSRTRPHTAARRQDAPHWNKEYPMNAAIHPRPAAERAPSYYAATLNEETDYPTLLGAVTVDIAIIGGGFTGVATAVELAERGYKVALVETHRIGWGASGRNGGQVTGSLSGDAAMHKQMRQWLGAEVEDFIWHLRWRGHEIIRQRVEKYGIACDLRHGHLHAAMKASHMGELQASYEEAVRRGMGDQVVLXDKAGVQAHLETELYCGALKNTRNMHLHPLNLCIGEARAAAGLGALIFEHSEVLDIVHGPRPAVITREGRIEAQQILLAGDVYHKLERRQLKGMIFPAMGGIVTTRPLGELAREINPQGLAVYDCRFVLDYYRPTADGRLLFGGGANYSGRDSRDITAELRPCIERTFPRLKGVEIEFQWSCAMGIVMNRIPQLGKLSDNVWYCQGYSGHGVATSHIMGEIMAKAMSGSLEQFDTFARCKHLRVPLGDLFGNPMLAAGMWYYQLMEKLR

SEQ ID NO: 16797 - protein, 118 aa, Pseudomonas aeruginosa
TGARLPPASASNGSAPRGETSGAGCPSARARCCAARRGRRRLPGRSGRSAAGAAAPGPPATARPSPAPRAAVSRTCGRRSTPPCRHWCPAPPARGCRKPDNSPVPPAVPRCAGFPAIR

SEQ ID NO: 16798 - protein, 981 aa, Pseudomonas aeruginosa
RFRTTLSQSLTLASGRYRWDRATAHYRGNGTLASADAAGPGRSQALSARRRAWRQDEARPAAPGPAVRKSEMPALDSLKTLRSLAVDGKTYHYYSLPEAARTLGDLGKLPMSLKVLLENLLRWEDGSTVTGDDLKALAGWLRERRSDREIQYRPARVLMQDFTGVPAVVDLAAMRAAMAKAGGDPQKINPLSPVDLVIDHSVMVDKFASESAFEQNVEIEMQRNGERYAFLRWGQNAFDNFSVVPPGTGICHQVNLEYLGRTVWTKDEDGRTYAFPDTLVGTDSHTTMINGLGVLGWGVGGIEAEAAMLGQPVSMLIPEVIGFKLTGKLREGITATDLVLTVTQMLRKKGVVGKFVEFYGDGLADLPLADRATIANMAPEYGATCGFFPVDEITLGYLRLSGRPESTVKLVEAYSKEQGLWREKGHEPVFTDTLHLDMGEVEASLAGPKRPQDRVALQNVASAFNEFLGLQLHPSSTEEGRLLSEGGGGTAVGANAAFGEIDYQHDGQTHRLKNGAVVIAAITSCTNTSNPSVMMAAGLLAKKAVEKGLQRKPWVKSSLAPGSKVVTDYFKAAGLTRYLDELGFDLVGYGCTTCIGNSGPLLEPIEKAIQQADLTVASVLSGNRNFEGRVHPLVKTNWLASPPLVVAYALAGSVRINLSEEPLGTGKDGQPVYLKDIWPSQKEIAEAIQKVDTEMFHKEYAEVFAGDEKWQAIQVPQSDTYEWQADSTYIQHPPFFEHIAEAPPAIADVEQARVLAVLGDSVTTDHISPAGNIKADSPAGRYLREHGVEPKDFNSYGSRRGNHEVMMRGTFANIRIKNEMLGGEEGGNTLYVPSGEKLAIYDAAMRYQEDGTPLVIVAGKEYGTGSSRDWAAKGTNLLGVKAVIAESFERIHRSNLVGMGVLPLQFENGQDRKSLKLTGKEVLNIRGLGGELKPHMPLSVEVTREDGSQDSFKVLCRIDTLNEVEYFKAGGILHYVLRSML

SEQ ID NO: 16799 - protein, 645 aa, Pseudomonas aeruginosa
GSGGTRGGVASATPFSFRRPGPRALRRANDAPASSADTPQDRRMAASRLSARPLPSPCAPPGTTRNRNALTSISESAIYPTTWSVLMLWVNSYLFFLVKAFTNPSCERRFRRCRGKCFTCFGRPMRNNQPITQHERVYPAEQRLITTTNLKGIITYCNEAFIDISGFSREELMSAPHNLIRHPDVPPAVFAHMWTTLKAGRPWMGIVKNRCKNGDHYWVSAYVTPIYDQGAVVGYESVRVKPTAEQIQRAEALYRRLGAGKPAIPRRDRWLPVLLDWLPFILISQIGFLIGIWLNSWWGFILAGLLAVPLGLAGLRWQKRGLKRLMRLAEQTTSDPLIAQMYTDSRGDQARLEMAILSQDARLKTCLTRLQDTAEYLTEQARQADTLAHHSSAGLEQQRAETEQVATAVNEMAATTQEVANNVQLTADATQKANELTSRGRDIAAETRNAIQRLSESVGETGAAVSRLAQDSNEIGGVVDVIKGIADQTNLLALNAAIEAARAGDQGRGFAVVADEVRSLAQRTAASTEQIHHLIAKLQNTANDAVHTMESGLQQAEAGVQRVLEADSALVGISEAVSNITEMTTQIAAAAEEQSAVAEEINRNISTIAALAEQTSDEALRTAKLSEELTTTAQSQYSLVERFNR

SEQ ID NO: 16800 - protein, 308 aa, Pseudomonas aeruginosa
PWMEAHSMSTTNPESAYNYKVVRQFAIMTVVWGIVGMTVGVLIAAQLVWPDLNFGLPWTSFGRLRPLHTNAVIFAFGGCALFATSYYAVQRTCQVRLFSDTLASFTFWGWQLVILLAAISLPLGYTSSKEYAELEWPIDILITVVWVAYAVVFFGTLVKRKVKHIYVGNWFFGGFILTVAMLHVVNNLELPVTFTKSYSLYAGATDAMVHWWYGHDAVGFFLTAGFLGMMYYFVPKQAERPVYSYRLSIVHFWALIAVYIWAGPHHLHYTGAAGLGAVAGLGDVADPPGALTGGGMINCMMNPSGPRP

SEQ ID NO: 16801 - protein, 227 aa, Pseudomonas aeruginosa
GPGPRPQAFDQPAGMAEAAEHQARQRRAVGREFQVEHALGVARGFPGEAGMAFDQGHLPSARGEAGGAGAAGQAAADHQCRAAPGVGRGACVPRLAGVRRRPLVGAAEHLALLSVARYPLHGETGLDQPAADETGAGEGAQGRLRRRQSRQFGEQYGRPHVRVLRRGEAIEEPGVDPRVELRQALHGIAQQQGQADPSARERQALEARVHGKVLAQQGLAPRRQFRP

SEQ ID NO: 16802 - protein, 653 aa, Pseudomonas aeruginosa
RQGAAHVCGGEGEFLHADELQARAGRRDPLEQLPGAEEVQSGAEAGLPDAQHLAVAQRGEALGQAVGGEEHMARLVEPGMPGKNIRRRRRGIAAGRFRPSRAGHAGSRTWQNLKKRMAHFTGLCRPAARRCANMPRRRADSRTPIRYLEGLRLRETSMFESAEVGHSIDKDTYEKAVIELREALLEAQFELKQQARFPVIILINGIEGAGKGETVKLLNEWMDPRLIEVQSFLRPSDEELERPPQWRFWRRLPPKGRTGIFFGNWYSQMLYARVEGHIKEAKLDQAIDAAERFERMLCDEGALLFKFWFHLSKKQLKERLKALEKDPQHSWKLSPLDWKQSEVYDRFVHYGERVLRRTSRDYAPWYVVEGADERYRALTVGRILLEGLQAALATKERAKRQPHAAPLVSSLDNRGLLDSLDLGQYLDKDAYKEQLAAEQARLAGLIRDKRFRQHSLVAVFEGNDAAGKGGAIRRVTDALDPRQYHIVPIAAPTEEERAQPYLWRFWRHIPARRQFTIFDRSWYGRVLVERIEGFCAPADWLRAYGEINDFEEQLSEYGIIVVKFWLAIDKQTQMERFKEREKTPYKRYKITEEDWRNRDKWDQYVDAVGDMVDRTSTEIAPWTLVEANDKRFARVKVLRTINDAIEAAYKKDK

SEQ ID NO: 16803 - protein, 261 aa, Pseudomonas aeruginosa
GCSDVHRAQLAVRRRPAERRRCTDSRQPRREAGDHPGNLSADPQCPGPRLQPEDQPRSGDEPHARPGRPEPAPARGARPGQAGDGQPRRPLGAHPGQGPGIGGATGGAARPAVPAWSADPQRTAHPQQPPTRFRRRRADPPPPGTPRRPWPGRAPGASRRAARGALHAPARQPGRPRGRRGGDGQRPGTRRAGRSVGRCGSADRRAGDAPGGAGGAPGQARRRGVISREGAIGDMQVPADNRERLFALRPAVTLWAALPVG

SEQ ID NO: 16804 - protein, 180 aa, Pseudomonas aeruginosa
DGTISFRRACHSGVATLSLKAFSSTDSMIGAAVEAPGEAPSRAATEPSAAVTTSVPNCSTPPFSASFLMICTRWPACTSFQSSSRASGKYSRSEAMRSSWLSINWPIRYWLRSKLSMPALNIGPMLPLVTEPGRSHSEPFFRNLVEKVANGPNSRTGLPSIMRVSRCGTDIGGEPTEALP

SEQ ID NO: 16805 - protein, 65 aa, Pseudomonas aeruginosa
VPRVALMMPPPIRSTSTGFSDSTLFLEQPSTLTHKSINKIFFMDLPLENVEKRGYARHGRYSPGE

SEQ ID NO: 16806 - protein, 154 aa, Pseudomonas aeruginosa
SPLSVAAGPGWPCSPFLPCFPRQRPPPPPLKSVSTMPTTPPPAWRSGSSAGWRKAWTAAAPGCAGCSARAATVPWSTSTPAASISPRPPASPRYSRGPTAARYVPYTSPAARSGPRCWCARIRRSAASPSSRGARWLPPRAPIPTCSCSAACTA

SEQ ID NO: 16807 - protein, 210 aa, Pseudomonas aeruginosa
LPGHCRTQPDPRLRPGRRERPQRRNRRGVPGAAPVALADGGAERRFRRRLAGGRALGRAPARRCRTGRLRRIAAQATVRRHGAARGDRPRSLRTAAGAVARRAVQRGRRLHPHAPPGPAAGRGAELRDQRPAGHPRSRRGVLSRRPRAADGRPSRTHPPRVPRTAGASPRSPGGGAGLLARRGPDRNAAGARALRQDPEPGSYMLYGINK

SEQ ID NO: 16808 - protein, 297 aa, Pseudomonas aeruginosa
TPAGASDPSAASARAPRPDCTTHTRRPHCSVNGAAGSAPTTTKESAMRTIALRRGLAALLVAALSYGVQADEKSANTLRIGYQKYGTLVLLKARGTLEKRLAEDGVKVQWTEFPGGPQLLEGLNVGSIDFGVTGETPPVFAQRRRRRPALRGLRTAGADQRGDPPAEGLADSVGGRAEGQESRPEQGLQRALPVGPRPRAGRPEVQRHPTRLPAAGRRPRRLRASQRRRLGDLGPLPGRRRDSSCPRGSWWMVASWSTTTSSTSPPGLTRNGIRRCSTSWWTRSARSATGRGPTRSR

SEQ ID NO: 16809 - protein, 691 aa, Pseudomonas aeruginosa
SGRRRPARSPAHPEPVPPTYRHDHRAATPRRRAHSGVNCDEPRDFLVPSHPRRRPLPGHHPGRPCRRPRLPAADRPGRRPPGLRRRTDPHRTFLRGLLAGRRLADPGNPAPEVPRRAASRDHFADRRRAPGGDPGPAVQRPRAVQPGHRRRSRRTGWRRPAPEPRRTLRGLGRIHPHLASRAGGRDRRLRRQAHPGEGRQTALSAVAAAASAAVLRRLLGGRPGPRRRAGRAVPDLGRAAGGGCREDRPGTREGRPPGPPGALRDPPARDRPRDQRGSLAGRRSTDRAPRRRHHRPRPGLPGALRLGRPATHGRAARRFARQPGSQPQSLGRRRPGARRRRYRAGRRRADGGGAGQGVRRAGHRYLHLLRLSAPGRVLPGRRTAVPAPRRAAPGAARGTRLCQPVRRDGGQRHPAPAGRAELRAVGANDMSISKRLAERLAPWALPLVLLAVWQAAVEFGWLSSRILPAPSAVLEAGWALLRSGEIWQHLAISGWRAAIGFLIGGAIGLVLGFVTGLSKWGERFLDSSVQMIRNVPHLALIPLVILWFGIDESAKIFLVALGTLFPIYLNTYHGIRGIDPGLLEMARSYGLSGFALFRQVILPGALPSILVGVRFALGFMWLTLIVAETISASSGIGYLAMNAREFLQTDVVVLAILLYAVLGKLADLAARGLERVWLRWHPAYQVKGGGA

SEQ ID NO: 16810 - protein, 147 aa, Pseudomonas aeruginosa
SLSRTARSASTCRWNCPGRARVARRDWPRWKPKCSTGCWRSRSCRRNPNPFHPCPRNCAGRSNQPCLVPNPPRRNAMTIKAINVRNQFKGTVKEIIEGPVLSEIDVQTAAGIVTSVITTRSVKELELAIGSEVIAFVKSTEVSIAKL

SEQ ID NO: 16811 - protein, 258 aa, Pseudomonas aeruginosa
ASRAKPCATAHPAGVGGKPSVRFRQAGGALRAAVQPGGEQAAGEGDEPVGHQRGEDQGAEQHPRGQRQLAEVGAGAEVEGQRDREERQPDRHALLPARRFAVVVEPGGETVGAALARFVEEPLAAFEPGLARGGVGPGGEGGVVGEAKDHLEFVSAGGRRQRPGAEVAGEVGGEGFAFALPGEEVAVTAGGDAAGHQQGNGSGRHRVSPGTVERASWAPSDNGASPGVVGCVGGQARIVPAVVAKVRCRVYGSAMTSR

SEQ ID NO: 16812 - protein, 174 aa, Pseudomonas aeruginosa
FGASRSANACGIMPGLPLLAYGVFMKVAILSGSVYGTAEEVARHAQKLLSAAGLEASHLPRASLDELKAFAPEAFLVVTSTTGMGELPDNLQPLYYAIRDQLPAWHGLPGGVIGLGDSSYGDTFCGGGEQVRELFGELGVREVLPMLRLDASETVTPETDAEPWLAEFAAALKG

SEQ ID NO: 16813 - protein, 204 aa, Pseudomonas aeruginosa
PGTRCMAKPASTSPRRTKPALVKVPRVACGADSRASSANSTGDHMSGFFAGAKPSRNQASTRASSCGRHSMASPSSRVRPTLPPANARRWKPGCTARYWPSRASLQGASSGHSARARRMSAAAKGNFSTLTNSKRAPAGATRSNSCQAQRKFSPVPKPVSPMHSTSPSPSAAKRSARRLVARNTWRVSLSPECRGKIYVAEGAG

SEQ ID NO: 16814 - protein, 151 aa, Pseudomonas aeruginosa
SKCRASSVPPTRNWSGRRSGASGGACRPRGGPVSSSATGTARCSTRGSRGISRRPSWIRPSMPPNASSACSATKARCSSSSGSTSPRNSSRNASRRWKRTRSTAGSSVRWTGSRARSTTASCITASACCAAPAGTTRPGTWWKARTSATAP

SEQ ID NO: 16815 - protein, 231 aa, Pseudomonas aeruginosa
APFSLHRDVAMSTEPNSPFVDDPLSAVDARILGSLVEKQATTPETYPLTLNALVLACNQKTSRDPVMNLTPGQVGQSLRQLEGRGLVRLVMGSRADRWEHTLGKGLELVAPQVALLGLLFLRGPQTLNELLTRSNRLHDFDDVEQIRHHLERLAGRGLAVHLERRAGQREERYMHLLGSQADLEAAVEAMGSDPERAAPAALSADAEARIAELETRLAALEERLARLEGGA

SEQ ID NO: 16816 - protein, 222 aa, Pseudomonas aeruginosa
WAPTRTRSDPMSLRLGDIAPDFEQDSSEGRIRLHEWLGDSWGVLFSHPADFTPVCTTELGFTAKLKDQFAQRGVKVLALSVDPVESHLKWIDDINETQDTRVNFPIIADADRKVSELYDLIHPNANDTLTVRSLFIIDPNKKVRLIITYPASTGRNFNEILRVIDSLQLTDEHKVATPANWEDGDEVVIVPSLKDEEEIKRRFPKGYRAVKPYLRLTPQPNR

SEQ ID NO: 16817 - protein, 529 aa, Pseudomonas aeruginosa
NPSRLCLLRPHQPGAQEVRLAGEKPGRQRHPGALGVQPGQQPFPGVPQRRQRRFRLDRRPRRGTRAGQRQPGTYRIRRQPPGVDRAAGAQGFADPQPRRAQGAQGGCHQGHRSLPVPAPQPAQRRPGQERPAYRPPAASRRPGSPGEGPGRRLGRTRSAHGGQRVAGRLAAALPQPRLQQLRRAQCPRGFRRTPSATDPPGAGGLRAGAPLGDRASRRGRATACRGSRPAAGSGSPATVAHRFQPAAAGRRTGRRAQGRGADPGGRAPGAAGRGRAEGGRRTDRAAVGRRGHRRCPVGAHGALSHGQPEPATGPASLAPGVATARAGRLAGLGLAAAGTIVVGGAGAPGLAAGLPDAGAERHPADPGGTGSRRAVGACRREPGAGRRRLRDRQRPGPGGRYLGRSQSSRRSLPGAELPGPAGDPQPGLGAPAAALVRHRRDAEDRPHRPRRLLPGLPRAGRRGTRGRSQVGGTGAALPFVALRPGPPHPPSGGAAEPVHRPARGAQPELDVPRRGGADRRHPGPRLPAQ

SEQ ID NO: 16818 - protein, 297 aa, Pseudomonas aeruginosa
RSGNLASGPGDRRDPGPGGPRQAQRWPAPLAGAPGPALARQLRRGGRRMSGLLDLLEIRKAYGDTRVLEGVALSLAPGEVVSLLGPSGCGKSTLLRIAAGLDDDFQGTVERNPILGFGPDGENGRSGGIGVVFQEPRLLPWLTVAQNVGFADGWLEDEHWVERLLADVGLAGCGGLLPKQLSGGMAQRAAIARGLYGRPQVLLLDEPFSAVDAFTRMRLQDLLQDVVQNYEISVLLVTHDLDEAFYLADRVLLMGGRPGHIRREFHVPLARPRDRRAVELAYLRGEALTEMQRAHVL

SEQ ID NO: 16819 - protein, 646 aa, Pseudomonas aeruginosa
PAKPRRSSPSAAGADLLYVAYEPPAPTSEAILLPKDSPIRSVAELKGRKVALNKGSNVHYLLVRALEQAGLKYSDIQPVYLPPADARAAFERHSVDAWVIWDPYQAAAETAVVRAGPGGWSRAGRQPPVLPRHPDLRATASAGARQAGGRDPPGRRLVAGQPAAGDRAGRAAARAARRHHPYRGEAPGLRRAVDHPGGGRGAAEDRRHLYPAEADSQTAEHQGRDLDAAGRQGRQRTLSPYRPHTDTIIARLRHAGALTLESIAMSLEIFWFLPTHGDGHYLGTTQGARAVDHGYLQQIAQAADRLGFGGVLIPTGRSCEDSWLVAASLIPVTQRLKFLVALRPGIISPTVAARQAATLDRLSNGRALFNLVTGGDPDELAGDGLHLSHAERYEASVEFTRIWRRVLEGETVDYAGKHIQVKGAKLLYPPLQQPRPPLYFGGSSEAAQDLAAEQVELYLTWGEPPAAVAEKIAQVREKAARQGRQVRFGIRLHVIVRETSEEAWQAADRLIAHLDDDTIARAQASLARFDSVGQQRMAALHGGSRDNLEVSPNLWAGVGLVRGGAGTALVGDGPTVAARVREYAELGIDTFIFSGYPHLEESYRVAELLFPHLDVQRPAQPEGRGYVSPFGEMVANDILPRQAAQS

SEQ ID NO: 16820 - protein, 338 aa, Pseudomonas aeruginosa
TPASSCRPTWWSWRSCSMPSSASSPTSPPAAWNASGYAGTRPTRSREVAHECPQRRPWRHSAAPQARYPAGPARSGAALRRARGAQGHRPAGSGRAVRRHRRPQRLRQEHPAAPAGRPRPAQPRRVAGRLGGAGRGPRGHPADVPGLAPAAVEAGDRQRRPRPARRLAGEGPAGAAGGRPGRACQRVAGGPVRRAEAARRAGSRADPRAAPAVARRAARRARRADPDRDAAPDRRTLARTRFHRPAGHPRRQRGGGGGRPGDPYRGRRDRPRPAGGTAPAALAWLGATGRAGSRSAQPGAGAAGAAAATRTRFTPAHATALGALTNHASFRIPPGETP

SEQ ID NO: 16821 - protein, 399 aa, Pseudomonas aeruginosa
RTQVKGDLHVRIRGSWPQHRQGHLREGRHRVARSAARGAVRAQAAGALPGDHPDQRHRGRRQGGDGQAPQRVDGPAPDRSAELPPSLRRGTGAAAAVALLAAPAAQGADRYLLRQLVQPDALRAGRGAYQGGQAGSGHRCRRTLRAHALRRRRAALQVLVPPLQETAQGTPQGAGKGPAAQLEAQSAGLEAERGLRPLRALRRARAAPHQPGLRALVRGGRRGRALPRPDRRSHPPRRVAGRAGHQGARQAPAARRAAGVEPGQPRPAGLPGPGPVPGQGRLQGAARRRAGPPGRADPRQALPPAFAGRGVRGQRRGRQGRRHPPCHRRAGPAPVPYRADRRADRRGARAALSLALLAAHPGAPPVHHLRPFLVRPRAGRTHRGLLRTGRLATRLWRDQ

SEQ ID NO: 16822 - protein, 424 aa, Pseudomonas aeruginosa
SVPRAIASPYPRSIRPLPRRPTDNNSEGTPMREVVIVDSVRTGLAKSFRGKFNLTRPDDMAAHCVDALLARNDLDPLLVDDCIVGAGSNEGAQGHNIGRNVAVLSGLGIQVPGMTLNRYCSSGLQAIAIAANQIASGCSEVIVAGGVESITLTLKSVNTDHLVNPLLQREVPGIYYPMGQTAEIVARRYGITREAQDAYALQSQQRMARAQADGLFADEIVPMTTRYAVEDKASGEKQVLDGVVDRDDCNRPDTTLEGLASLKPAFAEDGSVTAGNASQLSDGASMTLLMSLEKALALGLEPKAFFRGFTVAGCEPDEMGIGPVFSVPKLLKAKGLKIADVDLWELNEAFASQCLYCRDRLEIDNEKYNVNGGSIAIGHPFGMTGSRQVGHLVRELRRRNLRYGVVTMCVGGGMGASGLFEAVR

SEQ ID NO: 16823 - protein, 578 aa, Pseudomonas aeruginosa
PRAVVRPTARSDFVGGAACRVGRITPAALSADAPPRKANANPKKPGYCRAFSCARVGGRSGLRLYRHVDQLQALAAPGTGAVGQLDVVVQLAPVRRHDFLQACLPLGSSDLVLEGLLQHRQHDRRGGRGARRGAEQGGDGAVGGGHHFGAELQYAAFLGVLLDDLHALAGLHQLPVLVAGFREVLAQRGHAVVLAEHQLADQVLAEIEVVDAGVEHRADVAAGHRARQVPQRAVLQELGGEGGERTEQQNRLAVDHAGVEVRHRHRRRTHRSLAVDLGQVALDHVRVGGGEERTAHREAGVAFGLGDAGNLQQLQRAAAGADEDEPGLDAGFLVAIGQVGHGHGPGVVVVALEVADLMLQAQLEGVLGRQRAHQLASDLAEVDVGADRHARGGDLLPRLAAFHHQRHPLLDLLGVFRVLHAAEQRAVLQGGVALLEEGDVVVAPDEAHVRDVVDERLRIVQHLAVDLVGPELLGDLEVLVDRHRLADIHRAVRGLAGVVQFAERRVTGARVVPAVGAFFGDLVQALDHLDGPAWFQFVQIGTQGGAHDAATDQEHVDRFFRFDAVFGATQHADAQKHQ

SEQ ID NO: 16824 - protein, 353 aa, Pseudomonas aeruginosa
LARQTGRRLAHPPPSRSRRMIAALRRCRAWLALLAVLAVFPAAEAAAAPAEIRLDYAYYAPTSLALRKFGWLEKSLDGSGTRVRWVFSQGSNRSLEYLNAGSVDFASTAGLAAVLARANGSPVRTVYVASRPEWTALLVRKDSPIRSLAELKGRKVAATKGTDPYLFLLRSLHSVGLDKNDLRIVHLQHPDGRVALEKGQVDAWAGLDPHMAASELQAGSRLLYRNLGFNSYGVLNVREDFAERHPQLIRQVLAAYEQARHWVIGHPDEAAQLLAEEAGLPLEVARLQLSRTDFSQPLPGAEQVAALKAAAPILADERLVRPGVDVQKVVDELIAPQWAAEVIGGVPLARTEP

SEQ ID NO: 16825 - protein, 275 aa, Pseudomonas aeruginosa
AMVSQSLRLARRVSRRAWRLRVPGAWRAWALPLLALSSWEALVRLGWLPAYQMPAPSGILLTLVELARGELWGHVGASLARVAAGFAIGSGLALVVGTWVGLSRRAEAYLEPSFQALRAIPSLAWVPLLLLWFGIDETPKIVLIALGAFFPVYLALVAGVRGVDRKWVELGRLYRLSRFALVRRILLPAALPNLFTGLRGALSLSWMFLVAAELIAATQGLGYLLSDGRETSRPDLVIAAILVLAALGKLSDGLLRSLERRALRWRDSFDGEGGA

SEQ ID NO: 16826 - protein, 201 aa, Pseudomonas aeruginosa
GIPPMLVVSIAGSPSVRSRSGVLLERARDWLSRRGVEVASHQVLDFPAEDLLRARLDSPPVLALAEQIGRADGLLVATPVYKASFSGALKVLLDLLPERALEHKVVLPFATGGSSAHMLAVDYALKPVLAALKAQEVLHGVFAVDKQIAYATESDPARLEPVLEQRLENALETFHLALSRRPQPIDPQLLNERLVNARWSI

SEQ ID NO: 16827 - protein, 170 aa, Pseudomonas aeruginosa
SVRRQRTRAAARLHNAHTTTSLFRQRRGRFGTHNDKGERHAHHRFASWTGGPAGGGPVLRRSGRREVGQHPADRLPEIRHPGPAQGPWHPGETSRRRRREGAMDRVSRRPATARGTQCRQHRLRRDRRNPAGLRPAPPAPTCSTWPTNRRRRPARRSSCRRTRRFGRWPS

SEQ ID NO: 16828 - protein, 138 aa, Pseudomonas aeruginosa
SGTPTRPPPRQQLSARVLVDGRELVDNHQFYLATRTYAQRHPQVLDKLVDEIRQVGDWSRANPQQVTEQVAPLLGLPADITLTAVKRQGYGAQLITPAVVEAQQKIADTFTQLKLIPKPLSIKDVIWTPPAGKVASAP

SEQ ID NO: 16829 - protein, 171 aa, Pseudomonas aeruginosa
SRTSTTTPSPAPRPPWRASTRSASNAWPRCTAVRATTWKSAPISGPASAWCAAAPVPRWSATGRRWRRGSGSTPSWASIPSSSPAIRTWKSPTGSPNCCSRTSTCSARRSPRDAAMSARSARWWPTTSCPGRPRRVESGRSERHEHFQTTGRAPGALGAAAGPAGGVAGGG

SEQ ID NO: 16830 - protein, 507 aa, Pseudomonas aeruginosa
VRLAVQPHPPRAQRRTRGRLGAAAQRRDLAAPGDQRLARGDRLSHRRRHRPGAGLRHRPVEVGRTLPRQFGADDPQRAAPGADPAGDPVVRHRRVGEDFPGRPRHAVPDLPEHLPRHPRHRPRPAGDGAQLRVVRLRPVPPGDPARRAAVDPGRGALRPWLHVVDPDRRRDHFRQLWHRLPGDERPRVPADRRGGPGDPALCRPRQARRPRRPRPGTRLATLAPGLPGQGRWRMNAHNAALGGTPQRLKRGIPLALRGVARRFGEREVLKDIDLLVPAGQFVAIVGRSGCGKSTLLRLLAGLDQPSRGELLAGSAALAEAREDTRLMFQDSRLLPWKRVIDNVGLGLRGDWRAKALQALRAVGLAERANEWPAALSGGQKQRVALARALIHEPRLLLLDEPLGALDALTRIEMQHLIEGLWREHGFTVLLVTHDVSEAVAVADRVILIEDGEIGLDLPVELPRPRSRGSARLAALEAEVLNRVLAQPELPPQPEPVSPLPTQLRWAL

SEQ ID NO: 16831 - protein, 251 aa, Pseudomonas aeruginosa
RMVRLISTSCLLRISSSLIPMKVRRRRSLTRIRAIPGSSRGMSLAPSDQLQKFLAGGVRVAERAEHHRGEHLRVLLLHPAHHHAHVLGLDHYRHAGGAGHLADRLGDLPGEVLLDLQAAGEHVDDPRHLRQAEHLAGGNVRHMSLADEGQEVVFAQGVQLDVADDDHFIVVRGEQRAVDDFLQGLAIAVAEVLHGLGRALRGVEQAFALRVFAETDEDLPVMLGKCWVHKGSLAPHLTWRPPFTVRVVPVT

SEQ ID NO: 16832 - protein, 269 aa, Pseudomonas aeruginosa
AGHYAACVRRAGRTESMQTGRKSTISVRALSSGCHRAAVDTAANLRHHGGNDPCLSSDAAHHPRRCAVVRGRPRSALNRSRRYTMSTAPVTLLVARRVAAGRYRDFLAWQREGEALAADFPGYLGSGALAPPAGGDEFQMIFRFADDATLAAWAHSASRQAWLERGQGLFDEPRERRAHGLAAWFDDNRKPPRWKQSVAIWLAFFPVSLAFNLGAGPYLGELSLAARVLLSTLVLTPLMTYWFIPLSSRLLAPWLHRRPQRAASLPEAH

SEQ ID NO: 16833 - protein, 161 aa, Pseudomonas aeruginosa
NGHRPRHRAVLPVRTPPPALHRQGSCGVHSHRQGARPVEGGADRRHVRPPPADPGEPHPADRRGGPPGDQRRRRGGSDRGPAHVHDDARGGEAELADVHLGDARRVPRLEHHPPGISAIDRKEQVTCRDWNREWRESASRTCACAPSSGSRRRKSSTSRTC

SEQ ID NO: 16834 - protein, 156 aa, Pseudomonas aeruginosa
NRVRARVLRSGAASRSGSARRARRAARRATAGAARGSAREPARRAASARRTGPPATRWHARPGRPPAAPAGPSPASRRAGRGRRCRSPASTAAGASPGTSAGCPRGPRPAPPSRPATRRGWAGRGRPAGAAGCSCRSRCGRRWRRTARPEPAGRCP

SEQ ID NO: 16835 - protein, 276 aa, Pseudomonas aeruginosa
PDAFQAAGGEVGELAEDGIEQDRQDHHVGLQELAGVHRQVTDARAGGNGLGDDQGQPHEAKGEAHPDQDRRQRAGQDHLAEQGEAGQPVAARHLQQAGVDAADAVVGVQVDREQRAEGDQENLRRLVDAEPQDHQRDQRQVRHVADHLHRTVEEAFAPLRQAGDEAQHQADGAADEKADRRAPAADRQVLPDLAAAQQRPAGLEYGAGRGEDAAGQPAELNRRLPHRQQDQRQRPGRQALGQSFGNAHVVRSDRSQLCAACRGRMSLATISPNGLT

SEQ ID NO: 16836 - protein, 167 aa, Pseudomonas aeruginosa
PEKMKVSMPSSAYSLTRAATVGPSPTSAVPAPPRTRPTPAQRLGLTSRLSREPPCSAAMRCWPTESKRAREAWARAMVSSSRCAISRSAACQASSLVSRTITCRRIPKRTWRPWRAAFSRTWAIFSATAAGGSPQVRYSSTCSAARSWAASEEPPKYSGGRGCCNGG

SEQ ID NO: 16837 - protein, 154 aa, Pseudomonas aeruginosa
SRSAPAALGEDRRGFAGHAEVDAADIESLEQLRAAGKLGPLHLHAVFGETFLQGATGLEQDQGAVFLVADPQGVGRLLVGLNAVGQGRHQQGRQSTTQSDGAHGALLCRCGCRTCRAVDGTVRSSCVRCAIGPRRACAGGGRIRCSSGRSPGAR

SEQ ID NO: 16838 - protein, 133 aa, Pseudomonas aeruginosa
RPRAIAARCAMPPDSCLGSNPPQPASPTSASRRSTQCSSSSQPSAKPTFCATVSQGNRRGSWNTTPIPPLRPFSPSGPKPRIGLRSTVPWKSSSSPAAIRSRVLLPQPLGPSRLTTSPGASDSATPSSTRVSP

SEQ ID NO: 16839 - protein, 244 aa, Pseudomonas aeruginosa
SSETLRSASAMIGKLTRVSWVSLISSIHFRCDSTGSTDSARTLTPRWANWSLSLAVKPSSVVHTGVKSAGWENSTPQLSPSHSWRRMRPSLESCSKSGAMSPSLRLMGSLLVRVGAHYAQGRLTLKRINSDFLITKNRIPNPSPGNPSPFVRRPAARPTPAYTENTLARYPGVAVMLGKRSTDPTPATRFRSDRISSVNGQYFFSTREGTLEGPYFTRFDAEREIDAYIRRMRQSAEIHAPGSR

SEQ ID NO: 16840 - protein, 380 aa, Pseudomonas aeruginosa
PESFKVADRRAAVCAAPRHVRAAPRRWPAKPRKMRHPLFQVLPCPTSSMPSSTGTKTASRYPAPSATYIFPRHSGLNETRHVFLATNRLAERFAALGDGEVLCIGETGFGTGLNFLCAWQLFERVAPAGARLEFVSVEKFPFAAADMRRALALWPELAPWSEALLGQYLAVHPGFQRLAFAGGRVGLTLLLGDAMECLPQLDARVDAWFLDGFAPAKNPDMWSPVLFAELARLSAPQATLGTFTSAGFVRRGLVEAGFAMQRVPGYGQKREMLSGTYQGPPANAGKPWYARPAPHAGRRAALVVGGGLAGCASAASLAARGWQVTLIERHPGLAREASGNPQGVLYLKLSAHGTPLSRLVLSGFGHTRRLIERLRSGPGS

SEQ ID NO: 16841 - protein, 429 aa, Pseudomonas aeruginosa
ESHGDSPDPDHRRQPACRPALRPPPAGRRRVGDRQLPQRTPGAGRTAPGRRADPARRLRQRGRHLRLHRGPPTAYRQPASDRPQRLGLGRRDARPRSRGVPATVQRAHARALPDQPALRRAAGTLAACRHRPPHRRRGAQGQRPAYRLLREQGRAGQPDPVVRRALRAEDQGQRHFTGAGDVQRRGRRRIPRPHPGEIRPRHRAGAGSHLPEPSLPVGQPLRHRDHPDRERRPPRQVRRQGPLMNPALSQHYREILVGLGEDPQREGLLDTPKRAAKAMQYLCHGYGQTLEEIVNGALFASDNDEMVIVRDIELYSLCEHHLLPFIGKAHVAYIPTGKVLGLSKVARIVDMFARRLQIQENLTRQIAEAVRQVTSAAGVAVVIEAQHMCMMMRGVEKQNSQMFTSVMLGAFRDSNTTRQEFLQLIGRSK

SEQ ID NO: 16842 - protein, 270 aa, Pseudomonas aeruginosa
HAATGTGNGANPRQGPAPAHLHRDQGGGNPQQAGRADQPDHPLPGRGRRGGQRHRARAELPHHHQGDHPPRRGEPLRPARTDDPGNPRPGDGEPGGALRRGGSGQAARAALRRVGLDHPRRPPLRRPTSEPREDAHKRCPPAAPTLIIAGPGPVPSPCPEPSSRNTAMTAANLTEQQRLELEAAAFRTLVHHLQTRKDVQNIDLMNLAGFCRNCLSKWYKAAADDLGVEVSNDQAREEIYGMPYAEWKAKYQKEASPEQQAAFAKSQGNA

SEQ ID NO: 16843 - protein, 129 aa, Pseudomonas aeruginosa
GHRAPCQPCPRHHEPVSMTLTDFRARLRSEHHLFTDTLAFIAEHYSYTPSAFDNGSVSNPAGQNEGSCKTLGFAILEGLSLEETLLAFGEHYRAVRDNPEGDDHANIRALQQTGLAGVHFERQPLSRRG

SEQ ID NO: 16844 - protein, 270 aa, Pseudomonas aeruginosa
NGFGLRRQLRLRQHPVEHFGFQRGQSRRATRARPGQFHRQVEADLAVLDKDHPVGHRHRLADVVGDQQDGETVFAPESFDQVLHLDPGQRVERAERLVEQQQARLVDQRASQRDALLLPAGQGRRPLVGTLGQADRPQRLQGLRPPVAAQAEADVVDHPLPRQQARVLEHQPGVLAGLGQRRRAGQQLAAAGLVEAGQQAQQGALAAAAAADDGDELPGRNQQVDVLEHLALAEAPRHSAQGQRDTALEALRSAAKGGVVGIHAPPPLTW

SEQ ID NO: 16845 - protein, 164 aa, Pseudomonas aeruginosa
IGNSVPRATRKIFADSSMPNHRITSGISARCGTLRIICTELSRKRSPHFDRPVTKPSTRPMAPPMRKPIAARQPLIARCCQISPLRSSAQPASSTALGAGRMRLDSQPNSTAACHTASRTSGSAQGARRSASRLEMLMSFAPTALNSARPAGAGCRWPPSRRTG

SEQ ID NO: 16846 - protein, 150 aa, Pseudomonas aeruginosa
LPGCRANRRAARPCVAGRPSRSAPGRPGRGRWCRRRGARSVDRRPARLPRWSRGRSRAGGSRSAPGGPGGRPSRVPGRSSRQPPPAARPRSGTARPARRRGPGRPPRSRRSTAADAAAATADRAVWRPSPGCACRRSRRSRPPARDARCG

SEQ ID NO: 16847 - protein, 223 aa, Pseudomonas aeruginosa
GRRVCVVQSGRGARALAADGSDAPAGVHQALVEQLRVDRLRPSREGQVEGFQGVFQALLEDRFQARRVALGGVGDLLVHGEYAMQYLLGLERGQDRLQCIVHGQHVRAAATGSERQHHLVLQGALGQQVEQDLQRAGKRGLVHRGGDQQAVGAADLLGQRQYRRTVEAGTQQVLGGKIQHLVAGHLDAATAQPVPGTLQQHPGAGAYAGTSGDGNDEHGGDSL

SEQ ID NO: 16848 - protein, 271 aa, Pseudomonas aeruginosa
PPRRAPATAPRPPAPAYRHRPCESPAGRAGRSCAALPVEAVAPAQGPALQRAEQAIAELAEGRQDQDRGDHQVRTRGFPTVTEQVAEALGGGDQLRRDEEHPAQAERPAQAGEQVRQRRRKEDAADQGEARQTVEPPQFHPLAIDPAYPGDQREVDREEGAEGDEDDLRRLVDAEPEQQQGHPGQAGDRPQGLEARLQVGFGATTETDPGTDHQGQAAADREAGGDPRQARAYMPPQLAASQFHQGQQDAARRRHLVGRQPAQAHQRLPRR

SEQ ID NO: 16849 - protein, 399 aa, Pseudomonas aeruginosa
CQQRQGPGPPGARHAQSPRPARDSPGQSQALADHGSGLRARQRDTADDLGGPLRRDQFVDHLLHVHARPHQALVRQDRRRGLERGDLFGARQRLAEIGARQLQASHFQRQAGFLGKQLRGLVGMPDHPVARLLVGRQHLADQLRMAFGEILADIEHAVAVEAEVAVEQPRAGLQLAGRHVRIESGPGVDLALLQGYPAVGMLQVDDTQVVLVQAYAVQAAEQEQVGIGALGGSHLAPLELGEAADRRILAHQQRGPLRAAGDVYGTYRAAVGPREYRGEAGGRGEIDAAGVEVLQGTVAALAEHPAHPGAAAVQAFLQPAELPERQAGGGVVGIVETDFSGGGGGLCRGKHGKNGEQGQPGPAATESGDHASAPGRRWMSEPSPRLAGKSEPVSEMDGG

SEQ ID NO: 16850 - protein, 578 aa, Pseudomonas aeruginosa
NVQEREGRYSRRNAEANVTACERTHIGGEFQYHSPGEYLPCRAYPRFSTFSSGKSMKKILLMLLCVSVLGCSKNSVESEKPVDVLLIGGGIMSATLGTYLNELEPGWTIEMVERLDKVAEESSNGWNNAGTGHSAFCELNYTSEAADGSMDISKAVAINENFEISKQFWAYQVDRKVLNDPKSFINNVPHMSFVWGDDNVAFLKKRHAALQHSSLFRGMEYSEDPEQIKQWVPLVMEGREPGQKIAATRMSIGTDVNFGEITRQLVGSLSAKDTFKLRLQHEVRDLKRNDDNTWTVTMADLANGDKETSVKARFVFIGAGGGALKLLQISGIPEAEGYAGFPVGGSFLATTNPDVVKRHLAKVYGKASVGSPPMSVPHLDTRMIDGKPVLLFGPFATFSTKFLKNGSLWDLPGSVTSGNIGPMFNAGIDNFDLSQYLIGQLMLSQDDRMASLREYFPEARDEDWKLVQAGQRVQIIKKDAEKGGVLQFGTEVVTAADGSVAALLGASPGASTAAPIMLSVLEKAFKDKVATPEWQARLKEIVPSYGRKLNNDIELTNSTRAWSSERLQLIHVPVQPEA

SEQ ID NO: 16851 - protein, 144 aa, Pseudomonas aeruginosa
RRWRYPPYPTGSAAHKVTAGRRANNRSRLSAGTCMSPIAPSRDITPLLRAWPGAPPAPPGASPARRSALPHRPTERPARRVPGRCPSPPRRPRGRPGCRAGACSAPRAARRDAPGARPGHGRRGVPGGGGSARRRRNRVGGCCG

SEQ ID NO: 16852 - protein, 594 aa, Pseudomonas aeruginosa
GSADRFPGWSPASRRGCRESVHRRRSAGRRRTASWARWTSLHPYARKKAPSLARVAGDGTERHVNKTHEASPDLRGPPSRTGSAYGFEQPAGAHAAADAHGHHAVAQVAPAQFADQMTDLARAGHAERVADGDGAAIDVVLLVVDLQPVAAVQALRGEGFVEFPEIDVGDLQPLRLEQLRHREHRTDAHFVRLAAGHGEATEEGLRLQAQRQRFLQAHQQGHRGAVGELRGVAGGDRTVLGERRLQRGQAFEGGVRAVAVVAVDHSVEHLLLAAGLVLHRVAGGHRHDLVGEQPVRLGSRHPLLALQGVGVLGLAGDAVATGDDLGGLPHGVVDARHLPLQQRVHQVVGVDALQGQGDRLDAAGDDHLAATGSDLVGGDGDRLQAGGTVAVEGHPRHLDAEAGEHRHVAPDVVALGAFVGAGANDAVIHQQRVEVVARQQRVDAVGGHVVRPGQVELAAEGLGQAGPDAVDDHHFTHGGTLAVIVGRPPGQRPDRARIRRGNRARHRSFIRRMRRHPLERTAPHSGGPHLSFLYAASMASLMVRSTLTRAKRLSLASTRVQGAISVLVRSTISPTASTYWSHLSRLRQSSSVIL

SEQ ID NO: 16853 - protein, 136 aa, Pseudomonas aeruginosa
PCCWAMPWSACRSSTRGSTPGSSMASPRRRTRTCGRPYCSPNWRDCRRRRRPWAPSPAPVSSAAGWSRPVSPCNGYRATDRSARCSAAPTRGRRRTPASRGTHAPRPTPGAARHWWSAAAWPAAPAPPASPRADGR

SEQ ID NO: 16854 - protein, 289 aa, Pseudomonas aeruginosa
TLRKPTGVSRALCRMRSPSGTHRINADRPQKHHFGARPVIGMSSRCRRHGSEPSPPRRERSLPVLRRSPPPPAMRRCPRAPTKRAQPFQEIHDVYRSRYPAGGPPRRRRPLPRLPRLAARRRSPRRRLPRLPRLRGAGAARRRRRIPDDLSLRRRRHPRRLGPLRLAPGLARTRPGALRRTARAPRPRSRRLVRRQPQTAALEAERGDLAGVLPGLAGLQPRRRPLPRRAVAGRAGAAQHPGPHPVDDLLVHPPLQPPARPLAAPPPAARRQPAGSALTACRPPRRGGP

SEQ ID NO: 16855 - protein, 259 aa, Pseudomonas aeruginosa
RKALPDWLSRVPCIHPIPFACCESPMATAPILITGASQRVGLHCARRLLADGESVIVSYRSERPALDELRQAGALTLHADFASEAGIFAFIGALRQHTDSLRAIVHNASDWVAETPGHEAEAFQQLFSVHMLAPYLINLHCAELLERSQPADIVHLTDDVARKGSARRIAYCASKAGLDNLTLSFAARFAPRIKVNAISPALVMFNDGDDAEYRARTLAKSALGIEPGPEVIYQSLRYLLDNPYVTGTTLTVNGGRHVK

SEQ ID NO: 16856 - protein, 128 aa, Pseudomonas aeruginosa
TQHFPSITGRSSSVSAKTRSAKACSTPRSARPRPCSTSATAMARPWRKSSTARCSPRTTMKWSSSATSSCTPCANTTSCPSSARLMWRTFPPARCSACRRWRGSSTCSPAACRSRRTSPGRSPRRSAR

SEQ ID NO: 16857 - protein, 129 aa, Pseudomonas aeruginosa
SEGASDMPRLEPGMARIRVKDLRLRTFIGIKEEEILNKQDVLINLTILYPAADAVEVNDIEHALNYRTITKAIIRHVEENRFALLERMTQEILDLVMENPAVRYAEVEVDKPHALRFAESVSITLAGHR

SEQ ID NO: 16858 - protein, 143 aa, Pseudomonas aeruginosa
ATRPGRTKVPARPWASPSSRASASRKPCWPSASTTVRCATTRKATTTPTSAPCNRPAWPACISSASPCRAGAEKSRSPPRRITASGYSPYRPLHSDPRQPSPPAGLADTRRKKAGPPRGPRPSRRRKRGAASVTAWRWIPRWT

SEQ ID NO: 16859 - protein, 278 aa, Pseudomonas aeruginosa
SAQRSCVGRGETGSGCGGSSGCASTRLSTSASSAASRAEPRERGRGSSTGRSRPISPSSIRITRSATATASLTSWVTSRTVKPCSRQSPSIRCCISIRVSASSAPSGSSSNSRRGSWISARASATRCFCPPDRAAGHSLARSARPTARSACRAFARQSPRRPRPTLSITRFHGSRRESWNISRVSSRASASAAEPASNSPRLGWSRPASRRSRVLLPQPLRPTMATNCPAGTSRSMSLSTSRSPKRRATPRRASGIPRLRRCGVPPRAALWAFMRHLP

SEQ ID NO: 16860 - protein, 454 aa, Pseudomonas aeruginosa
SPGAARSRRCAAAPSRPRVRRWARGGCGWTASRTQPPPATPPAGPAAAPRAPGARPVVWKCSCRSLRPLSTLRGLPGQDVVGHHLAERADIAASLGLRRALHVEVREQQFGDPVGLFQVRIAGEDEGIDAQLGVLPDPRRHRRPVADQRGTGAAAHQADAGPEIGADFQVVARTAVQRGHALLADRVEARQGGLGAGDGVVVEVRDQSIGGLPGFLAGLADDHVQADPEAHLAALAGGLLAYLGDLLGNRRRRLAPGQVQLDLLGGEVLGGLRGAAEVQRRTRLLQRRIEQFGALHLDVLAGVVDGLALQHATPDAGEFDRGLVAFGVAQVQAVASQFVGIAAGDQVEQRAAVGQPVQGRRLARGDGRRNDPGTQRDEELQALGYRDQRGGDQPGVLAGTSGGDQYAAEAQAVGGLGDLLQVAVVDGTGALGGAQVVAVAVGGKEPENLEAHRN

SEQ ID NO: 16861 - protein, 138 aa, Pseudomonas aeruginosa
NWWLSTSSRPSTRTRADNCCLGGGLVGVPDHPGVDAVTLEGGAGVGRRQVDGLDVAVLQAGLLEGADQQVMHVGALVQGDFPALQLGHRPNRRVLRQEDRLAGRRRRFVGHVEQVGAGGAGRRPAGFRRSRRSRCCRH

SEQ ID NO: 16862 - protein, 330 aa, Pseudomonas aeruginosa
QATSYSNKCFLFIYLFHKAYKNPVRGLASEHVRPLHFGQGLAAQVGQLHRPAIAGTRQRYVELAADVSGTAAHQQHAVGEIERLVEIVGDQQDADLVVLHHVLQQVLEAHAGEGVDRAERLVEQQHLRPSVETAGDRRALRHAAGQLLGQQSSAAGQSDIGEQALDPVLVLQPAVGETDVLRHRQPGQQARLLEHHADSAAAAVLAVRAEAEDRVAFDSALEVIVQSGGDPQQGALAATTGAEQADHLAGRQRQRHALQHPRIAIGLANLQQVEQAAHAPPSPSKLSRQRRARRSSERSRPSLSLPRAARTRIAAITRSGREVSRPSLSR

SEQ ID NO: 16863 - protein, 148 aa, Pseudomonas aeruginosa
AGSQPRRTSASHDDSASSGKAQARQAPGTRSRHARRETRRASRRLWLTMAQGSVRANGTPPMTSAAHCGAISSSTTFCTSTPGRTRRSSARIGAAALSAATCSAPGSGWLKSVRDSCRRATSSGRPASSASSCAASSGCPITQWRACS

SEQ ID NO: 16864 - protein, 259 aa, Pseudomonas aeruginosa
KVPPAVPAHAGGTNPASAVGLGRQAQVGLHRAVAFGETPLDLFLVLQRRHDYHLVAVLPVGWRGDLVLVGQLQRIDHPEDLVEIAPGARRVGDDQAHLLIRVDDEQRTHGQRVVGVRVDQVVEFGNLAVGVGDDREIDPGVLGLVDIVDPLQVRLHRIHRQRQDLDPALGELVLELGGETQLGGAHRGEVGGVGEQHAPAVAQPLVEADAPFAGVLFEIGGDVAESEAHGVTPCSCWSPLCPRPADVKKNKFRFSYNQK

SEQ ID NO: 16865 - protein, 163 aa, Pseudomonas aeruginosa
PTWREPVMPNGWPMAMEPPLTLYFSLSISSRSRQYRHCEAKASLSSQRSTSAIFSPFALSSFGTENTGPMPISSGSQPATVKPRKKAFGSRPSASAFSRLISRVIEAPSESCEALPAVTEPSSANAGFSEARPSRVVSGRLQSSRSTTPSSTCFSPLALSSTA

SEQ ID NO: 16866 - protein, 141 aa, Pseudomonas aeruginosa
HGGWRRPCRPRRCPRTPRPANAGGSACRGSARPGGPARRRAAPCRRPCPGTGPGPGSPAGRGCPGSTPAARRAAGAWRAPWWPARPATLRGGCDRRSGRGSARPRLPPRTRARSPGWCGAARARRNARSGRRPRSASSPAD

SEQ ID NO: 16867 - protein, 347 aa, Pseudomonas aeruginosa
NAPSAFSGSAMSDFQHAQLDWDENGQPLSRAFGDVYFSPAFRAQRDAPCVPRHQPPGRALRRAGRRRGAVHRGDRLRHRTELPLRLAAVRAGRAGRRALGVRQRGEIPLRRRRHAPRPGAMAGTGALERGPAGPVPCRAPGLPAPGVRGRKGRPDPAAGRCHGVPAAARRAGRRLVPRWLRPGEEPGHVVARTVRRTGATVGAAGDPGHLHQRRFRPPRAGRGRFRHATGTGLRTEARDAQRHLPGAAGERRQAVVRTPRAPRRAPRGTGGRRRPGRLRQRRQPRRARMAGDPDRTPSRPRPGSLGQPPGRALPETLGPRHAAVAPGAQRLRPYPPADRTLAVGARV

SEQ ID NO: 16868 - protein, 169 aa, Pseudomonas aeruginosa
TSRARWHRRRARPCARFPAVRRRDRCQRDRVRSGCSDRATARGPAHSRCRRCARPARRVSRHRWRPWPRPGRRYRRRWGQGSARRGGRPARHGCRRCIAGSDRPGHSRHSRWPAPPASATCRSRWCRRPRCRGWRTARSSRYARRPAYRSARFAGCRHGCRRSAGYPWR

SEQ ID NO: 16869 - protein, 242 aa, Pseudomonas aeruginosa
KKRFAPMAGKHYQDADVHAATLSRLRLVFRNFERVCVAFSGGKDSSVTLQLALDVARELGRSPVDVLFIDLEGQYQATIDHVSEMLGRPDVRPWWVCLPLNLRNASSLEEPYWCCWEPGAEADWVRPLPKQRGVISDPAFFPFYRYRMEFEEFVAGFNAWLARGRAYRVPGRHPFGRIAQSLPGGQAQEPGETMRLDAAGRLRAAGLERARPGQPAGGELLPDLRLAFRGSLALRRRPRLRL

SEQ ID NO: 16870 - protein, 223 aa, Pseudomonas aeruginosa
RGAAFQAGFRIARAVPRTRVFPLLGVAGGAVGRTARPGSGRAGGQADVLVFDEVVQGGDPVQPAEAGLAVAALLEFVVDLGPVVDPHGAGANLPRHPEGTRDIAGPDPGRQPVLAAVGQGDALLLVLEYLQGQHRSEGFLLHDVQVRIIDLQQGRTVEGAGRQLALGYRAAADHHPRAGGDGLAYGSLDALDVGLVDQRPHVAARVRRRPHAQVFQALRQAFA

SEQ ID NO: 16871 - protein, 147 aa, Pseudomonas aeruginosa
PFGNAALHQQARTGHAELPGEHRQRLLQHGQGGVQVGVVEHQVRCLAAQFQAEALQVPRAGGGNRSAGGARAGEADHRHLGRVDQSPGAFGTRFAEDVHRPGRQRRRFGDDPRDHGVGLRGLPRHLHHRGGTGGQRRRQGADHQHHR

SEQ ID NO: 16872 - protein, 778 aa, Pseudomonas aeruginosa
IPRHDDAGDAHRLAQHQRHHVGARRAAGAPFAARQAGVVAQLARHHADLEGSLGLDLAVLQGKQVDERIGMPLEGRGDFLQGFRAQRVVVLPGTIFEGAHSGGDRRIGLGPPAVGVGADRLAAGRVEGLSPLRGIEPCAVDPVSGVSVHLQVLLGRSGDALREVLGNGDGGDVGGHRNGIGEDRGVDHPQSLQAMHPALQVDHRPALAGAAHRRAGGRVVVGIEGGADRRFDLRIAACLGPRPEFGVDQPGERFAAAYPARQLDPFQQPRAVFGLGEEVQVDQRRDGRVAAGQAHTAQRLRPGQGHGEDEADPGRAHLGGEQVGGGDVQVQLAVLRPRAMGPELGADHRRLRADALRPGGIGVVVERMVLEPAAHRQVGKQRDRQRLQLVGRADTGAQQDRRAAVGAGAEDHFAGVDFLAGGQAHAHRALAFEEHPVDQRVAADRQVGASAHGVVEVGHAGVDAHTVDDIHRVRPDAVGVGAVEIGDGLETVGQGGVDEGPLHRREIGAAQLPHRQRSVPAVQGRVAALAGLQAAERRQQVVVGPARQVPAGEVFAPRADRHRAVDRRAAAEDLAADRMDRVPDRPRLGLVAPVAGGVAADAVAAGDDPGVVPGRIGLAGFQQQYPAVAALAQAPGEDRAGGAAADDQHIDPAAIEGLAGRFRRGAGHAGRAAEQRAQGERGGAGDGLRQQGAARRVFGLVHGVLPYPDRLTGATLCPARPRRQTAEGEPLVRFFRTQPGGNRPRSMSARSQGAGSPISSSRNWPRTRIFRGVRWVLR

SEQ ID NO: 16873 - protein, 133 aa, Pseudomonas aeruginosa
QRTEGGDQAALRPSSYTAGRRWRTRRERRSGFHPGRRRRPCAVASRGDGEIPSMNRAKLYLCCVALLLVPAIAGAATADYVYGMPLDVARVLSVDEAPSDTCQVVRATLVYLDSHGERQVLHYLKQARACSNE

SEQ ID NO: 16874 - protein, 652 aa, Pseudomonas aeruginosa
FAVQAQELRFLRLNSSEAVRPASAGAGGRRLAYPSPGSIMARSNRRKDWEHGVQTDSTGLLRATGSGDLHRQCPPRILLPGRAAQTLRLPLLQRRVPGTGDQGIGEQLRQAAAGHPQGRALQQVPALHPPAELRVVRRGRRGRSAPGRIRRGGRPAAHPRQAGRLRRGIRSGHRRGSRAATSGPGRRGTAAGLRRSAHRRSRRASAENATATAHPRFRTARRHLPPGPRRAAGGRVQATGHPHQRPRPDSAARLFPAHRLCHPGQRRQGILRRRRPGPALRCAEPAAGLPLQVPRPHRRQAGIPLRRSGNLAGLSASALPRRHPRLRRNGALLHPLRPRAAHRSAERQELQPGAGCPAPPGDHPRSGEGRRPSELVVESVADQHVPRRVTDVQLRLNLGEHRLGRDPAGPEQRDLVRRERHRVAVVGPRQVADADQRRIAQVQRCAMGHREAAGDLDRPDRLGGLQRPHRYHRGPGQATARPGSDGAAVHRHVAPQLEVAQADAGVEQRLFEGERAADGEGDEIRFPEGADVAHLDGLLTASMHPVARQVAAHVDIRAEPGEVRRAGFADVEQRAGPGVQGTEAKELVGPGFLQDHQVGLQVALAEAAGMAGVVAAADQLAQDRRRQLREFVEGRFGHGGSVRWRTSLLAGL

SEQ ID NO: 16875 - protein, 459 aa, Pseudomonas aeruginosa
LDARWPASKNATTGCDGAHRIFITPITTIGAPMEKHMTLDAGPDASRDGHFGWYRALDKQERRAFWSCKIGYGLDGMDTQMLSFVIPTLIALWGIGTGEAGFIHTMTLLASAAGGWIAGILSDRIGRVLTLQLTVLWFAFFTFLCGLAQNYEQLLVARTLIGFGFGGEWTAGAVLIGEVIKARDRGKAVGLVQSGWAIGWGLTAILYSLMFSLLPPEEAWRALFMLGLLPALFVLVVRRLVKEPEIYREARQRNQGADKVSFYEIFAPGMLSITLRASLLTTGALGGYYAITAWLPTFLKTERGLTVLGTSGYLAMVILGSYVGYVVSAFLTDLIGRKKNFVLFAVGSFTVVLLYTQLPVSNGAMLWLGFPLGFFASGIFSGMGSFLTELFPTRIRGSGQGFCYNAGRAIAALFPMLIGMLGQKLSLGLGIGAFAAVSYGVVILAALSLPETRGKQLEL

SEQ ID NO: 16876 - protein, 417 aa, Pseudomonas aeruginosa
AVDRGNPSMHPTPRLAAALLAGSGLGWPLLAQADLVEDSHASLELRNFYFNRDFRQSGARDNADEWAQGFLLRLESGFSEGTVGFGVDAIGLLGFKLDSGGGSGGTGLLPADGSAGGSQDDYAKLGLTAKARVSNSLLKVGALHFKSPLVSANDTRLLPELFRGALIDVQEIDGLTLRGAHLDRNKLNSSSDYQVFSANRIGGRSDAFDFAGGDYRLTPALTASLHQGRLRDIYRQTFAGLVHTLDLGGQRSLKSDLRFARASEDGGFRELDNRAFGALFSLRLGAHAVAAGYQRISGDDPYPYIAGSDPYLVNFIQIGDFGNVDERSWQLRYDYDFGALGLPGLSFMSRYVSGDNVARGAANDGKEWERNTDLGYVVQSGPLKNLGVKWRNATVRSNFANDLDENRLILSYSLTLW

SEQ ID NO: 16877 - protein, 749 aa, Pseudomonas aeruginosa
DRVVAIGRQRGGQRIAVAVDARALPAAYRGTAGALGLDQGEGIADAGAKGQPVAVGDQRATDAAAVLPVAIALGIAGIHGGQRRLLLQRAVPGGVGDLAVAVGGQRVAPGTLVAQRTVQPGLQAAATAVAGAPGIHGAERRRPTGRTQRHGDAEGQGVVALAAAPVAPEQLDARVLVALLLVVGGGLPRPGEVVAQLPPGIGVAELQLGVAALAVVEIAGGAGKIEVAVTAEGLAHQQVELVALLVAAGIPSVPVAQCVARAEHVAEFAVAFGGIAVAGQGQGSAGGLEGPAVLEPDAPALLARAILDACAGIGAVQAEGAEAGGEDAAAQHGQVVVGDTQSQVGGQGVAHAALVGEVGEQVVAVAILARLAQGEAVARQAGTHGLRDRGERHAEARYAAIGFEHLDIQIAGIGAVVEIVDDERTGGDIHLADLPAVLADHHPRRGGRGAAHLRRIAAQGLGQHAVVGGQAQAAVADAAEQVAGGVALPRRQFAAPGRQGALGIGADAVPLAPGLPVVAGIGVVGLVAQTPQAEVDAAVQADIGVVRSSRFAAAVFGAIEVGVVVDEAHAVAGVPLLGADVAARLEVEQGLRHREIQAQAGDVQAEPRAGQACIEKGAVAPVAALARIVTRLGAEALAQEVFVEAGLHRAAGGVGAETHFAAAGEALVEVDIDVIATRIDPTVLVEARQVAAAQGRAEQQAIIEFVAGLGMTEGARRQRHAARHQGRAGAAAAFMAIGHDGYPYGRRSR

SEQ ID NO: 16878 - protein, 280 aa, Pseudomonas aeruginosa
SATRRSSPSTATAWSSRSSSPASTPGWPGEEPTAFLVGIRSDESLNRYLAVKRRSRAKQCAWTPPGGSAPLAWSARDRANPQAVSFFPIYDWRFEDLWRCVADHGYAYNRLYDQMYRAGVPFSQMRICQPYGDDQRKGLDLFHRIEPRTWFKVVRRVAGANYGARYCRQRFLGYRGGLGLPPSFGTWREYSQFLLRSMPPPLRGIYQRRIERFILWWKQHDYPLAIWPDAGIPALENRRKQPSWRRIALSLLKQDMARSLSFGFSQADIDRLVPGREKRS

SEQ ID NO: 16879 - protein, 214 aa, Pseudomonas aeruginosa
GKPMAQTKTLTERAEALFGELHGLPLAERIEAINRIRRLLHAHSPFAEEPVDCVQWVRAERVAGNDYNPNTVAPPEMRLLRLSIESDGFTQPIVAYPQADGRYEVVDGFHRLRVGSAKGALRQRLHGYLPIAAIRAGREGDSERIAATIRHNRARGVHGVLPMTAIVVTLLKAGWSEADVARELGMDNDEVLRFKQVSGLPELFREHVYSRSWE

SEQ ID NO: 16880 - protein, 252 aa, Pseudomonas aeruginosa
KAPAASSPSVTGPPRTTTRAPAAMAWRTARSTRSTLALSINGPMSLRGSAAGPTRRFSRRCARRSRSRSATPRCTSRREPVMQNCPANTVSDFSSTGKAASRSASSNTRCGVLPPSSRPKRFRCRAPAAEIARPVALEPVKLITGTSAASINRRAPSEPDSLKMFTAPAGSDGASAMIRATMALVCAVCPGIFTTVVVPAASAGARERIISTTGEFHGTMMPATPIGSRSTSDTTSGRGVPLAPRSLRARPA

SEQ ID NO: 16881 - protein, 201 aa, Pseudomonas aeruginosa
RRWSFRQTCSSVSFCDPPPRTPIIRFPPPLSAPRRPDAGGAWTPPTRVRCDGAAGTGWPGASTSRRSGIPGCARSGCRPRSAGIRSSGAGAAPGRHGRWRATGVPAGTRPPSRTSARRGRRRGCPPRSARRPAAGQRRRRPATTRDAIPARAPGWRRRRGSPRARGRSRFGAACGSWRAPRRFPLPSGGYRSTSPSTGRPG

SEQ ID NO: 16882 - protein, 335 aa, Pseudomonas aeruginosa
WINRMRIIHEAELAAARPQPASGLRCPDARTQPVARGDPPASQPAGGEQRPRPPARAARPAAVPAHRQGPGTHRRRPRPVRAGAPGPASAAGRPWLPGNLRSAHCADLSPDDERLCPVAPAAGPGDPLEDPGPAGDAGGTSRRRRLDPGATGQRRTRPGDRLSVLRRARAGLPAGRRGTPGGDRPAGPSGLPRRPRPRGLRGRAARLDPAAGRARQSAGDRPRLGQGTAPGAIAGASLPDHPGHRRQHRAARHRATPPGRALRQQPWFATGGRPLRDGPGAGQPDLASPAGSDARPAMAARADRADRTGLSHRLRARISLPSLSIIERGLSRNLW

SEQ ID NO: 16883 - protein, 369 aa, Pseudomonas aeruginosa
GCSMSKMMKAAVFIQPGRIELVDKPIPDVGPNDALVRITTTTLCGTDVHILKGEYPVAPGLTVGHEPVGIIEKLGSAVVGYREGQRVIAGAICPNFNSYAAQDGVPSQDGSYLVESGRCACHGYKATAGWRFGNLIDGTQAEYVLVPDAQANLAPIPDGLSDEQVLMCPDIMSTGFKGAENANIRIGDSVAIFAQGPIGLCATAGARLLGASTIIAIDGNAHRLDIARGMGADVTLNFRECDVIEEILKLTGGRGVDASIEALGTQSTFETALRVLKPGGTLSSLGVYSEDLTIPLSAFAAGLGDHRINTALCPGGKERMRRLLNIVASGRVNLGPLVSHEYRLDDIVAAYDLFANQRDNVLKVAIKPH

SEQ ID NO: 16884 - protein, 258 aa, Pseudomonas aeruginosa
SRRVRAATNETTIGKDERSGLSFHFTKFSPLTWILEPAEGPAPHCIEPTIEWAFCIPGRVSPGLGLNPALPCAAVRACAPRPSGSRKCRRRDVPPGGRESPPRSGSPRRPGPPHAPLAARRSVRRSAHSSPCCPAVFPAVPARPVPGTPYRVRPAAGPVPVEATRRSPPPAPPAVRSRRRRRVAGRAGTGPATRAAMAPAPRRGGSRRCRAGSAPPGSRPASIGRWRNGSPRRRRHRGNRAGACRGVATRTRRSGCWS

SEQ ID NO: 16885 - protein, 133 aa, Pseudomonas aeruginosa
TDDGSGTDSCPVGRPAPPVPAASPPSRSSGRPAPPARRAAPPPVCGRRRRAGWADSRRPRRPRQWRRTRRSRAWADAPRNSDGNRPQWSSPHRRTPRPPPRRASARRPSAVRRCGRRCKDRAAGSWRFPCGSG

SEQ ID NO: 16886 - protein, 337 aa, Pseudomonas aeruginosa
WPARTGGRTGNMAFKRIALAYCVQLDRVISIASARREYFSQAEPRKRFDFLCSSEGCRAQGIKVSASNYDKLPQDTRKAAHFSKFPHSTHLPNCEWFVEDDEDALRPGESAEEAGQRRIRDKLDAYVEEFDPAIAEEAAPPPADPDAEEQPPASAAVRTDAPAAPRQRTQRPRRTRDFELLVDTFRQARAELPAEEFKQLDIRISGLGRIALRAYFQHIGYATPGSAGKVFYGGADLVRRYGAPSRPQGFRFKFRDRIDGKPVFLYVAPETLQGYPHRRYLEDILGCAETVRYFTLYALGRLIEAPSGKSYSLEPDALRHLAIIPGPAKDDAPQSSS

SEQ ID NO: 16887 - protein, 405 aa, Pseudomonas aeruginosa
SPRRISWRRTGGGSCASSWKVGSGMAAPCAGGRRCWQVCRSGRRSASNEIFPPGAIGKSESARTQPPHSFLQRRQEHALRADVGRVVGQHRLAQLHHFVHQFQAGAAAPGHHHRQVRRRRAEAQQGQFAAFQFLADQRRRQGADAEAVAQQAGHRRHRVHAVQARRRDAVGVQQAKHVLVRPRVLGEGHHPLPRQVRQRGVVAVVDRAGGNDPAQRIAAQFEVQHRLVAQRVGLEDQVQVALLQLLGEVARGVRHQLDLHRREGFRDPGHQRAQPGVDDRVHGADTNPSLGAGSGVERLLQRVHGVHHPLGVGQYLVAFRGQGHATRVADEQFHAEFVLQHGDPAGNGSLGAEQLLRGEAEALQARDPDEGLEEFQVHVAGTDGQGTQGGGSEQLPCQRPPSGGT

SEQ ID NO: 16888 - protein, 144 aa, Pseudomonas aeruginosa
SSPPSACRKPAASNWNSEPSTEEIPACIPLPAWLPRCSPAAGWAGRCSPRPTWSRTATPASNCATSTSTATSARAARATTPTNGRRASSCAWSPASAKAPSASASTPSACSASSSTPAAAAAEPGCCRPTAPPAAPRMTTPSSA

SEQ ID NO: 16889 - protein, 177 aa, Pseudomonas aeruginosa
RNLHEQPVVELRYRRELRCLAHGPGRRGDAADRLRQHRLRLPRRRSRHHAPHRGPGGGAWRAHRRAPRLPRPGRLRPALAGLLGAGSGRPAALPDRRPRRTLPRPGHAGTLRQAAWRAVPGHDARPGDPRRRAARTGGLRPHPAADADEHPRQHRGARAGRGPRHRAVVRGVRRPRL

SEQ ID NO: 16890 - protein, 341 aa, Pseudomonas aeruginosa
  UNSURE (321): Identity of amino acid at the above locations are unknown.
RRRLPGLAQPARRGTPRRRDGARPGPPAGPWRGAASQRRQRPGAGGADPLRTRRQPRLAGCGAAHPRRPGGGMSQPQPRIEVAAIDSFVLRLFERIDEANMPWLLAAEENLRAAFGAALLDLVPSYTTLLLQYDLLQLDPGEARARIAAALSDLHPRRQDGGRLHILPTWYDPRVGPDLEPLARRKQLGVSELIRRHSQREYRVFALCFSPGFAFMGLVEETLAAPRLATPRQRIAAGSVGIAERQTAVYPHASPCGWKLLGRCPVRLCDLTLERYSLLRAGDRVRFEPIGHAEFFRLRGDDTPWKSRHERLPPRRPAGVXQTPAGSVARSPALPLPAISE

SEQ ID NO: 16891 - protein, 466 aa, Pseudomonas aeruginosa
VMTDIHMGAVVVDQQRVQAHASRRQGFSGFGLPFGMAARLQHAAAQAPAALADAERGAGERGVIAARVVHPHRPAGAAPDQCETQLPGQVLGTALDARRAVEQLQAIAQHQQHLVPIRMAAVAWRDLQDVEMEQRFAIARQALPGVDDAQRLAAVRGHAEYRRVDQERRVRLVRRRVRGVDVDPGLDDVGKRIAIAQLHGLLPCLAGIDHPGPGHHHACPRLGDARQQDEQKRRCPAGSVRMSGHAAYLAGHGPATGPGFSAGKRKGRRMRRRHSLVTQRVGHGAEYRTGRHGRRFGDVLHRVVVAGAGGSVGEHDIAGGHRRAAGQVDRVAADAIEQLQRHARRAAGGGVHQVPGGAGVGGLEQGGEMLVGRRRDAIGELQGEGGFAGAAAHCAIEGAHRYAVEDHRGVGEAVDRDLAGLVGHFAAECDSVCRHRGSRSGNCRKGQYHCAWVRSSGHAYVPSVRQ

SEQ ID NO: 16892 - protein, 212 aa, Pseudomonas aeruginosa
STRCRRESSAPPGRHARHRGSRPRPPARTRCGWPRRRPPPRARIPAGSAPVRRFPVARCPGPDHRPPAGSDGRRRRPPARPRLPGRRGPPPARRRRWPGVRLARRARRWPCRSTAPCRCAGPPPAPRAGFPGAAPGVRVAVRQRRAAPAGANRSCRTARRTPSATSPARARRRPGRRRRTPGAVSCRPVPGRSASGAARRRRKSLGRWRSSR

SEQ ID NO: 16893 - protein, 257 aa, Pseudomonas aeruginosa
SWGSPRPDRPGRLPATVPGGRRARSGAGRGPRRRSRRRRSAHRSCRHRRPCGAFPPWRWPRRARRRAASPGRARRSRRRSAPARCGAPGFRVGAWGSPVSRSIDGSNAMPGAPSATDSGRRTAGSVFPNSARRQQATLDERAVPGCRIADFLFEELAEDEDLPGRPLGLAVDHGNLPAVRRVARQDRQQLAGQQGIGGQEARQDRQAEPGARTFEQLVPGVGAHPHPDAERGRFAVHRQTEHAAGLAVVVDQPVVRL

SEQ ID NO: 16894 - protein, 304 aa, Pseudomonas aeruginosa
GLFMKLNLQQLDLNLLLVFDALMRERNLSRAAIRLHRSQPAVSNALARLREQLDQPLFRRTAKGLEPTAAALALYVPVRQALHLLQAGLGSQETFDPHTARTFRLTMNDYAQLRLLPGLVTRLKTLAPRVTLEVRPDEGASIPAQLASGELDLAIDYLYFDEPELAYRPVGEERLVVIGRQGHPAFRGGLDRAAYEAAQHVSILPRVGRGSPLEIVLGSARVQRQVQLLVPHYLTIPAIVASTELLGTVPRRLAERFASSHGLQLADVPFEMAPVQVNLIWHRQQEATPGLQWLREQIVQIEQG

SEQ ID NO: 16895 - protein, 191 aa, Pseudomonas aeruginosa
VIGCARGSVFRHFRSLSEAFPATYGEAPPRNRPQAAPGIQSSTRQRSHRMTSLPLEANAAATLAEWHGLIARRDLSGLPRLLHPDAVFRSPMAHKPYAGAPVVSMILNTVLTVFEDFAYHRQLASADGRSVVLEFSARVGERELKGIDMIRFDDDGRIVDFEVMVRPMSGLQALGEEMGRRLASYLAASKA

SEQ ID NO: 16896 - protein, 136 aa, Pseudomonas aeruginosa
SPPSSGLFAFRAAYRLALGSIPLFPAQQFALALHAPAVAGNVAVATYHPVAGNRHRDPVRRAGLGHRTHRSRRADPFGDLRIARRAARRYFPQCLPDPFLERRTAYVQRQVQSQLRRLDEAHHLRHQPFEVGVAAE

SEQ ID NO: 16897 - protein, 310 aa, Pseudomonas aeruginosa
LGARELVLQLAQQWLRLLAEEDRADAALALRHQDRAQRALADGETDRRAGAAIAVIARAHAEALRRGLVEAAVGVETGVVDRLGHRGGRLAQALAQAPGTIGRGVGLGRQAGFGLEQTMEVERTHAQSGGQRLQCRRRLRRLDHPAGLRHPLGALLRRQSAVAGGAPAGPIAGGLGGLGSGEELDVLAPGPTRRGTRTAIDPSGLHRIDERPVRRRVARQHGGPALFVGVVGVARIGLLAHGVSPVGADDARRLIRRSSARTPVLALEFERGRASGFGRRGRPPACLPIARLHNGPLEPAEGLGTWRSNG

SEQ ID NO: 16898 - protein, 181 aa, Pseudomonas aeruginosa
SPSPVPAANTSPRPSRANASTSSAPAKGAGHRGSRYRRATTTSCRRTPARPRTSASSRTPPTCRTASGSSRTTRTLCARANPPRRPASGASATSWTPTSRNSIRPSPRKPRRHQRTRTPRNSRRPPPQCAPTLPPRLGRERNGHGAPAISNCSSTPSARPAPSCRRKSSSNWTSASAASAG

SEQ ID NO: 16899 - protein, 694 aa, Pseudomonas aeruginosa
ASTLSPSGVRVTPRESRTNSFTPSSSSSTAIRLEMEAWVLNSFSAVRRKLFRRATQTKVSRNFRFMWRVPTGKGHKVAGASSFHASAHLPAAHDRRMTACSAIEISYPRRPHKLVGRSLASLEECDHRVRRRPPNLHNTNNDDRCPHGKTHDPRRRPGRFPGRSFRLVSRPRQAGTPGLLELQDRLRPGRHGHPDAQLRDPYPDRPVGDRHRRSRLHPHHDPARLRRRRLDRRDPLRPHRPGADPATDGALVRLLHLPLRPRAELRAVAGRTDPDRLRLRWRMDRRRGTHRRSDQGPRPRQGGRPGAVRLGHRLGPHRHPLLADVQPAAAGRGLARAVHARPVAGAVRPGGTPAGQGTGDLPRGQATQPGRRQGQLLRDLRPRDAQHHPARLAADHRRARRLLRHHRLAADLPQDRTRADRARHQRLPGDGDPRLLRRLRGQCLPHRPDRAQEELCPVRRRLLHRGPALHPVAGEQRRHALARFPARLLRLGHLQRHGLVPHRTVPNPHPRLRPGLLLQRRARHRRAVPDADRHARPEALAGPGDRRLRRGLLRRGDPRRPQPAGNPRQATGTLSRRPRKSQHASHSPPGCRAARRQRAGLAAARPGRPGRGQPRQPRTAQLLLQPRLPPERRARQRRRMGAGLPPAPGVRLQRRHRRLRRRRHRPARLQARLRRRQRRNRAAAGRRLRRRLPG

SEQ ID NO: 16900 - protein, 302 aa, Pseudomonas aeruginosa
LRQARPDRQGAGLQQPAQGRRAALQEPAGLGQRHPPAAGTVPRRADRRAGDRRPDPARRAPGPQQAEQLQRLPGVQRQPHRRAQRCLRLRRRRLSPDPGADRQPAPGSAQGHLPADLRRPGTHPRPRRTAFAQERPALRPGQRGRRLPRTGQPRLRRPLQPAPGRPRGGRRLPADQWRRSLSLHRRQRPVPGQLHPDRRLRQRRRAFLATALRLRFRRARPARPELHEPLRLRRQRRPRRGQRRQGMGTQHRPRLRGAERAAEEPRGEMAQRHGAFEFRQRPRRKSPDPQLQPDAVVRSGEQ

SEQ ID NO: 16901 - protein, 252 aa, Pseudomonas aeruginosa
PEGTCMNNLLLNCDIGESFGAWRMGLDAEVMPLIDCANIACGFHAGDPGTMRRTVALAVEHGVRIGAHPGYPDLVGFGRRSLACSAQEVEDLLLYQIGALDGLCRAQGTRVRYVKPHGALYQDMMRDPAILAAVLRALAAYDRTLPLMLMSTRDNTAARALGEAHGIELWLEAFADRAYDGAGYLVSRSQPGAVHHDAETVLAQALLLARGAALRASDGSALALEAQTLCVHGDNPASLAAVRRIRDALEAA

SEQ ID NO: 16902 - protein, 1046 aa, Pseudomonas aeruginosa
RSVPACPGRGRVRRGRRSGRAAGLPLPAPSRPASAGRSRPGRGSRGARRCARHAPPPGPRCGAWCRDRRRGSRRRCWRNRSAASPRRPGPCARHRSSRRYRSSTTGCSCRFLQVIARRTSPQRQAVAEDQAIFVEVVGEIRTHRGVAPFHPEVLQRPALHHVAEVGVAFPFLAVVGRAAGDVVAGDVAAHEAQAGQAERAEIVVVAQLPGTLVDVAEVADLDEVDQVRVAAGDVGIGIVATDPLVAGGHRVGAQAQAEEGAEGAVVQFAEAAVLAGPGEAQVALERTLSAEVEGVYQAGEGLPVDVPEPTLVQAGGQRRGQAIVAAGEVEGIAAPADAVGAEHLVVAGAVQLVAVQVRAAQGQAVDLLHVDQRAAEQFRQQAGVVGRDQRALEVQRADLEQAVGDPRLGGQAELGVVILGAAGGAVGRQQPGSAAAAAGVELEAEQADGVDAEADGAFAEAGLQAQEEALRPFVGVVARAALAEVAVEVEVAQFEAGVAVLDQVGLGEQRPAQPAAGEQRGSQAGSGMHAGISSVDGSEFQLLAAGFRQAEGGEDHHAVGDRGEGADPQAQRELLAEHADQHREQRGDGAPGVVAEALAGAADAGWEQFGEERAHAAEDARGEEAERETEPEHGAVAHRQLGVEQDHGEGADGEQDKVLLAPDQVGEEGTDHVADVGAEDHHRQVAAGAEHGQPAFGLEEGRQPGGDGVVAAERAGGQQRGAQGDAEHPGGEDLVEADLVGALVALPGLAVDLRFLDQPAYHQDEQRRQQAEHEQRAPGLFRRQQAEHQRVEDGGEAPADGPAGLHQADRLAAVAGLDHFADEYRAGGPFATEAEAYQGPCDQQLLVVLREAAEEGEEGEPEHRQLQGQHPADAVGEDPGDPAAGGGGEQGHGVDEAGFAGADPPQGDQGRDHEAEHLGVHAVQAVADLAAPEGPAFLLVEGAIPAEMTVPGSVRAGVEGHVFFHGGTDRRYWCYEDSVGAVAPGGRILRGWPASVQLIYAAAGDKKFRWRSKPSCVDHVPPEGGRWHGSCSLPPPCVPCPSVPAT

SEQ ID NO: 16903 - protein, 311 aa, Pseudomonas aeruginosa
RKEWGGCVRADSDFPIAPGGKISLDADRRPLLQTCQQRRPPAHGAAMPEPTFHELAQLPPPVLRQLIRRGDYTGHTSGLGQRHLQANLVILQKSWADEFLRFCALNPRACPLLDVSEPGSPHFARLGADIDVRSDLPRYRVHRRGQEPVEVSDIGTFWEADFVAFAIGCSFSFEQALLDAGIGLRHLELGRNVAMYRSSIATRPSGRLAGPTVVSMRPLKAAEAIRAIQVTSRFPMTHGAPLHLGDPALIGIRDLARPDYGDPVPLAADEIPLFWACGVTPQAVLAEVQPELYISHAPGHMLVSDRLYDEL

SEQ ID NO: 16904 - protein, 473 aa, Pseudomonas aeruginosa
ASAIRLNAMFPVLPPVRAGHYGAWRWVGKPAASRACRSRTHGLARIQAQEPEFLRLNGELVCGHHPLPQGKRHEPAARSLQRLPHRRTALGRRADARRGGGRGVRLCGEDHWGLLPSEFLGASAQARERRVLRHCRGRRGRRLSAQPARRRRPQTGGGAARRAGGAGLPDDRDGGDAAGTGGAGRPTGHESVPLPSSVQGRNRPDAQGLRLGLSCPAPARAPGPGVRLGDRGDLRLRFQLQQPLLRVLVATPRHAPARLPRWRRRRGDPFRHRPMLAGRDPGGAEPARHLRDPPRRGAGAIAARVAGPVPARPATRRRRRLRTAGGAGGGLRRVASTGTGPAAGRTRYGVPGTGLAGTAGNTAGQHGELCADRRTDRRAASGACGGPGLRGEPDRGGDSLPPGGTSRRRHFRLPLGRGAQARTAAQGRAGLSPRPGDTRPGMQKAHSMVGSMQWGAGPSAGSSIHVRGENFVK

SEQ ID NO: 16905 - protein, 137 aa, Pseudomonas aeruginosa
TPRLERVPPGLSTLRAVSKVDCVPSASIEASTPRPPVSLRISSITSHSLKFSVTSAPIPRAISRRWALPSMAMIVLAPSSRAPAVAHRPMGPWAKIATLSPMRMLAFSAPLKPVDMMSGHISTCSSLRPSGMGARLA

SEQ ID NO: 16906 - protein, 263 aa, Pseudomonas aeruginosa
PAPGPSRRGRPPVANHGCWRSARPGGVARCRAARCWRRWPGWSGSEAPAIAPGAVPWPSRGRSPADCRARPAAGSRRAARPRRPRGRGRRGRPDGPAGRSPPGVPRRPAGRPARARRSTDSRSPGRVRRWPVAPGSRRLRRDVPPASPAGPGSSSGSPGPAAGATGHSRSSSGERSAQCADRRFPGSQGRPAADAGPGAPARTGRGRRRWVPGPWRCAGTAAGRAARAGGRGRCSPPAGCDAGGSPRATGCVRASGHRRPEAG

SEQ ID NO: 16907 - protein, 449 aa, Pseudomonas aeruginosa
IILILFIHYPDKTGIATLECKPFRPGGSARFAAQPITITREMPTMSFDPQPFRQQYRAAIRPGYNPWLHAGFVLAYGGAWIVFFLSRLEQPSLLEWLTVPAALVFFNWGEYRIHKSLGHHKHPLGRMFYKRHTGDHHSFFVAGQMRYEQARDWRVILFPAWLVVVFSLGALLAWSLARPVERQPRRAVRRDPAVGLPQVRDLPRLRTPAAGASAQPSAVDPPHAPPARTASPSRADADAQLQPGLPVDGLVLRYPPLGSGNRRGARHDPHAAPNRDRPRARGDPRLRRQPGALAGMASLVVAGRRRRWPAAGRRALRGGHPRRRPRRALVLDGGRVPAGTPVARQRPWRPGAAPAPELRMPAERGRHPLRAHPGIPLRRLVDAPGQPVPAAPSHRTRVGGVHAPPASGRRGADSGGGKRMIGVRGGGSQKDTDEQVCRNDHLRQRGRRP

SEQ ID NO: 16908 - protein, 558 aa, Pseudomonas aeruginosa
RCSRQSIWIRENPMHQPENPARRTLLAQTVAGSAALALGSLLGGAPGVASATAETPRKAFDGGRIDVLIVGGGSAGAVLARRLSERGDRRVLLLEAGQAYPAWDYPRIIASSDSVGGDPSSDWGYQSQPGAIGHPIHAIRGKVLGGSSAINGAVAIRARREDFARWNLPGWSYDDLLPAFRRLETRQGGDPALHGGDGPLPVRQLSRADLSPMQRAFVDATLANGFKAIADFDGADANGVGPYPMNVVNGVRVNTGMAYLDNAVRARANLSIRGDALVDRVLFEGKRAVGVRLASGEEIHAGEVILSAGAYGSPAILLRSGVGPADELKALSIPLLADLPVGRRLKDHPFYYNAYAARPERIGAQSPVIGAKLWTHSSRAQNGELDLHITATHLFPAEMSPTGVGFVLAVALTRPQSLGSVRLASRDPAVAPLIDLNFLAEAEDRARLLEGVKLARRIGRSEPLAGLIHAELGPGPEARSDAQIEAAIRATLDTYHHPTSSAPMGRAGERWAVVDLEGRVHGLQGLRVIDASIFPDAISVATNITTIAVAEHLAQRIA

SEQ ID NO: 16909 - protein, 489 aa, Pseudomonas aeruginosa
PTQENLQMNGHARHWIDGAWLDSAQRGQSFDPASGQPIGTYADGGRAEADAAIAAAVRAFEDGPWKDDHALRAKALEEIAAAFERHADALIDLLALENGKIKPEAAFEVGMVPGKLRYYAGLARSERGASGTPRPDVVSLVLREPMGVAGIIVPWNSPVVLMIRSLAPALAAGTTTVVKMPGQTAQTNAMVARIIAEAPSLPAGAVNIFSESGSEGARRLIDAAEVPVISFTGSSATGRAISAAGARHLKRFGLELGGKTPHLVFDDADLDAALPVLEKSLTVFAGQFCMTGSRLLVQRGVAERLRERLAQRLENLRVGPAADPRSDMGPLIDKANVERVERAVRQAIAAGARVVVRGGPVTEGELAAGAFYRPTLLEVDDPDLDIVQQETFGPVLTLQVFEHEEEGVALANRSEYGLAAGVWTRDVARAFRVARKIRAGTVWINDWAKVYDEFEEGGYRQSGLGRLNGVAALDDFVEYKHISLTTGAA

SEQ ID NO: 16910 - protein, 217 aa, Pseudomonas aeruginosa
NRGRRPDTRAGCGGGSARRLRAACAAPGVPGRGRPAGRTRSAGCAGGRRPDVSGASRTAPRRSARGLRRGRAGAGRIAGAGWCRTAPGRAGRRRTPPAGFPPPPAARACWLRRCARTGAGRSCRWRPPRCAVAVGSCRLQGVADAPHRSQRGGVVAVYAEGLRLQRQGAAVAGSQRRATGQQEGLGEHRLGVVVYRAGLAARDQVAGAVIGAVGERL

SEQ ID NO: 16911 - protein, 182 aa, Pseudomonas aeruginosa
PQLDAVGLAQRARRGVVAGAHQHQRQGAVVGRQCAQHGGEDRRVAHHVLVQRAMRLDVAYPRALGAAESVEGADLVEQQVFHFLRRAGQRAPAEADQVGVAGVRADAHAMLHRQGHGAAHGAGIAGVEAAGDVGAIDQRHHLGVQAHAPGTEALADIAVQQQVVHAGSFRSLLAGPHHSVRL

SEQ ID NO: 16912 - protein, 420 aa, Pseudomonas aeruginosa
FMRPPGIRNFDGGASRHASIMCRRKVGAGMEAARSRHLVSLARRYPPHEPEIPRDLRLGRAPEELPPHRGEAVQHPGFHFQPDRRAGGRTRRETVRPRLAWRDPDPGRRQGTGLRRADDGHHARAEAVARHRSQHPGTDSYRRHGHGHPHLAEPVGGQGHGNLPGGGDRADGGHRAQPLRAVAEGLPGPDLPDRLAAPRVGAEPRTGQLSAALDRFHRLDLPPRLRLAGGPGAGAGGDLLQALAAAPGRAWPAARQRRRGAAPELRELGGGDDPPAARRLRRRRLAAGAGQPGTGTRRTDPAAPRPAAAEPAGGGVLARRHRPGTGGRSGGAEQGGAGRLRGQRRPGVHAPGAAEERSGAAAFALIRIFRSPPAEKSRWTLTAVRFYKPANNDVRQRTEPPCPNRPSTNSRNCRRRSCAN

SEQ ID NO: 16913 - protein, 370 aa, Pseudomonas aeruginosa
SAGIIRSHRGNAMSQQPDPCNAYHTDEQRWAAVLTRDAAADGAFVYAVKTTGVYCRPSSSARRPRRENVEFFATAEAAEAAGYRPSRRAAGDRRLAAEQRAERVAQACRMIETAETPPALEALAARLGMSPFHFHRLFKAETGLTPKAYASAYRARRLRERLGQASASVTEAIYDSGFNSNSRFYESSSQRLGMRPRDYRDGGAGAAIRFAIGQCSLGAILVAQSQRGICAILLGEEPEPLLRELQDQFPRAQLLGGDADFERLVAQVVGFVESPQLGLDLPLDVRGTAFQERVWQALREIPPGSTASYAQIAERIGAPRAVRAVAQACAANRIAVAIPCHRVVRRDGDISGYRWGVERKRELLRREERD

SEQ ID NO: 16914 - protein, 310 aa, Pseudomonas aeruginosa
SSRATYDSALFDLHDLLAQPLQAGRRFLLAMPDQVDLHRGHLEGDVRQLQTMAAGEALGQAAWHGAEQLGAGDDGRDGQVVRHQQLHLALYPGRAEDDLQRTAAPDPRQDRDVLRGLVGRAVEAAAEGRMALPADHHQAFLADRPVGQLGLVEVQIVDRQVEFAAGQLRRDRGAFVGTYLQRHPRGQGLQAGHQARQQAQLGIVVHRQAKGPRSVRIEGFLGAKAGLQQMQGLAHRHVQGEGGGGGFQALGGAPEQRLVELLAQAGEGVAHRRLAAMQADRRARQVAFAHQGIEDQKQVEVELLQVQLHE

SEQ ID NO: 16915 - protein, 264 aa, Pseudomonas aeruginosa
SCSRPGWWWSSASARCSPGAWLGLLNDNLAALFAATLLLGYLRYEIFHACEHLPPEHPLSRLPWIRHMRRLHELHHRRELMQTHNFNLVFPLMDWCYGTLHWEAETAEEHAMTRMQHRIEIAREPEATLAYAASPGLWPEWHPSSLRVDGAAGPLPAGARFEEDIHAGGRAGHLSWTVVEYQPGHLWRANARGDRGLHLRLSYECQPSAAGTRFVRTLEYRFDGWSMRLANLFLLRRRIERESEESMHRLRRVAEARIAAAESV

SEQ ID NO: 16916 - protein, 322 aa, Pseudomonas aeruginosa
SGSAGADRRRTPMNKFAEMTTFVSVVDAHSFSEAARRLGTTKSQVSQRIQQLERRLGRVLLNRTRPLSLTDPGRTYYEHACRLLQELEQAEASVLDADDDLRGQLRLSAPLAFTPRYLAPLLARFAERHPQLRVDVQADDRFVNLQEPRFDMALRMGRLDDSCLVARPITANRHLLCASPDYLARHGVPQHPEELQAHDGLVYYNREPGGMLCLPVDGEPASFRIRVRMRTDSGHQLLEGARAGLGLAILPSFLAADALLAGELLPVLPGYSPDGGQVSVVYRKTQRTPRKILVLGQFLEEEIGDPAPWDRALIERGLLPPG

SEQ ID NO: 16917 - protein, 70 aa, Pseudomonas aeruginosa
PCRYSSTRRRASPWPTAASTGWRPGSGPAMSRVPSGWRGRFAPAPCGSTTGPRSTTNSRRAATASPASAG

SEQ ID NO: 16918 - protein, 197 aa, Pseudomonas aeruginosa
KAGGRLLPHRRNIGMTRTSNPCAVVLAFAAIAASGTAMAANTITFSGEVTDQTCQVAVNGFTDPTVILDSVPVSALDGAVGRSAGETAFTLQLTDCVAPTADEHFTTLFQATNPSAAGNLVNTAASGATGVALQLLDSVGGNPVDLAGGAAVPAGDIVLANGATSTSYDYAVQYVSEAATVTPGPVLGAVTYTLRYE

SEQ ID NO: 16919 - protein, 277 aa, Pseudomonas aeruginosa
MPAAHAPPLPFPSTKAGPGRWTVPGQVSRMPRHSYRSGRTSALLLVLLASIAQARASVVVTGTRVIYPGEAREKTVQLSNRDAFPNVVQAWVDIDAPDAPPDQADAPFLVNPAVFRMAPDSGQTLRIVYTGQGLPGDRESLFHLNVLQIPPRNSSHADRNQMLLMLRNRLKLFYRPAGIQGRPEDLPGQLRFALVRRSAGWAVRVDNPSGYYASFASATLSVGQRRWRLRSGMLEPRSHAEWQAETREALPPGRVRLHALLINDYGAHMDIRHDLSP

SEQ ID NO: 16920 - protein, 981 aa, Pseudomonas aeruginosa
RSAQERRRAPLRLSRCTPARLAVQPGRRPPAPGSLGAASLARPQAARLRQPRGVGRRRQHGLRQLRHQPLSLRIPRRRIGTIGLRLCRPEQRHQPRPVAFAPPVQLHLFPLQRAGQAQVEQHPHLCPARLAGLAQRTDGGGELHRRQPARQHRLPRPEPGHRRPHAARVPAPLCAAGARHRGHRGAGGDQPERQEDPRGECRPRSVRHRRSLRQRLCRRSGCPGVRSRWQRIELQRAVRLGPGVHASRPVALQLHPGPGAPVWRRRRPVRRLHLPARHEQRPDRQPGTACRRRLPGHAGRRRPRHPLRRLRPEQHLFQRTRRGWRAQAGLAHRARVQPDLPAHRHYPDPGRLPLFHRRLPRTRRRARLARRTAPRGHLGFRQLQAAQPVQPAGEPGPRRLRQPLSFRLLQRFLRRQEPRHPIAVRLLQYLGAVELQPRLVAADHHLLPGAGRPGPWRRAAPARPAQRPAQRHPDPQRLHAAGFFQSGADAQRHGYPALRRQPWRQPANRAERYAGRRAYLELRAVRQPRQRGRRHHLERHVAEAGGAGHRECRLCPGRSLPAIQRRHPWRAGRPPRRADPWPQRRRYLRPGRGQGRQRCRDTRRAGRAHRRQRLCAGPLAVALSLQPDLTRSRWHRSRRRTAGNRAQGRALRRCQRARDVQDADRPSAADPGAARGRQCAAARRRGGRRRRGGHRHGRAGRPGLCARGKPAGQVAGAMGNGAQGALRVALRPGRCVSRPGADPPARHLPGSHHRLQPGERQMNRTLPLLPALALGVLLGLPASGQATCYRVTSVGSETTTSNTQIRPGEGTAGSWTGACDTCNGSLGLPSVVNVSDESFQPYPTLIASAVAPLTQYGATGGYDPERVFFRCSAGDAVYEMFSTNGDDLYSGYYTGADTVGNDIGLQDAYRTAWPNVLLRLTNVETGETITPIWKERQLSGLDIDSRGFQLVKAKNLAAVRAELYSAPLEAIRYYSPTILSQ

SEQ ID NO: 16921 - protein, 357 aa, Pseudomonas aeruginosa
EISMAEQAVMRRSCAAGRWALAWKLLAPATLCPLPVGTRHMNLKFLETFVWVARLKSFRLTAEKLFSTQASISSRIAVLEDELGVKLFVRDSRGVTLTPEGDKVLAYAERMMDTMHALKQSLDTGASTQGRIRIGAMDTVIHTWLSPLVARVTETFPAVEIELMADTARNLSEQLQKGYLDLIFQTDSLRHESVLNLELGSYPLRWIVSTGSIYHRDYASLADLARERVVTFSKHSRPHQDVLGLLHANGVAAPRLNCVNSVAAMTRLLRDGFGVGALPPALVSQELERGELTLLRLGPPPPNLPVVVSWRGGTGLELVDEVVELSKAVLADYAANVGPECMLLAPLKKGVGRLRSR

SEQ ID NO: 16922 - protein, 671 aa, Pseudomonas aeruginosa
PPSASTNLPTTTSASARSRHARTDLPRTRATAAAGPAPTDPPRRLHRPYQRPRPAPLAGQPGDPAEILGRRVPSLLCPEPPGLPAARRQRTRLAALRQARRGYRRAQRPAALQGASTRSGARRGERHRHLLGSGFRRLRHRLLVLLRTGVARRRHRPAPPRAGAQRGDVPQLHRYPAERSPGRAHGGIDAAVEGRRGDPGDPGHQPLPYDPWRTAAPGRSGADRHPRPGAARLRRPGAARGGRDPAVLGLRGHAPGGARRGSAGAVHQSRAGAHAGQRPTLRRALRGVVLRRTGDDRQVAQGIRLQAVALAARRFDEPPEGVEGEVAHRFGATEDVFEVAPMRIALQGFRSDVEEYRLAVDAVAELEAEALRPARRTVAPDQVGAAVEYLAGAARGGIADVLEIGAQRYPAEAADADVQLLELFRRQLGAGLAEGVDEQFEIAGAPWPLRSLPRRGGSVGAHCGGGRRLFLGVRVRWWRRGFLGDGRIEFLDVGVQLVADAPLAGLLGGFARAQSVLVVLDEPLAVRQVGGVRELAEVRGLAGVLRQLVVVARRYLDPLCPAPFAGAEEVEAFARLGLGEVFAAGTGDGDHPIQLHAVGQCYPFERHVPSPSAGSSGPLWSLAMGRQAGGLPRLPKPDARPRSNSSARTGVLALERRISLRASSAPTGETP

SEQ ID NO: 16923 - protein, 238 aa, Pseudomonas aeruginosa
PRRSTTPVSTPTAASTSPRRNASACARAITAMAAPARRSVSPSANARWARSWWRRASAASARSSSARSRSHCCASCRTSSRAPSYSAATPTSNGWWRRWWASSSRLNWDWTCRWTYAVRRSRNGSGRHCGKYRRAARRAMRRSPNGSARRERCVRWPRPARRTGSRWRFPATGWYVATATFPATAGAWSASANCCAGKSGIEPKARRYAARNAKSPLDGGLYAMGRWSFSWFQYPCQG

SEQ ID NO: 16924 - protein, 572 aa, Pseudomonas aeruginosa
PFVLSYRGFIRCCTHAPASGSATPGARRGSPGTPGWRAPPGRYRWAPRRRSAPWPRPAACRRRSRQSPHRRWPAPAVVRRSRGRAWLGSWTVSLHPPAKRRRKGAADALGGTRFVVRDGFATSVQQYRMTVSVRLDRHLQYVVTLVGEQVVSGDDVVEAVFVADQRPEVDPARSHDIEQSAHALLAAGAQRGIDPVVAEAGGEGRQRNRQVFRVDPEAGKGAAGLEHPQGGLEGRLRTECLDRSIHAAPAGEFENFLDHVALPEVQRDVGAHSTGDIEAMGVAVDGDDRAGAQQPGAGGGAQAYGTLGEDRHAIADADVGVLRALEARGHDVRTHQHLFVAETIGYGGKVGLSVGNQHILGLGAVDQVAEAPTGGRLVAMAGATAGFHQVAAVLRRYAVLGGIGVEVGADGTGDHALAFAVADHRAAELFDDPDRLVAHRQAGRDRILALEDVHVGAAERGGGDAHQCIVRPHVGNRLVDQLDTAGLDEYGGFHHLAHGASSRVEALGRHGAGKNGRMPGQWRNCRPMSLIWVMAAMDAGSRSTDLAFLLGNVLARFAAELPKPLRCGLGRR

SEQ ID NO: 16925 - protein, 493 aa, Pseudomonas aeruginosa
GCAPTPGTSCSKVRAPGSAWRSCRASWPPMPCWPASCCRSCLATRRTAGRFPWSTARPNGRPGRSSSSASSSKRKSAIRHPGTARSSSVACCRRAEFGKTEPAVRLPLSVAEGAPGIALLPSIDLDTGEPHAPTRKPGAPHLAGADRRRLRRARPGLAARRRARRGQRHGGNAPQGLRWRQDRCADRRRRLRRRGPRPAPERARRPPGTVAGSRPGLSGLGLPQDHRQQRQRRRRPLQRLGLPVPTGGDRAPDPCDPRQGPRRQLGDQRRGGDPRAARRLRPLEPAGLVLRRPAAGVPPPGDPPGRRPGPARRGRTAAGAATEPRRSLADAEGLRRRHPGQRFQGHRRFRRRRRQRRRAVPDECRQRCARQHRHGLPRQRRARSRQPVDPRRRAGRPGALRRQARGGRAPGLRRGNPRRRSDPQRRRLRQPGDPAALRCRPGRRAEGAVDPVACRLAGGPPAQGPSVLLQRLCRPAGAHRRAVAGDRRQALDP

SEQ ID NO: 16926 - protein, 562 aa, Pseudomonas aeruginosa
LAGAERRAGPAHHRHPPVPRRDEPDRGRLRPRRGPDPAAIAGQCAPGQPRPGRRAADRPELPRRGRRPRAVAGRGQAGAPDRPQRTARRADPRRTRAGARGTQRCADRSGDPRHPRYLPPPDLQRADGPRRRALGGGRPGGQGAWPARIAGDRRLDLPRCHFGGHQHHHHRRCRAPRAAHRLTDPGELADERTRQTLDRRRMARFRAAGTILRPGQRPADRHLRRRRAGRGRCGDRRRCARLRRWSLEGRPRAARESPGGNRRGLRAACRCAHRPACPGERQDQARGCLRGRHGAGQAALLRRPGAQRTGRQRHAAPRRGVAGAARADGRRRHHRAVEFTGGADDPLPGAGAGRRYHHGGEDAGADRADQRHGRADHRRSAVAACRGGEHLQRIGFRRRPAIDRRGRGAGDQLHRLERHRPSDFRRRRAAPEALRPGTGRQDTAPGVRRRRPGRRLARAGEVADGVRRAVLHDRFAPAGAARRCRTATRTPGAAPGKPARGAGGGPAQRHGAVDRQGQRRARRASRTPGHRRRRAGGGPRRPGNRGRAGGRRLLPSDPAGGR

SEQ ID NO: 16927 - protein, 337 aa, Pseudomonas aeruginosa
SGPGHRATGNLRTGADPAGIRARGGGRRLGQPQRVRAGGRGLDPRCRACLPGGAEDSRRHRVDQRLGQGLRRIRGGRLPPVRPRPAERGRRPGRLRRIQAHQLDHRRGLSLGERCGRRRRPLLPGAGIHVFAEQLGQSGNLLETQHLVIVHAQFAGHVGLAPAGLEQGHHDRRHRQYAVHAACSVVADGGGDALAVAFTPGAYRGDRQVAVQTLAQRALGAAHAQAVKTVDHLVAPVGLRIGDDGLGESVGLDGQPQQSHLRWRDGIGVVVVAGDALGTHPLHAIDRLFGERTVRVEQPADPVDGFNPLGKRQPVQFAEQRLGSLRQCLCLCHGLSS

SEQ ID NO: 16928 - protein, 225 aa, Pseudomonas aeruginosa
RDTPPGRLLATILQGRDPRVRPDGKGIVVLLPPEDETLDAPLVDAAQRRRHAAQEELAVLAPGAEGGRQAKAATVAEEALATIARPIVGAGDAPDYLEPGAWLDPVEQVEALALVVAIGLADAHLRERHAGAVHLVVEAVIGVAVVGDATPEILETPVVDREEAHRLRVGPVARAPGQRRGAARRRPGALFRPAPALDRQVAIERFVRTDADQERGRLFPWPARR

SEQ ID NO: 16929 - protein, 883 aa, Pseudomonas aeruginosa
STTTAPIWISVMTYRHERRCRTGTALMAGGMALAASAFGHAQPGYEFDDRLLLGSSLGGGDLSRFNQDGRIDPGRYHVDVYLNERFASRSEVSFRANPASGAVEPCLDEDFLRQRLGAKPGDDPRKSGDGRHCAFLDARLPGSRFSLDVARLRLDLSVPQALLDLKPRGYVSPEEWDAGDSMGFVNYDTNLYRSEYRGGESGRSDYAYVGLNSGINLGLWRLRHQSNYTYSRYNGQARRKWNSIRTYAQRALPAWRSELTAGESYTAGNLLGSIGYRGLSLATDDRMLPESLRRYAPQVRGTAATAARVVISQNGRKIREVNVAPGPFVIDDLYDSAYAGDLDVQVFEADGSVSSFSVPFASVPESMRPGLSRYSFTLGQARQYGDGDDLFADFTYQRGMSNALTANLGLRVADDYLAMLGGGVLATRFGAFGLNSTYSSARVEDGARKQGWRIGLEYSRTFQPTGTTLTLAGYRYSTEGYRELGDVLGSRDALRHGDTWDSGSYKQRNQFNLLVSQALGGYGNLYLSGSSSDFYDGKSRDTQLQFGYSNTWGQLSYNLAWSRQTTTYYQEQGDQDPGVELLRRDRRSGQRNDTLTLSVSMPLGSSSRAPTLSAMDTRRSGDSRGGSLQTGLNGTLGDERTWSYALSANRDSEVADTTWNGTLQKQAALATVNAGYAQGDRYRQYSGGIRGALVAHRDGLTLGPSVGDTFALVEAKGASGAAIRGGQGARIDGNGYALAPSLSPYRYNPISLDPVGIDPDAELLETERKVAPYAGASVRVTFRTLTGHPLLIQARREDGSVLPLGAVVVDDGGAAIGMVGQGGQVYARAENQRGRLLVQWGTARKERCELPYDLAGVSRDQALIRLRGTCRAATTDSNLENAR

SEQ ID NO: 16930 - protein, 292 aa, Pseudomonas aeruginosa
VRPIIDYSLLAKLFGQLGGALAGGVQGLLHQCFEAVGLEGFDRRLGGAVGRSHPAPQFGRLDLAGQRHLRRAEGGLQGQARGCLAGQAELLAGVGHGLHQQEEIRRAATRHCGHRVDLRFVVQPQGDAHRGQQLPGLLALRGADLRVGVQPAGALAQQRRGVGHAADHRARLAEPGFEAGAGDAGGDGDDQLLRLQRRRQGLAHGFHGLRLDRQDHDVGVGHGLGVGLDHVDGELAGDLRALLGARVAGADLRRRHALGAQAADQAGGHVAGADERYAGCAHRGFLQEAGAP

SEQ ID NO: 16931 - protein, 166 aa, Pseudomonas aeruginosa
SRAPNRAVPMRTQVAPSPMAASRSSLMPMDRVSRPRFRSSSSSRRRANATCCAARSAVGSGMAIRPRNRRLGSCFTASARAGRSSGAQPDLLASPLTLTCRQTFRGGSPAGRCSDRRCAIFNRSTECTHWKCSAMGRVLFDWMGPMKCQFKGRSASSACLPRASCR

SEQ ID NO: 16932 - protein, 123 aa, Pseudomonas aeruginosa
FSPKSRRPAACASRTAAAGLVLLTASRPTVAGSRPAACAASRMRAATFAIFSAIVDITCALWKCGRRRLDALETAGLDGHLPVPVSRFRVWRRTPRVSWKHPGSSGVFLVRDGGFGGILPACL

SEQ ID NO: 16933 - protein, 348 aa, Pseudomonas aeruginosa
LGSPMDITELLAFSAKQGASDLHLSAGLPPMIRVDGDVRRINLPPLEHKQVHALIYDIMNDKQRKDFEEFLETDFSFEVPGVARFRVNAFNQNRGAGAVFRTIPSKVLTMEELGMGEVFKRVSDVPRGLVLVTGPTGSGKSTTLAAMLDYLNNTKYHHILTIEDPIEFVHESKKCLVNQREVHRDTLGFSEALRSALREDPDIILVGEMRDLETIRLALTAAETGHLVFGTLHTTSAAKTIDRVVDVFPAEEKAMVRSMLSESLQSVISQTLIKKIGGGRVAAHEIMIGTPAIRNLIREDKVAQMYSAIQTGGSLGMQTLDMCLKGLVAKGLISRENAREKAKIPENF

SEQ ID NO: 16934 - protein, 387 aa, Pseudomonas aeruginosa
VSENIMEFEKLLRLMVEKGGSDLFITAGVPPSMKVNGRVMPVTKTPLSPEQTRETVLGVMNEQQRRDFAENHECNFAISARGIGRFRVSAFYQRNLVGMVLRRIETNIPTLEELKLPEILKKLALTKRGLVIFVGATGTGKSTSLAAMIGYRNKNSTGHIISIEDPIEYIHQHQGCIVTQREVGLDTDSFEVALKNTLRQAPDVIMIGEVRSRETMDHAVAFAETGHLCLATLHANNANQALERIIHFFPADRHGQVWMDLSLNLKAIVAQQLVPTPDGKGRRAVIEVLLNTPVAADLIRKGEVHELKPLMKRSTEQGMQTFDQALYQLYTQGEITYEDALAHADSANDLRLMIKLGSESDADHLSSLTQGLSLEITDDDPAGRRFR

SEQ ID NO: 16935 - protein, 478 aa, Pseudomonas aeruginosa
VQWLTKPRTVSLRAETPKGEKMTSDSRPAVLDLIGNTPLVRVTRFDTGPCTLYLKLESQNPGGSIKDRIGVAMIEAAERDGRLRPGGTIVEATAGNTGLGLALVGRAKGYRVVLVVPDKMSTEKVLHLRAMGAEVHITRSDVGKGHPEYYQDVAARLAQDIPGAFFADQFNNPANPLAHECGTGPELWAQTGHDLDAIVVGVGSSGTLTGLTRFFQKFQPELEMVLADPEGSIMAEYSRSGTLGTPGSWAVEGIGEDFVPAIADLSSVRHAYSISDEESFAMARELLRVEGIPGGSSTGTLLAAALRFCREQKEPKRVVSFVCDTGTRYLSKIYNDQWMTDQGLLQRKHYGDLRDIIARRFEEGRVISVGPDDTLLTAFQRMRLADVSQLPVLDDGKLVGVIDESDILLGVHADAPRFRDAVSSAMNAAPETLAPGASLAQLQAVLDRGLVAIVADASGFHGLITRFDLLNHLRRKLA

SEQ ID NO: 16936 - protein, 142 aa, Pseudomonas aeruginosa
ASTTSIPTPRPRPSRPGSSTPGRPPIPRPARSCRRSMPTPPTSRKAPGYTRDSTTAARTTRPVGPWSAAWPTSRAAPRPSPSPPAWRRSLRCWNCSTPVPTSFPAMTFTAVPSACSSGSAGAAPGIASASSTRPTCRPSRPR

SEQ ID NO: 16937 - protein, 245 aa, Pseudomonas aeruginosa
SALPPGSSPARRSAPSIRTARGPGRSPPGRRRRRSAGCRSRSPAAGAAACRWPSGVTGLGGEQAEVDAQARGGGAEALLGRQVEEDRRVRRAGQPGVVAQFGLQLAGFPAGIAKADQALFRAGAGGDGEQHVLRGGHRQLAQFQGRLVAQAAGVEDEATVGLHRAAVVDVDVLAARRRQGVRLELFEDFRQVEAAGTVDHQAHGALLVVFDQVGHGLGEIGVGHVRHGDQEMMLEVGWAALFHGR

SEQ ID NO: 16938 - protein, 448 aa, Pseudomonas aeruginosa
HQPVRRLRPRRPGPGLDHPDRPGDGARDQPPAGRDRREERPQPGRDPASARRDRRPRGRRPDRGRDRDRGLHRRHRRLDQLLHRPAPRTGGDHQPDRRAGGRSGPGNPVHRDAPGRSLRAPGAGNRRRLGGDQRNGGVDRPGIGERLGILGGSGTFGSHRQQGQRGGAQHHHRHGQHPRADPGHLEANQAPRRIVPGDRRHRQPDQRHRRPDQHPRPERRDPGVDGRGRGPRLRRGSGRGTATGGTFLGGDQADRGAGEDHPDRHQRSGDLDGADHLRGGPRRAPGPGRRCGPGGDREGIQDPRGADPEHLQRRPSAGIVGRPHFQHHERHSGDHLADLRRYHRHRTEHRQPGEDGERDAQLGIRLQTAGGRGAGLSIGAAAAWRAPRRHLGRGARHAGERRLVTAAAGRYVGSGVPRLAGPVGEPHRRGAQRATPDVPAGQPDRAHA

SEQ ID NO: 16939 - protein, 186 aa, Pseudomonas aeruginosa
PARLRRSGVGERRDRRNPETGAPGAGSVRREPAGPDPHAVLPDLRAPGAGHPADGRVLRRGPARRGNGAVGPGLAGRSRAEPGRGPGSADAGDPATAGLPRPDPDRPARPADGGPAAAQRPARRARREAALGNQPVRARPVAAPAATGRRGHRATAHRRTRRLAAQAAPDPADGPGRPAAQPGRGH

SEQ ID NO: 16940 - protein, 489 aa, Pseudomonas aeruginosa
RGQQRLGAHPAAPARPRTQAPGRAGRRRPEPGRAGRAGEEPAVLRGQGAFAVAADPRSEGTVPPRRGAARPRDGGRRARPPRRTRPRRDAFGGRCLVRGTGTDQGQPRPVRAQRPWPPLGTGRPPGAAQADRRYPGGTRLRPTAQGHPRPVGRHPRPGPGPPRAERRDPDGRRRRVALRRGHPGRHGRSRRRAQQRGKPPAHHRCGADPPVGDQGSAQRSGAGQGRDHRVHRLAVEPRAPGPRAGAADPGPRRPGDDPAGARRDPAGNLQPLYPGTAAGAQGGAGLAEPGYPGRCHHQRRVLPGAPERGPCQPERPDPRRRRGQPGEPRLYAETEFVGPGRAWPVRARCHRVPGCRAGEAGGGRRGRRDSGATARRHGSCRGREGRCPAAGQRRQLDPWRSRARRRRAVPRPGPGPAAGRFRRSAAGVAGGGRGERPAAVDPGACPQPGRFQPRRDRSLRPRPARRCGPGLRAGGPGGLVAAGAVGARR

SEQ ID NO: 16941 - protein, 672 aa, Pseudomonas aeruginosa
RTDGPCPGDRRTGLVDREPVQPRARSQHRRQRAGAASGGPGRGPVAGAGRGVRRQCPAPARRCRPAGGHRACPGQGRAAAGTAGAGRRRSTAGSRGGAAVEPGQRRPGAAIGRRAAGRCRGAERRRTARSATAGDLHQRGGNPSRGPGRLPRRLRPRTAAAGHRCLAACPAYPQGQRTHGRHPADRGDRHAAGKTGQGIQVQPARLRPARSRVAARRRATVPYRPGAGRRATAIEPDPRQRRVAGAYRGTASGTHRLDRGRALQRCRRAPRSVADRGVPRRRHGHPAGRRGPARALARASAGAPGTECAARGAQHSGPGRPACRAATGGRTLPGLAGALRCRRGRPPGGQPGVLRGSPPGPRGADRDDGPGRRRPAGHAASGAGRGPAGAVGSARRRGRSVHRPGEPRRRRFPPGRRRTGPPRGGLRRGRDACRGDRAGSACTGSRPRAGRGNGVDLPRRGGGHPRKRRPGTGPMAGRAGRAVFAQRPAARPAYPQGRRTDGRDRRDRRPGPRAGGPLRRTGRPPLPALPATGRIAASLSRPPGRTARPVERRPAPGRPARPYPVDPPVPPGPAGRGRDTGRGGKPCRGTRCTYRRGARRACCGGVRRARSRTGGDLPRGRLRYPRQRCRRVAALDGRRRQHHRTGSLAARPAYPQGRCADGRDRRDRRPRP

SEQ ID NO: 16942 - protein, 193 aa, Pseudomonas aeruginosa
  UNSURE (170): Identity of amino acid at the above locations are unknown.
IPLRRPLRWTPARQPGLVRPAAALPRRAGRDARGGAWPPHAARRAGADRGDQAPAQRSRRATERTHQRQPQAAGGEGRGGRRERDPRHLPRGSRRPAGEPRTGARPLGRRQRRRPAAGRPAADPAHPQGRCAPGRTDRAGQPGPRPRAASHRCAATGPAVAGQPAAGCAXGAGRPAAAGRPVARAAGRGRRGR

SEQ ID NO: 16943 - protein, 186 aa, Pseudomonas aeruginosa
AARARPGAGPGRRYRPRGGLRAGRADPPGPGGRRDHGGRGGASGRPGHHPAVRAQGPGGGPGGRFPTCPAGAGEGAGGTAGEPGQPGGRDLDLPRPGRAAGERRRLHPRRDGVHHRAGARPVAPPRHRDPGADPLASPGRCRTRRLRRVRPAGNGPLFAVAAALARTLRIGLRPSRPEGNPGGEEP

SEQ ID NO: 16944 - protein, 147 aa, Pseudomonas aeruginosa
RGDPAAATGAGQHRTPGRPDAHPHGAVRSAGTAFAADRPAGGRRAWQAGRIRGRQRRRRDGSYRPRTHRRAAGAHAAQRRGPRHRVRRDAPRGGQAGARYDPPEHRPRGRRHPPHPLRRRRRHPPRRGTAQGHRAWPDERRQRPQRS

SEQ ID NO: 16945 - protein, 304 aa, Pseudomonas aeruginosa
SFSAAWVATAAPLPPTCGARVARYGPSAPTVASVRACRTACAKPVTAVSMPAPANWPRHWSSIWPHAARRQESKHEPGRDRAGWHEPEHPSQPDPGQPHRAAPAAERPHPAVAQRRRGRTDRLSQPTGRRRPAAVVPGPGGLARPAPAAAVLRGGLQRRTAAGARQQRAGGGHQRPRRTTPCEVPRPAGAGHSALGAAGRQSREHRRAAGGAGTGGGGHRRRNRTDSGPGRARREARRRRPDLSRPWPACSTRGSAPPSRSPAPAWPGTASRSTATTSSSSAPTSADWKMSGWMAVPSRPTAAT

SEQ ID NO: 16946 - protein, 205 aa, Pseudomonas aeruginosa
PSTTRGRSRAAASATASPGASPASICLPPNWRAAWIFPPSSSTARCCAVRRWAASWPPASKPCWPATVSPANGARSACWISLAACWRRAAPACRRGPILGARLSPACRRCSPSAWPNRRTWMRWRSRWACRNTTCCGRSRRPPGSARASGACNWRTRRALGLLRRGLAVGEVAHALGFADQSHLTRYFTSAYGISPGRYQRAVRG

SEQ ID NO: 16947 - protein, 213 aa, Pseudomonas aeruginosa
SDVPPRSRRSMLAIFLAALLFGFAFNVSPGAVFSETLRRGLTGGFRPALLVQLGSLIGDAVWALLGLTGLALLLGYEQVRIPLTLACAAYLAWLGVQGLRDAWSPPLAAEDAGEQGRNAFGAGAAISLSNPKNVVYWGALGSALAGIVDGTPNQAQSLVFFAGFMLSSLIWCFCCAALVDWLRRNTSLFWHRVSYAGCGVLLLGLAGLALRGL

SEQ ID NO: 16948 - protein, 173 aa, Pseudomonas aeruginosa
TRLRPAPGAAAAGVGAGFRTCRGRHAGHGRRRRSGRRAAPPSAVVRPPGPVRRSGCAAPGRIRGARAGRGPASDAVPATAPGAASLRPGPGASGRGLRPGRPASGCGSRRCRAGLRRAFHAPARRWSRAPPRSVAPDRRADPCRRGTAGAGCVPRAIRRTARGRAGRRAGPEW

SEQ ID NO: 16949 - protein, 187 aa, Pseudomonas aeruginosa
PRRAGRPPNWPGRATRPGFPPRHRAGVAAWAIGAGPAGRGCPRPAGGRWPGRAPGARRVRGRCRPKPAPGRPARRRGGPPGRPRGRFPGAACGRCGPALRVHRGGAGCGGRRPRTGSGCRLRPGVPPTPVPGIPAPGRGLAGNPREGRRAGAPAASPVRRRPTAGSVRHSLGGVRRARRAGGSSNRR

SEQ ID NO: 16950 - protein, 178 aa, Pseudomonas aeruginosa
ACSTSASLRPPSGPTRKARRDGGAWLARGAATGCRTSLRSSSRPRSQSSRARGGWISGRLERPHCSQALIATWRQCCRRLSARSSFRRTSQRSLTIGVISATPSSVAFWIAQSIRSPRDRPCPRWIRRGESGWPANCSRSSTRTFFLPTSTSSPRYSRPLPSNSCTASPVACRSTRPM

SEQ ID NO: 16951 - protein, 141 aa, Pseudomonas aeruginosa
SRRAAGNTPRCPAGAAARRAPGHAGRPSGRGAPARGRASWMPCPGPFQWPGPSRSGAPRRHAGGRPGARWPWPCGCTARGWPRSPCLPRRCPGSPGRRRRPAGCRYRCASGGRRAGSGSRRRSPGRRSRWSAPRTSAGSHR

SEQ ID NO: 16952 - protein, 538 aa, Pseudomonas aeruginosa
DEQPGGLGHIRQQPPTDSYGGPNGSGVCCAPLRLCFFPGESGMSLRWLRAAAFLMLGVFSAVALGKDKQPTAIVVGAGLAGLSAAYELQKDGWQVTVLEARPQVGGRSGLATSEWVGNQKVQPTFNAYLDTFKLKPVPAPDFVRTPSYLIDGLYYSSSDLALKQPNVAADLKRFESTLDDLSASISDPLNPASSNTLFALDQMNAARWLDKLNLSPTARLLVNQRIRSRYDEPSRLSLLYLAQQGRAYRGVDDRDLRAARLPGGSQVLAEAFVKQIKTIKTKSKVSSIVQAKDGVAVKAGSETYKADYVVLAVPLKALGQIQMTPSLSGTQMSALKGTNYGWRDQILLKFKRPVWDDKSRLSGEIFSDQGLGMIWVEPALKGGANVLINLSGDNARVLQAFGDRQMVDQVLIRMNKFYPKMRGAFAGYEIRRYSADPGTGGSYLAYGPGQVTRFWRIWEQPLSRVAFAGEHTDALYPGTIEGALRSGKRAASQVRDLYAGKTPVIEGAPMVAKAEKVAAPTTGGEKKNPFAWFTRLFD

SEQ ID NO: 16953 - protein, 224 aa, Pseudomonas aeruginosa
PANLSCESMFQSRIFCFNSMDLPLVLRLRFSRKFFMQWRNTSSRYGVFSLFLHWGSALVVFGLFGLGLWMRELSYYDPWYHPAPALHKSIGILLAIALLVRIVWRFVSPPPPAPANHGPLTRVASKLGHLALYGLLLAVIVAGYLISTADGEPISVFGWFSVPATLSGLPDQADVAGEIHLYLAWALVVFAVLHALASLKHHFVDRDPTLKRMLGRSSNDQQPR

SEQ ID NO: 16954 - protein, 527 aa, Pseudomonas aeruginosa
SAAWSLRPSWRSSGYRCSTWRSARCSRTRRPSSKRPSKRGNDMKRSFLSLAVAAVVLSGCSLIPDYQRPEAPVAAAYPQGQAYGQNTGAAAVPAADIGWREFFRDPQLQQLIGVALENNRDLRVAALNVEAFRAQYRIQRADLFPRIGVDGSGTRQRLPGDLSTTGSPAISSQYGVTLGTTAWELDLFGRLRSLRDQALEQYLATEQAQRSAQTTLVASVATAYLTLKADQAQLQLTKDTLGTYQKSFDLTQRSYDVGVASALDLRQAQTAVEGARATLAQYTRLVAQDQNALVLLLGSGIPANLPQGLGLDQTLLTEVPAGLPSDLLQRRPDILEAEHQLMAANASIGAARAAFFPSISLTANAGTMSRQLSGLFDAGSGSWLFQPSINLPIFTAGSLRASLDYAKIQKDINVAQYEKAIQTAFQEVADGLAARGTFTEQLQAQRDLVKASDEYYQLADKRYRTGVDNYLTLLDAQRSLFTAQQQLITDRLNQLTSEVNLYKALGGGWNQQTVTQQQTAKKEDPQA

SEQ ID NO: 16955 - protein, 481 aa, Pseudomonas aeruginosa
LTTWGNWSISRPRAAMSVATRIRTSLALKSASALVRAFWLLLPWIAAAGRPCLVRYSARRLAPCLVRVKTSTCSQAPTVTRCASRARILRRRQAEHALLDALDRGVRRRYLDAFRVVQELVGEVDDVFREGCREQQVLALGRQLGENLLHIVDEAHVEHAVGFVEDEDFHVGQVDLVLPGQVEQAAGAGDEYVDALGQGLDLRVHANPTEDAGAVQRQVAGVDLEAVMHLGGQLTGRGQYQHARLARAVAVFAVGMTGGEQALQYRQGETTGLAGAGLCRNHQVATLQHGGNRPLLHGSGLAVARSLHSAGKRLGESEGRKGHAGFPIWAGARPAAVKSPSSANSCLPSGPVGQGGRSGRGAAYALGGRCRTGALAGMAAHLVGGAGRFAPGPGWGGRGQRQRRAAVRAGHAGANAGGSRWPGSQGGCAASCDSANPRFVPQSVPADSVRWHWSRLSPTRRGRRPGRTRYCIRGNRRAVRY

SEQ ID NO: 16956 - protein, 387 aa, Pseudomonas aeruginosa
GRSSTTPYWPSCSASSAERWLAAFRACSTSASKPLAWKDLIAASVVPLGEVTRRRSSAGSTSLDSAICAAPRAVCRVRREAVSRDRPSFSPASVMACISRKKYAGPLPDTAVTASICASSSSHRAMPTADSNCPACSRCAALTCALAYSPLAPWRSSAGVLGMQRTTGRGWPSQASRLAQGMPAAMETISCSGFSAGAKAWHTAFMACGLTDRTTTSASATASALDSTTSMANSPAIFARCSAPGSLARICAAGTPWARRPPIRLAAMLPAPMNAMRGVLIGDSFKKPARRSRGRRTGRYRCGPRSHLRRWLPRGRRSCPWTGCPGQGSGPAAVRAGGRTRRVARRVRRWVRGWPSGHAIGGWAVASRPRPGPAGPRGRSRTCWLRR

SEQ ID NO: 16957 - protein, 257 aa, Pseudomonas aeruginosa
RFAQLGQLDFLRHPFEQHMQALAQQDPGARQDPETDQHRHQRVDPGPAGETDHDRGDDHPQRAEHVAPDLQVGALDVQAVALGRRQQAHAGQVHQQAEHGDHQHAHGLDLRRLVEPLVGRVEDIEGHAEQEEGVERRGEDLEAVVAVGQAIVGRAPGDVDRGQGDGQGHGVGEHVRGIGDQRQAAGEDAADDLGDEEASGQQQRPFQAGRVGLGEAVLVSGAHGGSCGAVAAAPAYRIGNCKTVMRRAALARRPPLR

SEQ ID NO: 16958 - protein, 150 aa, Pseudomonas aeruginosa
PAAQARPQPRTERGGRMTQQHDTHSKAIGYLLWIFGFTGSHRFYYGKPITGTIWFFTFGLFFIGWIIDLFLIPSMDREADRRFQGGNLDYNVAWILLTFLGVLGVHRMYMGKWITGIIYLFTGGLFFLGVLYDFWTLNGQVSERNGPQRI

SEQ ID NO: 16959 - protein, 134 aa, Pseudomonas aeruginosa
SRPPSVTAACGPVAPSSRPPPATPVSAWPWSAARRATGWCWWCRTRCPPRRSCTCAPWAPRCTSPARTSARAIRSTTRTLPRAWRRIFPAPSSPTSSTTRPTRWPTSAAPARSSGRRPATISTPSSSASAPPVP

SEQ ID NO: 16960 - protein, 96 aa, Pseudomonas aeruginosa
AGETADAWLRRMISLDLRCDLAGARRFLENVRIFSLAESLGGVESLIEHPAIMTHASIPAETRADLGIGDSLIRLSVGVEALEDLQADLAQALAKI

SEQ ID NO: 16961 - protein, 138 aa, Pseudomonas aeruginosa
GGLVAEAGIGRPPRQRIRPRNREREDEKARRMAGFFVVAGISPRGSGVRPPGCNALVPAGSDRRTGCSAPSSTSSHRPGSNPAGRTTLGRRPGRPPGARQAGAGPGPGRGRGGRAGSAGRAGRPAPASSPAAAAARRR

SEQ ID NO: 16962 - protein, 186 aa, Pseudomonas aeruginosa
AHGGSSLTSMGWPPGEPAVGRRPRWRKHNGKRRRAGCHGSIRVFGQPAFQQQGGGQGIHRSLAVAVALALGQALALGGVGREAFVVGKDRQVETAVEAAAELFRALAHLAWAAVHVQRQADDDGVRLPFLDQRFHPVPVRHAVLRLQYAQLAGLAGHRLADGDADLPGAVVEAQQQAQRLVAGHQA

SEQ ID NO: 16963 - protein, 156 aa, Pseudomonas aeruginosa
QGVSALKKTQKNDSPSRYRANMEQQSDGLKVMVIDDSKTIRRTAETLLKKVGCDVITAIDGFDALAKIADTHPNIIFVDIMMPRLDGYQTCALIKNNSAFKSTPVIMLSSKDGLFDKAKGRIVGSDQYLTKPFSKEELLGAIKAHVPSFTPVDAVS

SEQ ID NO: 16964 - protein, 308 aa, Pseudomonas aeruginosa
LSDRDVQADRHAGKAWSPGTQGRERRRRGRPGPPGKARRGPDGHRHARPQRLPGDPSIDQGRRDQRHPGDHRHHQGPGDRQGLGQAPGRSRLPDQAGGRRDPAENHQCGAGGLSPSQRIAHPDPGKTRPRMSDVQTPFQLLVDIDQRCRRLAAGLPAQQEAVQSWSGIGFRMGGRFFVAPMGEVGEVLHEPRYTQLPGVKTWVKGVANVRGRLLPIMDLCGFLGTELSPLRKQRRVLVVEHLDVFAGLIVDEVFGMQHFPVDTFSEQLPPLEAALQPFIHGVFHREQPWLVFSPHALAQHQGFLDVAV

SEQ ID NO: 16965 - protein, 696 aa, Pseudomonas aeruginosa
HGNRNRGRSGRGPNMKKINAGNLFAGMRSSSVIAGLFIVLIVSIVLLFANFAYLNTQSNHDKQYIGHAGELRVLSQRIAKNATEAAAGKGEAFKLLKDARNDFEKRWNILVNGDESTSLPPSPEAVKPQMDVVQQDWDGLRKNADSILASEQTVLSLHQVASTLAETIPQLQVEYEEVVDILLENGAPADQVAVAQRQSLLAERILGSVNKVLAGDENSVQAADSFGRDASLFGRVLKGMQEGNAAMSISKVTNAEAVDRLNEIAELFEFVSGSVDEILETSPDLFQVREAANNIFSVSQTLLDKASQLADGFENLAGGRSINLFAGYVLGALALASIILIGLVMVRETNRRLAETAEKNDRNQAAILRLLDEIADLADGDLTVAATVTEDFTGAIADSINYSIDQLRELVETINQTAVQVAAAAQETQSTAMHLAEASEHQAQEIAGASAAINEMAVSIDQVSANASESSAVAERSVAIANKGNEVVHNTITGMDNIREQIQDTSKRIKRLGESSQEIGDIVSLINDIADQTNILALNAAIQASMAGDAGRGFAVVADEVQRLAERSSAATKQIEALVKTIQTDTNEAVISMEQTTSEVVRGARLAQDAGVALEEIEKVSKTLAALIQNISNAARQQASSAGHISNTMNVIQEITSQTSAGTTATARSIGNLAKMASEMRNSVSGFKLPEGVEQA

SEQ ID NO: 16966 - protein, 303 aa, Pseudomonas aeruginosa
ARRPPGGRRVDTLDEGHGMQANGVWSLQPLADMSAAEFRDWQVLLENRTGVVLNEQRRTFLQASLTARMRELGIGDYHSYYRQVTDGPRGAVEWATLLDRLTVQETRFFRHPPSFELLERYLGERLRREGMPRPWALWSVGCSSGEEPYSLAMCAAQVLRGQEREDFFGVTGTDISLHALQRARQANYPARKLEQLEAGLVERYCERQADGSFSVKTILTERVCCARLNVLDLAKAPWSGMDVIFCQNLLIYFRRWRRREILNRLAERLAPGGLAGDRGRRSGRLEPSGARAGRRRAGPGLYP

SEQ ID NO: 16967 - protein, 2482 aa, Pseudomonas aeruginosa
  UNSURE (1766): Identity of amino acid at the above locations are unknown.
GVLRHMNGVAMGDRHDYVALEWVKGEIAETLKQARQALEAFVENPQDPTRMRFCLTYVHQVQGTLQMVEFYGAALLAEEMEQLVQALLDGRVPNQGEALEVLMQAILQLPVYLDRIQTARRDLPMVVLPLLNDLRAARGEKLLSETSLFAPDLSQRQPQLDGEAIAQLRTDELGGLLRKLRQTQQMALVGLLRNQDVATSLGYLARVYARLEGLCREAPLGPLWSIASGLVEGLANGSVVNSASVRTLLRQLDRELKRLVEQGADGLNQAAPDELVKNLLFYVAKAPSQSPRIRALKEQYRLDEALPDHETVDAERARLAGPDRDAMRSVVGALCEELVRIKDSLDLFVRSDRGHPSELDALLAPLKQIADTLAVLGFGQPRKVILDQLDVIHALAQGRREPSDAILMDVAGALLYVEATLAGMAGPGDERNSEESRLPTTDVAQIHQLVIKEARNGLEQAKDAIIEFIASQWNHEHLARVPELLTQVRGGLAMIPLERAATLLETCNRYIQEQLLARKAVPDWQSLDTLADAITSVEYYLERLSEDHASQSDLILDVAEDSLANLGYTLKPNSSAPAEPGLSGPAAIESPAAEPERPEAVVEVAETAEQPPADTAPAEAAREDAPQLASDDNWTLGEVAPDAGEPSLDLALDLPLDDSAEVPPALPEVVEESGQPQSTPAPARSLDDFSLDEIDLSGLDLPADAAPASGPAALADWSLPEQWGLGDDLAQPTQAGETLDLSLEEPALSFDAPLESLEPLPALEPFDGSAEQELVLDALDPLPLDVALPEAEGEVSAWEGSSLEELDLSDLDLPEVQLPEAEAEAPPAAEALASEAPALSLAEVMAAPVQPINPPAQNVPVSLLPPPADEEPVDEELREVFIEEAGEVLETIGRYLPAWKADHDDREALTEVRRAFHTLKGSGRMVRALVIGELAWSIENLFNRVLDRSIAASEPVQRVVDQVVALLPELVEEFAANAQRQRDDVDLLAATAHALAKGEPLPEPPAPDDGGVPPEAGAEQPSSLDNGVQAPPLADAPQAAAEAQSDVELLDPQLLEIFTNEAETHLEALVGFLADCARELPQPVTDALQRALHTLKGSAHMAGILPIAEIATPLEKLVKEYKSNLLAFDLREAELLHDAEQLFRIGLEQVGAQRPLNPIPGSDALLERIEALHQERIASIEAERYSDAGERRDPLLIEAFLVEGMDILLDAEDLLERWHEHPQERQELSALREELSTLDRGARHAELPQVEELCQALLALYDAVEEGRLAVSPAFFEEARQAHEALIGMMDQVAAGLQVTPRPERVAALQELLEAPAAEAVPFIDPESLGADDFPPEDEEPALPEAVFEEAGTPAEETVPAAPAPAPGRELDEEMVSIFLEEAVDILESAGQALAQWQAEPGALSSLSALQRDLHTLKGGARMAEIAEIGDLAHELEALYEGLVDRRYQHSPQLAGLLQACHDRLAEQLDQLSAGQPLADPHDLIQSIRRFRQGPLAEAATPGEAESPVEELVAPTVEEPAAPAAEAFEERDPELVEIFLEEGFDILDSAAAALQRWMDDVDNTIELEALQRDLHTLKGGARMAEIGEIGDLAHELEFLYEGLCGGRLRASPALFGLLQRCHDELAEMLEAVRGHRTLPDGQALIAEIRRLRSDPDEQLSVPTSVSLKPLAAKGAAADESEILDIFLEEADDLLENLELALGRWDGGNGDAQPLDDLLRILHTLKGGARLAGQTELGNLAHDLEQHLTDAQQQGPPWPDSLLLDAXSGLEGLQRQVDLLRERLAEDDEAGERPEPAQALVQADDTDRAVASALAELTRLAPAAGAIMAAEAAPPAAPATTLPFVRKAQEAAQEAASRRAPQELVKVPAELLENLVNLAGETSIFRGRVEQQVSDVGFTLGEMESTIERVRDQLRRLDTETQAQILSRHQADAERAGYEEFDPLEMDRYSQLQQLSRALFESASDLLDLKETLAAKNRDAETLLLQQARVNTELQEGLMRTRMVPFDRLVPRLRRIVRQVAGELGKQVEFVVGNADGEMDRTVLERIVAPLEHMLRNAVDHGIESGETRRAAGKPEHGTIRLNIGREGGDILLTLSDDGAGIRLDAVRRKAIERGLMSADSDLSDHEVLQFVLESGFSTAEKVTQISGRGVGLDVANSEVKQLGGSVSIQTEPGQGTRFNVRLPFTVSVNRALMVLSGEDLYAVPLNTIEGIVRVSPYELEALYDQRGEAGLDTPSFEYAGQSYELKYLGELLNNGQEPKLVGQSLPLPVILVRSSEHAVAVQVDSLAGSREIVVKSLGPQFAGVAGISGATLLGDGRVVVILDLLATIRSRHALLGQESRRERLALRQEMAASESEQQRPPLVMVVDDSVTVRKVTTRLLERNGMNVLTAKDGVDAIAQLQEHRPDILLLDIEMPRMDGFEVATLVRHDERLGNLPIIMITSRTGEKHRERALGIGVNQYLGKPYQETELLEAIQSLVGQHE

SEQ ID NO: 16968 - protein, 235 aa, Pseudomonas aeruginosa
RRQRRCRLRAAPGWRGMDPARRQLRLFEHAGQLARSRLQQFQCQPPRTGRGIGQASGRTLRADRSRNMNQAVIEQDGMSRNTPANPTPDSLTGLLLPLSDRTLLLPNVAVAELIAYRNPQVAAGLPQWYLGQVAWRDLRLPLLSFEAASSGEQQPVLGSSARVVVINALGGRPHVKFLALLVQGIPRSVRLDANLASTAAPLAALELAAVDIGGETARIPDLAGLEEKLADAGLI

SEQ ID NO: 16969 - protein, 664 aa, Pseudomonas aeruginosa
FPPPPARWPSGSPSPSARRATGLAPGGYAGASRAGRRTARGVRRGHSSCRPRPARRGIPGRCRRTVARRRPWRAAARGRCSGPGPRAGRAGRGREAGRRRSGTGAWRFEGSGDRRAVYCLPRGAGTGPLGTKGRRRSARIAVVRVEVADRHADRVAGGDVDAFAGHLGEEVDLLRGNHVGRQEIHHAAQRAQQRAALQAMLEDLQAAALLPGVGRPGCLVLDHFNGQDHPGLAHLGDMRVVGQVRGGPGHVGAQRAVGLDHLVFLEDVQGRQGGGAGQRVAGIGVRVEEGAQGLVVVVEAPVDGLAGQHRGHRQVATGEGLGQAEEIRGDAGLLAGEHRPGAAEAHRDLVVDQVHAIAVAGFAQQLEVDRVVHAHAAGALDQRFDDDRGDLVVPFGQGALHVGEHVPRMFFPAHAVRTQEAVRAGHLDGVEQQRLVGFGEQRHVAHRHRRDGFAVVAVGQGDEALLARPAAIEPEVVAHFQRDLDARRAAVGVEHPVEPRRGDLHQSLRQLDHRLVAESGEDHVLQLVDLVLDALVDARVGVTEHIDPPGTDRVDVALAFEILQPDAFAAADRDHRQAFVVFHLGTGMPEYVQVALHPVGVKAHGLSPRIDRQSLCNGGEMNNPAGWDTSDSSRRRTPMVAQTALAYAARRCVFAFFLGSPVCR

SEQ ID NO: 16970 - protein, 154 aa, Pseudomonas aeruginosa
FPQRQQEPDRYLRIHRSEGQRRQRRHHRQPDPERRDQAGHHQGQADRPGRRPVGRLPCRLRRQRHPEAERLRHQDGPRPGIPGSRAAALRRRHSPVSGYLKRKTPAIAGVFHCASKRMFLNILKRLRGQALVEEMHQGGLFHRGERGKQLVMHA

SEQ ID NO: 16971 - protein, 336 aa, Pseudomonas aeruginosa
GSEDPRRGDPPRVPGDVPVPAELPRHADPDHRRTGGAAGDLRRARRVRLLDQHPDHVRHGAGHRLAGGRRHRGGGERRAGDGRGRPVAKGGGAQVHGPDPGRAGRYRHGALGGIPADGVLRRLHRGDLPAVLHHHRVGHGPLGDRGADPHPGALRDHAQADRERRPWRAQGRLLRLVQPDVPFHHPRLRAGRGVDPQTSRAVPADLRGDRGRDDLDVHPHSHRVPPRRGPGRTVRPGTDPAGLQCRAYPGGGGLDARIPAGEGKLFGQLGVHRDRLQLRRPRPEFGHGVHHAQALGRASRWREQRVRTGQARADALLQLQGRDGVRLRAAVGTGTG

SEQ ID NO: 16972 - protein, 161 aa, Pseudomonas aeruginosa
RHRLRPVPPGPGGCRPRSPAPGAQQVPHARRAEPGAATRAPQRHERRTAVQAGDRRREGQRPRRVPCRHQQHRVHRLGFQLRQRLHRPWPGQAGLPAGQAGRADEPGRPEQVVRAQRQGRDGAVQRLRHRQVGIRFAEAGALQWRAGDGDPRRAGARPEFR

SEQ ID NO: 16973 - protein, 210 aa, Pseudomonas aeruginosa
RHGGGRGDRQAIAERRWLLLDRPVLRGALVRLAGAGAVCAVAAGGVPLPGGPVRKLVDSVLGDAGGAVGRDRRAAGDVHARPVQRRVLPGGPVDDHRPVGEERHSHRGVRQGAARAGQGHRRGGHRSLPHASAADRDDLPGVHPRRGPAGDLHRRRLGQPACDRYRRDRRHGHCDRPGDLLGTAVLRGGQHAVQGRGVQAASVRRKGAMI

SEQ ID NO: 16974 - protein, 153 aa, Pseudomonas aeruginosa
RPAPVPRRRRLPGAPAGRGFCGAGRRNTRCSMRSTVVFGGVTSMRSGLCRSLLARSTMSFEKVAENSRFWRLGGSLARTFFTSWMKPMSSMRSASSRTRISTWDRSTLFCPARSSRRPGQATSTSTPLARAWICGFMPTPPKMQVLFSGRSRA

SEQ ID NO: 16975 - protein, 323 aa, Pseudomonas aeruginosa
VGHVCRGSRERHPCRYTLPGRTAWAVSAWQLEILPDRQARIGLVQSIEMQSRCAALQQAFAHLADDLLAEGLDAAAVVAVGFQLLADPARQFGAAGVGEARQLGVVGDRHDAGDHRDVHAELGDPLDEVEIGIGIEEVLGDGAAGAGLHLAHEVRQVILEAARLGVDFRIGGDLDVEVVAGLGADEVHQFVGVAQFAAGHAHARRQVAAQGDDAADAGLAVAAEQFAQLGFRVADTGQVRRGRHLHLAVQLQHGTQRAVAGGSAGAVGAGEEVGLVARQVAGGGQQLFMAGLGLRREELEAETAFALTHDRFLGRDHGRASSC

SEQ ID NO: 16976 - protein, 666 aa, Pseudomonas aeruginosa
GIPSRSRRAVVAGAEQGGTDADPGRTFADGCLEVVAHAHGQGVQAKVQVQQQFAQAGERDVLRGAFGGGFGDGHQATQSEVGQLLHGLGQGRQVLGGAAGLAGFAADVDLQADIQGRQPGRALLRQALRDLQPVHRVHPLEMLGDGPRLVRLDGADEVPVQGQVGQFGLLAEGLLQVVFAEVAKAGGVRLAHRGGGLGLTHGEQADRGRIAPRSLRCLTDARGNLCNILCYRGHYLRPMEVRSASARRPRNRRPRWPSSCSSVEVPRLAQDTTRVLEAPWLIRCFPCPRRRLWRHSTCLLVIGESHGYYRAARLQCQTGRFGPAPLRRPATHDPGGWRCTPDQPATAGTQAGACADLRHHERQAAQGLRGIPRDRLLLRGAGRRAFPGQRLQPEPWRRRGIPDHSLQGTDHGGAWHGRSVQTCFRRPARVGTGHRADRFGQVHHPGGDARLPEQHQVPPHPHHRGPDRIRPRIEEVPGQPARGASRHPRLQRSAALGAAGGPGHHPGRRDARPGNHPPGPDRGGDRPPGIRHPAHHLGGEDHRPGGRRVPGRGKGHGSLDALRVAAIGDLADPDQEDRRRPGGGPRDHDRHPGDPQPDPRGQGRADVFGDPDRRLAGHADPRHVPQGPGRQGPDQPRERPREGEDPGKLLILAPIRRASPESRNCV

SEQ ID NO: 16977 - protein, 227 aa, Pseudomonas aeruginosa
VQLRHQRPRHRPLPGQCLLPAQPGGYGIAPDRDQHPDPGRAEAPGNPQEAGADQARPGDLRRRHRHRQVHLAGGDDRLPQQELHRAHHLHRGPDRVHPPAPGLHRHPARGGAGHRLLRGGAEEHPAPGAGRDHDRRGALAGDHGPRRGLRRDRPPVPGDPAREQRQPGAGADHPLLPGRPSWPGVDGPVAEPQGHRRPATGADPRRQGAAGGDRGAAEHPGGRRPDP

SEQ ID NO: 16978 - protein, 243 aa, Pseudomonas aeruginosa
RPPAARWHHRRGHRRQHRSRPGPGRPREGLPGGAGGAGQDVHREGPAPARHGRRGAHHPLGRRQGPSGVLPGRCRAPGAGYSRRLLRRPVQQPGQPAGPRVRHRPGALGADRPRSRRHRRRRRLLRYPDRPYPVLPEVPAGAGDGARRSRGLDHGRVLPLRHPGYAGFLGGGGHRRGLRTGHRRPLQRAPCLFHQRRGKLRHGPRTVARRGHSRRLLHRHPAGRGAALLSRAEGAEAGGQLRL

SEQ ID NO: 16979 - protein, 463 aa, Pseudomonas aeruginosa
HRYPLPVEDLQRPVDDRPGPAATQALRRPARHHRAALRGGPGDQRRSGRHPAHRLPAHAPGRRFAIAGAGRWKTGRCDRRVGYPARCPRRRATLPRCGKQRDERRAGDPRARRQPGPVAGGPGPRPGGDRCRCQRLPRPDHPFRPVEPFAEKARMSQHDQHPDAPAQAFATRVIHAGQAPDPSTGAIMPPIYANSTYIQESPGVHKGLDYGRSHNPTRWALERCVADLEGGAQAFAFASGLAAISSVLELLDAGSHIVSGNDLYGGTFRLFERVRRRSAGHRFSFVDPTDLQAFEAALTPETRMVWVETPSNPLLRLTDLRAIAQLCRARGIISVADNTFASPYIQRPLELGFDVVVHSTTKYLNGHSDVIGGIAIVGDNPDLRERLGFLQNSVGAISGPFDAFLTLRGVKTLALRMERHCSNALALAQWLERQPQVARVYYPGLASHPQHELAKRQMRGFGG

SEQ ID NO: 16980 - protein, 441 aa, Pseudomonas aeruginosa
GRRRSLRIVVAGVGRSLPMGGGKVYDALRALDTRSLAVAHRPGRGGRTEARPRDSAGSQLGGDGVHQLVADAGVEGLVDLADAGRAGDVDFRQIIADHVEADEQQAALAQVRADLGGDPTVALAQRLGHAAAAGGEVAAGLALGGDARQAVGHRFAVDHQDALVAVLDFRQIALRHDLLAAMLGEGLEDHREVRVAFAVTKYRRTAHSVQGFENDVTMLGGKLAQNIGSPADHRRRSALGELRGEELLVAVAQALRPVHHQGAGTLGLFQQVGRIDEFVIEGRVLAHQDHVQFVQRLVAFRFQFEPAGGIVEDLQRAHASTRDAGLLVEVLLFHVEQRPAAGLGSQQHGERAVLLEVDARDGVHDDPEAYAHGNSSERGWVVRSRRGGRVASGFDAQVGAPFALGQGKSRPVPGIMDRVASSVLKRPAIGSQPVGDRALAH

SEQ ID NO: 16981 - protein, 129 aa, Pseudomonas aeruginosa
CLFRDGDPMARILIVDDSPTEMYKLTAMLEKHGHQVLKAENGGDGVALARQEKPDVVLMDIVMPGLNGFQATRQLTKDAETSAIPVIIVTTKDQETDKVWGKRQGARDYLTKPVDEETLLKTINAVLAG

SEQ ID NO: 16982 - protein, 170 aa, Pseudomonas aeruginosa
NRIRRPRPSLACPGPLPSSPRLPSRRGRRRSSRSPRQRSNRPPTRLLPRPRGKMPRSWPATTTGPLAKSRPTPASRPSTWPWTCRWTIPPKCRRRCRRWSRRAASRSRPRRLPAAWTISASTRSISPASTCPPMRPRPPGRRPWRTGRCRSSGGSAMTWRSRRRPARRWI

SEQ ID NO: 16983 - protein, 384 aa, Pseudomonas aeruginosa
SPRGPARNTASARWASASTSTSASLTRKPSCSKPSSPWSASMSERVTPRVAVIADTSLQRHVLQQALLGHGYEVVLNADPARVDDAALECAPDLWLVDLTQQDDSPLLDSLLEQDRAPVLFGEGHAPERHTEHYPRWERRLIGKLKRLIGDPSDGVGDSLGALLDEERPPRLEIPGDLAAMPLQAGEAAREVWLLAASLGGPAAVKAFLDALPGGLPIGFLYAQHIDASFEQNLPQAVGRHSQWHVKNVRDGEALRCGEVMVVPVLHELGFHHDGRLKCSQRSWPEPYTPSIDQMMLNLAQQFGPDCGVIVFSGMGSDGSAAAAYVRRQGGEVWTQRADSCVCSSMPDSLREAGYSSFNASPRELAEALVKHLAARCAPTGVET

SEQ ID NO: 16984 - protein, 551 aa, Pseudomonas aeruginosa
SEPSMAGLQHARIGASLEVASASLAGHRFEKHSHDEFVISANLCGLEDVWLDGRTFQADSGDLTLYNPGQIQGGGVRDGQPWRFASLYLPAAELASSLDLSSVEFDRPLLRSPALGRELAASIEALLASDRFARERGEERLLDFLGRLLAASGTRLPQRADPGRPAVARLQALLAERLAEPPDLDEMAEQVGLSKYHLLRAFKKATGLSPRQWSMQLAHPPRPRPVAPWPGGGRGGPRPGLRRPEPPDPLLHQRLRHFAGPLPARRARLNCAIRFKSAEPPAGIIRRPTTESSFHARHLPRRLAVRFRLQCFPWRGVQRNAAPRFDRRLPPGVAGATGVADRRCRLGPARAHRAGAAAGLRTGADSPDPGLCRLPGLARRARLARRLESAAGGGGCRRAGAQRLRRRRGDLPVQSEERGLLGCPRQRPGGDRRRHAEPGAVAGVLRRFHALVADLVLLLRGAGGLAAAQHLAVLAPRQLRRLRRAPARPGGTGAARAVDAPQAGARRRRSRRWRRLSNVPRSTCRAWSPTTIRPSGSSAQCCSPPSRSSSP

SEQ ID NO: 16985 - protein, 362 aa, Pseudomonas aeruginosa
SRRSTPSTSGRRIFQSKVTGVSMRAIRCEVGCATVFTGCRRCKAAGGISGEVAPELLGHRQRYHRRGLGAQHSRAEARGVETGRLSLLHLGIAQAAFGTHQEGQARRRRMAGQGGGHRVQDQPEVIVPPAQPVLQGQRRMDQRQARTAALLAGADRHLAPVLQALVGALVLQAHFATLADDRGDFRHPQLGGLLDRPVHPLAARQALPQVDTQGRVGLAGELLAEFDADILLADLDQLAEVFPAAAVEQLHGVARGVPQHAADVVGLGLGQVVLAEGERLVDEEAGQAHGDSRVVATGAQFTACRGALEPAPSERRGGDVQPGSRWSGWKSLTATLTASRVAMSMPSLATSARKSICSGVIT

SEQ ID NO: 16986 - protein, 417 aa, Pseudomonas aeruginosa
TAYGDRRRRGPGRPERGLRIAEGRLAGHGARGAAAGGRAFRPGHQRMGRQPEGPAHVQCLPGHLQAEAGAGAGLRPHPQLPDRRPVLQQQRSRAQAAERRRRPQALRVDPGRSLGIDLRPAQPCLEQYPVRPRPDERRALAGQAEPVADRAPAGQPAYPFALRRTVAPVAALPRPAGPRLPWRRRPRPARGAPARRQPGAGGSLRQADQDDQDQIQGVEHRPGQGRRRRQGRQRDLQGRLRGSRRAAEGARPDPDDPVPERYPDVRAEGHQLWLARPDPAEVQASGVGRQVAPLRRDLQRPGPGHDLGRAGAERRRQRPDQPVRRQRPRAAGFRRPADGRSGADPHEQVLSEDARCLRRLRNSSLQRRSGYRWFLPGLRSGPGDAFLADLGTAAVAGRLRRRAHRCAVPRHHRGRAA

SEQ ID NO: 16987 - protein, 200 aa, Pseudomonas aeruginosa
STTTLRRMSMLKKTLAALALGSALFTAGQAMAADYKIDKEGQHAFIEFRIKHLGYSWLYGRFNDFDGSFTFDEKNPSADKVKVTINTNSVDTNHAERDKHLRSGDFLNVSKNPTATFESTEVKANGDSADITGNLTLNGVTKPVTIKAKLIGQGDDPWGGYRAGFEGSATLKLKDFGIKMDLGPASQEVELLLSVEGIRQ

SEQ ID NO: 16988 - protein, 453 aa, Pseudomonas aeruginosa
LTLSTLFQVLNMGHGAGWITGHRAKTFQVFSREAFGRLQTPMNVSILPAFFEPVQRLHAASAAFAHEDNAMQRTPAMRVLVPALLVAISALSGCGKSEAPPPAQTPEVGIVTLEAQTVTLNTELPGRTNAFRIAEVRPQVNGIILKRLFKEGSDVKAGQQLYQIDPATYEADYQSAQANLASTQEQAQRYKLLVADQAVSKQQYADANAAYLQSKAAVEQARINLRYTKVLSPISGRIGRSAVTEGALVTNGQANAMATVQQLDPIYVDVTQPSTALLRLRRELASGQLERAGDNAAKVSLKLEDGSQYPLEGRLEFSEVSVDEGTGSVTIRAVFPNPNNELLPGMFVHAQLQEGVKQKAILAPQQGVTRDLKGQATALVVNAQNKVELRVIKADRVIGDKWLVTEGLNAGDKIITEGLQFVQPGVEVKTVPAKNVASAQKADAAPAKTDSKG

SEQ ID NO: 16989 - protein, 1051 aa, Pseudomonas aeruginosa
SRGFVMSKFFIDRPIFAWVIALVIMLAGGLSILSLPVNQYPAIAPPAIAVQVSYPGASAETVQDTVVQVIEQQMNGIDNLRYISSESNSDGSMTITVTFEQGTDPDIAQVQVQNKLQLATPLLPQEVQRQGIRVTKAVKNFLMVVGVVSTDGSMTKEDLSNYIVSNIQDPLSRTKGVGDFQVFGSQYSMRIWLDPAKLNSYQLTPGDVSSAIQAQNVQISSGQLGGLPAVKGQQLNATIIGKTRLQTAEQFENILLKVNPDGSQVRLKDVADVGLGGQDYSINAQFNGSPASGIAIKLATGANALDTAKAIRQTIANLEPFMPQGMKVVYPYDTTPVVSASIHEVVKTLGEAILLVFLVMYLFLQNFRATLIPTIAVPVVLLGTFGVLAAFGFSINTLTMFGMVLAIGLLVDDAIVVVENVERVMAEEGLSPREAARKSMGQIQGALVGIAMVLSAVFLPMAFFGGSTGVIYRQFSITIVSAMALSVIVALILTPALCATMLKPIEKGDHGEHKGGFFGWFNRMFLSTTHGYERGVASILKHRAPYLLIYVVIVAGMIWMFTRIPTAFLPDEDQGVLFAQVQTPPGSSAERTQVVVDSMREYLLEKESSSVSSVFTVTGFNFAGRGQSSGMAFIMLKPWEERPGGENSVFELAKRAQMHFFSFKDAMVFAFAPPSVLELGNATGFDLFLQDQAGVGHEVLLQARNKFLMLAAQNPALQRVRPNGMSDEPQYKLEIDDEKASALGVSLADINSTVSIAWGSSYVNDFIDRGRVKRVYLQGRPDARMNPDDLSKWYVRNDKGEMVPFNAFATGKWEYGSPKLERYNGVPAMEILGEPAPGLSSGDAMAAVEEIVKQLPKGVGYSWTGLSYEERLSGSQAPALYALSLLVVFLCLAALYESWSIPFSVMLVVPLGVIGALLATSMRGLSNDVFFQVGLLTTIGLSAKNAILIVEFAKELHEQGKGIVEAAIEACRMRLRPIVMTSLAFILGVVPLAISTGAGSGSQHAIGTGVIGGMVTATVLAIFWVPLFYVAVSTLFKDEASKQQASVEKGQ

SEQ ID NO: 16990 - protein, 345 aa, Pseudomonas aeruginosa
RHPPAFAGRPVDHRQSGDFQPVRGDPGHYRLGTRSLRPPAQPARPGPGAVPGDRTGAAQRADHPGGQRGDRLPDAEGRPGAVAADQGHPGHLPEEFRPDPAQLRRRRRLRARPAPGADRRGRRPRDPGAVHPPGSPGPECAGPAAGLRDPGEPAARPGPGPDPADRSAGGSAVGPAATAPGHPRGRAPAHGCQRQHRRRARGVLPEHQPDRQRRHHEPPTVRPVRRRFGFLVVPAVDQPADLHRRQPACQPGLREDPEGHQRRAVREGDPDGVPGSRRRPGRARYLHRAVAGAARSGQGQRRVLPARRQALSHGGGQLPDPARRATLAVHRAAATDHRPPQSADQ

SEQ ID NO: 16991 - protein, 490 aa, Pseudomonas aeruginosa
GRRFFILAEVGGSASRTRSALAVAGQQCGALALAPRFQLVELLGGGEAIHAHQVALVDHHRLAARLLAGAILGRLAQRRVAHPRGILATLAARLAGARFLRLALAGTLTASAALSGALALAASLALALATTLLAGAALGFLLATAASASLVFLTLVGADVVGAVAEIVEVVVEELFRIAITVDFRRPIGLGRTRFAALPRLLRLAGLAVFLVLATATAALSSRLLGTVLGRSDIAVGVARLGVFRLALAAAAPFLVAARLLLRRFAGLRLGHLGQHGLGVETLGIAIGNTLSGHLLDGLEQLLFVRRHQRDRLAAASGSAGTADAVDIVFLDVGQLVVDHMGQLVDIQAAGGDVGRHQDTHVVGLEVGQRLGPRVLALVAMDRGGRQAVLGQVLGETVGAVLGTGEDQHLFPGADGYQVRQQGADSAAPAGGTRVARCARPWCSAALPRCVPGCAGACWRGRRCLSRRLPRTAGSGAWAAAWREPSSHRG

SEQ ID NO: 16992 - protein, 495 aa, Pseudomonas aeruginosa
FHSSRPRPGPYRKTRMSFSSLGLSEALARAVEAAGYSQPTPVQQRAIPAVLQGRDLMVAAQTGTGKTGGFALPVLERLFPAGHPDREHRHGPRQARVLVLTPTRELAAQVHDSFKVYARDLPLNSTCIFGGVGMNPQIQALAKGVDVLVACPGRLLDLAGQNKVDLSHVEILVLDEADRMLDMGFIHDVKKVLAKLPPKRQNLLFSATFSKDIVDLANKLLHNPERIEVTPPNTTVERIEQRVFRLPAPQNPRPAGAPGNRRRLGTGAGLHPYQARRQPSRRVPDQARPAGRRDPWQQEPERADQGAGRLQGQRRAYPGGDRHRRPRPGYRPVAPCGQLRAAQRRGRLCPPHRPYRPSRTQRRGDLAGGAGRREAAQGHREDDQTAYSRWRCPGFRPRGRAARGGPAGAPRSAAEAAAPRQGTAQQPRAQAERRPGEQPRQQCRCGPGRYREAGWKAPPSRWQEQGKPRGRPSAAAAAEPRSASGQAQSAAGSRR

SEQ ID NO: 16993 - protein, 518 aa, Pseudomonas aeruginosa
KNADPRVGVLAWRGRRSSLGIFLLRGLLLGHGLLVPAAAEGLVQVDLTGQLIEAVGDQLLLRGEQRALRVEQGQVVVHPRAIALVGELVVLVAGLDQIALRLQLLGEGTARGQAVGDFLERRLDRLLVLRDVDVLLDLRVVQAGTQAAGGEDRQVDRRLEQPGTRTGVEQAGQLAAHGAGVGGQADAREERRARGADAGVGSHELVLGLEDVRAPLQQVRRQTRRHFGQQGLVQAQALRQVRRDPGAQQQDQRILVLGYQAGVLRQGRAGAFHGGLRLAQVERGGDADVVAALGQVETLLVGAQGVLGQLQLRLVGLQRQVGGRHAGHQGGLRAALRLFGRQVLLQGLVAQAAQAAEEIEFPGGSAQGHPVLAGNRRTAGGRQVARQTLAGAATVHADPREQVGPLDAVLRPEGLDVQRGDPQVAVVFQRHADQLLQLRVAEELAPADVGGRNGRRAGVLPVGLPLRVGRGYRRLGALVVGDQRAAGQNDSGYRQGKEGPFHIIAPFRRTLAAWTPRP

SEQ ID NO: 16994 - protein, 522 aa, Pseudomonas aeruginosa
VRRLRKNPGLRCEPGSARRRSFRRRRRGSIEQAGEPGERVLLLAAGRRCGHLLGLRHHRRALDHRRLAGIQVAHLAGRALAATQRALDGAGVQRIGVLAGEGDPRQRLFPDPPETRHLARTVGQVGTTGTRIGAVATNFVAGEGTAHLRIELVHADQHLIDHLPVAESLQHAGVVAGQVDQDVGAAFQRRLDPDHAQALVAEDLAGEARLVVPHRTLELQQDLVAPAIVGALQRGHLGTAQGRGHLDLAERLQRHGENHVVGLVGLAAGLDGDAVLGLDDARHLGFGLDRLDLLDEGFRQHLAAAGQARRAQVAVVDATVGAALLGEVEQRQARRFVVARTDTLVDQQARGRRQVQLVQPARGVHLVEGEQGIARGRVERVGDRCREIVQGRLEALEVGGDVRLLEREIAAAVVQAVDQVAGGADEVRRRHRLQLEGVQVGIERGLDLLVADPFAGGQAGTPAHLRPRLEHRDLPAVLLQFVGRAQACQARADDDRRRLFILAQRHRAEHPQHEKRRGAQPP

SEQ ID NO: 16995 - protein, 162 aa, Pseudomonas aeruginosa
TPAAGGISTGPPAPPSHPGPAVRPGARRAAPAGGRQPGAQDRPSAAGGCRSPPAGGQGNPAGAPRPVRGRNGRWPARLRCWRPTRGPAPDCAAAGGRTRRRKDPGCSPVRRQADRGWRSARAGRRGRRRPGSAPGCRGSGRRCRPGRYGHPARHLPIRRGWR

SEQ ID NO: 16996 - protein, 183 aa, Pseudomonas aeruginosa
PRRNAALHRRGRSSHATGCAGRLPAAGSARSWHRCAGHRGSRSAGRRARRREMPSPPPGRRARPPAATPRGPLRRPAAASPRGRRESPGAADAPRRAMRRGCRQRHRWGRRSSASACRSAAAPSAGNVRYAAPARGPRRTAPAHGPAPAGCPAAASRPAGSGPPATGRARTPARRRRPWPGRR

SEQ ID NO: 16997 - protein, 176 aa, Pseudomonas aeruginosa
SLRSLSALIRPRSMALRRTASRRMPAPSSERVRRMSPPSRPMFRRIVPCSGLPAARRVSPDSMPWSTALRSMCSSGATMRSRTVRSISPSALPTTNSTCLPSSPATCRTIRRKRGTSRSNGTMRVRIRPSWSSVLTRACCSSRVSASRFFAARVSFRSRRSEADSKSARESCCNCE

SEQ ID NO: 16998 - protein, 327 aa, Pseudomonas aeruginosa
  UNSURE (161): Identity of amino acid at the above locations are unknown.
RERICAWVSVSRRRNWSRTRSMVDSISPRVKPTSLTCCSTRPRKIEVSPARLTRFSSSSAGTFTSSCGARREAASWAASWALRTNGRVVAGAAGGAASAAMIAPAAGARRVSSASAEATARSVSSAWTSAWAGSGRSPASSSSASRSRNRSTCRCRPSSPXCASSSRLSGHGGPCCCASVRCCSRSWARLPSSVCPARRAPPLRVCRIRSRSSSGWASPLPPSQRPSASSRFSSRSSASSRKMSRISLSSAAAPFAASGLRLTLVGTLSCSSGSLRRRLISAISACPSGSVRWPRTASSISASSSWQRCSRPNKAGLARRRPPQRPS

SEQ ID NO: 16999 - protein, 137 aa, Pseudomonas aeruginosa
RNSSSWARSPISPISAIRAPPLRVCRSRCKASSSMVLSTSSIQRCNAAAALSRISKPSSRKISTSSGSRSSNASAAGAAGSSTVGATSSSTGLSASPGVAASASGPWRNRRIDWIRSCGSARGWPALNWSSCSARRS

SEQ ID NO: 17000 - protein, 178 aa, Pseudomonas aeruginosa
RASSSWARSPISAISAIRAPPLRVCRSRCRALSEDSAPGSACHWASAWPALSRMSTASSRKIDTISSSSSRPGAGAGAAGTVSSAGVPASSKTASGRAGSSSSGGKSSAPRLSGSMNGTASAAGASNSSCRAATRSGRGVTCRPAATWSIIPISASWAWRASSKNAGLTARRPSSTAS

SEQ ID NO: 17001 - protein, 278 aa, Pseudomonas aeruginosa
CSASIRSSNASLPGIGFNGRCAPTCSRPIRNSCSASCSNSASRRSKASRLDLYSLTSFSSGVAISAIGRMPAMCALPLRVCRARCKASVTGCGSSRAQSARKPTRASRWVSASLVKISSSCGSSSSTSLCASAAACGASANGGAWTPLSRLDGCSAPASGGTPPSSGAGGSGSGSPLARACAVAASRSTSSRWRWALAANSSTSSGNRATTWSTTRCTGSLAAMLRSSTRLNRFSIDQASSPITRARTIRPLPLRVWKARRTSVSASRSSWSAFQAGR

SEQ ID NO: 17002 - protein, 326 aa, Pseudomonas aeruginosa
RPMVSRTSPASSMKTSRSSSSTGSSSAGGGSRLTGTFCAGGLIGCTGAAITSARDRAGASLASASAAGGASASASGNCTSGRSRSERSSSSRLEPSQADTSPSASGKATSSGSGSSASRTSSCSAEPSKGSSAGNGSRLSSGASKDNAGSSRLRSNVSPACVGCARSSPSPHCSGSDQSARAAGPEAGAASAGRSRPERSISSRLKSSRLRAGAGVDCGWPLSSTTSGNAGGTSAESSSGRSRARSRDGSPASGATSPRVQLSSLASCGASSLAASAGAVSAGGCSAVSATSTTASGLSGSAAGDSMAAGPDRPGSAGADEFGFSV

SEQ ID NO: 17003 - protein, 234 aa, Pseudomonas aeruginosa
RAALEMFWISAARVLDTFSISSRATPASWARRAPRTTSEVVCSIEITASLVSVWMVFTSASICLVAAEERSASRCTSSATTAKPRPASPAIDAWIAAFRARMLVWSAMSLIRLTMSPISWDDSPRRLIRFEVSWICSRMLSMPVMVLCTTSLPLLAMATERSATAEDSEAFADTWSIDTAISLIAAEAPAISCAWCSEASARCIAVDWVSWAAAATCTAVWLMVSTSSRSWSME

SEQ ID NO: 17004 - protein, 507 aa, Pseudomonas aeruginosa
HHSQTPGRNGRFVDISSPRRRPEPLGDPRDPHPAWQPADHGAALSAGNQGRRQAHPDDRRRTGALLPGAHPRPGRDPRQPRRRRPRRGPAAERARPLDRRRGRPAPARARPAVRRPRRDRRLSDGNQRHQPDLHPRDRPGLRHPHRRQADGRHRRPAGCPLNRAGGPRSARLGPADAPRRATACPRRGVRHRLFRPPSADFAPRQPPRSAMNAAVLKSPSAAAGVRPADRLGFTLFIAAILHVAFILGVGFSMPAPSQISKTLEITLATFKSDKAPEKADYLAQMNQQGSGTLEHKAAPKTTEVAPFQDNQVKKVAPPATPKQARSEEAPKAAVTTTRQRQQKAPSKTQAQKAEQVAKPAPHFDSTQLSAEIASLEADLAKEQQAYAKRPRIHRLSAASTMRDKGAWYKEDWRKKIERIGNLNYPDEARRQKLYGSLRLLVSINRDGTIYEVQVLESSGEPILDQAAQRIVRLAAPYAPFSGDLADIDRLEIIRTWRFERGDRLSSK

SEQ ID NO: 17005 - protein, 205 aa, Pseudomonas aeruginosa
RRQGWLSRVRSRTLAAMKQSSPTYLKHHFLIAMPHMADPNFAQTVTYLVEHNEQGAMGLVINRPSGLNLAEVLEQLKPDALPPARCQHIDIYNGGPVQTDRGFVLHPSGLSYQSTLELGELAMSTSQDVLFAIAAGTGPEKSLISLGYAGWEAGQLEAELSDNAWLTCPADPAILFDLPPEERLSAAAARLGVNLSLLTAQAGHA

SEQ ID NO: 17006 - protein, 726 aa, Pseudomonas aeruginosa
GLPHADRRQAPAAAQRPGPAAPLHLARRIAPRAAHRNPRYRRFLPGGRRPRGEKGPAAARQDRLQRVLRELHAHPHHLRAGRPAAVGRRDQPERIHLFHQQGRDAHRHPAQPGGDGRRHVRGAPQRLGRGALHRRARQPQRGGDQRRRRTPRAPHPGDARHADHPPAQRELRAAIGGDRRRYPAFASSPFEHAGAQDPGLPGHPRDRPAHPLADRPGRAVRRARVHQRRRRPEGRRRGDHAAPATRAHAGWPATQRGRVLQALRPDREAPEAGQAGCHRHAPWPDQPRRGDRVGGGRRGPVGDPQPGHLRHRHPHGGAVHGHERPEHPTPAGTGGRRMTISIRGARVIDPASGLDQVGDLHIEAGKIVAIGAAPAGFSAQKTLDGAGLVAAPGLVDLSVALREPGYGRKGNVESETRAAAAGGTTSLCCPPYTRPVLDTPAVAELILDRAREAGNAEVYPIGALTRGFGGEQLSELVALRDTGCVAFTNGPAWLRQQPHPAARPGVRGDLRPDGDLHLAGHRSRRRRPRPRRPDRQLPRPRGDPGDRRDRGPGPQPAAGGTERRARALQPVDQRPRHRTRRPGPGPWPAGDLRRGAVPVDPHRRSAGGLLQPLPRATAAAHQGRPRNPARGGKERRGTSHRQPPPTPRGGRQERAVRRHRAGHQRRRAAAAAGDDAGAGRPARPADPARPPLPRPGPGPAPACRAPGGRPGRRPSVVRPAGFDPGR

SEQ ID NO: 17007 - protein, 172 aa, Pseudomonas aeruginosa
RGALSAEACSPGTPDGRQPRRSAPLHAEPQIFASACARSACRSSSASTPTDRRISESPMPRSARVSAGMLAWVMIAGCSIRLSTPPRLSAREKIRTFSRKRRAPARSQRRSREIIRRSHASAVSPAHAAGAKPGRGSRPAPPAAGAPATGPGPRRCCNGAPCAAPGSSPHAG

SEQ ID NO: 17008 - protein, 470 aa, Pseudomonas aeruginosa
PGSRRPGPGRRDAGRAGSCELSPQMVQQVETGDQAVEAAGIGNDRHQAAVQDRLQLGQAGAGREGLRRGVHRAAYRIAEAWRVGVDTEQDIRLVDHTDQFSIVQHRQLRNVGQAHALEGGEQGVVRTDADHPALLEAPRDDVAQVAVVLALQQALVGHPLVVVDLRQVAGTGVTDEADHPLRLLLLATEAQRRGQQGAGGGAAGNALDAQQFAGHGEAFLVADGIGMAHAGEVGDGRYEVLADALHRPGTRRTQGAGAGVLGHDRALGIGEHHLQLRLELLEEPGKAGQGTGGADADDDGVEIVAGLRPELRAGAALVGQRVGRVVELVGEEGAGNILRQARGNVLVVLRMALADVRAGDVHLGAHGAQVQDLLGGHLVRHHQHHPVALRAADQGQAETGVAGGGLDDGATGPQAAVTLGGLDHGDTDAILDGAAGVLRFELEVQGAGAGIEACHANQRGVADQVEHGGT

SEQ ID NO: 17009 - protein, 355 aa, Pseudomonas aeruginosa
NTAPCNWKPRPAPRPRSRWPTEDGSAEAPAGRVVVGDFQAQALGQARQVVGVAFRTELDHQAQVVGRVGVGQGVLVGDLALGVELVQRLVEGLHALLGGALHQRLQLVHLALTDQVGGHRGVQQHLDHRPPPLAVGGRHQLLGDDGLEVQRQVHPHLAMTVGREEVDDPLQRLVGVVRVQGRQAQVAGLGEGHGVVHGLPRAHLADHDHVRRLAQGVLQRHLEGVGVQPHLALGDDAALVLVDVLDRVLDGDDVPGGVLVAVADHRRQRGGLAGAGGADEDHQAALGQRQLLEDFRELQLFQGRDVGLDPAQYHTHQVALVEGTDPEAADAAGADGEVALMVLGEIAALLLVHHA

SEQ ID NO: 17010 - protein, 255 aa, Pseudomonas aeruginosa
ECAYGTALPLLNPRRSSGIRAKRGGSAPGSEVFRDLRLLAGVLAADQALGDQALEAHVEGLHAQRAAGLDRRIHLRDLVLADQVADRRGADHDLVGRHPAAADLLDQGLRDHRLQRLGEHRANHGLFLGREHVDHPVDGLRRRGGVQGAEYQVAGLRRGQGQADGFQVAHLADQDDVRVLPQRRAQRFAEAEGVAMHLALVDQALLRFVDEFDRVLDGEDVVVLGVVQVIEHRRQGGGLARTGRPGDQYQPARDV

SEQ ID NO: 17011 - protein, 472 aa, Pseudomonas aeruginosa
DQARRRGARGARRRPSRLRRKLPAGGPRQAGRTGRPALELALHRPHPVEQDAAHRRAFPVGALGGPVEDRAAPVGATPGRAAAPECLPAGQRQRRSQQVRLRPRGPAGPGRGREATAQPPIAWPDGHPRTHRRTRRATRRVRPPARTAAGPEPWPGHPVHGHERRPRGSHRRRCDLGPHRYRPVRRPRLRRAGFLKESPMSTPRIAFIGAGNMAASLIGGLRAQGVPAAQIRASDPGAEQRAKIAGEFAIDVVESNAEAVADADVVVLSVKPQAMKAVCQALAPALKPEQLIVSIAAGIPCASLEAWLGQPRPVVRCMPNTPALLRQGASGLYANAQVSAAQREQAGQLLSAVGIALWLDDEAQIDAVTAVSGSGPAYFFLLMQAMTDAGEKLGLSRETASRLTLQTALGAAQMALSSEVEPAELRRRVTSPNGTTEAAIKSFQANGFEALVEQALNAASQRSAELAEQLGQ

SEQ ID NO: 17012 - protein, 118 aa, Pseudomonas aeruginosa
RCPRPPHPGPGANRPAPPTRCAAMPARAPVRHRPPSAYAAPRPDLPPWPTGPEGRQEFAELGDFTAAGLAPAHIGKPACPFLPSDSPRRLPALWRLRATASPLPCNSGRFPPCCKVAT

SEQ ID NO: 17013 - protein, 425 aa, Pseudomonas aeruginosa
RRRTPRSSASSNACSACRRRRIRALLAHLVTVGAWEQVLVFTRTKHGANRLAEYLTKHGLPAAAIHGNKSQNARTKALADFKANDVRILVATDIAARGLDIDQLPHVVNYELPNVEEDYVHRIGRTGRAGRSGEAISLVAPDEEKLLKAIEKMTRQRIPDGDAQGFDPEAVLPEVAQPEPREAPQKQPRRDKERRSSRERKPKDAQASNPDSNVAAAQDGTEKPAGKRRRRGGKNKENREAGQAQQPRQSREARPAKPNRPPEVDGNRDPEEFLDDDFDNFGNRADYVSPYQGQENKGRGRRGGQQKPQGGTGQQGRGQGQGQARGKSQGAAQGGARGQGAGQGKTKKPRAGKPRGQGRENASRMSDAPLREPSEYGTGKQPSRQPVVINKRDLVRMDRFPTAEQLDELEPRRKGERPALLTRNR

SEQ ID NO: 17014 - protein, 953 aa, Pseudomonas aeruginosa
SGISEQPDRTTAATARERKDRFISLPLFDGRLLLGRLVLEQRADRHVEQRYPEDRQDGRSDHAADHAGTDRMLAARAGAGGDRQRDHAEDERQGGHHDRPQTHAAGFDGRLDDALALLVQLLGELHDENGVLRRQADGRQQAHLEEHVVGQAAHGRRQQRADHAQRHHQHHRERNRPAFVQGRQAEEHHQQRQRIQRRRLRAGQALLVGQAGPGVANAFRQLLDDLLDRRHGVTGTQAGRRLAEDLHRRHAIVALQLRRTVFPLAGGEGVERHHLALVVAHVPLAQVVRVHPRVRPALQVDPLDPATVDEVVDVAGTPGDGHGAVDVGKGHAEGAGLLVVDLQLVLRFVAHAVGAHALQRRVLRGEHEELVARLEQDFVADTRLVLEEQVEAGGVTQFQYRRRREGEHHRVLEAEEVHLRALGQFEHAVLATGTLFPGLEHDERHARTLAAAGEVEAGHGEHRADRRAFLLQQVFAHRVHHHLGTLGTGARRGLYLGEQYALVLVGEERGGNAGEHPDHPGHDHHVDQQVRRAMFEDRRHAPLVAVGGGKEHPVEPAEEAALVLAMVAFLDRLEHGRAERRGEDQRHDHREGHGRHDGDGELPVDHPGGAAEERHRQEYRREHHGDTDQRALDLAHGLARRLPWRQAFLGHHPLDVLHHHDGVVHQQADGQHHAEHGQGVDREAERGEHAEGPQQHHRYGDGRDQRGAEVLQEQVHHQEHEEDRLAEGLHYLMDRGRDHRGGVVRVDHLHALRHERFQVGDGLADRLGGIQRVGAGGQLDRDTGRRAAVELRVDAVVLAAQAYIGDVLQAHLGTVGIDLEQDVLELLRGLQAGLADDGGVELLALDRRQAAELAGGNLHVLRLDRAAHVAGGQLVAVQLGRVEPDAHRVLRAEHLEVTDALGPRERILDVGNDVVRQVFLGHAAVGGNHTDHHEEVLHRLGHPDPLALHFLRQ

SEQ ID NO: 17015 - protein, 416 aa, Pseudomonas aeruginosa
SALAVGFRRSGVGLLRGRDILRRHGLHLDTRLHELQAFGNDLVAGVQAFGNQPFVADHPVGLDHPQLDLVLRVHHQRGSLALEVAGHALLRSEDGLLLDAFLQLRVNEHAGQQLVVRVGEHGADGDRAGAFVDGNLGEFEATFQRVLATVLQLQGDLRRVVAGALQLAAGQFAAQAQQGGGRLGDVDVDRVELLHGGHRVGLPVGHQGAFGHRGTADAAGDRRQHLGVAQVDPRLLHRRLGLQVGGIGVGVLLLAHGLVGDQQLVALGLLLGRSQVGLGALVVGLVGGGVDLVELLPGLDVAAFLEQALEDDAVHLGTHLGDAERIGPARQLGIQGHRLRFQGHDPDLRRLRRRRRLAFSAPGKGRNRDQQGRNQYTHGWRSLHSVVLMSESGRCSVKALHRLEEGRQNTYIHRCL

SEQ ID NO: 17016 - protein, 222 aa, Pseudomonas aeruginosa
GYLRTFFSKHNEKRRRSPAFFVSGIRLLANAFDGEQQLDFLGCRAEVHLDAEVFQLQGGAAFEAGTVAAPRVVALADQLGLDGDRLGHAVQGQVAGDVGAVAVGLHFGGFEGSGRVLADVEEITAAQVLVTLGMVGVHAVGVDGHLDLVGRRVLLVEGEAAVEVVEAAVQPAIAQVLDAELDEGVLAFLVDLVVRGHCLAGGEQCGAERQRGKGLLQHGHSP

SEQ ID NO: 17017 - protein, 358 aa, Pseudomonas aeruginosa
NGPGQGIQDALPLAGAPRPEGLPAWPGARRAAAPAGQRGVFPAALRDYPGADRLPRRGGQRRHRHRHPRRGQRGGQRLPPGPPRSGLNVAAPSFRGGRFQRPAAGSKLRACRHYPRIAMRLSRFFVDQPLSLGQHDLPEAQAHYIGRVLRHATGDAVQLFDGSGREYLGELVEVGKKNVRVELREQFAGQPDSPLRIHLGQGLSRGERMDWAIQKATELGVAEITPIVSERCEVRLKDERADKRLQHWRQVAISACEQCGRSSLPLIHPPLALEDWLRGRDDDLRLVLHPVAAPLASHAPPSRLAFLVGPEGGLSDAEVEQAQAAGFHSARLGPRVLRTETAPVVALAVAQQLWGDFA

SEQ ID NO: 17018 - protein, 366 aa, Pseudomonas aeruginosa
YPSRRFTTATASEYRCATHFATDRTHGHARYLRLEDPPARRARRTPPRLCRTLPAVGLRRTGDAAGAPARRPSRGFPASPRPGAGIPGTGVGGTPGRRRQPEPVRGRRPPQPAPPRCTRSAGPQRPHAAPGKRPRGRPGGPPRRRAGRPGAGFGLHLPRTRRAPGARPGHRPPAGRGQPRPAGPAPMAQAATPARWRGGNPGRVALPGQFGGRPARLGQDDPFGKPLRLAASLPRPRLVDARTTALAAAAGAVVAPTPHPGTCHRPGRGRPAPGRPRPVLPLSGLRPGQRRTAVALRRAASAALHRESAGGLHHSGPARLPALPRAVLRMARGTHPAPAVPRRQGSARRSGATDLGGARDHRLAGA

SEQ ID NO: 17019 - protein, 138 aa, Pseudomonas aeruginosa
NALRRPARQRRDPQPLAGRPGRRPLPEAPGPGRRLAAPGAVAGTASLAGPRPALAPRIRPGAAHPLRRTGPGGRTTALGGAARRPDRRRRPCPACRPRHVRKPAPTPAAAAPGAGLRRVYSPRSASPARPSRSTPQPA

SEQ ID NO: 17020 - protein, 97 aa, Pseudomonas aeruginosa
PSSSASPVSPSRAQTASPISDPSCTSNAGRKPPVKPRRSVSLNTAPGETLKAKPNSKAARKMASMERRLRGGTSDYPGRRLRRLEPDCAVQPRTARW

SEQ ID NO: 17021 - protein, 178 aa, Pseudomonas aeruginosa
PAAAAAARFRSPPFPGAAPGVRDGFPGRAARAGSGWSPAGRGSPPPGHHRAGSPRKSRRPRRTADRGSSPRSRGNRPASRPAPLPHAPRSAPGSPARAATGRPAWVPGRCSAARRGTSVRRTARRIRSWAYPAPPRRAGRRAPPVRRAKPARCPRWCSAAPRRDPRRIAPSAPGSPTR

SEQ ID NO: 17022 - protein, 83 aa, Pseudomonas aeruginosa
AKTARPARPAIGPVPGRRFRGCPPPLRGRSTPFPRPARGREPVQALPARSPRQASRPLRRPPRGGPVLRLPGGNRRRRGSPGR

SEQ ID NO: 17023 - protein, 162 aa, Pseudomonas aeruginosa
SAAPAQPSPRPETGPALRWRAPRRQAAPRPQPRAIAPRGDRGRKDPVPPGSSPPRRTPRPPPPARLHPAAADRAHREPAPVQRSRRKAPAPATARGFPAARRRTTPAPPGSDPTSRRPASAAPGHRRAPTAPAATSPPGPPARRPGPHRRAGRGRRDRSRRG

SEQ ID NO: 17024 - protein, 154 aa, Pseudomonas aeruginosa
NRPGCGQAPGSTAAGRSPRPPPATPAALRRNRPAAGPGPGRGTARRRRARLRQGSSCRRWPAAGHLPSRPRQEPCRRAVAPLSRRPRRPPPASPARQPGTRWQRARTGQARPGPTNSVSAYSRGSPGCPRRRRGSGRSGWHGPRSGAPGNTRRW

SEQ ID NO: 17025 - protein, 120 aa, Pseudomonas aeruginosa
AAAGPPSAGRAGRSGSGRGRPAVAGSPASALPGPRPGSARDRPARPGPTAPFPRRAGPRRRTRPSAGCPAPGARRSGRTACGSGPAGSRRTLPAPGAPVSGFRRSRLSPTPERRSRAGHP

SEQ ID NO: 17026 - protein, 184 aa, Pseudomonas aeruginosa
RCCSPLPGPGTGRARSRGSRPPNRRRTRRVRRSRSGDPPPRRWSPWRCSSPRCLPACPSVRGRTGWRRGRSCRRPAPSSRRRPAPCSPSRGYVRRAATGAGRPRPGRPGHRSPAGCRPPLRIPPAAAGWFRRGSRPPGAGTVRSVRWRGWSRRSCAGRPSPAAPRPSAASPLRGWAAGMCSRRR

SEQ ID NO: 17027 - protein, 368 aa, Pseudomonas aeruginosa
HTRRNSIHNARNRPAFSLTKRKRGANLSVKPACHAASPPRPDNPPPFGGIPMSVRLGIVMDPIARINFKKDSSLAMLLAAQARGWSLFYMEQQDLYQKAGVARGRMRPLKVFNDASRWFELEAESDQPLHELDVILMRKDPPFDNEFVYSTYLLEQAERAGALVVNRPQSLRDCNEKFFATQFTQCTPPTMVSRRSDILREFAAEHRDIILKPLDGMGGSSIFRHREGDPNLSVILETLTQHGSQQIMAQRYLPEIKDGDKRILMIDGEPVPYCLARIPAQGETRGNLAAGGRGVAQPLSERDRWIAAEVGPHLRERGLLFVGLDVIGDYLTEINVTSPTCIREIDQAFDTRIGDKLMDAIAAQLAAR

SEQ ID NO: 17028 - protein, 364 aa, Pseudomonas aeruginosa
TGKIGRSRTARPRAQGPFLRFLILFTRACPMPTDAKRPLQLNDQGQLRHFISLDGLPRELLTEILDTADSFLEVGARAVKKVPLLRGKTVCNVFFENSTRTRTTFELAAQRLSADVISLNVSTSSTSKGETLTDTLRNLEAMAADMFVVRHSDSGAAHFIAEHVSPNVAVINGGDGRHAHPTQGMLDMLTIRRHKGNFEQLSVAIVGDILHSRVARSNMLALKTLGCPDIRVIAPRTLLPIGLEEQYGVRVFTNADEGLKDVDVVIMLRLQRERMQGGLLPSEGEFFKLYGLTEKRLKLAKPDAIVMHPGPINRGVEIESAVADGAQSVILNQVTYGIAIRMAVLSMAMSGQNTQRQLEQEDAE

SEQ ID NO: 17029 - protein, 296 aa, Pseudomonas aeruginosa
PAASAASNCRNWWPCATPVAWPSPMGLHGFASNRILRRALEYAATFDLTVIFTSQDTDLAEGGLAHEGPTASFLGLAGIPETAETVALARNLLLVEQSGVRAHFSQLTSARGIELVAQAQARGLPVTCDVALYQLILTDEALVGFSSLYHVQPPLRTRADRETLREAVKSGVVQAIASHHQPHEADAKNAPFAATEPGISGAELLLPLAMTLVQDGLLDLPTLLARLSHGPAQALRLPAGRLAVGQAADLVLFDPQGSTLAGESWYSKGQNSPFVGHCLPGRVRYTLVDGHLTHEG

SEQ ID NO: 17030 - protein, 477 aa, Pseudomonas aeruginosa
SPDARSGFPPRPGSPPGRRSARSPGSAGRRPGRSAGRGRSSAEATHLPFRQLMLRVRSQAGVVDPRHLRLALQPLGQGQGVAAMALHAQRQGLHPTQGEEGVERPGDGAHRVLQEAQALAQVRVVADDGDAADHVGMAVQVLGGGVHHHVEAQFQGALDVGTGEGVVGHADDAAGAAELGDGAQVGEAQQRVARGFHPDHAGFRGQRGLEGLQVGRVDEAEAMPGAAPADPLEQAEGTAVKVIAGNDVGTGVEQFQHRRDRRQAGGEGEGLGAALEVGHAALQGPTGRVVRAAVVESLVYPGAFLDVGGVGIDRRHDRAGRGIGGLPGVDDPGREGLGRGVGMLVVLAHASFLRKWFNRSKRVIRPWKPLASATIATRPRSRTACNWARLAPGARVSGAAFIALLTASRKRGASAWTPSRISDSSITPTSFPSSSTGNCETSARRMRWKAVSRVSSGPTLITRPSSKRRAMMSRRSP

SEQ ID NO: 17031 - protein, 102 aa, Pseudomonas aeruginosa
RSAGKKWMIRSSAWLALFACRVARHRWPVSAKATAWSMVSRERTSPIMITSGAWRRVFFSATSKESVSSPTSRWVTMQPWCWWMYSIGSSMEMMCPVEFLLR

SEQ ID NO: 17032 - protein, 217 aa, Pseudomonas aeruginosa
ILDAVPGFGRSAADRRQDQKFSGIFAFSRAFSRLIRPLATRPLRHMSRVCMPSEPPVWIAEYICATLSSRIRLRIAGVPIMISWAATRPPPIFLIRVCEITDCSDSESIERTMAFSSAGNTSTTRSMVFAAEVVCRVPNTRWPVSAAVRARRMVSRSRISPTRMMSGSSRSAERSASLKPRVSRCTSRWLTRHFFDSWTNSIGSSMVRMWWYLVLFR

SEQ ID NO: 17033 - protein, 352 aa, Pseudomonas aeruginosa
ISACTCLCSSGGRLIRRTSPSTRIMGGRPAERCRSEAPCLALKASSSVISMGLPNYKQAGRMPPKPPSRTRKTPDEPGCFQDTRGVLRQTRNLDTGTGRWPSRPAVSRASSRRRPHFHRAQVMSTIAENIAKVAARIREAAQAAGRDPATVGLLAVSKTKPAAAVREAHAAGLRDFGENYLQEALGKQAELADLPLNWHFIGPIQSNKTRPIAEHFQWVHSVDRLKIAQRLSEQRPAGLPPLNVCLQVNVSGEASKSGCAPEDLPALAEAVKQLPNLRLRGLMAIPEPTAERAAQHVAFARLRELLLDLNLGLDTLSMGMSDDLEAAIGEGATWVRIGTALFGARDYGAPAS

SEQ ID NO: 17034 - protein, 76 aa, Pseudomonas aeruginosa
SSPSPPASPAPASKPGSASRARWSAACPTPRRCCARAPAGCTPTRRSAPRNASRPGSCCPRWASPCGWTTKRRSTR

SEQ ID NO: 17035 - protein, 200 aa, Pseudomonas aeruginosa
QTRIARKNAERTCPVRMSAPTMSTHLADRYNQAWLFAARAHRNQTLSGSPLPYLVHLGMVANELLAADRDGAIERLGETLQIAVLHDTLEDTATSPEELRQQFGEFVCAGVQALSKRVGDGPKRSLDDYLQALAEGPAQYALVKLCDRITNLQPPPQTWNQDKIANYHQESQLILARLGHAHAATARRLREKIEHYRQYY

SEQ ID NO: 17036 - protein, 299 aa, Pseudomonas aeruginosa
SESTRRGAAVVASKEPIMSQSERRFSFEFFPAKTEAGHEKLLATARNLAGYKPDFFSCTYGAGGSTRDRTLSTVLQLDGEVKVPTAPHLSCVGDSKAELRELLGRYREAGIRRIVALRGDLPSGMGMASGELRYANELVDFIRTETGDHFHIEVAAYPEVHPQARSFEDDLANFVRKVKAGASSAITQYFFNADAYFYFVERVAKLGVDIPVVPGIMPITNYSKLARFSDACGAELPRWIRKQLEAYGDDSRSIQAFGEQVISEMCERLLEGGAPGLHFYTLNQADPSLAIWKNLQLPR

SEQ ID NO: 17037 - protein, 379 aa, Pseudomonas aeruginosa
YRPRGSARQRIPAGMPLTRSTTDMANSRKHLIYLVYGRQTYHQEALFSIASAFAHLRDGAAHGLTVRVYTDDPSPYAGLPVQVREVTAEELVAWCQPHGYHFRAKHVALRDALEDADQALLIDTDTFFHSSPLRLFDRIQPGSLLCNAIGARYGEHRNFPLYRDLSPYLFERGWADDEMHQLNSGVIGLPREEAKILDRSLELMDELYPIANGAYTLEEFVLAVAAHKRLELVGCTDLIHHYWSRKQLFRAKIQAWLCKHGSSLVSAAALDDTLKVTDRLPRPPRAKRLLYKLGTLPLPAPMRQFSIELLYGCHEYSNEFDRACGPVWWEKAATNAIERYPQEPIAEQIEDWLNHSLLRNLLGSRANEIRQHLRQRDLL

SEQ ID NO: 17038 - protein, 211 aa, Pseudomonas aeruginosa
PDSVFPMAMPRVSTPRPCCPRWPSRSPAKRRRSSRAATRNGAAAASASRKTPRRATPTAMSLRPRTVPRSRLESAAVAVARTRKTARPAKRSSRGRAAKRVRPSPIGRRKSTVIAIRKSSSTTTSTISATAPTTSAPTRVRKTRDADAAVASRNPRAAPASRVVAKARAKLAARARAPLKAALAVRVPARARRRNRAPASRAARVARMPRG

SEQ ID NO: 17039 - protein, 160 aa, Pseudomonas aeruginosa
AGARPRGCPGAVAAGPTADPPALRSAGSGPGPGLAAGSPGSRSPAAGPAHSGPGLPGGCTAPGSRGRLPRRSAPGAGRARRRRRRRSCAGSGRNSSGRCPGCPWSAATAPGRPSASGRRSPRWPPGWSARCAAPVRSPGTAPGPGRAGCAGGRRDRVPRR

SEQ ID NO: 17040 - protein, 160 aa, Pseudomonas aeruginosa
NSGTQKIARTVAVTMPPITPVPIACWLPEPAPVEIASGTTPRMNAREVITIGRRRMRQASMAASTMPLPCSCSSLANSTMRMAFFADRPMVVNRPTWKNTSLDRPRMDVASSAPITPNGTTSITENGIDQLSYRAARQRNTTSSDSAYSAGACEPDKRSS

SEQ ID NO: 17041 - protein, 211 aa, Pseudomonas aeruginosa
LEPQAMDTVLLMSARDTPRALAFSSSISSLYCGSSLMPLGRTRCSAGFCAASMRNLLRAWSRTSWPTPAWSWRNRSKPVALPSSSTDGGAKANTIASLKLKKCICARLASSNTLFSPPGRSSQGLSMMNAMPELWPRPAKLKPVTVNTELTEELSFSSRYSRIESTTTWVRSALEPGGVCTWANSTPWSSSGRNAVGMRVNIQIIPATITT

SEQ ID NO: 17042 - protein, 141 aa, Pseudomonas aeruginosa
ITPVEPPKNAIGRNTAESTMAIPTSAPWIWPMDLRAASLGDRPSSAITRSTFSTTTMASSTSKPMASTMPNMVRVLIEKPNAASTPKVPSSTTGTAMVGISVARKFCRNRYITRNTRRIASPRVFTTSWIEAETTGVVSYG

SEQ ID NO: 17043 - protein, 158 aa, Pseudomonas aeruginosa
LTCTAMAGGAMAGYWLTGRLRIDRPPASMITKAITHAKMGLSMKNFDITNPLDQPLLSVFAGAASAFCADATFFAGTVFTSTPGCTNCRPSVMILSPAFRPSVTSHLSPITRSALITRSSTLFCAFTTSAVAWPLRSRVTPCCGARMAFCLTPSCNCA

SEQ ID NO: 17044 - protein, 81 aa, Pseudomonas aeruginosa
TNMPGSSSLFGLGNTARMVTEPVPSSTETSENSRRPSSGYWLPSSSFRETFAALSPARSNWPLASSRRRRSRAVDGWVTST

SEQ ID NO: 17045 - protein, 153 aa, Pseudomonas aeruginosa
VYSAKPMNYPVNPDLMPALMAVFQHVRTRIQSELDCQRLDLTPPDVHVLKLIDEQRGLNLQDLGRQMCRDKALITRKIRELEGRNLVRRERNPSDQRSFQLFLTDEGLAIHQHAEAIMSRVHDELFAPLTPVEQATLVHLLDQCLAAQPLEDI

SEQ ID NO: 17046 - protein, 144 aa, Pseudomonas aeruginosa
TRRTGSSSRRRSSVRPPSRPSPPSARPRSPASCRHTGRAPGWPRACRYAARPRWCRGTAHRCARRRRRPATAAVPRSARNASPGPDRRPGRNHRYPDRRCSDEFRSRRRHRASSDRTCSCGSAPDRPSAGRRKPAARGRCRRTG

SEQ ID NO: 17047 - protein, 477 aa, Pseudomonas aeruginosa
ALPIDPRRQPMGLNADWMQRDLNVLWHPCTQMKDHERLPVIPIRRGEGVWLEDFEGKRYIDAVSSWWVNVFGHANPRINQRIKDQVDQLEHVILAGFSHQPVIELSERLVKITPPGLDRVFYADSGSAGIEVALKMSYHFWLNSGRPRKKRFVTLTNSYHGETIAAMSVGDVALFTETYKSLLLDTIKVPSPDCFLRPDGMCWEEHSRNMFAHMERTLAEGHDEIAAVIVEPLIQGAGGMRMYHPVYLKLLREACDRYGVHLIHDEIAVGFGRTGTMFACEQAGIAPDFLCLSKALTGGYLPMSAVLTSETVYRGFYDDYQTLRAFLHSHTYTGNPLACAAALATLDIFEEDKVIEANRALCTHMARATAHLADHPHVAEVRQTGMVLAIEMVQDKASRTPYPWQERRGLKVFQHGLERGALLRPLGSVVYFLPPYVITPEQIDFLAEVASEGIDIATRDAVSVAVSDFHPDHRDPG

SEQ ID NO: 17048 - protein, 148 aa, Pseudomonas aeruginosa
TSPPLRSEGAGSSAPRQAVNCAPVATTLESPCACPASSSTSLSPSASTTCPRPRPTTSAACCGTPRATPCNCSTAAAGNTSASWSRSARRMSASNSASSSPASPTRPCVSTWGKACRAASGWTGRSRRPPSWGWRKSPRSSASVAKCA

SEQ ID NO: 17049 - protein, 496 aa, Pseudomonas aeruginosa
RWRWPSNSGATSPDIPPAALQRRQPVNTVAQPTSQRIARMDTPVTFDWKIRLPDVLGVLRRDYAGRFPQLASAALETLLERLRDDLPEDFLPALGQELESLGLALVERLDEDDSLNLYVVGAPHSQRLLDALAAQGHNARTLRQENAPEGARAALPAAAPAGLAPASAYICLEHAEHLAPGLAIARLPGEDSRDLLDLRQWPRLQRLPDGAEETQGALLCRASSADGLHAWVRMTRSGSPYAWLHRSRDLASLTPELPPLPLPPAQSLRQRRTPELAIGLAGDDLLLADRGLFFLYPGFAQGNDEPRLLFDVPQARRSIENPPAVFTTPDQRVCLLSRGQFFEWREARIQPLPFPVGKDLPADPAQPTSAAPGTIVWLERETLCEGRLDSGEIRSHSLDGLAEGPYLKLQALDGGWLLLAPWLEPHRSRDLAQLWHLESGRALRIRYGELDLEGGLQHWAELPDGRIVVGDHARHVDLGTFESLRQRLLRRRLAPA

SEQ ID NO: 17050 - protein, 163 aa, Pseudomonas aeruginosa
SNGSGGSGRRSPGRGPPRPPPGHGATGRGRGGCASCMLHWRGLSPVAFLNARSRWYFDRPTCSAISSRSGGSARRSASSACRRATAGRPGSALCGRRVPLAASRRPRKSSRRSSPRSRAKRSLASKASMLAANSRPSAGLRSSGRSNSTEERSRLLASSAAGR

SEQ ID NO: 17051 - protein, 315 aa, Pseudomonas aeruginosa
PWPSSACCNTWRCNEVSAITATRGVTRSLMLADQGLDGFEQLGFLVRLAEVLVDADAQRALAVFLAGPRGDHDDRQVAQALVVAHQGGDLETVHARHLDVQQEDVRTVLLELGDGVHAVLRGQHVHAVALQQAGGDLAHGDRVVHHHDQRRPLLLAFARRHFLAQRQAFATAFLAEQRVPGADGRQQVEDHHHPAITEQGRPGNPGDPGELRTEALHHDLAGTGQRVDLHRYRMLRGAHQDHRQGQRLADQLGFLAVVQQLAEVLQFVGLPGVFEAGRIQPRLAALVVERLQFVGRNPHDALDGVQRHRVEILAG

SEQ ID NO: 17052 - protein, 2472 aa, Pseudomonas aeruginosa
  UNSURE (429): Identity of amino acid at the above locations are unknown.
HHQRPVHRHGERQPHVEAGALARLGLDAHRAAELLDLGVGHVEADAAPGDLGDLFGGGETGLEHELQHFMIAEVAVGAHQATLDGLAPYRVEADAGAVVGEGEEDVAALAADVQADRTVLRLARRAARLAGLDAVVHGVAQHVLQRRDDAFEDGTIHLAVGVADHEFDLLAKLAGHLPDDPPQTRYQPIERHHAGAHQAFLEFGVDPRLLQQQGLRVTVLRRQGFLQVEKVGGRFEECARELLQLRIAVHFQRVELFVAGAFGIGLVTREDLRLGLGVEAAQLVAHPLDGGLHLAEGEADVAHLLLDPAAEDRGLARQVDQVLQQFRRHLHQLLRGTSGSGLLGRLLGLAHERQGGGRGGRRRRLGRHDRAGRRGQAGQLGQRGGHRAVGIVGLDQRLGGLGPLTGLVVLGQPLAQQVDLPLQAFQPRXRIQQQAVRPRRALLLRIGEMLLEVVGQVAQLGLSGQARTALEGVQDPQQVVQRLGVAVAAVPAAERQFEVLQQVVGFLEEDVEDLALVGRRALRRQRLEADAGGYAQLLVGIAAQAPDLRDQRLPVGQRAVATHRLEHLGQLVVAALQQAEQGRAGAQASTAEAFVEEFKLMGEVADLADLGHPRTALEGMQVALQGFQFDGVVDVVHPALQRGGSAVEDIEAFLEEDLHQFGIALFERLRSRRGGLLDGRCNEFLDRAFRLARCRGLGQRALAEPADRLDKVVRVGQGLAGAQLVELFGQAVVTGLQQSGQLRGVLVTAVDQSFVEGLQLVGQVADLGDLGHPCAALEGMQVALQGAERRQRARLGLPLGQCLAGAFEDVHRLFEEDRHHFLVQLAAGSRCRRCRHGLLGRRPGLFEDRLGEGRFFVFRGEIVGAEALRVDERNGLGGGRFQQLLQGRDPLRTRRDLQAGGDLVHHPDQRLVGLAGFLEERRADRQAAFLDGIVERQQGLAEFFHLWQLGMPGAPVQSAELLAQRTQFLALLRMLVPALEQVLGVQQDVHAFDEERLDQQRIAALAGIAVALGLDRGDAFLMQCLDTLQQRVAAGDRVQWPLRADLLQADTEQLLGVVQQLGFAQVEGEQVGLVFLDQFFQRRGDLRDRQDAGHVCAALEGMQGTLQGIGDRLRQFAGAVGEEADQGLEMGFRLVGEDLQQLRIEQFDVALRLGSGLRRVGQWRRLDAVVQARRLLRPGFRRYSAVVRRRRFRQRLALGQGMRGGRQQVDIVALALGIGGELLDQLRQQGHDLVHHSLHRLAGGDAAIEHAVEQVLYRPGQFADHQGTDHPSATLEGMEGTAYLGQRFAVVVVGFPGRQVAADGLQDLAGLLDEDLAQFLVHRFLVGRRWQQADRNVLRRRVDRLHRRSHHLGQRQGRRFAGERLGGRRRLGLSLGQLHLGEIEVGKIQFLQARALPGGHLALRLRQGYIQRQRIERIENQLLFSGAVERLQRRQRLEAFQRRVEGQRRLLQAQIQRLAGLRRLRQVIAEPPLLRQRPVRQGRRPGGRGRIGGQVEAGEIDLVEAEIVQAAGRRRGRLRLAALLDHLRQRRRHFGGIVQRQVQGQVEGRLAGVGRDFAKGPVVVAGQLRGIFPRGLGRSRVGGRLLRCLGDLDDRLRPLRLGSRGLDGSGPGQARLGRGRRIRFQRIAEVRQAVLGDVEDQVALAGMVLAQALQVILDAGDGIGQGIQALPVRHRLARQQLFLDIAVAGFQQGRGALQRDHRQAAADLGQQLRHAGQVLVVPLRGDELDDRVLGLLQTVARFLDHQLVDLRHIGGGQAAFLAVALVAGTGHAGQGGLDVEQRAGDVHQDRVARLAAALGQGVDDVQLVEDDLARLAEAEYRQGIGDLLERRQEGVQFRGVATVAAHEQVEAVLDPYQFLAQGTDHRTHRVAVGSGEAGALGVHRLVVGQRLVEAVLFLQSADPRRLRRRLGHVEQQVLHQLVRRGLVQAVGALLDQALEFAVELAQQGAHRGAVDHATVGQALDQAGSDAPQRPQRCLAAQALQARIDTRQVAEASGHVLVAQQADQGHLLGLAQLAQQAAEFVGAQLRDGLAVQLRLALRQVGREQAGFREQLLAARGAQVVEQRQDHHRQVAPGGLDPVEVDRQLQDRLHQHFQGLALVRHATVQQGLDQLLHFLGEQGRAVELDHLQGALHLVHVGQAEPHAGRVLRVLDERFQRLARLFQGFGDLAFHPLQSDVVVPVTHSHSIHVPEYPLRVKARTRSSATGSSSGWLQSTTSPTPITSKASRRQPFGQPVEDLAPSPATEVDQQVLTKNHVHAGPGRLRQVQHIQPGAADALGQYRFHAEAAVGLAFAIAFDQPGLQLLQLAGRIVRLPRPLQGVKADIRSGDAEKIFPFLPAQHLRGAHRQRVGFLAAGAADAPQGPGPRHAFAAQALAQVALEQLERRGMTEETGFLDGQAVQQGRPLHCATRTVGHLAVVAVVVADAQFTHARGQAGLQERPALLVEHHAGAVLQQDLPVAELRCRHIGQRLQ

SEQ ID NO: 17053 - protein, 735 aa, Pseudomonas aeruginosa
PDAVRLHAVPLVQGVDAAPARRPPRLCSGLLHALRQFEAGYRVAHLARHLRQVADAPCGGGGTGGGLRGDLLNDVHGVGNVAGRRCLLTGGVGDVLDQRREGLGYLLDLLQGHTGVLGQARAADHLGGGLLHRDHRFVGVGLDGLHQRLDLLGRRRGTFRQSLYLVRYHGEAAARVPGHRRLDRGVQGEDVGLVGDVVDQADDVADLLGRFAEALDSLRGVLDLLADVVHAGDGVVHHLVALVGDGYRTFRYRRGFRGVRRYLVDRHRHFVDRRRGAGDFLRLVLGGFGQVHRGGLGFLGRCGHLHGGLVDGLHQFAELVDGVVDRVGDGAGEVLGHGRGHGQVAVREVGDLVEQTQDRGLVAVVLLGGLGQPAVGLAHHHQADQDDRGQGQGAEDVTGEQVDATPAGQVLEAVGQLRGLVQQGLRNAEDVVRRFPDLEQVGRGLEDLVHRTGDELEEFGDLVQAIHRLGVGHLGDAHRRVAFLHALQYAAEQAGVAAEAVGGLHRVLVAGQHLVHRAEDTFGEQRLALGDRDLVGRGTVLQQDVDHLFVFHLQLRDGFGEGRGHLVQGQYGLFAGEDGVGVLAQAVPVLLHHVHLRLHRFGAGRQGCALVAVDQDVPAFLEVVARILQELERLALARRRFGGVLRDPLRQDAQFAGMADVLLVMVRLGVEVGKVGEQQHDRDDEDDEQPRDHRAAAHAREKIACVDFLHIWPPPGPTTITISMSRHGPADRPNR

SEQ ID NO: 17054 - protein, 666 aa, Pseudomonas aeruginosa
TFPPPIGRLRPTPATTIRNERRRPQVPLRRCRRPPGGPFGLHPVHRSHPARRLHPRGGLLHARAEPDQQDPGNHPGHLQERQGAGEGRLPRADEPAGQRYPGAQGRAEDHRGRAIPGQPGEESRAAGNAEAGQERRGAQGRGDHHPPAPAEGTEQDPGTEGRAGRQAGAAFRLNPAVGGNRQPRGRPGQGAAGLRQAPAHPPPERRLDHARQGRLVQGRLAQEDRTHRQPQLPRRGPPAEALRQPAAAGVDQPRRHHLRGAGAGVFRRADPRPGRPAHRPPGRALCAVQRRPGRHRPAGDHPYLALRTRRPAVQQVAPARLAFSRPKQDTSGHETEQPNLPQASFPDRHAAHGRPQFRPDRDLPGRTQRAGRHGPGDQPSQRPQPGGSPRTAQAGRPAAGALPAHRHLQRRPGADRPWLRPPPQRPELPVDPGTGRAGDVHLAGRAVRHRRRHRPGKEPDQPWLCRLGSRPAGGRTERQRLADLPGGPGDPLRPAARGAPQRRRRAPGRQPQPAHRPGRSRLMASDKPLRLLLGFDYGTRQIGVAVGQAVTGQARELCVLKAQNGVPDWNRVEALIKEWQPDAIVVGLPLNMDGSPSEMSERAEKFGRRLNGRFNLPVFTHDERLTTYAAKGERLAQGQRDGYRERPVDALAAALLLEGWLAEHPD

SEQ ID NO: 17055 - protein, 207 aa, Pseudomonas aeruginosa
PMAAGTPPFAIMLSPPRAPPYSGLSRRPSHRCQRGATMSLPNPAELLPRMASDLRAHLAERGIERPRFVGIHTGGIWVAEALLRELGNQEPLGTLDVSFYRDDFTQNGLHPQVRPSALPFEIDGQHLVLVDDVLMSGRTIRAALNELFDYGRPASVTLVCLLDLNARELPIRPDVVGQTLSLGRDERVKLVGPAPLALERKVLSSAS

SEQ ID NO: 17056 - protein, 189 aa, Pseudomonas aeruginosa
AARTPNASWNRRTPNDHQYPRRPRHRPGQWPGPGRRPPHRGWQDRRHRRRAGRLQRPEDPRRRRPGGRAGTGRSERRPARAGLWTQGQRRKRDPRRRGRRHHQPVLPALHPAGAGHPGGGRADPRPRPRGRQRRGLPHRRADPRLRRRATVGTGGPARHRLRGLHQWACMASPATASCGAPWSTRRPST

SEQ ID NO: 17057 - protein, 187 aa, Pseudomonas aeruginosa
PTRADPCHHEKARHPAGFFIFAFAIPGAYPLPGWAPYPSLCHQPASTAGRITRSVIRRGMLAGNTRWPAAAPVGAAPCGASDLRQRLRQVGLQVLQRLDAHRQADQRVTDAQVGAGFRRDAGVGHDRRMLDQAFHPAQALRQGEDPHVLQEAPGAGQVAAQVEGDHPPKPRICRFASSCCGCEARPG

SEQ ID NO: 17058 - protein, 520 aa, Pseudomonas aeruginosa
NLWFLKSRRRNSLPTVAPPMKKPAGWRASRTWRRASDALRPVALGHLSVEGPEVVEHAEEEQAAGEQVDDPGDPLAHVHPVHAEHTEEGQQDPGHVVVQVAALEAPVGLAVHRRDEEQVDDPADEEQAEGEEPDRPGDRLAVIEAVRTGETEDPQQVADGLAMGVVLLSHASPSFRARLRPRLSRRLAERRTPRQSGPAHDSFAIAYPVGWCCRHRPTGAAMSAGHEHSFAQTNSTRLKWALLLTGSFLVAEVVGGILTGSLALISDAAHMLTDAVALAIALAAINIARRPTNDRLTYGYHRFEILAAAFNAFLLFGVAFYILYAAYERLNQPAEIQSVGMLVIAVLGLLVNLASMRLLAPAQGNSLNVKGAYLEVWSDMLGSLGVIVAAIVIRFTGWAWVDSLVAVLIGFWVLPRTWILLCESLHVLLEGVPKEIQLAELREALLGIPGVTGLHDLHVWSITSGKISLTGHLVYDPALVDAEALLGTVKALLHDRYEIEHSTLQLETSACAQAEEPLAY

SEQ ID NO: 17059 - protein, 210 aa, Pseudomonas aeruginosa
ATTSRQPSAKVRPGSASVPPCSAPATTARRLLEGIPYEHTPHSVHRRRQHGRQPDRRPARPRRAGGADPRQRPGRRATREDRRRVRHRRGRVQRRGRGRRRRRGPVGQAAGHESRVPSLGAGAEAGATDRLHRRRHPLRQPRSLARPAAPGGPLHAQHPGAAAPGRQRAVRQRAGQRRATRAGRAVAVRGGHRPVAGRRSADRRGDRSVG

SEQ ID NO: 17060 - protein, 145 aa, Pseudomonas aeruginosa
TRNPGGTRPLPMIELEQEDPIPQGDLALQITALPRETNGFGDIYGGWLVSQMDLAGTAMASKIAGGRIATVAIDRMAFMVPVAVGAQLSFYTQTLEVGRSSIRMLVEVWSDDPLSSEWRKVTEAVFVFVAIDGSGRTRPVPPRRG

SEQ ID NO: 17061 - protein, 585 aa, Pseudomonas aeruginosa
TQERRLSPAFLFARSSGPHGVAAYRRIPGHVVLRRAARQRLATADPVGDLLGHHDGGGIEVAGDDQRHDRRIHHSQSFHAMDPSLAIDHRHVVAAHLARAGWVESGLSMVADELVEFGVRLHAHPRAQLAAPIGVQRRLVHDLAGQPDAVAELLPVLLVGHVVEQDARMLARVPGLQVDAPAARRAHRAHVRLEAVLLHALAAVVVDRHREEMELDVRPFERFAGSDEAAGLELVAGAEALAEEQPLGTDGRLVPPFGRRVDRHRLLAGVLQVEFQVILQVGADARQVMHHRDVQVAQQGRRADAGALQQLRRGDRAAAHQYFAAGVGGDRVVAVAHQVGDADGALAAEQDAVAQGVGDDGQVGPAAGLVQVAAPGGGATALRGDGPVHGAEAFLLVTVEVIGSRVAGLHAGLDHRMEQWVVAGLRRGHADRAVAAMVVVGADVPGFRLAEVRQAVEVAPVLEARLLGPAVEVQGVAADVAHAVDQRGAAQALAATALHAAVVHVGLGVGLVGPVVAPPLQREGKGRRHLGAEVEAVVGTAGFEQQDADVGIFGEAGSEYVTGRAGSDDDVVEFLGHAGLPLFSA

SEQ ID NO: 17062 - protein, 770 aa, Pseudomonas aeruginosa
HRPRRWRAGVWKFGMAGVRERCLGPAWLGVRALRRGSEHRGVVAQLHLHGLDASVMSQGGETVLATDTGLLVTADRHFRRRLAPGIDPADAGFQAMDGAVGAGQVLGHDAGGEAVLGIVGAADRLVFVVIDQDAHHRAEDFLADDGHVVAAIGEHGRRDVGAIAERSIGHTLAAAQQASLLRLAGLDVAEHAFHVREADQRAEVGVLVLRVAETDALHALQYLGFEAGLLGTVDEHPGAVGADLAGAEEVGHDGDVGGTVEVCVGEDDQRGLAAQLHGHFLQRRAGSAGHDFLAGGGATGEGDLLDQRVLGQPLADFASAAGEHVEHAVRHAGLGVDLGQLEGRQRGDFAGLEDHRVAGSEGRGGFPQGDLHRVVPGANAGDHAQRLAAGVDETGFAQGNLLAFDGRDQAGVVLEHVGAGDDVHRAGFRQRLAGIQGFQGSQFVVALAEDVDGATEDARALHGGHRRPHLLPLDGALHGPLDVFPGSPLDLGEHFAVGRVDGLEGGATAGLHVATANVELLFFESGHVAVLSYRYRRRKAAPRGFSSLPRLFCQLLVEVVVSDVQGLVGIEGVAGQRATQPQAVDQGRQAACRGAGVVRRELAAELVAQVRIQAMVVDPLQSTQCRLVHAGRPERQPGLHRRTIDLAVVEVAFDDRSQVRPRTVVVERRAAFAYGLAQGAEQVPHGRFQQAVLVLEVVTDDAVGNTRQAGYQGDAGVSHADLIDRLQGGVNQLRAADGLHTDLGHCYLLSSMGACGHRPTSLVASLFCFY

SEQ ID NO: 17063 - protein, 112 aa, Pseudomonas aeruginosa
PPPSSSIPTAPEPCSAASRRGCRTASAGTTCWPSAPTCSSSPGWPSRASAPSSSARSMKSRTSATAPGPACCSPPGSASRCSTSPHPSRSTTSTIHPKAFPAALRRRARRCN

SEQ ID NO: 17064 - protein, 726 aa, Pseudomonas aeruginosa
RPRAGRGGSAEVLAQQRVVQLAVAEHPDHPVLLLQDQLVAGLVANLQGIAHTDADIHQGRFAAQLLHRVALAPALQVDDVAALARALEHVAFAETDPAVAALVEADLVVLPDALVEATHQALAAQHVERVGMGDEGTHVVVRGAQHDLFRLAVLDDPAVLHDRDAGADLQRLVEVVADEHDGLVQLPLQHQQFVLQLLADQRVEGGERFVHQQDVAIHRQRASQADALLHAAGERVGTLVAPLRETDQLELLVDQLLPLGGRTALHLQAEADVLGHRQPGHQGELLEHHGDALGAHGLEGRRRAVGDVHLRTFVLDQQLAAADLVQAVDAAQQARLAGAGKSHQHADLAAVDVQAGVLDAEHLAGALEDLGAAEALVEELQGFLGVGAEDDVHMVESDRSHGLFPLHGALLAHPVEQDGEQDDGQAGFEAEGDVGGVQRVHHRLAEAIGADQRGDHHHRQGEHDALGDAGGDARHRVRQLDARQQLPARAAEGLAGVEQLRRNVLDTQAGQADRRGDGEDHRGDQARHHAETEQGQGRDQVDEGRYRLHQVQQRPQRGVEPRLVRGDDAQRHAHGDAHQGGEYHLGEGFHGLLPVAQVEDQQQRGQGEHGQPPAALDEMHQPYQQGDQHQRVEPEQAVGDAMDEELQGVGDLVEERCAMQGQPVDETGDLLSQRELVISQEHNQGPSRAGNERPVAYLANASLAAAAAGCPSRVVTPASQASSCSG

SEQ ID NO: 17065 - protein, 545 aa, Pseudomonas aeruginosa
WSLPATSGCRFRSGASPFSFRRRAGADAPRPQRFPDPGADAALLDMAGSVADAARPGESPMMRRNRGRRSRHPHYAGTDAAAIPEAGMAISVFDLFKIGIGPSSSHTVGPMRAAALFTTALRQRQALSAVRRLEVRLYGSLSATGVGHGTDRAVIMGLMGEWPDRIDPTQIAPRMAALLDSGLLQLDGRMAVPFDWVRDMRLLDENLPYHPNAMTLVAYGEQGELHQETYYSVGGGFVVDAAQAASGQLDQDHTVLPYDFSSAEELLLLCKRHNLRVSELMLANERIWRSETDIREGLRRIWQAMRDCVDNGLRNEGILPGGLNVQRRAARLHRNLQEIGKPNVIGSTLSAMEWVNLFALAVNEENAAGGRMVTAPTNGAAGIIPAVLHYYMKFNPDAQDRDVVDYLLAAAAVGILCKKNASISGAEVGCQGEVGSACAMAAAGLAEVLGATPAQVENAAEIGLEHNLGLTCDPVGGLVQVPCIERNAIAAVKAINAAQMALRGDGQHFISLDKVIRTMRDTGADMHDKYKETSRGGLAVNAIEC

SEQ ID NO: 17066 - protein, 371 aa, Pseudomonas aeruginosa
GDTPMTTYAPGVPPQNRNPQSIGFLLLDNFTLISLASAVEPLRMANQLSGRELYRWHTLSLDGRQVWASDGLQITPDAGTDNAPAVDCVIVCGGVGIQRSVTREHVTFLQAQARQGRRLGAVCTGSWALARAGLLDGYDCSVHWECLAAMQEAFPRVAMSTRLFSIDRNRFTSSGGTAPMDMMLHLIGREHGRELSAAISEMFIYERIRNEQDHQRVPLKHMLGTNQPKLQEIVALMEANLEEPIDLDELAVYVNVSRRQLERLFQKYLHCSPSRYYLKLRLIRARQLLKQTSMSIIEVASVCGFVSTPHFSKCYREYFGIPPRDERQGQPLGQPVVLMPIPQDLALMPNSSALSALSQAQGESTFASVRI

SEQ ID NO: 17067 - protein, 432 aa, Pseudomonas aeruginosa
GAKDAHPPRQDRYQTPGPGPETHPRPAAQRRPGRRGDPPGSFAMVAAQRHQRADPGHRARHRRRQHPVPSDRRRQRRRRRLLQADPAARRDHPLRPAPDLPGHRRRRIARRAAGRPDARQHLRPGVPARHPAVRPGPHHHPADRRRQFDLRRRRGDGHRAGRAWPRRTGRGGGFHRGGVRHPGHLPLSGAVPARPGLGAATARPWHLGRVHRCHGARGGPGGRRGSLDRHRGSGYRSDRQDGPGNDVGALPDPALGLAGTRQGAPPAAQRRDQDHHSLVRRRLRTGRRAQLAGQPAAGAGQPRQRPRHLPPGHGNGRPRPRHAPLGDPPRRPQAAAAGRPAIRLAGARRWITHPPGARLSPPPGSPARPAARPRAGLPPHRCRGRAGSHGPARFPDRTLPRHPPRVALRHSARRRRAADRIRQPPRRPAAGQ

SEQ ID NO: 17068 - protein, 139 aa, Pseudomonas aeruginosa
NQRPPGVAPAAVGAAPPAAGRRPGTPAHHRGRATARRRSRSARAMAQRTARDRAISARPATARRHRAGPGTAPPPGCRRRCRRPPAGVAHPALRPARPGSAPARHAGNPAMPPGTDAPAPVGNPPPAPAGPGAPPGRRR

SEQ ID NO: 17069 - protein, 304 aa, Pseudomonas aeruginosa
NRVNRGRRASSRHRAGRAAPASHRAVPGGRGDSGARAPAARPASRSRAPANRPGAAARTPGTSARRPHVAHPGADCRWRTPGCARRSATSPETADTSQPSRSAHRRQADHPTDTFRHGERAMCLGERLDPRQHLAFEQYRARAVEADVEQHLLAQRQRLPAARQVQGMVDMQALAIVTEQLRTHLDPGALLHLMEEVQVAFQGEQRVSAGVAVLAVQADMRHQRIGGVAEHQQVERIAQVAVVVHPLGQDRRLVGRQDLAHGRLRGCATPGGAEGASCHSAKAKPCRALVSLIAPSTASRQSSR

SEQ ID NO: 17070 - protein, 539 aa, Pseudomonas aeruginosa
SGRCRRRSSARPRRRSSAPHRWTARRPGSAARSLRSGLCPGKAWRPAAWSVASSRGTGPAACRPGRPGRSVARRWSASPGSPGRRARPRPRRCWRPRRSSSPCPGAPCGTARVRRPGRRHWPGSAGRSPAGESSSSSVSPRAAIDCFSARWVPAPCETDPGDQGTQPGRRRSALRRPALALQRPGHCQERRACATHRLRNLNPGAPHVPGLLVSPAARLLGNGLRFRRGATASGQPLPRRPLPLARAQRRRRSGAGQQWHVGEQRRRAGAAEERRPAVRGGRFRAAAGGHPGPGAVAAQARSQRRDPRWHRYRQRGAGRGRSARRAPRDPALGSHRRLPGVLPATERDPGAVRDRRSAHHLGRRHRLHRPDARPDRPGPRSATGGAGFRAVRARPHPPAPGPPAPAGGDPLWREQPQAGAGDRRDGAAYRAATDHPGAGRAHPGHPPPAGTAVPRAPGRHALELLPRPAPGQGPPVAAPDRPQRATGEPGLRLRVAVVLLPQLPRALRRQSQPGSRGAAAQGSRSHAARRASRASHASS

SEQ ID NO: 17071 - protein, 175 aa, Pseudomonas aeruginosa
SISARLDSRLTVSKATRSARMSRLPGMSGSRAQVSRCAVEEGNDPLTRRRARRSSAHGSGRGRGSHSPASAACRRATVARAGRWGRARPSRRAGRPPARAGRRPPTAPPNAPARLRHQRPARHASPPAGARRAGLRRSRRHPPSPRSLPARPAGCRPPRIVRRPAHGGRRAPRGR

SEQ ID NO: 17072 - protein, 223 aa, Pseudomonas aeruginosa
CCPPRPRPGPVRGSDRSRTAGPAAGGAPRALPAGQGRCGRYRRRRRRATPGSSRRRAPGSPPGPAGRSRRRRRRIRSVRPGSRPDAPGRGSPRYVRRGHRSRRWSHARARAWRLPHPIRRARPATSRSRGCGRNAADGHERPPRGRPGARHVAARRRSVPPTNRRRPPVPHLRAAAAGCSSGPSGSAGYARRAARSAGSPDAGTGQWRRPRGWPRWSRRRFPR

SEQ ID NO: 17073 - protein, 699 aa, Pseudomonas aeruginosa
SLAREKLHARAGGGRQRRRSGPADELASWRNRAKTNGEAESPNGNRAFRSRFQRGFADVQSSRRFSEDRRDQPRHAHPQLLQAAHAAAVFRSEFERLGEVRLEHRLHLAGEALVDGHHHHLEIQPERTVVQVGAADGGGVAVHQHHLLVEEAGLVAEHLDPGTDRLQRVEAGRGIHRAVVRARGYQQAHVDAAQHRQAQGGHHRFVGNEIRRGDPDPLVGGVDHLDEEQRAGFLGIRRTAGDYLAERALAVVLRRQDQRRQAVGRPVPVLGEAFLQARHRRPAQFHVGVAPGRQRRLLAEVLDADVVPADETALAIHHHDLAVVAEIHLEAVEHAAAGAEAMHLHAALAQPLDIAVRQRVAADGVIEEEHLDAVGRTFQQQLLEALAEGVVADDEELHQDHLAGGGNRLEHRLEAGLAVDQQAHPVVRQGRRAGHPHQRLEPLVAADLAGRQGLLDPGTPVQLGGRQVHLAVGLAPRLDVGVETAATEHQVRQQGQVRHEYQRGGPGDRALGGAHGEHGMDGGDEAEYLDTDQQQAEVGGGGHCARSILVHSGGGHHSPLRGRSGQPGKQPGGRGGIGRIRGIDVIRPRSPCPTLFPSKTTADRGARHERRPSPASPLHRRNRRAEGPRRRGRLEQPRPAARLAGLQSRQRLAQSLDLRPRPRADRRIPQRQVAARAGVPADQGTLGVYRQPHRRALRL

SEQ ID NO: 17074 - protein, 364 aa, Pseudomonas aeruginosa
RFRHDPGRFRAGSRRAPTICCPQSVGTSPGAPSLKGVCQMSPAELHADSIVIDGLIIAKWNRELFEDMRKGGLTAANCTVSVWEGFQATVNNIVASNKLIRDNSDLVIPVRSTADIRKAKEQGKTGILYGFQNAHAFEDQIGYVEVFKQLGVGIVQMCYNTQNLVGTGCYERDGGLSGFGREIVAEMNRVGIMCDLSHVGSKTSEEVILESKKPVCYSHCLPSGLKEHPRNKSDEELKFIADHGGFVGVTMFAPFLKKGIDSTIDDYAEAIEYVMNIVGEDAIGIGTDFTQGHGHDFFEWLTHDKGDARRLTNFGKIVNPLGIRTVGEFPNLTETLLERGMPERVVRKVMGENWVRVLRDVWGE

SEQ ID NO: 17075 - protein, 218 aa, Pseudomonas aeruginosa
LPAHSRLVASSSREGHCIAPIFPLPASLPEGREGVKRIGAYTMAKHAPQLPIEVDSETGVWTTDALPMLYVPRHFFVNNHMGIEEVLGADAYAEILYKAGYKSAWHWCEKEAECHGLEGVAVFEHYMKRLSQRGWGLFEIERINLEEGTAEVRLRHSAFVYVYGKVNRKVDYMFTGWFAGAMDQILAARGSRLRTVAEQVYSGAEDGHEDGLFVVKPL

SEQ ID NO: 17076 - protein, 682 aa, Pseudomonas aeruginosa
AEERVMAFEAMFQPIQIGKLTIRNRVLSTAHAEVYATDGGMTTERYVKYYEEKAKGGIGLAICGGSSVVAIDSPQQWWSSVNLSTDRIIPHFQNLADAMHKHGAKIMIQITHMGRRSRWDGYHWPTLMSPSGIREPVHRATCKTIEVEEIWRVIGNYAQAARRAKEGGLDGVELSAVHQHMIDQFWSPRVNKRTDEWGGSFEGRMKFGLEVLKAVRAEVGEDFCVGMRICGDEFHPDGLSHEDMKQIAKYYSDTGMLDFIGVVGSGCDTHNTLANVIPNMTFPPEPFLHLAAGIKEVVDVPVLHAQNIKDPNQATRILEGGYVDMVGMTRAHIADPHLIAKIKMGQVDQIKQCVGANYCIDRQYQGLDVLCIQNAATSREYMGRAAHHREVRRTEAQGGGGRRRAGRDGSGPRGGRAWPRRDPVREEGAARRPDHHRRQGAATRPDRRHHPLVPAGAGAPGHRPAPGHRGRPRDHPRPAPGRGGAGQRRTSVPRAERTLGRRRRPGGEQLGRARRHGRARQERAGLRHHLRVQRHVGGGLPRRQGRPGGDRHRRHQAGRGHRRHHLPHLLPQHVSQGSDHDRRPHAGEGLPRGRQAGGGAGERIHRRAGRAGGRPGGGGKRRAPRREPLLRAQAGLAEQGPDRRRGAVRDPAAALPQPVRRRLPAVPHRRLRGPAQHPCGDL

SEQ ID NO: 17077 - protein, 699 aa, Pseudomonas aeruginosa
RAALVQGFLRHASWHPTGTAGPPLPQAGEEADPAPPDVPQGDQKCSTPSSPSCSSPPWHLPCSAPRSASSCGAAADPPRSTGSAASWQMPRRYLVDLHHVVERDRYMSRTHVATAGGFVLAGPAGRSWCTGFGAARAGSSGFALLAATALMFVGALFVARRRLDPPSRLSKGPWMRLPKSLLAFAASFFLATLPVAGILPEGFGGWFLAGLLAIGVAWGVSELFLGMTWGGPMKHAFAGALHLAWHRRAERFGGGRSTGLKALDLADPQAPLGVEKPSDFTWNQLLGFDACVQCGKCEAMCPAFAAGQPLNPKKLIQDMVIGLAGGNDAKFAGSPYPGKPLGEHGGGPHQPIVALDGKALVDADTLWSCTTCRACVEECPMMIEHVDAIVDMRRHLTLEKGATPNKGAEVLDNLIATDNPGGFAPGGRLNWAADLNLPLMSEKKSADVLFWVGDGAFDMRNQRTLRAFVKILKAAAVDFAVLGLEERDSGDVARRLGDEATFQNLARRNIATLAKYRFTRIVSCDPHSFHVLKNEYGALGGDYQVLHHSTFIDELLRAGTLQPGRSKAGSVTYHDPCYLGRYNGEYEAPRNVLRALGIEVKEMQRSGFRSRCCGGGGGAPITDIPGKQRIPDMRMADIRETGAELVAVGCPQCTAMLEGVVAPRPEIKDIAELVAEALIEQAEAPAKKPLRREAVAEVH

SEQ ID NO: 17078 - protein, 271 aa, Pseudomonas aeruginosa
RPLPPGRGPQDRVAAATGSIPHERYRPSRSTRRMDRPQPPASAACGHAVRPRRRGALDGPPRRDPQEPARRRLPRPQRHPPHRSLRRPAGQRRAPRQRSAGSAVAAACGRATGIPRRGGPGHGRRPSLQPRQGPPRTGPQARRQRRRGARRGVRRTQGKRLRQRRRRPPAAPRRRRVRRLRARAANTRPAQPGEPARPAPLAVPGQSQRRRRTGPAPGRRARRAAGRSRLAGRGRPLHRPRRRRPRGHPARPAAPAAGRGGMRRAGQRDPP

SEQ ID NO: 17079 - protein, 171 aa, Pseudomonas aeruginosa
AEHRRAGLHRRPSRLRTPAPCRTGRPRGGTRPAPERPTPTGAARRRPARRGAARLSRHGPGTLVRAGTAGRRRRSARTGRAPARLPRATGAHRQPGGNRGRLRDAALPPRRAPGLATGGRPGRGREGRRRQRSGPPGSASRPATPTAGTPAVRRQRRQCRAGGPAERLRPG

SEQ ID NO: 17080 - protein, 75 aa, Pseudomonas aeruginosa
EPSYDDLMIIIRLDVILAKNKVRSKELAEAIGITEQNLSLLKNGKVKGIRLDTLEKICAFLDCQPGDILEYVADD

SEQ ID NO: 17081 - protein, 136 aa, Pseudomonas aeruginosa
NGATARQPPIAIPSSPTPGTTRWAAAFTGEAGCRSLATDHGPGFGRRFSLSCAPFERLGRDHAGEHPGTPGNPGSRAAATEPGPARQPRPASAAAAPGHRGKRNPATLHARAGRKAERHPGPPGSPGRAPQRAATG

SEQ ID NO: 17082 - protein, 97 aa, Pseudomonas aeruginosa
RMSRDGVQVLSILGRDYSIRVPAGEESALADAAALLQAEVDANKRKFPYVTSNELVVLSALNLCARQLGANDGESPRLRAVEQRLEALVERIAGASG

SEQ ID NO: 17083 - protein, 297 aa, Pseudomonas aeruginosa
SLTSAQASSRVRSRRMTKALPLSSWRHRHQRVSSAGFAATASGLQGRSLAQAQREHDQQHAEEHRVGADHPDHRQRPGAGVGDHQHAEQHRDGTREDHPPFVLDRLAQADRRDDLEDAHRQRPAGDDQEQADGGQLRPEERNQAGRHADHPDQCQRPVELPIAAHVERGDQGERSVHQRVGAPEQHQHGQRQGRREQGQDAEHQRRHAAQGHQFPVLAQFGPQGIVFHACLQRPPLSGPFRLSPPTLVLLPGGCQGAEAGGKASARAQGRDFSGGRWRRQQANRFQASSRLTKAELT

SEQ ID NO: 17084 - protein, 173 aa, Pseudomonas aeruginosa
RPPARWRWSTTAGSPTRMSPKATSSPAAACPRATWSSTTEGARETPGAPSSAAAAVPRPAASVRRRPAAARREPSAASPGPARSAPSPRSGSTGRRRSCRSTGTRRGRRGSDATSALARRAAAGATGPVPGRFPRSAGRAGSAPGSDRPPTRSLAPPGCPSRCPTRSAGSRRG

SEQ ID NO: 17085 - protein, 307 aa, Pseudomonas aeruginosa
NLAGVDRPAARRATPGAAPGYRVWPGAAAGSAPRRRPPRPGSDRNRTRGGRASTRHPGASRPGARHRRRAPPPDRRATTPRRPGCHRPAVRSATGIPACRPRHPGAATGPGAACRPRASAAGRPHRERAEGRGWNGCTNPACRSVRRSGRVAPGPGRNAASHPPARAVRARRHGARRATPTTARPAHAARRPLAKASRYPAPAARLLPAAPAPGRHRSKPMAALHGTGRGRWPRRLSTARRGWRAAARKDRPGPAGCPAARGGFPARARQAGTVAVARADPRSSAAIRFRAARGHRWQRRPRPRCRP

SEQ ID NO: 17086 - protein, 170 aa, Pseudomonas aeruginosa
NSRRASGSGIPAGRPWRSRRRRTGGSARPRGFARALRRPRRYLPPAAVRPAPAEPGAPGAGHARNGSAAARRRSPPASHRPVPARSPAVPGPGRCRHPEPRRTAPVAGDTAPCRANDPWPTRRPAAAPNPALPAATAGGRQGPPARRSRRSRRGLRATSGRAACLTSDHP

SEQ ID NO: 17087 - protein, 424 aa, Pseudomonas aeruginosa
RKEPVRVGLEVAVKAPGHQRQQHATGNESQPRAETIRHAPGDDAAKGQADDRQAVGLERRGGIEAVYALQHGRGHQDDHHDRGRQHPGQQHRHQDGATMIADHRFQRHFLCQRLALLQLGEYRRLVQPAAQVDREQAEHPAEQEGNPPGVVLHLCRAIEAIDRSSHQRAQQDARRQAGSQRPAGITDMPCRYMLGDEDPSPRHLPANRGALDHPQQEQRQGRPDADLRVGRKQAHDQGRHRHHEDAQGEHALAPEQVAEVGHDHAAQRPRQVAGGEQAEGLQLTQPFRHVRREEQLADHGGEEHEDDEVVELQRSTQGGEGQGLVVAAGQWTLGRRLGSIRGWHVGIVLFIRSASMSGVRPAGVSTCDPGTQERNHSKSTNVHTVGRRENRAVVGCPTPLYNARAPLKAVPRPCTGRRFGRVFP

SEQ ID NO: 17088 - protein, 147 aa, Pseudomonas aeruginosa
PSTLSMCGKLTSGPKLVFSSCGSPRRMRCTRSSTLASKRACWERWMNTRVPLVQTWPELKKLAMTAMSAARSRSASGKMISGDLPPSSMVTSFSDELEALAMTFLPVEVPPVKEIFSISGCSVSHWPTSRPLPVSTLNTPSGTPASV

SEQ ID NO: 17089 - protein, 553 aa, Pseudomonas aeruginosa
KAGLQLRRLGRHAVLLRDRHLAALLRRIRADRPPLPSTRRRSRQPSGGAPGAATDLPPLGPARLGDLCPGRPRRRLFRLPPSPAAGIALGALSDPRRALGERRRGPRGGLLRHLRHPSRAGDQPGHRRLAGVVRSRVPDRHAAQQRHPAGGDPGDEPGRHPGGGLRCRERHPPAVQPEYRAVQLAAAVRAGLRFDPGTAQRLRTEPRRLSRRPGAEDLRPLRLHRCRRRQERGMAGPVDPVLLGLVDFLGALRRYVHRPHLPRSQRARTGLRGAADPAGLHPGLAVGIRQQRPGPGDEPRRDRPGQGRAGTAVDVDLPAAGTLSAVEDRHRPVDLRRLRAVPHPGGFRLGDAGQSLAQRRRAGRGRAELAAYPLVGRRHASHHRPAVRRQLHGDANRRGARRAAVLGGADPVHVRPAQGHARRLRGPGRRPPHLPAGAGANPAPDLNPAPLGRPRQSGAYLARRFAGPFFSATRRPAHAAGTGAQERAKGRTDGKSAEDKRECPAAPGIRSGPERAEGDQPRFLPSNAWYSSLSPSTPTTLSCSCRTSLWPVW

SEQ ID NO: 17090 - protein, 401 aa, Pseudomonas aeruginosa
SSAGLSTISSGLPCWMIRPSFMIAMRVPIFSASSRSWLTNTMVLCSCRCSTSSSSCNCWRISGSRAENGSSISRMSPSIASARARPTRCCMPPESESGRLSRHCERPTSSSFSSISFFRSAAGRPCISRPKPTFSATVSQGIRANFWNTMAMRLVRMALRVAGEQLAMSTCEPSCSISSLPRLTLFRPLMQRSRLDLPEPESPISTQISPRLTSRQASSTPSTWPVRLRISARPRPWSRSFRASLVWVPKMTSTWSNRIAVMAYFPFTARCLHTRSSRMASRTMARPASKPREMSAVFSAFTTGLPRPSAPTSAAITTIDRESMMHWVMPAAMLGIACGSSMRVSSCQREQPKALPASSSSAGTSWIPRQVRRIGAATAKITVEIRPGTTPRPNRVRVGIR

SEQ ID NO: 17091 - protein, 393 aa, Pseudomonas aeruginosa
GPWTHLPVFQVFNTETIRFTNSFPLPNLRPVTSPEERRMHTLPVKTGTRLLAQVQKLIPGLLLSAALAGVAILLGRSQWLQHNGISALTLAIVLGIVVGNTLYPRIAAGSAAGVGFSKQILLRAGIILYGLRLTFQDIAGVGLHGVLLDALMLASTFGLACLLGTRLFGLDRTTTLLIGAGSSICGAAAVMATEPVVRGRAEQVAVAVSTVVVFGTLGIFLYPVLFQLDQDWGLLPRDPGTWGVYIGATVHEVAQVVAAGRSIGIEAADTAVIAKMVRVMMLAPFLILLSAWLARDKAHRRQHSGATKITIPWFAVGFVLVAGLNSLVSLPPALVSHVNDLDTFLLAMAMAGLGLGTHLSAIRRAGLKPLLLAALLFAWLVLGGGLLTRLALA

SEQ ID NO: 17092 - protein, 1058 aa, Pseudomonas aeruginosa
RRTWTSPEVVPAPDGAGRKKSARLQVHPAAPFRRAQGAPAEALDDLDGALHQAAVARRHALVQPDVVLQADPHVAAQQHGLGDHRHLRAADAEAGPGRPRRQVVGHRLHGRGIGRRAPGNAQADLEQRILQQPFLEHLLGEPEVAGIEDFQLGLDPQLGDAPGAGAQLRRGGDVDVLAVAEIEGAAVQGADFRQQLLDMPEPLQRTDQVGAGTELQRLLALADLQVAAHAGGEVDDHVGVAFADTLDHFAVQRHVATGLAGGGVADVAVGDGGAGPGRLDGGLGNLFRSDRDRRMPADGIAGAGHRAGDDDFMVHGGSFLYSGCTKPRPAAPGGTDRCGLLQRGLERGQAVLAVEGAHAIQPGLQRLGVGLQPLARGVEGLGAIEDRRHHLADLGAAEAQVVQQPGDVAALRLVAGGGHGGDGGRAFVGTEHILAAGEVGHVDLQVHRMRLPAEEHHPLLALDRPLHRREHPGLAGLHQLEALQAETVVVDHLPGDAVRAAARLDSVDAAAKLVLEAGDVGEGLQPALGDVARHRIGGLRVGQGRRLDHFDPAFVQVRPGDRLHGRLPVAEEQVQLLVGQAGQDDLLRGAGLLHLVAQAVEQGLGHGAAGDHVGPVHRAQAHRAALLGFGGQGGATGQDQQGAAQLANRRLHRSPLVRLLIVFLRGGCRPLARPTLATKVRSRDGGEAHCGDQLLHCSDLAIAKSGGPALHTGCATSTPERPMSQDFWFLLLPGFSVMGFVSAVEPLRVANRFHADLYRWHVLSADGGPVLASNGMSVNSDGALEPLKKGDLLFVVAGFEPLRAVTPALVQWLRKLDRNGVTLGGIDTGSVVLAEAGLLDGRRATLHWEAIDAFQESYPQLSVTQELFEIDGPRITSAGGTASIDLMLDLIAQAHGPQLAVQVSEQFVLGRIRPRQDHQRLQVATRYGVSNRKLVQVIGEMERHTEPPLTTLELAERIQVTRRQLERLFRVHLDDTPSNFYLGLRLDKARQLLRQTDLSVLQVSLACGFESPSYFSRSYRARFAASPSQDRAVLPLKAPAATPPGAPAGHRTPRAERG

SEQ ID NO: 17093 - protein, 477 aa, Pseudomonas aeruginosa
ASADFLEAGLRSLRGAVLFLALGGVAVCEVLALDGDVVGDMARVVPDAPDERGAAPRQPGQADEIHAGFAGHATLVARLAVAVEGIDLQPAEVDGIAGGPDDAAHPGLGQVQFEDRIGHALRVRQPAARLGLFRQVKAVAGDIGVGGVEQRQVVLVAARQVLRQVRPEGRDAVDEGFGQSDQGHALMRQGAEVHGMSAAGTAHGDGHMLAPGLGDFRIPFAEHAQPPAEVAVAVGTRRTVMSAHREVDLAPGTLQLVGDLYPRRTGADHQYRTFGQLLRVVVVGRVDLPDTLVARRDRRDHRTLERASGGDHAVGLDGPGGGFHGEAGAADIAHHLPHLDAGTDRRVEFLRVGLEIGRHLVLAGETVGIDVEFHSREAVVPGRAVGHQRIPASAAPGLGDAVALQDQVRHAEPAQVLAHRHAGLAGADDEGVGLFHGPVRARGQGGAIQVGHGSVPRTLVVLVLRLRDGRILFRAGE

SEQ ID NO: 17094 - protein, 225 aa, Pseudomonas aeruginosa
VVEVIARGRSLSTPVAAIIALSGVGLASLANSQGGEAGLAGSVGSTSFGRARPALRCSHRKPPQTEEPAMSDVRPPLPPFTAETAAQKVRAAEDGWNSRDPQRVSLAYSPDSVWRNRSTFVRGRERIVEFLSGKWQREQEYRLIKELWAFTGNRIAVRFAYEWHDDSGNWFRSYGNENWAFDEQGLMYERHASINDLPIREDQRLFRWPLGRRPDNHPSLGELGL

SEQ ID NO: 17095 - protein, 136 aa, Pseudomonas aeruginosa
GSCATSGASNSRPTPDSSPLPPGRGIASHPSSLSPPLSLKGERESKESELTPWPNMPPNCPSRSTARPASGPPTPCRCSTYRDISSSTTTWASRKCWAPTPTPRSSTRPATSPPGTGARRKPNVTAWRAWRCSSTT

SEQ ID NO: 17096 - protein, 111 aa, Pseudomonas aeruginosa
SACPSAAGACSRSSGSTSRKAPPRSACGTPPSSTSTARSIARSITCSPAGSPAPWTRSSPPVAADCAPWPNRSTAAPRTVTKTACSSSNPCKPRKGSWPSKQCSSRSRSAS

SEQ ID NO: 17097 - protein, 353 aa, Pseudomonas aeruginosa
SPRSRWARSTRSSSASAPTTASTASTRAWTCCASRTPRPPANTWGVPHIIEKSAGPKRKVVVVGGGPAGMEAARVAAERGHDVTLFEKKEQLGGQITTAAKAPQRDQIAGITRWYQLELARLGIDLRLGTAADPETILDLRPDVVVLANGGHPFLEQNEHWGAAEGLVVSSWDVLDGTVEPGKNVLVYDTICEFSGMSVADFLADKGAQVEIVTDDIKPGVAIGGTTFPTYYRSMYPKEVIMTGDLMLEKVYREGDKLVAVLENEYTGAREERVVDQVVVENGVRPDESLYYALKQGSRNKGQIDVEALFAIQPQPCLSQSGEGYLLFRIGDCVAQRNTHAAIYDALRLCKDF

SEQ ID NO: 17098 - protein, 688 aa, Pseudomonas aeruginosa
PQPQEAFRMNDIVRRDPRAEWIARNRLHPLHAAMQSAQGGEVRWMGPHGVIRKNPHAVGFLGPNGIRRIDRSGGQQGSGARRASVAQEAQLPLHVVEQPAFLVAVVPDMVGGRLSSHDKDLLGLARKLAGNDGAVLAVVFGEHKESAFDSAGVDRLLHLAGGEYDGYAPEQRILALRNLENQLAPRHWLFPDSRNGGGELGRRLAAALGERPAGRVWQVEDGRCIGRAGAGREDIQRALPRLLLAAAECAEPVSETRHEVRELHMAEQVARNLPRIEDLGPVAVDPARIPMAEAEFILSGGNGVQDWTLFHQGRRRPRRHRGRLAGGGGRRAHAAQPPGRRHRYLGHRAGLPGGGHLRGDPAPAGHRRLRQGGGGEPRRRLRHDQARRSLGDRRLDGNPPRADPPGRGTPQRRRPRCGLNPLPRTFHRYRTMTELNIVALVSIGAHPASGRPRRAEQDARAVELGLRLSGPRLQVLHAGDPHAEALRGYLGMGLERLSVLEQPAGADALPALAEHLRDSRAQLVLTGSQAETGEGSGMLPFLLAERLGWPLVVGLAEVEKVEDGSAQVLQALPRGQRRRLRVRLPFVASVDNAAPVARQSAFGPARRGEIEAHEVEVVDDPLLAEDSLQPARPRPKRLKVIKAKTGAERMKAATAKASGGTGQVLKDLSAEAGAEAIFKLLREEGVIR

SEQ ID NO: 17099 - protein, 179 aa, Pseudomonas aeruginosa
RTARSRASASTPWRRSAPSWTASRATSWNTSRTTDPRSTLSQPETMNRHLNLSGVALALALISGCGPSVRYQYVMPPSEAGRTCVAQCRTQQSQCESLARLEWQNENRLREAERRSYHYCSQGKSKKQARKECLAPGYSSSFGYNGFGGSGNFNCSSDYDRCFTDICGGTIRRIVEQPQ

SEQ ID NO: 17100 - protein, 191 aa, Pseudomonas aeruginosa
SEYPHEPTPLPSPAVPVPGRLRPGLSLLLRHPSGRPRQRRRTQLRRARRRLPETAQLPASHRSRSLRRRPRALLAGRQLSLVKPGAEAWQPTTDLASAGAFLYPARPLNDWDEIMLENTLERLETLVAELLQQNQALRDSHDQLQQQLRQATEENETLQLSMLEQEEKQSGTQARLEALVERLSAQQPVSA

SEQ ID NO: 17101 - protein, 446 aa, Pseudomonas aeruginosa
PFLRSGAPPGGASSGLAAGHLAHVGGLLAEVVQHALAVPVEEIDHAELVGLRVWTRLVGVGVDPALVLLGQPAILVVGRVPYLAQARHVVVDAFHRVLVHQPFGGDQGFLGADRPHGEDDQVVAHAVVPGVRQVQDAHRAEVGVLDPAHELLAALLAVHGHRHRAVQQRHAHDAIAQAEAGMGVRDLLGVPGAGAGRHLVLERLAGARVGDVVPLQQGLQQFRVGAVAVVALAVVLDHQLPVGGFADGGLHRHLGVLHVVRLHVVLERRQEVVDGRRVLRQADEDVAAGGLHLDRLQAVLLHVEVGAHLGAGEQQAAIQLVGPLVVGADQLGHLAFLAHAQARAAVPADIVESMHLAFGATDHQDRVLADLQGEEIALGGNLAGHAGDQPFLVEDLLHVDLEQALVAVEGLRQREAVVAAAQHVGGGLAGRFQGIAETQGGSDVHR

SEQ ID NO: 17102 - protein, 660 aa, Pseudomonas aeruginosa
ACKCRWQVNERPRRCAQSAPSGHRSAPCARRDHHVEQLPQSGHHPDLGQRPAPRALRQGHPGNLGRAHLLLHGRPADPVLLQAGPVRHPGAGDRRRAGDALLHHLQLALGALQLLHHHQAGAGRAGFQLAARQPQGRPGATGARSGRPVQRHRLPGRQGAVPLRRGRHHPGDVHGALVLRHQRQRRHGLRPQRPFAEGHHLPPRAGAHGLADRQLQPAHHLRAPRPRRSLGRLPWLPEPAHAGTDRPGLPRAGNLLLRPDALYERGEAPAAGPRLRHEPLPRGSLRADSAGGPRRRQGTGRGSRRGAGGTGRRPAPGGIHRHRQEHPRQPRGNRARRRRQARPAHSEGLRDGHLRHLQGNEDRRRGGDGAQRRDHRRGCRRRLHPLLLQRAQGRRGHRLLRARGKRQALPVAPPRQFLGRQPASGAGLQRLGGSLQQRVQGQHVAPRPRAAEAQVVVEAVEARVLAEVVAVATQRPLLHVEQQQAPLVPFQVAFLVALDVPGQRQVATVRRPDHWRRQVAQADARRGQQVAVAAEPGAHVLVAVHALVVETEAPGGVLRAHRRQDEVAVAPGPRRCVQPARRGAQPPGRAIERHPRLLVVMPPVVVEAAECVPGAGLGQAFVEAAQQAGVAFARPARRLVGVAAEQVEQMHLAIDETLQV

SEQ ID NO: 17103 - protein, 276 aa, Pseudomonas aeruginosa
RLRAQIPAPALPFAFGQPEVTDGNEGLGLAAGLERLQLEALRCVGRQRAVPADHLALGDAVQLPEVVHGTAVKQPLLPVEDRQAPRASARYRRNEVAAIAGKACRRIAVGDETAVGHQVVAYQRAAHGDLAAVEQADRLALGGSLGRFAAPGATSRRQRYVQRLRSLALQAQATLETDLQQHAADHRQQATAQSQPEARQCLAQGDAATQNPEEQRLLQAIRHLAAPTIHGPLGAQQQRPTQRYQRQRQEDAKGHQHGDPGDLAEAFEQQAAERLV

SEQ ID NO: 17104 - protein, 546 aa, Pseudomonas aeruginosa
AAMLSLPWGHPPMSTASPIKTNEQVRLNPIVFFGSTALILVLTAALILYPDSAGALLGRIQAWLSHSFGWYYMLAIGAYLFFVAWVAFSRFGTLKLGEEHEKPDFSYGAWAGMLFSSGIGISLLYFAASEPIDHLYHPPEGVPGSPQAARQALQLTFLHWGLHGWAIYALVGLAVGYFAYRHRQPLALRSALYPILGERWVKGAAGHAVDCFGIFVTLLGLVTNLGIGALQVSSGLEYLTGMPHSKGTLLAVILAMSLVATLAAVSGVEKGIRRLSNLNIVLFSSLLLFVLVCGSTLELLNGFVQNLGDYLDGLVLKTFDLYVYTGAGAGKSEEWLGLWTLFYWAWWISWAPFVGMFIARISRGRSVRELVCGVLLIPLGFTLAWLSVFGNSALDLVMNHGATDLGKAALEQPSMSIYLLLEHYPLSKIVIGLSIFVGFVLFLTPADSGSVMLANLSRSGGELDEDAPNWLRILWSAVVTLVTIGLLFAGNFTAMQTVVVLAGLPFSAVLILFMFGLHKAMRADYEAQVGDRRTYQPVPAPTQPQT

SEQ ID NO: 17105 - protein, 564 aa, Pseudomonas aeruginosa
TTGRLLGERQLGRGCGRLPVAGGDTGQPGIQLFRVILQPGLSGFLGFLVFVEYRVHQLVLHLEGEAEVLQQLADVGALLGVALAHVGVDGRAAIVGAEEVVAAFQVLHLEAGIHGVRLPAEEHHPLVAPDGPLHLREHARLAGFHQLELAQFEGVLVNHALGDAVAVVARLDAVDLVAQLVGELRDIGKAAQAAVVDVLGNRQGVLGALQVGAQCLDRTFLGVLLDVVGHGGHPVAQEYVEVVVGQGAVGHRHREQIDLGLVAEGLEDLAGDRSGHCDVGPADVGETHRRTGFGLRGLGCQRCAQRHGQQPRLATFHSELLCRVRRRRYPEGRGGLSVSGRPVAALSGQFVNDHETGRIRRLQGGSQPVQAGSHSVPAVSHSIIVVFAGDQRMPFSERREPVLIPTPCRCRRPSAAEVPRSGRGRGAFGHGRVGGGCGPPRGKPDDAQESRAEEPPPPLRRHGCRGNPGGRHGYQCVRPFQDRYRPVQFAYRRPHARRRAVHHCPAPTPGAVGGAASRSAPVWLAVRHRRRPRHRSRGDHGPDGRMAGSYRPDPDRPTHGRAAR

SEQ ID NO: 17106 - protein, 381 aa, Pseudomonas aeruginosa
RPAATGRPHGGTVRLGARHAPARREPALPPQRHDPGRLRRARRTAPGDLLLGGWRLRGRCGTGRLGTARPGPHGAALRLLQRRGTVAAVQAPQPAGIRADAGQRTHLAQRDRHPRRPAAHLAGDARLRRQRVAQRRHPSRRAQRATPRRAPAPQPAGDRQAQRDRLDPQRHGMGQPVRPGGERGERRRRAHGHRAHQRRGGDHPGGAALLYEVQSRRPGPRRRRLPAGRRRGGHPVQEERLDLRRRGRLPGRGRLGLRDGRRRPGGSPRRHPGAGRERCRDRPGTQPRTDLRPGWRAGPSTLYRAQRDRRGEGHQRGANGLARRRPAFHLAGQGDPHHARHRRRHARQVQGNLARGPGGERHRVLNRNCSRNDRDATFWRI

SEQ ID NO: 17107 - protein, 505 aa, Pseudomonas aeruginosa
LHPDLPGLGGGTVAHGQPALGTRTLPLAYAEPGRPPGLGQRRPADHPRRRYRQRPGGGLRDRLRRRRHPAQRHPRARHVPPGPGPPGSAPRRGVHRQLGAGPRRPARRLRLQRALGMPGGDAGSLPPGGHEHPPVLHRPQPLHLFRRHRADGHDAAPDRPRAWPRAVGGDLRDVHLRAHPQRAGPPARAAQAHARHQPAEVAGDRRADGGQPGGTDRPRRTGGLRQRLASPARAAVPEVPALLAVALLPEAAPDPRPPVAQADVHVDHRGGLGLRLRLHPALLQVLPRVLRHPAARRAPGPAAGPAGGADADPAGPGVDAQLLGAVGPEPGAGRVDLRQRADLTARPCPPRPRERAGPCQPRGTSAGSNCREIASRTAGSSVACPPSMSSTSRRSAWARSGLRPRTAYSQACSGVESGGTLKPSACRRSRKSSWSIRSACIIAAAPSMGIAIDSAEPTSLPARGLSRLDMGRSFSANSTASDTATIASSGLRNAADGFRKTPDSH

SEQ ID NO: 17108 - protein, 351 aa, Pseudomonas aeruginosa
GPFLAPFSSPSARRARQGDFFAGSQLAGAESRPTVFPETLEARREELVALAQHVEAPAQRRQAAAQFDQRAGGQLFLDHPARQATDAQPGGDAVLDRLGAAQVQAVFQVMQVAQQGVADLLARARAGLAQQPARAAQGLAGDLGARGQRVAGRRHHDQAVLEPGLHPQARLVAGAFDEADVRREGHHVLHRRTGVADAGVDPHARLLPLEGGQQARQHVVADGAAGRHRQARLGRGGNRELLLQLRHPVEQAQCLGQEAAADLVQLQALADPVEQARGKLRFQLVERGAGGRLRQPDGFRRRRGTAAASHRTEDLELTETEGHGLTYLFFRYLIQKLFVSQIHSRYLTCVP

SEQ ID NO: 17109 - protein, 540 aa, Pseudomonas aeruginosa
TPAGRTHRASGRCSPPTRAGPASRRSSGLGSWQAPWLRYARRGGRRVMSLGEGEAVPGLGFPDRPEHRQQAVVAVALELGDAARALLLGGALHHPVDQGFGEFRRLQVGPGQLQRRAELRHEVAHAGVATGQGVGQEGAHERPAQAGAEADRIVDLAGRGHAVVDQVQRLAPERLEQAVGDEAGHFLAYVQRTHAQRLVDPHRRPHGLDSGAFAADHLHQRQQVDRVERVADQAALGVARLGVELAGQQARGGGTDQHVGPRRGADPGVQVELQVEPLGGALLDEIGVAHAFLDARDEAQALLRRAGRQALFPQGRPGIGNARAQRRFGARRRIPGDDVEAVGQGAGDPAAADDAATEGGEGLDLGDEGHGHLQRLFPPPTGRGGRNQRGFRFILRRPSAGLRARPPRRSMISMARSTRLPLLAGTPLSSQMLSSRPTRTLPPSNMAWATIGICVRPMPKPAQVAPGGRLSAIAFMVVVSAGAPQGMPRQIWNSGSSSSPSLSICLANQRWPVSKISSSALTPSSVMRRAPARSCAGVET

SEQ ID NO: 17110 - protein, 239 aa, Pseudomonas aeruginosa
MYSPSPKLRVPQSRVQISGSSSSTCLSRSSGPTRSVPAPNSRGCSPLPISRSPPMPAVRLMITSVSLSRIRSTTSRYSATSRLGLPVAGSRTWQWATVAPALAASMAASAICFGVTGIAGCRPTVSPAPVTAQVTMTSWFTVVASCIRGVRSPARPRRAERIGAGYFSEAWSAARPSLPSKVLTPSSQAFSGSGLAFSHWRAASRGWVRSRIGAITWLTWALLKRRLCSSRATLPHCAW

SEQ ID NO: 17111 - protein, 323 aa, Pseudomonas aeruginosa
RREADIGTSLHRAHPRQQFAFGIVAEFLGDLPRVVRRQRADLEVEAALGGHDVQRPAALDQSGLHRRVGRVETPVVALRRRQARADLAEATDQPRGVFDGIHPLRRVGRMAGRAVHLAAHGQLALVAEHRLQLGGLADDAQQRLVRTPLQRREQRTDAQAADFLVVGERQVHRQAQRRGEERRDGRQHAGQVALHVRRATPVEAAIALAEPERRHAPGLAVRRHHVGMPGKADAATVAGADGGIEIGLAAVGVEEQFAVDAETRQVVADVVDQRQVGLAADGVEGHQVGEDVAAAGHVGLQGAGLALRRRGRERPAHSSPGTP

SEQ ID NO: 17112 - protein, 655 aa, Pseudomonas aeruginosa
RPAGRPEMLDTLLPVLLFAALALAVLGAAKRFLMWRRGRPAKVDWIGGLLADAASLPGGPAPCGRARQVHVQDPRRHRRGLRPGGACWAILVHGFRGCTGRILRLRPAGGHSADVRRRAVRRPPPPRPTVAAVEGPLDAPAEEPAGVRRELLPRHPAGGRDPAGRLRRLVPRRPPRHWRGLGRVRAVPRHDLGRADEARLRRCPAPGLAPPRRTLRRRPLHRPQGARPGRSAGAAGRGKAQRLHLEPVARVRRLRAVRQVRGDVPGVRRRPAAEPEEADPGHGHRPGRRQRREVRRQPLSRQTAGRARRRPAPADRRAGWQGPGRRRHPVVLHHLPGLRRGVPDDDRARRRHRRHAPPPDPGERRHAEQGRRGVGQPDRHRQPRRFRPRRPVELGGRPEPAADEREEERRRAVLGRRWRLRHAQPAHPARLREDPQGSRGGLRRARPGGARQRRRGAPAGRRGYLPEPGQAQYRDPGEIPLHPHRQLRPAQLPCAEERIRRPRRRLPGTAPQHLHRRTAARRHAATGPQQGRQRHLPRPLLPGPLQRRVRGAAQRAARTRHRGQGNATLRLPLALLRRRWRRADHRHPRQATDSRHAHGRHPRDRRRAGGRRLPAVHRDARRRSGAAAGDQGHRRAGSGSADRTGGSAGKKAVAA

SEQ ID NO: 17113 - protein, 333 aa, Pseudomonas aeruginosa
RRKRSCRCMWSSNRHSSSRWSRTWSAAVSPATTRTSSDWPASSPATTARCSPWCSANTRKAPSTAPASTACCTSPAASTTATRPSSEYSPCATWRTSSPRATGCSRTVATAAANWAGAWPPRSASGRPVASGRSRTAAASAAPAPAARTSSAPCRACCWPRRNAPSRSARPAMRFANCTWPSRWRATCHASRTSARWPWTRRGFPWPRPNSFSPAATACRTGRCSTRAAAVLGATEGASRVAVDDGHMPRNRQVGATGTWVTARVYLAVGISGAIQHLQGIGACDKVVAVNRDAGCDMIKRADLSVIGDSTEILRALIRLAEAHRNGAARDAA

SEQ ID NO: 17114 - protein, 202 aa, Pseudomonas aeruginosa
FRHPDAKHTGEPGMALSTHLSNHKLYLLGMLCAILAWGMACIELGANTHLWFSGLSEQGYLQAWSDEMPRLASDGFVLSWSSRALLMLLDYLPTLLSAFGLALTGLFFRRLAKGERWSQRNARTLVHIGLLSFLALLLQPFINTLQGLVLSLDLPDGERVLSVSIGLTSEAAYEFLKAIFLCSFGLMMSEARKLDEEVRAFI

SEQ ID NO: 17115 - protein, 187 aa, Pseudomonas aeruginosa
CRRAKRDAPASPSAARNRASAKASRAWNGRTKTACAKRNGAATTIAARARARSRRARNAWRQAIPPRSATTASAAPATSTAVPTTTAASPTSAAAPSAASSSNLNDRSIPMSRRLFPLLPFLFLVGCAQGYPSFSGILPDVRVSGDERSYAERAEDCLKRRNCPPATDRDPFVADPGHYSLGGSFHW

SEQ ID NO: 17116 - protein, 234 aa, Pseudomonas aeruginosa
PSCCNRTRPCATATTSFSSSCARPPRKTKPCNSPCSSRKKSRAAPRPAWKPWSSASARSNRLAHEPRRRPGPVDPRSGLFDPRAGRRGECPSGRRRVAASGSGRQQAQVSLRHQQRAGGALRAQSLRPPARRERRRVAAPAGGGAAPGGAGRADRRGIRLVARLRTRPIQLPMPARLVVLDQRAGLVARQVAAHDEGIAVVVLAPQAPARFLRRLRRHRVRPSGSKSCASAARA

SEQ ID NO: 17117 - protein, 153 aa, Pseudomonas aeruginosa
TRRSGRTLRPPARRRPRTAPARSAPGPARAGSGRRTPAPPRRAGPPVSSACPVRPTGDCFPRLPPEAALERPVQVESSHLSPFAGRLSGGGGGRQGERAGSGPGLLRRPLAAPAGEQVPGQQQADESGTDVEQQVVHDLSSAAAPRQGAPRPA

SEQ ID NO: 17118 - protein, 391 aa, Pseudomonas aeruginosa
MSGHGDAHNPPHQAIVRPRAHGEIIMSSNFLNPVTTQTWANGRHLVRCVKVIQETWDVRTFCFMADQPILFFFKPGQFVTLELEIDGEPVMRSYTISSSPSVPYSFSITIKRVPGGRVSNWLHDNLKEGQELPVHGPVGLFNAIDFPADKVLFLSGGVGITPVMSMARWFFDTNANVDMVFVHSARSPKDIIYHRELEHMASRIDNFSLHIICERHGLGEAWAGYRGYLNLRMLELIAPDFLEREIFCCGPTPYMSAVKHLLQGHGYDMSRYHEEAFGPTPPEVRADVRELAAEAAEAPEVPVADQHQVEFTATGKSIRVSPGETVHAAAAKLGLHIPKACGMGICGTCKVMKTAGEVEMEHNGGITDEDVAEGYILSCCSVPKGDVVIDY

SEQ ID NO: 17119 - protein, 220 aa, Pseudomonas aeruginosa
WHTSGPPMAISPPSNRRIGSPSGVRSGASPPQALPPAGSGTSSACGAWRSRRRPRSKRICSSTPPITASKPPPSPSQKPGSAWPRAMPPPRTQKNSACCRRYGTLPRQRSMAHSAPSSSAQPSATSGNGRRTPRATSTAIQAISPRPSSNKRPSGLSDIRSSMIHPTFLAKAKGNQGSGQPPEPSRSSVLLILENTRAPRLSTFGLEFHTGVFSPPWRSR

SEQ ID NO: 17120 - protein, 204 aa, Pseudomonas aeruginosa
GGRTQPERAAQGRPLEASVENNPLWAELGKHWKLVALRGVAALVFGVLTLLSPALALTVLVLFWGAYALVDGAFALIAAFNMRSDGQFNWPLALVGVIGVAAGLVAFFWPQLTAIGLLLIIAGWALAMGIFQIVAAIRLRKSIQNEWWMILSGAISVLFGVLMIANPGAGALAVVWVIGAYAVFFGVLLVMLALRLRKTSTLKA

SEQ ID NO: 17121 - protein, 179 aa, Pseudomonas aeruginosa
PRYRWRRPGGCAACARRPPPPARRPRWRRGRRRPWWNSVQSCTPLPPERMNSASAMGIRAGSTATGPRSSMRGRLRATCSAMCSSRTSWRVSLTGSAHSAAASSRRGRARWMSSRPAPARPMQRPSSTCQTRPAGRSPSAAARRRPSSPPPLRLSGNSQWRGASWFSRLRRASIRCSGA

SEQ ID NO: 17122 - protein, 635 aa, Pseudomonas aeruginosa
SSTLSSMHLRHGFTPQRLFCRRFRLFYQRFRYQLGDVLDLRPRRHYAFEHRGALRAADGHQLGAGLADVGHAHVGNPLLAGDVGDRRAATAAATARAEAGALHFLDLDAECAQHVARRLVLAVVAAQVAGVVVGDAAGLAAARLQRAGAQQFVDEGAVVQYLVVAAEGAVFVLQHMEAVRVAADDAGEAVFRQGRDIAPGQVLEGSLVAQPARHVAAVALLQAEHGEVHRGCLEDLHEGAQGALVAHVEGAIADPEQHVGALLLAHQRQVQVGRPVQPAAGGETAGVVGGDQVVQHLGALVRRGAFLQGQVAAHVDDGVDVLDHHRALLDAGPAGGAGPQGVGVDQGLAIQRDDRLVRAAAVLAQRFAWIGAAGELRVVASGQADDHVLDQLLRVQRLAGGERRAHRLALAALHAGVEPEQLVPGEVAGLFHAQRRLRIGQVERLEAGGAAAAEAFGAAVPGQVQGTGEGVLHRPAPGHAEEQLGHAPGHANGEEAGEEPAAEAFRQDPGHRQGGEEEARGERQQALRQAHPGALRQPRRWVEAAAGDEQRADEHQRCGRQQGEAGGSGPCSPETRAPGSPSRPRQDEAPGGGDVGPGHVPVALYHMVQVHQVATRHLPRGRRSSRPWRVGRGAT

SEQ ID NO: 17123 - protein, 222 aa, Pseudomonas aeruginosa
TSTFLPGSTVPSSTSQLLTTRPSAAPQCSFCSRNGCPPLASTTTSGRRSRMVSGSAAVPRRRSMPRRASSSWYQRVMPAIWSRCGALAAVVIWPPSCSFFSNRVTSWPRSAATRAASIPAGPPPTTTTLRFGPADFSMMCGTPHVFAGGRGVLDAQHVQALVLAVDAVVGADALLDLVDLAHLDLGDQVRVGDVRASHADHVHVAAFEDARGLVRVLDVLRV

SEQ ID NO: 17124 - protein, 956 aa, Pseudomonas aeruginosa
HRHVDHFLDAGRQVQERLRREGHVGDDVGQGIVGIAAGADHADEVEHAGIAVVLGDLLHVLVGQAVRVELVAADAHADAEVLADLGAHRLEHLEAELHAPLEATAPFVGALVDPWAPELVDHVLVHGGQLDAVQAAFLGAAGGLRVVADDPPDLLHLDGLAGGAVHRLADTRRRHQGRPVVAVPARTAPHVGNLDHDLGAVLVHGVRQVLEVRDDPIGGQVHRTPPLLRAVDGDHRGAATDGQADAALGLFLVVLHVALGGHPAVGGVDFGVGGGEHAVADGQLADLDRLEHCFEGHDPFLGLQGFDDEQAVFVTVLGAAVDLFGHGAQSAATGGEDLVHGAGEPAGEHVIDLAIDLAVDVDEGGVPQADLGGAFLEVDPLDLEQAPAALGQALHVVLEHRHALQAVTFGFLLAPVPGGLVAGLVEDLGVGVGAQHFLDAHVVVDEEMSRYVEHRQGVGGPDAGLAVDLDGQLGGMFGHGVSSDSFDSLSPFRERGGEREDGCDAMPLPGGRGDESGVGRELLAPDVAQDPYPVLAHHLAHHALGHAALEQGLGEVGEFADGADAQRVDDLAEVGQAPGVALVVGQPLEEVVAVALGEIGADADGVLADDVHHVLDGLGVVVDGRVDAFLEERREHGHTDEAAMIGDELQLLVGLVARVFLEAGRQAVGVADRLLRFEDDLFGSLAADVGEVAHDADPVHLRDDLPTEAGEPAVTLVAAGADQVLGVVAHLHDAHAELLEHLDVADLVLECVGILEAVEDAGLALLLGLADVRGAAHRDHQVAVVADQLVAGDDIVHRRLEAFPYRYGAIGGGQAALAHVLEQFAVPLGDDQTVDDDAVGVQFGWAHLAYPFQAGRAGTCADALGAAYRRGPTRPGPKTTRVVPKASSVRPQRRGAMSRMEQALAARGRQRGVRAPLPARVQRPSSPSDGWLSGRRPSGQRNSRWSSRIGRSLMLA

SEQ ID NO: 17125 - protein, 579 aa, Pseudomonas aeruginosa
ASETRCGSRLFQPSSAARTFCAAVSAVKGGSGGRTSLMAGSSVCGGFRWEQRRAGRARPNDVDPTDPANPASPPWLFARLARPTPERAMMAATGVDKDRPRAMTSTTYLGLLLVGIQVLGFVAAIHAVLTVRTAQGAIAWATSLVFMPYLTLLPYLVFGRSRFDAYIEARRQANREMHLAAAELDWRPWVEEALAARQVSGYKGLKALVRMTRTPTLANNRVRLLVNGEASFEAMFKAISAARQVILVQFFIVRDDALGQRLQQLLLERAANGVEVFFLYDAIGSHALPHRYVERLRQGGVQMHGFSTGSGMLNRFQVNFRNHRKVVVVDGECGFVGGHNVGVEYLGEKPPLAPWRDTHMELRGPAVACLQESFAEDWYWATHSLPPLILPPQYDSEGALCQVVASGPADAQETCSLFFVEMINAAHERVWITSPYFVPDEAVMAALRLAVLRGVDVRLLIPSRPDHRTVYAASSLYALEAIRAGVKVFRYQPGFLHQKVVLVDRDTAAVGSANLDNRSFRLNFEVMVVTVDEGFAGEVEAMLEADFAESLEFTPEDRRSVRRLQQLGMRVARLVSPIL

SEQ ID NO: 17126 - protein, 262 aa, Pseudomonas aeruginosa
PIRSSNWTWPRPGWAASSGPPAMPSTSAGCRSMPSTATASRATSVACPANPACISSACPGCRGAAPRSSGASGTTRAMSPTTSPSSASTSHTATPPSARNRTAPRKLRKPASRKSADAYPYPHSHVQHQGHLPQPVPGQRSLPGRARRQHGVRARPGRHRLRRQPGRPRRPARPGRAGDEERQATAGGSRQRPLAHRQDHHLPDRSALPRAGLSRGRQVAQRGVPDLHRTGGLGPRPAAVADGDRRDRGDSRRLAAMRRRAP

SEQ ID NO: 17127 - protein, 439 aa, Pseudomonas aeruginosa
PAPSTRSVRRATACPATSERVVPFLDGAARDLRPGARHARQPRHPRRPGGLRHRQPRVQPGADRLRPRLPGGFRRRQRTVLRRRRPQGQSLCHHRPQRPWRRLPFRAYRRGAGGRPGLERAAVPAQRARWPPLRAWHGGHEGLPGLRAGGRPGVPRRAVAPAGAPGVLLRRGSRLPGRPFAARGAGAASAQAVAVHHRRAHRAEAGARPQGQAGHALRGARRGLPFGLRAAGGECHRIRRAADRSPRRDRRAPGGAGAPRPAFRPALLDGADRTDPGRPGAEHRARRVPLRLRGPRAAGGRPAAGRRGTPRLCRKRTAAADARGGAKYRYPLHAAIGLSRPAHRRRQPGGGADRPAQRFDGFLHRGLRHRGRAVPPGRYPGGDLRSRQHGPGPQAGRVRQPRSARGVRCPAGAPGGVAAGALSGSTARSWLGLAAKRAR

SEQ ID NO: 17128 - protein, 127 aa, Pseudomonas aeruginosa
SSTSPPAWAATWRSARASSLWSSVPAPTWSVRWSGSGMSRSCCRKSAPWTAAPSISATASTSTSPPLRSCAPAPGASPSWGSRPSWKSSIPATSGSPSRCSRKGCWRIRCSRSAWAFPGARRPIPRP

SEQ ID NO: 17129 - protein, 308 aa, Pseudomonas aeruginosa
RRHRQRLDRPRPGPRPRRRRLGSGAGRRSGVARARCQCLAGLAETGPGARRGAGAPALRREHRGMRGRRRFHPGERPRAARPEARPARQDQRRGAARRADRFLHLGPAAQRVLRRGEPPRALPGRPPVQPGLPAAAGGGGRRRTHRCRGRAGGDAGLRVAGHASAARTQGSARLHRRPLARGALARGAAPGQRRRGHDRRDRRCDPLRRRPALVVHGHLPDLHPGRWQRRHAPLHGAVRPGAAIALDLPAGAGTHRSPDRPGGGGHRRAAGRAQHRRARALPRRLPAGGARGDQGNQGPARLRLRRVT

SEQ ID NO: 17130 - protein, 174 aa, Pseudomonas aeruginosa
RAFRPAGRSATTEPAMSQVLTTYETPVLPEWVDYNGHLRDAFYLLVFSYATDALMAHIGLDSQNRDASGHSLFTLECHLNFLHEVKEGARVEVRTQLLGHDRKRLHIHHALYLPGSGQALALSEQMLLHVSLDGPRSVLFEGEVLARVEALAEAHRALPVPEGVGRVIGLPPVR

SEQ ID NO: 17131 - protein, 345 aa, Pseudomonas aeruginosa
AWASWTKRWMGDACWWPATAPAATWRRRCAWPCAMAARRRRPRRYCSIPCCPLRHRPRGSTAPTRRCSASVMCRRAWTPTCRWRRCTDSRWRYPWRPLISLACRRPSWRLPNSIRCATTASAMAQRYARRVARQGSIREAGWSMAACAATASMRWKPCTRPCGGPCRASWRRTQASARRVSNPPPSTSQANSRAASSSGLRPARRIAERCVPRPRPAIAMARRKVSRSLTWLTSAGGRLTSELSPATSTKPTANQGMVILVAPLCCRRCALSRASQAESRIRKGANIITRTILAITAVSAASMPIERPAATTWATSCTVAPMYTPQVPGSRGSSPQSWSSWNSTG

SEQ ID NO: 17132 - protein, 350 aa, Pseudomonas aeruginosa
VHGPQFPSAPDLLCGGSLRQYHGGGGIHLAVAVGHQRRAQRAGIAAFHAPVRPGRQAPATERGRPPLPAPGIAPARRGGATGAAVRGFRRAPGEPDGGGQQHHRQLRAAAPAGLLRAGAAGREGQRQHRQHRFGGAGRGDLRGGHRPHRRPLPRAGPAGGALARGQPDRGGGARPPAGLAHPGLPRGPAPRALAAARARLGHARGGQPRPAGPPALPGRQPGPGQLRGDQAQRRRRAGHQLPVALGGRGTVGLRRAGRTAQQPAAVAPALLHAAPARQVPLAGLRAFLGTLSGGTRRRLAGFRQKNPPAAPDARRGMKKEPGTALSVSLAFSGSRPLHSASRWRRLWRCR

SEQ ID NO: 17133 - protein, 466 aa, Pseudomonas aeruginosa
STRTISANACRRWASACRRTRLRSRPANTPCAASARSAPRRCGGWWRTCSAGTPRCSRRCARRFPGNCCRRWCRGADKALPAPVDGAGRDAPSDPHAGEGRLALRLAQGRQRRGVGHQRQVLRDRHQHHRLAQRLALALVARRDAEVLAVALGEVRGGDEAADRGHLDDRHGRLLEQLAGADQAQLQVVARRRAVQVLLEQPLELATRDVDVDRQFVEVDRFLQVGLHQRDDLLQLRLVGAEHVLERHALVVLLVADALVDEHLGDRRRQLAAMLAADQVQHHVHRRGAAGRGEAVAVDGEQAGAHGHPGEGFLHRRQAFPVHAAIVAVEQAGAGQRPTAGAHRAEAPTLAGLGLEERDVLAGDAALDADAAADDHAIHRRGVVGTGVGGDLQAVAGPDLAAVQAQRMPAVEFASRELVGHAQRFHRRGQGDQGEVIQQQEADGLRISVLWRNSGRVRGHGCISSR

SEQ ID NO: 17134 - protein, 552 aa, Pseudomonas aeruginosa
RMATARSRVICAKKWRLDRFVSNSGSALDGVHRQAPARGFLVLVVHVGAGVAHGADHLVQRDEMLAVAAQGHLRRVDGLHRGDRVALDTGYLDQPANRVAGQSEVVFQADLGSVLDLRRGGAEDFRQAGGGHRAGRADLALAADLGAGDRGVLLAQDAHRGGGQQVVDDVAVLGVGIELHIVVQHRRDDPRRAVGGRGDHAPAGGVLLVHRQGEQVDPFHGAEGRADHVGLADLLQVAVQARGAALHVEPAGKDAFVAQPVVDAIAHRLPDAPQAFADVGLAAPDAFVGQHQLGYPQVVALAQQQQFLGAGEVVGQHRVVLVELSRGGLCRIDHEAATHRVVGLLVQFALLAVGDQGHGVGVVGQVLVEQAHVAHPVERYRHAAVQLQQAAIEQRGHAWGDLGRVDTIRPFAHQAHDHRAIGAVADAGGGQRAIQAHFETPHRRQRLALAQGSGEQRGGAHGADGMRTGRADTDLEKVEHTDSHAGLRDCRGIRACVVGVAAPPPAIPAHHRAFPGAGRIRHRPGHVQKRRVRARIGEPLRPRGVCTCTASE

SEQ ID NO: 17135 - protein, 283 aa, Pseudomonas aeruginosa
WTLIMFLTDHKLPLGEQIAGFVDWLTLHGASFFDKISDTLEFLIHGVTNGLLWFNPLVLIALLVGLVHFIQRSWGLTVFALASLLLILNLGYWQETMETLAQVIFATLVCIAVGVPLGIVAAHKPWFYTALRPLLDLMQTVPTFVYLIPTLTLFGLGVVPGLISTVIFAVAAPIRLTCLGIQDVPAELLDAGKAFGCSRWQLLTRIELPHAMPSIAAGITQCIMLSLSMVVIAALVGADGLGKPVVNALNTADISLGFEAGLAIVLLAILLDRVCKQRAVKGK

SEQ ID NO: 17136 - protein, 393 aa, Pseudomonas aeruginosa
AMTAIRFDHVDVIFGTHTKEALKLLDQGLGRAEILKRTGQVLGVEDACLDVNRGEICVLMGLSGSGKSSLLRCINGLNKVSRGKLLIEHEGSQVDIANCSPATLKAMRTKRIAMVFQKFALMPWLTVAENVGFGLEMQGRPAAERKKLIDEKLELVGLSQWRDKRPDSLSGGMQQRVGLARALAMDGDILLMDEPFSALDPLIRQQLQDELLVLQRQLHKTIVFVSHDLDEALKIGTRIAIMKDGRIIQHGKPEEIVLSPADDYVRTFVAHTNPLNVLCGQSLMRGLDQCIRQNDEICFDQGRDCWIGLSEGDVLKGARQGSNVIDLQRWRQGDPVEKLRREPTLVDVSIRMRDALQIRYQTGHKLVLQEQDRVVGVLGDSELYHALLGKNLG

SEQ ID NO: 17137 - protein, 212 aa, Pseudomonas aeruginosa
RRSVPARTHRREEIAMPKVGMQPIRRSQLIHATLEAVDQVGMGDASIALIARLAGVSNGIISHYFQDKNGLLEATMRHLLSALSKAVRERRAALYDDSPRAHLRAIVEGNFDDSQVNGPAMKTWLAFWATSMHQPALRRLQRVNDHRLYSNLCYQFRRQLSADDARAAARGLAALIDGLWLRGALTGDAFDTDEALNIAYDYLDQQLAKQSG

SEQ ID NO: 17138 - protein, 510 aa, Pseudomonas aeruginosa
GRKPPRRRLAPAIPIREDCNMARFEEQKLYIGGRYVEASSGATFETINPANGEVLAKVQRASREDVERAVQSAVEGQKVWAAMTAMQRSRILRRAVDILRERNDELAALETLDTGKPLAETRSVDIVTGADVLEYYAGLVPAIEGEQIPLRETSFVYTRREPLGVVAGIGAWNYPVQIALWKSAPALAAGNAMIFKPSEVTPLTALKLAEIYTEAGVPDGVFNVLTGSGREVGQWLTEHPLIEKISFTGGTSTGKKVMASASSSSLKEVTMELGGKSPLIIFPDADLDRAADIAVMANFFSSGQVCTNGTRVFIHRSQQARFEAKVLERVQRIRLGDPQDENTNFGPLVSFPHMESVLGYIESGKAQKARLLCGGERVTDGAFGNGAYVAPTVFTDCSDDMTIVREEIFGPVMSILVYDDEDEAIRRANDTEYGLAAGVVTQDLARAHRAIHRLEAGICWINTWGESPAEMPVGGYKQSGVGRENGLTTLAHYTRIKSVQVELGDYASVF

SEQ ID NO: 17139 - protein, 597 aa, Pseudomonas aeruginosa
PGRSQATLPDTGHSELPDTGAPASRPVSCREKRKACMSQEFDYIIIGAGSAGNVLATRLTEDADVSVLLLEAGGPDYRFDFRTQMPAALAFPLQGRRYNWAYETDPEPYMNNRRMECGRGKGLGGSSLINGMCYIRGNALDFDGWAKEPGLEDWSYLDCLPYFRKAETRDIGPNDYHGGDGPVSVTTPKAGNNPLFHAMVEAGVQAGYPRTDDLNGYQQEGFGPMDRTVTPEGRRAATGRGYLDQARGRPNLTIVTHALSDRILFSGKRAIGVSYLVGNGDNPVTAHARREVLVCSGAIASPQLLQRSGVGPAALLRDLDIPVVHDLPGVGANLQDHLELYLQYACKQPVSIYPATKWWNQPAIGAQWLFLGKGLGASNQFEAGGFIRTREAFEWPNIQFHFLPVAINYNGSKGVQEHGFQAHMGSMRSPSRGRIHLKSRDPRQHPSILFNYMSHEQDWQEFRDGIRLTREIMNQPALDPYRGRELSPGVSVQSDAELDEFIRNHAETAFHPSCSCKMGSDDMAVVDGQGRVHGMEGLRVVDASIMPLIITGNLNATTIMMAEKIADRIRGRQPLPRSTAKYYVAGDAPVRGNPVRA

SEQ ID NO: 17140 - protein, 535 aa, Pseudomonas aeruginosa
PGAAPGVARRAAGRSTPARFHRWPGAFAPPARPQRLPAAGRAGRRRPRPVAPLRRRLARARRLARIRPLPRRLAALLRAGAGGVRWHGLAAVPHVALAGRSAAALERRRLRLAVGGREGRRLGLRFPLRGHAPRRGRARRVQPRRLPADRVGHRLGQPGGANDLVGGRSLPGADPARPALRGKRPGTGPVAPAAARRARADVASLPRRPRRVPVLRQLRRRPVLPLRGDGALRAGPGLAAEGSRRAAAGLRRTLAAGRGTAAAALLGAPGVSLAPSVVDDHVALGHAAAGEDVAFGDILVGDPAVVLHLHLAGGLHYLAGAADAHPAGLRNVQAELGGGGVHGFPGADADALAGGGEFHLVLVGDRYLRRLGGFRGQFPDVGADLRRSRPEGFLVVAAHVVAVALQQVLHRAHIGRRAAAEDFPLEEVRGDQFQHAQVQVATVAGPGFAEAVALADDVQAEVVDPRGHVLQLAVVDDVLRRTGAVDEDHVDVGVGVEEPARHGHHRGDADPAGEEQHLVGREVDGVEQADRTVHR

SEQ ID NO: 17141 - protein, 485 aa, Pseudomonas aeruginosa
GVTDGRHFHPESRRSPGTGPQGHRRHAAQPRPQLLAAAALLLRPAPVRDRHAGDLPQGMADRRHDLRDSRQGQFPHPADRQEPGPGDPWRRRPGACFPQCLPAPRLAPVRERERQGGQAGLPLPPVDLRAGWPPAVRRHRDGRRLRHEGVRPEADPGEDRRRLHLHQPGGEPAGHRRLPGDARALHGAVRHGERQGGGADHHPRSRQLEAGDREQPRVLPLQRLPPGTAEDPAGVGRRHRPARQPGVQGPGGGLHQRLGRREDPVRPCQLRPAQSHRAHAAAGRHGVDDHGRQAGQQEAHGPDQEPRPRLDAHPAPAALLEPLHGRPPDRLHRVADQRPGNPGHHQMAGAQGRGGRRRLRRGAPARGMGRDQRPGSPAGRGEPARDQLRRLPAWSILEDLRVRRDQFPRLVQRAHAEQPRRGVRPRAQGGRQLSRTRRPLAGRRCGGKVMDNLLFYVSSAFVSLLLAWNLFACWRRQRPPEKSRP

SEQ ID NO: 17142 - protein, 62 aa, Pseudomonas aeruginosa
RPDAVAAKPAEETRWCLWRQDDNGNAFVMRRDLTRDEACALVKDYQARGHRQLYWASPQARD

SEQ ID NO: 17143 - protein, 402 aa, Pseudomonas aeruginosa
PARRIPPRPAAGAAGRAGCPRGRRRRGRCSGRPRPARRDRPAARRARRPGAGPVRRRRCDCPGTASGAGRAGSPGCAGRVFAARARSRRTRRRRGAAGGRRRRCRRRFPCVRRTPRRAPRRRCRRACGPVRGGPCRGWRDGRRPCPGPPRRGMPVARPHAAATALPALRWRGARRCPAGRRSDRCGGCRWGRGSRRRAGSCGSRRGGPSSAPRRLGRTAWPHAADAGGCGRSIRRVDRDGRYRSCGMLPVAAATRSCGPLPGGRGRYPCCPGQQRVRCEARHSHQCTSATASRRNGFFAGASACSISASATSSAMSLISGRGATTPSSIAVHCGQPTATSSAPVSRMSAMRMSGIRCLPGMSVIGAPPPPPQQRERKPERCISLTSMPSARSTLRGASYSPL

SEQ ID NO: 17144 - protein, 93 aa, Pseudomonas aeruginosa
YLAICFMSSWDRPSGWNSSPQMRMPTQKSSPTSARTALSTSRPNFMRPSKLPPHSSVRLLTRGLQNWSIMCWCTADSSTPSRPPSLARRAACA

SEQ ID NO: 17145 - protein, 72 aa, Pseudomonas aeruginosa
SWCSSSSSATTPSASASSNCCWNVRPTASRCSSSMTPSAATRCRTAMSSGCARAACRCMASAPAAACSTASR

SEQ ID NO: 17146 - protein, 232 aa, Pseudomonas aeruginosa
TECGHHATAEQERPESEEPSHDRPESHRLALAHGRDRGKDRHPRRRRRPGRRGDERAPEPARRAAPGPGAQPHRRGLAQRTLGFAGGQRPGLARPLPGNGIRHRSRRFPRQGPGGGLFRGLREEIRRADPYRRRGEEGGAQCRPPRLHRGNLRRDHRGQPRGRRHWPVPASGDPADRAARRAYPADPLGPLLQPAAAARRCGTGGRRRFVGGTDRRRAATCRAPGLPLGGRS

SEQ ID NO: 17147 - protein, 274 aa, Pseudomonas aeruginosa
PAGRARGAPPAAGPAVRDRSDPRTGPGRGRGGQHHLGHRLCRRLRLAAGRCLRPRRQAAPPAWRVQRTRRVFHRPALAVAARLLVHLGRLARRAPCRRPHRHPAQVPRIPRRRPAPGTGPRLASSANQPPGSQLMPTHTRIRMFNTKDTYPNQSLDNDLCQAVRAGNTVYVRGQVGTDFDGNLVGLGDPRAQAEQAMKNVKQLLEEAGSDLSHIVKTTTYLIDPRYREPVYREVGKWLKGVFPISTGLVVSALGQPQWLMEIDVIAVIPDDWQQ

SEQ ID NO: 17148 - protein, 632 aa, Pseudomonas aeruginosa
GGARHDLFHRRPLRRNRPAGHRHQLVEHRRRRPLSLAARRHRRGGYAEHHPAGARPADPRPPRPGPGPWRSAGPGAEQQRLWPVSPGHGDRPARPHRVVHRPRGARRPPCAGRRTMRGGRQPAGRAGSDRGDGGCLRERRRPARRAPAGGDACRAGRWWRSRAGAFGGAVGGRRPALAGGRPARRLGRARPHRPARATVARLQAADAGLCDPRPRPDPCAELRRARRRVSGSFPSSTAQRETCALEPDMPGSRDILADLVAFDTVSRESNLALIDYVRDYLAGFGVDSELFFDADGRKANLYATIGPSDRGGVCLSGHTDVVPADGQAWSVPPFRLSERDGRLYGRGTADMKGYLACVLAAVPAFLAAPLRLPVHLAFSYDEEVGCLGVRSLLAALERRPHKPLLCIIGEPTELKPVLGHKGKLAMRCEVHGAACHSAYAPQGVNAIEYAARLIGRLGEIGARLAAPERHDRRFDPPYSTVQTGLIQGGRALNIVPAECRFDFEVRALPADDPRQVAEELRDYAESELLPRMRAVERSTDIRFTPLSAYPGLLTADDSQAAELIGLLSGSTDFSTVAFGTEGGLFHQAGIPAVICGPGSMDQGHKPDEFVSLAQLEACDALLARLAAWLREP

SEQ ID NO: 17149 - protein, 450 aa, Pseudomonas aeruginosa
ARASGRGRRGSGWPLAVAPRRKRSPLPRSRAAGETRSPGTWGAPGLRLRSLCVAQARRSWQWPGRCSARAGRRSALRRRPGCVPWSPGSVSQGAGTHLAEKQSIAARGETDEDDDSPAGLRPADPGQWRRPGRRTRAVPHGAPGHGELDRRGRQQRRGRGLARRPGLPGEADQRLATDRPGRPGRQAAGPVPRLLATDHAAGRQALPGQRPDRSDRAADPGRRAVHLCGAELRRRGRAEDLRRHRPLQGQAWRPHLRYRAGQRLEPHHPEDDRRQPFRPEGLPAGGVQRGRDAHGGEAGDQAQAVGGVLRLEAASDEPADRHDLPHRQRGCVRSRRRRGHRLHHDRRRLPGAVRQRRPAAAQPALQQRPGQPGDGADPRSHPAPRRRAPVAEGQPRAAEGLAGWREHLRRQGRPGRAPGLAEVTRTYPFRPARPGGASYTPNTGSYHREP

SEQ ID NO: 17150 - protein, 629 aa, Pseudomonas aeruginosa
SHRHLRGDRRRRYRRPASGDPGHSETDCRGRHRGGQGRRHRRPLPRPRPRHRQAQSRRGAVPRSGRAYPRKRHRRDHQPHRRHGRRPGDRQGRAASGVRCRHRPGRSAGAAQACRGAAAGNLHPGLRHPQFRRRRVHLRLHPCAAARRRPAHHRAGGQGRAGNLRYRPPLVRQADAQGRAAGGSAVPDLPGHSLGRAGRYHDHEGDGRQPAAGGDLGRLRHRPHADADGRPGHVAGRQRAGRPGGQHLAGQGRAGEQRQPGGARHRDHRAPRRARPEPGGRAPQDEPEAALISSSPPRRGREQPLEMSMSFVTEIKTFAALGSGVIGSGWIARALAHGLDVVAWDPAPGAEAALRARVANAWPALRKQGLAPGAAQERLRFVASIEECVGDADFIQESAPERLDLKLDLHARISAAARPDVLIGSSTSGLLPSEFYAEASHPERCLVGHPFNPVYLLPLVEVVGGERTAVEAVRAAMRVYESLGMRPLHVRKEVPGFIADRLLEALWREALHLVNDGVATTGEIDDAIRFGAGLRWSFMGTFLTYTLAGGNAGMRHFMAQFGPALQLPWTYLQAPELTEALIDRVVEGTAEQQGARSIAELERYRDDCLLAVLGAIRETKARHGFAFAE

SEQ ID NO: 17151 - protein, 220 aa, Pseudomonas aeruginosa
SACRRCAERDGCEVSAVSGDVALRRAQPGVRQRQSAPGCATCGLRADVPGVRAAAPGRFAGARLLLAGRAAGARAPLSPRPPGTARWLAGAALPARWRLDARRPRFTRFHLRRPGGAPGPAGAGGGLPTGAGASVPGGIAGLPACLAGAEPGRAGRSAGWATPAGGRRQRRRQPGGGAVPGPARWRRAVAGRADIALSLAVRCAIALADRLRRRAVARPR

SEQ ID NO: 17152 - protein, 182 aa, Pseudomonas aeruginosa
SWSRRCAAGGAPCRVPARPRAGSGRAPTSLPGPSWRSLRYPLPRCRSSDPRRPPGPPRAPWHRCTRPRCQGRAVAAPSPGRAGTAPDRGRCPGCRTPPRWKPPPRPVRRGHARPARWPSPRRRRRSNCRRRSAGWWCGPGRTAGCRAGTPGRRCWRASGRPAARRAIRRRRCPGRSGAGRRG

SEQ ID NO: 17153 - protein, 306 aa, Pseudomonas aeruginosa
IPEKQVGESMALSFRQLQIFCAVARCGSTTAAAESIWLSQSATSAALNELESQLSTRLFDRVGKRLQLNEVGRRFLPQALRLLDGVAQLEQQFAVSAAPQASLTVAASSTIGNYVLPRLLASFEREQPGVRVNASIGNTGSAVQDVVTFAADIGLIEGPCHEPGLRVEPWLEDSLIVVAAPGHPLASRTQVSREALRRARWLLREPGSGTREEVSHALLGHLHYLEDSLDLGSSEAIKHSVAAGLGISCLSRWVVEEQLASGALVELRSSLPPLRRRFYMLRQRDKFLSPGFERFWEHCRAGLGAG

SEQ ID NO: 17154 - protein, 217 aa, Pseudomonas aeruginosa
VWRFPEAVRCIPQAAGGDCGGVASGRISRKRPAHVQAGQPPCRERRGLSRIDGNPHRRSCRDDARRSDRPGRFPRTPAGAGLQRAAGLDSGAGLRIRRARPQPGARPGAAAAGGGHARRARHAAPGGARGDFPAIAAGAGAAGLTRPCPLPWTGRAGTRRQIRTLAKVDSPCAWLRADSAEELGINARSCGIGISTTGWPSGWPWRSSRGGMPKYSR

SEQ ID NO: 17155 - protein, 144 aa, Pseudomonas aeruginosa
AIPVQHSMAFTARPPREVSLYLSCMSAPVSRMVRITLSSEMKCWPSPRKAICAALMAFTAAIALRSIQGTWTSPPTGSQVSPRLCSRPISAAFSTCAGVAPRTSARPAAAIAQAEPTSPWQPTSAPEIEAFFLHRMPTAAAASR

SEQ ID NO: 17156 - protein, 133 aa, Pseudomonas aeruginosa
GRFSSSRRMSRTQSNGTAMRPSSCSRPLSSSAAMRGAIWVGSIRSGHSPIRPMITARSVPWPTPVADSEPYRRTSRRRTADSAWRWRRAVVNSAAARMGPTVCELDGPIPILKRSNTLIAMPASGIAAASVPA

SEQ ID NO: 17157 - protein, 356 aa, Pseudomonas aeruginosa
ATDASCFMIVHELPAEGRYRSARYRQTAAPFGVAPAPYPAEEFAMKGCKSWLLAVSLCAPLAAQAAEPESCASVRFADVGWTDITVTTAVTRQVLESLGYKTKVNLLSVPVTYRSLANNDLDVFLGNWMPTMTNDIKQYAEKGTVETLRANLEGAKYTLAVPQYVYDGGLRSFADIAKFSDKLGNKIYGIEPGNDGNRVAQSMIDKNAFELGKFKLVESSEAGMLSQVQRAIRRNQWVVFLGWEPHPMNTRFQMKYLEGGDDFFGPNYGGATIYTNVRKGYAQECANVGQLLKNLSFTLEMENKLMDAVLNENKKPEEAAKAWLKDHPEQLDAWLAGVTTRDGQPAAAAAKLAFAK

SEQ ID NO: 17158 - protein, 249 aa, Pseudomonas aeruginosa
CVASTSASGRTTRSASTRAATAGSVSAKATCSRARARAATSSTCNAGARATRWRSCAANRPWWMSASVCAMPCRFATRPATSWSCRSRTGWSGCSATASCTTRCWARTSADPPRPARGRYECPALPGIRVYPPRFFRLFFLSHAPARRFLRHAPGAGWQKRKARRNAGPSTHLIGEGALAAPGSGLGLGWRRHRLVGAAVADLGLVVGAHGLVQAEHEQDQHRRERQPGEHHDGLHRREVAGEQQADGD

SEQ ID NO: 17159 - protein, 475 aa, Pseudomonas aeruginosa
RDDGRPEDTQPVRRVLVQLAAAAREIGQHHRAGIRRGEEQHEADEDRQADDDLRQRIVFQQQVDRHRRLFQRGLAQVGRAVVHHQVQGAVAEYRQPGQGEAQRDQQHPADQFAHAATAGDAGDEHTDEGRPGNPPGPVEQGPQAQPFLALAGAGTGVDVEVEGLQHQAVEIVAEVLYEAVEQFQGRTADQHEQQQRAEQHDIQVGQPADAFLDTGDRRQGGDQAHRQDHRQQGAFAVRHAGQVLETGRHLQGADAQVGHQPEKGDEDAEAIHRVARGAFHPALAEDRIERRAQCQRLAMAVGEITDGEADQGIDRPTVQAPVEEGQLQRLARRLRAAGNAFGWMVEVVDRLGCGEVEQRDADPGGEQHAGPGAVAEVRLFMLLAELEGAEAREGHPGDEEQVGADGQHVVPAEAVRQPRLDAAEQGSGAVGIEDEGGGQNQDQCGRAEEHDRIQTYLLVCFYWRSSTHWRMTPWQ

SEQ ID NO: 17160 - protein, 189 aa, Pseudomonas aeruginosa
PRTWPAPTAPSIAWKPASAGSIPGASRRRKCRSAVTSNPVSVARTVSPPWLITLASSPCKWSWATTPRCSEPRRSARTPNQAGPRQRSLTPAIPNFQTPARQRRGRCHAEKRGRPACPRNSTTSSSEPALPVTYSLPASPKMPTSASCCSKPAVPTTASTSAPRCRRPLPSRCRGGATTGPTRPTPSPT

SEQ ID NO: 17161 - protein, 177 aa, Pseudomonas aeruginosa
ATASCSAASAPSASPTWWATATTRSPPTPAAKYWCAAARSPRRNCCNAPASARRPCCATWTSRWCMTCRASAPTCRITWNSTCSTPASSRCRSTRRPNGGTSLPSVPSGCSSARASAPATSSRPAASSEPAKRSNGRTSSSISSRWRSTTTAARACRSTASRRTWARCARRAAGAST

SEQ ID NO: 17162 - protein, 189 aa, Pseudomonas aeruginosa
REQSRHAIRECSRGAGPASIDPQRLQDPVPLRPGWSAGVLRLHHLRVLRHRGRQAVLPGGHAGMAASAANLRPVRRRLPGAAAGRRDHGPLRRPARAQAHVHPEHLHDGGADPDHGPASDLRADRHLGAPGAAPAEGDPGRRDWRGGAGGLGLRRRACTGTACRLCLRDADFRPDGGHPAGLAGGYCDQ

SEQ ID NO: 17163 - protein, 825 aa, Pseudomonas aeruginosa
LPLAFARKVGWIMDDRMSDKPLGRLLLEGLGEIAWIAVLVALGVLLPLPLVALGWALLLGAEWAMDRWRGKVPYRLQQALFFWVLGGGIALGQALPGFWLGLGGGLLAVIGGVLLQIRFERGLRLERQAPQALDVPLPAGGSAWGGEAPERTPEGEPIRLFDGGEIAMGGPLVCHYLMPDGCFIPDCNPSARFSSDGRHFVSPIPSRGAWGLAIFDRQERLLYRCAVDNFWELDSVTEREVIGRHSPLTSNAPQRLELQALKAGSEAEAFVAIGDLWLPESEWQRWSGDLRAQPLPSPLGGPALEIRPWLPDSLLALDDPFAPLRANRGELWINGEASGLYLSREAPPLAWNDDGRALALQAAGEPLGQDTYWLWREDGGLRALGAPWSALPAEPHAGGPELLGLEDGWLRFGLDLAQPCLTYERYGTLGSYSHSSLYLLHARDADDRPRWREADMPRLDLLLPLDGAAGRPGCLLQSAPLADGSRAVWEWLRDDQEAERGAYALRLGDWRLDGEWTLDHRVSDCGRYLAVVAFAEAPTLPQRLAILDSRERRLEWLAEPLADLHLQGFIDGQVHLLHLLGRNAYQPPGGPGEGDPGLLRRFDEGLPEPGAWHAFGRFHDDWRHYYEQARVAFDGTAWRLCPTSRWLDAAPRPWSDGDFVLPSVGAKDAAWGFGFHYEGMHRDEDVRAGFSRDGYLLTASGIGLGNLAAPMIWSADGRYLALTRHVQRYEESDLERDQWRLLLLDVQERTLRRYRDDLGEYPCFDSFDDDLCFRCAGTGRYVLALDSLLKAPAEPLQACAGRWLPAEELPRRRYWERLAFPSRPQ

SEQ ID NO: 17164 - protein, 449 aa, Pseudomonas aeruginosa
QPYQPLFPPPPARGRHEELPMDVTSTLSLGDPLEPARKATADMLRSRDHSFSLPQPFYCDQRLFEIDMQEIFHKEWLIAGMTCEIPAKGNFLTLQIGKNPVLVIRGAEGQVHAFHNVCRHRGSRLCVSEKGKVAKLVCPYHQWTYELDGRLLFAGTEMGADFDMKEYGLKPIQVKTAGGYIFISLAENPPAIDDFLATLEHYMEPYDMENAKVAVQTTIREAANWKLVIENNRECYHCNGSHPELLKTLLEWDDVTDPRASQAFKDQVAACTSAWDAEKIPYAHASFGLRNRIVRMPLLDGTVSMTMDGKQGSKKLMGRIKNPDLGSMRILHLPHSWNHCMGDHLIVFTVWPISAQETLVTTKWLVHKDAVEGVDYDVARLREVWDATNDQDRRLAEENQRGINSDAYQPGPYSKTYEFGVINFLDWYSERMLNNLGEESAHVRKVAGS

SEQ ID NO: 17165 - protein, 414 aa, Pseudomonas aeruginosa
TRAVTQVPVAPTWRLRGMCPSSTATREAPSVAPRTAAALVEQRPVLHAVAAGENEFGLGHGNPRRVHGHRAEVLDAWQVARHLLGHVQFANLMAGLADRLGAFRRGQQQARQGALDVLAAGAGAADAAAVLDLPDATGRPLAERGGQAPAQFAAAVATVREQPVARGELVLQVAQGEYSLLGRVAVVLAAGEVQQAVDAGAVEGAFLVFAEHHGEHRAVVAGELAGQSEEVLVVAGETAADHVRDHRDEECRLLDHMQRQLRFLRYAGAARAAALLAAGAIDAADAVGAEEADGVRVLADHAVGAHPAHLAALGGLHGRMQRMQAVAGDPFGAWIATDDIVHAECFLWLRLPDPAAPSLEGEAAIRAAPVSSGFDVKLDTLINAPPPRLHAATAFLPALPPVLSALPLPARRCP

SEQ ID NO: 17166 - protein, 151 aa, Pseudomonas aeruginosa
GSSRRRAGCAGCACRRRHRRPRTARRRSSSRSSAAGSGRPPSSTGRRGRNRRGCRWRSGCPTPRRPCSAWRLSPGSGGGACRRWRRRARSSSGTPRRRPGRWCRTTGCRRRPGPCHPARRSAGAGRRRARPAVCLDRGCRRTSRRCLRPGR

SEQ ID NO: 17167 - protein, 592 aa, Pseudomonas aeruginosa
GRWSGRRRSVRRGGARPGAGHRRRRASSARPRSCRGTARTRPRPRQWRGGRRGTSRRSLPAGSRPPAGWRGRSSRRTPAGSSAGASRGPSTAATVGRGGGGRRTARRRTSALWPPAGRSRRIRPVQPRNPCTRIAQQAPPGRSPRRWRRGSWTCTCRALPHGAGPPGSDAASAKRPPIQSTLAGRPRRHMRKRFAAPSTASARAAKSRTGRRVSSISGLPAGRQAALDRPPLPLAGEGGRPCRSDATRRVLEILAQAQRVIDRRMGVALGHAVADAEQQVAFSGLAEAGLRLDREQRLDVDLALVPRALLERVVEALVGAHAVFHHHLVDHPLFPRAGVFVLQHRHQLVALAVDLLQHEVAGHDHFLGIHAAVVGGEGGAADGHARLDVVGDDLHLGALVGEEVRHRHAAELADGVVDQHVLAWLDRAVEHVPAAHHQAFGGAPVFVLLEERMSAVGQHHHVRAQVEDGLGVGRGAQAQVDAQARQLQLVPTGDAGDLVALRRLGGGGDLAAELLLLLEQGHVVATLGRHAGRFHPGRPAADHHHLALRSGGLLDDVRHAPCIRGRSRRSGCTARPGPGTGGRCSSWRRRTA

SEQ ID NO: 17168 - protein, 256 aa, Pseudomonas aeruginosa
RCCRRAIRLGSSGIPLSGWARRDLCRRFGGSISSGPDATRPENDQGRAESVKRATATTGGNVADGTGAGRPGPATGSARAPAGAGSEAEFAERRMVVRPAPQRPAEQPLVLADRQVVDAGVTFVHQSLLVERPVLVAVGAEPVARVVVPFIGEAHGDAVAGKRPEFLDQPVLLLALPLAAEEFDDPLAAADEGRAIAPDAVGTVGQRDALRVAAVPAVLGGADLLRGGFGGEGGKRGTDVAHGGLLGLRWFSMGTA

SEQ ID NO: 17169 - protein, 219 aa, Pseudomonas aeruginosa
RRSHGSCQSRLAPLAVCQAGQTYPGEGYDGRHRSGQGSTSRNDLHHLPRPAAGRYPGTRLRRRHPCRAHRAHRPGRDRLGHLVGIHAVPDPAAVPGVRSQPFRRLHRGAAPGQPRDAPGGRRAGLASLGRGGPGGPPGQRLQGAQGAGADDPHADPGEQPGAPAGQRRGQLRGDVQGDFRRPPGDPGAVLHRPRRRPRPAPPATAAGTCGQRRRGVLPL

SEQ ID NO: 17170 - protein, 485 aa, Pseudomonas aeruginosa
PATTKIIISLFPGSEQNAAITQPQNKNDQSPRNRAMTDLNRTALPSRTDGTVEKTDTLVVGAGQAGVAMSEHLSRLGVPHLVLERNRIAEAWRSGRWDSLVANGPAWHDRFPGMEFDIDPDGFPGKDQVAAYFEAYAKKFDAPIRTGVEVRKVVRNVGRPGFTVETSAGTIEANRVVAATGPFQRPVIPPIAPRDERIRQIHSAHYYNPQQLPEGAVLVVGAGSSGVQIADELQRAGRQVYLSVGAHDRPPRSYRNRDFCWWLGVLGEWDAEVAKPGREHVTIAVSGARGGHTVDFRALAHQGVTLVGLTESFVDGVATFRPDLAENLARGDENYLALLDAADAYIARNGLDLPEEPEARRRLPDPQCVTDPILELDLAEAGVGSIIWATGYAVDFGWLQVDAFDRDGKPRHQRGVSSEPGVYFIGLPWLSRRGSSFIWGVWHDARHVADHIAIQRKYLAYRDAAQRQEQDRASQAPQTSLQEVS

SEQ ID NO: 17171 - protein, 236 aa, Pseudomonas aeruginosa
FPTTGSNEEARAMTFSIVGRCAETGQLGIAISSSSIAVGARCPWLRAGTGAVATQNITLPALGPQILDRLDQGLAPGEALDQALSSNGYGQYRQVTVIDQHGRTALFTGREALGVHHARAGEQCVAAGNLLAAPEVIEAMVDAFENAEGLLAERLLAAMRAALAAGGEAGPVHSAALSVVGDLLWPVVDLRVDWAEHDPIGQLERLWLAYKPQMQDYVTRALDPIRAPSYGVPGDE

SEQ ID NO: 17172 - protein, 283 aa, Pseudomonas aeruginosa
HAEVGLAQQLAGLVQAQAEVEVRGRVVQVHAEQPFQLAAGDLDALGQLQGGQWRLGMPLHLADHLHQLAVAHAIAGRHLQALVVLARADAAEHELLGNLHRQLRTVGLGDQVEHQVDGGGAAGRGDARTVDLEQLLGHAQLRVGLLEGVDGFPVQGRAAPVEQTGLGQHHAAGIDATEGHAVAIELAQPLHQGRGDRPQRLETGHHEQQVAFLQRLQRAVAVHRHAIAGQHRTAVGAEHVPAVEVGVEAVGHSQWLHGGNEAHYREAGQQEKPEVLGHGALRG

SEQ ID NO: 17173 - protein, 318 aa, Pseudomonas aeruginosa
PHEGRPMKTTIRQLGCALLILASGAALAAEPEQCRTVRLGTVNWTDVVASSAVAEALLDGLGYQVKQTSASQQIVLAGLADKQLDLFLGYWQPTMQPVARPYLDKGRIEVIEPPTLADAQSTYAVPSYVAEGGLKTFADIARFKDKLGGRIYAIEPGSGSNRITRKMIDDNRFGLKGFQLVESSEAGMLTAVKRAIKRKQWVVFFGWKPHPMNLQIDMTYLTGSEDVFGPDEGAATVSTMTAAGYQAQCGNVARLLHNLRFSSAQVSQVMAPILDRTQPLDAARQWLKANPEPLKAWLDGVSTFDGKDGLAALQASLK

SEQ ID NO: 17174 - protein, 318 aa, Pseudomonas aeruginosa
PAPIRSARRGRAGLRTPRIQEATTVNHEVIVTCAVTGAGDTVGRHPAIPVTPKQIAEAAIEAARAGATVAHCHVRDPATGKPSRDVALYREVVERIRESDTDVIINLTAGMGGDLEIGKGEQPLEFGAGTDLVGPLERLRHVEELLPEICTLDCGTLNFGDGEYIYVSTPAQLRAGARRITELGVKAELEIFDTGHLWFAKQMLKEGLLEDPLFQICLGIPWGAPADTTTMKAMADNLPPGATWAGFGIGRTQMPMVAQAMLLGGNVRVGLEDNIWLDKGVPASNGSLVERAIEIIERLGGRALSPAEGRRRMNLKPR

SEQ ID NO: 17175 - protein, 113 aa, Pseudomonas aeruginosa
FLPPRPVGGGNNLWRCPCPSSPRSRPSPPSVAASSAAAGSPAPWPTASTSSPGIRRRAPKRRCARALPMPGRPCGNRAWRPARRRSACASSRASRNAWATPISSRRAPPSGST

SEQ ID NO: 17176 - protein, 414 aa, Pseudomonas aeruginosa
GEGGRQGRGAYATARSRSQAPAYPPCPVPAWQRAGAGAERADAAPRQPRRPALGTVRRRGAGAGRGARRGTSRAPRAGRCRSGDRPAAGALSAMAAKYPLSPAMWRFVEHSRAFASDSPRLDAQRAAYARMCQAFAPPRPAGLRVLDSCLPAAPPVRVRRYRPDRPAPPGGWPALLYLHGGGWMLGGLDSHDFICADLAARLGLLVLAVDYRLAPEHPFPAALQDCLRAWQALSLGELDEALDGRRLLVAGDSAGGNLAAALCLALRDGGAPSPAAQILLYPLLSAAPSPSRIDCADAPLLGLGDVQACLDAYLPLAALHRQPLALPLEAADFTGLPPAFVAVAEFDPLRDDGERYGAALRAAGGEAGFYPGSGLVHGCLRGHGIDEVEALHEALRRAVQGFLAEDSGERQAGE

SEQ ID NO: 17177 - protein, 140 aa, Pseudomonas aeruginosa
QGGQQQRLEAGAADRREVRAEAEAGHCHGQEEGVEVVDVADQRRRQADQRVEPGDQYEADGEPGNGDLGRAAVLPAVRLVACQPGREQDQEGRQHHYPDHLGDHCGIRCLDADRATRGDHLGHLVHRGTDVHAPGARVAR

SEQ ID NO: 17178 - protein, 201 aa, Pseudomonas aeruginosa
QPPVLVELEQHRIEEDAQGAEHHHGGNRHRDLFGAATHDRLGGHHRGGAADRTAGADQQGGGAVQAEQPGAEQARQAEGAGEHQGVQQHAVQSDAGDVLEGQAQAVEDDPGAQQDLLGEADAGGAAGGDPRVQGVADDDAEHDGQGQRADAVVLQPLRTTQEDRHAGQGGAEQQAGDEFLDLGQESGTGLDGEGVHPSLLR

SEQ ID NO: 17179 - protein, 303 aa, Pseudomonas aeruginosa
SWWRRPATRWPRAPRSPARPCAARAGCCASPARARARRSATPCWATCITWKTAWTWAAPRRSSTASPPGWASVACRAGWSRNSWPPARWSNCAAACRRCAGASTCCASATSSSRRASSVSGNTVGRDSAPASWLPAKKSPCRARRAEGDEKGARNGPQCESGVFRKPSAAFRKPLEAIVAVSLAVELAENDLPMSRRDSPLAGSDVGSAESMAIPIEGAAAMMHADLIDQDDFRERLQALGFSVPPDSTPEQACEYAVRGLSPERAQALRRLVEDMLGGHATLLPAVREAISRQLLPALVPRG

SEQ ID NO: 17180 - protein, 731 aa, Pseudomonas aeruginosa
SQAPAGRADRRFRRLADPAWRIVLRQDLRHPGVPHPWRHQRLALVQPVGADRLAGRAGAFHPAQLGADRVRPGLVAADPQPGLLAGDHGNPRPGDIRHPGVHRRGRAAGHRRRAQAVVLHRAAAVAGPDADGTDLRLPDPDPDPVRSRRGAGPDLHGDLRRRRADPPDLPGYPGRSGGAARRRQGLRLLALATADAHRAAARDAEHRRRHHPMHHALPVDGGDRRAGRRRWPRQAGGERAEHRRHLPRLRSRPGHRPARHPARPGVQAARREGEISHDCDPIRPCGRHLRHPHQGSPEAPRPGPRPRRDPQAHRPGARRRGRLPGRQPRRDLRADGTFRLRQVEPAALHQRPEQGQPRQAADRARRFAGGHRQLLAGDPQGHAHQAHRHGVPEVRPDALADGGRERRLRPGDAGPSGRRAEEADRREARAGRSLAVARQASRLALRRHAAARRPGSRAGDGWRHPADGRTVLRPRPADPPAIAGRTAGAATATAQDHRVRQPRPRRGAEDRHPHRDHEGRPDHPARQAGRDRAEPRGRLRAYLRRPYQPAQRAVRPEPDAWPRPVHPAERRDLLRPGPRLLDRSQRRRRAQGRAPGQQRHRPATLAPGRPGGEAAPRTDPGGCQHPYARCPADSLPDRPQAGPAGAGQGGRGARRQRAVPRVAGQEPRLIPLGPLGAATNARRCRAFAFILRAFSVCSSFRTLLRAGSCGMRRAPGGRKERPGETPGQVRT

SEQ ID NO: 17181 - protein, 643 aa, Pseudomonas aeruginosa
TFNKNKIDWPPMTSVGARTHPSTRGDSNAQGRYAAHPPLATDSRHPGGGRSGRHGRRQHRPDSPPGGCFQRHHQSLLPGQERLAGSDHAAPAQRLEQGRTRTPRGALRRQSEGAPASDRRRQLRRQPGQWSGDEDLAGVLGDQHAPAGTASIAAGQRPSPVFEPVLPVPPPALGGRRPRRGTRPGGPDRRPVVAWRADRRRLRYRRGPEHRLRLPRPAVGKTVGVGTKTPAAPPCACDTDKRGLQHGPIRRTEALHWRSLRGGQQWRHLRDHQPGQRRSARQGPAGFQGRRRAGRAERRRGAEGVGGDDRHAALAHPPSRRRHPPRAQRRTGCPGNPGYRQAAGGNPLGGHRHRRRRARVLRRPGPGHRRRADSPARNQFRLHPPRAAGRGRRHWRLELPGADRPVEIRPGPRCRQRDDLQAQRSHPADGPQAGRDLHRGRRAGRRVQRAHRQRTRSRPVADRAPADREDLLHRWHLHRQESHGQRFQLVAEGSDHGAGRQVPADHLPRRRPRPCRRHRRHGQLLQLRPGLHQRHPGVHPPFPAGPLRSQGTGARAAHPSRRPAGREHQLRPAGQLPAHGKRARLHRVRQGAEGSPAVRRRACDRWSVRQWRLRRADRVHRLQRRHDHRPRGNLRPGDEHPGL

SEQ ID NO: 17182 - protein, 110 aa, Pseudomonas aeruginosa
RRRRGDPPRQRYRVRPRRRRRDPGPGPRPPRHPSPGSRHLLDQYLGRVAGGNAGRRLQAIRCRSRERSHHPGSLHSHQVRASGAGRLRLGVLSLDAALEPLTRPVPGNAP

SEQ ID NO: 17183 - protein, 180 aa, Pseudomonas aeruginosa
PAGRRRQPAGSPGTLPAVRLQAAGVDLPGDQMVEPACHRCPVAVPRQGPRRQQPVRGRRLHPNPRSVRMAEHPVPFPPGGDQLQRQQGRAGARLPGAHGLDALAEPRAHPPEVQGPAPASEHPVQLHVPRAGLAGVPRRHPADPRDHEPAGAGPLSGPRVEPWGERAVGRRTRRVHPQPC

SEQ ID NO: 17184 - protein, 131 aa, Pseudomonas aeruginosa
DRFPPILLVQDGQRRHGGGRWPGTGPWHGRTASGGCVDHAADHHRQPQCHHHHDGREDRRQDPRSPAAAAQHGEVLRGRGCAGTRQPRAGLRNAQTRTPAIAGVPASSPGVAGPGGCARCHRWRRTRTPPR

SEQ ID NO: 17185 - protein, 446 aa, Pseudomonas aeruginosa
TNKENNPDMPSANAPEAPAQRPLTRSDYKTLSLSALGGALEFYDFIIFVFFATVVGKLFFPADMPEWLRQLQTFGLFAAGYLARPLGGVIMAHFGDLLGRKRMFTLSIFMMAVPTLIMGLLPTYAQIGIWAPLALLLLRVIQGAAIGGEVPGAWVFVAEHVPARHVGYACGTLTSGLTAGILLGSLVATAINSFYSATEVQDYAWRIPFLLGGVFGLFSVYLRRWLHETPVFAELQQRKALAEEVPLKAVVRDHRGAVLVSMLLTWVLSAAIVVVILMTPTVLQSVYGFDAATALKANSLAIVCLTLGCIVAGRMADRFGAGLTFVAGSVLLALVSWSFYGNLKAHPDWLFPLYALTGFFVGIVGAVPYVMVNAFPPVVRFSGLSFSYNLAYAVFGGLTPMAVALLLKQSPMGPAYYVVTLCLVGFLVGLYLLAQKKPAGEAVSVG

SEQ ID NO: 17186 - protein, 425 aa, Pseudomonas aeruginosa
WRKRDHAPKTGYFRRFPGLKRRKRHSGSRGDERCSTCWQLRPPTYPALRPRRERDEQFGPSRADPAFPRRPGETRRQGLGVFRGRPAVDRTRPRARARSRNLPAAATARRPAAGGASAAPAAARLRRLPCALPATRSDRLLRHPTAGLAGNPHLSRRAALCRCRLRRRPGRAVPRRTAAPRHHYRAGVRHGPCGIRRGILPGRAEAPPADDRRQGSDGPQRAAGAVRYRGQWLRREPRADRALARQRAPAIRGHPALRADLLTRATGRGGAPAGRVSRRLPAHPSFGEPQGSRLGRRAVSPGAGLPGRLSSRRPGRRTQRVRPWHPSLRTRMPLPGAQERGAGALSQFQPVHRLRPVRPWPRPAIRHPRRHRQRRRRRHQPVAAGQPRRRLQDPAIARHQPRSVPGALPGHPRRRQGARPGRPGR

SEQ ID NO: 17187 - protein, 575 aa, Pseudomonas aeruginosa
ALSNLSSGPSLIQRSAAACAEPSNKKARGSNDEPAAQRGPAGFQRTQPARPLDALLRQPQLPEGPADHRRRRRQLADRRQGPQGLRQPVRPVDLRRRPLAQGNPGGGGSPARHPRLLAGLPVRPSAVLPVGREDRRVAARRTEPRVLHRFRLRVRRHLDQDGPRLLAPERPAAEDQADRPRPRLPRGQRRRHQPRRDRWQPQDVRPADGRRPSAAHPSTEHGVHPRDGPDRRRRAGQRAAQADRTARRLEHRRGDRRADVRLRRRTGTAGRLPAAPARDLRPAQHPADLRRGDHRLRPPGHLQRRRVLRRHPGPDERRQAGHQRRRADGRGDRQQRDLRHLHEPGAARARGGVQPRLHLLRAPGRLRRRPRRAGHPGQGQPGAAVRRAGAALREGPARPARREERHRHPQLRPGRRDPDRPARRRSDRASVRGRHEALATGFIRALRRRYPAIRPDLQRQAGRAGPPVRRGRRSAQRHRLMSGRPQAVPTVQVDNAEVIVTEWRFAPGAETGRHRHGHDYVVVPLTDGTLLLETPEGDRHAPLVAGQAYFRKAGVEHNVINASAHEVVFVETEIK

SEQ ID NO: 17188 - protein, 282 aa, Pseudomonas aeruginosa
RPSALSARPPSPNTSMPRAPSAASACRPWAARRTMRCLMPDADLDNAVSAADGCRLRLHAARRCMANIRWPVCVGDQVADALIAKLVPQIKALKIGAGTSCGLDMGPLVTAAAQAKVTGYIDSGVAQGAELVVDGRGYQVAGHENGFFLGGSLFDRVTPEMTIYKEEIFGPVLCVVRVNSLEEAMQLINDHEYGNGTCIFTRDGEAARLFCDEIEVGMVGVNVPLPVPVAYHSFGGWKRSLFGDLHAYGPDGVRFYTRRKAITQRWPQRASHEASQFAFPSL

SEQ ID NO: 17189 - protein, 172 aa, Pseudomonas aeruginosa
RVSTMSKVVLASQLPNKRNASLAPGLKQRHVTMLSIAGVIGAGLFVGSGHAIAAAGPAALLAYLIAGTLVVLVMRMLGEMAVASPDTGSFSTYADRSIGRWAGFTIGWLYWWFWVLVIPLGGDRRRGHPQRLVPGHRHLDLPPPRDFPVHRQQPLQRGPATASSSSGSGCSR

SEQ ID NO: 17190 - protein, 114 aa, Pseudomonas aeruginosa
SIKVFSTDETAGRLLARKLSYTFVFTVNTVYIENEADQKMSTVVSFRADDALVAALDELARATHRDRPYHLRQALAQYLERQQWQVAAIDEGLADANAGRLLEHTEIEKRWGLQ

SEQ ID NO: 17191 - protein, 121 aa, Pseudomonas aeruginosa
LDDLARWACFLALFPVIFPQAQSPARRNRHGFAERHGDLRHCGGQGLDGSRGPEPGHDPFGSQPADPQAGEPRPGHFAASHHPPADPDRGRRGVLSQLRADAGDRRGSRAAAWRMARCAGG

SEQ ID NO: 17192 - protein, 190 aa, Pseudomonas aeruginosa
AAAGEVRPSGVFPREGPSCRMPRAGRWWVEAGSACGRTGLAGKRPSAQPPPRCRRPPGHRAGRAARRRPRRYRPPPCSARCPARRVPPGHGRNPAARDSRSVRPGAGGSARRDGSARRCRGPRGKPAPRRPAPVARQGRRDPAPRAVAAPLRFPPAGARPAPAAPGARPGGRRWRPPSAASPPRRPRRDG

SEQ ID NO: 17193 - protein, 246 aa, Pseudomonas aeruginosa
RSCRTSSMVASPGAATSRSGSLRSRTITPLPGSERTTPRVSRTMIASRRLGRLISICSASSRWPGNIWPATQRPCSMVSSRRWATALTSLDEENMSPPFTCQSDVQRASARQPCSLPSPATALRLSGSPSALAGASRRPSSMACARGISMSFSQRAMVTVATQLPIRLVSARPMPMNQSTESTSTRPATGIAGTAVRVAARITRAEPGMPWAPLEVTSETSRMVTRSVIASGVPVTWAMNTTARVR

SEQ ID NO: 17194 - protein, 495 aa, Pseudomonas aeruginosa
QAAIGGRDEWPGTTARAGRSREEGARMAQGGGPERLAAGKGRSAGEGLGDEIEAILAEEQLVADEEAGRAEDAAPHRLFGGRLEPLLDLLVANQAEELIRIEPSLRQHLGDHLGLAEVLLSYPQRFEHRFQVGLEPFAAEIALGAAHQRQGVDREGRVEGQRHAVAFRIARQVVEGVAPLGRHLDRRMVAGGLEHAAQQHRPPGDARAMGGGDARQLGPGEVGGGTAEVEEELDLLAHAWLFPWRGSEGFHPGAQVQFVHPAVARLAVDLPVGLGDVLGIEDAVLLLALVQLGQGFADEVGVDGAVDDRVGDVDALRPQLTRHALGQGTQGELGAGERGEMRAAAQRGGGASEDDRSALPRQHHPRRLAAGEEAAEGGHLPDLAIDPFGGFGDREPDVGADVEDHRLQRTDLTLDAGEEVDHLLLLACVAAAGQSLAALVADGLHQRLQLLRVAPGDARHVALAGEPPGDGATGGVAGAHYQNRFALGHCRGLSC

SEQ ID NO: 17195 - protein, 193 aa, Pseudomonas aeruginosa
DTSSRSAKDSRVGSETKPTGHAFPAARRPWHNRVPVSCPGIPTMSLDWTCKHHADLTLKELYALLQLRTEVFVVEQKCPYQEVDGLDLVGDTHHLMAWRDGQLLAYLRLLDPVRHEGQVVIGRVVSSSAARGQGLGHQLMERALQAAERLWLDTPVYLSAQAHLQAYYGRYGFVAVTEVYLEDDIPHIGMRRA

SEQ ID NO: 17196 - protein, 527 aa, Pseudomonas aeruginosa
PSSEARVSQAVSGLVKASSTAIPASARSSAKPSAMLGDTRPSASGRLWVRAMIESMRRSTTWLTAAAAPAQRPMPRLPKISTCQGTKPSSGALVASSMPISEVISISTTTLGLVSSRKSRQVGWLWRSMTVAISLPPSFCLSGGLQPRTLRRRQRAAHALRRRCRRADAGRRAQAIVDQHQAEQQQGATAVVRHRHRQRQVQQHVADAQADLQRQAEQHQRGRPDQAAALQAPGEQQEDQGHAQRADPVGHVDRRARVAVELAAEVVGADVLGQVEAVGEVHPRPPLAMAGGQVDAGHRRIVAADPAAEGDLADHQEQGQPRQSAGRRRVAPRREASGEAQGEEKEQRQGGEAAEQMGGDHLRPELEGHRPHAEGGLRDHHREQQQRQLQRLSVAPAADQRMQRQAKDEQAEGAGEIAVDHLVPALLCLHRGVGEVQFGVGQLRLAQRHVDEAVAAWPVRTAEAGVGQPGIGAEQDHHGGQQGRQHGDGETGFAGCACHSRAPFSCRSVLIGPGTAPATPINRYARA

SEQ ID NO: 17197 - protein, 233 aa, Pseudomonas aeruginosa
PARAAGYVSPLLHHPRCMGDPMNTAALRELIQQAHLSEARHGHLADLIASRLPRLHRTIQPQGENTEDILTRFVHAYVEQVPDLLDAANSVAREAGIEERIKPVLKVAEQFFLTPPALLAGHDGLDALLDEAYLAHRLVEEVNDRYIAHFGQALIPLDTTVANLVAHQLIGEPFANRLDEAVHHAVENMLDATTFDADSARAYRENLKNPRVVAAWQQWPCLSKQLGVELSLG

SEQ ID NO: 17198 - protein, 499 aa, Pseudomonas aeruginosa
VVKGFSQPVGYVQGNSSNGKTRRTAPAAMTWPPGASQLSEQVQLAAHRRTGGEQRQVRHEARQQARRSHPLALLAVAQDLAAARLAQRFAEQVGAPGDETRAVVTPPGGDSLRLRPAKVLVVVEGDVVVVGIVVGARVVVGQGLQLQVEQRQVGAGDQAEGLAGDPRQTLVAHLLDQPGHRHRIAEQAGGLDADPPRVRRLHQLANPGHAGVARLPGEQHHGRRQLERAGLPGERTQWPQRLLVAHLRGGPVGPEAQARVIVGAIGANIRHQVAPTQLAGGARGARQHRRVGVAKGGQQRRPRVMPVHAAGGQANGAEQRLGRGQQALHPGPRLVPVEPAEGCGETAPGFRRRRKTGAHPSDQRIVSCLHGQHREGERLALGVRVELLEQGVMAGLAGDRQAVQVRLDALIELGELLQVVMGRTHGVVAEQGKEGGFLGVLVDDRCDAQSMRIHCWPSKLKMSFAAMLHNTPSAALRWKQRWGCSSPKSTSLRWPPTSV

SEQ ID NO: 17199 - protein, 161 aa, Pseudomonas aeruginosa
PGRTGRSRSPRPWVRPPPRSADLAPPVPESAAGDGTTGWRRCSPARSRTASRRRRCRFRRVPGPPGIRRRPPGTRGSGHRADSRSGGTGARRRSRAPRRAGARARAAPGSPRCGCARTARRPGSARIRRDSRTAGSRPPRAAGRCSNAPPGARRGAGSRSR

SEQ ID NO: 17200 - protein, 139 aa, Pseudomonas aeruginosa
SPARSGSGRCGSPRCASAATARAAGWPGSRRTGRARPPGYSARRCRERSAGCRRAAPATGSSACRATAPAAGWDFPIPGAARRRTAVPVPRVPPCAATAARPAPAGNPPGPGGSVASIPSTVPSTALRVAGCHSASAKS

SEQ ID NO: 17201 - protein, 451 aa, Pseudomonas aeruginosa
STVGRISGSSPCNALSCACSSASRACSAWRCSSSRRTSPSPSGTPPASTASAAARRRARVSSSSSTRRFSSAQRCSRAARRSRSSASRVSALRWRSAVATPMALSRRMIASSVSSASMRRRLSSTSAGTACRLMAVRAQAVSSRLTDLSGSWRAGMYRCDSRTAASSASSRICTWWCFSMVDATPRIIRMALCSDGSSTCTTWKRRVSAGSFSMCFLYSAQVVAATVRRVPRARAGLSRLAASPVPAAPPAPTRVWASSMNRMIGFSELCTSSITWRRRCSNSPFMLAPACSRPTSRARSSTSFSAGGTSPATMRRAKPSTTAVLPTPASPVRIGLFCRRRMRMSTNWRISSSRPTMGSSLPLRACSVRSTVKRLSASCLPIALGARAPLASPGAAPALKPSLADRPFSGEAPTYSSKRSVSASTLSLANSADSPVRAWRRLGVLRMPITR

SEQ ID NO: 17202 - protein, 558 aa, Pseudomonas aeruginosa
HRRSDKSLKDVGLVFYNPVSPDVSSRGDETPESRRASLDANRNPSGTGVSAWKSRALAMQGVAMPLRLTITSYHKLTPGQCSEKVLDQGQLTIGRGPDNDWVLPDPERLVSSRHCTILNRDGVYYLTDTSTNGVLLVNAGHRLRRGNSEPLQDGETVRLGEYDILVQLGHDIALPGSGNPQTDPFTSFDALMSRQAAGSAPAFAEPAPTPHPAVTAHFQGGSPLDTKPDLFDFLTPPPPGAAPRPDHVPAEQHDFRPPEPVIPPPPATTPAPPPAGGAPLIPADWDPFAELLGNTPAPSATPVAQPLPTAEPTPLAMPFADPGITQQPQPQPQPQPQPQPQPQPQPASVAAPTPPASAAASAGGDLLQAFLRGAGMTQLKVDPAGAEAQMEAIGRSYRGLVEGLVDVLRARASLKGEFRMAQTMIQPVQNNPLKFAPNVDEAMLLLLRRDNQAFMAPDRAVADSFEDLKAHQLAVMAGVQAAIRHLLARFEPAALEARFGKPAGLSGLLPGARQAQNWDSFTELYAKILREAEDDFQELFGREFSRAYEEHSARLRRS

SEQ ID NO: 17203 - protein, 151 aa, Pseudomonas aeruginosa
RKTPRSAAPTTSPSPTTPSRPSVATWWSRTSSSCVRARNGASTARSTSRPASSVSSPPTATSTAPPGARSSTCRGNAPAISTSRSARRPSASSRVPRPEPSESLCPGITAWCGPKACSCGHSISSSTTATWKPWWMAAAARSWRAAGAFPS

SEQ ID NO: 17204 - protein, 117 aa, Pseudomonas aeruginosa
PSAATSCSPAPAPACATSSSRCCCASPTPCARSRARCWSPGHSDNRPIATLRYPSNWKLSQARAQEVADQLGATTGDAGRFTAEGRSDTEPVATNASAEGRARNRRVEITVFAEGAQ

SEQ ID NO: 17205 - protein, 151 aa, Pseudomonas aeruginosa
CSAARTITTPTSSRPGSASTGNATCRATSRRNSARRCTRTSTRCSNDGRRRRAWTRTWSRTCAASCSNCRWRSGSTTGSSGRGCPRTCPTSASATPPAATRRWCSRARAASRSPTRSAASSPTAAIARCSSPPASARPAPSPRNSGCSGAT

SEQ ID NO: 17206 - protein, 541 aa, Pseudomonas aeruginosa
PWKAPGPGSACSTSRTWNAATRRTASPCGCASTAPASPASCAPAAPSTPSRAGSCPASASRSAFEQRRFLRQAGRPRRFRQPRPAEHLRRTLGRLAGQRHARQPGRARRGLARRLPDQPAVALRHRPRPARRRSGDRSGDAEHRPGRSLFPADRRLPATGERRPRRAGRRRRRLVRTGREPAALHPRTGGRGRGLRAGGGAAPGTALRSAHRTIADQRQPAAQRSGDPGAAPRRAGPARLRRRQPLVGTRLGTDLRRPDALPGPAAGAGVRTIPHRRGRGDPALSRHTRLRTTDGAQLSQLLQVGQLQPRRHGPQGQRRRQSRRPRGGTLGGRRRHGRPRRRRLRQQPDRRYPAAHPGGLLATGLRRRVAHRPRPGQRAGSPGGRPAWRQRDGQHPGTARRARQPGELPVGRRQPPVPPARRRAGSHLAGPQLRPGAARQRIDQRGRGAPPSARQRGHPRGRRARATGTVGSRAARAARRQLPALQRRPQQDRRRQRTARRAQPQRSLCGGPQPGPPGPDPRRPGQHHGPGGQGLLRRTWT

SEQ ID NO: 17207 - protein, 467 aa, Pseudomonas aeruginosa
RGESAIPAAEEMNDAVPAGNFVPPLILHSDHGGSAMSSSAHRGRILHFLGDPAKLGDKAWEYFEDGLLWIEHGHVRALDHATYLLPQLPADLPLEEHPQRLLLPGFVDCHVHYPQLGVIASYGTQLLDWLETHTFPAEQRFADAGYAAAQAELFLDELLRHGTTTALVFGTVHAVSAEAFFQAAQKRRLRMIAGKVLMDRNAPPALCDTAASGYAESRALIERWHGNGRLQYAVTPRFAPTSSPEQLAAAARLLDEYPGVYLHTHLSENLKEVAWVGELFPQAQDYLDVYHRAGLVGERSVFAHGIHLSERECRCLAHKNAALAHCPSSNLFIGSGLFDLGRAQQYGIRVGIGSDVGGGTSLSLLANLADAYKIQQLRGTSLDPFQALYLATLGGARALDLDGLVGNFLPGREADFVALDLAATPMIAQRMEHARGLADTLFVLNTLGDDRAVAETWVMGERRHAKE

SEQ ID NO: 17208 - protein, 468 aa, Pseudomonas aeruginosa
SNAPPPRARNLPTRKPEDRTMNQPLNVAPPVSSELNLRAHWMPFSANRNFQKDPRIIVAAEGSWLTDDKGRKVYDSLSGLWTCGAGHSRKEIQEAVARQLGTLDYSPGFQYGHPLSFQLAEKIAGLLPGELNHVFFTGSGSECADTSIKMARAYWRLKGQPQKTKLIGRARGYHGVNVAGTSLGGIGGNRKMFGQLMDVDHLPHTLQPSMAFTRGMAQTGGVELANELLKLIELHDASNIAAVIVEPMSGSAGVLVPPVGYLQRLREICDQHNILLIFDEVITAFGRLGTYSGAEYFGVTPDLMNVAKQVTNGAVPMGAVIASSEIYDTFMNQALPEHAVEFSHGYTYSAHPVACAAGLAALDILARDNLVQQSAELAPHFEKGLHGLQGAKNVIDIRNCGLAGAIQIAPRDGDPTVRPFEAGMKLWQQGLYVRFGGDTLQFGPTFNARPEELDRLFDAVGEALNGIA

SEQ ID NO: 17209 - protein, 299 aa, Pseudomonas aeruginosa
STPAHTKWSSSRPRSSNPHPLPRERVKGKGHGPFVTPSEERTRQDGHPPPPDQRRNGRRQRPQRRRLQPLHRRSHPQGPAGRRQDPAESHRCRQGRLPGLAQHPAGQACTGAVPLQATAGAERGADFQADQRRARQDPGRRRRRTQARHRERRVRLRRPGNPQGRVQPQRRPEHRRLERLPADRRGRRDHPVQLPGDGAAVDVPAGHRLRQHLHPQALRARPQLHPADRRAVPRSRPAEGRAERGARRQGSRGRPAPGAGSEGHQLCRLDPHRRIHLCRGHQARQARAGPGRREEPCGA

SEQ ID NO: 17210 - protein, 84 aa, Pseudomonas aeruginosa
SHLEGIAAAAILNAWFPAIDTWIFPLPVTFLFTVNNLFSVAPLRRVRVLVRVAQGDRHQSRSSCSARWPSSAACRSVRSAACPA

SEQ ID NO: 17211 - protein, 278 aa, Pseudomonas aeruginosa
WRATAASCRTDTARCSGALLTTMFSFMGTEIVTIAAAESKDPAKQITRATNSVIWRIGLFYLVSIFIVISIVPWNDPLLIQVGSYQRALELLDIPHAKLIVDLVVLVAVASCLNSAIYTSSRMVFSLAKRGDAPSVLKLTNTAHVPRPAVLASTAVGFLTTIVNYFAPEKVFTFLLASSGAVALLVYLVIAVAQLRMRKQLQASGQPIEFRMWLYPWLTWAVILFIVAALSIMLIMPEHRHEVFATALLTIFTVCLGLLNARRKPRLGEDYAGKTARV

SEQ ID NO: 17212 - protein, 155 aa, Pseudomonas aeruginosa
VHHRGKNPDSPPKKSPANGRASSGKVVSDLPDEFRFQLHRANAVDLAIDVVVAVHQADVLHLGADLHHQRGAFHFQVLDHGDGIAVLENVAHRILDHLAIIGRRSGLVRRPFMGALRADQQRTILVGVFGVALGTGRQRAHGILSSAGGRKPQII

SEQ ID NO: 17213 - protein, 437 aa, Pseudomonas aeruginosa
GFSPPCRTASEPLGLRRADGRPGEVEGALFAEAHGAEQASGELALHHVGHAPGRSVVAQAPGLAEGGKGGDGQRHAHHPLAEARHLAGLVADAAGQGLAVDVEVKGDAVVFDRLVVGVLYPQLDHEAHFHALPRQGFQADQVDTQRIALAEGAAGAQQDAQAQGRQQAAEVRRQAHGFSSLGRMCAHGATAARIRRAADPAAPMDKGHAHAYTRSARPRRRPPTVPRRLLGLRSVQRGDRPPARRARLRQTRLRQLHPVQDVPGDALRQLLRPRPGERQRRGLRRAGRRRPAAPRRRFLRPHARRPRGLQARVEGLLLQQRLRRQRPFGGPRQARRLRPGRGKGLVGHRRGQATRSEGLGEEPRGAQAGQPDHPATDHPTAGRPGLAGQATRRGRLQARQHPLLAQAGLPLQPGLVIPRRPSARPARGGLLIQPTDR

SEQ ID NO: 17214 - protein, 315 aa, Pseudomonas aeruginosa
FFPRRSLPQGGTGMDSLKGMAIFATVVDKGSMAAAAQSLGMTPSAVSQQIRKLESRAQVTLLHRTTRRLTLTEAGEAFYRSCAQMLAIAEEAERRLGEWRDAPVGELRLAAPVGFSGTLITQALKPLLENHRQLRLQLFFQDERIDLVAERIDLAIRVGNLADSSLVARHLGDWSSVLCAAPAYLRQRAPINRPEQLTEVDWISLNTSNHLNHLTLSGPGGEVCKLRLEPRVAANGMLAVRQFTLDGLGVSYQPLPEVRDALNDGRLQQLLPEWRIPGLGIYAVTPRREAQPAKVKVAIEALRRAFATDGDERWS

SEQ ID NO: 17215 - protein, 233 aa, Pseudomonas aeruginosa
RHRRLSADSRRRPGLERSAAPQQAPLPEQPLAYRHVPRVQRLTAFGTDQHAMHVLAAMLVHMLEWRPLDAGEVAVAPVHQGKDGRVQFHPFLGKPVFLAQRPFLVGHLGQYLRFDKALEAVGEDVTGHAEAALEVVETAHAEKAVAQYQQGPAIAEDRQHPRQRTGLFAQFFPTHETPPAVRQRIAAWVLKRNRPATPFQRPAAHGITAFLSPAPESRPCRSTGPASTTPTSP

SEQ ID NO: 17216 - protein, 367 aa, Pseudomonas aeruginosa
  UNSURE (194): Identity of amino acid at the above locations are unknown.
APSRTTTAASRVASTATVKPGLRVAPVIRGPLFLVVLSSSGREPRRPRRSTDMRELEQQLHVLQQLLAVGLGVVAQHQVAVRVDHPQQRPLAAAGLVVQGRVQAVALQARVVLPHQVGEVRRQLATGGQGVAGARGFAAEGDVDLAGQVDQLLAVLAASTRRGHQQLPLLALAASLHAEVGGGLAIADQRAAVXAPLRNPEIPFVHGAGEQHRPHHQADDRQQLQAATGAARTFRHRNRETHGFSPVRGAHRGRGRGRAGPSPGRTTARRSRCAAPAASRPGANRCRSWRRPAPGGFPRAARRDRRPATAPGCRAGSPGAASRRPARRPGAGRRVAAGRSRRRAGGRGRGFPASAASVGQSMRPSRG

SEQ ID NO: 17217 - protein, 546 aa, Pseudomonas aeruginosa
NCSSAAGAMSGAPIISGIIQLARPTKAGITAPKDHDQAVHGGHLVEERRLDDLQAGLEQLGADHHGHRAAEQEHHEAEPQVEGADVLVVGRQHPAHQALGRSVVVVAGMVVGRIDHSTHGGLLLLFLLVGDDVFRGDHVAIVVAPGVALVGDHRGQVDLVELLAEGRHGGAGHAVEDHFQVVLLGPGDDLRTLQRREHRRHALAFGLVAGGADGVVDLVAARNQLFLGPLLAGQFLDLRRLFLALGQPLVELGLGLDVDHDRHEAVVLAAQLGALAAIDAGLVDLGPGLVDEAGDGVALDREGRHPPGMDHVAGGDQEAHLGAHRQHQRLVHLQQVMLVLRLPVVDLVLRGGQVAEVLDVLAQVLVLPLPLVAGDLHVQLRLGSVVDVDQGAGGGHRHHHQDHERHHRPEDFHRGALVEVRRLLAGGAAVDDHRPEHRAEDQHADHHADPEDGHVQVEDGPAHLGSARGHVDRPGGIRLADRREQKEAHPDSWMSQHSGSPYRCFYPAGRRQRPRGGPPRQRTLTVAPRHTARQAGFIRFSIRVGV

SEQ ID NO: 17218 - protein, 231 aa, Pseudomonas aeruginosa
CWPELRTITPVIGSAPSRPQSMLRTPWADNSRSMSERGPSCRRSTAAAESRVSALAMKATTTAASSREGSARASRSAGRSQSMASPRLAGTWTRRTSSASQRLARVARLTPSSAPGRKRRRCGRSLSQPHITAMVPSPSSAASRPLSMPSEPSAANAAWGNASRLSRPDALGARSSITCNCERTMRMPMPASIPYTTAGEVTRNQQPRRSRPASSWMAPASSRIGPSMATP

SEQ ID NO: 17219 - protein, 144 aa, Pseudomonas aeruginosa
ARIFAIRSRRRSSPAVRAARASTAGSAWPKADSSAGPGSCRCMPQAARPMARNSGSGEASRRSTQGRAWSQSSQPRAAAKPRRASGDAARQARIRPINASSPACMASTARANASPWACASSCSSRASWPAWPAIAKPSRCASMR

SEQ ID NO: 17220 - protein, 185 aa, Pseudomonas aeruginosa
SPSGRCVHAAAFPPVHRRKPSHLPRSRSPSGASSSGSPGAASACRRTARSPRPSRRHRFPWHRSRRWPRIRPPLRCLPEAERRCRWHASRSRRSAGRPVDPSRRHRPPHRYRQRRAYCPGHRWHRRRRATALHGCRRSPCRIPGPERPETMLVPLARALPWPTRSPRAACRHPRQQHTRFRSPTP

SEQ ID NO: 17221 - protein, 788 aa, Pseudomonas aeruginosa
MDLDTHALTPWLCAASVLEDLASLHHHVLVGLDVDRPGSVDGDVLAADDDAAVLLHADAGGTGDQGDRVAGVEREALAHVQAIVLAHRGIAALADAARLVLADAGALVVAYVDGLVGAHRLAAVGADADRLVVAHRLATVRADADGLVVADVLGAIGTDADLLVAADLLGAVDADADGLVAADVLGAVRADTDLLVVADLLGAVDADGYGLVVVHGLGAIVLHVHGLVVVDGLGPVVADPVGLVVLDLDVLVLLGMDEQLLGALLVLHADLVEVGRRAALARTALGAALGSVRRQLVGHRLLGVVDPPGDDRPVRVAFEEADDHFLADPRDLDRAPVLPRPGLGDAHPAGAVLVGLVVAVPVEMHLDPAVLVGPDLLALGPDHHRSLRATDDRQRSGRQGAVGLAGIDAVQLALELRADPAAAGLVEFLDHPVLGADHQVLAVLVLARVAAELEQVARTQAAGAAAQAHPFVARLQGFDTGPRVLLAVLALHVFAGVVVQRVVGRRVRAGDVRTHLQARAGTLEVVVVEAQRAGLHLARHVPVVEMVALALFQGRRVVGHAGVVRRALVRAVGVGEHQDVAALLVAEPVVDAFLLHQPADEVETGLAVLHAVFPLAVGAAQGVLEVGEAEVAEHLLDDVRDLLVLEDAAVGGARQQPQPGAQGDLVAGELAVAGSLAASGDDAVEMPPAAVVQFQRQAGRLAQQPVEWQVGVFRDQFQLVGERPAELFATLHSLQLQDLRAERTVDPDQAGLLRKCHEIILDPRPSLAPLERRHPSSIGADAVERGDA

SEQ ID NO: 17222 - protein, 278 aa, Pseudomonas aeruginosa
DSPRFRCRRDGRRSRGRSPDRRRRGRRHRRHRRPGRGDPGRFDRRRRAVDVPDRQGPDHHLRATRADHRGAHTRQLQRLREQSQRDARRRRRFRHLQRPAAEPSAVAVPGADRRRQRDRVHQRQAGGAPAEQDGLRRAHQDRQPEHLHRRPHRAGGLRPRPGGMAAHRPRGAGPGGPSRRPAAGGDGRGRGAGRLRRHRRADDGRHGPARRPRRPPRSRLPRPVPGRGGDGIAGLRAETRRSSSGSGDLRNRATTRLPEQQVRSFRQPRPRHQLPRES

SEQ ID NO: 17223 - protein, 128 aa, Pseudomonas aeruginosa
LLVGKGTVISRQRRRATTVLQRERLLRSASPGGIMTPIEYIDRALALVVDRLARYPGYEVLLSAEKQLQYIRSVLLDRSLDRSALHRLTLGSIAVKEFDETDPELSRALKDAYYVGIRTGRGLKVDLP

SEQ ID NO: 17224 - protein, 179 aa, Pseudomonas aeruginosa
ATAASAWRGHARIVKTPAASRPRAGSQDAAASALRRRRKHRLYLAVDGALHALALGVDLAGAAGIEVEAAAGVDVAVAAGVEVEGAAGDIDGAVGVELHHALAADQADLRAGLDQVGAGDAVALRPAHQQGVVELHCAGAVVADARQLVVADALVAVVADRQRGIVLDQVVLVALGVDV

SEQ ID NO: 17225 - protein, 526 aa, Pseudomonas aeruginosa
LLGALLVLHADLVEVGRRAALARTALHPALGGVRRQLVGHRLLGVVDPPGDDRPVRVAFEEADDHFLADPRDLHRTPVLPGPGLGHANPAGAVLVRLVVAIPVEVHLDPAVLVGPDLLALGSDHHRGLRTSHHRYRSLRQETERLAGVDAVQLALELRAGAAAAGFVEFLDHPVFGADHQVLAVLVIARIAAQAEQVPGADPAHHAAQAHALVLRLDRLDAVARVLLAVLALHVFAGIVVQRVVGRRVRPGDVRTHLQARAGALEVVVVEGQRTGLDLACHLPVEEVVALAMAEGRRVVRHAGVATRAAMRAVGVGEHQDVALLLMAEPVVDALLLHQPADEVEAGLAVLHAVFPLAVGAREGILEIGKAEVAEHLLDDLRHALVLEDAAVRGARQQPRPGPQGGLVAGELAVPGHLATARDDAVKEAPAAAGQLQRQAHRLAEQLLQRQVGIFRYQVQLVGEQPSQFLASLHALQQQHVRPQRAIHLDQAGQLHQSHRRFLLLLCVSPVVTRPRRSRSGTGCRGY

SEQ ID NO: 17226 - protein, 135 aa, Pseudomonas aeruginosa
ARSRSRCAPCGRPGCRSSRRPPRPPPDSPRSAGSAALRPATRSVAPAAPPAAHAAPGAVPRRDAPRLRPAARRRRPPLRRRHADGRGSPAVRRPGVFPRPSAAPGRPGARAPRPAGSRRCAGVRRWRRRWRSRGG

SEQ ID NO: 17227 - protein, 209 aa, Pseudomonas aeruginosa
SPGCRTAPVAPRPPCPPGAGRACRTARPVPAPRRGIDAGRGSGRRTRRTGSAPAGRSIPAAGGSPGTPAAPPAAARPRRRSRAHAGCSSAGVRPRHCPGRGRTPRRRCRAIVRRGGRVVRRRRAGRAAGRPATGCRTGCRRRCAGGCAGRPWPAARWRRGGRAPRRDCRSSRPGPLPAATGSPGGRCGIRRRSGHRGRAGRAGRPRARR

SEQ ID NO: 17228 - protein, 206 aa, Pseudomonas aeruginosa
PAAGSSGLHVLADVPAVLDRTAVLRAIRLLRLVVDLDLGEVQGHVLGQAILATAAAGAHRGHQDFLQGDDQVLDLVLAAGLADGQLRLRIVLAAGAGHHQVGRGLVDVLGERQVLHVDLAGAAATAHVHRPGLGHAPAPCQHVDFLGVSLVLGLTLDVADLDEHINSHLSSRVARATTLCKRPPPWQALSLNASGLFGRRQLGYQA

SEQ ID NO: 17229 - protein, 672 aa, Pseudomonas aeruginosa
RYRQSLELVVRAKEELRVVVTRIAFDFLHHHFGRRQRVLGLGGLGGVGRVAVDVVEDPVLQPALHLVLLLEGTDLVANDALQVMGEAAGGEQVGQARRQVGVGGGVRIVVLGGFLQRLRADEGGEVGVLLVQQRHEAVLRQLRLAAVGNGDLGRALHVHAAVVGGEGVRRQALHLAAGLDAADPRAPAVELEGAVDVDRHRVGRVGPGVLAAVGAVGFFLEGELFHRIGLRPVGQARQEARHGQADVAGVLGLAQRTPAGVFRGGEDLGQVARVGQFLPGTHAHHRRRGGGNERRVHGGGDLRHLAEQLDVRRRLVEVVVADQAAIGLAAELAVFLFVELLEDRALVPGGALEFLQGLVQLRLGDVQHADLQLLVGLGVVDQVVQAAPGAFQLLEVGVVHDQVDLRGELGVDRRDDRLDRLDRVVGDQAGLLQGMLGEGPHGGLHRFAGALGLGLELLQQQAGELTGLLGGGLALGQVLGAQFGHAGILLRLRLVVFGLRRAGQGLKQGRVLDRLHDHFLGAGLAVHVGQQVGQLGTRLEQLVQRIDLARHRGGAEVVHALEGDVQAQVAFAGQHVRYVEGHPRLHRLQPGIEVVHVDLQELAVGDRRLGFGGLAGEVGHDAHDEGQLDLLLGTVQLHVVLDLHAWRPVPGDELLTAGSASHLVSPSRDGGC

SEQ ID NO: 17230 - protein, 155 aa, Pseudomonas aeruginosa
AAPAPGSTARGERNTRAGGRAGAGRLRGWRSRRWLAVPARRRLRQARRPPARRRPLRRPAPRARRRPAGRTGRTPGGPGAAVDEGDRGRVPGPSRPVRRRRSRWPGHVPGRLPGRAGWRPAHRRRHRRRRRRSARDSGSRWRSVAARRRSARRAG

SEQ ID NO: 17231 - protein, 2294 aa, Pseudomonas aeruginosa
PRGVVRRHVPAATAFPAARPLPGNPGGWPLPLAPGGRLGLFRAEAGRCPADPGQAGHRQRPRRAAGWYAVQHPRRRSGAGAAECRGKPARWHRLPRPAAEAGRHPRHGRGGRGPRRRPLRQPGAGSARRQCRLREPRPGGPGQPGVPPADRARRPRRIRRGGRRAGPREARGPGPEPGRGLPAAGARHCRRAAPGVLRQGAAGPAPPARRSPRRAGGGIQRRGRLGNRRLPAAATGQPRRGPHWSPVPRAPAAPAGAVPRTGGPGRRVLYLHRQPAASRGVPGVQPRRPGRQLRPGDARPAPGAGDGDRRQGDRHPDRREGLRRARRDAQRPQPDRQRQLRPGGARRRPRREPARALPAAGQGRLGGAHPRPGQPATAGYRPAADAGGAAADPLPRRLHLFRTGPRQRALEAADALRRLRLPHRRPVPRAEPGLLGHSRISNDASHRRSLRHPGRRRQRKPARRPHHDHAASRRPRPGTGRRPPRRRSLHAAADGQPGAAERPRRRPQPAGAGRRPTAGDAHPPAQHHRPSGAGQPARATARLPAPVRGEGTPGRRGAGRSDAGALRALHRPRRSGAQHAVGQHQRLGQAEPADHPAQRGLGRREGLPVARTLPAEPAPAPAPAGAAVPVHQPRLRRPLPGHARRPQPTGGAARAHRGGDPQHPRRVRARTVAALARPQRDARPPFAIPAAVGRYRHRPGLAAGLAVRPADEAGRRRRAGVQAHPRHRRDPGAGHRPPGGAAAGDRAATPGALPRRRHQGPAGGGGGRRRPLGGDHPRRRAVRQRQRQRARRVPAAAAAHRRRPAQGQGPGAGHRAIATTGRSPRCATRPTGNCPRPAPRRSPTSSARPPATPAASPPKGAATPSRWRPMPAPKAAHATAGWKSPYSRRARNERLPQLLRALGGAGARPARPEPDHLVPRPAAAPGQLRTVGLGDQPLGADRPAVPGLDRLPRAAHRAGPAQRGEGHAESRRGQRAGRRQRRHRRRAGDPQATHGRGPGPAQAGQAGRQRAAQPVRVALVRDHRPARFGQDHRADELRPGLPARRTDGRRGDPRGRRHAQLRLVVHRRSGAAGHRRPLYHPGQPRPGGQGRLAGLPRPAQDPAQAPPHRWRVHRHQPFRPAAGQRRRARRPCPGDPRTHPGAVPAARGALPDLRDADQVRPGAGLHGVLRQPEPRGTRAGLGDDLRPRRRQERGRPAGGVRQRIRPARTASHRAPGGTPAAGARPGAARPGLRLPAAIRRPARMPRRVPQRRVQAQPLRGTPAVARPVLHQRNPGRQSDRPPDRQHGAVDEPRPPAPGAADRNRAQLLHRAAVPRSGVRRTRPGRHQPEGRAPPQVADHRRAERHRAGGAGGDGGMDRQLPRQPELHRRGRPARRPAGARHRVAEPGPARRPGRTATAQRGAESRRRRAELGRRLRAVPGRHARRGVRQRLPQAADRGVRPAPGDPHRGTVALRRQQRFPLRGPEGLPDARQPGPLRRRLHQGLDQPRLGTQPAARPLAGTAPGAARAPRRVARTTAAVGAPGPGPGRGPAPPVAATAGGAAGLRPGQAAEAAQGRARLPHQRRRRPRRAAGVRAQERQAAHRPAQRLLHLPRLSRGVPHRQPQPGRHHRRGTVGARARPERCRRRRQPGPRRASPVLPGLPAAVGRPARRPYRSADHQCHPGRRRAAHSLRTDLAVPQAARGGGPRDRPAEGRPAGRRASEEGRRRHRGQAQAAPRLAGRPGGGARRPRTAAAGRQRPDQRPLRRTQQPGQQGRGRQRTGADRQPAGGHERALRTGQRHGRSQRRLAARRRQEPGGRRRLARCPQRRAPAAGGPGTGEERGQLHHQQHDGQRAQPAQRGLDQRRGQRLPAVPGRALPDRRRQLARRHPGRLRPLLRCRWGDGQLLPPVPATLRRHLRQHLALAARRGAEARHQSRRAAHLPARGSDPRRLLPLRRHAAGGALRTQAGDHGRGDQPVHPRPRRPAADLRPRPQPPGGDAVAERQRPRRGPPDGDAAAQQRPFRPDPGRPLGLVPPARPVGPGTRQLAGPLHPAAAHRRLQHRLRAARQQRLQPLQEPGRVRLQPPGAPLNSVGFYGKLAGRGDFVSRGLPNTFVEPWDAWLASGMRASQDELGAAWLDAYLTSPLWRFAIAPGLLGGEAVTGVVMPSIDRVGRYFPLTVACLLPANADLGGLVGGDDGWFEQVESLLLSTLEPEAEVEAFEQAVAQLPAPPCGARIEQSLISGNLLRSEAVTPAQRLAALAQHACDGASHWWGRGSARISAGLMRYQGLPPAPAFGRFLTGEGEVIPLFPGIPG

SEQ ID NO: 17232 - protein, 245 aa, Pseudomonas aeruginosa
GQLMVPNSVSYYRSASYSHVGMVRKVNEDASLDAPEAGLWVVADGMGGHAAGDFVSSLIVDTLRRIPAASSLPAYVGALRTGLAQVNERVRQEAGLRGVSVMGSTLVLLAARGNQASCLWAGDSRLYRLRGGVLEAISRDHSYVQELLDNALISEEEARHHPRANVVTRAVGVHEQLELSEAALHVLPGDSFLLCSDGLNKTADDSELRDVLSHSDPYAVVRSLVHLGLTRGAPDNITALVVRAF

SEQ ID NO: 17233 - protein, 134 aa, Pseudomonas aeruginosa
  UNSURE (124),(127),(131): Identity of amino acid at the above locations are unknown.
DGHGHRTSGIRHRTRAGRRRHGHGLPGHPALAAAQGGAEGDGRGAGRRPELRRTLPARRSDPGAAVAPEHGDHPRHRQRRQLLLHGHGIPAQRHAQGAHPAGPRSRAGPGLRTAGASALRHGIXWLXTDEXSNV

SEQ ID NO: 17234 - protein, 205 aa, Pseudomonas aeruginosa
SSAGTATGACNTRSPRASRRPPHPSNWPRRRACWTSIPASTCTPIFRRTSRKSPGSASCFPRRRTTWTSIIAPAWSANAACSPMASISPNANAAAWRTRTRRWRTVPVPTCSSAPACSTLAAPSNTASASASAATSAAAPACRCWPTSPTPTRSSNCAAPASIRSRRSTWPPSAAPGRSTWTAWSVTSCPAAKPTSSPSTWPPRR

SEQ ID NO: 17235 - protein, 149 aa, Pseudomonas aeruginosa
SSGNRVYTCASAAIPCNSARPSTPGRKSWTACSTRSAKRSTASPDERPPASRTHRTGGQRRGDRDRMALRPRRGNRAPPPRPRLCGGTADRRHAAAGNPRGRPPRAAGRRTGLLPQGRRRAQRDQRQRTRSGLRRDRDQVIRTRSPGSG

SEQ ID NO: 17236 - protein, 286 aa, Pseudomonas aeruginosa
RERATALSSPLAKREQDKMGTLHHLINGEMVADNGRSADVFNPSTGEAIHKVPLADGKTLQKAIDAAKAAFPAWRNTPPAKRAQVLYRFKQLLEQNEARISKLISEEHGKTLEDAAGELKRGIENVEYACAAPEILKGEYSRNVGPNIDAWSDFQPIGVVAGITPFNFPAMVPLWMYPLAIACGNTFILKPSERDPSSTLLIAELFHEAGLPKGVLNVVHGDKEAVDGLLQAPEVKAISFVGSTPIAEYIYAEGTKRGKRVQALGGAKNHAVPDARRRPRQRRQRG

SEQ ID NO: 17237 - protein, 240 aa, Pseudomonas aeruginosa
WVPPTAPCGEALHGEYSVAGMRRRPGGRRADRQAGSADQGAEDRRRHFLRPRHGPAGHCRRAGQGHRLHRQRRGPGRGAGGGRPRLPGRRPRERLLPRRQPVRPGDPGNDHLQGRDLRPGAVRGSRQQPGRGHAVDQRPRIRQRHLHLHPRRRGRTPVLRRDRGRHGRRQRPAAGAGGLPQLRRLEALAVRRPPRLRPGRRALLHPTQGHHPALAAAGQPRGLAIRLPQPLKADDDRHGR

SEQ ID NO: 17238 - protein, 187 aa, Pseudomonas aeruginosa
RPCLFSFSAIRSPQRSTAVKPHPRPHPWRRPQGGPDLAQEQLKGLNDVQSRTGFTTAEQAQRLARARPETTPRHHAVDRRGDRRRPVRRLRPCHRRRRPGRPARLPDRRHPGGAGHAHARRNGGRLPRYRFLLHLRRPLHRPLGRFHHRLALLVVLGAGDPTWRGSPPRPSSTPGSRPSTPGSSPSP

SEQ ID NO: 17239 - protein, 155 aa, Pseudomonas aeruginosa
RSSPSASGCSTRDASRASARTTPGRRRGSESTTGGRTQTALQRKARPMAGLLQARSSQTFLTNSDFSFIAPMPSILQSMSWSPSTRRMFFTLVPTFTTSEEPFTFRSLITVMVSPSWRTLPTESLITLPSSDAVAASFGDHSWAHSGQTSSAPSS

SEQ ID NO: 17240 - protein, 367 aa, Pseudomonas aeruginosa
GMPRVGALLLRPQAWRKAEKAETVSGTLTTRSPKRGTSPVWSLTPLARGWPLTSRSRAMPLYSIGSSLGFCTRSLTMKRISMPCPGRGSRPTRSIRNGSRWPKVLQALNRTPRHRAGSRRPRFAGRRMGSPPWVECAPMVPQPLEFAAQPIRLRQWTKDMPMPTRVLRGLVAALPLFLAACSDSAPSSEEIARLLAERGFDKPACASSTLFKTFPVTLSDSFSGPGPAKGNAAVYDALVGVGLLRRDGDSYDLTPAGREDYKPESKAFCYSSGFDVSVRSVDPAKPDDYGPAVEKGWLVTVEVKPREVKDWAKNPEVLKQASLTTLQQITQPQVGQVSLVKPRGEEGYKLVNTRFSPRQGFHFNQAW

SEQ ID NO: 17241 - protein, 116 aa, Pseudomonas aeruginosa
RLGRCQCRSPAGTHRDREALGAAMSLKWTRKAAADLDAIYDHYVVLIGPEKALKAVQDIVEQVKPLQQVANQGAGRPSEVPGVRTLTLERWPFSAPFRVKGKEIQILRIDRVEITP

SEQ ID NO: 17242 - protein, 152 aa, Pseudomonas aeruginosa
TAPLFSAMSSEARATRPRTKPCSKGFSVSSARRRWKRPARRISPALSRAARQACSSSTSARSSARAAGSSPAGSCRTTSLSTSRRASSTCRAWRSSGRATLATSFGGITTAPSSARRVRARWMVPLLTRKICPRVSLLSLAAGARRFSRIAV

SEQ ID NO: 17243 - protein, 771 aa, Pseudomonas aeruginosa
TKWLVGRSAAPCWVRASNPTMFTPVESCLWAFAGGGRKPSGRRDGPGLEPWRGRSDLRQAQVDVQARAFVEDVLAHRLARPLAVVLADRTEDGVVFLEDLLGVFRLAAHQVVAAFQGAADLFGNAEEDRVRGELHQAPVEGRVGLNQSLRVAILDRFAQVQQQQPQFADLRRPGALRDDADDERLQRIAQLQDVFHGRLAGRRDLAQRFAAFEDHHALARQRTDHAQGLQDHDRLAQARPADFHLFSQLALAGQHLAGDPATLLDGVEQALGNRVDQLGRRKHVASLYLPIGRATRLGASAMQLAFPGHRAALERLAVSLGRRLQAPVEYGLRARHIDVVFPAGDGHGGHAVADQVGQRATDAHEPVHRKHQHQAGHRDRRHRGEGGGEDHQGRAGNAVGALGGHQRNQQDGDQVGHRQRRAGDVGDEHNRQGQVDRESVEVERVAGGNHQAYRGAADAHVLELAHHLRQHRVGGGGAHHDQQLFAEVAQERQHAHPGETQDAAEHRHDEDQAGGVEHQHQRAQVAERVDAVAGGGEGHRAEHAERCQAHDHAHDAEHDVAEFVDQAGHAAGLLADQVQGAAEQHGEQQDLEDVVLGEGAEHRGRDQAHEECHGAVDLLGAPGIQGDVAGGQFVEMDVGAAAQAQAVGDHQAEDQGDGGEDFEVDHRLQADAADLLQVTGAGDAVDHHAEDDQCDEHLDQLDEAIAQRLHLHGQVGNADPADHAYHQANHDLQEYRAGTALDEHRRSLHSALPSGLAEAGDERIFIVVLPV

SEQ ID NO: 17244 - protein, 180 aa, Pseudomonas aeruginosa
PRSCLLPRNPDHVARLDLQAPRRPHPEGTLRAAAIAHRGLRGGTEMPLSGSRRPRSGRRYPSPDGLARRPVARLPAPAGPGSPRGPGGDRPGGQFLGRARPGARSPVDGTRAAGGGAPLAGYPGVPLGPGPPAGLLRPLWLRRGHRGLPGRRHPAHRHAPGLRPGAPRTVGGGKGIRPAA

SEQ ID NO: 17245 - protein, 237 aa, Pseudomonas aeruginosa
RPEVRWGPGEDDQYQQQRLGAQVAGDGDPAEQRRRRPGEPADDDVLRRGALQEAGVERRVAEQRGEGQPGRQRVGEGQQHGHPGQRQEQREAQRHARRHPALGQRPLVGPRHDRVDAPVHHMVDRRRRAGTKADAEVAEDQHLPGHEAIQRRLGGEQHADQRGDQHQHHDLGLGQFEEVAPGRLAVAIDDGGHILTSILLSVRRPSAANLAPAAACGARAAATVPARGRWPARAGDS

SEQ ID NO: 17246 - protein, 151 aa, Pseudomonas aeruginosa
LPGRHRLGAAPGLVAGQQGALLVGPLQLPGAQPEQHRQQAEDHQGRQQAGAERATHAASVIASGLPEALAILHESPHRRSPTMLKVAIVLLLLATLVSLFSGLFFLVKDQGHGSRVVNSLTVRVVLAAATLVLVAWGFYSGELNSHAPWHF

SEQ ID NO: 17247 - protein, 528 aa, Pseudomonas aeruginosa
SGTRAKPKANISTVTSSRRPTRRRVSTLASLMTRSSLDLGRGAEGVVGRRRGDAPLQALGAVPGLGRGRLAAADALDDDEQEQQLGGAEHEGADRRDHVEVGELQVVVGDPSRHAGEADEVHREERQVHADEAHPEVQLAEGLVVHVAGPLRQPVVSRGEDAEDRAGHQHVVEVGDHEVGVVVLEVRRGDRQHQSGEAADGEQDDEGHGEQHRRLEGQRTLPHGGHPVEHLHPGGHRDQHGGVHEEQLAGDRDADHEHVVRPDHEGEEGDAGGGVDHRGVAEQRLAREGRDDRTDRTEGGQDHDVHLGVAEEPEHVLEQHRVAAAGGAEEAGAEVDVHQHHGHHAGQHRHHRDQQERGDQPGPDEQRHLHQGHARGAQVEDGGDHVDRAHDRADPGQVDGEDEEGHAVRGEGGRQRRIEGPAEVGAAAGHEQGADQQAEGRRQQPEAEIVHPRQGPCPARRSSAGSSSWPGRRRPASPRRRTMIRPCMVVIWLKNAGSTICRPGWNSSARITMAIEPPSRNIMKLNHR

SEQ ID NO: 17248 - protein, 449 aa, Pseudomonas aeruginosa
SDSQPPAPPASHHPAARREHGRHTHPLRPRLRRTGTGPARRRQQRGPRSRHRGTDQAGAEGRRAVLPHPAGVARRPRRPRRPARRSLPGAPPGGRSERPLHRPLRPGTDPTGHHRSQPGGPPVDRRALRQPAGRSRPPCGGEHARRHHLRRRLGPRLPREPEEPAGGRRLAAVAVPVEAARGGTQPGLTAPPLRAPPNPTLPRRRHSRRRFKARGSITRRVALHRCHPPPILEQLHAGMVDIAEVIHRYVQGGPRLDLVEHPRQSRHLEESRGAAQAQLGFMLAGVAQGDLQPRRLQHQLQQGQGEAHQHAGQQVGEDDRQGGGRVHQHRHPAVAREVAEGLEIDQLDPGIDQHPGQARHRNLPQQAAEQEDEGEQPEAVEDRRGAGSRTGIDVGPSCVRSPRSSAARRAGRRACCGHPGRTTRDPCPSAGRRAGDPPPPPRAGSPHWR

SEQ ID NO: 17249 - protein, 160 aa, Pseudomonas aeruginosa
CPKLNHKLKNPSISHVASFFHDISRGCRQAIMANEWHFHSPRISGERFQSTGWLRAGKFVEWENPAHRASGHDLAARCQPAIRTGPVGGAPAHRWGTAAGSARSAPAGTPQPSAGVAGRRAGPGGSAPRPAVRRAGRRARRRNARRCHATRRRLAPPPAS

SEQ ID NO: 17250 - protein, 599 aa, Pseudomonas aeruginosa
RPRRRPAPDSRRASAGSARAPPPDRRTGRWPGCRSAACPPPASVGESRPCWCRAAARRAAPWSPAAGTGRAARRTHAMAPTPPRRPSARWPSWPRSAGSGHRGRDRREYSPSGRADAARRRCARRAPAPPGRRGQRRTAAPAPGHAGACRRRPGQWRGTAARARPAGAPPRAAPGPSRASRGLRRNRAGLPETPQDRRASVRSTHRLLPAWPAPRGRTPRPGRARRVARAGRHGRPGRRSPSRPGAPRCADRARRAPPGRNGAHARRSRGAGQGRRLPRRAGRRSLRCSIYAHPLLAVEAEDVFRGDAPQHAVGSAKVEAALGLLITEVHLLEMATDQRIDRRCARHVECAVEPREAPQVFIDIVLGDDLPVVVASTQQRSRLSTGVNRAIFRAADRRQEQVRRALPGLPALAVVLPDLPVPADGIDFPGTEAADGLESDHRFAACRRPSAGVDGTPVVLVEAPVDLSIHPAGIGHPIDTGNAAHIAPATDGIVAVGQLLFMDVAGAHAEYLAPSAQKQCLFHWLVHYRGRHDLPGQHVVILASNTPGSAVPLRDIAVRYVLLLDLVGYRGHVRQVLIADDAGDVRENRREFLQHFNLL

SEQ ID NO: 17251 - protein, 223 aa, Pseudomonas aeruginosa
AARVGPLTKESTPATRTCRQPPWISLRALSRATAPPTRPRAMSAEEGWKRRPSSPSRSRRKDSSSPAQRPGRSPSATQSSSGSSVQSRSGWPRKASSMARAAIFSSLARPRRGCSSGTLAASNHSPPWSMKRVSWKLSRAQRIAAQLAGALRPTALTMPEATMLRTWLMPRPPRPGGCVPTRQARGSSPCPARGRATRRRTCCRPAPGRSRTGCASTAGECAR

SEQ ID NO: 17252 - protein, 288 aa, Pseudomonas aeruginosa
LPGSAPLQFWRILRPFTTTFLSALTLIAPDPSMVMFLPLMTMLPSFFMRMLAAPVTRVIESPALSVKLLPTSRLSSLPTEVSRPWPTLRDSFLPMLVLWLSPMSMVSLAPTDSLRSAPMLIVSLLPTDSLRFAPMLMVSSLPTSSVRLAPMLIFSLLPTFSVRSTPMLMVSLLPTSSVRFAPILIFSLLPTFSVRSTPMVMVSLLSTVSVRSCFTCTVSSWSMVLVRSWPTQWVSSFSTSMSWFFSAWMNNCSAPFLSSMRISLKLAGVPPLLERLLVPLWVAFAGSS

SEQ ID NO: 17253 - protein, 155 aa, Pseudomonas aeruginosa
LTQNPREGVNTVTLYRLHEADLEIPDAWQDQSINIFKLPASGPAREASFVISRDASQGDAPFADYVARQLENAEKQLPGFKLHKRWDINIHGHAAVLLDYQWQREGRDLMLRQVFIERRPAVLITTLTTTPADLPHHEPAWKQAMQTLVPRPTPS

SEQ ID NO: 17254 - protein, 435 aa, Pseudomonas aeruginosa
SEYRRMDAQAAARLGDEIAHGFGVAAMVAGAVAGALIGAAVVAATAATGGLAAVILAGSIAAGGLSMFQIVKGLTTIFELPEPTTGVLIRGSFNVYVNSRNAMRAGDDVSATCSGLPLNHPLWPFPVLIAEGSATVYINGKPAARLQSKMVCGAHIKTGSQNTFIGGPTERVAFVLDLEEWLHTGLEALGLAALAGGLLLAAMAGVAALAGFVAIGGLMMGGMALLGDLGDRLGPGYRDLFQGVAGMALLGFGPKLAGRRPAAVTSETAQRRAYLNNKFGRSGNLDHDINYRGNRETAAKFFKSKDIDPADAESYMNGLDFNHPVRVETLAPGKNLWQYQSPGAPQGNWYTLSPRVQPTELGINPMGTNRAANTIEPKVLNSYRTTQKVEVLRSTAAPTDDFWSVKGQSYPAKGGAQQLFSNEKGSFGLLPREGS

SEQ ID NO: 17255 - protein, 984 aa, Pseudomonas aeruginosa
ANSRPSSSRPSMRCNSSTSGPSGQSTWTRRVSCINPIDGSFYCSACRRLSLGLGEVVVELVVAATDTYPGQRLAFEHAGEELAAHVRQQRVGEDRVDHPAAALGLGAARDDQVDDALVELERHLVGRLHALLDPPQLQARNGLEHVVAERVVGDGHQAAEQRRREDLQQRFAQRLGDGFRLGHQFRIGAEAGDHLGAGVGGEQDQGVLEVDHPAFAVLHHALVEDLEEDLVDIRVGLLHFIQQHHAVGLATHRLGQHATLAVADVAGRGALEGGDGVGFLELAHVDGDDILLAAVHGLGQGQCGLGLAHPGGAGEHEHADRLARVVEAGAGSLDALGDHLQRVVLADDALLQVPVEVEHGLDLVARHAADRDAGPVGDHRGHRLIVHGRQDQRLFALQRAQLRLQLRQPRMQRLALFLVETHLAFAQRHAAGVHRFGGGTQTGAGLQQFVDQAFFLGPALLQGGQALALLGQQGLGVALAFGGGDADGALAADDRQLGFQRLDATAAIVDLGRHRVQADGGARAGGIQQAHRLVRQLARRDVPVRQPDRRLQRLVEDLHLVVLLHGRRDAAHHQDGLVLGRLVHLHHLETPGQRRVLLDVLLVLGPGGRCHGAQGAARQGRLEQVGGVAGAGRATGADQGVGFVDEQDDRLLGTLHVFDHLAQALLELALHARPGLQQADVEGAQFDVLQRRRDVAGDDAQGEAFHHRGLADAGLAGEDRVVLPAAHEDVHQLADLLVTPDDGVELAATGLLGEVHGKALERLLLAHRARRQGAAGLARGGTGVEAVAGRQAVLRRGADVLVEALGERLDLELGEFRRQPGEGMAQARRLEDADHQVAGAHLALAEHQAAVDPAALHRFLDMGGQVGDRGRAARQAVEGLGQVLGQARRVDPGLADDLVQVRVRQLEDLVEPVHQLDIGIAAQLAEYRGGLDGLVGQAVQLAEQRNATDLTHVPSPCARAAAQWRTGGPAVDPWRPGRDRPARC

SEQ ID NO: 17256 - protein, 147 aa, Pseudomonas aeruginosa
RPSPAPRPGIRRPRRPARRSGRRRAGSAGIDRGPAAPGAGGTCAGGPRRGCPGRRPCPGSSSRRRGGCARAAPAIGRRIPRPPPGPRNTPRGSPAGRPGSGSARRGGRCSSSVRYRPAARAPAGSACRARRARRGAPTSSRRRSGRG

SEQ ID NO: 17257 - protein, 792 aa, Pseudomonas aeruginosa
GRRRTGPGAAPQRCRPGSPRPGSRARRCSRASARDAAGRPPAAPNDRGAAVAATRTRCAAAPGRSHSPRAPPPSRRAGSEVRTAARLRLPSHHLAPFAGAQHRLGKAVDRHVACQEALEHSAEKEHPGAAERVLVEVQGDLQATAEDDRPGHRQAPRARLAADLAQALDLQLQRRIAAVAVEPQQLAQGGGALAALGQRQVVQRQLADQPPGAGIVGTAGARPARSGEAAHLHDRRAVLQGEVALVRADRHEQRQVAVGAQRGDAELAQVVAIGRLVGVDQGDEGLAADVGRARALAPLLAGQHARFAAHAEVGLLAAVARRVAHRVERLEGLLRTAAVAAHLLQRMHLEIQRTGAVDDHVMLVDPVGQVDAVAAAREQVDRRGAERHQLLRVHRALQALVVLAEQHDQFQLLAVASTQGAVQAGELDEQEARRQGEVFLQQAVALERPRHHRQQRVLVVEAARTQAARRQAFDPGIVRGADEHRAGVAEQLFVEAVGLFVGAVQVERQGVQRQAVERDAGAAAQADAQAGLGPRLAGGEAAEHRGGIAEVVGLGHFQRPQGHRVGGAVFAGGLVIGAELAAQGGPALDAEAAAQGAFVGVRAQLHHGHRRGRRQVVRVGDFQQVVGEGRVLRVELQLDPRGEIGEAFQKALDVGVGALEAGQRQAPGDLREFLGELRGAFADVLQFLVVVLEQARVHVRLRSPWATRTWPVSRSRLVVSSRRSGAGSAQRSPSISKLRALWSISPGSSCARTRNEERMMRGSKVAMVSVSSASMACTSTLDAVCPASAGSP

SEQ ID NO: 17258 - protein, 95 aa, Pseudomonas aeruginosa
GRRAARLALAVASGSSYSAGFCSDCAPMKAAKSVFFLCSSGMKPFFASSASRRSEMAISVGHFMSTPPSSVGKVCAGRPCTSPPDSTPRIREHQP

SEQ ID NO: 17259 - protein, 421 aa, Pseudomonas aeruginosa
ALLAFRASQGFELGNPIGDEIPHDFGEVGRHQCLGALEQHRHRARRLVANVILEQAVELAQDVFAVGDLAAGSRCRRGDGCDRRGAPLLVGGRFGARRQGLAGALRAVQVEHLEGLAQQLTKGTEVESLGRADPFGDAALDGQGMFLGAFQGAPGGGQRIGVGIGEGAGDLLGTQGLAGEALQPGGVQRGAQVDRAERPRAHQRDRPDQLQQRFGDQAGEGVDTEGGVVVVIGVEQRIDAVPVLAEQLADQQQAVGEPVQAVEGDVALQQQVGYPQVLATAEQFAGQRAYARPLRRFGGQHGIAHLALGLALGDAFEFEERGVVLQIVATGRVRGYGSQQNGYIQHGDDLPIIEAAARPSPSLVRSTPSDLVGAIDEYRMTRKVGKILVACRKACQGRHNATSCMTPQIGQIFKRRRISLL

SEQ ID NO: 17260 - protein, 557 aa, Pseudomonas aeruginosa
HRPARQRQSADRSVHQLRRPDEPAGRRIGACLRRTGAHPAPRGDGAFPGRLAAGHQARPVRLPHPAAARRGAASGPCTGRTARLPPAGTGDPAAPRDHPGATARWRRTADSGRLGPVRRTARQHARAKRHARRPAAADGRTDAAGDALRRPRDHPTATATATATATATATATATASERGGADAAGKRRRVGRRRPAASVPARRRHDPVEGRPGRRRSADGSHRPQLSRPGGRTGGRAARAGQPEGRVPHGADHDPAGAEQPAEVRAERRRGHAAPAAPRQPGVHGAGSRGGRQLRRPQGAPAGGDGRRAGRHPPPAGALRTGRAGSPLRQAGRTFRPAAGGPPGTELGQFHRAVREDPARGGGRLPGAFRPRIQPRLRGTQRSTTAFLTPTNTRRNNVNEDDTMQKLIVALFGLLLAACSSSPPETPPTRVVIWLHAAPNLNPSAAGQAAPLRLRLYELKKDTAFGRADYFALTDNAQSTLGGDLVEQDEFLLRPGEERRIDRTLDEQTRQLGFVAAYRDLDRATWRQVLDVPGQRTSHLDITLGAQAIGIVARPAP

SEQ ID NO: 17261 - protein, 449 aa, Pseudomonas aeruginosa
TFGVPMSWNNRVVWSEGMFLRPQHFQQHDRYLETLVDGRCRSLLAGGWGFSELKLDDALLTQGKLAIVSARGVLPDGTPFNIPADDPAPAPLNVEESLRDGIVYLGLPLKRVGTRDTVEEGEALGGARYVSQVQEVRDDNAAFESRAPVALGSQAFRLLTERDGLGEYAAVGVARVREKRADQALSLDEDYLPPVLDIAAAPPLASFAKELLGLLHQRGEALAGRVVASSAGGASEIADFLLLQLVNRAEALTGHLSRVRPLHPQELYRELVALAGEFCTFTASQRRPEEYPVYNHDDLAASFAPVMLALRQALATVIDAKAIAIPIVEKAYGVHVAMLSDRSLIDNASFVLVVRADVPGESLRGHFPQQAKVGSVEHIRDLVNLQLPGIGLLPMPVAPRQIPYHAGSTYFELDRGSAHWKQLTHSGGFAFHIAGQFPGLNLAFWAIRG

SEQ ID NO: 17262 - protein, 376 aa, Pseudomonas aeruginosa
ATMPPIDDPFGTPAGGGNGSPPDDRTMIMPRPGGRAPEPAGGPRGGDPYTPPPMASLAPLSGRGDGLNPLEQAAGPLLAMLTRLRNTIAHPAPASLRAQLLGYLRQFEEKARQAGVAPDEVMLARYVLCTALDEAVLSTPWGSTSDWGKQSLLITLHNEAWGGEKVFQLLEHCLQNPHQRLHLLELLYLCTSLGFEGRYRVMHDGRSQLEALRERTAAVIRSTRGEYEHELSPHWRGLSVMRDRLSQYLPPWVGIAIGLALLLALLFGLRMKLAADAEPVFKRIHAIGEIPVQAIDRPAVQPRVIERPRLARFLADDIKAQRVAVEDAVDRSVVTIRGDELFASASASVRDEFQPLLLRIADALRKVKGQVLVTGP

SEQ ID NO: 17263 - protein, 1251 aa, Pseudomonas aeruginosa
RQPADRHAALPVQLETVPGPRPGGRRPARRDHRRRRPLHRRRAQRHRAGGDQCQRRRPRTQPPGGNHRIRGGRAMKGFLNFFARWVVPVLGLLALSLIIWFLGPLLRLGNYEPLASATSRWVLIVLLFLVWIGFRVLRIVQARRNAAKVMQSLAEVSAPDAASVATAEELATLKQRMDEALALLKRAKLGGSERRNLYELPWYVIIGPPGSGKTTALMNSGLDFPLAAQMGAGAIRGVGGTRNCDWWFTDEAVLLDTAGRYTTQDSHAQVDKAAWLGFLDLLKTQRKRRPIDGAFIAISLSDLLLGSDAERAAHAQAIRARIQELYQQLGVRFPIYVMLTKFDLVPGFMEFFDSLNREERAQVWGMTFALDDGKSAEGPLAVFDSEFALLEQRLTARLVERLQQERDPARRDLVYGFPQQFAALRECLGEFLNGVFKPNPYEERPLLRGLYFTSGTQEGSPIDRLIGSMAQSMNLDRQHLARQTGTGRSYFIERLFREVAFGERGLVGTNPKVERRRKWLTIGALSATALVVLAVTAVWIASYRANQSYIAAVDQRVDPLARGIESLSPAQRDVLAVLPQLNAVQNLAGDAPSWAEGYGLYQGDMLGEESASVYRKLLIAVFAPRLVTRIEEQLRSGGSSDFLYEGLKAYLMLGSPDHYDADFIKAWISLDWERNLPRDLSPEQRQALHAHLDALLERRPPSARLDQDLVEDLRRQLQQLPVAQRVYDRVKRQRLPKDVPDFRISDAAGRDAPLVFARKSGKPLTDPLSGFFTYRGYREVFLTASLSQAGTIAEEQWVLGRDLNDAGDAANLALDVRRLYFQDYLRQWDDLLADLTVVPITNVTQAADVLRILSGPTSPFRKLLEAVARETDLQKGDRLVAAQVKKAADGTVDKLKQRLGSLVGQEEEQGAREQPQQADSDPISAHFAELNSLVSKGEGGNEPAPIDSLLEDMNALYVQVSAMAGASGDSLLGDAKNQVAAAASRVALSAERQPPVVQGLVKNVVNSTTSSMMGSVRNQLNAAWISDVVSVYRQSLAGRYPIAAGSSRDATLEDFGHFFGAGGVMDSYFRQYLQPYVDTSASTWRWQPGAAQKLGINPGVLHTFQRAAAIRDAFFRSGGMQPAVRFELKPVTMDAAISQFILDLDGQQLTYDHGPSRPVAMQWPSANGLGVVRLTVTPPPSSGRSGLTLEGPWAWFRLLDQSDLERGNSPDRFTLRLRIDGSSIACELRASSAFNPFKSRVVSGFSLPERL

SEQ ID NO: 17264 - protein, 150 aa, Pseudomonas aeruginosa
  UNSURE (140),(143),(147): Identity of amino acid at the above locations are unknown.
PAAPRTTSRPWWSGPSETDMDIELPGFDIERELGEGAMATVYLATQRSLQRKVALKVMAAALAADPSFAERFLREGRTLARLSHPNTVTIHDIGNVGSCYYMAMEYLPNGTLKERIQQGLDPELGLVYVRQVLPRSGTAXPGXGRTXSPM

SEQ ID NO: 17265 - protein, 534 aa, Pseudomonas aeruginosa
SSAVFLVGAAEFAAEKLLEVVLRLAQDLRVQLGETVPVLCLAGPRQQAGKSGRLAEAGFQRGRFEARQQVADGGLHAGHHRQLVRLEVFEAVGHRAIRRHERLVVAAQQEQHGLVDVRRELQRVVLHRLDHGLRHAELALQAGPRAQHVHQSFHQAAIAAADGFHLRFGAGRVDLQLGHAGAAQERLQQVAAGRRGGACRRRRRRHARWLWLWLWLWLWLWLWLWLWLLGDPWVGEGHRQRRRFGRRQRLGDGRGAWRGRVAEQFGERVPVGRNQRCAASGRWRRGGRGGRRDHRFRRAEVVLFGRYMVRTRRRAGRRRGEEVEQVGLGVQRRAALEMRRHRGVRGGRRFGEGRRRSGGLPAHQGVEAGERIGLRIAAAGQGDVMAELDEDVVFAEADGLAVLQRLAVAAAQAVPGIDQQHAVGAGVGEVVHPVAVEDGAVAAGDQALRVRQDPVVVRAPTDGQLSLVQYLFRTLTGGQLVVAGDGQSQRHCYSLHCQRPALPGAHPRARGISVRIQAGPTAFRRFVASGRHIG

SEQ ID NO: 17266 - protein, 248 aa, Pseudomonas aeruginosa
RQRPHLPYQRPHRPGRRTAAATGLGDPAGALAGVRPGQPARRAERRRAATLRQRDPESRADRRRLRRCRRRCAGRHPARPGRRPGTCPGHRERRRRTGRLGPGTRPRSPSSTAAPGPPGVRPVRPAGRRRALGAGRRSGRRRAGGRRACRSRRRAGTASQRRDRQPRRRPAPARPPARVLRSPRAVEPGAGAAQARQDTGDGRLRRNREESHPRWDFPVRNPARPGKRVTPSGRPGQRCKPPGRFRRR

SEQ ID NO: 17267 - protein, 832 aa, Pseudomonas aeruginosa
PDRLRIPHRPPGDPVAAGSGPGRLLRQSRRGARPPRRQRAAGQGRPAHPPAQRRRHPVRQPVAGRPAALPARRRRTTLPPLRTIARQRLRGVRPRPGQCLGRTPADEQPACARLRRRGRAAAGGAAGVPGLPPAAGILRPAGALPVRRVLRPEPRPASMPRRGAGTGRAVRQARPAPGGHGGRGATGAVLHPGDQPVPAPLRPHPPVRPGQRASRDRRPHPSAGFRGAFAATGERPRQRSGATLPTVLRGARPGALRPRAGLLQRAPRTARAVQQAAAQGPALDLRRQRDLRRPGRRQPGALSPRPAPARHRRAVHQPRPAAVHADRRAQERLHPGGQRAGHAGALPRRTEPAARQPCPRCQRLAADQPAVAELPVAGRARPGRRRPARAAAALRRQRRSGAAIADRGPARGQQQALHAAPADARADRLRPWPGDHPGLRRERVPRHRGVPSRRCVRALPGTLRVDQQLYRDGAAHRRTGRGDEMAGEAGQPSEPLNLLAGMAAAPWDYDFFQALRRIECESPQLPRLGHSVRLADDPLRLGQKPDCTFAPSTLASVSQAGTAAVPRLDQFFFGLTGPNGPLPLHLTEYARERQRNVNDATFKRFMDVFHHRLLTLFYRAWAEARPEISHDRIDDDYWSARLAALSGRGMPSLRGREPLADTARYYYTGHLAAQTRYPDGLRVILAEYFEVPVAVEEYVGQWLELPERSRLGVDSTSLGMDVCLGTHVWDRQHKFRLRLGPLDLDQYQRFLPDGDHFVELAAWVAEYLGEELDWDVNLVLQRHEVPPLGLQGGGRLGFNTWLGDPGQDARDLLLARQYATARPHEHKEKEHE

SEQ ID NO: 17268 - protein, 230 aa, Pseudomonas aeruginosa
RGDPPVGGHPHAPPAEQPDPHRRGRRRQDRGGGRLRPAHRRRRRPAGAEGRRTARPRRRPAAGRGEHEGRVRAAPAPGDRRRAEFREADHPVHRRSPHPGRRRWRGRHRRRRQPAQAGPGARHPAHRGSDHLGRVQEAHREGPGADPAFPGGAGGRAVRAQGHPDDARRRVDHGEAPPGADPRRGAGGGGPAVAPVHPGAPAAGQVGEPAGYRLRAHRHQPARGAGRGRR

SEQ ID NO: 17269 - protein, 266 aa, Pseudomonas aeruginosa
PPSHRGAGNRAGDHPPRERHRRRHRRTPAQRRDPAGRGARAPGRPGAALGRGKTPGRRTAGDPRPSACRRRSGGRRRRAAGRRRGASRRGTAPGAACAAGGAAGATERVAGRRAADPADRGLSGGGLGGRRLDRHPGRPHGAQRDRDRAQPRPAPEEAHHRPGPRAGDDRQAHPDFPRRPRQPEQADRRVHARRHLRGGQDRDRTGLGRGHVRRRAECHHHQHERVPGSPHRLHPQGRPARLHRLRRGWRADRGGASQALQRGAAG

SEQ ID NO: 17270 - protein, 136 aa, Pseudomonas aeruginosa
SRPARRSAWSAARAWWSSTPTAPSISPAAPSTSTPAATATSTPAAASTSIPAAPARSTPRARACRAPSTARYRRCFRRRRRAEAAASWLPALGRDAAGVLTIRACPRQAEAAVAQDRWCCAQGRSTFRPRPVRIPT

SEQ ID NO: 17271 - protein, 206 aa, Pseudomonas aeruginosa
ASTTTTSSVPARAWRCVRTSPARTRRPTTRCTTTPANTCRARTASSTRGPVSKPCRRATNGCACAAAPAAWVRATCSSSAATRARTRTASTWWSAPSTGWSRNSTRPAAAGSARSSRASWTASMPARPTAPCRPLRCRSSVARRLRWWSGPRARRSGPTSTAGSRCISTGTATTSPTRTAPAGCASPRPGRGRTGARSRSRGSARK

SEQ ID NO: 17272 - protein, 401 aa, Pseudomonas aeruginosa
SSVAPIFPAAPPGSTGSRAVRCRSTERGGPDMELLNATPLAAAYNQGLDAEGRESLVVIAKGSFDLPLDGREARLLDEQQTLLMVDEFYGEPGFSAPRRECEFVPFKPFCDVLVLGSAQAPGGRPVQQLTAGIRVGRVSKALTVHGPRQWEPGLLGAGAGVAQPFQSQDISYASAFGGSHASPDNPGFMDCYMANPAGCGWFPRSADTAEIVGTPMPATEKLGEPVDSPHGRFTPMALGPLGRHWQARVGFAGRYDDAWLAERFPFLPADFDERYFQSAPADQWTDHLRGGEEVLLLNLTGEERAAFRVPRREVPVTFFLKKGGHETAQARIDTLLVDCDARRVEVTWRIRRPLKRNLFEIAQVLVGSKSAAWWRARELGKDYYPSLAALARSRQAEEDEA

SEQ ID NO: 17273 - protein, 436 aa, Pseudomonas aeruginosa
RCRRRVVEHRRERHLQLRRPAMDAHRLSIAAIVDQHAEEAAFLALLRDYAVRAPHYDLEELAELDQRIEAHLDGLAIAGQAGHDALLEQLDAHAQGEAFALAVLAMQAGDDALIGRMRACLAASPEARRGFAAALGWLDWDQARPWVERLLASPEPLFRAIGLAACGMHRHDPGPALLSAFGHADPAVLARAARTAGELRRRDLMANIRAYRAHDDPSLRFWANWATAQMGDEEALGPLRAFAGQPGPFQLPATMVLLAWQPRDTSMAWIRQLMQAADTRRIGIQATGLFGDPVAVPWLIQQMRDESLARVAGEAFSLITGADLALLDLELEALPDYDPGPNDDPDDDNVALDDDENLSWPEAERVSAWWRDNGARFVAGRAYLLGEPLGEARCRQVLRDGQQRQRMAAACLLARFVPNLPLFPTGAPVRRQLDLF

SEQ ID NO: 17274 - protein, 278 aa, Pseudomonas aeruginosa
PIGHVGRSAFVVPFSYGESVGRRGKIQSIHSSRFRTMPDRMRGVKSDSPEQESADDALKRIVDGFQHFRREVFPEQQALFKKLANSQRPRAMFITCADSRIVPELITQSSPGDLFVTRNVGNVVPPYGQMNGGVSTAIEYAVLALGVHHIIVCGHSDCGAMRAVLDPQTLERMPTVKAWLRHAEVARTVVADNCDCGASHDTLGVLTEENVVAQLDHVRTHPSVASRLASGQLFIHGWVYDIESAQIRAYDAKQGRFLPLDGEHPVPMATPAPRYLNS

SEQ ID NO: 17275 - protein, 463 aa, Pseudomonas aeruginosa
TGRYYKKKHTAHTQPAPGLVLASLPRRGKNSQENCAMHVSKVFPSLRDTLPRDLMASVVVFLVALPLCMGIAIASGMPPAKGLLTGIVGGLVVGFLAGSPLQVSGPAAGLAVLVFELVRTYGVAMLGPILLLAGAIQLLAGRLRLGCWFRVTSPAVVYGMLAGIGILIVLSQLHVMLDLAPKASGLDNLLAFPQAAFAALGSLGMDSGLDAALLGLGTIAVMWGWDKLRPQRLRFLPGALLGVSLATLASLWLALDVRRVQVPANLGEAIDWLRPADLLALADPSLLLAAVVVAFIASAETLLSAAAVDRLHDGPRSDMDRELSAQGVRNMLCGLLGALPMTGVIVRSSGQHQCRCANPRLGDLPRPLVARLRPPARQPAAADSGGEPGRGAGLYRGQAGRFQGPRQPLSLRPDADAGVRGHRPGDRLHRPADRRAGGLRPDPAEAGAEGGAAEDRPALHRRA

SEQ ID NO: 17276 - protein, 452 aa, Pseudomonas aeruginosa
SWSFGAVMPAFVGLANWMIPLMIGAPDMAPAADEQFQLLAAAGGLRPAGQHPVHARRRPQLRLDLLCAAVDHLRPAQRDLLHLRHPPGRDQLDHGRDQRDRHHPQPARPGHDPDEDAAVRLDLADHRVPADRGDAGAGRRGDHDADGHPLRHQLLQRRRRRRPGAVPARVLVLRPPRGVHHDPARLRCGQCDHPDLRAQAAVRLHLDGLRHRQHRLPLLRGLGAPHVRGRHPGHRRAVLHVRHHADRGAHRGEGVQLGDHHVGGFADLRDADAVRRGLRHPVHHRRLLRTDAGDRPGGLPVPRHLLRGRPLPLRAGARRDLRHLRLGLLLAAEVDRPHVRRDPRQAALLDELHRHEPGVLPDALRRPRRHAATDPRLQPAVRRLQHGLVDRRLHVRHHPAAVPVHRHQVHPRRQAGPCQALGRRRGPGVEHPLAGALPHLQHPARGQVRSAS

SEQ ID NO: 17277 - protein, 361 aa, Pseudomonas aeruginosa
RWPTPFSISLRGSRPYRLRDDKENNMASHEHYYVPAQSKWPIIASIGLLVTVFGLGTWFNDLTAGHKESHGPWIFFVGGLIIAYMLFGWFGNVIRESRAGLYSAQMDRSFRWGMSWFIFSEVMFFAAFFGALFYVRHFAGPWLGGEGAKGVAHMLWPNFQYSWPLLQTPDPKLFPPPSAVIEPWKLPLINTILLVTSSFTVTFAHHALKKNKRGPLKAWLALTVLLGIAFLILQAEEYVHAYNELGLTLRRRHLRLDLLHAHRLPRRPRDPRRADPRHHADPHPARSLRCRAPLRLRGRQLVLALRRRGLDRPVHLRLRDLTATGGIRNARARGCSARRCRSPRRPAPGSPRRAPRGRSAN

SEQ ID NO: 17278 - protein, 392 aa, Pseudomonas aeruginosa
RTCNCCSSSRISVDRRGRRGSRPDEDRTTRKRGPRMTGATRKPGFTVAVLATLLAAVVVLLGAYTRLTHAGLGCPDWPGCYGFVHVPLSEAQLAHAELHFPDAPVEAQKGWNEMIHRYFAGALGLLILGLALHALVRRGRDGQPLKLPLLLLAVVIAQAAFGMWTVTLKLWPQVVTAHLLGGFTTLALLFLLALRLSGRFAARRYPAATRGLAGLALLLVIGQIALGGWVSSNYAAVACIDLPTCHGEWWPRMDFANGFHLTQHIGPNYLGGQLDSDARTAIHMTHRIGALCVTLVLLLLAWRLQRSGLVWPTALMLLGLSLQIGLGISNVLLHLPLPVAVAHNGGGALLLLSLVLVNYRLRAPASVRAPAPSPQRVRRTLPPAQGSRLKAA

SEQ ID NO: 17279 - protein, 167 aa, Pseudomonas aeruginosa
  UNSURE (124),(150): Identity of amino acid at the above locations are unknown.
SCRRRARCRRWSSPTRTARRSALPVSRVAGTCCSSATPSAPMSARPPSPSSANCRASCRREVRDDLQVVFISVDPNRDTPQQIKQYLGYFNAGFQGLTGTPENIQKLANAMSIPYIPADTSKPXYTVDHSGNLVIIGPDGEQHGFIRAPXNNAKLEAQLPGVLKPQA

SEQ ID NO: 17280 - protein, 213 aa, Pseudomonas aeruginosa
FPSLPPPSAALRASGPAHADVRDVVFQVDLGDRDEAIAAVVGLQVGLGREVHRGIQPEALRRLQRAFHQLVTEPLAARGRGTDHPADHHLALVANRVQQAQVGEQLAVAPGHQVMGIADQIEAVDFLIGAFLFHHEDLGAQLQQRVEFLQGEVGVVLAGPVERHGRDSGAGDRNAVMPWAAGRWKGVAGRFRFRTHAAILCRTAGGVSCVGKN

SEQ ID NO: 17281 - protein, 259 aa, Pseudomonas aeruginosa
LSSLLGSKKELTREASAMTQRKAVLVMGAGDATGGAIARRFAREGYVACVARRNAEKLEPLVQAIRDQGGEALACGCDARQEQQVIDLFARIEGEVGALEAVIFNVGANVWFPITETTERVYRKVWEMAAFGGFLTGREAARVMLPRQRGTIIFTGATASLRGRAHFAAFSGAKFALRALAQSMARELGPKGIHVAHPIIDGAIDTDFIRETLPELYKRKEQDGILDPEHIAETYWQIHCQPRDCWVHELDLRPWMETF

SEQ ID NO: 17282 - protein, 203 aa, Pseudomonas aeruginosa
SPPRKEPRMSKQIEFFFDFGSPTTYLAWTQLPRIAAAHGASIAWRPMLLGGVFKATGNHSPIEVPAKGRYTLHDLARYAKRYGVPLAFNPAFPINTLTLMRGAQGYLGGEGFQPYLKAVFEALWVRQQNLGKPEVVAQVLAEAGFDPDEFLRLVGDEQVKEGLKATTEEAVRRGVFGAPSFFVGDQLFFGQDRLDFVAEALAG

SEQ ID NO: 17283 - protein, 359 aa, Pseudomonas aeruginosa
PEEGRPHRPEVGDLLRNPHHHRPGPRPGGRLQPGPGQRRQHPSQRTARRRRRPVYRAHPGDPRPRGIPHGPDPDLCVQRLRRERHPPGPAVLRAVRQRPEPGRRAGQRRGPPDQRIQPHRVPHHGHDRAPGTARRVRRGGLHHRPLRRRLAQPPGRAGAGVLRHLPGLRHGGARQRPASLRGAHAAVPALLPRRAADRDGHRLLRRGAAAGDAQARAHGHPQLHGRPGDSHRLLVQPRRILDLPDPGGCVHRPRHRHAAGDDRPGHHPAGFAGDLQGRPRHSRLGPGDPRRHPHRGAGDPGGRPGAGAFGGLVHGHRSRADQPDRQLRGHRDHRPLGKRHRYAARAGHTRRAPGGAGQG

SEQ ID NO: 17284 - protein, 122 aa, Pseudomonas aeruginosa
GLHGLPPAPGEAHLEPDLPQRFRTDRQRPGTQRQPGAPPAGIRRGDPPGTRRHPPCDPPARQRAGEPGDAPAHPQRRRAPEHRPALAAGLIARARVPTRDRRGARTAFVRRLRRPTSTTRQV

SEQ ID NO: 17285 - protein, 158 aa, Pseudomonas aeruginosa
ATRTRTRTRRSGATLKRLLTVNRKVTGRGKIQVSMAGNQALRMAAAAIPSKWDHQHPEPPVEPADGETGPAADGAVGVGGEGTGIGGGDRHFAEHAHDQHHQGAGDQVGEQGGRAGGGDGMAGADEQAGADHPGDRQHGDVALFQAGRERGVALVRQL

SEQ ID NO: 17286 - protein, 246 aa, Pseudomonas aeruginosa
LRKKKKGMVVTDHACRRQPSEAGEGELRGLVAGPLRPALGDGLASGVEAHAVRAVGVEVAEQRALPAAEAVVGHRHRQRDVDADHADLDLVAEQACGLAVAGEDAGAVAVFVVVDQLHGLFQAVDANHAQHRAEDLFLVDGHFRGHPVEQAAAEEEAVLVAGDLVAAAVHHQLRALGHAAVDVAGDLGLRGGSDQRAHVEAAGSAGADLQRLDLRNQLGDQRVGHLVADAYRPPNIRHAAPRRMEP

SEQ ID NO: 17287 - protein, 180 aa, Pseudomonas aeruginosa
NNNGQIPQPVARPGQRFRYPPAAHLQDHRRVRQFLRRGEHSRPQPLGDQPAHGRPGEAPGHAPVPARPRRLRPDRRGPRGLSRDPDPAGGAGGVPRRGQRPAPAPARRTQHRHHQQPGDPAADAHHPRSQRAQGAGTAGADQHRHDHPQRDRTGRARRSPACRRGAVDQSAVGARVPAAV

SEQ ID NO: 17288 - protein, 111 aa, Pseudomonas aeruginosa
RELRPPAERRLFSTARGGGMQRRAEPTRERGSHSFAWRRSPITQVSATARSSPRVFSTNRVSARPRACSMRWAIIGVAARSRATKSASRPGRKLPTRPSRSSALAPPRVAR

SEQ ID NO: 17289 - protein, 135 aa, Pseudomonas aeruginosa
SAIVRCALRRAVPGAAPPPARRPRPRPPVRGWRAAGSRPVRTSRRRRRPARRGRRSPVAGRRRSAGNSDRPGRCSASPLRSPLRRRAGRGRWRSATAGWSGRRRARPRRARPGWRACRWPARRPRVRRRCSAGRG

SEQ ID NO: 17290 - protein, 1257 aa, Pseudomonas aeruginosa
RNRRGRPACRRNRRCSKALREAEAGHDPALEGVEGAAGAQLAGDAGAVDAQPQGEAVRRVAAFQVRLVEQAEPGPGAFQGQAGTAAAGRRRHRQADHAEAVGARPLHRHRAAGAVVVGQLLAVEVEDELADRRVHGHRLEFEAHRRLHAAGAEEGVADRCRALEGVQHAGIDAELLRRAGLPAPGAGGGVDVGLQVLAEVAVHHPTGTEEVAEVFQGGVARAAGGDRVAPGQGLPVDADHVADPGRVELVAHAAHHAAGGGVDHVLHQSLDHRRLALGAEGNARGGGGHLVLGVAEQRVAAGSGHGADLYVKRVHVLQQAVDRRRFVAALALADQAVEFGEVGADRVAVGLLRLFAGALLLLLADQRAEALLELVHGAVGGLLHLRGDQPVALLQVGLAGHRLEQLAERRGRSGENAQHVGGLGDIGDRHYGKVGEQVVPLPQVVLEVQATHVEGQVGGVAGIVQVAPEHPLFLGDGAGLAEAGGEEHLAIAAVGEEAAERVGERLAALAREHQRRVAAGGVADAEVGHVLGQPLPLDPVVDPLRHRQLLQLAAQVLDQVLVQARRRRPSFEQRVEVRVQRLALFRREVARQVAFPVEADPGLDEVGVVMVRAAEHQVGLQALVEEIAAAAGAQLFLDAGHQARGEHRDQQLAVDAGGLLAEHVALVQPVAFGPARRVAGEILHRVELWQYGQDVALGRAQRLDAARQRVDALVDRGDVALVGAVAGDPYRRHRQHHQRGGAQRADGQPLAAALDLRVGADQAAFAERHFAEQPLDEVAAPGSGLPRQVLAVEVHRLRHAADQAVDRTAFLGSAGEVQAAQQRAFLVGVGLEHAVEELAEAFAQGGELLREAVDQVAPRRVALLLQAFHQARGETLFEQGEFAVEHRQRAFRALAVVEGEGHPPDLRAFLAVQAVEELHEARHQVELGQHHVDREAHPELLVQLLDACADRLGMGGALGVAAQQQVGKADGDERAIDGAALALGLEQVEEAQPGGLVHLGVAVLGGIAAGGVQQHRFVGEPPVAVARAADPADRPGAHLCGEREVQAGVHQRGGLARTGRADDHVPGQLVQVAPLAAAQLGPLEQGQGLVHALLEGRQLFGGGDAGGVRRADLGETLHDLRRVAPGLHDAQHAEADPDQEQQDDQHPAAGRRGQRFVVAQAQQRAEEPDDQAQGEQAEHRHHPAREEVEEAFHCAPSANTVISTRRLRARPSALALVATGSVSLRPSAVKRPASPVVAPSWSATSWARAWDSFQLDG

SEQ ID NO: 17291 - protein, 1017 aa, Pseudomonas aeruginosa
RSVAIGRLSLWPGDQHLALDLAQGVGDAQQQRLELVAHAGAGAGEQLVAADGHHRAVDGVLHRHPLGLDVVGEEARQAWPLDHPRLHRRAVDGLHRDLADGVDALEHRLGVGGQLHPQAEQQGQQQGQADGDTDPRRQVLRKAVAHHAEAAPVRRQFVLVLAAGAADHRRGALAQRLQLAAAVVHDPVAAFEAEAGAQVQQLQQVQALVRVLQAVFEQLEDLLAAPGLVVQGDQQALLAPVAGAAPRRAEHRFVEGGAEHVARQHHFVRRHAGLACLLLELAQVAEQLRAQAGRRRMGDGVAQAGEHRQQWAGGLLQRVEAVAAAAQRRQAGHRRRRVGIAAAGAAGRFRGAAAGTRHDHGAVVGRASVAAAGRGAEGIVDGRHRCLSSNGPEGQVQPGELAGDVEGEAAGVRQLLPMRAAAVQFEIGGAGVVGDLPRRHRHRQQADTRQLQVDQVADVLHRADLGLLREVPAQALAGDVGAHHQDEAGVVDQAAVAEHRDVHAVGLLDDRDGDRLGVDHRRQRLAQGEHHRGEAGGQVVVVVHRVLLGTPLAGGEGTELAGQGHQFAVQLLRVQRAHAGQVTSEGLGAVDQLQQQEVGDFRGAPGAGCHHPPGEGFAALVEQAQQLLGEGRQGRRGGNVEHRRQVVLVQAQGLVRALLADPRDAHRGVFAEAVALGQQAERLAAQGHRGAALEGGIVVAHFLHLADVAGAAEGLALLYRVAGADPLQRQAEVDDAIAQAFLDIQRRRRRIVGGDVERRTIRQHAAGADDGQLALGQQGIVQLQLGKAPAARQERAAAAIHQGFQVAVVLLEMLWPQEHAFGPHHAVIPGHRDSEGSGRGTRDDADGLRAERDVEMAGALPRHVEDLAPGGAVEVAVGGDETELAGLLVERAVDAPFLARTQEELVLLHQVATEGRLGVVGEGEVVGAAERGVFLQLVQPQAQRRRLAGGGRVEVRCGVEPDHHPGRRGFRRAGRTGGEQQPEQRDDQFLHGVVLIDVVSPGVRWRQERRSRALCSS

SEQ ID NO: 17292 - protein, 271 aa, Pseudomonas aeruginosa
LRPMASICASAPAGSTFNWVMPAPRRNACSRSPPADAAALAGGVGAATLAGCGCGCGCGCGCGCGCGCGCWVIPGSAKGIASGVGSAVGSGWATGVALGAGVLPSSSANGSQSAGISGAPPAGGGAGVVAGGGGITGSGGRKSCCSAGTWSGRGAAPGGGGVRKSNRSGLVSSGEPPWKCAVTAGCGVGAGSAKAGADPAACRLIRASKLVNGSVCGLPLPGRAMSWPSWTRMSYSPRRTVSPSCSGSLLPRRRRCPALTSSTPLVLVSVR

SEQ ID NO: 17293 - protein, 357 aa, Pseudomonas aeruginosa
GPRSGFDDREIVTVLDVPVLLAAVSPDSPCGDDLEYDAAFLELERIAQGQPERQMGDAVLPAEPPEWPRVRALASELFGRSKDLRVANLLLQSNVALDGLDGLADGLLLVRELLGQYWDGVYPLLDADDDNDPTFRINALTGLVAEPLLQLVWAIPLVRSRAFGPVNLRAALNAAGLQRFASETLSPEQIAGAFADADADALAATRRALEGAQEHALAIESGVAERVGSAQGLDLGPLRQLLRQALQVFDLYGPQGAGEPLAPGAEAAADEQGGAAPVAAVAAPAPRASGEIANREDVLRQLDRLLEYYVRHEPSSPVPVLLKRAKTLVTADFAEIVRNLIPDGISQFETLRGPESE

SEQ ID NO: 17294 - protein, 226 aa, Pseudomonas aeruginosa
RLAAVRANAASRRGDSDGANNRRRAREKQDGKHYQQSEVHRQEPGATRADRVRRGVVRCREEGPAALRHGRHGRPRRQARRTPGGGRRPQVPGDRRGQLRCPAEGDEAAGGLQRTERADRRRQPEPGHHLREHGRLQPRRGGAQGRFAEQAARGAYPAGQPADLHGRQDRRRGNDHEGDQGPGPASGPGQRAEAQRRRAAGVRGFQHGRIEHREPGPGPDHHRADQ

SEQ ID NO: 17295 - protein, 494 aa, Pseudomonas aeruginosa
VRQPAAAGVQAQDRARPRSGGDRRADPRRACPGADQPDLQRRDQVDRVDHRGDRRQAHRAGQPDHAPRRLPATGKRLARPALPGQQHRDRRATEDPRAEHLQAGAAQDPEEIQGHHLGPEPDLQEALRRGIRPVRRRALWLPGRRLLLRPVAAGRRAARRDGEDLRRHARAVHFRRLADGDGHGFLAGTVQPARPDQDLHHPGIRRLAFAARVRGLPLHRPDHAALPGAPALRGEDRSGGRVRLRGRNRRRRQQQVRLGQLGLRDGGQHQPLLQALRLVLADPRRRVRRRGAGPAGAHLPHRRRRRGHEVPDRDRHFRPPRGGAGEERLHAAAAQEEHRLRRLHRRAVAAETRRVRRSGRHRQRQPGGAPALPVRHLPLRPLPEVHRSRQDRFLQGEGRDAALAAGLDPQLRRRRPGPLHRDHQGPAPAGGGRSGGGGSRRQSGLLQLEVLPSPALPARGTDGIATPGIQAAFGQRGLRHSTTAPAMVAGACIA

SEQ ID NO: 17296 - protein, 293 aa, Pseudomonas aeruginosa
IPPGRPSRPPGAMADPSFASGRLGSRLQGSIAMIAEELLRAGRLDDALKALQEQVRSQPSNATLRIFLFQLLAVMGQWARAQNQLKVVGELDASALPMVQTYSTAIDCEALRREVFAGRLTPVILGQPAEWIAPLLQALSLDAEGHGEAAQALREQAFDAAPAVPGRIGEAPFAWLADADTRLGPVLEVIVNGRYAWLPMSNLRSLKVEAPSDLRDLVWLPAEQTRANGGATVALLPARYAETVEHGDDAARLGRKTEWLDSGLPVGQRLFVTDAGETALFDLRELDFEPTDA

SEQ ID NO: 17297 - protein, 788 aa, Pseudomonas aeruginosa
HGRTDPPGAPAAVAARPPHRRRAGQPQGSRGAPGADPEPAEGLGAARPGVAVQHHFAVRPRPRRTDAGRQLGAQLRAAGAGRAHRVERRRACHRGAAHRDHRHLRAAHHPFFVAGARATAARRDGPQRPELRDRGRPLGRTGAAAPAADHQPGPGDRPRARRPGRAEAYMNPRLLEYYNQELQHIRESAAEFAEEFPKIAGRLSLSGFECADPYVERLLEGFAYLTARVQLKLDAEYPTFTHNLLEIAYPHYLAPTPSMTVVQLRPDPNEGALSSGFSVERGASLRGQLGPDDQTACEYRTAHPVTLWPLEVAQADYFGNPAAVLGRLAASEPRAKAGLRIRLRSGAGIPFDSLSLDALPLYLHGADEQPYRLYEQLLGNACAVFVRAPDNAWVERLPTSSLRARGFDDEDALLPVVPRAFQGYRLLQEYFALPARFLFVEFSGLNRALRRCHGEELELVVLFGKHDQRLEGTVDAEQLVPFCTPAINLFPRRCDRIHLSDRVNEHHVIVDRTRPLDFEVHSLQQVSGHGSGPEQPFQPFYAVRDPARYGREQAYFSVRREPRVLSSKQRRKGPRSTYVGSETFVALVDANQAPYRHDLRQLGIAALCTNRDLPLFMPIGAHKSDFTLEDSAPVMQVRCLAGPSRPRASRAHDASAWRLISQLSLNYLSLAERGQGAAALRELLRLYGDSGDPALQLQIEGLREVSSKPCTRRLPMPGPIVFGRGLEITLDFDENAFRGTGVFLLGAVFERFLARYVSINSFTETVLRTGERGEVMRWQAKPGSRPNL

SEQ ID NO: 17298 - protein, 1049 aa, Pseudomonas aeruginosa
SSRSISRSRWRSRNTSANGWSCPSAAASASTRRAWAWTSAWAPTSGTASTSSACAWGRWTSINTSASCPTATTSSSWPPGSPNTWARSWTGTSTWSCNATKYPRWACRAAGGSVSTPGWAIPARTPGIYCWPASTPLRGRTSTRRRNMSEISRVALFGKLNSLAYKAIEAATVFCKLRGNPYVELVHWFHQILQLPDSDLHQIVRQSGIDPARLAKDLTEALDRLPRGSTSITDLSSHVEEAVERGWVYGSLMFGESQVRTGYLVIGILKTPSLRHALTGLSAEFAKLKVEALTERFDEYVGASPENGLSASDGFNAGAAPGEASGALAPSAMGKQEALKRFTVDLTEQARSGKLDPIVGRDEEIRQLVDILMRRRQNNPILTGEAGVGKTAVVEGFALRIVAGDVPPALKDVELRALDVGLLQAGASMKGEFEQRLRQVIEDVQSSEKPIILFIDEAHTLVGAGGAAGTGDAANLLKPALARGTLRTVAATTWAEYKKHIEKDPALTRRFQVVQVDEPSEHKAILMMRGVASTMEKHHQVQILDEALEAAVRLSHRYIPARQLPDKSVSLLDTACARTAISLHAVPAEVDDSRRRIEALETELAIIRRESAIGVATAERQRNAETLLAEERERLAALEQRWAEEKRLVDELLETRARLRAAAEAVDAGGVPLGEGEVRLDEEQRQALHARLAELQAQLSALQGEEPLILPTVDYQAVASVVADWTGIPVGRMARNEIETVLNLDRHLKKRIIGQDHALEMIAKRIQTSRAGLDNPSKPIGVFMLAGTSGVGKTETALALAEAMYGGEQNVITINMSEFQEAHTVSTLKGAPPGYIGYGEGGVLTEAVRRKPYSVVLLDEVEKAHPDVHEIFFQVFDKGVMEDGEGRVIDFKNTLILLTTNAGTEMIASLCADPELMPEPEAIAKSLREPLLKIFPPALLGRLVTIPYYPLSDDMLKAISRLQLGRIKKRVEATHKVPFEFDEGVVDLIVSRCTETESGGRMIDAILTNTLLPDMSREFLTRMLEGKPLAGVRISSRDNQFHYDFAEAE

SEQ ID NO: 17299 - protein, 351 aa, Pseudomonas aeruginosa
PEPRVPGGRRRIPGGPGTLRNRQRRRRLAVRERAGLHRRQPVVPSPAADSGTGGARSADRGGGRTQGRGDLDRPVRPGQGALPLGSPRPVEREQLLLDSRVPGLGREELGFDADPADRPGSDRQLPRRRPGPADHHRAGLQRRADGALRAAGERHPERDEEPFEQGRHAGQLQRDPHGGQEGRRAVIHPRRAQPGQPGRERCLAVGRPRPQQEHRPRRAGAHRQQPHPRSEAQRHPVGGRGEERQRHRHLPDRGRRADPPGLRQERGGVQRRRHHQYLRQRLQPLRQRQRQHRHRRPPRPQFRRRQRGRRQGQGRAGHHRRPGTGDVSAAGEGLRRRHPGCPPLGGTPRES

SEQ ID NO: 17300 - protein, 259 aa, Pseudomonas aeruginosa
LEDGGQALDDLEHRQPAGGDRTGQDHRGQAAGGGGGGDHGGADQGSGHGSGDHRGDTETVGYLIAQSGGGLRIHASVLGSARGRARDQGLHRLLPGRLVVRQVSRGGGQGGDQHRRAALDEHLAQHQVAALALPLVVEEHGGVAVDVDVPALVQLEAGQLLLGVFQLAGDIVGERRVALAGVTADDETGFAGGAAGGELEDVDALVLPGIGNLEIGFVEAIERHCVNPFPRILSESLLDKSFTECCSRIKAFLARSGLS

SEQ ID NO: 17301 - protein, 620 aa, Pseudomonas aeruginosa
FHGTCATDPPGPGRQSARRGGPAIAANGGSRRARPAVRLRAGTDLGKPRPATRRAAGQAGQPGAGTARRQPAAFPRHRRRLQPGIRQRPVRQLPGHPAPLAVAADAHLRLPHLPEPEGPGHHQAGVPRPRLLRLRGRPEPLLPRVGILRAVPRDQFRLRQPADGAGRHLLLVPPRAEPPHPGALRRLRRAPEPAELRQRALLPADPGTARARPFLRLAHGARGAVRLAEPQRLRLPASRRAPGGAFEHRPLARGGRLPAVRLPRRIRAEPGRRAVRADPYRSLAGALRTGAPARPRPRPGFGPPVQAQRLPARGPEPRVPGGRRRVPGGPGTLRDRRRRGRRAVRERAGLHRCRPGLPPLADHSAADRPWPADCGGGRAQGRGDLDRPVRPGQGAFPLGPPRPVQREQLLLDARLPGLGGEELGLDPDPADRPGSDRQLPRRRPGPADHHRAGLQRRADGALRAAGERYPERHQEPFEQGRHAGQLQRDPHGGQEGRRAVVHPCREEPGHRGRERRDPLGRPRPDQDHRPRRDRAREARSHRDRGQQRDHNHRRRPHREGRQQREDQYRREPHRGRRQQRDHQHRRRPHREGRQQREDQHRCQSHRGRRQRRDHQHRREP

SEQ ID NO: 17302 - protein, 234 aa, Pseudomonas aeruginosa
PGRGQELHAQRRRLDHPGHRCRQHPHEEGRQHRHQRQEHHHRRIRGDQRQGRQERGGEGTQDPPELKRRRARESAHECRDPSTRGHDGPSRAPGRCGHRRPPRRAGRRRSGGRLSRLPERARPGGGHHHPAQSRRHRRPGSADVRRRRSAPAAADRPHPAPAAGSAGATGRRAPGVQCRTRDRPALWQGQHHPDPRRQGDHPWRLSFQPLHRGQPDQGRFGADQLSAAGPTWNC

SEQ ID NO: 17303 - protein, 173 aa, Pseudomonas aeruginosa
RCMGRASGNRDCSVPARASRSRSRARTFPTPVPSAAAMPRRTTPVSWIATWPIRPDVAGFRAAPTPPRSSARRCRPRKSSASRWTAPTAASRRWRSARSAATGRPGSASPAATTTPGWPSASRSCPPTSTSATSSPRRPTSGPTICAAARRSCCSTSPARSARPSACRAGRSR

SEQ ID NO: 17304 - protein, 620 aa, Pseudomonas aeruginosa
PGRRAGTTLPSLLGTHRPWPGRWRGGPAQRAQADPGRLPAGPGGRRRLLRQRPDPGRLRGPRAAADQPELQRLHSRRGRRRRAGRRAAPRGGAAVALHRPRLRRREGHGGERGPAAARRRPEPGRARRPRRGWLRPGADGLPAHRHFRRAVLLQGGLADPESQPARAQAEVRPLAPRRLHRRMRRRHRSGVARRGPGRFAQGLRRRAERVLPPGQRCRRTRRRAAQLSTGEGCLMANEVYVNNMEISCKAASGKSIAAFPDVCFTPPQAPPTPLGVPIPYPNTGLSKDTTKGTRTIRITRKEVMLKNKSYYKTSYGDEPGRAPKKGIVTSKIKGKVYFTSWSMNVKFESKNVVRHLDLTTHNHASFPGNTPVWPYLDQATVDAGGGPCSNEVKKEKKDCADFKPHGSKDACAGLGAGKPSGKKTSNEADRLADKVAARKCLTARRCALQPYKPNSCCPQQTAHHLIEASALHDKGRGGKGSVPLKGISNYSENKAPCVCAEGVNQNVGTHGLMHTFQSAAAAKSRSGTLQLSNGSSISAKKTTYGTAKRQSMAAMGKVFPQSKCSKECLSAQLDNYHKQCGINARTPIKAVETGQTDVTAATQAIKTRNARLGATRSRVR

SEQ ID NO: 17305 - protein, 312 aa, Pseudomonas aeruginosa
PLQEIEMLKKLSPIFSNITGVVRYQDLAYVASVSDEIQEQNIAHSYVTEWDCGTWCVAGEDDDMLPWEIVSATVVHEPVEQALFLGARGQVFCMGSGDIHEEQLPDGDDAIGGRGNMRGVACIDGVAYACGMDRQVYRRFDENDWRAIDTGARPPAGSEAVVGFEAIGGFGAREIYAVGWDGEIWQYDGKRWQPRESPTNLLLTAICCAEDGSVYACGQAGTLLRGRNDHWEIIAQDDVDEDLWSLAWFDGALYVSSATAVYTLVGGHLKEVDFGDEQPQRCFHLSAADGVLWSIAAKDIFSFDGQQWMRID

SEQ ID NO: 17306 - protein, 146 aa, Pseudomonas aeruginosa
SPAPTWRCSTWSWRPCPTTTLAPTTIPTTTTSPSTTTRTLAGRRRSESPPGGVTTARVSSPGAPTCSANRWARRAAARSCATASNASGWLRRACWRASCRTCRCSPPVRRCAANWTCSDSWLAPGGQVMAAGAVRRVFPFDEFPCT

SEQ ID NO: 17307 - protein, 243 aa, Pseudomonas aeruginosa
SYAARANINAGARTRASAIFHGLWLLAFVLLLGSLLRQIPVASLAGVLVYTGVKLVDFKALGNLSRYGRMPMLVYAATALAIVFTDLLTGVLVGFALTLLKLVLKAARLKIALRYTGEHEAELRLSGAATFLKVPALSRVLDEVKPGTTLHVPMDNLSYVDHACMELLEDWGRMAPVQGYAPGDRTARLEASPGMAPARQRRVGRRAQWRGGQPRLSSTPSCFDRHGHCCQAATTRGFFRFSR

SEQ ID NO: 17308 - protein, 507 aa, Pseudomonas aeruginosa
TRPALLCAEVRRSKFVVLAVHPLAVGVCRRDKNNDKGNPNAATSTSLDGLPFALGDQPGECRLDGQHGPGRYRGEPVRLRPAHDHLLDLRGDRRAGLRRDVLVDDRPPPLHRPAAGALPREHHGGNPLDGGAVRDPGGDGGARHPHPDPHLRHFRAGAGRAGHRLPVEVAVQVPGPGRRVLQQPGHPAGPDPQPAGEGRALPAGGGRAAGAAGGHQGALPDHLQRRDPFLVGAGLRGQARRHPRLRQRGLDQGRRARHLSRPVRRAVRQGPRLHADRGRRQAQGRVRPVAGQAQGRGGEGQGTDQQGVDQGRVGCARRQGLPHHLRRLPPGRRPGHAADVPGAEGFEDRHRAQGAPLGSGLQRRARHRHGGLRQAAQRGRPGRGDHLRAQRLGQRRWRHGHPERRRRLQAETTIGDRHECCDRYARPPCRRPPPRTGQGPDALGADDQPQGHRHPLPVVQLHDVPARRLDGHGDPRRAVPARPADRRAGVLQPDDHHARPDHGPSAR

SEQ ID NO: 17309 - protein, 425 aa, Pseudomonas aeruginosa
SARRTWPLPRMNNFSFWLLPAAFGLLVSTLFMPGGGPNFGWTFYAPLSTTFAPHSVTFFIFAIHLAGISSIMGAINVIATILNLRAPGMTLMKMPLFVWTWLITAFLLIAVMPVLAGVVTMMLMDIHFGTSFFSAAGGGDPVLFQHVFWFFGHPEVYIMILPAFGAVSAIIPTFARKPLFGYTSMVYATASIAFLSFVVWAHHMFVVGIPVTGELFFMYATMLIAVPTGVKVFNWVTTMWEGSLTFETPMLFAVAFVILFTIGGFSGLMLAIAPADFQYHDTYFVVAHFHYVLVPGAIFGIFASAYYWLPKWTGHMYDETLGKLHFWMSFIGMNLAFFPMHFVGLAGMPRRIPDYNLQFADFNMVSSIGAFMFGTTQLLFLFIVIKCIRGGKPAPAKPWDGAEGLEWSIPSPAPYHTFSTPPEVK

SEQ ID NO: 17310 - protein, 73 aa, Pseudomonas aeruginosa
PSGAGIYGSTFFMLTGFHGAHVTLGALILGIMLIRILRGHFDAEHHFGFEAASWYWHFVDVVWIGLFIFVYVI

SEQ ID NO: 17311 - protein, 277 aa, Pseudomonas aeruginosa
QDDRHFQHGGTPAMGGFMQYSQRLGEAGRNDRRSMRGAFRPGLLPTLVVLGLLPVLLWLGTWQLQRADEKRALLASYEARRGAEPVSPGQLEGLRDPAYVRVRLHGRFDERHTLLLDNRLRNGQAGVEVLQPFYDQASGLWLLVNRGWVAWTDRRSPPTLETPDRVLLLDAWTYLPPPGGLHLADAPAGGWPRLVTQLDIPALWQAFGRAGLPWEIRLEPGDASFDTDWPLVSMPPERHTGYAVQWFALATALLALYLYLGVRRAREKNHESRDSDA

SEQ ID NO: 17312 - protein, 316 aa, Pseudomonas aeruginosa
RPPDRQKDGGKDMATVIDRHSQPTWRDFLELTKPKVVVLMLITSLIGMLLATKAPLDGFVPWQVLIFGNLGIGLCAGAAAAVNHVVDRRIDSIMARTHKRPLAEGRVSPSMALGFALLLALAGMAVLLAFTNPLTAWLTLASLLGYAALYTGFLKRATPQNIVIGGLAGAAPPLLGWVAITGHLSAEPLLLVLIIFAWTPPHFWALCIHRKDEYAKADIPMLPVTHGERYTKLHILLYTLVLFAVSLMPFVIHMSGLVYLLCALALGARFLDWAWALYCDSRPHAAIKTFKYSIVYLFLLFMALLVDHYLPLKLLL

SEQ ID NO: 17313 - protein, 144 aa, Pseudomonas aeruginosa
KRCSKRCGYDSRTSASPRWSPRCWRRLGSIRMSSSAWLATSRSRRGSRRPPKRRCGAASSARPASSSATSCSSARIASISSPRPSPADLPFPAASRSGPPPCAIRAPSSRLRPARAVVPGHSSRPPIAACQADFFAYRLNWSDR

SEQ ID NO: 17314 - protein, 468 aa, Pseudomonas aeruginosa
YHNKNAFIARLREARWKRRMETPAMFIKRCSRSIFLQVVIGLVIGVICGVGIPDLAVQMKPLGDGFIKLIKMLIALIVFCVVVNGISGAGDLKKVGRIGLKSVIYFEILTTIALVLGLVVAYSLGLGSGANIHLNELPAGDVALYTGRTQEIHGPVAFLMGLIPTSVFSAFAENDILQVLLFSVLFGSALNLVGEQASGVARLINEFSHIVFRIMGMIVRLAPLGVFGAVAFTTARYGVDSLSHLGALVLVFYATCLVFVMAVLGSVLRLSGVRMLPFLRYFREELLIVMGTASSDAVLPQVMRKLEHMGIRSSTVGLVIPTGYSFNLDGFSIYLTLAVVFIAHVTGTPLAMTDLVTILLVSLVTSKGAHGIPGSALVILAATLTAVPAIPVAGLVLVLSVDWFMGIGRALTNLIGNCVATVTIARWENDIDMPRAQAILDGRLEAPAKADGEPLKRSAVAGEGKLHG

SEQ ID NO: 17315 - protein, 244 aa, Pseudomonas aeruginosa
RAEARCTSDWQVKGGDMFSSSKLVNAVAQRLLDTIEQGRWVAGQMLPGQRELAEQMEISRPSLREAIMVLETLGVVRSLPGKGVMVLERSEPLREVAAPGEATMEDVLQLRYALEPFIVGIVAQSAGAAEISELRLLLLDLREAVEDGDPQALVEAYTAFHRRLVKLTSNPIFLSVSEQIGSALERSDNLVRRQPEYAEEILQEHDAILRAIRQHDSERASQAMRQHILNEGARLNIDLRLPQV

SEQ ID NO: 17316 - protein, 284 aa, Pseudomonas aeruginosa
SPAPGFQPGTVAAPGRLSSAACEGPQARLDRCEHGRIRSTYPAGRRAAPHQPFRLRKHLHGNPGKAPGAGRQAEQGNPRADLPGQQRHHPACPHPSRRGRRGGDAAEGGRQRRPPGRAPGAAGAGRAPAGGKRSGAATARGAGSRRPCRATGAGRRGAGLPRGPRQRRADPSRRALPPAPGRTDRESLAAGFRPWPGGTRLAGHRAEQGGGLYRRGLRRAARPARCPGGRRQRGGGCADGRLPARPVRPHALPASTHHRPARGIRHEGPSRGKTPEGLTSPAAA

SEQ ID NO: 17317 - protein, 157 aa, Pseudomonas aeruginosa
APGPVRDVLQEAVNAWLTEIDMAYAEWIAVKVVVSKSIGTVGIRNATLQWGKFYRYTNKDDEISTEEVSSMNVQAGSPQWIASCGRENASSGTQGSFDCYDGNTKMGTFSWDDPWKSGATNTWSFTPASADYAGITSGGNATGTDIGEVTLTLGRFS

SEQ ID NO: 17318 - protein, 110 aa, Pseudomonas aeruginosa
LPKGSCPGSGPRLPSSPCPPQWRRSPCLSANPCRFLLAGDCAWGKITGKSARKHAQRARSSSYGKIRTRMGAKHESAKELIRSQWSHVGRSHWSGRKMSIFCELWMFCPK

SEQ ID NO: 17319 - protein, 343 aa, Pseudomonas aeruginosa
PVTLACAAAVTSGPMSRPQEVPAPIFSALICGTSLAISASATWSPTHTGHRIFAMQRLAAWSRRRHPSAALTALSRSASGIRHRMVLRAAQGLHALAALGALGIDVFGDGGRADKADGLHFRRLEQAVHGFLVAVHHVQHALRQAGFVEQLCDQQGGAGVALGGLEDEGVAAGDGQRVHPQRHHRREVERGDPGDHADRLEVAPGVDVRADVAAVLALEDFRGGAGVLDVLDAALEFAGGVFQGLAVLFADQLGNPRLVLLQQLLEAVQHLCTLGRRGVAPGREGGLGGIDGFLQGLAVGQRDLVDGFAGGGVEDVGAAAVVGDHFAVDQVVEGAHLVLFSLR

SEQ ID NO: 17320 - protein, 312 aa, Pseudomonas aeruginosa
FRLGKTIMAKSRNPSLGQVSDFDIRLLRIFKTIVECGSFSAAESTLGLSRSAISLHMGDLEKRLGMRLCQRGRAGFALTDEGREVYRATQTLLAALEGFRAEVNDLHQHLRGELNIGIINNLVTLPQMRITHALSALKGQGPQVRINIGMTTPNEIELGVLDGHLHVGVVPLISPLSGLEYLPLYDEHAQLYCSRGHALFERADGDIAVDEVLAADAVAPSYRLPAEAQARHQELNNSASASDREGMAFLILTGNFIGYLPSHYAADWVAAGMLRPLLPERFHYAIALTIVTRKGRRPNLVLERFLEAVAVS

SEQ ID NO: 17321 - protein, 132 aa, Pseudomonas aeruginosa
SAFMSSSRLSIGAGSLPPSPLLTRLLSSAKWALIGSLSACCGCSRAPCSSSWPTSEPRRCLSLSTVPSAAFFTCAATSRSPFCRSVSRATASSSLRNGEVGPERMRSTSAAWVTLVIGTTVRSASRSSHCRR

SEQ ID NO: 17322 - protein, 143 aa, Pseudomonas aeruginosa
VPSRSPAPSPMPTPMRWPPPGAPWKAPRNMPWPSRAASPNGSARPRDSTSVPFVNCCARPSRCSTCTARRAPASPWRRAPKRPPTSRGAPRLSQPSPRRHREPAARSPTAKTSCASSTACSSITFATSRRARCRCCSSAPRHW

SEQ ID NO: 17323 - protein, 199 aa, Pseudomonas aeruginosa
RPSGPTLQAAGAIPTALTTAVARGRNKMGSTTSSQKFIARNRAPRVQIEYDVELYGAEKKVQLPFVMGVMADLAGKPAEPQAAVADRKFLEIDVDNFDARLKAMKPRVAFNVPNVLTGEGNLSLDITFESMDDFSPAAVARKVDSLNKLLEARTQLANLLTYMDGKTGAEEMIMKAIKDPALLQALASAPKPKDDEPQA

SEQ ID NO: 17324 - protein, 502 aa, Pseudomonas aeruginosa
EDSSMAELSTENLAQGQTTTEQTSEFASLLLQEFKPKTERAREAVETAVRTLAEHALEQTSLISNDAIKSIESIIAAIDAKLTAQVNLIMHHADFQQLESAWRGLHYLVNNTETDEQLKIRVLNISKPELHKTLKKFKGTTWDQSPIFKKLYEEEYGQFGGEPYGCLVGDYYFDQSPPDVELLGEMAKISAAMHAPFISAASPTVMGMGSWQELSNPRDLTKIFTTPEYAGWRSLRESEDSRYIGLTMPRFLARLPYGAKTDPVEEFAFEEETDGADSSKYAWANSAYAMAVNINRSFKLYGWCSRIRGVESGGEVQGLPAHTFPTDDGGVDMKCPTEIAISDRREAELAKNGFMPLLHKKNTDFAAFIGAQSLQKPAEYDDPDATANANLAARLPYLFATCRFAHYLKCIVRDKIGSFKEKDEMQRWLQDWILNYVDGDPAHSTETTKAQHPLAAAEVVVEEVEGNPGYYNSKFFLRPHYQLEGLTVSLRLVSKLPSAKEA

SEQ ID NO: 17325 - protein, 172 aa, Pseudomonas aeruginosa
RSGASHTGGKMAVDMFIKIGDVKGESKDKTHAEEIDVLAWSWGMSQSGSMHMGGGGGAGKVNVQDLSFTKYIDKSTPNLMMACSSGKHYPQAKLTIRKAGGENQVEYLIITLKEVLVSSVSTGGSGGEDRLTENVTLNFAQVQVDYQPQKADGAKDGGPVKYGWNIRQNVQA

SEQ ID NO: 17326 - protein, 263 aa, Pseudomonas aeruginosa
ATCAASRSRRRATCAIWSGCRPNRPGPTVAPPSRCCRRATRKPSSTATTPRAWGARPNGWTAACRSASGCSSPMPARPRCSTCVNWTSSRRTPDMAELTLQERLQPSLLDRLTDDEPGNLKEAAERRVLTLNQLKASVLRDLAWLFNTTSLFDHGPAARMPAGNSVLNYGLPALAGHTASSVDVHAIEALLTETIATFEPRIIRSSLRVRAQLLPGEMDHNALSFEIEGDLWAEPAPLRLLLTTNLDLETGHVRVAQGERRRT

SEQ ID NO: 17327 - protein, 139 aa, Pseudomonas aeruginosa
PCGRWKWPRPTTSAIPPRCSAASPPASRGPRPACASACAAAPASRSTACRWTPCRSTCTAPTNNPTASTNNCSATPARCSSAPRTMPGSNACRRAACVRAASTTRTRCCRWCRGRSRATACCRNTSPCRRASCSSSSPA

SEQ ID NO: 17328 - protein, 321 aa, Pseudomonas aeruginosa
LLPGAAAHRVRVAATAAPRSFGAAGGRPAASRAEARLHLRALDPGLGEPGRHRCGAAPGPVLLRPHRPQRAAAAAPHRIRPGTPAQRQRRDLQALHGRLPPPPADPVLPGLGRGAAGDQPRPDRRRLLVGAPRRALRARHAEPAGARAAGRYRTLLLHRPPRRADPLPGRPAGDPRGVFRGPGGGRGIRRPMAGAARAQPPRRRLDEPGHGRLPGHPRLGPPAQVPPAPGAAGPRSIPALPARRRPLRRAGRLGRRIPGRGAGLGRQPGPATPRSTPAGPAGRRAARFQHLAGRSRPGRQGSTAGPPVRHCAAARAQGEGT

SEQ ID NO: 17329 - protein, 144 aa, Pseudomonas aeruginosa
SASSRRRACAMPSPGCRRNSPSSRSRRSPSASTSTSAPRRRTACRPATASTPVPPRARPAAPWRRARWASRRRSSALPWTSPSRPVAASSTPSSGVTRRSASWWTSSCAAGRTTRSSPARPASARPRWWKASPCASSPATSRRR

SEQ ID NO: 17330 - protein, 650 aa, Pseudomonas aeruginosa
KEPSMGLMQLTRLVQVDCPLGPDVLLLQRMEGREELGRLFAYELHLVSENPNLPLEQLLGKPMSLSLELPGGSRRFFHGIVARCSQVAGHGQFAGYQATLRPWPWLLTRTSDCRIFQNQSVPEIIKQVFRDLGFSDFEDALTRPYREWEYCVQYRETSFDFISRLMEQEGIYYWFRHEQKRHILVLSDAYGAHRSPGGYASVPYYPPTLGHRERDHFFDWQMAREVQPGSLTLNDYDFQRPGARLEVRSNIARPHAAADYPLYDYPGEYVQSQDGEQYARNRIEAIQAQHERVRLRGVVRGIGAGHLFRLSGYPRDDQNREYLVVGAEYRVVQELYETGSGGAGSQFESELDCIDASQSFRLLPQTPVPVVRGPQTAVVVGPKGEEIWTDQYGRVKVHFHWDRHDQSNENSSCWIRVSQAWAGKNWGSMQIPRIGQEVIVSFLEGDPDRPIITGRVYNAEQTVPYELPANATQSGMKSRSSKGGTPANFNEIRMEDKKGAEQLYIHAERNQDNLVENDASLSVGHDRNKSIGHDELARIGNNRTRAVKLNDTLLVGGAKSDSVTGTYLIEAGAQIRLVCGKSVVEFNADGTINISGSAFNLYASGNGNIDTGGRLDLNSGGASEVDAKGKGVQGTIDGQVQAMFPPPAKG

SEQ ID NO: 17331 - protein, 749 aa, Pseudomonas aeruginosa
WTWIKDDFMALAQQTRLVRVDSPLGAEVLQLQRMEGREELGRPFAYELELISENPDLPLDGLLGKPASLALELHDGSRRHFHGIVAACSQGSGNGQFASYQVTLRPWLWLLTRTSDCRIFQNQKVPDIIKQVFRDLGFSDFEDALSRSYREWEYCVQYRETSFDFVSRLMEQEGIYYWFRHEQSRHILVLSDAYGAHQSPPNYASVPYYPPTLEQRERDHFYDWHMAREVQSGSLSLNDYDFQRPGARLEVRSNIARSHAAADYPLYDYPGEYVQSQDGEQYARTRIEALQARYERVRLRGRARGLGSGHLFKLSGYPREDQNREYLVVGAEYRVVQELYETGGGGVGAQFESELDCIDAGQAYRPLPTTPLPIVRGPQTAVVVGPKGEEIWTDQYGRVKVHFHWDRHDQSNENSSCWMRVSQAWAGKNWGSIQIPRIGQEVIVSFLEGDPDRPIITGRVYNAEQTVPYELPANATQSGTKSRSSKGGTPANFNEIRMEDKKGAEQLFIHAEKNQDIEVENDETHWVGHDRTKTIDHDETVHVKHDRTETVDNNETITIGVDRTEKVGNNEKISIGANRTEDVGSNETISIGVDRTEKVGSNEKISIGANRTEDVGNDETISIGANRSESVGNNETISIGADRSESVGANETIDIGDNQSTSIGKNESRSVGQGRDTSVGKDDSLDVGKSFTLNAGDSITLVTGAASIRMKKDGSIVISGKNITIDGSGAINVKADKNVVVKGRKILQN

SEQ ID NO: 17332 - protein, 158 aa, Pseudomonas aeruginosa
SGAEPGSQRMSVEIHLPGATTALPARLDGVVIGVLLDVPDAAAPVVAYPGCPSEHGLAAATTTQLSRADIGAQVALMFVAGDPRQPLLIGRIQRLPQEALAQLDGERLEFSAEREIVLRCGKASITLTRAGKVIIRGAYLSSRSTGVNRIKGGSVQIN

SEQ ID NO: 17333 - protein, 659 aa, Pseudomonas aeruginosa
ILWRAGVFRAAPGVRVRSLQAVLRCAGAGQRPGARRAAGTAVDRGHPRRPGEQGADGAWAAPVGTGIARCRRGRRAAVPEPGHFLRQCLRRQPCLAGQPRFHGLLHGQSGRMWLVSAQRRHRRDRRHADAGHGKARRAGGQPPRPLHADGARPARPPLAGPGRLRRPLRRRLVGRALPVPARRLRRALLPVRAGRPVDRPSARRRGGPAAQPHRRGARGLPRAAQGGPGDLLPEKGWPRNRAGTDRYPAGGLRRPSRGSHLAHSPAVEAQPVRDRPGAGRQQVRRLVARPRAGQGLLPLACRVGTQPPGRGGRGMSQVLSIVASGMVSAVGLSAPASCAAIRCALDNFQETRFIDQGGEWLLAASVPLEQPRRGRAKLLKMAARAIDEALRGQPDLDCTELPLLLCVAEGDRPGRCAGLDESFLRDLEGELGRRFHPSSALIARGRVGGAVALLNARKLIQGGCRQVLVAGVDSFVSGPTLAAYEARERLLTSQNSNGFIPGEGAAAVLVAAPLHEEAPQLLCIGLGFGVEKATVESEDLPLRADGLSQAVRAALAEAGCGLEQMDYRLTDISGEQYYFKEASLTLSRNLRVLKPKFDLWHPADCIGECGAAIGPALLAVALAASRKGYGDGPNVFCHLGNDAGERAAALLSYRRVRAA

SEQ ID NO: 17334 - protein, 202 aa, Pseudomonas aeruginosa
PAAAGDVHHLRGFAHRSRADHPEFPRRPVRHPQRRQRGAALRADERWRLHRHRIRCAGAGRAPHHRLRPLRLRGDARRARPADPGTHADGQGLAAARRGGTHGGGGQLRLRRQPRHPRGAHRRERGGPARSRAHPPLGGLAPGQRATVHPRLGVRHRECADPRLRRQAGSLPAPRRRASGADGHARAALPELVIAAAVRAAG

SEQ ID NO: 17335 - protein, 456 aa, Pseudomonas aeruginosa
QQRFRVTFRRSCHGRPLGSPVPGLNGSLLQEKTHCAHTTGAGPGPGVAPSSWKKFAGELCHACFKGVSVPPGHVAAGPDGLRGGVPRRPAAVHGHRHRLRDAAGQGPAHRHRRWPGGRLPGRLAATGQRPGGRPRGAGLRTGAYLRGGHARADPAARRRHPAARRAAAPGLLVPGHLAGGGIRDARRHRHPHRPFAIARDARPGAQGVRPRQPAGIPPGGVRRARFAGHGQRPRRGAARAGHHRGDVGLGQAASATPALPTRRAARREPGDPGQPLAGAGRAAGPGTGQPRRGHRLATPGRPAGPGRSLPAAGGGGGGLHRQCGDPALGGGGGSPARRPALGHGSRVVRPGCPQHALRPARRAADDRGDRTQLGPTSMPVREPAPRRSSTASGCSPSSSCSAACCGRFRWRAWPGCWSIPGSSWSISRPSATSLATAGCRCWCTRPPPWRSSSPTC

SEQ ID NO: 17336 - protein, 444 aa, Pseudomonas aeruginosa
RRIGTFQRRFYAALLCRSRCLYSHSNAEPDEPGLPCCVPRCDGQSSLSWRSTPWPLASAGGIKTTIRGTRMLRHPRVWMGFLLLSAISQANAAWTVNMAPGATEVSRSVFDLHMTIFWICVVIGVLVFGAMFWSMIVHRRSTGQQPAHFHESTTVEILWTVVPFVILVVMAVPATRTLIHIYDTSEPELDVQVTGYQWKWQYKYLGQDVEYFSNLATPQDQIHNRQAKDEHYLLEVDEPLVLPVGTKVRFLITSSDVIHSWWVPAFAVKRDAIPGFVNEAWTKVDEPGIYRGQCAELCGKDHGFMPIVVDVKPKAEFDQWLAKRKEEAAKVKELTSKEWTKEELVARGDKVYHTICAACHQAEGQGMPPMFPALKGSKIVTGPKEHHLEVVFNGVPGTAMAAFGKQLNEVDLAAVITYERNAWGNDDGDMVTPKDVVAYKQKQQ

SEQ ID NO: 17337 - protein, 119 aa, Pseudomonas aeruginosa
ETAMSAVIDTPDHHAGDHHHGPAKGLMRWVLTTNHKDIGTLYLWFSFMMFLLGGSMAMVIRAELFQPGLQIVEPAFFNQMTTMHGLIMVLRRGDAGLRRPGQLDDPADDRRAGHGPCRG

SEQ ID NO: 17338 - protein, 280 aa, Pseudomonas aeruginosa
TWRSSRCTSSASPACRDGSPTTTCSSPTSTWSRRSAPSCSAPPSCCSCSSSSSASAAASRPLPSPGTAPRAWSGASPRRRPTTPSAPRPRSSEERVMSDAKVDTRRLVGRLLLVTVLMFAFGFALVPLYDVMCRALGINGKTAGSAYSGEQQVDVGREVKVQFMTSNNIDMVWEFRSAGDQLVVHPGAVNQMVFYARNPSDKPMTAQAIPSIAPAEAAAYFHKTECFCFTQQVLQPGESIEMPVRFIVDRDLPKDVRHVTLAYTLFDITARKPPVPVAGR

SEQ ID NO: 17339 - protein, 247 aa, Pseudomonas aeruginosa
GEQHGKPRTLLRPRPEQVADHRQHRPAGDGVRPGYLVQRPHRRPQGVPWPVDLLRRRAHHRLHAVRLVRQRHPREPRRTLQRADGPLVPLGHELVHLLRGDVLRRLLRRAVLRPPLRRSLARRRGCQGRGAHALAELPVQLAAAADPGPEAVPAAERGDRAVEAAADQHHPAGHLQLHRDLRPPRPEEEQARPAQGLAGADRAAGDRLPDPAGRGVRARLQRAGPDPPAPASTARPSSCSPASTAPT

SEQ ID NO: 17340 - protein, 266 aa, Pseudomonas aeruginosa
  UNSURE (123): Identity of amino acid at the above locations are unknown.
PSSTSRRCGRPSVAPGCPGKSAWSRATPASTPIGPWSRCRRSGTPATPCSGSPWRRPCSPSTSTSVCAAHGRKTMSLAIPMPERPRRARGRLQLLAIIGLVVGPMLLASAMYKWNFWVPQGRXYSGALIGNGQTPADLGVQGRSQGEQWQLLVTAPGTCGEDCQQLVYLARQVNIALGREASRAGHALAASGELPADFANLVRQDYPRLQRYGLDPALYDKAGGGERPLLWVVDPHGNLVLRYDAKANGKKLLKDVQLLLKLSHIG

SEQ ID NO: 17341 - protein, 395 aa, Pseudomonas aeruginosa
GQNDKKKGPANDRRNPQTRFHRRRAGDPAGRRGGPARRLYPADPRRPRLSGLARLLRLRPRAAERGATGPRRTALPRRPGGGTEGLERDDPPLFRRRPRPAHPWPGVACAGPPRARRTTAEAAAAAARGGDRAGRLRHVDGDPQALAAGGHRPSARRLHHPGAALSPRPAPLRTLRGAALPGGDPRTGGAGPAPGDRPDRPRRLGQQQLCGGGLHRPAHLPWRVVAADGLRQRLPPDPAHRPQLPRRPARQRRAHGDPHDPPDRRAVRDPGPPAARLAPAAQRPGLADRADAARPVAADRPGHQQRAAAPAAAGGGGAQRRWRPAAAQPGAGQLSPARAGQRPRAGTVAAARAPHAAAGARFAAEGRLTDRRMEVRIWPPSSIATASRPGATSSN

SEQ ID NO: 17342 - protein, 256 aa, Pseudomonas aeruginosa
  UNSURE (182),(207): Identity of amino acid at the above locations are unknown.
SCFSDPTLEPCPPMTRVNKTVLVLVALVALVLGLTVHKVLTAQRQADPTVLLDAGIVILPQTRKVPALEFTNQDGQAVSTASLKGRWHLLFFGYTFCPDVCPTTLAQLRELQGKLPQGGARRPAGGIHQRRSEPRHAAADQAIPGLLQRRLPGAHRHSGEHPETGQRHEHPLHPRRHQQAQXHRRPQRQPGDHRPGRRAARLHPRAXEQRQAGSPTARRAQAAGLIPFPPPTVRGAPGLRPGACRCAGCRLPGRPR

SEQ ID NO: 17343 - protein, 213 aa, Pseudomonas aeruginosa
GRRGACRSSRATWSGFRGRRQERGYAMGGGPLERRGRSVSFQNPRGYPLPNGWRCLMRWEELSEQPCSLARVLAILGDRWTLLVLRDCFLGVRRFDDFERSLGVTRHVLADRLKRLVEAEILAKVPYQERPLREEYRLTEKGMELYPAILSLVNWGDRHLAGVEGPPLEHVHKHCGQHMHGVLVCSECGEPLHARDVTVREGLFWKGRLLRRG

SEQ ID NO: 17344 - protein, 287 aa, Pseudomonas aeruginosa
TSTCACRRSDRPRQGSNPGPSRRPDGFRPPPAKAHKHDSTGVNMVGFEARTQQGAALRPTSHFVYESIYTAILEKRLAPAAKLSKETLGQIFRVSNGTIQRALTRLAEDGAVVMPPKEVASVARPDERQARQVLDARLLVESEVVRQLPAGLDPAALAELRALVDEEQACLAARDSAGLIRLAGRFHLRLAELTENPLLQGFVRGLVARASLDIALNKGAVYTAEACAAQRALLDALEDGDSAAAAALMDAYLRGLFARMRFLPPPTTDLREAFGMKAPRGEKRRRA

SEQ ID NO: 17345 - protein, 303 aa, Pseudomonas aeruginosa
LLQAPVVQRVAHLRQRLVGHAESVEGELTHREHPVGGHPWLQAQFADFPARPAERQVVEVVRGVQGNPVDLGQLLRTVDGRPLAQIGRRRAEHAAPIAEVARHQAGVGEIADAYRQVDALGDQIDALVLEEQLQAQLAVVLQQRFQRLGDQRAGEPHRRRQAQLTHRRIAPFAKPPLGFLGDRQHLRATAIERLAGLGQGQPAGGAMQQSDLGAALQLADLLADCRRGHAQALGRGCHRALVHHSGEDRHAFQRIHAGSSLRETAPGEKSPEKARESMPSGRGRRVTEKYGRVWERSMSQPKN

SEQ ID NO: 17346 - protein, 272 aa, Pseudomonas aeruginosa
TAALPFAGPGPEKLSESVTGNVLNRVELAQAGLSKPRSASRRAISSLDGAESEQAARNSGRAATRPRRTRVGMGMSFVHWRSRIGCAANSSGCGTMGAHSTQGGEPMRLPANLGRLLPALCLGVLLSACSTFGQRDPLRIDLVGLEPLPGQGMEMRFMVKLRVQNPNDEPIEYNGIALDLDVNGQPLASGVSDQTGEVPRFGERVVSVPLTVSAFSAFRQAWGLSNNAPTRGMPYVVKGKLAGGLFGTVRFSEKGTLDFSGPAVGAPKTKGL

SEQ ID NO: 17347 - protein, 117 aa, Pseudomonas aeruginosa
RENAVSTLPPCPQCNSEYTYEDGALLVCPECAHEWSPNEAATASDDGKVIKDSVGNVLQDGDTITVIKDLKVKGSSLVVKVGTKVKNIRLVDGDHDIDCKIDGIGAMKLKSEFVRKV

SEQ ID NO: 17348 - protein, 189 aa, Pseudomonas aeruginosa
RHGAGAGEEEGEDLLRCEVVDDGGEEAHRGAGQHRRAWYVGGVGQLEHAWGVAALGQGEDHPRRGVDRRVQATGHGDQYHQVDDQLGVRDVQQLQGALVGADLDQQRVVPRHDGDHDEDRHQVEQADPPDHRVGGAGDLLRRVLGLGGGDGDDLGAHEAEHGRQQGARAPRRIRSARSRRGSPSGWTGR

SEQ ID NO: 17349 - protein, 261 aa, Pseudomonas aeruginosa
MYSAMGVEPTKLMAFTSGAWSRPSTASLSPCTTFSTPFGRPASWNSSAISRVELGSRSEGLRMKVLPQAMASGYIHSGTIAGKLNGVIPATTPIGWKSLQASMFGPTLRLYSPLRISGAAQAYSTFSMPRLSSPAASSRVLPCSSLISLEIRASFCSSSCLKRYSTCARLAGGVLRQAGKAALAASMAFCRVLPSASGTLWMASPVEGLKTSALRPLSATISPLIRWWRVPILSCSLFARGDERAVALSLYPLPGERVRIT

SEQ ID NO: 17350 - protein, 438 aa, Pseudomonas aeruginosa
TLLPELHAGLERTHGRIAVARGDLDRAGQAAVADVDDVLRALQAVQALLEVRRQLGGLLHQVVPGQDVQRGEAGGAGDRVRGVGVAVAELHRVLGQRLVHEGVVDLAAGDHRAHRHGAVGDLLGDVHQVRGDAEVLGAAVGAQAAEGGDHLVEDQQDVVLVADLAQALQVADRRYQYAGGAGHRLDDHRGDVRGVVQFDQLEQLVGQLDAAGLGHPAGERHARLKGVRQMVDVHQLAEHLAVATDPAEAGAGDVDPVVAAGAADQLGLLRLAFQAPVGAGHLDRGVGALGAGTGEEHVVQFAWQQPGDLLGQLEGQRMAVLEARRVVEGAELASHRLLDFLARVAGAAGPQAGQAVVDLAALVVGQPAAFGGDDDPRVLLEVAVGGEGHPVGAQVEFAGNRRGHVERLVHRSILGLSCWKVPRTRRRSVGSSLALTKG

SEQ ID NO: 17351 - protein, 284 aa, Pseudomonas aeruginosa
PARDAGRTWCWNGSWRRWRCREGADGVTRASAARRTASFLYGARRWHAATGRANAGKRLSLLRMAPLPHHPGLRHRAVVAQGVQHEQGIGQAARMLHALGDHRRGGQVEGDEVGFAAGQEVTDQAVQVERPGAAEGGQVERLERIEAGAAQLLDLVGVGEVGQQRQAGAAADVAADADADAVLLGAAKVEQAGADEQVGTGTVRQRRVLVRQAAAFAFGEMDAMGEHAAFADQAGAMIDVQVVLRLGKQLADPGDFLEVLRKMGVQVDAGILVQQARRRGQLLG

SEQ ID NO: 17352 - protein, 253 aa, Pseudomonas aeruginosa
GGRREARGDRVLQAPVAVPALDQRAALGVATGRGIAQRRRRVAVHQNLAGDHPQAALLRGLEECLGGYRMDRAEHQRGSGAVAQQFVEEQLGLGGGVAGIGKALLGGKGVGFQPVQQLGAVGGDHSELRVMHMAVDEAGQQQALRMLLQRQVGGQLRQQVGCVIERAHVAVFDPQQAVLEILPGLVAEFRRVAEEMQDPPAMGRTAHRAPAVVGVQDKWGDEVASRYCIVHLLCCRNGAFASLVREIDGNIPS

SEQ ID NO: 17353 - protein, 66 aa, Pseudomonas aeruginosa
ETEATRETLDDRYNTDEYGHNKGESDVDKSSTTGMCENDQSMSEQSAGRVTTNTTATGVGIGDTKR

SEQ ID NO: 17354 - protein, 74 aa, Pseudomonas aeruginosa
REPKKAGTVEEREGAGEESPRRKATETGPGAMDEEKRPRKKGEPEKQGGNKRREDGHSRKRREWRTTKTESETT

SEQ ID NO: 17355 - protein, 752 aa, Pseudomonas aeruginosa
RPCSSRYSNGGQEVSTPRRMLGCSASQARSSGVSVRAPASPGQQQARHRRSTACRRCMRRSRGGREYKRKCRRRAAGQAAKKNPRFFRPGVRSSLVEEGAQVLASRRMAQLAQRLGFDLADPLAGHIELLADFLEGVVGVHVDAEAHAQHLGFPGSEAGEDFAGGFLEALAGRHLDRRLHGGVLDEIAQVRIFVVTDRGFHGDRLFGDLQYLADLVLRHVHALAKLFRGGLATHFLEHLAGDAVELVDRLDHVHRDADGACLVGDRTGDRLANPPGGVGGELVAATVFELVHRLHQADVAFLDQVEELQAAVGVLLGDGNHQAQVGLDHFLLRPASLGFADRHRAVDFLDLGDGQLDLAFQGRQLLLVAQDVVAQTLDGLGVLRLALQDAVDPLLVGLVVREQAQEVGTRHARITHAELHDGAFLGAHAFQGGAHAGDQGVELLGHQLDRHEQLGQAGEFGGGLLAAATVLLQGLLGLVELLGDRGETQAGFFRIRTAVAFVVAVAAVVAFFFLVVLLFRVGGIVLQVDRLHLFGGQAAVIGIDIAAEDVGEATAFGDDAIVVGQDAVHRARELGDGAHHFADAFLDALGDFDLAFAGQQFHGTHFTHVHAHRVGGATDVAFHRGQGRCGFFRCGFVGIRLGQQQGIRIRGCLEYVDPHVVDHADDVFHLFRIGNILRQVVVDLRVSQVSLLTASGDQLFQTRLLLRFSGHNTLSTEGLGGQKISRGLYLMPGLRRQFSSGKAMKRQHCSAL

SEQ ID NO: 17356 - protein, 165 aa, Pseudomonas aeruginosa
AGRRRRGNRAGRRGSPVARPWIPPRTRMSSILTGRRTLVVASLGAGSEVDRVFIEGLEVDTVIGVYDWERGIRQCLRLDLTLGWDNRPAAAGDDLALALDYAALSERVQEFARESHFQLVETFAERLAEVLMGERGIPWLRIRVTKPGAVPAARGVGVEIERGCR

SEQ ID NO: 17357 - protein, 496 aa, Pseudomonas aeruginosa
GLQVDIEAPQAMQVLEHVGGGIAQRLAVELLVAQGQRAVAATVDVPDLDVRLAVAEVVLRRQGLADGAVAGFVVDRRDQQVVLLVVVENAEQLQVANHLGREELQDEAFVLEALHGELQRGQPVAAGDIREPAAVLVGRFLADAADVAVHGEAQGVGVDAAVVGAVEGRLVDHAGVVLQELHHEAVVDQAFVVEVVEQRVVPEGRPAFVHHLGLALRVEILGDLAHDADHLALPGLQKRRVLLDEVEDVLLRLARIARHGLFLVLAADARDGPPEVVDLALDQFLALLLPLPLLFRGNRVGTLVAVDTVVHQGVAGVEQVFHRVDPVALLALHDVLLGEHQVIDDRTGIGPGAEQVVALEETVVPVAGVGDHQRLHALGVFLHQVGDAGIGVDHDLVGQAHLATLVVLFRTEEVLAVGPVVIADRHAHRGVGVHHLLGGDHLDLVRIGIQGIALGDPADFPVVLLDQLEGPFRAGGDGLALAHATSLLWNSSRNTG

SEQ ID NO: 17358 - protein, 248 aa, Pseudomonas aeruginosa
SRMKKRLAMSLVAWVIEPETSIRQNITALEVGLGCLTSRLYLRSKVSRNGTRSMRARSLAISSSSSWISPRLSGSSRLIRSSSFSAARSLARLPPDSAMRRAWAERRVRTMLMRDGLPSLLMPARTVLKVSVPVMWRLTRLGSSRSSNMKSRNSSWVIWKTKSSMPSPLLLALPPPRPPPPPDGRAMCSPAVNSLLPGWTTVCRPPRPWCSTGSSISRPGMLICSPCSMSVMERRLTASSTAFLMCSR

SEQ ID NO: 17359 - protein, 538 aa, Pseudomonas aeruginosa
LMNAPQGLWRPAGAEAPRSECDGDRYGRSDRTDGRLLRLANPQVPFRQQADLLLGVAALDHAFDEVVVLLLVLLAGLGVEADDRKQVLGVGEHLLLDHYAQLLVGQPARVLAVVAGAGAQHEVDDLVAEVLRVADARGFLDLLQFLVEGGAVEDLAGFRVAVFLVLDPEVGVQHIAVEDVLTVFAVGLQVGGLDFLADELDVARRQVFLDEAQVALAGFRLELFLLDLLFEDVEQVHRVGRYLVRVEVEYLGEDLEGEAGGKPGHAFVDSGRVAVFLDRLGLGIGIFQVFAVIYPHLRVDIRVFRLFQPRQHGELREHLQGVRRAVGMRQRAVDQQLVVDLDLVRHAQAVRHLDDVDAVDEGLVVLVVAETVPFRFVGVSQDDAAVGQGAETFGAVVVAFLGRGQQRVQDLDRGLEHLDEFHQALVGPAEGARIAVGVRVVLRVFLQLADVDLADQRGYILVVLVAGFGLGDGDLVEDRGVQLDHAELADVAAELVEALGCPGRHDRAQVAPRDAVVLLEDGAVFVGVEQAQRRLEDR

SEQ ID NO: 17360 - protein, 201 aa, Pseudomonas aeruginosa
ALDRVEGHLLHQLLEFFRQGGFTAADRAEQVKDLLLLLQALGRVAEERDDLVDAFLHAVEVGERRVAANHLVGEDPRQPGVHRGVQQLRLADRHQQALGGGGIGCLVLLAEVEIFLEGIFLLAGRFEAFLEVTENAHDVSSLDAVSRRGIGRAGAGGPPARPARIPQTPSLHGASLSASAPNGHSRWPGSRCAGSPLFWMA

SEQ ID NO: 17361 - protein, 389 aa, Pseudomonas aeruginosa
QTTTSGASRSAAAMKSATEWLSMCREPLIWPTAKLCGSRMSTTWAPFSRSWRACSGAMRWKVSLMSGYLCTGRPPDAGDSCGRGGGSGRRALFGAIAAQAFAAVDVQQGHPRAPDAAGVQGEQAGLVAVAFEGRPVAEDDLLTAGLARREAEPGGVAGRRGVEAFLALQVELAIFGAETHTGEVVGDHPQAVDAMQLLVPLGRLVAVHAVEEQRQALVVAQCLLHLGCAQAGFFQAPLRGDAGMHQGDLALFVVVQQRQVTQPVEQWLAVRRLEDFPQRVGLLQALGLVRHRQQVQVVVAQDADHRLAHGIEEAQRLQGLRAAVDQVADQPQAVLGRVEGDALQQAFQGIQATLQVAYRVDRHQCSAPGTARRNTGIAASKAIPSLPSI

SEQ ID NO: 17362 - protein, 349 aa, Pseudomonas aeruginosa
QRSVGPAGLNDGRPPSAAAGRHLVGGFQGDLQAAAIDAAAAGQVEGGTVVDRGADDRQAEGHVHGGTEALVLEHGEALVVVHRQHRVAMLQVLGSEEGVGRQRADQVKAFATQALEAGFDHLDLFPAQVTAFAGVRVESADQDARMSDAELVAQVGVEDARDPGQALVANGVGDLAQRQVGGRQGHAQAASGQHHHHLGGVGEVGEEFGMAGKGDSGFVDHALVHRCGDHPGEVPVEAALAGAGQGFQDVGGVGAVQLPGADRGGQRRIPYVQLAGLGRSLWPGGRGNVLKVDRQAQLAGALLQERAAGDGDQGVGLGGAGEQQAQIGSDTCRLAGSEREAQAHCLIST

SEQ ID NO: 17363 - protein, 547 aa, Pseudomonas aeruginosa
ISIESNELGAIGELHSTWVVGQETVEGNLWQPVVRGYIGGGRQLVRLRIQTASKGVPAIGQSAPLVDVRSAAYAKVSIQILEVIGITDPRVVDLGQPARIEAGGVLETVQPAVLAVVRETFAVIVLVVKVGSVDDTFAAVGQVAELAFQHHAALGHVARVQRGVVVRRQVEVVRGDQGEAGVAGAAEARRQEAGLAAVVDREIDVRGVEHREIFDPEGRVGRGAEAGGRVQLDVVALQSPGVAARFAAGVGAILEHDDGVLAALGVERAAAGMGLVDHVLGVVDLGLAVVQLDLGVVTDHQHALVAQLDVADQFAAVFQLMQVGLVAFHLHASLAQDHVTGEGGDLFFLLVARSLGGYVGRALVAGRAVIHARTHRLDVGAAAIGADFRQLGGGQFFPRNPVEVRVVRTAGLQRATAGLGDQALGRLCLDGFASAAGYTGARRGGADRGRGMRRARWQVGIGVLQRGAIPAAGGRYLAVELIGGLYSQCCDRLQSQQAAGDQQGKLSSKHEGFHCHLVNPGFLRAIGPVGRTPLDGLKVGWEPAITG

SEQ ID NO: 17364 - protein, 835 aa, Pseudomonas aeruginosa
TQSTSLSGRAFAWFAGRARGKVCPLFLPLRCIPWSVAGMLRRCCLLFCCLLLSLPVRAEESVALPLTAELRTWLAEHRELRVGVVTEAPYAQYDRRLQQYSGANVELMGWLATAMQVTLRWQGYPDQAALDDALRAGRVDIAPGLSQTPAGLRLWLFSDPYLRVSRLVVGKRDGSGSVELEQLERDTRVAVRAGSSVADYLSSTYSGLQWVSADSEREVLRAVLAGQARYAVIDEAQLSRLTREPEFAELAVVGDIGYPQLLRVATRRDWPELAMVVDQALRSLPRKSLDQLHERWLQPKYPRLGESPGFWQNLSILLGLLLAGALAAVFLQRRQQHALEARLYGARRDLELRQAAEEALRLTQFSIDNSTLGILWVNWDSRVRYANRAAEQMLGHADGQLVDRPLADFEPGLDMDRWLNLWRRARNSEEGPLSFETRCLRADGSWLPADVSLSFLRFGTSEYLVVFLSDVTERRRAREALQESEARMKGIASNVPGMVFRLERPRAGAFSDFAYISEGSEALVGYSARELIESGRGIRGLVHPDDRERYWSSQMAALDENRDWHWQGRILTRQGELRWADIKASARCFEDGRAVWDGVVWDITANKQIELELGESRAQLRELSAHLESVREEEKARIAREVHDELGQVLTVLKLETSMCELAYADAQEGLRERLGNMKKLIAQLFQLVRDVATALRPPILDAGIGSAVEWQARRFEARTQIPCLVEVPENSPQLVDAKAIGLFRILQEALTNVMRHAEAHTVQLRLLREGDELCLSVSDDGRGFDVATVGRGSSFGLVGMRERVLMMGGTLDIDSAPGEGTTLSVRIPLGVASP

SEQ ID NO: 17365 - protein, 225 aa, Pseudomonas aeruginosa
QEQPPARRNSVRQQRVVIRVLVAEDHTIVREGIKQLIGMAKDLQVVGEATNGEQLLETLRGTPCEVVLLDISMPGVNGLEAIPRIRALNEPPAILVLSMHDEAQMAARALKIGAAGYATKDSDPALLLTAIRRVAGGGRYIDPDLADRMVFEVGLTDSRPPHALLSEREFSVFERLVQGANVNEIAQQLAVSNKTISTHKARLMQKLNAHSVADLVRYAMEHRLL

SEQ ID NO: 17366 - protein, 249 aa, Pseudomonas aeruginosa
NEQRCGYGRDSRRRCAGQLPWRAEELRRRDPHREGSQPGHSQGRIPHPARPLRVRQDHQPDDAGRFRNPHRRRNPPGRSLDQQCPSAQARHRHGVPELCAVPAHDRGREPGLSPQRPRHEQDRREGKGQARVVDGPARRLRRALSGAAFRWPAAARGAGPRAGLRAATGADGRAPGSAGQATSRAHADGNQASAPAPRCHRGLRHPRPGRGADHVRPGGGVPPGRNPADRAAAQSLRAAAQHLRGQLHR

SEQ ID NO: 17367 - protein, 223 aa, Pseudomonas aeruginosa
KRGRKDQGLHPGRRLHAGGAVAAHVHRIQGGAHRPVPRAALFQSDALHVLLQLRRLPCRGQLAGGAGTGRGWPGDGAPDRRYPSARDQRRGRPGTGAGSAVGRQGDRRAPDADRPGAQRRGAGVRYRRGEGHRKNGDRTLLQRHAHRVQRHRAIARGAQRDGRAAGDSAGGHSIRRAEDPRHGDHRRAGAGQAWSLRRRGRLPGMERQHGHRHCHPHRGDQER

SEQ ID NO: 17368 - protein, 984 aa, Pseudomonas aeruginosa
QTELSLMSPLGKGEQGRPAGRQFLIYYLLFQITQEVTPAGIDSPAGVGFRMRSKTGVLVLRSCCRELNDLGFLLPPPLRQVLEGKRLLGEFWFPGMDTQAFDFLAEIPQADPTAWRRRHATRVAQVGGLYRRFSGSANRLARFEEFAGEQLGGQRRTEDEALDLLAAFVGEEALLTFGFHAFGDHRELHAAAEGDDGAGDGGIVGIVGKAADERLVDLQDVQRQALEVAERGVAGAEVVDRQLYAETLEPVEDGEGLLGLVHDEALGDFQLQPRRFQAGLLQQLLEAFDQLRLAELGAGEVDRQRAERRVQLLPFAHLLAGVFQHPVAEGQDQAAILGEGDEALRGNFPEQRMVPAHQCLGADQQAALQAQLGLVVQLQLVALEGAAQFGFQRHALGGQVGQFAGVVLDAAAAPRLGAVHGGVGVLHQGRGVVAVLGEQGDADAGADEEFMTVGLERRGEGIQQLARDVLGVAFLVQAGEQDDEFVAPQAGHGIDVAQLVAQAFGDGLEQQVADGMAEAVVDVLEAVQVDEQHGAGTTLFAGLVEGVIEPALEQQAIGQAGERIVVGLVVEPGLGVLEGGDIGEDADEVSDLALRIVYRADGQPFGVQLAGLASVPDLALPVPVALQLVPHGEVEAGVVLSGGEQAGRASQRLLLAVAGDLAEGAVDRGDALAGIGDHHAFGGAFEDGGGLLQLLLHELALGDIADDGQHAVLAIDADPVGGHLALADATVAVPYRGGEALGQGVVAYQRDQALAVLGVDPQAEFERGAGDDLVAAVAGETGEAFVHVDQRAVFEAADQQTVGVGMEGVGELLLGDPQQFLGLHQVGDVADHHHQRRGLVEGHVLGAEQRAEGTAIAAPQGHLEVGQVAVAELFQDLRAQAGECPDAQFGGGLADGVVGGDADLLLEGAVHREEAAVGAVGQYHHVRAVVEHRSELLFGQAPGLLGELGPVMSSSDRAGAVRPCVIGVTKSRIQTTRPSAASIR

SEQ ID NO: 17369 - protein, 219 aa, Pseudomonas aeruginosa
GGLAVDGNISGSVDAGRRGKRQRKTPGFSGRGFVRHSSRKERRCSLRDGWRSLRSALASIWRIRSRVTSNCLPTSSRVWSVFMSMPKRMRSTLASRAVRPARTSRVDSLRLSLVAISIGDCMVESSMKSPRCESSSSPIGVSMEIGSLAIFSTLRILSSGMSMRSPSSSGVGSRPISWSIWREMRLSLLIVSIMCTGMRMVRAWSAIERVIAWRIHQVA

SEQ ID NO: 17370 - protein, 261 aa, Pseudomonas aeruginosa
PRRYSNLSTAFIRPMLPSWIRSRNCRPRLVYFLAMEITRRRLASTISFFARRALASPIDIARLISLISATVSSTSLSRAASFCWLRRMSSRRRSMASAYFGLLFRTLSTHFSSVSWFGNRRRKSARGMRASRTQSCMMARSWARTPSRAERTRATRASNCLGTSLIGMNSSARPVSSAVACLLPRPCFFRAFLALSSCSETAVKRRRASSGSGPPSPSSSLSLLSSLSSSSSSFSFESAESSFRLTGSTSSAGRLPSSGSI

SEQ ID NO: 17371 - protein, 510 aa, Pseudomonas aeruginosa
TLLPLAETLALGEFSNGVEELLFKVLLDDQPLLLAQGLQQAALGRAVPARDELHRALPRVLLQGFQQGHQQLGVGILLPGEGARIVDLQGQLRMMQQGAQGVEGGGLHADRRSLRSLEVAAAAFVPLLLAIPLLAVPGLLVLVPALARLRLAIAWRSVERRMGGLVLVVGAGGEIVVAVQGAARSVIHGRRWRAVVRQLSDVFAGQAGDFRQTLPHQQAQVVPGNLLQQRRGEGRQVGLAFQGGGVGLQHQLLEEVLRQRLGLLGDACAEGILALGAYQAVRVLPLGEEQEAHALAVLQVRQHRLQGAPGRLAAGLVAVETEQDARYQAEQALDVFLAGRRAEGRHRVADALLGQGDDIHVALDHHDLVEVAILLPGLVESVEFLALVEDRSLRGVQVLRLVVAEHPAAEGDDPPAAVADREHHAIAEAVVALAGVAVLHQQAGVEHGLELQVVATQVLEQVVPAGRGEAEAEVAGDLAGQAAALQVVHRGLARRVAFQRLLVELGGGAE

SEQ ID NO: 17372 - protein, 401 aa, Pseudomonas aeruginosa
LPGVERTPARWRGYVGFQGLRILTVRPEECKASDRKTLVWRKAADYHARLRICQALRLKPMRVLGLETSCDETGVALYDSERGLLADALFSQIDLHRVYGGVVPELASRDHVKRMLPLIRQVLDESGCTPADIDAIAYTAGPGLVGALLVGASCAQAMAFAWGVPAVGVHHMEGHLLAPMLEEQPPRFPFVALLVSGGHTQLVRVDGIGRYQLLGESVDDAAGEAFDKTAKLIGLGYPGGPEIARLAERGTPGRFVFPRPMTDRPGLDFSFSGLKTFTLNTWQRCVEAGDDSEQTRCDIALAFQTAVVETLLIKCRRALKQTGLKNLVIAGGVSANQALRSGLEKMLGEMKGQVFYARPRFCTDNGAMIAYAGCQRLLAGQHDGPAISVQPRWPMESLPAV

SEQ ID NO: 17373 - protein, 173 aa, Pseudomonas aeruginosa
VGAVPPDDQAGQHGHRQQRSGLLPGQQRQGQRGGHQRGERAGARQLEGQQPGRRGQQYGRRIEAEEHARGGGDTLAAAEVEVQRIQVADHGGDADPGLLHHAEPQPAGDQHRQQAFADVAEQGQDGEFLPGDAQHVGRAGVAGTAGARVLGAEPAAEQDGEGEGTEQVGEDRQ

SEQ ID NO: 17374 - protein, 337 aa, Pseudomonas aeruginosa
PALFAGIRERAGGYQERAVLQPGGVCPHRSAAGRTEPATQAHRGRQWPLCARAQGTAAGYRRAVLRRPGGRFRWPGAAARRSAEERFRALALVRAGAEPGASGRPPAAGRSLARDEDPAEALAGAIRMAWPGVDSRSAASGLSAFFLVGLECGEARTLQRLAQFRALQALFHQRLHADCPRCLRRAEQVGGLRIVPLFQAEAAARVHLAGGDELLETLRAAIHVEALQQLQQCIRAQLQRPMGVGVVLAHQARQFLAVARHPEALVHRIDQRHAASLVGDMAGPVRFAGESLAQVVQQAGPAYAERLPVAGALLQYRQDMDAGIDFRMVGRRLRYAE

SEQ ID NO: 17375 - protein, 95 aa, Pseudomonas aeruginosa
AALARSNCPGRTGAASGVSHTYSWPALAGRSGQAAGETSLRSIARPSWPARSCRSVRLAMAIRGWGWAERASSRHRSGPIPAGSPGVSAKRRLTA

SEQ ID NO: 17376 - protein, 111 aa, Pseudomonas aeruginosa
FSVTLRTAKYLADFERVSIRCKAFTLRHLPSRQAFAIRTCIPRTFRWTRLQSTSCHCCGAPESAGPACWLNSFMLLSSQVNYPSGRCTPPLTGWGTRQGRFVKGRWKLALG

SEQ ID NO: 17377 - protein, 258 aa, Pseudomonas aeruginosa
RAALLPLSGNRRGAPSRAGRTGRAAGLAAAGSRGMKAMILAAGRGERMRPTTLHTPKPLIEAAGVPLIERQLLALRQAGVYDWVINHAWLGEQIEAYLGDGSRLGGRIAYSPEGEPLETGGGIFRALPLLGEQPFLLLNGDVWSDFDYSRLHLADGDLAHLVLVDNPAHHPAGDFHLDAGGRVGETREAGGNLTYSGIAVLHPALFEGCQPGAFKLAPLLRKAIAAGRVSGEHYRGQWVDVGTHERLAEVERLLAEHA

SEQ ID NO: 17378 - protein, 403 aa, Pseudomonas aeruginosa
CLPANTIRRRNDVASHEDGPVVRPSRSYRARLGGIRDRDFLRRRQQGSPGNRVLQTLQERHRQSRGAWLLQWRPGQAQAHGGDQPRLLGRGGSRGAGAGARLRGRSVREAGHGEGRRSRGFRSRRGAALRSRHLRLDHAACLQPRQGCGQPAGLGGFLGREEVSRQARPALGRQVQPGVRPDGRWRGAEGRLPDAGDARRRRAGIPQARRAEALYPLVEVRAGPCARPGRWHGGDEFGLQRADRCGAGREAAPGNGLERRRLRFRLLGAAGRGLEEAVGRGVHPFRQPAGAAEGFRREHRLRPGQPQGGRPARSASGCQPADRTAEHAERGGYERGLLGGARRGPGAAFPELGQALRRPLRASRRALARKPLPFSKAPSQSGLAHSGGHLFCRAIPTKSFPFP

SEQ ID NO: 17379 - protein, 398 aa, Pseudomonas aeruginosa
KTLLPADLRPAPGSLGCSHSIHKTNKGAVMAETQGGDVLVSFRGVQKSYDGETLIVKDLNLDIRKGEFLTLLGPSGSGKTTSLMMLAGFETPTAGEILLAGRSINNVPPHKRDIGMVFQNYALFPHMTVAENLAFPLSVRGMSKTDVKERVKRALSMVQLDAFAGRYPAQLSGGQQQRVALARALVFEPQLVLMDEPLGALDKQLREHMQMEIKHLHQRLGVTVVYVTHDQGEALTMSDRVAVFHQGEIQQIEPPRNLYEQPRNTFVANFIGENNRLSGQLLSCDGERCVVGLPRGEKVEALAVNVGQPGEPVTLSIRPERVRLNGASESCVNRFSGRVAEFVYLGDHVRVRLEVCGRDDFFVKQPIAELDPTLSVGDVVPLGWQVEHVRALDPLPAA

SEQ ID NO: 17380 - protein, 788 aa, Pseudomonas aeruginosa
PSSEGRRGRRAAAPPTVPHFPGSFPTARFFSGVRYGHSCAHIPGHRQHPQATPGARRADEPPEVPGADPAPAGLPGPDLPGADRRAALQERVQPGSGSLVAADGRGHLRLGRQVAAGRRRLQGAQPGSRRGSSQPDHRRSLQAPEHGAGRLSQPDGEDRAQAAVQGGARFLQGRHGAARRALGRPRLLAGDPPQRQQLYALLPARSPRPPDRRSRRSGARHPGPGHLPGHLRPHLLDGRGDHRHLPAAGLPAGLPAGQPADAQEQPADDPGPAAVLDLDPGACRRLDRPAAIGWPDQRRAAQARPDRPAAATGVQPHRRIHRDGAHHAAVHDPADLQRDEGHFAELHARRDFPRLPPVRQLLAGVFPTDRRGRRRRLPAGVHPVHRLLHHPGAAGQPERPDGQLLRRLLYQQHHQLGHGHRPRRPAPARHPGALRRLQLAGGRQPLAPGIEGLPRRPTDSPLPSEKRLPGGRGEGDPHETHWRASHAESLHVPGRAPVVLLPAHPLRPGTAVPGTAGAGHRAAVVQLRHLPGLPAARVLPALVRRLLPVRRVDALVDQQHDRRSGGDPAGNGLRHSGRDRPDPRRVPRQGTGDEPDDFADGGAGGDHRRGQLPVLRSAGARQQLPVADRGACGARRAVRDHHRLRDPAGVQLQPGARRRQPRRAAADHLLPGDPAADRSGSDFRRAVRLRHLVRRSGSDPLPRRSRAGHPAAADVQRHSREPEPHHCRRGDLADRFLRTAVADPGMAARAQREDAYRTTRRLRRRARPAWSGRRLLRRKVVIFTAKNR

SEQ ID NO: 17381 - protein, 310 aa, Pseudomonas aeruginosa
DRRGGRRYLRRRLGHLQRPGLRRGHPRHACRTGPGAPVMSAAEPFFATRLPRLVMFDLDGTLVDSVPDLTAAVDSMLASLGRPPAGIEKVRQWIGNGARVLVRRALAGSIEHDGIGEEETEAALALFMEAYADSHALTEVYPGVVDTLKWLKRNGVEMALITNKPERFVAPLLDEMKLGRYFRWIIGGDTLPQQKPDPAALLFVMKMAGIEPEDALFVGDSRNDVLAAKAAGVRCAALTYGYNHGRPIAEEAPTLVIDNLRDLLPCADQAAEIVLPDDSLSPSDQRDQAVAVSKLWMKVIKALARWRWRA

SEQ ID NO: 17382 - protein, 501 aa, Pseudomonas aeruginosa
PFSPPMRLIMNREEFLRLAADGYNRIPLSFETLADFDTPLSIYLKLADAPNSYLLESVQGGEKWGRYSIIGLPCRTVLRVYDHQVRISIDGMETERFDCADPLAFVEEFKARYQVPTVPGLPRFDGGLVGYFGYDCVRYVEKRLATCPNPDPLGNPDILLMVSDAVVVFDNLAGKIHAIVLADPSEENAYERGQARLEELLERLRQPITPRRGLDLEAAQGREPAFRASFTREDYENAVGRIKDYILAGDCMQVVPSQRMSIEFKAAPIDLYRALRCFNPTPYMYFFNFGDFHVVGSSPEVLVRVEDGLVTVRPIAGTRPRGINEEADLALEQDLLSDAKEIAEHLMLIDLGRNDVGRVSDIGAVKVTEKMVIERYSNVMHIVSNVTGQLREGLSAMDALRAILPAGTLSGAPKIRAMEIIDELEPVKRGVYGGAVGYLAWNGNMDTAIAIRTAVIKNGELHVQAGGGIVADSVPALEWEETINKRRAMFRAVALAEQSVE

SEQ ID NO: 17383 - protein, 69 aa, Pseudomonas aeruginosa
IRTLAGATLSGKLRTLPLPATHVSLGYRWSHNESAATPYKQWLDNDRQSFRSCLLWGRENRDDLLAASS

SEQ ID NO: 17384 - protein, 105 aa, Pseudomonas aeruginosa
RPRSMPAAVATPLPPRKLKYSGYRWPITAAMPTQASSITPSPSQRATSTGSRPLPTSPSRVRMASFFPATRSMLVAPGLPEPLARGSWVPNQRLSRTAKEREPSR

SEQ ID NO: 17385 - protein, 296 aa, Pseudomonas aeruginosa
RSGQSFYRRLGGRYRHRRVRLGARHPSVPAPGPDPGLGQPSGRRGRRSRPGAGLCRVVRASAGVRPGIAFPVGGNLRRAPRRGTDGRARHSLAAHPRDQARRGAGGPWRWRGDRTRMSLIPVYLGLGSNVERERHLHAGLDALAAFLHDLRCSPVFESEPVGIKSGPFFNLVVSARTDLPLAELSLRLKHIEADNGRYAPERKGLPLDIDVLFYGDLVGDFDGLVLPRAEVLKNAFVLWPLSELAPNLEHPVARQPLGDLWRETRIQQKLWPAPFEWRGQALTPEALLQAFPRSSL

SEQ ID NO: 17386 - protein, 508 aa, Pseudomonas aeruginosa
FPGRTAGSARRSIPSRWRWAGACSCDEPPLEQLAEHRVDVRCRDDLLLGEAVFEGFAHALVLEPQGLVFARGDLDVGVVLDERHDLLEEDVPAHRRVVVPVVAVRGLGGVDVPLMGRITLGHDLLHHLQRAGDDGAAGLAGVEELLLVDLAGAGVVADEHHFDLLVVPLEEQVEQDEEALGDVLGRLGHRAGDVHQAEHHRLGGGVGLLDQQVVLEIEGIEERHPVDARAELGDFQLEFLDIAEVVRLFALDPLQFLQRRAQLGPAAAGQRDAPRMGRAQGADDVDARRVAVVADAGADGLEGVGAGDVALDQVGQLQVLEHEVEEFLLGDLEDEVVHAFAAVAGLAAAAAAPAAGWAGDVLAGGEFLVAGVDDGLPPAAAMVQHRFVDIAPGNADLLAVLHVGNGTPADGLLDGLLDVFTVAPQEALAVHRALVLAVQTPVDDVAHECSSGPVAPRRSGGAEVRMRRRPVRSQRPYRWQTTATCEPAGTIPTAGGPASRCSRARPCV

SEQ ID NO: 17387 - protein, 168 aa, Pseudomonas aeruginosa
LEAAVEAVDVAEALLDEIGGGALAGVAVVADHHQRSVEVGGGDEVRHRVVVDVPRAADMADSEALRVADVDHLGAVFAELAGLFGGDALEGVAHVGVPVYRASTGRRGFMRAWRRVWPARAVRRNRSSGVRRCRRSAGSSARPRRSRCPGRTGRARRSGLRGPPSGRR

SEQ ID NO: 17388 - protein, 524 aa, Pseudomonas aeruginosa
PGRRPATGGPWSGRRRRAPAGISGDPGNPAGRLPRRPPSVQRSRYGQAKHRDRGVEGDSVAAEHLIAAAHAADPGRQHRAAGVGVLRAGGDQRLLADHAGAANFLGTAVAVGDDPVARQQLGRNLALVLDGHRVGEGETVLLRGGLFRKVAGVDPDVDLVLGIAHTACLIPDECLIRLTIAWQLGQPVGQADECGQVELFGTEGRIDLCGLDVLDAQERLEGVAQGLAALVEGLADHPLEQFRIACRMGRLGEGGETDDGRVDLGRRVERAGADVEQVLHPTVILDHDREPAPVSAARRGRQALHHFLLQHEVHVLDHRRVLQQMEDQWRGDVVGQVADHSQLLAALHQRGEIELEGVALVQAEARLEAEFQLQQGDQVLVELDHVQACAAAQQSLGQGALARADLQQALTLAGMDGTEDAVNHPGIVQEVLAEALARAVLVKLGHWKRFQAAGPRPRREARMRKGAILTAKRRAGRAKRWPTAVSSGWPPSGRRFPGRPAGCRYRCGRCRPGRGRYRGRQRCG

SEQ ID NO: 17389 - protein, 431 aa, Pseudomonas aeruginosa
ARSAGSLLDFHVGLVADLPQPGLQFLVVLAVAQYAYRLLLAELLAAVGGATAEDLQDVPAELRAERLGQLALRGIVHHLAELGHQGFWVDPVQVAAVEGGTRIFGEALRQFAEVFPGLDALVQLLRQLLGLRFAADFAGLEQDMADMHLVTDHLAAAALLFQLEDDEAAGGADRLGDVADGQGADHAVERLRQLGGLAPADLAAFQGVVAGRAGNRQLAEVRALLELLVELPGLPCGGLDHVRGRGFRHRDQDIGQAVLFGKLDLAHVRGKEVLHLLLADLDALGDPALAHTADHHLATDLLAGVGVGQAVAGEGGLELLQAHAVALGDGAHRLVQLLVGDTDAGAVADLLLDVLDDQAFQHLLGQHVLGRQRRTALEQRLVHFTQALVELALHDHIVVDDGDDPVQWYHFGMREGAKECCAQCKGAQPVT

SEQ ID NO: 17390 - protein, 338 aa, Pseudomonas aeruginosa
MSDDARFQQLNRWLDSCLPELFVAEGWGEVPPAELIPASSDASFRRYFRWQGGDRSLVVMDAPPPQEDCRPFVKVAGLLAGAGVHVPRILAQDLENGFLLLSDLGRQTYLDVLHPGNADELFEPALDALIAFQKVDVAGVLPAYDEAVLRRELQLFPDWYLARHLGVELEGETLARWKRICDLLVRSALEQPRVFVHRDYMPRNLMLSEPNPGVLDFQDALHGPVTYDVTCLYKDAFVSWPEPRVHAALNRYWKKATWAGIPLPPSFEDFLRASDLMGVQRHLKVIGIFARICHRDGKPRYLGDVPRFFRYLETAVARRPELAELGELLASLPQGAEA

SEQ ID NO: 17391 - protein, 427 aa, Pseudomonas aeruginosa
STMPGLASRSRPISATVRAWAGGSPIPRRVNRWKPVAESSAPCRCSASSRSCCSTAMSGATSTTLGCILPTATWRIWCWSTTRRTIPPAISTWMPADGWARPAKRAATLPTAGSPYCIPRCSRAASRAPSSWRRYCARPSPRGGSAANTIVGSGSTSVPTSAWRKSSDCWRSTPEMLWPATLIGAGAGWALASIPGALLGGLLGQLLDRRLHLESWRGLLARLRGRAVNDEDDLLFQLLGYLAKSGGRVEEIHIRQAREEMALRKLDRRAQRRAIASFGKGKAGIAHLQAEVARLKGERAEAVLLACWRMAWAGGVLSQSARQLVLQWGRWLGWSAERTERLSARVMPKRTRAVARDSYREALLLLGVEAGSEPALIKRAYRKLISQHHPDKLAGAGASVERVRAATEKTRELQAAYALVREREGFR

SEQ ID NO: 17392 - protein, 348 aa, Pseudomonas aeruginosa
GEETMLPAMRTGLLCALLGVTAPAWAEYVTVISFGGANKEAQETAFYKPFKSATGNRVVHGSYNGDLAKLKRMVEISHVSWDVVEVEAPELARGCEEGLFEKLDMAKVGDPADFVPGAVQPCGVGIFVWTTLLAYNPGKVAGSPQGWADFWDVKKFPGKRGLRWGAKYSLEFALMADGVAPKDVYQTLATPAGVERAFRKLDELKPYIHWWKSGQDPVRDLADGTVVMSSAYNGRIAAAQAEKQRLAMVWSGGVYDFDFWALPVGVWKKQLAEEFIRFASQPEQQKAFAENIAYGPANRKAVGLLDPQVAANLPTAPQNMQNAVGMNVAFWAEHGEALEQRFQNWAKR

SEQ ID NO: 17393 - protein, 376 aa, Pseudomonas aeruginosa
GRSTLCRRRERRQSRTVPKQPCTVERTIMSKSLKAASLKFATLAAGLACAAQAMAVDLTVVSFGGANKSAQIKAFYEPYQKATGNRIVAGEYNGEMAKVKAMVDTNSVSWDLVEVESPELSRGCDEGLFEELDPAQFGKTEDFVPGAIQPCGVGFFVWSTVLAYNADKLKSAPTSWADFWDIKKFPGKRGLRKGAKYTLEFALMADGVAPKDVYGVLATKEGQDRAFKKLDEIKSSIQWWEAGAQPPQYLASGDVVMSSAYNGRIAAVQKESNLKVVWNGGIYDFDAWAIPKGAKKREETLKFIAFSVQPQQQKTYSENIAYGPANKQAVPLLDKALLKDMPTTPENIQNQVAMDVTFWADYGEQLEQRFNAWAAR

SEQ ID NO: 17394 - protein, 453 aa, Pseudomonas aeruginosa
SSPDPPVRAGGAAARRLLLPFHTFQGRSRRPAFFPEFAMATAVPISQATGSTLKQRLARAERMNRLKSQALILPLLAFLVLTFLVPIAALLYKSVSNPEVVRSLPLTVEAISAWDGKSLPADAVYKALSQDLAEARRNQTIGDLSKRLNMELAGYRSLMAKTARKLPFKEEPASYKDAMEQLDERWGDPAYWQVIRRNASSYTPYYLLAALDHRIDDLGEVARATPDQAIYLDIFARTFWMGAVITVICLLLAYPLAYLLANLPTRKSNLLMILVLLPFWTSILVRVAAWIVLLQSGGLINGALLKLGLIDQPLQLVFNRTGVYIAMVHIMLPFMILPIYSVMKGISPSYMRAAISLGCHPFASFWRVYFPQTVAGVGAGCLLVFILSIGYYITPALLGSPNDQMVSYFVAFYTNSTINWGMATALGGLLLLATLVLYVVYSWLVGASRLRLG

SEQ ID NO: 17395 - protein, 311 aa, Pseudomonas aeruginosa
RAFREGQPIPLCLRKKGCPEGGERGIRTKHIGERVMLSPYMSPVERLWFYSLRILCGLVLLFLVLPVLVIVPLSFNSGTFLVYPLQGFSLRWYADFFQSAEWMRSLTNSMIVAPAATLLAMVFGTLAAIGLTRGEFRGKALVMSLMISPMVVPVVIIGVASYLFFAPLGLGNSYLSLIVVHAVLGVPFVIITVSATLQGFNYNLVRAAASLGAPPLTTFFRVTLPLIAPGVISGALFAFATSFDEVVVTLFLAGPEQATLPRQMFSGIRENLSPTIAAAATLLIGFSVLLLLTLEWLRGRSEKMRTAQPGG

SEQ ID NO: 17396 - protein, 230 aa, Pseudomonas aeruginosa
SPLRCAMQPFAIAPSILSADFARLGEDVDKVLAAGADIVHFDVMDNHYVPNLTIGPMVCSALRKYGVSAPIDVHLMVSPVDRIIGDFIEAGATYITFHPEASQHIDRSLQLIRDGGCKAGLVFNPATPLEVLKYVMDKVDMVLLMSVNPGFGGQKFIPGTLDKLREARALIDASGREIRLEIDGGVNVKNIREIAAAGADTFVAGSAIFNAPDYAEVIRAMHAELAQAHQ

SEQ ID NO: 17397 - protein, 92 aa, Pseudomonas aeruginosa
RSITIFSVTFTAPISDTRPTSLRPRSISIRCSAISLASDSRSCSSARSASSLIPRGRVPAIGRTVTRPSSTRTSTSGELPTTWKSPKLKKYM

SEQ ID NO: 17398 - protein, 198 aa, Pseudomonas aeruginosa
TPRPTASSKPRPAAPRSRNRRRRRSRPLPGAASRPAPQRSARCRPNSSPPCHRPGRAQGPARTSTNGYRASARRACGMPARRRRASPASGRRPSAPRHRPSGRTPGCTWRPSAGRACRETSSRPRNPPSPAGCPQPCRGCRQAAWSRRRCRLRRAAPRRERNPRDRRPSPCPASRTDLPRNRAPAPAPRLPPRPRRRG

SEQ ID NO: 17399 - protein, 858 aa, Pseudomonas aeruginosa
LREGRTTGPSSWLATSFLLLIVLAGKHHSLPRGSQVDSRSRKPDLAHKPRAKPGRTPLSEQAVLHRVAHQVGYRMRVELLHQACLVGTDGFVADRQLLGDLVDVGALHQPLEHRELALGEQRMGRTRIGQANLEDHPIGKVRVDVASAAGDPADRGEQQCRIAVLGGIAGSTYLQGAGGHLRLVVHRQHQDRRRLVQRANPRNRLEAIDAGHGDIQQDHLARRSAQGFQQLLAIGGLADHLQVLGHANQLLDAFPDDRVVFSDQDSDHHSLLPHAVPPCRRLFLSRARDAQRNPHAERGALAGGTVDVQRTAHHQHPLAHADQAEGTATPHRGNIEPATVVADAQAQLVALAQQTQLHSMRLGMPHDIGQRLLEDAEQADSLGVDQLRRVLRHLHQAGNLRARLEAPRLPLHRRADSGVEDRRAQCGSHVAHQLEQLGDQLFHVAQAFAQALLGIGIGQLAHRGFQLQHRQHLAQLIMDLAGDTRLLLLPHRLQVRRQLAELGARLAEFEFDLLVRGDVPDHPVPDRATILETARRSLDVGPAQFALAGEDAALPMPVAILVEGSHLARPVALAVVGMDQATNAAAAFDQFASAVADQRLAALADIGEVGKRAGPRALQAEDHARHVGGDALHPRLAFLQCLAGTAALGDVAEEHHQVLGRAEAQEAKRDVGRQPTAVGAQASGLEAERALLAIARTTPKIQPAVHVQAGLEVGQRTVHELAVGMAEHLFGGAVGVAYAAVPVDPEDAQGAVVDGELGQAQRLLGRLAQLQVAAGAVQPGFQRMLLAPLEEHRSQRAGQQQAEEDRQVLPEPRRLAEARILGLQPALVQLVQGLARQRAQRLVDHHRQFRPVATGRHP

SEQ ID NO: 17400 - protein, 212 aa, Pseudomonas aeruginosa
RERRKRQRAGAGKHRRSRQRRTGAERGPGPSPSHRSGRAAQGARRTGHGAPAGEHRPGPAARTQKRRPARSWHGRLLGGTLPGGEGACGNPQPAAGYRGGTARFSPGAGRYGAEAETGDRRLLLPRRPRRPRGGQAAHAGRQAAETPGLRTNRDAGATGRPQGGAGATVPTNPRLAQPSPAGRCAETCGVISGTPHALGPGRRPPAIHGFSR

SEQ ID NO: 17401 - protein, 574 aa, Pseudomonas aeruginosa
EDSSMKEFSQQAGPALSGAPQQWHDVDWSRVQRNVRGMQVRIAKACREGKWRRVKALQRMLTRSKSARYLAVRRVTENQGSRTTGVDKQLWDTPNAKWEAVGQLKTRGYKARPLRRVFIPKSDGRERPLGIPTMTDRAMQALYLLALSPVAETRGDPNSYGFRIERSTADAMAQLFVCLSKRASAQWVLDADIEGFFDNINHDWLIRNVPTDTRVLRQWLKAGVVHRGQLHATDAGTPQGGIISPTLANLALDGLESLLKQHLGVTRAKRLKINVVRYADDFVITGASPEVLENEVKPWVEQFLAVRGLRLSPKKTRIVHIDEGFDFLGWNFRKYDGTLLIKPSKKNVKAFYGKVREVIDTHKTSKQEDLIRLLNPILRGWALYHQPVVAKQAYSRMDNRAFVKLWRWAKRRHPNKSLDWIRKKYFRPQGERGWVFATTVLEANGTKREVELYQLAGTPIERHKKVSGEYNPYDPTMEAAGEKLRMERMLNKLKYRKQIASLFASQSGLCALCKQPISRETGWHDHHIIYRSQGGGDSLENRVLLHPICHQQLHARGLHVSKPAPLGVLDRPEP

SEQ ID NO: 17402 - protein, 968 aa, Pseudomonas aeruginosa
ALKGARTVLRGGSASNGWFPPDFQPIERRAAHRADGAQEARINKMAVKSLVFRRKFPLLVTGSLLALQPVAALTVQAADQFDCKVSATGGWDCSPLQNANANLPPRPAHTATSVSTAAAGTSVSGSGGETVEAEPTQRLVTESGGRALKSRSADYSHLDWIPREKLTAAQLAEIGPYCGGSYIEPVRPGMDDGAPSDESPTYVSAKASRYEQEKQIATLAGDVVLRQGSMQVEGDEANLHQLENRGELVGNVKLRDKGMLVVGDHAQVQLDNGEAQVDNAEYVIHKAHARGSALYAKRSENAIIMLKDGTYTRCEPSSNAWTLKGNNVKLNPATGFGTATNATLRVKDFPVFYTPYIYFPIDDRRQSGFLPPSFSSTSDTGFTLVTPYYFNLAPNYDATLYPRYMAKRGMMLEGEFRYLTHSSEGIVNAAYLNDKDDHREGFPDYSKDRWLYGLKNTTGLDSRWLAEVDYTRISDPYYFQDLDTDLGVGSTTYVNQRGTLTYRGDTFTGRLNAQAYQLATTTDVTPYDRLPQITFDGFLPYNPGGMQFTYGTEFVRFDRDLDENIYFNDDGSIRGKRPDASLQGLARATGDRMHLEPGMSLPMTRSWGYVTPTLKYLYTKYDLDLDSQGKTDLNKRDESFDSNQDRSLPLVKVDSGLYFDRDTTFAGTPFRQTLEPRAMYLYVPYKDQDSLPVFDTSEPSFSYDSLWRENRFTGKDRIGDANQLSLGVTSRFIEENGFERASISAGQIYYFRDRRVQLPGLTEKDLKRLNLDPSGLDNDSWRSPYAFAGQYRFNRDWRINSDFNWNPNTSRTESGSAIFHYQPEVDPGKVVNVGYRYRADARRFDSSRGTFRYGNENDIIKQHDFSVIWPLVPQWSVLARWQYDYNKNRTLEAFGGFEYDSCCWKLRLINRYWLDVDDDAFLVQSEKADRGIFLQIVLKGLGGIVGNKTEMFLDKGIQGYRQREDQAM

SEQ ID NO: 17403 - protein, 233 aa, Pseudomonas aeruginosa
SAPDAAQARCAAAARARADPAGAGTPDHREHPAADRRPLRHPYLRRGAEPGDGHHRPAQRHEPGAVPGRPHPRRPVLRRRPRAGPSRDGDQPCAPAPGRRAHPGQRAGGEELPCLGHGQDPAFRRVPPGQYPDPGAGSRVLGRDPGRRKAGPGALPAAQAGRGLRPTGDFPLGRRQRPGRRRDRLAQGRPVAAAVRQHDRLPGRRRRHRACPHPRRLHHPQAGREARRQQDGP

SEQ ID NO: 17404 - protein, 471 aa, Pseudomonas aeruginosa
RGACPPYPAQAQRNPQRSGDREAGAEAVRAHPVRGRLRRTGEELLRRSGFRPQRRRPELDRPRSPGARVPPGDERYPAGRAVQAVPLAVRLAHPAGPRPSRHRQQREVPRAAGGKRTAQPQVRRGTASLAAADPRRGLRGNQAVSLRFALTPGEPAGIGPDLCLLLARSAQPHPLIAIASRTLLQERAGQLGLAIDLKDVSPAAWPERPAKAGQLYVWDTPLAAPVRPGQLDRANAAYVLETLTRAGQGCLDGHFAGMITAPVHKGVINEAGIPFSGHTEFLADLTHTAQVVMMLATRGLRVALATTHLPLREVADAISDERLSRVARILHADLRDKFGIAHPRILVCGLNPHAGEGGHLGREEIEVIEPCLERLRGEGLDLIGPLPADTLFTPKHLEHCDAVLAMYHDQGLPVLKYKGFGAAVNVTLGLPIIRTSVDHGTALDLAGSGRIDSGSLQVALETAYQMAASRC

SEQ ID NO: 17405 - protein, 301 aa, Pseudomonas aeruginosa
PCRPDASLLKWRPFASAPPALAWGPQPGTVSNVRALPTPRAQALRPELPARCRGDSPHPPCHPCPRGSAPAGDRPGPGRPDRGTAGQRRTPGRDRARPGPDPLVEAEIRPRVALQPAPGRRPQVRSRLAGGERREAASGRQPALQHLHATDLPSAGARAGDRGHALHAAKGSGGAPGGHAGRRRLGPALDHGPVSLSGGAPVQRRPRRVQPAAQGRLGHRPSHPLRRAAPSGTRSETARAGGPRGLQPAPQDPAQHPQASPERRGHRGRRGRSDPPSRTTRPGRIRPPGQPAGRAARQSLV

SEQ ID NO: 17406 - protein, 419 aa, Pseudomonas aeruginosa
DTRQESGKPYERYPAPGQRQGRHPLPSGTVRPGAEPFRLRLHGDHREPGRGSGPTAVAPLDHHRRRRPYPGSSRRRRGRRATADRPRRATHLHQRHGAGDPGRQHARQLSDARQRRNRLRRRDPGVSPGRTGSAALMAVYAVGDLQGCLDPLKCLLERVAFDPTKDRLWLVGDLVNRGPQSLETLRFLYAMRESVVSVLGNHDLHLLAVAHKSERLKKSDTLREILEAPDREPLLDWLRHLPLLHYDEQRKVALVHAGIPPQWSLEKARLRAAEVEQALRDDQRLPLFLDGMYGNEPAKWDKKLHGIDRLRVITNYFTRMRFCTEDGKLDLKSKEGLDTAPPGYAPWFSFPSRKTRGEKIIFGHWAALEGHCDEPGLFALDTGCVWGARMTLLNVDSGERLSCDCAEQRAPARPAATPA

SEQ ID NO: 17407 - protein, 722 aa, Pseudomonas aeruginosa
LLSPFFLYSVQNELFFSSGHPKQGRAGTPASGPSAVTVRSAGGKGSTVQRRSLGDSRRPGWRPPRTRTTDPAPAHCIERGDVMSIFSHFQERFEATRQEEYSLQEYLDLCKQDKTAYASAAERLLMAIGEPELLDTSVDSRLSRIFSNKVIRRYPAFADFHGMEECIDQIVAFFRHAAQGLEEKKQILYLLGPVGGGKSSLAEKLKQLMEKVPFYAIKGSPVFESPLGLFNPDEDGAILEEDYGIPRRYLRSIMSPWATKRLNEFGGDISQFRVVKLYPSILNQIAIAKTEPGDENNQDISALVGKVDIRKLEEYPQNDADAYSYSGALCRANQGLMEFVEMFKAPIKVLHPLLTATQEGNYNSTEGLGALPYSGIILAHSNESEWHSFRNNKNNEAFIDRIYIVKVPYCLRVADEIKIYDKLLVNSSLAHAHCAPDTLKMLSQFSVLSRLKEPENSNIYSKMRVYDGENLKDTDPKAKSIQEYRDSAGVDEGMAGLSTRFAFKILSKVFNFDPHEVAANPVHLLYVLEQQIEQEQFQPETRERYLRFIKEYLAPRYVEFIGKEIQTAYLESYSEYGQNIFDRYVLYADFWIQDQEYRDPETGEILNRAALNEELEKIEKPAGISNPKDFRNEIVNFVLRARAGNNGKNPSWLSYEKLRVVIEKKMFSNTEDLLPVISFNAKASKEDQQKHNDFVKRMVERGYTEKQVRLLSEWYLRVRKSQ

SEQ ID NO: 17408 - protein, 305 aa, Pseudomonas aeruginosa
THQEGRRGGRQPAFHYRHGARRADQHSRARYRRTGAAPWPRRAADRRPPRQQGIHRRRAHRPPIRRRGRPRRRQGQQQRRRHGRLRLPDHPGGIPRLHVRGPGAAQPGQAPHHRHRHLQDRPRRHQQRRQPVAHQHRPHPALGPCAAHRAVRRQPGQAARGAEGTGADQARRAGQPRRYPGTRAGNRQAPRAHRPGAVPRYLRSQVQPAGQAAQPHLQGGDVLPDGRLRLDDPGDQGHRQALLHPALPVPQAELREDRSGVHPPPHQRPRGRRGGVLLLPRDRRHHRLQRAEDDAGDHGRALSDP

SEQ ID NO: 17409 - protein, 606 aa, Pseudomonas aeruginosa
VEHLRRPGLGRRQLERRLAGVPGHPPQADHAVRPVLHLRRDHPARTPGPVVRVRARARSLRRQLRPAADRLGIGHLPGVPRAVPEEARRMSKRQPIATGSEWTFELIQQYDREISRIAERYALDTYPNQIEVITAEQMMDAYASVGMPIGYNHWSYGKHFLSTEKNYKRGQMGLAYEIVINSDPCIAYLMEENTQCMQALVIAHACYGHNSFFKGNYLFRTWTDASSIIDYLVFAKQYIMQCEERYGIDAVEDLLDSCHALMNYGVDRYKRPYPISAEEERQRQKEREELIQRQVNDLWRTIPRVGGKDKEQSMARYPSEPQENILYFIEKNAPLLEPWQREVIRIVRKIAQYFYPQRQTQVMNEGWATFWHYTLLNDLYDEGLVNDGFMMEFLQYHTSVVYQPSFDSPYYSGINPYALGFAMYRDIRRICEEPTDEDRRWFPDIAGSDWLATLKFAMKSFKDESFILQFLSPKVIRDLKLFSILDDDQKDDLLVAAIHDEAGYRTIRETLAAQYNLGNREPNIQIWNVDRRGDRSLTLRHQQFDRQPLSDSTADVLKHLHRLWGFDIHLETLQGDQLVQTHHMPPKGASEGEEGYPRLDLIIPPI

SEQ ID NO: 17410 - protein, 296 aa, Pseudomonas aeruginosa
SVDVRPDRRPACRHGRGRPQQNKKPAVHGSRHAPVRYHPALPRSGHLRQPHPQRPGDPSGQRRTARPARFPVDAAGTGGRRPALPQPLSADKRRAAPGTGGPRLPRERHPAIPRLLLAGATRRTAGIPPRPSAHLRHGALSGDPPPARRNRDIARAPGRPGGARSLGRYGKHRPQPRQGQSGTARTGGRRPAPAASTGPLGHPGVDFRLSRGGFPCRFTRSAAPCAIAFSAVRSPISTGWWSVPAATRCSPAATARWAPTSRSSFIRRAARNTPWRAPSERAGAATAASPSMPAPR

SEQ ID NO: 17411 - protein, 619 aa, Pseudomonas aeruginosa
GVMSGKAQQQSRLKELIARGREQGYLTYAEVNDHLPEDISDPEQVEDIIRMINDMGINVFETAPDADALLLAEADTDEAAAEEAAAALAAVESDIGRTTDPVRMYMREMGTVELLTREGEIEIAKRIEEGIREVMSAIAQFPGTVDSILADYNRIVAEGGRLSDVLSGYIDPDDGSLPAEEVEPVNLKDDSADSKEKDDEEEESDDSSDSDDEGDGGPDPEEARLRFTAVSEQLDKAKKALKKHGRGSKQATAELTGLAELFMPIKLVPKQFDALVARVRSALEGVRAQERAIMQLCVRDARMPRADFLRLFPNHETDEKWVDSVLKSKPKYAEAIERLRDDILRNQQKLAALESEVELTVAEIKEINRAMSIGEAKARRAKKEMVEANLRLVISIAKKYTNRGLQFLDLIQEGNIGLMKAVDKFEYRRGYKFSTYATWWIRQAITRSIADQARTIRIPVHMIETINKLNRISRQMLQEMGREPTPEELGERMDMPEDKIRKVLKIAKEPISMETPIGDDEDSHLGDFIEDSTMQSPIEMATSESLKESTREVLAGLTAREAKVLRMRFGIDMNTDHTLEEVGKQFDVTRERIRQIEAKALRKLRHPSRSEHLRSFLDE

SEQ ID NO: 17412 - protein, 497 aa, Pseudomonas aeruginosa
RTNPRPEKPGVFLCRLPRRPASTLPLIFPSTARPPHAASAGRASPVSGLLLAGAGRRPHAHARGTGLAGRAPEHPPGRGHLLAAIRIPRRTGPLPGTRRRLHRPATGTPGRQPDACRTEDLDAGPGAGQGRSAGPAARHHGYPGAPGVPELHPALPGFPDHHPGTQERPDAEAHRRALRAQGRGGRPLCSSRTADRPASRPHPAAAAFGSGSPAGAGHRPGRRLRRRLRLQRMEPPPAQAQRPGDQRRDAIPLPTGDGRAARTTDPRRDRRQGPRRPQRRGDRATPGPLGRRPARPTSGLARDGDLRSSHRPADPGLGRHTAGHEPPPAPRGESPAAIGARTARQRTALPGTGGKPECHRLGNAPRGEPLHLRLAPRRTPARLSPRRMAAAGLLAADPAPHGRRVRHPLLHERKPGRTRPQFDYRMLAADGRVVWIRDLVTPITQGRTAPARSDDDITGPSSPSRPGACPNRSSLRCSTTARTWWYWPTAPTAASSR

SEQ ID NO: 17413 - protein, 74 aa, Pseudomonas aeruginosa
SPIPANASPRSTAPSARSPATASRRRWDARPACSPPDNTTPASTSPCGTSWSATGTGRARSGTDARPASCTPNG

SEQ ID NO: 17414 - protein, 139 aa, Pseudomonas aeruginosa
PSARYTIRRARSLTSSASSPISPPSSTPRPGSTTRPTTIRSPACPIACCSRAGSITPSTRPAKRVVPAPCCSSTWTASSTSTTASAIPSATCCSRPSPNACATSCATSIPWPAWGATNSSSCSPACTRKATPSTSRASC

SEQ ID NO: 17415 - protein, 159 aa, Pseudomonas aeruginosa
GRERNRPACHPGRTSPDAAGAWRRTAPQRSLLVRLGQFGMHGADDLGVVRGVEDGRAGDEGIGARRGDLTDVLDVDAAIDLQADLATGGIDQGACLAQLVEGTGDEFLPAEAGVDAHQQDHVDLVHHVLQHLQRSGRVEHQARLATAVTDQLQGTVDVL

SEQ ID NO: 17416 - protein, 765 aa, Pseudomonas aeruginosa
RLFAAAADARTKPGAPCASAAGLCGTHLLAAPAQPFQGQQQQYGETDQQGRRGGNGGAQVLANAAEHLPRQGGLLGTGEEEGHYHFVERGGEGEQRAGNHSRSDQRQGHPEEGGQRRRAEAGGGAHQVVVEPLQGRGDGDDHERHAEHRMHHDQRQVAVAEPQRSEEQVAGHADDHHRHHHRRNHQAHHQCLAAELAAGQADRGQSAEDHCQQGRRRSDDHAVGQRAHPLGGLEEVGVPAQGEPLQRVDQEGAGVERQRHDDQHRQYQEQQYQAAEDAQGVEPQALDRGHVGTQHDSLSNVFRADPPLPALRATFFPKAEGNRLAFSEGPLSQAQAAGAHQPAVDDVEHQGGEQEQAAEGGGHAPVDGAVGIEGDEVADHLVVRAAQQRRGDVVADGQDEHQQATGADARDGLWEIHPPEAGERVAAEGNRGAHVARRNALHHAVDRQDHERQHDVHHRDVYAGAVEHQLQRLVDQAELEQRAVDQATRLQQDDPGGDTHQDRGPERQQDQDHQQVALARRQVGQQVGQRVGQQQADDGDHRAHPEGAGEDVQVDGLVRGGARHFAEIVDPVVEGCEQVIGRIAAGVAADHLPVGGVAPALVELLHGVLVGSGLLLERQLARGLRHQAAITGQLHVQALGEIADGLVATSLGEILAERLVDGVGRQRLAVPGGDGLYRQRQRANHFRVGHALVEQRGDRHQEGQDQEGQQGQDQRLGLQAVHPLGARQALLEGAAGGLGYGHSCGHSELRKKSGPSGTTLESVER

SEQ ID NO: 17417 - protein, 421 aa, Pseudomonas aeruginosa
EEPPRGGPSGPHWRVRRGLPGRPGVEALFQLFAVVGPKGHVHCHLVLDVFRSGRHVLQQGLVQQRHRLLVGRTVGDVFRVSLLLLGLHREGDELQGLFPFLRPLRDGPGVEIVDAAVPYHLQVAFLLHRGDPTVVGRTHHHIAGSQVLRRLGARLPPLDARLDLVELLEGTILAFLGGEHAVDVLRRHAIGHQGEFEGVLGALAQAALAGEFLDVPEVRPTGRRAFQLVGVVGEHRGPDEETHAARLDGAGHEVLGLAELRRVEFLEQAFVAAARQLRRLHFHQVPGHAVGIDHGLDLGHLAVVFAGDDPVAGGFLVGLVERLDLGALVGPAEGHHGQVHRHGLGRAGQAGRQGGELQAGRFQGFRHYCSLHSAGLLRYGSGLPALTPPAEGRAPSHARPASPAEPHHRRSASGPARRSAA

SEQ ID NO: 17418 - protein, 404 aa, Pseudomonas aeruginosa
ESPYKKDAPRNGPDRSGKGLSRRAKVCAPALSGWRATASSALGPVLETLLQGLAVLRPEGHVHTHRVLHVLRCGRQVGSHLRIEQAYRLAVGRAVGDVLGESLLLLRLAGETDELLGQLLLPNPDRQRPEVEIVDAAAPDHCQALLLGLRRSDPPVVGRTHHHRAIGQVAHRVLPGLPPMDIGLQLVELAECPLDAGGRRQRLVDVLRRHAIGHQGELQAVLGAPAQAALAGKLLHVPEIRPALRAARNLAGVVGKQRGPDEDADSAGLHRAGNEIRGIADLRHVQLLEQTFLATARQLRRLDFHHVPGDVADLHHALELGQVAIVGAMHHAIAGGALEGFVERGFLGFLVGAAEGNHGHVFRPGGRGNSEKGAQQARPHGWQHRFFSLSCWPASIIPCRAEAR

SEQ ID NO: 17419 - protein, 288 aa, Pseudomonas aeruginosa
PAAPIFRARAAICASSCIDSTRIAGGSFSARIRGIASRPLTPGMEISSRTTSQGVPRRVSSNCSPLVASPTTCRSLAMPISCLMPSLTIVWSSATRTRITTLCCLTLFRLAGGCSCHGLATPSGILTLSVVPSPGALSMSSVPPIISTRSRMPTRPKELPRPTVATSNPRPSSLTLRHSSSPSRSRRSCTVCASACRMTLVNASWRMRNRPIALASTNCGEFSGTSTRQGICVRASKRRACHSTAEPIPASRIGGRSAVATSRTSWNNWAISFFMLPRRSRRPSWASA

SEQ ID NO: 17420 - protein, 360 aa, Pseudomonas aeruginosa
IVYREFPMPAFSLLPKPSVLLPLLLAAAFLPPAFVQAEEEAAKDQPPAPVERPAVSERSQDEAKGLERQLPEDGQQILKAGDESFLTLWLPANTAEAEGVVILVPGDGESPDWPQAIGPLRRKLPDAGWQTLSLALPDPQSTAPVTRPAESAASASADKDASAADSASKPDVKGESGNAPAPESTAEAGSGEPAQSEDQAPPPAIDPVEQRKAHAERVMARLQASIDLALQHEPKSVVLLGHGTGAYWAARYLAEKEPAEIHNLLLVTAEVPRDFRPALEDMVPKLKLATGDFYYRDARADREAARLRMQAGKRQKHPAYVQIAMQALPADPKAEQEQLYRRIRGWLSLHLQADAQKPAE

SEQ ID NO: 17421 - protein, 136 aa, Pseudomonas aeruginosa
IPAAWTMTAGALPTPLPASTVSTATGASTPTSIGTPTPVVLSPVAPSSTTSPKSIRARWSTLAIAIVQMLGALIPPAAHSDMATKTTSSSSTISRSSGRWCRSGPCSPAGSTTTTRTAHSRPSAASNTTAAAGSCA

SEQ ID NO: 17422 - protein, 447 aa, Pseudomonas aeruginosa
ATRRKCSSTKASKVIVNVKIKLCNRLRPLALGAALLCSFAHAEVVPLDRVVAIVDNDVIMQSQLDQRLREVHQTLLKRGAPLPPEHVLTQQVLERLIIENIQQQIGDRSGIRISDEELNQAMGTIAQRNGMSLEQFQAALTRDGLSYADAREQVRREMVISRVRQRRVAERIQVSEQEVKNFLASDMGKIQLSEEYRLANILIPVPEAASSDVIQAAARQARELYQQLKQGADFGQLAISRSAGDNALEGGEIGWRKAAQLPQPFDSMIGSLAVGDVTEPVRTPGGFIILKLEEKRGGSKMVRDEVHVRHILLKPSEIRSEAETEKLAQKLYERIQSGEDFGELAKSFSEDPGSALNGGDLNWIDPEALVPEFRQVMNDTPQGELSKPFRSQFGWHILQVLGRRATDSSEKFREQQAVSVLRNRKYDEELQAWLRQIRDEAYVEIKQ

SEQ ID NO: 17423 - protein, 290 aa, Pseudomonas aeruginosa
NGALSHPRLPPWPGARSLEPFPMSELYQHRARKRFGQNFLHDAGVIHRILRAIHAREGQRLLEIGPGQGALTEGLLGSGARLDVIELDQDLIPLLKLKFGLESRFSLHQGDALKFDLASLVESGEKLRVVGNLPYNISTPLIFHLLEHAPVIEDMHFMLQKEVVERLAATPGGGDWGRLSIMVQYHCRVEHLFNVGPGAFNPPPKVDSAIVRLTPFAEPPHPARDPKLLERVVREAFNQRRKTLRNTLKPLLSVEDIEAAEVDPTLRPEQLDLAAFVRLANRLAELPGNR

SEQ ID NO: 17424 - protein, 138 aa, Pseudomonas aeruginosa
SDETLVRNQASRMSDTQHQVNVRVDTRYLPEQSAPEQNRFAFAYTVTIENQGEVPAQLLSRHWIITDGDGRTQEVRGAGVVGEQPLIAPGAQHTYTSGTVLATRVGSMRGSYQMLGSDGIAFDAAIPVFRLAVPGALH

SEQ ID NO: 17425 - protein, 143 aa, Pseudomonas aeruginosa
AAIAPNSARRPDPPPRPHESPASGGRPVHRYPDMSDTFQRIAPEQARQLRENGAQVVDIRDPQSFAVGHISGSRHIDNHSVADFIAAADLDAPLVVVCYHGNSSQSAAAYFIQQGFSDVYSLDGGFELWRSVYPADTSSGEAE

SEQ ID NO: 17426 - protein, 142 aa, Pseudomonas aeruginosa
RPTRCTCSTSSNSRSSRNSSSRKPASATCASSRNTWRRATSSSSARKSRPPTWSPTANTVRTSSTAMCCTPTSGSRTRNTATRKPARSSTAPPSTRNWRRSRNPRASATRRTSATRSSTSCCAPAPATTARTRAGCPTRSCA

SEQ ID NO: 17427 - protein, 426 aa, Pseudomonas aeruginosa
GAFMSYVIDRRLNGKNKSTVNRQRFLRRYREHIKKAVEEAVSRRSITDMEHGEQISIPGRDIDEPVLHHGRGGRQTVVHPGNKEFTAGEHIARPSGGGGGRGGGKASNSGEGMDDFVFQITQEEFLDFMFEDLELPNLVKRHITGTDTFKTVRAGISNDGNPSRINIVRTLRSAHARRIALSGGSRAKLRAALKELERIKREEPDNLGDIQELELEIAKLRARIDRVPFLDTFDLKYNLLVKQPNPTSKAVMFCLMDVSGSMTQATKDIAKRFFILLYLFLKRNYEKIEVVFIRHHTSAREVDEEEFFYSRETGGTIVSSALKMMQEIMAERYPTHEWNIYAAQASDGDNWNDDSPVCRDILLKQIMPFVQYYTYVEITPREHQALWFEYERVREAFEDSFAQQQIVSASDIYPVFRELFQRRLVA

SEQ ID NO: 17428 - protein, 205 aa, Pseudomonas aeruginosa
SSRPFDRLTSAPTAGQHAGTVGAAHSRTRSRPSTGAAMRLFAIILLCLVLATCASHIPSARVTHPASAGLPGLQGFQLMPPEQAVDALPYRNRYPLINAELRQGLAAHGYHESATPQFRVYYWLALRDAPLEFRPDLPPTSGMGPYLAIHRLRDETGTLRVRLVDLEERVLWEGMVSTGLSPARANPEQLELAVGALLRQLPRAR

SEQ ID NO: 17429 - protein, 553 aa, Pseudomonas aeruginosa
PDHQRHGRGRTGPGNRPLRRPGRPRGAPAAPRFPGVRRGSPAGPARSALRRPLRRPGLPGRRRNPRPDAPTGGIRRVAGVDPGAQLEGNFPSPDGTQPRGLHPGPARLRRPGRTDPGSRGAIRRTAAGGPPSGNRYRRPCPVGIAAMRPPPAAAQRTLGLPAARPGQGTHQRSGLAPPYRPRGSRRAVDRCGEPALQGAARLPGTGAPGGRVPHPRPSGAGAAPEYTAGAVAELRRVSPPAAFRGVRRRQRDGRARPPRPGTAGLSAGRLPARRGAGSAGSQREAAGGKGLEGRGTGRGAEACAPRRTQGLQGRTRKGLKQRFGSQRLATPFEWRRPELLLDPRLAPEIAQRLAGDRMLQVRRQLGQGPEHESVLQHFGARQHQAIEIAHQVAVEQHVDIQRQSLALWRIAAIVGLDVLESQAQFGQRQIGAGRHHQVEERPALDTHRLALEYRRTTQVMKESGQRIEAGMQMALTLDIAAEAEVDRNQRHPRSISTPTPRAAGTAPGLVTRMRSQGMPRSPISTSARRSAKVSTNWKCDSRANSCTRSDNAA

SEQ ID NO: 17430 - protein, 283 aa, Pseudomonas aeruginosa
RMPRSQSYTPMTVSTSKPSIKTLSTSLPAPRDATTSVRRPVRIEDILVLGGIHGLATGDPRLPARFPLLRRPAQPLVRHPGPARQRFRQPRRDQHAARRREETRHPDPARRRRQRPAAGAGRPLAGARRDGGGLGRHRRRDRPPVSAVLQLPRRQGCRHRRGHAPRPLSAGRTAGRGGLAADLQAVAHQLARLAGGHPADPAVAGLAAARSAAADDRADRPDRLAAPRQLTRSVRRPRTAFLIHKRKKLHAVWPSCVIDTCLTATWRPLRPPAATPSASAAGR

SEQ ID NO: 17431 - protein, 156 aa, Pseudomonas aeruginosa
SPGRGDRSSAAGTRSGQECRAPPGGRFPDHRDSPGRSAWRSCRRLRRRHRPPIRQATGSGRYRPPAPTGCDRRKPARRRTGTAVAALPASAPAGALPCGARRPPARPRRRPSPGHRKPPPAGRRPGRDRRYRRSRRYPPACSRTRRAPGGSAAACA

SEQ ID NO: 17432 - protein, 135 aa, Pseudomonas aeruginosa
ALELGKYEAAHDNRRLCARPVFFDRRLCIPPAEPLISATLENRRIRATLPEYVQPPVISEGTTWMPAVKVKENEPFDVALRRFKRSCEKAGVLAEVRSREFYEKPTAERKRKAAAAVKRHAKKVQREQRRRERLY

SEQ ID NO: 17433 - protein, 172 aa, Pseudomonas aeruginosa
STRRPRVSDRASARPRPGFRLSAMSEIKSRLLDAVKVAMRAQDKPRLTTLRLALADIKRVEVDERIEVDDARALLILDRMIKQRRDAQRQFSDAGRQDLAEVEAAEILVLQDFMPKPLDDHEIDALIERSIVDSGAQGPQDMGKAMNLLRPQVQGRVDMAQVSQRLKARLSS

SEQ ID NO: 17434 - protein, 595 aa, Pseudomonas aeruginosa
PAEPHRHRRGGEFTHPAEENRQELQRLLPVPQGKDSLVHRQPGQAVLLLLRLRRRRQRARLRHGPRPAGVPPGGRGTGQACWHGRAARGTRRTRAHAAPADRLAALPATQRRRRVLQAGAEKPPGAQGRGELPEGPRPDRRDRPRLRPRLRPARLGQPAQAPGWRQPATQGHARRRPAGGEQRHRQALRPLPRSRDVPDPRQPRADHRLRRPGARRRQAEVPELPGDSGLPQGPGTLRTLRGPAEESRPRRDHGGRGLHGCHRPGPARHPQRGGDPRHGDQRGTHQAPVPPGTEHPVLFRRRPGRPQGGLARPGVGAAEPAGRQARALPVPPRGGGPGQPGTRRGRGCLPRTHHPAGPAAGGVLLPATDAGGRPRHPGRQGPPGDPRRAAAGEDSREQPAPADAATSVGNHRPVRRKHRTTGAPQPATVVHGSRSERRLGRRRLFRRQRLLRERALPCAVRRCARLWRGATAQELEQGQEALGRQEVGWQEEVGQRRPRRLQDSATNAGQRGVHHPQRPAHLAASSAVGLEGRRCGHPRQGAGYLRPVAGVPAGSPAEEPAAELDATHRALARHAPGPPAAGPGREGVADRPGEP

SEQ ID NO: 17435 - protein, 989 aa, Pseudomonas aeruginosa
PASGSARSKPRRCASCAIRREASTCAPSSTSDERTPGLKNRGFFFAACPAARRLHFRLYSRPPRDRLMQRLQAVLLLCLACCWPGLAGALTLTPEERAWLAEHPSIRLGVDTSWPPFEYRDEQGRYQGLAAGYIGLLQERLGVSLTPVEPKTWTQVLEQAKDGRLDLLPGIMATPERQEYLSFTRPYLDFPIIILARKNGPMPKRIDELYGLKVAVVDHYAPHELLIAQHPDLTLLPLPSVAAALQALATGQADAFVGDFASSVWNLRQLKLNGLEISGETPYRYQLAMAVPRGQPILAGIVDKVLADLSAEEIERLQAPWVGGLLDRRPAWREMATYGLPIVLLILVSVAILLAMNRRLRREVSRRRQLERELRDSEQHYRGLVESLNAIAWEMRLEENRFTYVSPHAERLLGYPLGEWLQPGFWQRTLHPMDAEYAIHYCMSESQAGRDHSSTTGCSPPTAGWSGFAIWSPRSRKAGLLLRGLMMTSRGQAHRAGQAPVRTEVRFGVPPLPGHGGTGQRRRRPLPRGEQHLRAADRHRRRRRHRQDRHRTGHLGTPRPGPAGPGKARPRQPDQPRGAPAAPQWQYLQRAAQRPARGPRPDPGAGGGDPRHHPPGGDPGTAADLRGEVRQRLPCLPRRSADQQPRRRHADRRERRLHPSHRLPPRRGHLPLHARTRPVGRHRGPQAPDLAGTPPHPDPGLHRPCTGPQRWHPPVRDVRPPDQHRWRGLRADHRPRYHRAPAHAGEAAAGRHRLRKHRRRRDDHRYPPTHHRGQPRLQRDHRLQRAGGAGTLAQPALLRTTRLQLLPRHVEPAGARRALAGRDLEPTQDRRAVPRMADHQRGTQSAGRDHSLRRRLRRYLHPQVRPGPARLPGPPRSAHRPAQSPAVREPAQSRPRRGPRRESSRRRAVHRPGPLQAHQRQPRPSHRRPAAQGHRRTPARPVARRRYRGPPGGRRIHHPAPRPAPGKRRRARRAQAAECLHRAVPGRRS

SEQ ID NO: 17436 - protein, 337 aa, Pseudomonas aeruginosa
ILRQRQRRHRPVPQGRRRRPDPGEERRRRHVPRQVAGPQPHRVLHPRTDLPGHRAHGAGNRTAPRPRARRVAAVLPTQAEPGERLAGRRRGTGALVPSAVRGNFPGALHPPRRGLRPDPAPRRLGAGTRLPADGRMAKAARAVRPAVGQPRRRPARPAATDRTPRAIAGAVRPGTVAAATGNHRELHHEPDRGGPRRPPRAQASRRTAGDRRLRHRLLLAQLPQAPAAGHPEDRQVVHPRPSRRSPRCRHHPRHHRPRPQHAAHGDRRRRGNRRSAELPHPRRLRADPGLRPQSAAARRAVRQQIPQTAPADWRSPRSAGIIRRPVRHAWRVSVSKL

SEQ ID NO: 17437 - protein, 86 aa, Pseudomonas aeruginosa
FLLSCSRSCRFLLISPSHLDYTSPFDLVLFLCSLCLLLTVVRLSSPFLFSVYTLSLRALYRFVSPIPTPVAVVFVVTLPALCSLML

SEQ ID NO: 17438 - protein, 284 aa, Pseudomonas aeruginosa
RKRNYNQSYLSSTPRLFTENPSVCRLPSMDKRTQIPPDSFAARLKQAMAMRNLKQETLAEAAGVSQNTIHKLTSGKAQSTRKLIEIAAALGVSPVWLQTGEGAPAARSAVSVADGSPLVLEPLHPWDSDTPLDEDEVELPLYKEVEMSAGAGRTAVREIEGRKLRFSYATLRASGVDPSAAICAQLTGNSMEPLIMDGSTIGVDTATTHITDGEIYALEHDGMLRVKFVYRLPGGGIRLRSFNREEYPDEEYSPEDMRSRQISMIGWVFWWSTVRHRRGPSLVR

SEQ ID NO: 17439 - protein, 124 aa, Pseudomonas aeruginosa
TRKQPELYFPQRRVAAGGNTMQPSIAPSTPIPRQETVELVYRIFGDVLVPLEQVRERWFRNLNKENFSKALACGRIALPVTTLDDSHKAMQFVALDHLAAYVDQRANQAGGARRAPPGADSIAP

SEQ ID NO: 17440 - protein, 713 aa, Pseudomonas aeruginosa
SARRQNRPQRVHRAEPLAQLPGDVGHDVHDVGVTFDHHFFGDLHRADIGHPPHVVAPQVDQHQVLGDLLGVRQQILLQCQVGLFVDPARTGTGDRAHRHQAILDPYQHLRRAAHDMEVAEVEEVHVGRRIETAQRAVQVDGRRLEFDGHALRRHHLHAVAGQDVVLDPSYRVFIVLAGEAGTKRRLTTLGRLEVEAATRGDRLAQTLQQLLQTCLAALVGIFLGGIGEDDGVDLPGQVVEYHYGIGHHQQDIRVAQRVRVRTGGQAFFHVAHAVVTEVADQAAIETWQAGHGGHLVARLELLDESQRVGAIEALGFHAIDADPHLMVVDPQHRAARQADDRIAPPFLAALHRLQQVGVRRVGQLQVDRQRRVEVGKGLEGQRDAVVAIGGQPQEFFAIHDQPHRRRERSTECKRAPAIRRRMMSGAPAPTRQGLDDLHPEFADRHGLISLVGGGKGVVRQHYLSGLVGARQQVAQVVDDQGGRFLGDRPAVVVAIGQRRAAHAGSFGGEHVVARVTDEQRIFGLDAGHLHHEQQRRRVGLLLRQGVTADDPAKIATQLHLIQQRSDEALRLVGDQRHFHAVALEPLEGVDDAGVDLGERMTVGIGLHEQRQRGFGFLLTDAVVLDASGQGATHQDACAVTDPLADLLDARRRPPEAGEHAVDRGGEVGNGIDQRAIQVEHHQTRQARGEERLRSAHYWCAWASSACMARMTSA

SEQ ID NO: 17441 - protein, 119 aa, Pseudomonas aeruginosa
SGALKMAEPATKVSAPAAAISRMFLTLTPPSISRRISRPEASIRARASRNLSRVPGMNFCPPKPGLTLISRTMSTLSITYFSTSSGVAGLNTRPALQPPSRISCRERSMCCEASGWKVM

SEQ ID NO: 17442 - protein, 138 aa, Pseudomonas aeruginosa
PLSVFGGENDDFSPQQPTPGPSRARPAPQPPGCAVRIFSLRPRSHSRVSNSSTEKPISKVAAAAMVGLRFSRMPLNICRGRVACSGPARKRVTTTSSNEVAKANSAPEITPGAISGRVTRKKVVSGGAPRLAAARTRL

SEQ ID NO: 17443 - protein, 261 aa, Pseudomonas aeruginosa
TVVLTDEVGHEGVARLLVEIARRLDLLDFALVEHRHPVGHGQRLALVVGDVDHGDTEALVQMLDFHLHVLAKLLVQRSQGLVHQHQLRLEDQRAGQRHALLLATGKLRRITPGEGVELDHRQRALDPFLHVGLAHAADAEGKGQVLGHGHVREQRIVLEHHADVALVRRDIVDRATGQEDFAGGGGFETGQHHQAGGLAGPGGAEQGEEFALANVQVEILHDEGLAVVALLHATEADQHIAALSLGHNRTFVRFMDAVRTA

SEQ ID NO: 17444 - protein, 138 aa, Pseudomonas aeruginosa
PRGCPGCCCRWRTGSGAAPPRPPGAAPGRGGRRTAGLPAHAAGAAGGTPQPARRPAAGRGGSTGSARTPATRRGADTWVATSARATGPGTCAAASATPGRPPSPVPASRDGSPPVAAAGSRYRQPPLARRTPVRGSGG

SEQ ID NO: 17445 - protein, 62 aa, Pseudomonas aeruginosa
PLRERIPAGVPPASKQEETFPESTLRPQYLLTSNWRHGRKLCLSLSNHAHQGAVADSLCDQR

SEQ ID NO: 17446 - protein, 92 aa, Pseudomonas aeruginosa
SAPWPSATSPSLSAPPAASSSSSWKRSAAAARWSVTRCMSAISCSSPAKSAAKRRPRSWRRSCTSASSPGKTSANWRRASPKIRVPPSTAAT

SEQ ID NO: 17447 - protein, 273 aa, Pseudomonas aeruginosa
SPPARNTPTPAARCWRPGSAACAAAIRCSAATESPSTPRSRCFAWPYRERCTDGGLRGRRPAGLPGSPEMPAGARRLRPDQGPPVAGRRPGQPRPAVPGDAALPLCHARVGGQRPGQPRPAPAGGGAQVRAPEEVRHAAGNPRGAGPRATARLAASPAAAALRRTTQGRPGACRHPPAVEPGKSPPARSRGGASIARRPAPAAVPRRHVRQRAGQVGQEAAWHRPPEGDHQLLHPYAFLHRRWQARPEEQGRPRHRAARLRPLVQLPFAQDPR

SEQ ID NO: 17448 - protein, 158 aa, Pseudomonas aeruginosa
ATPSSASPPNRPASSAKTAPRWSTSATRRASLSAISAARGTSTTTRWRTSSPPPTSTLRWWWSATTATPARAPPPISSSRASATSTASTAASSYGAASIPRIPAAAKRSRPRRYPAKKTVTSLAFLPLLRPERTILFLRPSKTGESRHTGFRAIGCDR

SEQ ID NO: 17449 - protein, 268 aa, Pseudomonas aeruginosa
ILPGGKTQATDGEGALLRDQGLTGLRVAAGLVQPRRRRRHPRGGLRHPEALPALDHVALGNQAPQRVRRRHQPVPRGQAVPLDPQPDRHRQDRTRRREQPGYIRAGRQGRHPQAGGIPAERRGRLQLFGRPLPGQPGPDGIRRDVQGPDQGPAPAADRDPGRQLQQHRRSRRPALQRHHPGSLQRIGMAQFPQQQEQRGLHRPHLHRQGAVLPARGGRDQDLRQVAGQQLAGACPLRAGHPEDALAVLRAVEAERAGKLEYLLEDAGI

SEQ ID NO: 17450 - protein, 166 aa, Pseudomonas aeruginosa
GATVNTSRRPSRRPSAGVPLPTWSTASRSAFPGAISTNRCCTMAAAGGRPSSTPATRNSPPASTSPAHPAAGAAAAAARPATAAKAWTTSSSRSPRRNSSTSCSRTWSCPTWSSATSPAPTPSRPSAPASATTATRRASTSSAPCARPMRGASRCPAAAGPSCARR

SEQ ID NO: 17451 - protein, 163 aa, Pseudomonas aeruginosa
CRRSWPSVIRPMSGTSTPPRPRTATTGTTTRRCAGTSSSSRSCRSSSTTPTSRSPRANTRPCGSSTSACAKPSKTASPSSRSSRHRTSTRCSASCSRGGSSHEQAPAHRHRLGMDLRADPAVRPGNQQDRRALCPGYLSEPDRGDHRRADDGRLRLGGHADRL

SEQ ID NO: 17452 - protein, 457 aa, Pseudomonas aeruginosa
PLVLRQALPQYGKELQAWPDGPGLRDRDQLRSLHRLPDGGKHPVHAGAGDRPRLLRAQQFLQGQLPVPHLDRCQFDHRLPGVRQAVHHAVRGALRDRRGGRPARLLPRPDELRCRPLQASLPDFRGRGAAAAEGARGTDPAPGQRPLADHPARRRQGQGTIHGALSERAAGEHPLLHREERAASGALAARGDPHRAQDRPVFLPATPDPGDERRLGDLLALHAAQRPLRRRPGQRRLHDGVPAIPHQRGLPAVLRQPLLQRHQPLRPGLRHVPRHPPHLRGTYRRGPPLVPGYRRQRLAGHAEVRHEELQGRKLHPAVPLAQGDSRPEAVQHSRRRPEGRPAGRGDPRRSRLPHHPRDPGGAVQPRQPRAEHPDLERRPSRRPLADPAPPAVRPPAAERFHRRRAQAPASLVGLRYPPGDPTGRPARADPPHAAQGRQRGRGRLPAPGPDHPAHLIG

SEQ ID NO: 17453 - protein, 454 aa, Pseudomonas aeruginosa
APASAPPGPIRNSSNWRSAPCSGSFHGPARTPWGRLPPITRRIPMQIYKVGGAVRDRLLGRPVTDIDWVVVGASSDEMLARGYRPVGADFPVFLHPQSGEEYALARTERKSGRGYGGFTFHASPEVTLEEDLTRRDLTINAMAEDEQGRVIDPYGGQADLEARLLRHVSPAFAEDPLRVLRVARFAARYAGLGFRVAAETLALMRQLAESGELQALTPERSWKEISRALMEPNPEVFIQVLHDCGALAELIPEVEALFGVPQPAAHHPEIDTGVHVLSVLQQCARHRQPLSVRWACLLHDLGKGLTSEADWPRHIAHEARGVPLIDAVNQRFRVPRDCQELARLVGEYHTHAHRALELRPNTLLELLQSFDVYRRPQRFEEFVAASEMDARGRLGLEQRDYPQAAYLLGAAQAARAVSVKPLVEKGLKGAELGEALKRARLAALKAYKEERGKA

SEQ ID NO: 17454 - protein, 221 aa, Pseudomonas aeruginosa
KLCPLRYPLQGMPRQACAAPLESRTSSSSVESMVWLLAILAYLLGSLSFAVLLSRWFGTQDPRASGSGNPGATNMLRVAGKKLAILTLLGDVGKGLLPVLVARWLGLGVMEEAWVGIAAVIGHLYPLYFNFRGGKGVATAAGMLLGLYPPAVLLAAAAWLLTFKLSRTSSLASLVATPLTLPLLAWQQPGALLPMTVLTGLIVWRHRANLRDLFAGRERHF

SEQ ID NO: 17455 - protein, 352 aa, Pseudomonas aeruginosa
LRPGGHSDRRQRLHRPARLDADRRAVMLAGEQALAAGVGDHRAIVGAEARAGVEHLPLHFAEHLFQAAAQRLVGADTAGDHQVLQAGLLQGATALDQQGLDHRGLERQGDVAAGLLAVVAGLDATLPGVQGKGLEPAEAEVQAGAIGHRPREHEAARSAALRQAGDFRTTGIAQADQLGGLVEGFAGGIVHRFAKQLVAADTVHPHQLGVTAGNQQGDEREPRWLLFQHRRQQVPFHVVHADRRHAPGEGHRLGTGSPHQQGADQAGTGGIGDRVDIRRRAAGLVEHLADQRQHALDVVARGQLGHDAAVDAMEVDLTEQRVGQQAAFAVVKGDAGFVAGRFQSQHAHGLEP

SEQ ID NO: 17456 - protein, 698 aa, Pseudomonas aeruginosa
RRASPPETPRRPDRPGDNCYAAALRPRAVVFENTMAGLIPQSFIDDLLNRTDIVEVVSSRIQLKKTGKNYSACCPFHKEKTPSFTVSPDKQFYYCFGCGAGGNALGFVMDHDQLEFPQAVEELAKRAGMDVPREERGGRGHTPRQPTDSPLYPLLSAAAEFYKQALKSHPARKAAVNYLKGRGLTGEIARDFGLGFAPPGWDNLLKHLGGDNLQLKAMLDAGLLVENSDTGKRYDRFRDRVMFPIRDSRGRIIAFGGRVLGDDKPKYLNSPETPVFHKGQELYGLYEARQKNRDLDEIMVVEGYMDVIALAQQGIRNAVATLGTATSEEHIKRLFRLVPSILFCFDGDQAGRKAAWRALESVLPNLQDGKRVRFLFLPEGEDPDSLVRAEGEDAFRARITQQAQPLAEYFFQQLMLEADPATLEGKAHLATLAAPLLEKIPGNNLRLLMRQRLSEITGLSGENIGQLAHHSPPPSSMDHGASGALDGDDYFAASAYYENEPSHAPFDAAPGYGEAQPRKSWNKDKKPWDGKKWDGKKKWDKGGRGDFKTPQRTPVSVESTTLNALRTLLHHPQLALKVDDAGTLAREQDTYAQLLVSLLEALQKNPRQSSMQLIARWHGTPQGRLLQALGEKEWLIVQENLEKQFFDTITKLSESQRFGEREERLRSVMQKSYSELTDEEKALLREHYSVAASSPSQS

SEQ ID NO: 17457 - protein, 823 aa, Pseudomonas aeruginosa
HHGAKLTEQARRLSEQKFASVFHHCPDMVVLANGADGRFLAVNSTFEQQIGIAADDAIGKTATELGIWALPGLGPQVLEKLGHGNLTNLEVPLRRRNGSTFSALLSAQHVALDQTPALVVVIRDITHLVETQELLRISEEKFANAFHAYPDGLLISSLEDGTLIDVNEGFTRLTGYRRDEVISRSTLELGLWVDTEDRKRLISLVRHHTLTQGFTAPVRDRNGGIRQCEMSAHRISIDGEDCVLTIVRDITERQLMQEKLQQAATVFESTAEGVMITDTRQRITAVNRAFSEITGYSEQEALGRSPSLLSSGQHDSSFYLAMWNQLERDGHWQGEIWNRRKTGELYPEWLTISAVHNPQGEITHFVGVFADISTLKYAQARLDYQAHHDPLTGLPNRLLFESRLNHALDEAREESRPGAVLFIDLDRFKHINDSLGHPIGDLLLKAIAERLRDQLRDVDTVARLGGDEFIILLPGLHQESDAEHVARKLLNAFTAPFQADGHEFFVSASVGIALFPKDGDDAPTLVKNADAAMYRAKSRGRSRIEYYTRELTYLATERMALETELRRALERDELQLYYQPKLSLESGLLVGAEALVRWYHPLFGEISPERFIPLAEDCGLILPLGDWVLEHACQQMGEWQKLHAPFGPLSVNLAGAQLGQPQLIERLEQLLEQSGLEPSRLQLEITESFIMNQTEEALAVLHGLKRLGVQLAIDDFGTGYSSLSYLKRLPLDILKIDKSFIRGLPDDPHDAAITRAIIALGRSMQLTVIAEGVETEGQQSFLTHEGCEQIQGFVLSPPLPAELFASKFLKPRQPIGAPREAPV

SEQ ID NO: 17458 - protein, 565 aa, Pseudomonas aeruginosa
EESSMKELSPSAGSALSGAPQQWHDIDWCRVQRNVRGMQVRIAKACREGKWRRVKALQRMLTRSTSARYLAVRRVTENQGKRTAGVDRLLWDTPDTKWKAAQGLKRRGYQPRPLRRVFIPKSNGKERPLGIPTMTDRAMQALYLLALSPIAETTGDPNSYGFRIERSTADAMSQLFVCLSGKASAQWILEADIQGCFDHINHDWLLNHVPTDKVILRKWLKAGVIHKGQLQATDAGTPQGGIISPTLANMVLDGLESQLKRHLGVTRAKKLKLNVVRYADDFVITGVSPEVLEKEVKPWVEQFLAVRGLQLSLEKTRIAHIDQGFDFLGWNFRKYNGKLLIKPSQKNAKAFYGKVKEVIETSRTARQEDLIRTLNPILRGWALYHQPVVAKQTFSRMDNRVFLKLWRWAKRRHPNKSLDWIRRRYFRIHGDKTWVFATTVLESNGKKREVALYSLASTPIERHRKVSGEYNPYDPAMEAIGEKLRTERMLKKLKYRTQIRNLYLSQKGLCSLCNQPITRETGWHDHHILYRSQGGGDSLENRVLLHPACHQQLHARGLTVSKPAR

SEQ ID NO: 17459 - protein, 474 aa, Pseudomonas aeruginosa
  UNSURE (167),(176): Identity of amino acid at the above locations are unknown.
AAQAFDRRRGVGEGTHIGKRDPGPSPGESLGKTPRGGVITGKVLAPRQRRFRGDGVQGVLAKTRRMVERMGARPGVGRLGRNASGFRRQGSATPGANGSSIPRRHDARHGARAGRAPRRSRHARRRHVISRSRLGPSARDVPGHGRHPRDHPAERPGSTLAPRGRRXVRLRRRRMXGPRATRDLRHRRRHPRLPARRRAAAEAHSRAGHPPAGHPAKPGAAHRGLRRGLRRTAAWRRTHPRRQLRLQERRPGADPRRTPGQPRTAAGNIPRPVAAPGRRRPAAGAPGRPRGIPLHQPRLPAPGRPAGRARGLRRGLRGARPRRPPGAGACLPLAARPVPEQRPRLARADQRAAVRRTAGGVDLRRAAAAAARGGRGLPPEPLPAARPGARAARLKPRAHRFALPFGPAARAGHTGPPAGSPAEIVDRRWMYCSSNPWASAPFSACCSASPAPAARWSPCPCCSACTCRCATPSA

SEQ ID NO: 17460 - protein, 647 aa, Pseudomonas aeruginosa
VSAAVLLLSTIINSSLRVLIGPENSYRTPSNCNGPLLGKSCTRKGYATHFPNGEPVRNMCGISGEFRFDNQAADLAAVERITHHLAPRGPDAWGFHAQGPIALGHRRLKIMDLAEASGQPMIDPDLGLAMVFNGAIYNYPELRGELESLGYRFFSGGDTEVLLKGYHAWGADLLPRLNGMFAFAVWERDRQRLFLARDRLGIKPLYYSLDRSRLRFASSLPALLKGGDIASDLDPQALNFYLNFHAVVPAPHTLLEGVKKLPPATWMSVDLDGSCEQRTWWTLDYGPRPDERELTLDDWQERVLDGLREAVAIRQRAAREVGVLLSGGVDSSLLVGLLHEAGVDNLLTFSIGFEDAGGERGDEFQYSDLIAERYHTRHHRLRIGEHEVIEQLPAAFRAMSEPMVSHDCIAFYLLAREVSKHCKVVQSGQGADELFAGYHWYPKVDGADDAFAAYRAAFFDRDHEEYLATVGERFRVEDVAGRFVRDHFASPGAEAAVDKALRLDSTIMLVDDPVKRVDNMTMAWGLEARVPFLDYRLAELSARIPARFKLGDGGKQVLKGAARKVIPSEVIDRPKGYFPVPGLKHLQGRTREWVRELLLDPSQDRGLFQPAIFDRLLSDPNGDLTPLRGSKLWQLAALNLWLSEQGL

SEQ ID NO: 17461 - protein, 272 aa, Pseudomonas aeruginosa
KWAPNAGARTRSDHERPLASASPAQPAPATYPGAHLRTPPGASRRRSQRAHRETAEHPLRLGPPADRADLPGRRGTGPRPVAGSPRRTRHRALRGGAAAGPGPRPAAALPRSLGYPAPVVHRLPPGAPSATRFPHPPGAYRGGLGGDQPPVPGARHASGADRAPQPAPPRRADLLAGRGRRHWRRGRHGDGPQPRQGVPGSGGRLQPLVPGGGPAMQPAGRLRSAGTAPGRALHEPRTGLPRPLGAAQQPPGQGALPQARLPRTGDLHHQAQ

SEQ ID NO: 17462 - protein, 666 aa, Pseudomonas aeruginosa
IALRPDHGGKHDPLPGQGPHPPRPAARRPAPATAAPGRQRGGKRRVPRRARFAGGQAGGRRAGPGRGGGPAHRGRGRGGHRGRPPFRFARAAGELPRRPRPARAGDWLRGGGRRHPSSRRGDRRRPAQHPRADRGAEPPAPGRHRRGKPHPARPRDRAHPAGRRLWLRRRVAQRRTPGRAAHRQPAHRRHPRGRHRRPPSGPPRGRDPGRAGPGNTGGGPGLPGRGRRPARLRDHRSQRARRPGQPRAAADRRTLRRSSLPPQPRGAFMTPLPQPDLNYLQRVLLEMLAIPSPTGFTDTIVRYVAEQLDELGVPFEMTRRGTIRATLQGRLNTPDRAVSAHLDTIGALVREIKPNGRLGLAPVGCWSSRFAEGSRVTVFTEQGVFRGSVLPLLASGHAFNTEVDNLKISWDNIELRLDAYTASRADSESLGISVGDYVAFDPLPEFTESGHISARHLDDKAGVAALLAALKAVKESGQEPPIDCHPLFTITEEVGSGAAGALPWDVSEFVGIDIAPVAEGQNSNEHSVSVAMQDSGGPYDFHLSRHLLRLGERHDIALRRDLFRYYHSDAQSAIAAGHDTRAALLAFGCDATHGYERTHIDSLAALSRLLTAYILSPPVFASDAKPRETSLERFNKQLEHPVHMESCTHVPPVDEVLDSSNNSDKD

SEQ ID NO: 17463 - protein, 418 aa, Pseudomonas aeruginosa
LHVPTLPGPAVALLRAAGPGAAARAAGRRGPAPVPGRIRRVLPRRRRQGAPGRHPRLAGAGLRRPARRPRELRQERRGLVVQGAPGQPQRHRPGRFPGDQLPAAGRPQGLPADRRWAHRTAGERRPVRLLPAPGASAQLLVPAATAARREHPAAARAEHQHRLRAAVLQHLRGQRGQPGNPDGLQRGLLRGAVRVVLLQPVPLRLATRGHLCLVPAVQPQPRPVFRQLRRPAVQAAARTRGAGVGRHLPADVPELPGVDPVQPRLPLHPPRLPAPRPLPPRPAAGLRGPVGQRAAGGAARLERPRQPDGDAGLPQPAAGRRPRLAPGPALRPLLHPGLGRAAAVVPGHHRRLAGLRTVRPVRQQRGQDRHDRGTGDPVHRPRRPHQCAQGGRLPLAPGGRAGAGGERGEEPLPGEDEP

SEQ ID NO: 17464 - protein, 225 aa, Pseudomonas aeruginosa
DSHPAERRAGHAATAPRHPAGPRPGGLRGDHRQLRQRADVGDQRYPRLRSHRVRQAAPGAHRLRPGGTALRHPGAVQRPGRGKTPAPASRPGQGRAAPPQRRPDAVAPGTDEPAQQCPQVHRRRPCRRARAAALRRGRTRAPAVQRQRQRHRDIRPGAEDPVRILLPGRLHHHPPLRRQRPGPGDQPRAGADDGRAHRGEQRAGQGHPVQRRPAAQSRPRRRRSG

SEQ ID NO: 17465 - protein, 155 aa, Pseudomonas aeruginosa
TGATAATPPGPAGQRGQPDPGLPAGIAGALGAAGRTLPAAETAERLPGGLQCTAPAGPGGALAGTAVDLAGHPLCATGARPAHPPAMPAAALPGPAAARRPAPAGPGPAGGGERPARSPAGTVPGAAPTARAEQARRPRTNARTPHASWSPRTTR

SEQ ID NO: 17466 - protein, 120 aa, Pseudomonas aeruginosa
SPARRRPGGRPAIRRWRRRRPRRGRSTRRPPRRASRSANRPDRHRRGGCRRRRRASAAGGRRGAVGAASRTGISPPRYGGSRHARWPPAFPPGSRAMPCPPSVASPPGWHRAAAWSGRAG

SEQ ID NO: 17467 - protein, 489 aa, Pseudomonas aeruginosa
PAAPRGTPDASRRPRPRQRSAGRPDAPGSCRYALGRRLPARPAGRPVRRARRRGTPPAAPPRLPAPRGWPPARAMPGSCPPYGWTRPTGSARRPTPPAAGNATATSSAFRSCLDSVPASLPMRDTQGTVLPGHRNSPIAPSDQCLSTPGRPHDRHQWRPGARRLDFPDIRHADTRHPSDAPVRFAQARPAPQTRRPSGQARTHRHLGAVLDPGLPHHLDLQPVRQPRHLGPVGGRRLGGHRRPRQPADGGDDPGRRGAAAGAAVDPLRGHRRQPRPAQDHALGTQLRDDRGDVRHPAGLPRLPRPGAADHLHPLDLPRRLGDHPGLAGGGQRAGAGAHGQRRGAAQQRQLQRRPRRRPGPRRPVAERGGTGLGVPVQQLLLHGPDLGDLAVAARGAQAQPAAGRHPRRCHRGAALHPVLHRHPPGDDALLRLRPLRQRGLGPAAAAGAPQPGRRRGDLRLHARRPRPRRDSRQHPGLAPAPADRQQPAD

SEQ ID NO: 17468 - protein, 507 aa, Pseudomonas aeruginosa
RVPRRRPTTRRARRRGAENGARQSPGADSASGVIRHPTPARRITANGYPPSEAVGGARSLRRRLLALERRHAVGADHRRRPGLRPRGGLALGRGLGGGALPVLLFLLAAGGLARRLEFLRPLVGGLQFLDVASFEVLLEVAFDARHQVPVAMADQRDRQALGAGATGPADAVHVLVAAARHVEVDHQVQAFDVQAACGDVGGDEDLHRALLQAFDGQLAVLLVLLAMQDEDLVLVGDQPPGQAIGGDPGIGEDDGLGVGLVAQQPLQQLFLVRHVVGGDDLLADILVQLADLVQAQHLRLAQHLGDHLVQPGAAVGGGEQQGLALGRAGIGQGQHVVGEAHVEHAVGLVQHQHLDVLQRQVAGVALLEQAAGGADDDLRVLAQARALHLEVLAASDQAGLDEGELGEALDFLEGLLGQLAGRQEDQRARQGARLVLGQQAVQQRQQEGRGLAAAGLRRDPQVVPLQRLGNGRGLDRRRLAEGQAFQCLQQAFVEGKLAEQGRPRHCT

SEQ ID NO: 17469 - protein, 595 aa, Pseudomonas aeruginosa
SASAWPCSSSCSACGRCSTPIPRNSIRPPRAPPARASPRRSGGSARCSARWSPGWSCRSPARAGCSPSAPSVSASPPWWSGPSASRPAGAPWRSLPAEPARRRKTFVDTSGMRSGARWGTLGSFVRSRPPRRDLRSTAGPARPPARYKGSRLSMDSTSLLDQLSGYWSALDQHPILHAGLAFGLLLVGALILGRVARYIVLYAANLLARQPALHWLGDLIRNKVFQRLAQTTPSLLVQFGLPWIPEMPDKAAHFLGNLALAFTVLFLILALTALLNALLDIYARTEHARTRSIKGYVQLAKIAVFVFGAIIIVSIIIDRSPLLLLSGLGAMSAVLLLVYKDTLMSFVASVQLTSNDMLRVGDWIEMPQVGADGDVVDITLYTVKVQNFDKTIVSVPTWRLMSESFKNWRGMQQSGGRRIKRAIYVDSSQVRFLDEKEERRLSQVRLLTEYMARKQTELQEWNAANGGVAPLAANRRRLTNIGTFRAYALAYLQNHPDIHPHMTCMVRQLQPTAQGIPLEIYCFTRTTAWVDYERIQGDVFDYLLAVMPEFGLGAYQQPSGQDLRQGLQGMLEGRDAEARSFEALAAPSRSDEATV

SEQ ID NO: 17470 - protein, 212 aa, Pseudomonas aeruginosa
LPGGRAARRGDRQRHSAAARRRHPAVRRRPRAAPATAGTTWLQQRHRTDALPGDRRGRPAMTDNLLSISAACLFDDQGNLLLVRKRGTQAFMLPGGKREPGETPLAALQRELLEELRLPMGASTFEHLGSFQAPAANEANTRVDADIYVARLPHAVCAQAELEELAWLVPGQAQPDNLAPLLRDHVLPALARRAAENPETQAEHRTRPDHVR

SEQ ID NO: 17471 - protein, 144 aa, Pseudomonas aeruginosa
RPGRKSQEGSFRSPRRQSDEQRVTTNQRKPGPLFTHAKTCRNAFTLFDMPVCRLRGPSGRPLDAQPGFQPGHPHLQAVEEFHPVAQPGRQHPPVRQPLGGRGRRFRSHRPRLQHDRHPLPLGRHHAEERLRLQRPGQLCVPGRR

SEQ ID NO: 17472 - protein, 379 aa, Pseudomonas aeruginosa
LLGTERLAEEQYRHQEQQHRFDVAENPEQPHRQQPAGSHHRAEGQRADQPQHRQQQPQARRLAEGLALVAQPVQRGQRQRQQEEHLEDEPGQRVHAHPAPQHEVRGIAQRGDQGDPGERAGQPELVEHPGQRAGHGDSLQRRQALAVEHPPHQHHRQRQEEVAQRQFKGLPGQRRPDEDAPLQQHHRRGQREAGQQPGLGEQPAPGGAQGRPLAGGDDQQEYHRDRPDHPMRHHLQAVQRLQQVDVARQGNEQHRGGQRQQHALSGNPHARTSRRPSRLTHSEATITAPPRARRGRSACWFQISRLSSNPTGTCRLFITARVPASTSVAPLFHQNWPRAVASSPIHTSTPHCSSPAGRRCGSPNSSQAGNATSSAPTKK

SEQ ID NO: 17473 - protein, 66 aa, Pseudomonas aeruginosa
RMDQAPGWGADHNVFAAAKEGRAGPRPPSPPLYYLPCAVGQRYSSQCSMRWRNKPLCSAMCSHWST

SEQ ID NO: 17474 - protein, 156 aa, Pseudomonas aeruginosa
AAASVLFGASNFFWMFLWWKFTVLSEMLRMMAISPELLPSAVHCRISRSRWLRQTGLDISIGCSRSVSFWVSNSIMQRSRRRISSRSKLEIFCWSRATESTLSKLFGARIGKVAPTQRPQSRASFQSIRLWSNRLSLQTTISEERRPLRIAGSTAP

SEQ ID NO: 17475 - protein, 417 aa, Pseudomonas aeruginosa
AMRRIHLSDLMVMEGVLSKAAKNDRESYRGRRPRAKAAVADGCPSASVVADTDVRQADAGPLAENDARADMAGDFLVEHRQLAFRVGDHRRPAAVGLGADGDRQRHGRQQLDAELRRQLLAAALAEQVLGMAAVGADVHRHVLHHAEHRDVHLAEHLHALLRVEQRQVLRGSDDHRAGHRHLLRQGQLDVAGARRHVHHQVVEVVPGGLGDQLDQGTGDHRPAPDHRRAVVGEEGHRHHLHPVRLQGLEPLLLTDLRPGAFRQAEHDALAGSVDVRVEDAHPRTLAGQGQGQVGGGGGLADAALAGSHRDDVLHVAHHLDLRLCLVRLDHAVDPDLGASDAVERLQGHLQGLRQAVPEQPGGVPQFQAHPHAVALDLHLAQAAGADGVLVQIGVLVLAEGGFHRLASDSGHGGFPEG

SEQ ID NO: 17476 - protein, 148 aa, Pseudomonas aeruginosa
RTRNRRSPAPPRCSRNRCTTSSSCRTSRPCSSNGPAAAPFRSRWPTSSPNGWTAASSSGTSRVTRRTSASRFPTLPASTSTSGWTRRSATWPASRTSARGVPSWTSTRSGARTPAPSCTTSSARTSSTSTRCSGRPCSKAPATASRPR

SEQ ID NO: 17477 - protein, 154 aa, Pseudomonas aeruginosa
THGSLPPASCWRRSTDAPPNTPKASPAMPVSRARRANPAPPSPTNTASASAFPPRVSTRNSPPAATPATASASASATCSPSNNAAVSAITPNSPCASSRTAWRSWSRPLPRAARWKAGRPAPRTWPRRSPTPASNASACNASTRPCSNTRGART

SEQ ID NO: 17478 - protein, 237 aa, Pseudomonas aeruginosa
LGRLAGDPPGSPPGDRRDPQRQRARCDHRRTRQERLADQAVPAGGPAGTGALADRQHRRAHHHAALPGTQCLDPQPDQQSPGHPDRQLDLLPHHHLLRHLRRPRRRRWPPGLRRGRRHRGGQPGDPGSVQRGRRHRRQSDRPAVHCLRRPAQAAQQGPGDRHQVQQPARRPGRLPEPAVAARQAEPGTDAGRPADQHAVPRRLSGQPAVAGQGHVRGRAQVRPDAATDRRDHPRRAA

SEQ ID NO: 17479 - protein, 300 aa, Pseudomonas aeruginosa
PDPRRRRQGLSGGSQHQERQHLHRPRPGGGLHRDQVRAVHRPARPAGAPRSVAQGGRHPAGFRRIQHLRHRPLHPLRRQPRVATGPAQVAEDPRRISLHRSPRLRRQSAQLAAGQCPRAGLGIHLAALGRQPVAGLADVRRRCLRHLPRPWNEVPMKTVALILASLALLACTAESGVDFDKTLTHPNGLVVERPVGFDARRSAEGFRFDEGGKLRNPRQLEVQRRDAPPPTDLASRRLGDGEARYKVEEDDGGSAGSEYRLWAAKPAGARWIVVSASEQSEDGEPTFALAWALLERARLQ

SEQ ID NO: 17480 - protein, 254 aa, Pseudomonas aeruginosa
IRLPPGHYPGLRRRAGLFPGAGAVRRPARAHRHRRRAGAVPRRGHRHDHRRPDVAGVHGLQRVGPAMNGVFLAIGALLPICLAGGALLGYAAVRFRVQGDPVAEQVNALLPQTQCGQCGYPGCKPYAEAIAAGDKINKCPPGGEATIRALADLLDLEPEPLDAAEETPPRVAYIREAECIGCTKCIQACPVDAIVGAARLMHTVIADECTGCDLCLEPCPVDCIEMREIPDDVRHWKWPQPSPRLIASDRERAA

SEQ ID NO: 17481 - protein, 161 aa, Pseudomonas aeruginosa
APCTPSPAASACRPTRSAPPPCRSSRRRWRSATSCRSASTSARRRGLAWKSARPYSRARPSPSRTAPSAPRCMPRPRVPWWRSAHTPIRMPPVFPRRPSSSPATAWSAGPSCIPARTSAPKVRWRCSNASARPASAVSAAPASPPRPSSPRARRKRSIRWW

SEQ ID NO: 17482 - protein, 289 aa, Pseudomonas aeruginosa
RRPEQAGVMDSELERLRGELQAAERDLHGRRGRLQQAGAGAGADRQAPGRPAHPRAEDRAGLRPRRPEEARTPGERRRRRNHRRPHAPERRRARPDRTRHGVTMAPAPPHFAPRPRLQPYPGDHAPGARRLRPRPADADLAVRPGHPAQPGLGQPRRAGLRSRHAGLAQTSAGGVPQGRQRAGHRPVAGRRPAALRPVVADPGGDLLRPGIRQAPVRRPRTEPVQPGDAWLRRGAGLVSPGNDPLALAGQRPRPARQPPRIPRPRYPAGRLGPRHRPRRAEDRPQPDRR

SEQ ID NO: 17483 - protein, 359 aa, Pseudomonas aeruginosa
RRQRVGQPGVPPRRPVPALAPAVHLARAAGHARRPVRHEPAVLEWFRLRFPWLATVPSVQRGDHARRLLHRHRPGVRRHQQSRAAGLRPRRRRPHLRHPHLGRLSRWSGVRRAADEPGGADHRLLHPAAHLRPSQGRARLQGRRLMDAATRRSMLRNALLLGLFALVGVGLVALVQQFTEARIAEAQREARGRALLELLPPGSYDNHPLDSQVPTFAPKLLGLDAPRPAYVARLHGQASAVILQASAPDGYSGAIQLLVGVTAQGRLLGVRVVAHKETPGLGDRIELAKSPWVHGFDGKGLGDPADAGWAVKKDGGTFDQFAGATVTPRAVVRAVHKALRYFDANRERLLAPEEAAGHE

SEQ ID NO: 17484 - protein, 237 aa, Pseudomonas aeruginosa
TRFPRDRPQRPVAQQPGPGPVARPVPAAGHQQLDGQRPRPGPGHHARAGLLQCRGIVGARRGERGDPAAGVRHDHRRADHLHRTADAGLDLRAVPGPRHLHPADHHQLRDPRSRRGPPFAAKNGVLRASFDGLLMGLGFALVLLVLGGLRELLGQGTLLADMHLLFGPAAADWKIQPFPQYQGFLLAILPPGAFIMLGLLIALKNRIDESLAERAKVQAGDVPATQRQRVRVTGVIE

SEQ ID NO: 17485 - protein, 435 aa, Pseudomonas aeruginosa
PSVASSTTCWKNAACSASCRTTTSTCEQRRPHRKQAPQLAGLRFSGGHEKPAEAGLNTGAIEPRPPCPAGTRRAAATATAIRRLPSRPSRITPSGSQFEQRRQRRPLRRHLAEATEAGGLGHLPRAVLAHEGAETLAAVGQRTGHAIQRALRVHHATEQVHVLVQFLRQVEFHHQVGPIVGGRLAQVLHHLLRVGRVVDDHQGRDEVELLARQRIGIADLEAHPVADPRGLGVRPRAFDGRRVEVTAIDLGFGERLGHHDRGQPAAAAEIEHAATRLELFLDAIQRRNPVLHEEVLVPGHGHALHAFPGFQREGFLGATAAAAEGLDDLRRHAHEGHAQLDDPAGEIRRVLVGEHRDELGRQPIAPALRIVGQVVAGDHAAQPFAQVAGGVAGLLRQLFQGHPLAMGERLEQPQAVADVEHRAAQGIAVVLHDPC

SEQ ID NO: 17486 - protein, 104 aa, Pseudomonas aeruginosa
GRRWCRSAATAPSAHSGKRPPPHTIPGACRGSPARARGSWRPTRAGPGPWPAGPAPRPARSLPDCACGAWCCYRSAAASSPPPARRSPSGSGCGSRRRSAPETR

SEQ ID NO: 17487 - protein, 185 aa, Pseudomonas aeruginosa
PGRGTRANPPAARPATAAARSFRAGAWPRRRRRPSCPRRRTVAPPGSACAPRPGVRGDAATRRSSRPPSARRWSATPGSSGSWRPSAHCGSRSPAPRAGPGGCPAPAPFHPAHRAFPGTARCPGYPAWSRRNARTRARWGCSSVAAHPAGASASARCWPRRRRSAAGRRPKAWRPSRSPARPRAE

SEQ ID NO: 17488 - protein, 139 aa, Pseudomonas aeruginosa
NTGVRNRPNSVTPSIPANTATPMAWRISAPAPLAMTNGTTPAMNASEVIRIGRRRRRQASTTASSARAPSASSVRANSTIRIAFFAARPTSTTSPIWTNTLLSPPISHTPAIALSRHIGTISRTASGNSQLLYCAARIR

SEQ ID NO: 17489 - protein, 138 aa, Pseudomonas aeruginosa
NSPCRPLRKAVGMNTAASTEVIAMIGPVTSSIARRAAWSGGSPFSMWRSTFSTTTMASSTTMPIDNTRPNNDRVFSEKPIRCMTAKVPTSETGTAISGISEARQLRRNSTTTTTTSRIASSRVVATVCNEARTNTVGS

SEQ ID NO: 17490 - protein, 796 aa, Pseudomonas aeruginosa
SRSLPERPRLSLSAIRNEEPRLMAGVLRSIAGGARRSGQRAALVRGDAHAQRVELDEARGIGLVVGAAVFLEGRDVGVEQRVVGLAAHHHDVALVQLQAHYTVHVDLRGVDHLLQHQALRAPPVAGVDQAGVLGHQLVFQVGHFAVQGDRLDGAVGLEHDGAAGGLVAATGLHADIAVLDDVEAADAVDPADAVQLGEHLGRGHVLAVDGDDVALAVGQLDVGRGVRRVFRGSGPLPHVFFVLGPGIFQHAAFVGDMQEVGVHRVRRLLLAVALDRDAVLLGIVHQLLAGQQVPLAPGRDHLDAGLQRVGAQLEADLVVALAGGAVGDGVGAGLVGDLDQALGDQRTSDGGAQQVLAFVDGVGAEHRVDEVADEFFAQVVDVDFLDAHRAGLGASRFDFLALAEVGGEGHHFAVIGILQPLQNYRGIQAAGIRQDYLLHIRHAITPRGSSRKATILRRAFGKLQRGDSFRRKSDRFYRLRDSNRGFSLKRGGRRLRCGRFCRGRRRLVLGLRRFRRRLDHRLARQVHGDPAVARTVGGAVVGHQRVALAVEAHVDLAFRHPVALQVLLHRQRAAARQVAVGQAVAAVVGVPVEFDPVDARIGLEQLQDDVQLGSRHVVQRRAAVGEADLGQLDLVEVHRQQLGDAGLVLAVDAGEARRQQAHLQAIALPGAMADQRAAPLEQAGEQPTGLLLAAVERHLAATDADLAKVDVALPRSPGRRGSQQGRRPAPQPLGLGLQAEGRLLAGTPDELADSEIRHRLRQAAFELVAFDLPLDALQPRLEGHRQRRQAAEQERQ

SEQ ID NO: 17491 - protein, 398 aa, Pseudomonas aeruginosa
KKARLHDGGLRESVQIRRMYRTARTKLDSECPAPPFPVAFPPTKSRPGSPMSDRLTLLRPDDWHIHLRDGAALANTVGDAARTFGRAIVMPNLVPPVRNAAEADAYRQRILAARPAASRFEPLMVLYLTDRTSAEEIRTAKASGFVHAAKLYPAGATTNSDSGVTRIDNIFEALEAMAEVGMPLLVHGEVTRAEVDVFDREKQFIDEHLRRVVERFPTLKVVFEHITTGDAAQFVREAPANVGATITAHHLLYNRNHMLVGGIRPHFYCLPILKRNTHQEALLDAAVSGNPKFFLGTDSAPHARHAKEAACGCAGCYSAYAAIELYAEAFEQRNALDKLEGFASLHGPDFYGLPRNTDRITLVREEWQAPASLPFGDFDVVPLRAGETLRWKLLEAGA

SEQ ID NO: 17492 - protein, 297 aa, Pseudomonas aeruginosa
ADNARTLSVLRDRSGNLPLFGARRVTWDGAAGPREPMKKPRRSGAFSNARSRLFLQLAGVLGQVLGHAFGRCGHALVALLPVGRADFAVLLMELQGIDQSQQLVHVAAQRQVVDDLRAHNAFLVDQERATEGHAAVGLDVIGLGDLVLGVGRQGVLDGADAALVHRGVAPGVVGEVGVDGNADHLDVARLEFRDAVVQGDQLGRADEGEVQRIEEHQAVLALDGLGQGEALDDLAIAQYRGNVEVRRFLTYEYAHSMSPLSGRLKDGTAACRLLVKPRWQGRRSPGNNHHTPRPSRR

SEQ ID NO: 17493 - protein, 182 aa, Pseudomonas aeruginosa
LRFDTLLRRGQTWRITPTTTAGFGMKGDKKVIQHLNKILGNELIAINQYFLHSRMWNDWGLKRLGAHEYHESIDEMKHADKLIERILFLEGLPNLQDLGKLLIGENTQEMLQCDLNLELKATKDLREAIVHCEQVHDYVSRDLLKDILESEEEHIDYLETQLGLIQKVGLENYLQSHMHEDD

SEQ ID NO: 17494 - protein, 810 aa, Pseudomonas aeruginosa
RDARLYSRVPSTRSGRFHLHRQAVERGVTRQQVEMTLVGQVVGADAGLGAGDRQLHAGPRVAPAVRQADHPGHHLAARRHLHLHAADPRAHPHPLPVDQAATLQVPRVHQQLVTRLALHQAMVVVHPGIVAAHVASSDQQQLVGRRQRLCGEALQVVDEQRRRGLDALVGGLQARRQVRPQRPKVDAVGMFAQSGQAQPVLGTVAVGASAQAEVDHLLRLQGRFQLQAVARGEGPRQADEDLPVVQRTLGTRQHGLVETGHVTHGEDVEGGVVVIVLQRRGGRQDEIGVAGRLVDVEVDAEHELQAVQGLFEPPPVGRGQHRVAGYRDQRAHLPLAFTEDFFRQCRHRQFAAIFRQPRDAAAPTAEVATRGTRHQVQGRRGAQRATDPVEVAGDQVDQLHQPLAERAEGLGGNAHPAIADRPFGGGEIPRQLANAFGRHATARAHGLGVEGRDRLAHPLQPVDRQRRGATEVLLEQGVEYPEQQRRILAGTNEQVPVGDSRGLAAPGIDHHQPAAACLQRLQALLHVRHGHDAAVGRQRVAAEHQHEVGVVDVGDRDQQTMAVHLLADQVMRQLVDGSRGEAVARFQQAEEVVAMGHQAVVVHARIALVDRHRIVAMALADLAEAAGHQREGLVPADRLPLAADPAQRLAQAVGVVLDVLQGHRLGTDMAAAEAVLRVALDRADPRHAALVALGLDGEPADGLAEMARTVVEGLAHGSPLHCRRPAVAARRVREDQTTGLVVESALCGAFRRRASSVSRLNRQASGWPMGAVEGRRAVCPAVNYPPGNSGAAKAGAKPCLFESTPVRQDQ

SEQ ID NO: 17495 - protein, 291 aa, Pseudomonas aeruginosa
ASTVRCCPPSKSMPAAPSAATAGSAACWRAPAARWPRATPSAPWRSPGTCASNPARPTRWSFRKAPATGSSPAARRASRAAMSPWPWKTALTCSASPRSRAWSAAATTSSTPPAASRGASTRYCRTTCSSAAPWTTRPTPSAWISDATARPSPASRRRPTRRRSLVPWKRSAPATRSTKACSCRKTPQPPNGPSSNCPGKSTRRSPACCSTTAAICATASANACARPATARPAGRLPKAGSRRSAPGARVPMAATAAKATGIRSAASCSASTARSPATRASAWWPATATAR

SEQ ID NO: 17496 - protein, 312 aa, Pseudomonas aeruginosa
KVVSDERTALSLVYGLQPRRADRSDPPRQRAEGPAQPRRALRAAEEPGPGHGLREGFDPYPPVLRSRDDPARRPGDLPLPARHPARPRRADRRQRPGHVADARRRDDPHLRPRHPDGIRRALEGAGDQRPVRRPAPLPVARRHADLPRAPRQHPGQDRGLDRRRQQHVQQLYRSGAEVGLPAARGLPRGLRAEGRVRRPCRRPPARRPRPARGGGRRAPGEHRRVGLDGPGRRSRRAHRPVPSLPGERRVARWGRRRCTIHALPAGPPRRGNQRRVAGRPALGSLGPGREPSARAEGPPRIADRTRPLRLSP

SEQ ID NO: 17497 - protein, 183 aa, Pseudomonas aeruginosa
KISPAATPRRKWCRTSTCTSMPETSAACWVLRDAARPPPCAPSPASNRCWPGRSSWAAKSSRVPASPWRRRNAGSAWCSRTTRCSPISAWPTMSASASASIHNANAWCASFWSWSSSTTSPRATPTNSPAASNNGWPWPARWRPNRCCCCSTNPSPTSTWNCAAASARRFARSSRHAAPARSW

SEQ ID NO: 17498 - protein, 260 aa, Pseudomonas aeruginosa
TMLMVISPAKTLDYETPPVTHRFTQPQYLDHAQELIQQLRQLTPLQISELMKLSDKLAGLNAARYASWHPEFTPENAKQALLAFKGDVYTGLNAEDFGEDDFAFAQDHLRMLSGLYGVLRPLDLMQPYRLEMGTRLANARGKDLYAFWGERISQWLNEALAAQGDDVLLNLASNEYFGAVKRKALQARVIDTEFKDLKNGQYKIISFYAKKARGMMARYVIRERLRDPAGLKDFNAHGYYFSAEQSGPDQLVFLRDAPQD

SEQ ID NO: 17499 - protein, 419 aa, Pseudomonas aeruginosa
SHWCGCLQHQDRPDQPGQVAHRRTGPGSVVAARPADRTAVGHHRLQEGRAGLRRIVHLRRHAEQEERRPGPGLHRDRLPRDRLRHPREVRTPHRGGAQHRTAGHRQQRGDPADRGLLGQEGRGRLRRRHQPRIPPREHRDQGLRLPADDRDRRTGQADRRPSRGNLPRAGRADHPQDRRGRRDDQVHLQRLARRQGHLRQRDRQHRQGGRRRRPRGDGRDLPGPQAQPVALLHASRLRLRRLLPAQGCTRPHLSRQPAGRRAPDARFVDAQQLQPGAEGLRSHHQPRHPQGRPARPVVQGRHRRFARKPAGGAGRDAHRQGLRVAHLRPQRRIRACPRGQQGIHRVEDPARLLTAGLRPRRSGGEFRCAGAGQWRRAVRRPGEQDPERQEAGRPGGLHAAHHHCPGRGHLLVAGRPLAP

SEQ ID NO: 17500 - protein, 420 aa, Pseudomonas aeruginosa
  UNSURE (410): Identity of amino acid at the above locations are unknown.
PSYDHRIDYGQRQGRGPRANRPRLDRTGPDTMNTAVNVNVVHESEAQRQFARVKLPARIRYIGANREGVDARLLDLSAGGFAFTASGAPIQPGDLYKGKLLFQVDSISFSLEVEFQVRSVDPASRRVGCEFQNLKPREVAALRYLITSYLAGEVIGVGDMLNTLQRENFTKARKQGGGNGGMGFFGRVRAVTLSTAIFVVGVGAFAFILNQMYNLYFVTHADSGVVSVPNQQITMPREGTVQSLLGPNAEVAKGAPIATFSANLLDMLKGNLTEEQLNPGNIEKLFGHQMKGTLTSPCDCRVVQQLVADGQYANKGQVIFTLAPRDSVASIEARFPYRNAAELAPGTRVNFQVAGDGVNRSGRIVNTAPVDGDLSSEIRVQIQPDQPLDAQYAGRPAEVSIGGLPGRTLXNKAVTLATAR

SEQ ID NO: 17501 - protein, 1520 aa, Pseudomonas aeruginosa
PVPDHEDAHPPSPAPGVPAPAAGLGHRPGRRLRRTARPAPGPGGPGARRPRHRPEQLPGPGRDGLRRRPGRPRRHAGRQRRQRPAGQGRKALPRGRADLAAGPRAPWQVAGGQARRQRRRAPRGRAPAQPGLRTGRGQCPGAAHRALPAVPAVLAGNRPAAAHRPVARARTAAGRPGADHPLPHPGHLRPAPGRDRAGLPALAAAHGCVLVRTGHGLPDAGQRGKAEGPARTAARRLQGRPGARRAGRLGGRGARRRRTRPARPADRPGAAGRDRAELPRGLGQPGQAALRLSRPGRPGKDARLPEERPGRRPATRRTAPRAPLLRRQVGAAGPAQGRAAPAQGRRQRTPGQLLPGADLPPRLPRQGLSAEGRRPPDPRRPRRPGQRRHGPGPALVAGPRHPAEPGQRLRLRPARRAAAGTAGQRPARADRSATAAGRTQPGAAIAQARTTEPRQQLAGHRQPATEPGLADQRRRARKPMNSSRSVNPRPSFAPRALSLAIALLLGAPAFAAGSGEAPKNFGLDVKITGESENDRDLGTAPGGTLNDIGIDLRPWAFGQWGDWSAYFHGPGGGRHRHHRDRHPAIGHRRRQQQPQRRSRAGQELPRRTRILGRLRRPHRLPRRAPALRPPAPAGRQRPVAGHQHRGAELELRDHPAQRPRRGRPAFQRIPHRPRRTGSGGQGPHPCVRRHLHPVGAAPPHRRAHPPRRRQRPPAPPRRGSRQPRQDLYRPAHLARHRGYRRCLQLSFEHAAELLGQRHLADRRPRQPDHHHGRRPAHRHRQAERRRQCLRRRPRPALEHRRAMEGRRRLRPRQRRWQGRRGAVPADRAGEQSLQLHRHPLARAPLRRSLPRRTEQPPGSHPVRLLATARGLRREPGLPQVLARRRRLRHRYQRHQRRPATGREGHRPGTRPGGDQVLQARPAAGLDEPVRRRALGADPLPRRPVQAGRRLRAGHRLDHAPRLRRLHLALLSPARKPDMPDISLSIPRRRLPRLRPLAAAVLGAVLLHGQAWAAQPVEKPQPVPAQAGNEPGLTQGLKETGNYTVTTAPAEPLHLDPPKLPDLSGYTAAAVEAKIVRKPGGRASVQRMVQQQPLKEFTGGSNRLAEWVKRQRQMPQAIFIEGGYVNLAQLAGKLPASALEQVEPGVFVARLPIVVSQGATLDIDKQVKELRLSQERGAFLVNDGMLFVRDSKVTGWSESKKEPAWFKTPNEFRPFLISWGGAEVYLSNSTFTSFGYNASKAYGISISQYSPGMDKQMKRPRPKGWVIDSTIVDSWYGFYCYEADDLVVKGNTYRDNIVYGIDPHDRSHRLIIADNTVHGTRKKHGIIVSREVNDSFIFNNRSYENKLSGIVLDRNSEGNLVAYNEVYRNHSDGITLYESGDNLLWGNQVLANRRHGIRVRNSVNIRLYENLAAGNQLIGVYGHIKDLTNTDRNIALDPFDTKVSLIVVGGKLAGNGSGPLSVDSPLSLELYRVAMLAPTKSSGISLPGVLGEKQDQILDLLVRQDKAVLIDPVESQAELQD

SEQ ID NO: 17502 - protein, 478 aa, Pseudomonas aeruginosa
GPRRMKTRTSRLFRLSALAAGLCLAQAALAADPGAAPSYQALPAGNLCPAAADDSRYNTKYLGFFTHLVQAQDDWLFRTTYDLRTDFGTSAEGWRELRALRDELKRKGIELVVVYQPTRGLVNREKLSPAEKAGFDYELAKKNYLATIARFRQAGIWTPDFSPLFDEKEEHAYYFKGDHHWTPHGARRSAKIVAETLKQVPGFEEIPKKQFESKRVGLLSKLGTFHKAAAQLCGNSYATQYVDRFETEPVGASDSGDLFGDGGNPQIALVGTSNSGPAYNFAGFLEEFSGADILNNAVSGGGFDSSLLAYMTSEEFHKNPPKILIWEFATHYDMAQKSFYRQAMPLVDNGCSGRKTVLSRKVKLRQGRNEVLLNSAALPIRSGSYVADVTYSDPSVHELKNTIWYMNGRREQLKIEQSKAVDTGGRYVFQLRNDSDWADQQFLSLEIEAPEDMPQGLEVQASICQAAPAKASQSVAGR

SEQ ID NO: 17503 - protein, 368 aa, Pseudomonas aeruginosa
TMKTSHLIRIALPGALAAALLASQVSQAADLVPPPGYYAAVGERKGSAGSCPAVPPPYTGSLVFTSKYEGSDSARATLNVKAEKTFRSQIKDITDMERGATKLVTQYMRSGRDGDLACALNWMSAWARAGALQSDDFNHTGKSMRKWALGSLSGAYMRLKFSSSRPLAAHAEQSREIEDWFARLGTQVVRDWSGLPLKKINNHSYWAAWSVMSTAVVTNRRDLFDWAVSEFKVAANQVDEQGFLPNELKRRQRALAYHNYALPPLAMIAAFAQVNGVDLRQENHGALQRLAERVMKGVDDEETFEEKTGEDQDMTDLKVDNKYAWLEPYCALYRCEPKMLEAKKDREPFNSFRLGGEVTRVFSREGGS

SEQ ID NO: 17504 - protein, 921 aa, Pseudomonas aeruginosa
  UNSURE (886): Identity of amino acid at the above locations are unknown.
RERRHGLFFKRVPVPVPAGLSRPVLPERRTLPEPAAADRQLRVLRLVAGGLPPAVRRGHRLQLLDRPAHRRRRRTHQGRATLADPRRGGRPLRARVLQVRQLRRRQPQRDHHLVRHAAVRADPHPAADRHLLLHLRVDQLHHRRLPRRYPGDPQPDRLRRLRRDLPAPDRRPGAALQGPGRPVQPPHPHRRQVRRRLHPLHAGLRQEGVHRRHPGRPRRPLLRPAEPDHRRRLARRPGLHRAALLRLLRLQRHGHRPRPDDGLPLHGELQPALHQPVDHRVLAALAHQPVDLAARLPLHQPGRQPRQHLPDLPQPVPDHAPRGPVARRQLHLHHLGRLARHVAGDRAGPRSERRAARAQPVEVGVHLPPGGDRLGDLPRREPAGRLAHVRSHVQLRHLAALRTEPRQPHRPAGRHPGPGLPGAGVLRPAPVLQPAIADQGAQGRGEQRRSGRRRPGQCPAARPARGRRRPGGDRLLAERRAGLPAELAQPVARPGHPPGAAPAVRRLGAEALRAELLAIPLLPVLSEAHAMTQSISRPLQYAYIAAFGGLLLGLAGWSLKSVPGFSAAADTPLLNGKLAHAFEAHYDKEFPIKRLGTNLWAALDYTLFHEGRPGVVIGKDGWLFTDEEFKPAPSGQQLEDNWALVRGVQRELNRRGVKLVLAVIPAKARLYPEHIGREQPAALHDSLYQDFLARARAAGIDSPDLLGSLRQAKDNGAVFLRTDTHWSPLGAETVAQRLGAEIRETHLLDVPAQNFVTRVGEERTHKGDLLSFLPLDPLFDELLPPPEQLQQRTTEAAPALPGGQQSGAGDDLFGDSQQPRLALVGTSYSANPRWNFEGALKQALSADLINYAKEGKGPLEPMLELLQDEGFRKDPPQLLVWEFPEXYLPMASDLSQFDADWVAQLKASGGRDERLAASRND

SEQ ID NO: 17505 - protein, 224 aa, Pseudomonas aeruginosa
RRSNGGIPMNPMTRRHTWTRLACALSLGVAAFAAQADEGALYGPQAPKGSAFVRAYNAGNSELDVSVGSTSLNDVAPLGSSDFKFLPPGSYTAQVGQQSLPVKLDPDSYYTLVSQPGGKPQLVAEPPFKNKQKALVRVQNLSGSKLTLKTADGKTDVVKDVGPQSHGDREINPVKVNLALFDGSKKVSDLKPVTLARGEVVCLYVTGSGGKLAPVWVKRPVKAD

SEQ ID NO: 17506 - protein, 525 aa, Pseudomonas aeruginosa
RDIPPRGGIPRQTHRFKEKQHDPSNPFRWQRLATLASFPQAVPQAVPRPHRRRHPVPADHQAPGLRRHAGAAAGVQQGAPLHRPGTAGGTEPGEPGDPPRTLRPQHGAGGGHRRDETGRRRPRRTAADPSRRPRDRGPARLPAGPGAGHQRRRKGRDGALRHSRQPPRDRLRLHPRERRCATAGRRQPGAELRREARRSPRPRVRRRRRLLLEQRHVPVPRQPLPGRTEEARRRHLRHLPAGPGAQPARRRPGEHRRRHLRMLPGQLHRLRGDGEDLTRLRGAAVRRLERCRQLVVDLGRARQGRQRQRHQGRRAGPRQPQLPGARQRQAGLGDRPGGHRGGGNQGRHDDRPQGPGAGRQARGQGPRRPGPQRDPEPLRGLPPVGLLRLGGHGRPLPGQAHHREARRAPLSADAPPPRRALDRGFRDRPGDLRRQDLPAHREPVDLHPDRLRAPPGQPRQDPAGDHRGAVRQLPRRGRHRAPGRRLRAHRRTGPASGRRQPLKRRPGPLAERSARGLFFSDNLRD

SEQ ID NO: 17507 - protein, 395 aa, Pseudomonas aeruginosa
PLRTALPVPRLHYMSLDFLPFSRPSIGEDEIAAVEQVLRSGWITTGPKNQELEQRFAERLGCRHAVALSSATGALHVTLLALGIGPGDEVITPSLTWVSTANVITLLGATPVFVDVDRDTLMCSAQAVEAAIGPRTRAIVPVHYAGSTLDLEGLRTVAGRHGIALVEDAAHAVGSEYRGRPVGSRGTAIFSFHAIKNLTCAEGAMFVSDDSALAERVRRLKFHGLGVDAYDRLSHGRKPQAEVIEPGFKYNLADLNAALALVQLKRLDALNARRQALAERYLERLAGLPLAPLGLPAHKQRHAWHLFILRIDAEACGLGRDAFMEALKARGIGSGIHFIASHLHHYYRQRQPRLSLPNSEWNSARLCSIPLFPDMRDDDIERVARAIEEILEKRR

SEQ ID NO: 17508 - protein, 1064 aa, Pseudomonas aeruginosa
PPRRCACSAWSAAAWPWPASSSPCSSSCCAWPSAPPGPATACSCCSCSAACSCSAWACSASTSGACTATCARGRASSSSAWSAQRPPRFPRPCSGPVSPLHPASLPRHDLESRRLRLPRHRLHRYRSPAQCRLRDRRRLHPCRRPTGKHLLRLGRTPLCRARHSAARARGREPSAVAGAHPPTAPGLPVLLLLPPPARRRAARLRRTRRLQPARFAAAALPRTSPGELGAGQRRNADRGDPASHDRARRHRADPRPAGRRHRPRGTRPEPARQAAQGRRCPAARQPAAARPRRAAGSRAGREPGQPLRPAHPGGRPARLAQAGTAVVRPGARGDPALPWRLLPGRRTEADRLERRGGRRQPRSRAGQRTVLRPAADRLRRGLAGAALRPARRARPVPGRHATGHRAGPGRGRAPAWRGVRPAAPHAGADPRGQRLHRQPPVRTPAARRSLRGPRHGHRLRRHRTAQGRPAFPLRRRRHRHPFGVARIPCEEMRRDPAAGGHRHAHRVHAQPAAGVRTGLRGKPADRPLLREIRQTRGVPFHLRGLRHVPGPGLRRRPLEPGGRADQQAALDLLGVQAVARPGDLGLRPAGPALHPVPSVQLDGPAPGPPGFGADRQLAGDHPAHPAPGRRHADPPGRRRRAEALLHRRRRRHRGPRADHRQPRRPLRRADRQHRQPGQRGEHPPARRGTAAPVRGPPAARAVPALRRLPRGGEPQLLRRRLPGRGPPQAEHRQRPAPARLAAHHRTARDHRQDPRLLPPRSAPRARGTGVIQAGLRIDVDTFRGTRDGVPRLLELLDEAGLKATFFFSVGPDNMGRHLWRLARPAFFWKMLRSRAASLYGWDILLAGTAWPGKPIGRELGPLMRRTQAAGHEVGLHAWDHHAWQTHAGVWSVQQLGEQIRRGSDCLADILGQPVRCSAAAGWRADGRVVEAKQPFGFRYNSDCRGRGAFRPRLADGSPGIPQVPVNLPTFDEVVGPGLPREAYNDFILERFAAGRDNVYTIHAEVEGLLLAPAFRELLRRAERRGIRFRPLGELLPDDPRSLPLAELVRGRLAGREGWLGVRQP

SEQ ID NO: 17509 - protein, 161 aa, Pseudomonas aeruginosa
AGGSPPPRRPVADRRRRGPAREERMNALRGWLAALGSMLLASAAQLGMRWGMSRLPLPEAWAGQTPERAALLAVALAVAAYAASLLCWLAALRHLPLGRAYSLLSASYALVYLLAASLPAFDETFSTSKTLGVGLVVLGVLTVNARRTAAAPAHHPSRKAP

SEQ ID NO: 17510 - protein, 190 aa, Pseudomonas aeruginosa
STAPSRRIAPATCCRQWKRSTGGRSSSCSNASGCSTTGTCAARTSPSGALAFKPNTDDMRDAPSRELMEALWRHGAQVRAYDPEAMQETQRLYGHDERLSLMGTPEATLGGADALVICTEWQQFKAPDFELLKERLKAPVIFDGRNLYDPERMARHGFHYYPMGRGQSCSLPINEASLAQEDGMRLLRQA

SEQ ID NO: 17511 - protein, 287 aa, Pseudomonas aeruginosa
RISASRRLPRGRGPQRQTRLGAALEHGVEQPGKQAAGDDRQQVRQGVVDRVGHQHHEQPAVRRLQLAAEIHRQGAGQRAAGDARRDHPQRVLGGERDGAFGDEAQPQHRGCLAGLPLALGELAPRQQGRQAHADRRHHARRHHRRHRRVAVRREQADGKGVGGLVDRSAEVDAHHPAEQQAEEDGIGGTHAVEEPGQCREHPGHRLADHVEHQQAGDQAGQQRDDQDRIQRLQARRQPQPVADGPRRIAGDEAGDYPADEPGAEGPGEQAAEQARSRPLAMEPVHQI

SEQ ID NO: 17512 - protein, 354 aa, Pseudomonas aeruginosa
  UNSURE (127),(137): Identity of amino acid at the above locations are unknown.
REKFWPHGNAVFGAMVFRGFWPKPAGWWNAWGRGQEWDAWGVMQVAFDAKEAQRQGQMAAAFPADMMHGMEREQAERLAGVAMPAGGMLYPEAGWVHPPAMCQAMAATPGITLLSGRAVRLRREGDXWCAYAGDECXARAPLAIFATAADIRDFPPAAELPLKRIRGQVTRLPATPQSRALRTVVCAEGYVAPPRGDEHTLGASFDFKSEDLAPTLAEHQGNLELLREISPDLLQRLGADDLPLERLEGRAAFRCTSPDYLPLVGPLAERAAFDEVYAVLARDARQVPERACPWLPGLYLNSGHGSRGLISAPLSGELLAAWICGEPLPLPRAVAEACHPNRFLLRDLVRGQRG

SEQ ID NO: 17513 - protein, 629 aa, Pseudomonas aeruginosa
AIRTATSHRCAAPSCGSWPPSTSGSANRDFENGPPTQGPEPGAIMKGHLHLPHPHNQRLQRIQAPTYERLQARLAEDHSEPTEKPLSIHCGWGRLLIGQTYPDAEELARDLLQEAPGERDIALYVAAPQQVLAHAPQQLFLDPSDTLRLWFTDYRPARRPPRGFRIRRVHTEEDWAAINRLYLARGMLPVQTERLSPRHQGGPIYWLAEDADTGVAVGTVMGLNHAKAFQDPEGGSSLWCLAVDPQCSRPGVCEALVRHLVEHFMSRELAYLDLSVLHNNHQAKALYRKLGFRELATFTIKRNNGINQSLFLGPGPEEDLNPYARIIVDEAHRRGIEVRIDDAEGGLFTLTQGGRQIRCRESLSDLTTAVSMTLCQDKVLTHRALQHAGLRQPQQRLAGSAEENAAFLAEHGSLVVKPVDGEQGQGVAVDLRTAEEVEEAIEAARHFDSRVLLESYHAGHDLRVLVIGYEVVAAAIRRPAAVIGDGRHSIRELIEAQSRRRQAATGGESRIPLDHETERTLRAAGYGYDDVLPSGEHLAVRRTANLHTGGILEDVTDALHPALREAAIQAARALEIPVVGLDFLVEAADQPDYVIIEANERAGLANHEPQPTAERFVDLLFPLSREVPS

SEQ ID NO: 17514 - protein, 135 aa, Pseudomonas aeruginosa
RRSRKAARSRRSTATRCSPSPRKSAPAPPAPCPGTSASSSASTSPRWPKARIPTSTASAWPCRTPAGPTTSICRGTCCGSASATTSPCAATCSATTTATRSRRSPPATTPAPRCWRSAATPPTATSARTSTASPR

SEQ ID NO: 17515 - protein, 952 aa, Pseudomonas aeruginosa
ADGRFPRLSRFLRSIMRADSCPWSSCMSRLCLVLLLLCCALPARAQPPAPLDGEDLRLSLGAYAEYYRDAGGKARLGDILALPAQAFAALRGDHANFGKNAAAWWFRVRLDNRNGTDLAGFLEINYPLLDDLKVYLLTADGRIEQQESGDLFAFSQRPVQVRNFWFPLRLPPGESTLLLRVQSTSTVYVPLYFSTYAASAASQETLMGFNGAFYGVLFGLFCYNLFLFVSLREATYAWYLLYNLSLGLFSASFDGLLFKLLPGHVALESAGIYLLMYLSCLVSIQFSRGYLYTRRDFPRLDRFLRGLLLACVVLLASEPLVGLRAWNVLASLTVMLVSLSLLLAGVHVWRQGLRYGLYYILAWGALLLSFLVTTAASLGCELFGLFGSSVVKIGMTVELVTLSIGLADRINALKEEGFRSRQAAEQARVENEAKSRFLAKMSHEIRTPLNGVLGMLQLLRDTPLDRGQAAYVETIASSGSALMSVINDILDYARIESGKLHLERIDFDLEELLSDTLALFSAQAVEKRLRLHLGLDRGVPRRLNGDPTRLRQVLMNLLSNALKFTAEGHVAVRVQRRFDEGGRERLLYSVSDSGIGISAQAQKTLFESFSQADSITTRRYGGSGLGLAISRELVQMMGGRIEVSSEPGKGTRFSVDLPLSPALDAGEADELAQLLQHRPALLASEDNLTLDCLQALLERWGLRVERCLQPRRLNAYLEDFSAPPLLVLAAPWPGPPSIWLDTLYAQLEQGQRILLLCPPQHCQDLPPHEGLRLLALAQPVAVNALREALLELYRERRRQPGRSRRGGPGRTPGRPMHPGRRGQPGEPAGGARLPRQARLRGAPGRQRTARAGRVPARSERHPVDPDGWRDAGNGRLRGDPPDPPGGACPGLATRTDRRPDRAHPRRTPPGRNRGWHGRLPRQAGGPGGTLCHPRTPARPAFATGMTVRDASR

SEQ ID NO: 17516 - protein, 612 aa, Pseudomonas aeruginosa
TFPTSGTLIQGTHLMLQSVSPKHDLPLKPEGQAAKPERTGTWAPFSIQAFRIIWICNLFANLGTWAQSVAAAWVVTDAHASPLMVAMIQVAAALPLVLLSILSGVIADNHDRRKIMLWGLSFEMTGAMFATLLAFLGYLDPVLLIISILWISLGGSVTIPAWQAAVNEQVPARMVSDAVLLNSVNYNVARAAGPALGGLLLSAVGPAWVFLFNSFCYMALIWAIWQWRREVPKRSLPPEGILEGVTAALRFTQYSTVTRLVMMRSFAFGLSASAVWALLPLLAHRNPDGDAAIYGYMLGALGLGAILGSTQVSRLRQRIGSSRLISLAGFTLALILLTLGLVDNLWVLFPVLILGGGCWIGALATYNSAVQILVPDWIKARALAFVPHPPCTVALALGFVPLGPSLRDHDRARCAAGRRLPAAGLGDPPVQLAPAGNGRRQYFPRAGEHARAAELRLQHAAGHGAGLHRIPDSRRAHPRLRSRRPAAAPPAPAQRRGALVAVPRREQPGGLAGTVPGGQLDPAPAHARPHDPGRQDRHRQRHRPACRRRSAADPPLRELRGQQLRYAAGEECHAAGQRRGGRDGGELRTGPGSPPGRTAPAALSAIQRRRGG

SEQ ID NO: 17517 - protein, 363 aa, Pseudomonas aeruginosa
VSLLSSHCSNCSLCATSSAVMTCWRTFSFSSPTWFRRSTCGSRSTSAITLFNPAPLWVAENSRVWRSAGQALARASTSSAKPMSSMRSASSSTSTSMSCNGRLPALRCSSRRPGVPMMISGFLRRRAPCTLKSSPPVIRQALMKVNWAKRSTSLRVCWASSRVGRRISARARERGLSSASRRCSSGSRKAAVLPLPVCAVTRRSCPSSALGMAAAWTGVGSLKDRLSSAFSRRSWRGNWLNKGDLGIARENGQVHSLTVAAPARRLYSRGATASAGVAIGSTPGRRQASTARAAIADSFDARRPEEPGHARRARIRRRTPRTAAAESVSPTGLRDHRAGVLLRLDGPGDDDLPARLDQSRVRA

SEQ ID NO: 17518 - protein, 409 aa, Pseudomonas aeruginosa
LGAGRAAGQLELLRHGDRRGPVGHARRPLRAQAGIPGQHRALGPGQLPVLHRRRPRQPDLLPGIAGDRHGDGVSHRPVAAVGDDPGQPPRQVHCADGRLLAAGLRRCRLPVLLPAAADRLAQHFPGAGAAGGVRPRHPLPDSRVAALAGAGRPARTGGPGIARHRSTGDAFAGPDRAAAAVAPAAAGTQPSGVLQRLRRTMVASLPAPHPDRMGPVVLRPARFLRPDLLAQRAAPAIRLRRHPVGVLHGADFAGRDTRLPLRGLAGGKLGPQAELRADAPRRRRDGLRLRPDRGVRRQPGTADRLRPGHAVLPVRHVGGALHLYPGTLSDLRARHRLGLRLGGRADRLAARPAGHRAGPAAHRPGRGVHPRRPLFRRRRPGGLGLRHRDPRAHPGGACRLSPRVGGKPL

SEQ ID NO: 17519 - protein, 236 aa, Pseudomonas aeruginosa
CRSSASAPTSSPAARTCARGCRACSKGVTPRPVRSRRWPHRAAATKPLSEARGAPSMKPHLIYYVATSLDGFIARPDGSVDWLDRFAEGGNDHGYNGFYQGIDGLLMGRGTYDIVRGFGDWPYPGKPCQVLTRNPRESAVEGVELRHGTPQEGLARLGEQGCRRVWLAGGGSLAGSCLAAGLLDEVIVSVIPQLLGAGIPLFAGGRERRLQLLEQHGYNSGIVQMRYQVIAEDDPQ

SEQ ID NO: 17520 - protein, 380 aa, Pseudomonas aeruginosa
ASERSPAVGTVAREPEVRLDGVVQYLVAGMQGLALGLGLLGHGDGDALADLADVAQRRQHGALALGNDRRAVGQGVGRGHQHAFGDPIGPRGDHPQADAGEDIGVVALGDGNPLVAHLHRLERATGGDQRLAVGPVEDFLRSRLDPRGRVGQRHHQRLLAMAVQLTDDLFGKQPALPGDADQHRRPGIADHFQQRQVVALLAAPGTEIGALLRQAVLEVEQVAHVVGEQAPAVDHEDAPTRLGLVQALQLHGGDDLFGDAATGGAGADEGHGLLAELLALGLASRQQGAHGHRGGALDVVVEAAQLVLVALQQRHGIGLGEVLELQQDVGPAALDRLDEQVDELLVVRPAHPLVAPSPMNIGSLSRSGLLVPTSSTTGRV

SEQ ID NO: 17521 - protein, 267 aa, Pseudomonas aeruginosa
AGLIPAAGGVQGQLADRDAHPADALVAEAEDPLAVGDHHDLHVVLGGAAQDVVDPLAVRVGDEQAAVGPVDLRELLAGLADRGGVDDRHHFFQVLLEQAEEQGLVVVLDRAQEDVAVQIGVAQVVLAVGALGLLLDGLDVVRQQALQVEIDAFLGTERAAFVQQRHLQQRWAGMGNVQGTLGCFGHIWTRFYGLHSGTGNTNIPPAQRLSKATANNRSLPDPQVSPLARRNRRVTSGTDHSTNGQKAGVKIGHNSRRFRRGIRWERR

SEQ ID NO: 17522 - protein, 216 aa, Pseudomonas aeruginosa
PRTSGSLDRYSRTRRHAEMRSPFLTCLSVGFAALLAALSTPSLASNQVTHTFKPSKNSTLSPSRVVSTRQSANRSVVAAAASEVTDRAFSMIGTPYRWGGTTPKKGFDCSGLVNYVFQDVDDVDLPRTARAIYNMDNNKVSRGKLQPGDLVFFRIRSRSVDHVGIYVGNDRFVHAPRRGKKVRVSDLNSSYWKRHYLAGKRILPTTLAQVESTRKR

SEQ ID NO: 17523 - protein, 704 aa, Pseudomonas aeruginosa
NERMEACRRRPAGGALRMLRRTRRKRLRQCRFPGRDGQTRHRPRLRTPRRHPPSRRAYRRATRRQPRRLQQRALRPVRRARHRTTRRYRPLRRTHRAHRPGRRGEAGRGRCRGRHAGKPADPRRGPGPGGRRHPPATRAPATRVPDPAAIPGAQGHERRRPAGPGQGNRRGGSPTGRQRPGRRPAAAAHRYQPADPELQQRGAAGQPPRPARHGRRATARRPCRWHHRRNEVLRLQPAVPRRAAAAGPVAARPVALVAAARQERGALSPGIRADREGPLFRPGPPDGPGNSQGGRPMTATSDLIESLISYSWDDWQVTRQEARRVIAAIRNDNVPDATIAALDKSGSLIKLFQRVGPPELARSLIASIAGRTTMQRYQARNALIRSLINNPLGTQTDNWIYFPTITFFDICADLADAAGRLGFAAAGATGVASQAIQGPFSGVGATGVNPTDLPSIAFGDQLKLLNKDPATVTKYSNPLGDLGAYLSQLSPQDKLNQAQTLVGQPISTLFPDAYPGNPPSRAKVMSAAARKYDLTPQLIGAIILAEQRDQTRDEDAKDYQAAVSIKSANTSIGLGQVVVSTAIKYELFTDLLGQPVRRGLSRKAVATLLASDEFNIFATARYIRYVANLASQQDLRKLPKTRGAFPSIDLRAYAGNPRNWPRDNVRALASEYTSRPWDDNLSPGWPMFVDDAYATFLDPGMRFP

SEQ ID NO: 17524 - protein, 209 aa, Pseudomonas aeruginosa
GISPDGPGPATNASRMTELALILVSAILVNNFVLVQFLGLCPFMGVSRKIETAIGLSLATTFVLTLAAMCSHILQRYVLRPLDLEYLRTIGFILVIAVVVQFTEMLVKKTSPLLYRVLGIFLPLITTNCIVLGVALLNANKAEYGFLQATTQGFGAGLGFSLVLVLFAALRERIAIADVPAPFRGAAIGMITAGLMSLAFMGFSGLVRP

SEQ ID NO: 17525 - protein, 230 aa, Pseudomonas aeruginosa
SPATGSERHERPARLPRRPLPAGQQGALHRPADPAGAAGAALHRAARPAHRRAGAALRGSRPGRTQGPDHRPPGRHRQRRAACPDLGYRGGDRRTPLSACLRSSRAGHRHRQRRPGALDRAASLPGLPRRKSAGVARTHPRGRHRRSRRRRLPHRGQARRAPGGKDPYAGGERRRMRALHQRRRPAHARARHAGAGRHRYPGADPVPRRGAGRHRGRQTGSHRRPRRRPR

SEQ ID NO: 17526 - protein, 167 aa, Pseudomonas aeruginosa
RQRTAETAEDRSEHGAGGPEEGRETVAQPRHPGTAWPGRGTARRRRGRRQGPGRCRSQPAARPTQRTACRARRRSRTEEGQGPGRHGPRPAQALGKGLRRSARRRAAGDPRRTARRGRALRSHPGPPRASRAEARGARRRRPSGAEAGEDRPGRQARGLEEGPSRPG

SEQ ID NO: 17527 - protein, 93 aa, Pseudomonas aeruginosa
WTASWNACAASCKPPSATCMAAEDACSKPAPELVRIDKRPVDPRTRELKTELAYARAALKKLERLANADAAAITAARTRLSAAERALTEHGTE

SEQ ID NO: 17528 - protein, 345 aa, Pseudomonas aeruginosa
PWPLPRPTLPHARGSNRTPAIMRLVLGACVPGLLTLTWLYGPGTLLNLAWASLVALACEAAMLALRKRPPGVFLKDGSALVTALLLAVALPPYAPWWLTLVATFFALVFGKHLYGGLGQNPFNPAMLGYVVALVSFPLEMTRWPSPDSALGLPDSLREFLGLATRPDAWAHATALDVLKTDRSLTVDELFAGNPAFGHLGSAGSEWVNLAFLLGGLFLLWRRLFTWHAPLGMLAGLFAMSLLFWNGSGSDSHGSPLFHLFSGATMLGAFFIVTDPVSGATSNRGRLVFGLGVGVLTYVIRTWGGYPDGVAFAVLLMNLAAPTIDYYTRPRTYGHRKAERGFKAGD

SEQ ID NO: 17529 - protein, 182 aa, Pseudomonas aeruginosa
RRTAVRSTSSPAPPSPRAPWSAPCTRRCATSTPTANACSPPKRLPDMSEQDFREIARNGLWRNNPGLVQLLGLCPLLGTSNSTVNALGLGLATMLVLACSNAAVSLVRGAVSEAIRLPAFVMIIAVLTTCIELLMQAWTYELYQVLGIFIPLITTNCVILGRAEAPPSRRRTACCAPASTDC

SEQ ID NO: 17530 - protein, 504 aa, Pseudomonas aeruginosa
YAVPPPLAAGDSVVAGDLVQHLVDDGPGHAEMGPRLEQPGQGFLRHDGAHPRIRLERLAHRNPLALAGLGDLEDDFVSAALAQLLGHLEDERLGTDRIAVCIRRPRHGLVVDREAVDGVGQQRQRHQRIVGNVRHRTPFQARAAVVPLVLEDHGVQREQDLGLGQPGQHHDLLAAFRIALVGHGAATDLLLRPAHLQLADLPAVQGADLVGDPRQRRGDHGQGADELGNPVAGHVPTRQRHVQRQPPREAFEQEHGLVAEGGHRAHAAEQLHHQDPLARLAQAFAVTQQLVDPAGHLQPEGGRQRRDRVGPGDHQRIAGPARQHREPVQEDVQRPLRFIQHIAHFQGLRGVLDILRGRAEMHVLARAGAAVPLQRTQQGHQRVPGAGHAVGDLLQVDGRKPGGLRDLQRGLGRNDADIGLRQRQRRLHVEPALQAAVATEDPSAHRTGVAAAMGFRVNDVTVFVLAGRLGRCAAEALRMRGARGTGKHFQRFSIHHRSSITYWD

SEQ ID NO: 17531 - protein, 78 aa, Pseudomonas aeruginosa
ISFATRPSVTDTWTSNPATSSTRSRALCQLVDGAPRPSLARVRRCSSKPWAPNDARVPTAPVRLPTRTRSRASSKRAR

SEQ ID NO: 17532 - protein, 243 aa, Pseudomonas aeruginosa
RINASCARASLAAIRARTRPRSSNAQRITGFRTLKDVPLSSKASRLPATRPIEPRTSTCGYSPAVSTPIRAVAAARLRSAAAMSARRASSPDGSPTPRVRSVSLSPEARATGGLKACGASARRTASALRVAARRRSRSGTAASTLCNNASARNRSNSWAEPALTRRSTISRLSRWLPAMSWTTASSASMPCSWNQVMATVAATLACTLRSRASREPACASAASTERRTRPNRSISQEASSAPR

SEQ ID NO: 17533 - protein, 84 aa, Pseudomonas aeruginosa
HFPPRNPVLEAPCPTVSPSCAPTTGTFTCVTVPRWPIPSATPPAPSAAPSSCRTWCRRCATPPKPTPTGSASSPPAPPPAASSR

SEQ ID NO: 17534 - protein, 204 aa, Pseudomonas aeruginosa
AAIRNSSSAPTRRRTPATPRKPPAVAPGATAPTPPSSCMPRPSNSAMRWTSWKASPACTARTSMACRATPTGSPWSARNGRRPPASPSATSTWCRCAPARHSAGNCWRPGHERRQLRRRIRRQPPQRPAPSDGAPLPRLPAGSGGRRDRRLQLGHRRAAGNRRDHCRHGRERLPVPGTHLLLPHRALRRRQHRAGRAGIHRHQA

SEQ ID NO: 17535 - protein, 93 aa, Pseudomonas aeruginosa
QSFSLLLVSFPTQLPSSQIAMYVCLCQGVTDNQIRDAIYEGCCSYREVREATGVGTQCGKCACLAKQVVRETLNDLQSAQPVPAFGTTAFVAA

SEQ ID NO: 17536 - protein, 462 aa, Pseudomonas aeruginosa
SRKSAWRITCSRTCTKTTDREPRRSAGGLPRRRFFLARQKASGAARPAPDQIGAQGQQQAKTDQHQQCPAQADLVGQQADQRRPHQQSAIPHGRDGGDPDHRIDARLVAGGADHDRHHHRQPQANHPETGDAQRRPGAEQRYQHAQRGQRTQAAQQWRIVDASAQAVAEQAPHHHRRGKRREAQRRHPLGSIQNAVQEQRAPVSHAALGNERAENQQAQAEQGPRRQGEAAALARARLARVRRKQRAYEEWQAQQAECGENEEMPERRQSGQGRGAQRTDQAAEAVHAMQHGHAGLAEQALDIHRLDVHRHVHPGEAHAQHVEGQGQLPPALAQAEQRKHQQHDQATADHYAAAADALDQETAQRERRERADPDAEQGLAERALVQLGLLLERRDASHQVADDQPGHGEEIDASQATLARIDFRHGGSRFPCWLLRTKKKPRTRRGSSSDARIRRWLWPPRP

SEQ ID NO: 17537 - protein, 178 aa, Pseudomonas aeruginosa
RPAPAPGRGRRRARGLAADAEGQGLGKRLAGRCQPAGTHRLCHRHGPRPGRRPAPVPGQPGQGRSRQPGPERRQHLSRADPGRWRAAERRRFAAVRRRSQCRRHPRRQRQDRRPAGALRRHGGRGQLHRHPGGRRGPALRIRLDLRGGAFGKRQRPDRRQRQGEHRGRQCHPGHGKQP

SEQ ID NO: 17538 - protein, 296 aa, Pseudomonas aeruginosa
PAQPVPGREPGRPPLRHPRRRRRHRGALRRGIAELPVPRRHPGLRGQRHPPGYRTQRHGPRQRRADAQPGGGRWCRGSARRRQPGLRKPAPVGKRRNRPTGLPAIVRGNLPGARRPVAQRQPLSARQRRRTPAPGQRRRGRRGGSRRLVQGARLLGQECRWQPRQRRLPAFGRRLPARRRQPGRQRHAPRPGGRLQQQLAEHGQQPAILRQHRQLPPRRLPRPAIAAMAPEPRRGARLAPRRGQARPAIRRRGRQAEGQARRTEQPVVRRGRLRVGLAQPGAGTLRRAGLRARRQR

SEQ ID NO: 17539 - protein, 107 aa, Pseudomonas aeruginosa
RIHAKCIALYCPSSAVLSLPALIATRCPHHRAARAPEIRTSGAHLLLLSHPPSPAEPLPLQIRDEWLQSGNPMNERPNRGRPGCLRTVAERVRPGGRRSCRTAPPGR

SEQ ID NO: 17540 - protein, 307 aa, Pseudomonas aeruginosa
SAMSVRHFLSFMDYSPEELIGLIRRGSELKDLRNRGVLYEPLKSRVLGMVFEKASTRTRLSFEAGMIQLGGQAIFLSPRDTQLGRGEPIGDSARVMSRMLDGVMIRTFAHATLTEFAAHSKVPVINGLSDDLHPCQLLADMQTFHEHRGSIQGKTVAWIGDGNNMCNSYIEAALKLDFQLRVACPEGYEPKAEFVALAGDRLRVVRDPREAVAGAHLVSTDVWASMGQEDEAAARIALFRPYQVNAALLDGAADDVLFMHCLPAHRGEEISEELLDDPRSVAWDQAENRLHAQKALLELLIEHAHYA

SEQ ID NO: 17541 - protein, 332 aa, Pseudomonas aeruginosa
AHEPRPAAEPERSRLRLRLAESGAGPRPAPQCRRHRLPAGSFGMRQDHHPARHRRLRTGAGRADRAGRRSHLASRLHPGAGETPDRHGVPGLRAVPPSQRGRQCRLRHPQASTTRTPGARASGAGQARPPRRAPPPRTLRRPATTGGPGPRAGARTAVAAARRTLLQPRRGTAPQPQPGGSRDPQGTRHQRDPGDPRPGRSLRRLRPHRRVQGRSPGTVGHSLQPLPRAADALRRQLRRPGLLHSRPVAQPRYGADRTRRDPRQSRLQPAFRQRGRRPAAPGRPGARAAGRAEGADRRQDLPRRRHPVPPAIAHRYPAGIDLPQPCRPPAGR

SEQ ID NO: 17542 - protein, 455 aa, Pseudomonas aeruginosa
GSGHTATSLTARQTIEVNAMRISIFGLGYVGAVCAGCLSARGHEVIGVDVSSTKIDLINQGKSPIVEPGLEALLQQGRQTGRLSGTTDFKKAVLDSDVSFICVGTPSKKNGDLDLGYIETVCREIGFAIREKSERHTVVVRSTVLPGTVNNVVIPLIEDCSGKKAGVDFGVGTNPEFLRESTAIKDYDFPPMTVIGELDKQTGDLLEEIYRELDAPIIRKTVEVAEMIKYTCNVWHAAKVTFANEIGNIAKAVGVDGREVMDVICQDHKLNLSRYYMRPGFAFGGSCLPKDVRALTYRASQLDVEHPMLGSLMRSNSNQVQKAFDLITSHDTRKVGLLGLSFKAGTDDLRESPLVELAEMLIGKGYELRIFDRNVEYARVHGANKEYIESKIPHVSSLLVSDLDEVVASSDVLVLGNGDELFVDLVNKTPSGKKLVDLVGFMPHTTTAQAEGICW

SEQ ID NO: 17543 - protein, 486 aa, Pseudomonas aeruginosa
PWPPLADRYPTMKMPILPPLPLASRHLLLASAIALAAGCAGLPDQRLAQEALERGDLATAQSNYQALAAMGYADAQVGLADMQVASGDSAQQAKAEKLYREAAQTSPRARARLGKWLAAKPGASDAEHREAERLLSQAFEQGEDSALVPLIVLYLQYPQSWPEIDPQQRIDQWRARGLPQADLAQIILYRTQGTYAQHLGEIEQVCQRWLRRMDVCWYELATVYQMQGNAEKQKVLLEQLRAAYKAGRVPGERVDSVAGVLADGELGQPDPQTAQALLEEIAPSYPAAWVSLAKLLYDYPDQGDLEKMLGYLKNAQDAAQPRAELLLGRLYYDGKWAPQDPRKAERHLLKAAASEPQANYYLGQIYRRGFLGKVYPQKAVDHLILAARAGQASADMALAQLWSQGRGIQPNRVNAYVFGQLAVQQQVPQASDLLGQIEAQLPPAERSQAQQLLKREQQSRGNNWQGTVSLLQSQDSPINEEEPESL

SEQ ID NO: 17544 - protein, 444 aa, Pseudomonas aeruginosa
RSPANRKTIATSAPLPAAPSTTSVSTCGPGPSASGATGAPTFMGQAVAATDTIETDTLQSDTDDGNNSRNDGREPDKSYLAAREFWVDYAGLTAYPGEHLRFGRQRLREDSGQWQDTNIEALNWSFETTLLNAHAGVAQRFSEYRTDLDELAPEDKDRTHVFGDISTQWAPHHRIGVRIHHADDSGHLRRPGEEVDNLDKTYTGQLTWLGIEATGDAYNYRSSMPLNYWASATWLTGDRDNLTTTTVDDRRIATGKQSGDVNAFGVDLGLRWNIDEQWKAGVGYARGSGGGKDGEEQFQQTGLESNRSNFTGTRSRVHRFGEAFRGELSNLQAATLFGSWQLREDYDASLVYHKFWRVDDDSDIGTSGINAALQPGEKDIGQELDLVVTKYFKQGLLPASMSQYVDEPSALIRFRGGLFKPGDAYGPGTDSTMHRAFVDFIWRF

SEQ ID NO: 17545 - protein, 527 aa, Pseudomonas aeruginosa
RSRERDGMVFSSNVFLFLFLPVFLGLYYLSGERYRNLLLLIASYVFYAWWRVDFLLLFAGVTVFNYWIGLRIGAAGVRTRAAQRWLILGVVVDLCVLGYFKYANFGVDSLNEIITSFGMQPFVLTHILLPIGISFYTFESISYIIDVYRGDTPATHNLIDFAAFVAIFPHLIAGPVLRFKDLVDQFNHRTHTVDKFAEGCTRFMQGFVKKVFIADTLAALADHCFALQNPTTGDAWLGALAYTAQLYFDFSGYSDMAIGLGLMMGFRFMENFNQPYISQSITEFWRRWHISLSTWLRDYLYISLGGNRGSTFQTYRNLFLTMLLGGLWHGANFTYIIWGAWHGMWLAIERALGVNAAPRVLNPLKWAFTFLLVVIGWVIFRAENLQVAWRMYEAMFSFGTWQLSELNRASLTGLQVGTLVLAYLVLAFFGLRQFYNQPLQTKAPKAAANSDEVAADGPASAQPRAPREAAGDPAAIAYSPSGALVYQPSWLSQLPVLATRLALLLLFAASVLKLSAQSYSPFLYFQF

SEQ ID NO: 17546 - protein, 176 aa, Pseudomonas aeruginosa
SRPRPACIPSTSAASSRPRCTTASTRTSWPAPAPPASTVPTCSAACARPRTTARCSCAPTPTGRRSARKPWPSASARRSARRTCWMCRRRTSSPASAKNARTRATCSASCRSTRCSTNCCRLRSSCSNAPPKPRRHCRAASSPARATTSSAIASNRAWRWSAPATAPTPGGTSRAR

SEQ ID NO: 17547 - protein, 550 aa, Pseudomonas aeruginosa
RRIETDREGLAPPGIPHNKTGPTPAHQPSALPQKERTGEVTRGSVEPGNEISRRAAGSLDRRIASRRNNMIPVILSGGSGSRLWPLSRKQYPKQFLALTGDDTLFQQTIKRLAFDGMQAPLLVCNKEHRFIVQEQLEAQNLASQAILLEPFGRNTAPAVAIAAMKLVAEGRDELLLILPADHVIEDQRAFQQALALATNAAEKGEMVLFGIPASRPETGYGYIRASADAQLPEGVSRVQSFVEKPDEARAREFVAAGGYYWNSGMFLFRASRYLEELKKHDADIYDTCLLALERSQHDGDLVNIDAATFECCPDNSIDYAVMEKTSRACVVPLSAGWNDVGSWSSIWDVHAKDANGNVTKGDVLVHDSHNCLVHGNGKLVSVIGLEDIVVVETKDAMMIAHKDRVQDVKHVVKDLDAQGRSETQNHCEVYRPWGSYDSVDMGGRFQVKHITVKPGARLSLQMHHHRAEHWIVVSGTAQVTCDDKTFLLTENQSTYIPIASVHRLANPGKIPLEIIEVQSGSYLGEDDIERLEDVYGRTAEPALQVVAGSR

SEQ ID NO: 17548 - protein, 1037 aa, Pseudomonas aeruginosa
ACPTASGTRPACAPSRCSPTCATTTSSASPAPSRRSWRNVDEALSDRPGLGGDPGLQRGSQPARTAAPHRGRLPGAGPRLRDRAGRRRQPRPLRGTLAGRRRTRRQRRGGGDPQPQLRPARGDPRRLRTVPWRPGDHPRCRPAEPAGGNPAPGGARRAGLRRGRQHPRRAPGLGLAALAFAPGESGGAALHRGRHARLRLHAARLPAQHRRSDAGLPRTQYLHPDPGQRLRPAYLRDPRRPRRARPRRIEIQRDAPAQPDVRPGHLHDHHAAAPAQPGRRRHGPGRLPLRPVPPRAAPGLRRRLGRQRPVRAVHVQRRAVARHGPARRVPRAHVQRRARAAALLHRARGPRNALRASLGPAAGRFHLFIQRAFHAMTSKAVVFAYHDIGCTGIEALLNAGYEIAAVFTHADDPRENTFYASVARLCAERGIPLHAPEDVNHPLWLERIRQLRPDFLFSFYYRRLLGAELLACAARGAYNLHGSLLPRYRGRAPANWVLVNGETQTGVTLHRMIERADTGPILAQQAVAIDPEEPALSLHGKLRKAAGALLRDSLPLLALGVLPEVEQDESQASHFGRRTPADGLLDWHRPARQLYDLVRAVTQPYPGAFCQVGEQKLIVWSAEVVAGNHGREPGSVLSCDPLRIACGEDSLVLRFGQRGERGLYLAGTQLATELGLVEGARLRGAASGPQRRTRVLILGVNGFIGNHLSERLLRDGRYEVHGMDIGSDAIERLKADPHFHFVEGDIGIHSEWLEYHVKKCDVILPLVAIATPIEYTRNPLRVFELDFEENLRIVRYCVKYGKRVVFPSTSEVYGMCQDPDFDEDRSNLVVGPINKQRWIYSVSKQLLDRVIWAYGQQGLRFTLFRPFNWMGPRLDRLDSARIGSSRAITQLILHLVEGTPIRLVDGGAQKRCFTDVDDGIEALARIIDNRDGRCDGQIVNIGNPDNEASIRQLGEELLRQFEAHPLRAQFPPFAGFREVESRSFYGDGYQDVAHRKPSIDNARRLLDWQPTIELRETIGKTLDFFLHEALREREAQA

SEQ ID NO: 17549 - protein, 563 aa, Pseudomonas aeruginosa
TCRPSTRWSVPACRARPTTTSSWNASPLAATTSTPSTPRSRGCSSPRRSANCCGAPNGAASASARWANCCRTIRAACRWPNWCAVAWPAARAGWECASHEPPPDLFAAADRLRPVLPGSIEQPWPVDSRRDPLRADQPGDAAGRRLGVAALPRPALLREAGRRLLDDRPRPGGLRRKPVRRAHRLGRRHRPQRPARIPAGPPPVARPTHQPGVRAALRQLRLDRRAVRLGQPRPAIHLLGQPEPGGAVACPRRGEPPRAPARLDPARPRLRHGLPDQGLPRLAAAGAGRPALHALAAALARAAWLRCAGGAGGAARLPALGARRACAGSGLLAVLLLARTHPPLRRRRRPALSPVVVLPAVAGGLLPALERPAAERAAPGLARAAPGAGGLPGAMAAVAAGVLQPEPGQAADLHHALPAAAGTAHGPRPGAAAAPGEQRRAARQRAAQPGPGAPRAGGPGLPATAQAGVPGRTLRAVPGPAGDRRLGRRRPRPVALPATRLGRAAAGELGADRAAAGSDAQPCGAEQDPRPVRRRTHRRTDRRPPSAEQRPRRRLGPRLAPAS

SEQ ID NO: 17550 - protein, 198 aa, Pseudomonas aeruginosa
RRDALRHARRAEVRPLLPRAQPAQRALGRHPPVALAGTPGRLGCRAAADQQRQRPLPAGAVAGRRRTLPERQPGPGDPAAGAPMSAALLLATLLMTGLGQVAQKLTVEHWRLVAADGWTARLRSPWPWLALLALGLGLLCWLLLLQRVEVGSAYPMLALNFVLVTLAARFVFDEPVDRRHLAGLLLIVAGVALLGRSA

SEQ ID NO: 17551 - protein, 360 aa, Pseudomonas aeruginosa
PSTPAAPLPRPRIIRRGKHHEDQRIRQWLCRTGAGRRPRRSGPRCTVHGHRPEQGRTPRAGPRQHLRTRARRLAARRPGQRPPAFQQRCAPGRGTRPGAVHRGRHPAWRGRRGRSRRGLRGGRCHRRASPQARHRGGEIDRPGRHRRPPARAHRAAPGSRRTRAGIRDRLQPGIPQGRLRRRRLPAPGPHRGRLRQRRGAPGDARTLRAVQPQPRPHAVHGPAQRRTDQVRGERHAGDQDQLHQPDRRTGRTPRCRHRGGAPGHRRRPADRLPLHLPRLRLRRLLLPQGHARADPQRRAGALLQRPVAGSGSDQPAAEAQVVRTHPGVLRRGPARQELRPLGPWPSSRTPTTCATRPAAN

SEQ ID NO: 17552 - protein, 87 aa, Pseudomonas aeruginosa
GACNLQPKYIDRAPVSAPPAMLAGITRNGSLAANGMAPSEMKHSPSTEAALPACRSLSANLRRASRVARPMPIGGTMPAAITAAIGA

SEQ ID NO: 17553 - protein, 252 aa, Pseudomonas aeruginosa
STMDVLLFESLGIGAVLGLLLGLTGAGGSLVALPLLLSLHLPLRDAIGVSLGAVALSALIGAIPRARQGQVAWRPVLVLALAGLPSNAVGQWLGRFVPEGVLIVAFCLLVLWSAWRMWRGAGMKREASDQARSLPLLGIGLAVGLLSGLMGVGGGFLVVPGLLWFTPLSMMAATATSMAVIALVSGGGFLIYLTGAHPPLPLLGGLAAGGAVGVLGGNLLAQRLGGPTLQRLFALMLVAVSFSLAAQKLYGG

SEQ ID NO: 17554 - protein, 157 aa, Pseudomonas aeruginosa
HDHAGRRPGQAGRQHDHGLGPGSPRAVPRLPPGRAVGAHSRPLQARRRRQAGAQGCRAQGDSQRSHRPAQGLLPGARPQALAGPHPRMGTRTAARPEPGPRPVPAGDIRSPAERSERRPHTAARLQAVAAGRPQPLAQRTGTLKMGPQRRGPNQERS

SEQ ID NO: 17555 - protein, 120 aa, Pseudomonas aeruginosa
SGRPTRTPRNWPATCCRKPPANATSRSTWRRRSRSWPTPRSSSSSIPRIPCACGSPTTARRAVRHAVSASAGCIPRRTGRRSTACTWRAACFRCRPSASARATKAGRSTGWPRTPTLASR

SEQ ID NO: 17556 - protein, 139 aa, Pseudomonas aeruginosa
SSKPTSAPAWPTTSRSRPPNASSIFSSPSAARCLHDPSATTGPQLPATGAAGDARHPQPHRLHRYHRALCRRAARRTWRALRDDSPGNHPGDPPGPPEYPGPCGFRAPRHDRRAGPRDQAQRPPRPGPGRLLVEPLRRG

SEQ ID NO: 17557 - protein, 162 aa, Pseudomonas aeruginosa
TPCAKPCWNCTGSGADSQGGAGEAAPDERPDAPCILVAEDNPVNQLVVRGFLAKRGYAVRLAGNGRLALDEYLRDPNGIQLILMDGEMPEMDGFEATRLIRREERAQGWPRVPIVALTAHILDEHRRAGIEAGMDAYLGKPVDRAELYATLERLLGQPSRQA

SEQ ID NO: 17558 - protein, 93 aa, Pseudomonas aeruginosa
QCAMRRASIRRHPGVPPMLIPHDLLEADTLNNLLEDFVTREGTDNGDETPLDVRVERARHALRRGEAVILFDPESQQCQLMLRSEVPAELLRD

SEQ ID NO: 17559 - protein, 234 aa, Pseudomonas aeruginosa
SSAAAAGSAPSPPTTRRCRSSSPTGSRRAPWRLFHTRPVPWPWRWGSFLWGHLSETMTVHGALLAAGCLLLASVILLYNSRLPEMDAASISRAPASMPGQPSFVFNTRRGMVLVSIEYRIPAERTRDFVRAAQPLRRLRLRNGAERWSLFRDVSNPEVWQELFLVDNWIQHLRMLDRMTLADKIVIDNVTALHAGDGPPQIRHCVSYEASSYDTPLVKSATPPANDEAGATAGS

SEQ ID NO: 17560 - protein, 506 aa, Pseudomonas aeruginosa
RLPRRRAGFIRAARRPAPASQSARRRVAARQARRGRRSQTRSTPAAQRNQVMPDAPASAAERLERLPLSPYHRLVFVIIALAFFFDSMDLAMMTFLLGSIKAEFGLDSAQAGLLASSSFFGMVIGAALSGMLADRFGRKPVFQASIVLWGLASYLCSTAGDLDSLTFYRVLLGIGMGMEFPIAQSLLSEMIPASRRGKYIALMDGFWPLGFVAAGCLSYFLLPLTGWRSIFLVLALPAVFVLAIRFLIPESPRWLEQAGRREQADRVLRDIEARVMRSLGLTELPPPLRQPQRERSRPGFFSAFAELWSPAYRRRTQTVWGLWFFALLGFYGLTSWLSALLQQSGFAVTQSVYYTVLISLAGIPGFLCAAWLVESWGRKPSCVLMLLGGGAMAYAYGQTAVFGGSLALLIGFGLAMQFFLFGMWAVLYTYTPELYPTSARATGSGFASAVGRIGSLLGPLVTGLVLPLTGQGGVFTLGALCFGVAALVVWAFGIETRGRTLEELAG

SEQ ID NO: 17561 - protein, 476 aa, Pseudomonas aeruginosa
ARASAENLCRHVGDAIRRPMGHSWFLCAFPAPASGSPFNRGAGPSPRPLQRKSPVHGLHIPSRPALRVLVGARPTPYPARRPGLRPAAGGRPDPRPGGPLHRPLRRQPARPPARAALARRPDPQQGVPAPGADHALAAGAIRPAMDPGDAGQGRALPRQPGTGLHRAVPDPRPHRAAECPAGHLRAYRARPHPLDQGLRATGEDRRVRVRRDHHRLDHHRPLAAPAAVRPRRDVGGPPAGLQGHPDVLRRQRAAHQQRHAASRRLDRDAAGRRRRRRGGHHPVHREGAELRQDHRLGADLAPDVGVVQELARHAAVRRTADQAGDLRRLQPGAFPRREGRAAPEPGAPAHRIHGPQADRVAGVECRQRRGRPAGRQPPPADQHRYVPRLRPRLPAEPSGHPSAHDLHGPPVAADRPGHPAGDILLHPHHRLGRLRAHPGRRVRLPAGGDAGVRPRRLPAAQRPGPAPGAAGHARRA

SEQ ID NO: 17562 - protein, 91 aa, Pseudomonas aeruginosa
RGNQKFASMASFSTSSLVCRALPSAWACLATATAMRLLTSRMSPSAGNTAPSPWVTIGEQLARALAAAISMPSVTRLARAAITPRPMPGKI

SEQ ID NO: 17563 - protein, 205 aa, Pseudomonas aeruginosa
ALLHWAMGIRLSPTCTGWNGLPVATSAWPSVQLRISCGVASTREVGLDSGITSGCLQWLCSSRMTSSENSPRCPETPISTVGRALRITSSNARSSPCWPPQAPRSARFCARRCWKSSRLLMSSVSRPQRSTMKMRRRAWASSRPSSCMAAMICSAMPQPAEPAPTKVTVCSLSFSPLALQAASRVPTATAAVPWMSSLKQHSSSL

SEQ ID NO: 17564 - protein, 187 aa, Pseudomonas aeruginosa
SAPPTAGAAPRRRKASIAAAWSTMCSRTSMTSTCRGPPAPSTTWTTTRSPAASCNRATWCSSGSAAAASTTSASTSATTASCTRRGAARRSASPTSTAATGNATTWPASASCRPPSPRSKAPASADSGACGSLRCPAAPVSSAGARCPSRSTAPPARSARRSIAARDGTPRRGTVPPPGTAAPVRRS

SEQ ID NO: 17565 - protein, 300 aa, Pseudomonas aeruginosa
RTAPRRPATAARPVRKSSCTHLAPAEPVDPQRSDDHRAAQGQARQVGVLVPDQQVEQQPDRHVQVVHHRQGTGVHLGGALVPPELAEGGGQQPHPYQYAPLQLAGRQALRIAEQQPGRQRHQQRANEEITEALALRQLGRVLAHQALVQHLAGGEGGVGQLQQQEALEELAGDPVVADDRRAQHRHQRGGQGPEVEAAVEQVVEQGHVDRRQHGEQQHLGHRQHVEAQVQADVGDAELQRADQHHPADETRFDAAPAGQREKHQASEKDPGKHGEVAVDLAGEVLADQVEGERPEDGDEQ

SEQ ID NO: 17566 - protein, 680 aa, Pseudomonas aeruginosa
AEPMSEPRKILVTSALPYANGSIHLGHMLEYIQTDMWVRFQKMRGNQAVYVCADDAHGSAIMLRAEREGITSEQLIDAVRAEHMGDFADFLVDFDNYHSTHSEENRELSSAIYLKLRDAGHIDTRPVTQYFDPEKQMFLADRFIKGTCPKCGTADQYGDNCEACGATYAPTELKDPKSAISGATPVLKESLHYFFKLPDFEAMLKQWTRSGALQESVANKLAEWLDSGLQQWDISRDAPYFGFEIPDAPGKYFYVWLDAPIGYMASFKNLCARRPELDFDAFWGKDSGAELYHFIGKDIVNFHALFWPAMLEGAGYRKPTALNVHGYLTVNGQKMSKSRGTFVKARTYLDHLAPEYLRYYYASKLGRGVEDLDLNLEDFVQKVNSDLVGKVVNIASRCAGFIHKGNAGVLVGADPAPELLAAFREAAPGIAEAYEARDFNRAMREIMALADRANAWIAEQAPWALAKQEGQQDKVQAVCGLGINLFRQLVIFLKPVLPKLAAAAEAFLNVAPLTWADHQTLLANHQLNPFQPLMTRIEPAKVEAMIEASKEDLAAASQPAGNGELVKEPIAAEIDFDAFAAVDLRIALIEKCEFVEGADKLLRLSLDIGDAKRNVFSGIKSAYPDPSALEGRLTLYVANLAPRKMKFGVSEGMVLAAGPGGEEIYLLSPDSGAKPGQRVK

SEQ ID NO: 17567 - protein, 277 aa, Pseudomonas aeruginosa
RRPRSHGGLDRMNAWKLAAGVLLAALYGCSAEHAESVSGNAGFQGETGKPGTALAYEHRVGIRLPAARIDAQLAASRDACNSERFGQCDVLAIEQRGGIGHYAELTVRIVPDGVEKLVAAAAEGGTLESRQTRAEDLAQAVADTRQQRERLQREYQTLQQYQGRKDMSVGDLLALAKEIAAVEAQLADNAQAGAQQQRRIATNLLTLSFSSEAQPDSRLGQLATAAGQLLDDLVDGTIAAMKFFAYSLPFLVVLLPLGLLLRGLWRWLRRPGKNEAR

SEQ ID NO: 17568 - protein, 162 aa, Pseudomonas aeruginosa
SARSSSPSSVTRPATKTPRTIRRQSASRAPTPPSASARWWSPPRSSTSCSPTCSASRCAAVCRARRSPPCWLPTNSTSSPPPVTSATSPTSRRNRTCASCRRPAAHFPPSISAPTPAIRATGRGTMSARWPRNTPRGPGTTTCRRAGRCSSTMPTPPSSTLE

SEQ ID NO: 17569 - protein, 153 aa, Pseudomonas aeruginosa
CRWRSWASAGWSGHERRVPGDRRAAADLPGRRCAARLCGGALPRPGRSGRRAGQRPVAADPVRPVWLPRLQALRRGDRRRRQDQQVPAGRRSDHPRPRRPARPGARAARRCRGNPAAGSLHPRGRMHRLHQVHPGLPGGRHRRRRTVDAHGDR

SEQ ID NO: 17570 - protein, 776 aa, Pseudomonas aeruginosa
RMHRLRPVPGALSGGLHRDARDTGRRAPLEMAAAVAATDRQRPGASGMSALHAFPGGLCLPANKERSTALPIQQAPLAQRYIVPLGQHIGAPARPCVEVGQAVLKGQTIALPDGTVSAALHAPTSGTVVAIGAHPYPHASGLPAPAIVIASDGLERWTELHPCPDFRAESPLALLERIRAAGIGGLGGAGFPTAAKLAARPAEKIHTLVVNGAECEPYISADDLLMRERATQVLGGIDILVQILCPEEVLVGIEDDKPEAIAALGAALGERPYRIVALPTRYPSGGERQLIQLLTGREVPADGLPADIGILCQNVGTLAAVHDAVVLGRPLISRITTLAGGALERPMNVEALLGTPVHELLAFAGLAEGRLERVLMGGPMMGFALPDLSVPLIKTCNCLLAGDATELPEPVPAMPCIRCGDCAQVCPVSLLPQQLHFFALGDEHEQLLAHNLFDCIECGACAYVCPSSIPLVQYYRASKAEIREQRQKLLKAEQSRERFEQRQARLRRDEERRAAERAQRAEKAALARAAQAEREEAAPATAVDPVQAAIERARARKQAGSGSERLKRLKIEASMARVALKKAEKQLLSHDTPEQHGLVAELRAAAEAADKALADAEASLPRDLPSAPPAALDDEAELKKAKAQAAMARAQLKRSEKAFGEAPGAEQRATLDELRAEVERCEATLARLERHAPKPAAPGDDGQAALKRAKIALVGKRADLKKARAGRGDGQRAGTPARRAASRRARPAWPPRTPAASRRRSWCGSTSARSTRAPAS

SEQ ID NO: 17571 - protein, 242 aa, Pseudomonas aeruginosa
TWRRRPSTTTPGRAPTAIARPSAASRQATDGRRNSPFDAAQRPPARALRPGRGGPGGPGAAIHRSAHRRSPARGARPRPAGTAAAGQLRQPSAGQPGANFRTEAARPGCAASGLCRPPARPGQRSHPPGQRAGWLQRRHPATGRGHRPGPAARRAGRRAQGNPRPRRPHRTGQESLGARFRRQGPGRSGGRRLGGEEGRRYVRPVRRRHRHPARRGPRRAQGAALLRRQPRTPARPRRGCRT

SEQ ID NO: 17572 - protein, 212 aa, Pseudomonas aeruginosa
MNAAKRAEIFRRLHEDNPEPRTELAYTTPFELLIAVILSAQATDVGVNKATARLYPVANTPEAIHALGVQGLSEYIKTIGLYNSKAKNVIETCRILIEKHGGQVPDNREDLEALPGVGRKTANVVLNTAFRQLAMAVDTHIFRVANRTGIAPGKNVLEVEKKLLKFVPREYLLDAHHWLILHGRYVCKARKPQCGSCRIEDLCEYKHKTSDD

SEQ ID NO: 17573 - protein, 64 aa, Pseudomonas aeruginosa
VGVNVMAKAKEELEIDDEAGVEEDDGEETSVEVAKTNLTKRRIIDNLLEERRLQRQLSDYDFDL

SEQ ID NO: 17574 - protein, 140 aa, Pseudomonas aeruginosa
SRSCSRIMASNASRTWALASRASTTTCSQPSGLRLWGMVLLPICCCVQPTSSSPISQRFRVRISSAIRARDAVTMARVLTNSVTRSRDTCQPASGTSSDSRRAKLSSRSMASSPKAAIVPTPPNSCTTRIRLRASPRRSR

SEQ ID NO: 17575 - protein, 172 aa, Pseudomonas aeruginosa
PGRPTTGSACAAWCCCPPVPAGCPRVPRRFRCAAGGRSRSPPGPASPTPGPATRQPPAPGPGRCANWSTARRDQAWPGFAAVARSPGRRTTPGFPRHRSDCRPGRVRAPRRSAPGDGRFHPPRRRPCSRRSWAAPAARGCVQPSACAGGAGRAPADGHGSSAGARAHGPRLP

SEQ ID NO: 17576 - protein, 1293 aa, Pseudomonas aeruginosa
PRRSPARCAAGPRANPPAPRRPPPSAAPGRTGRFPRKHPARRDRSRCRAAGRPVFPPRRAAGPGNRTPARRAAGTPRGSRAAAPSLRPGARRQGRCRGSPRAPAGSETPGLARRTRATTRSPRHCHRYPPASRRSWPVRTRSAAHSRAPPRHSRPAGSARSTKTAGMASWTASLQMRQAAAGASLQARRQCPYQYVEHRREEQAEQRHPEHPGEYRDAHGLAHFRSGAAGHDQRHHAGDERQRGHQDRPQAQAASLDHRLQRTGALGLQRAGELDDQDRVLRRQADQHHQPDLDEHVVVAAHQPHPGDRAEQAHRHDQQDRQRQQPAVVLRGEDQVGQQHAQREDEQRAVAGQLLLVGQVGPFEGHALGQHFAGQALHQRHRLSRTDAGKRAAADIRRRIAVVVDHPVGTGAGRHGDERGQRQHRPGGIAYLQAPDGFGLHAVRRIGLGSDLVGAPEAVEVVDVQRAEVDLQCLEHIGQANALALHLGAVDHHLELRGIDIEAGHQAPELAGLSGLHHQHLGLPGQGFQPGAAAILDLHLEAADGSQPRYRRRREDPEEAVGNAGEPGLQAPGDGQRAEIGGGARFERIEHEEHDRGVRHVDETVHRQARKGHDALHPRLVEADPGHLPDHRIGTLQRRSVRQLGDADQIVLVLHRHEARRHRLETDPGQAKQAPIHHQGQAAHPHHLAHRVAVGLGGISQRSAEDLEQSLEAPRHRTSGRPRTQQQARQGRAEGQRVERRQDGGDGDGQGELTIELALQATEKGRGDEHRRQHRGDRHDRPGDLVHRTPRGLERRLAVLDVALDVFHHHDGVIDDDADRQHQAEQRQGIQRETHQVHDGEGADQRDRHGHQRNQRSTPATQEQHHHHHDQQDRLQQGGGHGLQRSADEHRRVVGDARAQAGREVAFEPRHGGTHRFGGIQRVGSGALDDVQGHRRLAVQQAAQRIGIAAHLDPRDVAQARHLAVGAGADDDVAELLFVAQPPEGIHRDLEGRGGVRRLADGAGRHLDVLFAYRGDHFARRQPARGDQVGVEPQAHAVLAGAPHHHIADPRQAQQFVAHLEVGVVRDVQRVVALLRRQQVHHHEDVRRGLLGDHALPLHLVGQAREHPRDPVLHLDLGHVGIDVLVEGDGQDHSPVGGRLRGHVQHPLDPGDRLLQRCRHRLRDHVGVGAGIGGSHLHGRRRHRRVFAQRQLEERNDASDHHQHRKNDGEDRPIDEEAWECHCAAPTVFDRSTGVPSISARRGVICMSGRTRPLTTMRSPGCRPWRTTRRPSTIGPSSTGRYWVLLPSSTTST

SEQ ID NO: 17577 - protein, 161 aa, Pseudomonas aeruginosa
GVTGRTTTSATGTLGGALAAPGGADSPQPAIRAATPSVAVMRMKCLRFIVVPSWSEPAWPGWTKPLPWPVIDLDTLARSTPLFSDLMAKAQRAFGRSPGAGRLARSETQRAAREGGGGRPTGYRRPAQGRGETPRRKGSPAKGRSPGRGRSRSRSRLPATW

SEQ ID NO: 17578 - protein, 140 aa, Pseudomonas aeruginosa
NPPLTVKLEAMKMRILHTMIRVGNIDRSIDFYTRVLGMTLLRKNDYPDGQFTLAFVGYGNEADSAVIELTHNWGVDAYEIGTGYGHIAIEVDDAYQACDDIRNNGGQVTREAGPMKHGTTVIAFVTDPDGYKIELIQKSS

SEQ ID NO: 17579 - protein, 421 aa, Pseudomonas aeruginosa
EAVHRRAPAPGGRALPDPEGGLRAHHHRRRRPVRPGSPGQRRRDHYRPSPAVQPQPHAGRRYPSALLLPADPQAQHPPGSPAGRRGERQSEILPRHRLGAARPPRQGSRLRLRRVLQRLRRHRAVCRGLRTAQCAGQAGRLRQPARPGLLWPAAQHRPDHPGPRGMAGARQPPLRRLRRGAAARRRDTPLETAGGRGMSEDNFDDEFDGSLPSGPRHPMARRFRGYLPVVVDVETGGFNSATDALLEIAATTVGMDEKGFLFPEHTYFFRIEPFEGANIEPAALEFTGIKLDHPLRMAVQEEAALTEIFRGIRKALKANGCKRAILVGHNSSFDLGFLNAAVARTGIKRNPFHPFSSFDTATLAGLAYGQTVLAKACQAAGMEFDNREAHSARYDTEKTAELFCGIVNRWKEMGGWMDDDD

SEQ ID NO: 17580 - protein, 482 aa, Pseudomonas aeruginosa
HPASSRPNLANHTHYDGRIRHERRQESHPAPQQDPRQRADRDQPVLPPLAHVERLGPEAPRRPRVPRVDRRDEACRQAHRAHPVPRRSAQPAGPRQAADRREHPGNAAVRPEPGAEGDQGPARSHRALRAGARLRQPRPAEGHPGVGRRAHRLPGDPAGPDPESRPGELPAVAHARRRLIGNHDEAPAACPVGAFFLPARKPQALRGLRRTRSARRASNRQRPTSTSNAQRRPISWASRPISGGPISSPPYPTVETAATPITGSMPGWLPAALITIGTITDSPRPTTPKPAMLSAGQGLNSATSMPSVASEPRPRSNGASSMRPRRRSPNRRPTTIAAENAAKPSAATRSEASRTLCRNSALQSATPPSETNAQRISRPRPSKARGGKVKPPPLRAPALLGSGGSNARTKNGRLSRPSAVRMRKCQNGVSPARAAALNAPTRQPRLYMPCSMDMQGLPSRRSTSTAWMFIATSIPAKLTPST

SEQ ID NO: 17581 - protein, 198 aa, Pseudomonas aeruginosa
MQARRPWRGLTSDMEAPGFLAGFSGQKRNPAQGGALRRMRGSGVGFGRRVLDQGLQFALLEHLGEDVAATDQFAIDPQLREGRPVRVLRQVGADFRVLQDVDVGELLATGHQHLGRARGETALRGVRRTLHVQQDGVVGDLLFNGFDDVHGLPQQERFDTVTRQIMTGIVSESLARRSALLSRSVDPLRPLPPPPAGR

SEQ ID NO: 17582 - protein, 188 aa, Pseudomonas aeruginosa
PPRASSRCSPPPPPPRCRPASAPAPVARRPGRDPPGPAGASATGDAACPSPGDGSCASRNCCCARGVVRSATTGRTQAAAVRRSVAGRRRTAAARPGCAGRRSSGAAPGSAAAAQGRCRGDVRAEWPGSACARNGRRRRQRAGRGRSSAAAPGSVSAPGRCARRRPAPGRRRSPSRAAHPRDAAARPR

SEQ ID NO: 17583 - protein, 1014 aa, Pseudomonas aeruginosa
  UNSURE (187): Identity of amino acid at the above locations are unknown.
TLSLRVHPCPTRPIKRGDRMTDDHSFRPRPTSLSAALLLGAWIAQPATAAYVEAGRPGDPASWRSAEYQQDWGLERMRADQAYAAGIDGQGVKIGEMDSGFDPSHPDTPASRYQPVTASGTYVDGTPFSVSGAMNGNNDSHGTHVGGTLGASRDGVGMHGVAYAAQVYVANTNQNDSFLFGPTPDPXYFKAAYQTLADAGVRAINNSWGSQPKDVSYETLDGLHAAYAQHYGRSSWLDAAAGVSRQGVINVFSAGNSGYANASVRSALPYFQPDLEGHWLAVSGLDQQNGQRYNRCGIAKYWCITTPSRLINSTMPGGGYANKSGTSMAAPHATGALALVMQRYPYLNNEQALQVLLTTATQLDGTPTGAPTDTVGWGVPDLGRAMHGPGQLLGRFEANLPAGLRDEWSNPISDSALLQRQAEDAAEHAAWQRTLKDKGWENGLPAGASQQERTDYAIGMARDQAAAQRQYQGSLVKAGAGSLVLSGDSTYRGPTLVDGGLLSVDGSLLSAVEVNAGGTLGGNGRIGGLLARSGGTVAAGNSIGTLEVAGDLRFESGSTYAVELSESASDRIVASGKASIAGGNVTLAMENSPDLLSQSQVESLVGRRYDILDAAGGIEGRFDAVLPNYLFLGGTLDYAANAIRLDIGRNGTALASVAQTPNQAAVAGAVEALGAGNPVYESLLLSENAATAQRAFQQLSGEIYPALAGLLLNDSRYLRDSVGERLRQASDGEAGGEAPEGWFKALGSWGKSADGSHGSEGYRHSVGGFLLGVDSQVASDTRLGLVAGYSNSSLNMDSSLQSSASIDSYHLGAYLGRQLQQWRLSLGAAHAWHRAEVKRDLQYGAVAGKQKAKLDAQSSQLFAEAAYALGWRSLELEPFAGLAYVHVASDDFRERGSAAALEGGDDNLDAAFTTLGLRAKRHFELDAERRLALSGTLGWRHNLSDTTPQRHLAFASGSQPFSVESVALSRDAALLGVDASLAVNREVSVRLGYNGLLGSREKDHGVGLAVDWRF

SEQ ID NO: 17584 - protein, 182 aa, Pseudomonas aeruginosa
TSGRTAGAQAACAQSRNGSGLAEEDHAEQHRQGAEERQPGLPQDHQDRGRRRAQRMPAPEQARQVEDDAGQGQVTLAAAPEQAGQAQHQAAGRYREDRQQGGEQAEQMVLVAEVDPLAERQRHHRQRDGDPGQGEEQRQAAQPRLAQWPCRRRGGECFSRVHVRPPWSETRLLHEGIRARTA

SEQ ID NO: 17585 - protein, 369 aa, Pseudomonas aeruginosa
SNTPITPEPMSHDLLLNLKDLACGYASQKVVQDLDLHLNAGDIGCLLGPSGCGKTTTLRAIAGFEPVLAGQIELGGEVISRPGFTLAPEKRRIGMVFQDYALFPHLSVADNVGFGIRKHPQRERLVRELLELVKLDHLAARHPHELSGGQQQRVALARALAPEPLLLLLDEPFSNLDVELRRSLSQEVREILKARGTSAILVTHDQEEAFAVCDHIGVFKEGHLEQWDTPYNLYHEPLTPFVASFVGQGYFIRGQLLSPDTVQTELGVIRGNRAYSLPSGSAVDVLLRPDDLVHAPQGELKARIVGKTFLGAATLYRLQLPTGTQLESIFPSHADHQPGDDVGIRVAADHLVVFAARGSVAAHLAPVQA

SEQ ID NO: 17586 - protein, 512 aa, Pseudomonas aeruginosa
QQQAHAGVEAKVPSPMELMMETYKRGLAEATGWLVFLSLLMVLALAVPKTVFDADSKDFILLIGAVGIWRYSMGGVHFLRGMLFLHVVYPYYRRRVRQLGSAADPSHVFLMVTSFRIDALTTAMVYRSVIREAIDSGYPTTVVCSIVEMSDEVLVRSLWEKMNPPDRVSLDFVRIPGTGKRDGLAYGFRAISRHLPDDDAVVAVIDGDTVLDHGVVKKTVPWFKLFPNVGGLTTNEFCEVQGGYVMSEWHKLRFAQRHINMCSMALSKRVLTMTGRMSVFRARVVTNPEFITDVENDHLEHWRLGRFKFLTGDDKSSWFSLMRLGYDTFYVPDAAINTVEHPPEKSFIKASRKLMYRWYGNNLRQNSRALKLGARRLGWFTMLVLFDQRVSMWTSLLGLVVAILASLKYSIAFLLVYLLWIGLTRLVLTLLLSLSGHRIGPAYPLILYYNQIVGALVKIYVFFRLDRQSWTRQPTKLERGLASFQRWFNAWSSRAMTFSAASIFVAVLLTIV

SEQ ID NO: 17587 - protein, 422 aa, Pseudomonas aeruginosa
  UNSURE (406): Identity of amino acid at the above locations are unknown.
PPNRLRTTPGPRPARKSTQIGPNRTRHHEYSRQRQRRARIRSPAPVRPGQAAGAHPLHRRQPRRRRRTPAGSLRRRLRLHRERRADPARRPVQGQAAVPGRQHQLFPRSGVPGALGGPRQPPRRLRVPEPQAARGGGPALPDHLLPGRRGDRRRRHAQYPPARELHQGPQAGRRQRRDGLLRPGPGGDPEHRDLRRRGRRLRLHPQPDVQPVLRHPCRFRRGQRPQPADHHAPRGHRAEPSRAQRGSRQRRADRYLLGQPAGHAQGQPDRGAAQPGQHREALRPPDERDPDQPLRLPRGPATGSRRAIRQQGPGDLHPRAARQRGQHRGTLPLPQRRRAGAGHPGELPGRRRRRQPQRPHRQHRAGGRRPVLGNPRADPARPAARRPVRRPPGRGQHRRPARPHPXEQGRDPGHRSLTGTRP

SEQ ID NO: 17588 - protein, 299 aa, Pseudomonas aeruginosa
RCPSSLPCPWRPGTCCWPRPSPWPPAAPDCPTSAWPRRPWSAATSPPPRATTRPWPRWVTPTPRSASPTCRSPAATAPSRPRPKSSTARPRRPRRGPARALASGWRPSPAPATPSTARPSACSARPSNRARTVPWCRSSCSTCSTRSPGRKSTRSSASTSGARADCRRPTWRRSSSTAPRAPTPSTWARSSRSASAGCGAWMCAGTNWPRSTRCRATRKSRRSCSNSCAPPTRPAGCPASGSTRWPGCSPTANSASPTRRPPRRCWKRSRRATPRPGSAWPSCSTTIPTRATWKRCSAT

SEQ ID NO: 17589 - protein, 270 aa, Pseudomonas aeruginosa
SSPPAPARPAPTWPWPSSGRRAAASSRTGSTPTSSASSPCSSRYRRPATCSGRSKRNCRRPNAARRSNCSSANNRAAATTGRAPSACYRARTRRSTKKSQKAYEQLPFRQPAAVLRAARPVPGHRPAARRAGVRRRQRRGTEELRPGREDHRRIGKRSRPRHRSRRHPQRHRYRPAALGLRPVGRLERLLSWARRWPPPTPSRPTPCNRTPTTATTAATTVASRTRATSPHANSGSTTPASPPTPASTCASAASACGKTAASGRTPTSRR

SEQ ID NO: 17590 - protein, 416 aa, Pseudomonas aeruginosa
SASAAACSSRATPTGRAPTRPCTAPSSTSSGASEPREETGHARHFPFDPPPPAPAPAPAGRGSARRGAAARPGVGGAAGGETAAGPGAGRQRAGPDPGPEGNRQLHGDHRAGRTVAPGPAETARPLRLHRRRGGSQDRAQAGWPRQRAAHGPAAATEGVHRWQQPPRRMGQAPAPDAPGDLHRRRLREPRPARRQASRQRAGTGRAGGVRRPPADRGQPGRDPRHRQAGQGTAPVPGARRVPGQRRHAVRPRQQGHRLERIEEGAGLVQDAQRVPSVPDLLGRRRGVPEQQHLHQLRLQRLQGLRHLHLAVQPGHGQADEAPAPQGLGDRLDHRRQLVRLLLLRGRRPGGEGQHLPRQHRLRHRPARPFAPPDHRRQHRPRDQEEARHHRLAGSQRQLHLQQPQLREQAFRDRPRP

SEQ ID NO: 17591 - protein, 548 aa, Pseudomonas aeruginosa
QRGQPGGLQRGLSQPFRRHHPLRERRQPALGQPGPGQPPPRHPRAQQREHPPLREPRGGQPADRRVRPHQGPHQHRPQHRPRPIRHQGLADRGRRQARRQRLRPALGGFAAEPRTVPGGDARPDQILRHQPARRSRREAGPDPRPAGAPGQGGADRPRGKPGRTPGLRTQTHENPHFPTVPPERPGRRPLPGPGSPRRRPRRGAELPGAAGRQPVPGRRRRLALQHQVPGLLHPPGAGPGRLAVPHHLRPAYRLRHQRRRLARTPRTARRTQAQGHRAGGGLPADPRPGEPREAQPGGKGRLRLRAGEEELPGDHRPLPPGRHLDPGLLAAVRREGGARLLLQGRPPLDSPWRPAQREDRGRDAEAGARLRGDPEEAVRKQARRPAVQARHLPQGRRATLRQQLRHPVRRPLRDRAGGRQRQRRPVRRRRQPADRPGRHLQQRPGLQLRRLPGGVQRRRHPQQRGVRRRLRQFAAGVHDQRGIPQEPAEDPHLGIRHPLRHGAEELLPPGHAAGGQRLLRPEDRTQPQGQAAPGPQRGAAEQRRATDP

SEQ ID NO: 17592 - protein, 532 aa, Pseudomonas aeruginosa
RQLRRRRDLQRPFGTRVEEHHLVHERPPRAVEDRAVESRRYRRPLRLPAAQRQRLGRPAVPFPGNRSAGGHAPGPGGPGQHLPGGARQGQPVGGREVNDENVPPDPYRPARCPRRGIARQPGQPGRRPGTPARLLRGGRRAQGQRRQLPRGAAAVYRQPGLHQQVRRLRFGAGDPQRQGGEDLPLADQGHHRHGARRHQAGHPVHAQRPRRRPGLRTELDERLGPRRRPAERRLQPHRQVHAQMGAGQPLRRLHAPEVLQLAAARGPRRAEPGNRGLVRPARHPGSPRLERPAAEEDQQPFLLGGLVGDVHRGGDQPPRPLRLGGERVQGRRQPGRRAGLPAQRTQAPPARPRLPQLCAATAGDDRRVRPGQRRRPAPGEPRRPAAPGRAGDEGSRRRGNLRGEDRRGPGHDRPQGRQQVRLAGALLRPLPLRAEDARGEEGPRAVQQFPPRRRSDAGVQPRRGKLRAWREAGAQAGGHAPLYPARRPGATPRPMRDRRGRAQHLRQHHGEENGGSSRLSSSAPGRGKAGPT

SEQ ID NO: 17593 - protein, 305 aa, Pseudomonas aeruginosa
SSPRRATRHSSTSSSERGPRHDTEHFPPPAIRLYRRLRRAAAGARRMVAEERAGLLRRGRYATAQRQAGARLRSPLRQGIPDQAPGHQPLGRTRLHAVPRRPPRRGDRQGRLAVHRRRVQAGTERPATGRQLGTSTRRAAGAEPARRQAGARGDPGQGPPVSRAHRPRAAGRAARQPLPGLPGPRPRRRHRQSRPARQPAPGQGQRRGVPAHRHPLVAARRGNRGPAPRRGDPRDAPAGCAGAELRHPRRRRTHAQGRPAQLPAARPAVRRTAAASGAVAATHHRSRAGTAGRPAVRRGRRPLRR

SEQ ID NO: 17594 - protein, 305 aa, Pseudomonas aeruginosa
APGRQPQRLNEHSQGCLPTGPSAPLKKKQRRNTHEPDDPPPHLDPPGLRTFPRRRRIRRAGRRGRPVRAPGTQGLGLRPRLQRRQQRTRRVGRQHQPERRRAARFQRLQVPPPRQLHRPGRPAEPAGQARPGQLLHPGQPARRQAAAGGRAAVQEQAEGAGTGAEPQRLEADPEDRRRQDRRGQGRRPAKPRRPRDQPGEGEPGAVRRQQEGQRPEAGHPGPRRGGLPIRHRQRRQARAGLGQAPGEGGLRPTGRGSPLPAFHTTRPARHRRTNRQRSRRRSALERSPGAPWSPVTRYPAARRDP

SEQ ID NO: 17595 - protein, 334 aa, Pseudomonas aeruginosa
ITSSYRPPSTEASLHVTGLSAILPAKHRRGRNRRRGAGPAFRLDHHRAEEPGARTALRRTPRLPPRGGAILGHRRPARHPAGAGHRPRRRSDHAVADLGLHRQRHHPARRHPGVRRRRPRHPDVFGAGSGSRHRPAHPRHRAGALRRLHPGSRRPAHGRRAPRHRPGRGRRPRGRQRIPRAPGRLPRHGDLFLPRDQEPDLRRRRDVRQRRQCPRRTGPPPQVPRPRGRCLRPPEPWTQAAGGSYRARFQIQPGRPQRRPRAGPAQAPGRAQRAPPGPRRTLPGAPRRPAAGAARPARAQAAPRLAPVHPAHRRRGLRPGPRRLHGSPEGARHR

SEQ ID NO: 17596 - protein, 396 aa, Pseudomonas aeruginosa
RHPFHRQSPAPLLPPAPAAPEPAQQRVELGPPVLHPAVPRHARRRHRARRPRHRGDPGETSMKPYPIDLVSVVIPVYNEEASLPELLRRTEAACLELGRAFEIVLVDDGSRDRSAELLQAAAERDGSAVVAVILNRNYGQHAAILAGFEQSRGDLVITLDADLQNPPEEIPRLVERAAQGYDVVGSIRAERQDSAWRRWPSRLVNLAVQRSTGVAMHDYGCMLRAYRRSIVEAMLACRERSTFIPILANGFARHTCEIRVAHAERAHGESKYSAMRLLNLMFDLVTCMTTTPLRLLSLVGGGMALAGFLFALFLLVLRLAFGAAWAGNGLFVLFMFSGVQLLGMGLLGEYLGRMYSDVRARPRFFIERVVRATPSALPSALQRAGFTSSSSEPSTP

SEQ ID NO: 17597 - protein, 611 aa, Pseudomonas aeruginosa
SGPTASRACASPCSVRSTGWARAWTAWIRRGSAARGRSPSSSCTWSKARRSAWSTAARRSAASPTSTTASRPSRGSSTTATAAATGRSSTSATRTTRRASASSARNCCASSRPTRCARSSRPSPASARWRAAASTATATRTWPTASRASTTPGACSTGSPPSNCARPSARPSTSSSTKRSASARHRRDPGRPAHRRRHLPRHPRRGAAAARAARRSRAEGDLLLQRRPGQHGPPPLAPGAPGVLLEDAPLARRQPVWLGHPAGRHRLAGQADRPRTRPADAADPGRRPRGRPARLGPPCLADPRRRLERAAARRADPPRQRLPGGHPRPAGALFRRRRLARRRPGGRGQAALRLPLQQRLPRTRRVPPAPGRRQPWHPAGAGEPADLRRGGRSRPAARGLQRLHPGTLRRWPRQRLHHPRRGRGAAPRPGVPRTAAARRTARHPLPPVGRTAAGRSAQPAAGRTGARSPGRPRGLAGSAPAMSRRQTCSLLLIAFGLFYLVPLSNHGLWIPDETRYAQISQAMLLGGDWVSPHFLGLRYFEKPVAGYWMIALGQAVFGENLFGVRIASVVATALSVLLAYLLARRLWRDPRTSLACALLYASFGLIAGQSG

SEQ ID NO: 17598 - protein, 418 aa, Pseudomonas aeruginosa
ANLDPQFTFWVNLSLVALWHALDAGSRRARLLGWTLLGLACGMGFLTKGFLAWLLPVLVALPYMLWQRRWRELLGYGALAVLAALLVCLPWALAVHAREADYWRFFFWHEHIRRFAGEDAQHSRPWWFYLPLLAVSCLPWSGLLPSALRQAWHERRQAPVVFLALWLLLPLAFFSLSRGKLPTYIMPCLLPLALLMGHVLVQRLRLGNSVALRGNGLLNLGLALLALAALAYLQLRKPVYQEEPFELFLVLLVIGAWAAAGLAQWRYPLHAWAAPLLASWVLIALLPAAMPNHVVQNKTPDLFVAEHIDELTGARHLLSNDLGAASALAWRLRRSDVTLYDTRGELKYGLSYPEHSQRSVPLADIRQWLWQARQDGSVAVLLRINSASDRYQLALLPGDGERYRNGNLVLAILPQVRP

SEQ ID NO: 17599 - protein, 542 aa, Pseudomonas aeruginosa
NLQYQQDPGRRPGGARRVDRQRPPHRCRARASSVEESTMKISVFGSGYVGLVQAAVLAEVGHDVLCMDIDRNKVERLAQGLASIYEPGLDALLREGLDSGRLRFSSDARLAVEHGRVQFIAVGTPPGEDGAADLGAVFAVADAIAEHRRKPVIVVEKSTVPVGTGDRLRAHIERRLEADGRELEFEIVSNPEFLKEGSAVADCRRPDRIVVGCDNEEVRQVMRELYEPFNRNHDRMLFMGLRSAELTKYAANGMLATKISFINQIAELAEHLGADIEAVRQGIGADPRIGYHFIYPGCGYGGSCFPKDMRALIHSAEQAHCSSDLLQAVEAINRRQKLKLFERIRVFYDGDLRGKNFALWGPGLQAEHRRHARRAQPRTDGSALAPRRAGARLRSRSHAGNPAALWPRRTPEPDGHPRGDPGRRRCAGHLHRVAAIQGTGFRAAQGAPEGPGDLRRAQPLRPRAHGPPRLPLLPDGTRAVLLVADQRGQPRTGRWHAPVAPGLRPPQVGSTAGANNRLRLSAGSPEFRRITHAALFALPSAT

SEQ ID NO: 17600 - protein, 240 aa, Pseudomonas aeruginosa
SLNPILVIPLLASLVTGLLMLYVVGKPVAGMLAALTGFLDGMGTSNAILLGLLLGGMMCVDLGGPVNKAAYAFSVGLLSSHSYAPMAAVMAAGMVPPIGMGLATLLARRKFAESERQAGKAASVLGLCFISEGAIPFAAKDPLRVIPASIAGGALTGALSMYFGCKLQAPHGGLFVMLVPNAINHALAYLLAIVAGSLLTGLLYAVLKRGAEPGLALGTSSSREPAAGGYPLGGHAPYAT

SEQ ID NO: 17601 - protein, 165 aa, Pseudomonas aeruginosa
SAAARQPSRPGVPARATGGCLPRARCAGCARGRRGRTSARRACRRASRRYDAGARRGPRRRRGRCSADGGRRSVRRCVRRRTGRGSCSAPHGWASLPAAARSAPSSPAAARPRRVAGSATGRGRRRPRRRSPAGPGTARRVLPGTPACAVAGRPGPPARGAPGPG

SEQ ID NO: 17602 - protein, 162 aa, Pseudomonas aeruginosa
RTPAATAAIAPGRPPAPGAARARPGAARSAAGRSRAGRRPPATAGRTTTGESAGRLRRRSGGCVRARRRTASSPLPAHARRAPRAGRRAAPPAPPAHRSQAARASAAARACRAGRPAPAAARRGSPWSGSPCRRRGRAGSSRAGARGGSPRRGHATAPPGSG

SEQ ID NO: 17603 - protein, 380 aa, Pseudomonas aeruginosa
SARSGSRRESTGHGCSMEPGRTGRRRSAAANRSGGGSWLAHSQPALAAGQATAHQFGQRQAARIVRQQFAQRAEADAAPFGAPQQFAERRGEEQPLDLGVDGVDVVAASGEAFQDEVVVGLARQAGTDHLVEGRQVHRHLRDARAAVGQARAERAASAAVAVVAEAEGLLGLDHPAVGAPTGGGGTTHRLAEDVRQAIAAAADLLAELLHAPDAGVGLPGMVVPGVQADLVAGGLGPPHQRAEFAADRLARPGGAGQQDVPAIQAGGARAEHLPEERRARQAPEVAAHVVRADAEEEGRLQPGFVEQLEQPRHPVAGAAEGVDVDAQAGLDHACASRSRSASWRKKSRVLPMVSRSSMVGCQSSRRRALSMLGLRWATSW

SEQ ID NO: 17604 - protein, 399 aa, Pseudomonas aeruginosa
GSPPPRRCRRVRRRPARVPRSGRGCRRRPARSRRRGPAPGRRPRCGAAVRAGWLPRCRPGSPPRPGRSDRASSTFLQDLLDGAGDALDVVVAHVGEQRDGAQAGRVPLAVGQAQARLALAVVVVQVTGDEMDAATDAARLQGFHEGVAAQAAGLGVDAQDEQVPGVALLVRGQAERRQRQAGEALQVAFGEGLAARVERVQALELDQREGGVEVGQVVFETGLDNFRLRLASMAQAVVGIDPEAVELEAADPFGEGTVVADEHRAFGAGQVLDRVEGKDRRAAGAYRAPAVFAADRVGGVLDQGDAVAPGDRAQAFEIQGGAGVVHRHDGAGARADGGFHCLRRTHQGVAVDVDEHRGGAEQGDDVGGGDPGQRRRDHFVAGADAQRQQGDVQGAGGRG

SEQ ID NO: 17605 - protein, 496 aa, Pseudomonas aeruginosa
  UNSURE (255): Identity of amino acid at the above locations are unknown.
ADHLAAGQGDRLQVADLLAAVEQRQVHLHRVDLAVAVALRADVLDHVGLAVGGLQGQLRAAEVLHPYQRLLLVLERRLGHQLRLAAGLADQGVVAVRVELDRQALLADLGGVAAGGEELEVAGTERRDVVQAGAADRHVEFAVAGVVGADEGRALGCLGPVQGALVGLRGECGDAEGKCAGQAGPGVAAGHRVHGYSSVASSSAGRSAPWVNSLGCVRSIVAAGGQALIAAAAGLQLGDPVGVELAEVAGHRQVXLGKLPDQQLRRVLAEAFVLQQFQHRFEGALAFLRVIDQVGGQRLFQRALEVPPGVGAVAGADQRQARLLAIAEEVVARAGLLAARQCRRGFGGALLQLLRRRQQFVEQRVERQEAEQVALVRAFFADAGDEVLRRHIQQVRLADLRAEALGHGFRAERRPVGVGAQEHRAVVLGLAQAAEQVGTVDAGGAGAGQEVLVEAVVQRGRLLAADVLGIQAGLGRDHREHQLDAAPVQLPLHAAY

SEQ ID NO: 17606 - protein, 508 aa, Pseudomonas aeruginosa
GVAPARVCRAWVGVWRLVGERGRGARGPRPVRPLPATPSTSPFAAEHPRHFAAEAETVERLAVLLRLEHLRLAAVEGAVGLQPGVLVVDLEVGHVLVLAGLLLEGFLVVDSLHHPLGQALQGAVVLLAQVDAVDLGERGDHRQRWQRIVVVGEGALAALEFVGQEALLVDLVGGDLELAHRPVEEVAAVGHHRGGHHRPGRPVGMVVDLLQRQAAPVADYLGAEPGEPVLDFPALLGVGRERPRAGELQAHVGAGEAAQRPFAHGLAGVVEVVALQGAGAGPGAHPVQCAGQVAVAAAAHVLGDQLGGAALHVGDVLDLRAEGLLRLDVEGRPRRIGAFVLAGEDQAAGIRRRHRGATAGAALALADRRVVAGRGYQVGGLADLAGEQCRGEGTGQGDTDQVGRFHRLPPGHRLAGLGGRRLADAGLDLQALGHVLRRFDFQGKELLVGPVAVVAQLEDVAAAGIDGFRLLDLQLLAAAVHVPDGVLQLVYRRVAVGHVGDVAAATDR

SEQ ID NO: 17607 - protein, 948 aa, Pseudomonas aeruginosa
RGAVQQHLVAALAQLDLAAEYGLPAGAAVVHQRHGLAVEALLRHVVVGGEFPDEDLRRVLVEFLAGHVRQQRTVEAAAGHRVVEDVGAAELLQEAGEVVGRAAVGGADQGDLRVAAVAEQVAAVAGAHRLGLEAVDVLGGVAVAAELRGGLVEGAELGQQADALAFELLLRDLLEAGHLLQRLGHDLRAAPGAMGSPVVVALEVVGVLLLLVEQRREVRGPDAGLAEAGDGRQVVLLRQLVVEAGLFRRAELLAVHQAAGRLVDHHQLDALALEFVAQCAEFAPAFGAGAEVGTQVVGGAEQPVVLGLHQVGEEAQVLGVVARVVGGGRAQVAGRQRLVARRRAGVGGEGCLGQAEAGGQGAQAEQSGSAGFHASGSSVLEFGLAFHGVDQHRLVLAHQQVEDLVLLLAENAGQADAGGFGRGEHRHPVQFEAQRRIHRERAGAVAGELAADHDQRDLGVEWVEGDVAVGVGEVLDVAVHADQLVARREVLVEADVHAVAHADAVAAVGQDLVAPEQVVAALVEGDAVGMVAIDLVVGHQVALAVTVEDDPGKLVLVAAVVEDEAVVDFPRDDDAVLLPGPVDGVVGDDQAVRTVVRVDAVDDVVAVGVALHHQVVGLVAIEAVPAVDDGRVDHPALGARALHLLVHARAVLRDGDAVGLGGVVAEAGEGAVAQVHLGAAPGDQERTELVGRLEPGRLLLRFAPAGDLAVADEQHAVVDQERAALLGQAQFLDLLVDVEGRALADHDRQAGDEHPRLDLFQRAGGKLAGELGEVHVAAFDEDRLGHLALALDPFGEAVAATGELLQWLLLDHALHAGAATRLAHDLGFHRGGGVAGEVGQFRRVQVQRFGRRGGHRVVAGFLQALGQARLVAGLRRDRLRFLHRLRRPRLAVQQHRAEHCRGQRAQAREPAAGDRKGNVGHVRFPRGAQKRQMKSTKARCMVESVPGP

SEQ ID NO: 17608 - protein, 498 aa, Pseudomonas aeruginosa
  UNSURE (68): Identity of amino acid at the above locations are unknown.
LLWAVARSPRSRASWARRWSGSPAQPAARAMAEASSRCRDARGRGGRMGIFMVGYRSASGGQGHGLVXQGAAGQAADADLGRAAGVLGVERLVGLDLHADFRGQVAVHRRGVDDAAAAVDAVAGDLEVHPGARRQLGGVAVGEACLDAGHAVARREGEDHLALVGVLPVGYQLLDHAAVAGAGQGPFHLVAEELLDVARVELLLGQVALEHVQQVGREGSDRRAFGDFRVGPEKALHGALAGHGDLLVGDADHAGIGMGDEVQVVHLVEDEGEGADPDDEDRGAQGHRPDPAEEAHPAVAAALLAGLGEVLALEGIEHVADADHLAGQVGGDQVAQGRHLARLEVLELAADAAAGGVHRAHLELHFEGKADAVDLEQQLALVQVAGLDRRAARGEGEAAGGEIQQACVDAFAVGADVADARRQLDPGELALGFGFVHDVDVDGCIHGVGSCSVQSGSICARAAALALSVVDSVVIRWSAARRRRCWRQRRSWPATTRR

SEQ ID NO: 17609 - protein, 327 aa, Pseudomonas aeruginosa
AYSPQGLFRGERRRSRGVGGTNGSARRRRRAERGAARQDGGPGRSVLRGVPEEYQLIRAGLLGAEVIAVGIEVLQPGRVAQALADHVASHHAASLLGVEADDLVLAVLQVLELGVDDPRLQCLALHRAEVLVGGQVEQHVVALGGQRFVQPLADTLAPEGVEILATGVGQAGAHFQSIGLHEVERAQHAVETGEHAQVILGEGEIVLAEVFRVEAGVDIALEGEQRLLGVLRGELRMPAGVASGIQAGELVGKLHQFADLQWRELAQLLDQFLGVVQVLRLGEAVGDRRGLVVQGLGGGNHHQHRSGSSNRRAIVGAGDVRLHLCGR

SEQ ID NO: 17610 - protein, 725 aa, Pseudomonas aeruginosa
TGRLVLAYAPGRDGRATTMKRRAMSKTLHYRACHLCEAICGLAIETESDEGGVPRIRSIKGDPQDSFSRGHVCPKAVALQDIQDDPDRLRQPLRRVGSEWQPIGWDEAFALVASRLGEIRERHGNDAVAVYQGNPSVHNYGLMTHSNYFLGLLKTRNRFSATSVDQLPHHLVSQQMYGHGLLIPIPDIDHTDFMLVLGGNPLASNGSIMTVPDVEKRLKALKARGGRLVVVDPRRSETAAIADRHLFIRPGQDAALLLGILNTLFEENLGRPTPLPVDGLERVREAVAAFDAESMSARCGVPAESIRQLARDFAAAERAVCYGRMGVSTQAFGTLCQWLVQLINLVTGNLDRVGGALCTSPALDLVASTSGGHFGRWRSRVSGLPEYGGELPVAALAEEILGEGEGQVRALVTVAGNPVLSTPNGRRLEQALDGLEFMLSIDLYINETTRYADLILPPTAPLEHDHYDTTFNVFAVRNVTRFNEAVLPRPEGALHDWEIFVGLARAFAARNGLELKPTLEPQQMIDLGLRAGAYGDRSEHRLSLATLREHPHGIDLGPLRPNLAPRLKTADQRIQAAPPLFVDDLQRFAAQPLPASDQLLLIGRRHVRSNNSWMHNYHRLVKGKPRHQLLMHPRDLEGRGLVDGQRVRVRSRVGSVEVEVAASSEMMPGVVSLPHGWGHARPGVQLAIARAQAGVSANDLTDERHLDLLSGNAALNGLPVEVEAA

SEQ ID NO: 17611 - protein, 204 aa, Pseudomonas aeruginosa
RRHGMSVLVGKKAPDFNVAAVLGNGEIVESFTLSEAIKGKYGLVFFYPLDFTFVCPSELIALDHRIPEFQARNVEVIGVSIDSHFTHNAWRNTPVDKGGIGAVKYTLAADTKHEIAKAYDVESDGGVAFRGAFLIDKEGVVRSQIVNDLPLGRNMDELLRLVDALQFHEEHGEVCPANWKKGDKGMTASPEGVAKYLAENASKL

SEQ ID NO: 17612 - protein, 753 aa, Pseudomonas aeruginosa
SRRSRRPPLPAGSRGSGAPSDGAGRWGGCRRIRRRSCLRSCPGLQQFPAECLAGAQRHHVEVAEGEAGGRLPFLADQGDPVGVARQAIEVRAVQAGEAFQLVQRIALFEGLGIQLDGGVGAVAPGATAGGFLGVAGVRRRVGAEEEFRIAAHRGVQQGFLVGVALEDRQAIEVRTDTADQHVVAVVQQVMGGNGRADVGRGFPDELGGVAGGDVLEDHLQGREALDHPAQVLVDELLLTIEYVDLGAGHLAMHQQRHADLGHRLERFEDIVDAGHARIRVGGGACRIELGGMHEAAGLGGTDFLGAGAVGEVQHHQRLEAAGGGAGGEDALPVGVGFGGVAHRRHQVRHDDGAAEGAGGVADGIGQRGTVTQVNVPVVGAQEGETVGHGASRTGFRGGKCYRKRGGGALAIKFCPGRPIHPSYLDAFPEPAVVQPRLLLLPFLLSSLPALAVTFQTRLESVEWKVEGDQFECRLSQPVANFGVGEFVRRAGEQATFRLKPEAQWLGRGSATLLAAAPPWRPGQGDINLGQVSIGSGEVPFNSSQQQAGRLLTGLLEGRSPLVRHRTWQGDRLEVRLLPARFASVYSQYQACIAKLLPVNFDQVKLAQVGFPDGGTALNDVARAKLDIILQLLKADPSINRIELDGHSDNSGNRLTNRDLSRRRALAVQEYLKSNGVPESQINVRFYGERYPLVANNSAANRARNRRVTVHLSREAVVEPATEAPKAEDKPAPPAAEPAAPKPPAASLQGKPTV

SEQ ID NO: 17613 - protein, 412 aa, Pseudomonas aeruginosa
RPPWSDGMADVKKVVLAYSGGLDTSVILKWLQDTYNCEVVTFTADLGQGEEVEPARAKARAMGVKEIYIDDLREEFVRDFVYPMFRANTVYEGEYLLGTSIARPLIAKRLIEIANETGADAISHGATGKGNDQVRFELGAYALKPGVKVIAPWREWDLLSREKLMDYAEKHGIPIERHGKKKSPYSMDANLLHISYEGGVLEDTWTEHEEDMWKWTASPENAPDTPTYIELTYRKGDIVAIDGKDMTPAEVLTELNRVGGINGIGRLDIVENRYVGMKSRGCYETPGGTIMLKAHRAIESITLDREVAHLKDELMPKYASLIYTGYWWSPERLMLQQMIDASQVNVNGVVRLKLYKGNVVVVGRKSDDSLFDANIATFEEDGGAYNQADAAGFIKLNALRMRIAANKGRTLS

SEQ ID NO: 17614 - protein, 352 aa, Pseudomonas aeruginosa
ADLRHRSFGADDDRRHRFVLPVAAERIPGGDAADRAGDYRLSRRQPRRDRADGGDTAGAGDHRGRGDAVHVLAVGHRRANDPDHHLRPAHRSRHGPDPGAEPGLAGALAPARRGAAAGRGHPEDLAGHPHGGAPAVAGATLRPAVHLELRLPPGARRTAAPAGDQRCGGVGRRRVQHAPVARPRPDRRARADGGRSDRRGTRTERPGGGRRRRPGAGLHRGLPGHGEYPRAAERRRAVRRHHRPHRRRRPGDAPARRRADRDGRRCLCAAQPAGRRAGGGLAHHPEPRSLRAGYRRIGACHRGEARRQLPGRPERAHRLRPDGVRPRFVADRGHHPAGGDPAGRGGGGAVPA

SEQ ID NO: 17615 - protein, 299 aa, Pseudomonas aeruginosa
RHRGGGKRRAPHRERRAAAPGRAACDGRGHRADHGDHLGAGGGVHPHGLSQWPAGRVLSSVRPDHRHLHHPVGAQLADPQPGPGGPAVASAAGRRCGGGALPATAPGPRPTVAKCPRGLRQRGAQGGAGERPGPGGVWGPAWPDLGRFPGGAAGLRADAGQVLSGRHRPVAERSVAGAYRCGGQADVPDRPRRAGGGERRGLSGPVGERFRQRAERRGHVLHARSVRIAHLRRSRRAGHRRAPASQVRQHSRRLPRGLPAAAGTGAGNHRRLQDAGRGSRRRRAGSPGQADPGADDEGH

SEQ ID NO: 17616 - protein, 834 aa, Pseudomonas aeruginosa
VRPARGLDDQLRYQCPAARGGGRPHQGEEPGRSPGRCVRGIAGLPRLAVHQRLQPLRAHLQGHCPGRCAAPHAGRSHRAPAGTQCRRGDVAAVLVRHRDAQLRSRPGDPLQRLSVGGYQRRRASRRQFGTGGGVDGAPGRRSAARGHDLRMDRPDLPAEAGRQQRAVHLPAVRAAGLPDPRRAVQQLAVAAGGPADRADVPAQRDRRGVADGRRQQRVRPDRAGGAGRPGGEERDPDRRVRPHAGGRGRPCAGGGGRGLPPAPAADPDDLAGVHRRRGAVGHGQRRRSGNAPGHGRRGIRRDARGDAVRPVPHAGVLRTGTGTGGAPGATRRRQPGASGGRPSMKPYLRSSLSALILLGGCAAVGPDYAPPSASAPASFGAMPAGIDGSGVEIEWWRGFDEPALESLIQRALAANLDIALAGARLDEAKALLRENREEFLPRGGPAFDYQARRRGEVETPAGQQRDIETYRGALDASWEIDLFGRVRRSVEAAEAQAGSREALLRNVQASVAATVAMTWFQLQGIEAELAVVHDIAGNQRDSLEMVERLVSAGSAHEFDRLRAEALLHNVEAAVPDLERRRAATRNALAVLLAEAPQAFSPPVARASGERLTLRTLGVGDPSGLLARRADIAAAERNLAAATARIGVETAGLYPQVEVRGSIGLVAGNLDALDESGTSFNVLNPVIRWALLDRGRVRARIAASEARAQEALILYDRTVLRALQETDDAFNGYGAAADRLRLRLLEATANREAARLARERFVQGDGEYLDVLEAERSDYLSRRALSIARTEQRLAVVGIYKALGGGWEACAGARRCGVATDDTSPGVARQRDSRS

SEQ ID NO: 17617 - protein, 83 aa, Pseudomonas aeruginosa
PCHDGRTHGSQESTNQEVAMFSFHIPNMTCGGCAKTVTRILHGVDPQARVETDPPRREARVESTLDKHAFLEALSEAGYPEGR

SEQ ID NO: 17618 - protein, 111 aa, Pseudomonas aeruginosa
QLCERKEALTGNPKSYSPMDSQAFSSGFFAAHPVLSKSTFRRTPLSAEKAAALLDLATVASFTVAPHNNKNKGDPNDFKSVTAMLQFFLRYEYPFPADNVGTCPKCIGSPG

SEQ ID NO: 17619 - protein, 648 aa, Pseudomonas aeruginosa
SLETRCLPGPDHARARGDSRGHGQRPGRRCFGLRAVPGVAPGTARRQRSAYGADPPLDGEPGLPGRGSFRSRAGRFQRRPGGGVPQEGRRRDRGAQPGAPSHVGPPVPGHAAGRGRALLPGTPLGPFLQLLQPPGGAGLPLRKHRGRLGVLPQPLRRGRGGDAGALAPRVAVPPDDLLRHTAAHRFPGAASAGEGLPQQPYPLRAAHRCRLGPCAPVRGRVGELRQSPAHLRTPAAPGRARATQRVPSPARHPGRDRYRGDVGADRQVRAERRLPAQVHAVAGAPLRNQPGLLRPALGADAGEFPGHGLMPIQNKNKEYRMNTRNFSLPQLQNLPIEEARIVADALAVHATSRQIDSAASKLAALAEAGLKGDRQAYAAYQQLLYVLSLSDDVATAQTRRWLARAIYRVEERFMPAADLSRALSEEDFQKRLEQEIAAQSRERHPMSQYVFSGSASRAQLQVFLRHQWFRTFRLYRDAADLLVNLTDVDEAAALARYLYGELGEEDEKGSHPRLLAKLLEAIGLEADFQAVSTMPEEIAYLNNRARAFRHAEVGWGLAVFYITELVVPGNHEKLYRALLQAGLSEDQAEYYKVHISLVPPRAKREWQLIARRIPDVQFQNAFLTSLSQHFRVERAYYDAIWEEMQSVK

SEQ ID NO: 17620 - protein, 487 aa, Pseudomonas aeruginosa
LPPGQSEHSKMPSHITESRIHGGAYSSPAFAAIFSDTNQVRRWLDVERALAATQGEMGIIPHEAAREIDRAAQVERFDLMQLGRESLETGHLLVPTIRALARLCEGSWGEYVHYGVTTQDILDTGLMLQVKEAWGHALGLLHSIRGHLLALALRHQHTPMVARTHGQQALPTTFGYKVAVWVDEIDRHLARFDEARERVLVGNLTGAVGTLASFGAQGFELQRRTLARLGLGAPSTSWHSARDRVLEVAGLLVQVSVTLGRVANEIYHLQRSEIDEVREGSRPGQVGSSTMPHKRNPSSVDLVSALSRLVRAQMVALTDAAFQLHERDGTAWRIEWAALPELFVYAGALLTRMEAVLAEGLEVREERMRTNLDLLGGLILSERVMLALAGQFGKQTAHELLHEITQASQRQGVPFREALLGQPRLRGCFSAEALEELLDPVGYVGLAAEMVDLVAGKPRTGASGDRPEGAASSQGNTGQSQYVMEDR

SEQ ID NO: 17621 - protein, 482 aa, Pseudomonas aeruginosa
PTPSTASRSTTRPWRGRRMHTAMRSVPRRSSSRWPSNWARAALTKSSSRSPRPASASGFRCARRSSRIRGWAPSCRRKPWPGCSSRGPISAWPGPSSTRCWTRSPATTESPAARGGGTAYQRRTRMTKANEIETAKVKQFSARIMEDYGNTLRGAMLYIGDRLGLFKALAHGQWVTLEELAQQTGYTTRYLREWLGSMVTGNYLAYDPQSRSYRLPAEFVPVLADEDSPYFAGGIIQLSVPFVSMAPKIIEAFRCGGGCPEESFPLETWEGMERMTMPWYKHFLVQHWIPSLDGVKEKLQAGGSVLDFGCGSGLAAIMMAKAFPEAQVYGCDFHAPSIERARANAEAAGVGDRVRFEVSDSDALAGKKFDFVTTLVVIHDATDPQQMMKDLRESTADDGTYLMVELNLSQELHENMNLFGRVMYPQSTLYCMTCSLSHGGEGLGAFMGEDRARQMAEAAGFSRFRKVPSEWPPLPALFELRP

SEQ ID NO: 17622 - protein, 178 aa, Pseudomonas aeruginosa
AVRRGWCRPVRSLARGCLRAVGGRFPRAWRHSFNHSGDADALALGGGYVARLHLGAFRQAFIDTVLQGDQQAEHDERARRQDRQQEALVLRERLDLPVRRRRAEQQVHVGQQGTLAEQLAQAAEDQQDQGEAEAHQQSVEAGAQHAVLRREGGASARPRITQLVVISGMKMPRTWYSS

SEQ ID NO: 17623 - protein, 193 aa, Pseudomonas aeruginosa
VQACISSSMQVVSTAMIMTNAGSRIASLTAPRTNDTAALEQASTSMVARPRPRALTVELLVPSSGHRPSNWTRPGLLRHRPLRAISRKSCSLMSGSLFGGEQAFAVGVEVAQRLVHGADHGARGDGGAGELVERTAVLLHRPAGVRRIAQALAVETVHPGTLGQFDAVAEAGGFLVRDDPHAEQPALGGDPDQ

SEQ ID NO: 17624 - protein, 167 aa, Pseudomonas aeruginosa
VRTPTPRPKTSRPRLLVAPDTGSVTMKKAPSMVAPLNRWNSGEPWESEPEPFQNSRLMANRPASMPSGACQVNSRRQSRNRPPRRNARLTHSLPALPRWPKAGLPANSSSTVRLRSVFSTSRAVAWAQASGRVARPRNSRRLSGRPRALSGEGQRVISRGNETSATT

SEQ ID NO: 17625 - protein, 159 aa, Pseudomonas aeruginosa
ATVSRPSSGPPAPCSLRSSAVSAVRCRYRPACAPWPARSPPAPGRPPWRGRLPRARPGRRAPARPSPRVGRVLRPGAPRRGAGEPGVARNAHGIVRPSAASAAARGSPPWTRGSTAPGECSTGRRRRRRRIRCNRTGCGRAIARARRPGRRNAVVVAAG

SEQ ID NO: 17626 - protein, 376 aa, Pseudomonas aeruginosa
VRPGRLPRKAAPARRCAGRAARCSAAPAAPAGSAGRWSAPCWPAGRGRRGRRAGRSCRSLPVAGDQSRRRLRPFPVAHVVRYLAHLDAVHRTGLQAQVATGAFVSDHRVHQPCGADDGVHRAGLDALGAADAFGLADVGYPRRGFLGSVERLGLQVEQVGEGADGRFAARRALVDLVAGGDRLGVGLAAGVATLAALGLRQQGVDLLGDRIALDAEAHRRIAEQRTAGQADRQQRADRQEHAVHGRTNPLKPMNASDIRPAVIMPMAAPRNGAGTSAMAMRSRRAANSTSTREKPSPAPKPWVVAWRKPYSALLALSRATPRTMQLVVISGRKMPSTRYSSGLVFFTSISVNCTTTAITRMKPMVRRYSRSSGRST

SEQ ID NO: 17627 - protein, 377 aa, Pseudomonas aeruginosa
PASIPRLTLRKSPMSAITRQTVEATLRQYQHPYLNQDPVSAGCLREVEIQGDRVRVRLELGYAAGLFRNGLAQTLQMALEALDGVARAEVRVDCVIQPHKAQPQVEVMGNVKNIVAVASGKGGVGKSTTAANLALALAREGARVGILDADIYGPSQGIMFGLPEGTRPKVREQKWFEPLEAHGVQVMSMAFLTDDSTPVVWRGPMVSGALIQLITQTAWDNLDYLVVDMPPGTGDIQLTLAQKVPVAGAVIVTTPQDLALLDAKKGVEMFRKVNIPVLGVVENMAVHICSNCGHAEHLFGEGGGEKLAAQFGVELLASMPLSIAIRTQADSGRPTVIADPESQLAMLYQEIARHVGARIVLSERASVGLPNISISDD

SEQ ID NO: 17628 - protein, 298 aa, Pseudomonas aeruginosa
NAARKSVGIGLQGPAGTCRARWAGSRAQHGDAGQRRDGDHRLVRPDLQVPGRTFQRGAVRPALRRAVASAQPAARVDHQGRRGGNPPGADRALRGQSPGLRVLGRYLHAAGAVAQSARYPQLGGDGIRPWTEPGDARLRRAGAGADRAGRQVGDRPSAQRDRRQIPAAAPESQQPSAHGFAGHRRIRAGALSHRPGAGAQRSGLPGLPGADPEPRAFHQRQLGRIHHRRGRPPVPGLPAALQFLAGGGHRAFPRPGVQAGRGTRAPRPARAPAEATGAAAGGTRGGIPRDGHRLRLNP

SEQ ID NO: 17629 - protein, 445 aa, Pseudomonas aeruginosa
PAKTRPGRALRLHNARSSPMHAILIAIGSAGDVFPFIGLARTLKLRGHRVSLCTIPVFRDAVEQHGIAFVPLSDELTYRRTMGDPRLWDPKTSFGVLWQAIAGMIEPVYEYVSAQRHDDIVVVGSLWALGARIAHEKYGIPYLSAQVSPSTLLSAHLPPVHPKFNVPEQMPLAMRKLLWRCIERFKLDRTCAPEINAVRRKVGLETPVKRIFTQWMHSPQGVVCLFPAWFAPPQQDWPQPLHMTGFPLFDGSIPGTPLDDELQRFLDQGSRPLVFTQGSTEHLQGDFYAMALRALERLGARGIFLTGAGQEPLRGLPNHVLQRAYAPLGALLPSCAGLVHPGGIGAMSLALAAGVPQVLLPCAHDQFDNAERLVRLGCGMRLGVPLREQELRGALWRLLEDPAMAAACRRFMELSQPHSIACGKAAQVVERCHREGDARWLKAAS

SEQ ID NO: 17630 - protein, 487 aa, Pseudomonas aeruginosa
RDAADPRQPGRVRRPGKGSAAPGLRLLRLWRAPYDSLHPAEDRGPWHLSQGLAGAIPDAELRGRGSGDPQRPALLGNGGLERQPVRPEPDALERGSRLGPLCRRDLADPRAEQFAQRAFRGARPAEYLQLRARGNTPAAALHDRVADPEADRPGASDADVQPGLPEPSRTRDPAMDRRRQELRGNRHHPEHLREHGELPPQEHPEEVRRAEQDAGCRLRRGAGPHLMLRARRPARPTRSGRLPAVHPPLVFPLMCVLVCPPTERAQEYQGRDAAFFSRPARHGDLVMIELLSESLEGLSAAMIAELGRYRHQVFIEKLGWDVVSTSRVRDQEFDQFDHPQTRYIVAMGRQGICGCARLLPTTDAYLLKEVFAYLCSETPPSDPSVWELSRYAASAADDPQLAMKIFWSSLQCAWYLGASSVVAVTTTAMERYFVRNGVILQRLGPPQKVKGETLVAISFPAYQERGLEMLLRYHPEWLQGVPLSMAV

SEQ ID NO: 17631 - protein, 753 aa, Pseudomonas aeruginosa
RRSAFPDPGADRPAGRDGHRQPRRHQREVRPGEPEEGPDPGASGQRDDLPADRRRQGRPDDDRRHRGPPAVASAPGTLRRASAATLRLRREGLPAAARRGLQALRRPVAAHRRAERLVAPAHGALARIPLAHRARQVIQGRRGWPRARAAFLGGGKNVMVGAPSWCLVHALSTVRHRPLGVLLQPDRRVPRRPGRQLLRRAYPGPSRWPGVSPADPLARRRTAFRRRGDAGRRAAVRHHLRLPVPELQRADGARGAAVHRADAGPRGPVRRPAQPPLQLLGPGRRAGGGAGRGDHPLRRDHRRVPPGLPAAATGQRHLRRRPGAVQAPGAQVPVRAAAAPALRLFLRWRAAGGVACLAAVRRSAAPAGRRAAMGRTGMDGAAGHRPRPVLVEQGRHRGGRRYPGGDEQPARAGRVAAQPADLEPARRPAAPGPGRRGDRRFAVGQPARPARGACMRISGQGVLLSLAASVLFVTLPGYVHLLEPLDSLQVVAHRVVWSIPMVFLLVVATRQWPTLRAAWCRLFAEPWLLACFPLTAAMMLLQWGIFIWAPLAGKTLELSLGYFLLPLAMVLVGRVFYGERLTPLQAIAVACALAGVLHEFWLTRAFSWVSLVTALGYPPYFMLRRRMGVDALSGFVFEMLFLLPLALAALYWLGDESQAFREAPRLWLLLPMLGLISALAFGAMMASSRLLPMGLFGILSYVEPVLLFLVAVLFLGEAFRPEQLWTYAPIWLAVLLTGWDSARLLRKQARRGI

SEQ ID NO: 17632 - protein, 71 aa, Pseudomonas aeruginosa
RSWWSPTASGSSASATRASAGWASRSASCPCTPPAAGISPAYTLPVVLDVGTNNPDLLNDPMFMGLGATRG

SEQ ID NO: 17633 - protein, 472 aa, Pseudomonas aeruginosa
IRCGFMDGAPLASDSGFVAAARCGQRLERTGLGVTPFEHALQPLAQVLAAGLLVGAEAELRHHRQQVVEHVALDALVVDPGGGAGEAVYLQRDALGGRLQLADHAGHVRMDVRMVLQVGEGVGAERTDVGQPAAVGGQRGDPAVGGIPLLQLGLLAGHVFGEQAHLAQAPLFLLVEETHLAGVDVDRPLDPPSAGLLHAAPVLERLRHQAPGRHRDDGLVEVLHLHGVQGDVHHVAVGADLRHLDPVADSQHVVAGELHAGDEGHQGVLVDQQEDRRHRAEAGQQQERRAVDDDRDDDDRAEHEHGDLRQLHVALDRAGAGVLGTRVDVQQGIQQRGEGEDQEQHGEGQCQVAEEVRGLVRHLRDPWQAELHQQRGRGLRQALEHLVADQVAEPVQRGLAGEQVGGVEDDVAGHPAEDQGAHQQQAEGQAGVQDRVLVERRPVPGELVEKGCGVHGQATSFVAGGGTGRPRG

SEQ ID NO: 17634 - protein, 200 aa, Pseudomonas aeruginosa
RTPDGCVPAAAGATAAAARSGPANASPVLLCRAIPGPPVRAGRPAPASAATRESGSGWRGRTPPAAPAPGKCCASRSAAAGSRTGSRQRRSPAARSRPSAQCTCRGGWPGSSPTAATGRWETPSPCRSPAIPGRRSGCRGRRRWSTGSWPGPRARCWPGIPACARSGRRACPTGPRRSPCRRSSSWPAARPAPSQARTRL

SEQ ID NO: 17635 - protein, 465 aa, Pseudomonas aeruginosa
SLRAGAATVRLCTCPFSRAMPRSPLFSQFPLHERLLKALESLSFSEPTPVQAAAIPKALEGHDLRVTAQTGSGKTAAFLLPLLHRLLAEDKPRSLARALILLPTRELAQQTLKEVERFAQFTFIKACLITGGEDFKVQGARLRKNPEIIIGTPGRLLEQRNAGNLPLQDIEVLVLDEADRMLDMGFADDVLALANACPAERQTLLFSATHSGAGLNKVIAEVLREPQVLRLNQVGELNENVRQQVITADDVAHKEQLLQWLLSNETYTKAIVFTNTRVSADRLTGRLIANQHKVFVLHGEKDQKDRKLAIERLKQGAVKILVATDVAARGLDVEGLDLVINFDMPRSGDEYVHRIGRTGRAGAEGLAISLICHGDWNLMSSVERYLKQNFERRNIKELKAAYQGPKKLKASGKAAGSKKKKQDRKGAAAKPAAKRKPAARPKAGPSAVVSADGMAPLKRKKPTAE

SEQ ID NO: 17636 - protein, 220 aa, Pseudomonas aeruginosa
SCCCVACCWGRGSSRRACGPGPTIRWAATWHCASWRPSARRRKSRWSRWRRSSPPSAADWPPCWTSRKPTPERISATTRRVRTPCASLPRARPATCVRRSSRRCGSTRRSAWRWRSSRFPGRTSRSARTSSHRRCWCSRTSRRGPPGVSSAWSPASESRPWQCWPPPPTNRTTATTSTCSATTPAKPASATASAPSHSATRASSSAPRRRSTWASITRRR

SEQ ID NO: 17637 - protein, 186 aa, Pseudomonas aeruginosa
STAARRSSPGPGRNGVPTSTSACPASPSPTVIPTGATGSLAGACTTSRTSPSPTTPRRCPVPAWRRCYRWRARHCSATRRKSRRPSSVSRTAIPRWRNTSSTGCANCSATAARSRCSTPTPTPAATVPIRPIRRPTCATWWPPSRTPTPRPSTPPSANGWPPARPPPRRTSARATSHAPRPTTMRC

SEQ ID NO: 17638 - protein, 208 aa, Pseudomonas aeruginosa
RDASRTVMPVAKAGRAGVRGWHRVPPGPPACRGRRPCQPRFRPGGVRRGCARSGRRSVRVASPGHAPPGGSGGSPRSRPFPASRHPSGSTGCRSDRAGTRPARAVRCRPGAPRSRAWRGSRAPPAGSPGCPRRPGCMGRPGVRPGPPRLLRPGCRRRSRYSSSRASRRAFTATGWARASRRRPSCGGRSWQCCGGHSRRMRWPCSSCA

SEQ ID NO: 17639 - protein, 127 aa, Pseudomonas aeruginosa
RRVVMESAWEKDSNRVFCAWADIPMPLSLTLYSRRSRPPSSKRRCTRTATWPSAVNLRALLSRFISTWRNRVGSPLRRRGTPLSRPRCRRRRFSTAWALNSARVSESSSSRSKSMRSRCSLPDSMRA

SEQ ID NO: 17640 - protein, 111 aa, Pseudomonas aeruginosa
AAWPRSSGVSRSSCSMPSTPFSGVRISWLIFARKRLFASFSTRACSAAWRERKPSSLSALMRSARPMDRVTSSTVMPILTTLLPNRPNSSQPSEAAVVTRNDSSSAPQARM

SEQ ID NO: 17641 - protein, 453 aa, Pseudomonas aeruginosa
QLAGEEGGLPGGGEAGAGSVLVAVVAAVEHFVHRRDVGAAFHVHRMLELLVEAFQRGFPGLGVAGEDRRAEDVGGEQPAQRGEAVDVRALVAVGGVAAERQQRGAGVVAGGDRRLRVAVVVAEQVAAQGDVVALAEPQQVPRQMEVVGPAGVLHGHADAVLVGILAFGHRGDVDADELADVPGQGAGGAGADFLGDGEQRVAVDRRLLAAFLDRLQRRQQRRDPGLVVQVAGADMAALGELRQRIEGHVVTHRDAQALAVGATGGISVETQLDVVPTDLQVVHLGIEGVARSQQRQHAATEHALFGEHRDPTTLGEAARPAAYRGQAEAAVGLDLADQRADRVEVRGNRTVRGIQAALEGRPDGSPASHLEGHAKFVELLGDIAHDGIGEAGGAGDGEHLQQHPLQVVEVRLWQRGHEGTSRLRGKRRSTKRSAVGCGSWLARPARSLASMIT

SEQ ID NO: 17642 - protein, 455 aa, Pseudomonas aeruginosa
GRCKWPFMIAPGSGPCVGGPFSKSLFAEPEVEGGQLPQLGAAQRCEVAVRIAQQAIEYRRLEQAAVLARVEQQFAYPFAGAALQVLEAGHREVALGPVDDFAGNHLARGTLEHLLAAVAELEAGGNARRQLGQAVVEERHAGFQAPGHGHVVDPLDRVVDQHDRAIQAQRLVHRGLGAGAGEVVADEAPGDVLDAEALADGGQVFLVVAVEERRAVRGEGVVGAIHLRIPVVAGEQLVGALAALHHLAVLRDFPREQVEGDAVVADHRLAHGAEGRRQLLDHFVLADAQAMVAGVIALGDQVGILELVAALAAGILEADGEGQQVVHPGFVQQAHQQARIDPAGEQHADLAGGALADRHRFAEAVEDALLPVVERQLALVRAWAVVQRPPGALLAAAVEVDAHPGRRRQLLHALQQGVRGGNHGVEVEVEIQRLRIEVAGDVAALEQGRQARGEA

SEQ ID NO: 17643 - protein, 360 aa, Pseudomonas aeruginosa
ARTCAPWRQSASISSRLGASRMSSVFGLKARAPEGEVLAAQVPVVEHPDAFEQLELLPPVDRFHCLQQVAGAMRLLGAVDQRAHVLGEAGAAVAAAGVDEVVADPRVGADALAHRLDVGTEVFGQFGDLVDEADLGRQHAVRRVLGQFGAAQAHEQHAVVVAVERLVEFAHHLAHLFVVAADHDAVRAPAVGDGGAFLEEFRVGDDLEFQLASVGFQAPLDVRAQAVAGAYRDGRFLHHDDGLAAMLGDGIGHREDRAEIGRAVLARRGADRDELHPAVFHGQARIAAETQAAAVQAFAQQGVEPGFVDAGEALREAFDLVPVDVHAQYIVAHFGEDGGLHQSYIATAEYADLHGAFLDG

SEQ ID NO: 17644 - protein, 103 aa, Pseudomonas aeruginosa
RVAPLGEAGGGPGADHQQDQEQLEGFFLVHRLAQLQVGQGRQREERQAQVEQPVAAQRDAVPQAQPLHQDVAHEQCQRQQAGHDVGRQLAPAQAEERQRQQQP

SEQ ID NO: 17645 - protein, 360 aa, Pseudomonas aeruginosa
RQEDHRRLAPLVPGLAQRARQQAAPGQAGDRQQRQVEPPRARVLGVFAGEAADVFVPEEEPPVVRFPRMHGERPGQADEQRRQHRQRTVAKQLAPAPLPEHVGQGDQHRQQPGEEALGQEAHAAGEAEQGPAEQARAAAPRVEGMPQRHQAQVDPEGELRVEVGLAGLPGDQAEAGVEQRARQAGAWVAPQAAGQQVCEQDAEGGGDDRGDAHAEQVFAEDRLAEGDHPVAGDRLLEVAQAEEVRRHPVAAQQHRLADLRVAGLVGNPQAMVAQWNQVEQAEGDQQQRTGLAAAHGWRTPSQPSRPARRPRTSSASGRLRGSSGSSSPNGRKRMPRRSARRSSSRNAGARSSPSTSAWMV

SEQ ID NO: 17646 - protein, 266 aa, Pseudomonas aeruginosa
RKPKGCLASTTRPSARQPAAAEQRTGWPRMSARQSLPRRICSPSCCTLQTPAWVCQAWWSQACRPTSWPAAWVRRISGPSSRPIGLPGQAVPASRMSQPYRLAARERSIFQKNAGRARRQRWRPMLSGPTLKKKVAFSPASSSSSSSRGTPSRVPRKVSTSMRRPAWITPVPRARGALRGGRSRGSCRWSRAVRWWAASRAGAGRCRCSACGGPRPGSRRRRSCGSPPRGSRRRAGTARAAGGPRTGAAVPRRAGGCSPRCPGCRC

SEQ ID NO: 17647 - protein, 200 aa, Pseudomonas aeruginosa
PRGSAPACGAAGRTPRHAGARPRPGPARWPVACRPGTGRARRAGRSAAPASPRRRRSAAGRRTVRCPARDRGCRRPPRRSRRSASVRRPGRRRQGRAGSPRAPGRTTAVPACASRAGRPPGCAGRSGWPGSRPARLPAARRGRAAAGCRAAGHRRPCAACRAGSGRVPRGRWRRPAGRGSARCRRARSCDAGSPRSAFRR

SEQ ID NO: 17648 - protein, 375 aa, Pseudomonas aeruginosa
RGETGPLQGRGKRGGRCADHALDEEARPRAHVAVHAPEVLAEQAHAEQLHAAEHEQHEQAVAGPGGAEGQAQHEEEQGEEEAGQGHAAADQAEQAQRRGGHAGDQVEHQVEQAHRAVFRFAVGALGVGDADLAGMPGEAVGQDRDEGTAFAAGQHRFDDAAPVGAQHAAVVVHGDPGGALHRQIHQARRPAPPGRVLALGADAADHVVALRGALHQARDFLRRVLQVGIEGDHQVATGLFEAGEDRRVLAVVAVEDHRHHGAAVAFGGGLQEFRGAVAAAVVDQHDLEGAAQLQAGGLGAAQQFGQAGFLVVDRDHHRDQVDRIGLHRRFSRISSMARATRSMSSSRMSGNSGMEHRRAEFHSLLGRLRRGWRWR

SEQ ID NO: 17649 - protein, 212 aa, Pseudomonas aeruginosa
  UNSURE (140): Identity of amino acid at the above locations are unknown.
AGARPRGARRRWRRAWPPATCQGARGPAARSARPRGRAFRPWPAGRCRRWRPACRRGRPGRRRNPSRPGPGSCSGRWRGRRAPGPPGPGAGRAVRRSRRPGRWPRPAAGAGTPGAGEGGWASSWSGTGQRAVARVTALFXRVRPGRPPMLTSAGRPAYWASSGWSGWICTRISEDRSPSTGAVLTMRPLRLTPSPATWKFTRVPGASSAALR

SEQ ID NO: 17650 - protein, 531 aa, Pseudomonas aeruginosa
SIRWSYDGQQHGDEDAGGREGHGPRRPGVEPALEAGQAALQLGRLAGPGLPVEAEEHVDLHQRADDLVVIEDQRIGRADAVPGEREEQGQHQAGEADPEQVHQQEGDAVLEAGEDRHHQAEQAGPHRDALVEQHQHGEPAQAPRAELERARVLPQVVAVPAVHQLATGLDEALLRRVLDRVDRRVGHVEGVVAQAHQAEPAGLVVAGEELEATQAPVLQVVVLDVGDELGVGHHPGAEHRHPSGHGQHALGQGHRAHVDVALGEAQLVPLAHHVAALHFAEFIGGEAADVGEELEPGHGLLHHAVVEHGVAVDHRDHRIVVRQVPGNRAEAIGQAVALAGAGNPHEVEADPVRRVHLLPQRTDQDLVGHLDDGADHGGRVAAVDGFADHRAIDHGSGQGVDAETGDHQEHVRRVGRAAQLAHAPAVVRVDHVEEQHAAQEVHAAHGVAPDADGADKQDEILGVGVEHGLRHCQREHHQQAEEHQPAGGFGEATFVSFHHQFHRAGDLGLDAGVRLLLLWRTPRRRPSVRGR

SEQ ID NO: 17651 - protein, 424 aa, Pseudomonas aeruginosa
GLETSGSTYAVDRERRRRPNGAEVSGLDGSEVRGDAAPGGEHHQVVGGDADTDVIARLVVGMAGEDRFQLGTGGQLQAVQGGGAEEGLADDPRLQLALRRVHQVVRAQQDVYRAAGRQAVGAIAADHAEFGLHRIGAEQLAANEVALADEAGDEGRQRLVVEVVGSVPLFQVTFLEHADVVADGEGFFLVVGHQDRAGAACLEDLANLLAEAAAQFHVEVGEGFVEQQQQRFGRQRAGQGHPLLLAAGEFVGVARGEVVELDQLQKLAHQAFALWMLADAEADIVGHAEMGEQRVVLEHHADPAFLRRQGEAGTRDDFAAQLDLPGQHRFEAGDGAQGGGLAASRRTQQAADVSGIEVQVEVLHHFLRGVAAGEIFQVQQQVVAHGLRRNGRVRSAIRGGPSARADGSLPGPRLPSAGRPATLR

SEQ ID NO: 17652 - protein, 213 aa, Pseudomonas aeruginosa
GKARSYKEMSRKHKEGLGRRGLRGFSRVFAVVPPPKSRLVDLSVGRGDALCCARPNAFMEEAGFGPGRSNMHTGETLAAAPPARPLRQSRLGGLSLFLALAGVAIALAVMALALGERIDLSDENHLLGLFAALLAVFAVSTCGLVLGLAGLLRRSRKRHLALAGIVLNLSCLLWGWHALSTAAAAILMVLGQTGLSFLSALAVLFGMIFFRQA

SEQ ID NO: 17653 - protein, 882 aa, Pseudomonas aeruginosa
  UNSURE (730): Identity of amino acid at the above locations are unknown.
AQGGEGGVQVVVATLQGRGTTAFAEVIAGDVHVGQPGEGFQLQAAPAQRVGGLGEQLAALCVELGLLLAGHGAVLQVALDLGAVPGVRRAEAQAPLLQLPAEVGAEVVAVDAGGGLQAAVHVQRAVAVAGHQAEARVAGDLAVDAEQEAADRMPVAFAAVAAIGTLAPGAERLEPAFGSLPAGLAVAGLAQAFADAVAQIAAVVEQQAGERRVDFPGQLLEGPLGGCGVFRQEQAFVDRVAGAERFHGTSDRRLVGRLRDAGEGRAVASDIQADGVGRVVQGAAEEQVVRQYRVEAPLDAAGGVEDVVAAADQALDLGLAEQVRAVFHGQGDIAARDARLAAGDDPVAGAFRKLHRVGRAGFEAQVPGDLQGADGVARGHRAAGARQQAADPAVAAEGAAGIDFDGGQQRTVDAQQPAIDQGRPAIGAVAAQDQAAGSGLDQAALVLALGGGLVAGHADGIVGAFLLAGTGRQAVFPALVLQRPLPGRVLGGVLGLALEQGAIGNRVAPFVAQAGRKVGLEAAEQLSRPMHRPTEIRHAPADGVGGGAGRRAVELGGGGQQNLQRLLVVQVRIALHDQGQRAGGVGRGHRGTGLVGVAAAGHGAVDQAAGRGDAPVLGDAAAVVALAVLLVEAGHGQPVAFQVRLEVGQGGAHAGVGVAAVAGAEDVDHALAGDAGGGVQPAGAPVVLGIGGVQAVEGLVADVLGLAAPTVVDRPHPGVGQRLVGGLEIXRVGRRAEQEAVVLVGVGDVHLCRVGHPVHADAVARGAEGAADVGAVGVIVAVHRAADAERRAVDIGAAGRHRLVARGGGIRMARVETGVHLADLHALAVDAGGIGLVGPHPFQAPVLLVFGGAPTGRIAGPTGFDIGGRGRLCDPGAQQQGG

SEQ ID NO: 17654 - protein, 109 aa, Pseudomonas aeruginosa
AMDIIETIKEQIANNPILLYMKGSPNAPQCGFSSRAAQVLMACGEKFAYVDILQNPEIRANLPKYANWPTFPQLWVNGELVGGSDILAEMFEKGELQTLVKDAAAKANA

SEQ ID NO: 17655 - protein, 97 aa, Pseudomonas aeruginosa
WAVMVAPTLAGASRTNWAASPVVMCSKTTFRVGKRSTTRRRCSSMNCFSRSNTSTSARVTSPCTSSGMPTSAIASSASKILSMRVTPESELVVAPAG

SEQ ID NO: 17656 - protein, 196 aa, Pseudomonas aeruginosa
SCTRATSWWWAASPTTRCSTPTSRPSRKTAAPTTRPMPRASSSSTRCACASPRTRAARCPDRRAPPAMERRTPAMSRGSSFRIAESDSRGRSGRLLDQFDLVAVRVGHEGDHGGTVLHRPGFAGDLAAVVADVVAGLVGVVDLDGDMAVAGADLVGIHAPVVGKLDHRGIRLVAIADEGEGELAVGIVVLPEQGHA

SEQ ID NO: 17657 - protein, 1467 aa, Pseudomonas aeruginosa
PCQGVKVDNRPRKRFRPARPRRLRPGRHNNESQTLHPHHRDARCRGPYRWLRGIGAAGGGERPAKRSRRRGGGSPGDTLRRVHRLADRCRAGRTAAARRRLHPGRYGAGRPPGREGPATVPHRPARVQGGAGCRQGTPARGRGRGVAGAHRTRASRAAVCAEGRRPGAARQRHRLAQCQQGPGRCGQGRPRRGATGSRLHAGDGTDRRACRAYPGHRGQLRHQWRHRADQHRFGRSAIRVLRCRRAHLPAGPGADPRQGRRAGPQGQGGAAHRRVLWTKQSPRFPRQRRRPRDRHGPGSGGGRQPGRATDAGAVRQGQAGDRQASRAGAGRRPFHRHRPGQALCAGRRRRQQDPVPAGGTRPDGRRPAGRPPGPAAGRAHRRQGPGPAGHADHTAPCGNRWHARRPVEDRGGRTMTFPRFFIDRPIFAIVLSVLMMIGGIVSFFQLPLSEYPAVTPPTVQVTTAYPGANPDVIAQTVATPLEQAITGVEGMLYMSSQSATDGRMILTITFDQHIDPDMAQIQVQNRVSRVLSRLPDEVQRQGVVTQKTSPDILMVVHLLSPEQRYDPLYISNYAYLQVRDELLRLPGISDVVVWGAGEYSMRLWLDPDLIAARGLTAGEVIAAVREQNVQVAAGAVGQAPDSTAAFQVTVNTLGRLSDEEQFGDIIVRTGADGQVTRLRDVARIEMGGDAYALRSLLDGEPAVALHIIQSPGAYALDTAESVRATVARLEGNFPAGLSARIAYDPTVFVRASLQTVATTLLEAILLVVVVVVLFLRSWRASLIPLMAVPVSLVGTFAVMHLMGFSLNTLSLFGLVLSIGIVVDDAIVVVENVERHIENGEPPLQAARRAMDEVTGPIMAITSVLAAVFIPTAFLSGLQGEFYRQFALTIAISTILSALNSLTLSPALAGLLLRPRPAGGAVAGRFQRLLQVLGRPLRNAPEAYGNAVRKVVRVSGLALVVYGGLLGLTWVGFQAVPPGFVPMQDKYYLVGIAQLPNGASLERTDAVVRQMSRIGLDEPGVESVVAFPGLSVNGFVNVPNAAVMFFMLDPFESRTSADLGALAIAGRLQARFASIPDGFLGVFPPPPVPGLGTIGGFKMQVEDRGGAGLEALARQTQVLMMKATESGQLGGLMTSFDINAPQLEVVVDRTKVKSQGVRLADVFEALQVYLGSLYINDFNRFGRTYKVTAQADAPHRMQAEAIGRLQVRNAAGAMLPLSSFVTVTPSSGPDRVIHYNGYPSADISGGALPGVSSGQAVALMERLAGEVLPEGMTFEWTDLTYQQKLAGNSALFIFPLCVLLAYLILAAQYNSWLLPLAVLLIVPMCLLSAIAGVWLMGGDNNVFVQIGLVVLVGLAAKNAILIVEFARTLEAEGARALEAVVEACRLRLRPILMTSLAFIAGVVPLVMASGAGAEMRQAMGVAVFAGMLGVTLFGLFLTPVFYVLVRALAARLERRAGGSLAHLEGGRP

SEQ ID NO: 17658 - protein, 411 aa, Pseudomonas aeruginosa
QETLKVILRWIRRPLARGFSQRIQCYRRAPFGELRCPPRRPLHCLTLPPWQALRSPRTTTKTRVIQMTSNPLQQCCSSSSDMNIRSQRTMSEPARNASALLAEALKPGASLDQITLALEAILAVTAKGLGGDASAYAQYQALLLELHVGSDPHTEPTRRWMASQVYLVEDRFAPEPAGFSAVPVEEFRKKVDAEIEARSRVRHPMSVHLFQGTPPVEDVRFFLEHHWVRSYNFYSLLAELAFRFENIEDASVFYRNLYGEAGAETPERSHPALLSHLMTYFDIPLRIDFPALHPLEKAYLNNRIRCVRHTDVAWGLALLYAVESVSCVNHRRIYELLQRLGVPEQPSEFHRLHGTQDEIDTEEMWALIAKFAPSEDFQRKFMQSLARHFEINRAYFDLLWEQMQANSLAMA

SEQ ID NO: 17659 - protein, 341 aa, Pseudomonas aeruginosa
SLVLVFAQVLDPTASALRLARLADVAAMQDQPVVGIEQVLARHELQQFLLHFQNVLSRCYAGAVGDAEDMRVHRHGQLPEGGIEHHVGGLAANPGQGFEVLAVVGDLAAVLFDEDAAGFDDVLRLAVVEADGLDVLRQPLDAEGVDRLGGVGHRIEAGGGLVHPDVGGLGGEDHRDEQFEGGGVGQFGPWLGVVFVQSAEDFRALGGIHSITPVTRTRWRWVAGTSPACTLARSARLSSIRFFRAISRPSMMNAPGGRIASRKPWYCGNGWIFQSAAAGPNSKCMSASRVPWPSSSRRPPRTSRTRAKPRPISSPSKLARSTPFFAAKGGPRRDRGSRSWW

SEQ ID NO: 17660 - protein, 657 aa, Pseudomonas aeruginosa
VARQAGFGIGQGLVGGLGGGAQFRDQAMLFRGVVAEQLFLGLLQGHPRHARFDLQPFQPFAAATGLLARPGPLDRRLHRVDRRGGGGFLALGLGGARQRGLLRALGAFCGPALLVAAQASLALLETLTGLFGLQQLLPLLADLRLGRAVVLHQGNARRADVGAGAAFDAIEQVVGEQLLVLVAQGEEMQLLWQQADGADLGAVAAADTGHGRHWFRQLRGIAGEQAVAGLDQRHREIGQGEAHHRPAHQHAFQASLGEAGERQQLVYRRTEQRLDVHRPLQGAAGEGSDPRDQRPTEDDGIVHGGQGADVLAQDADVRRQAVRRDFPAGEQLDQLALAARGIAGRQGDDAIGPFTEGGAEGGDGFRFVVLDADQHLFGAQDLHQDIDAAQHLRGALAHEQVVGADVGLAFGAVHHQRMDLFRRARGELGRGGEAGAAETADAGRADAFEQRQRTFGAEVRAGMQLGPALQAVAGDDDGRRGKTGGMRIGVCADRHHGTRGRGMQRGADGAVREGDGLALEYGLADFHARPRRRADVLAERHDVALRQRRLLDRQGGGALLVGRQAEAAGEGVQGAHAARSRSLAISRGDGCGHFQWRTSSGISRISMQSTGQGSRHRSQPVHSSAITVCINRAAPTMASTGQAWMHLVQPMHSASRM

SEQ ID NO: 17661 - protein, 1045 aa, Pseudomonas aeruginosa
SASRSCRVRRWSHRARCRCGSRRSPGGLPGGSPASRPSYRKSVTRSGRWWRSSVFLLVSCQARQAVLGERADPPGPPVCLGSARLVLAGPPQPAPQAAQQQAQRQQHDEERQAVGEELHCGDGAIDKVVEQLPGGRGELAEAAVRLRLAAEAQGQQVGSDAPLLLGAGLGVVGQLGFHRGDFLGQGQQVADAHVLAPLVLLQGLVLALQALALLAGVGDRLGQVLGAGLPAFQRAALGSGRDQLLHAVRDDAHGEFGVMADTAALFDGEHVALAEALAVAGVAAGGELRVDTRGGKADADAVFVGEGGAGFARLALETGIAGDAFGVFGGASVERRQQDAGGKLPCVHSIEPSVASWSALLDALARLGAAVRTQQVDLLATRAGGQDHALGHPELHLARRQVGHIERQAAFQGARVGIRALDPGEHVTLRVADVQRQAQQLVGAFDEFALLDQGDAQVDRGESVEVDLRGDGFLDQLAIAGGLGCGGEVFLGGFDHGFYFRGLDTGHQGLERVQLVVGQQGLVVGPGQRGDVEEGFGGGGQLRQHRLEEDHQLAEQVDAQAADGLDLVLLAFLLGQRPGRLFGDPGVGAVGEGHDLAHGAIEVAGLIGLGDARGGLAEGCEQLRRRIGADQHAGVALVDEAGAAAGDVDDLADQVGVDLLHEVLEVQVEVLNAAAELGRVVVAQVFRGQVVEVGARLDEGAARLGHLLAVHGQVAVHVQRGRLAVAGAFEHGRPEQRVEVDDVLADEVVQLGAGVLAPERVEVQLGTPRAEVLEAGHVADRRVQPDVEVLAGSVGNLEAEVRRVTRDVPLLEAAVQPFGELVGHRLLKGAAAGPLLEHGLEVRQLEEVVQRFLEHRGGAGDRRFRVLQFGRGVGRAAGLAVVAVLVGGAALRAGALDEAVGEEHLLFRVEVLGHRAGVDVPGVAQFQVDRAGQLAVLFRVGRVVVVEVHQEVGEVAHVLGAHGVDQLLGGDALALGAEHDRRTVGVVGADVDGLVATHLLEAHPHVRLDVLQHVSQVNGTVGVGEGAGNEDLAWFGHGFGLSAES

SEQ ID NO: 17662 - protein, 202 aa, Pseudomonas aeruginosa
DSRSFFAAFDRTPSMTIKSDKWIRRMAQEHGMIEPFVERQVRGADDSRVISYGVSSYGYDVRCAAEFKVFTNIHSAVVDPKNFDEKSFVDINSDVCIIPPNSFALARTVEYFRIPRDVLTICLGKSTYARCGIIVNVTPLEPEWEGHVTLEFSNTTNLPAKIYANEGVAQMLFLQSDEACEVSYKDRGGKYQGQRGVTLPKA

SEQ ID NO: 17663 - protein, 71 aa, Pseudomonas aeruginosa
LSNWLKSVHRLRVNTDANRLRRPICKTHTSPSPEGVRIRRGWSARMAAELLVCRSNNKNELYVMPGYPWQR

SEQ ID NO: 17664 - protein, 307 aa, Pseudomonas aeruginosa
LFACSKIFGRCEMRRESLLVSVCKGLRVHVERVGQDPGRSTVMLVNGAMATTASFARTCKCLAEHFNVVLFDLPFAGQSRQHNPQRGLITKDDEVEILLALIERFEVNHLVSASWGGISTLLALSRNPRGIRSSVVMAFAPGLNQAMLDYVGRAQALIELDDKSAIGHLLNETVGKYLPPRLKASNHQHMASLATGEYEQARFHIDQVLALNDRGYLACLERIQSHVHFINGSWDEYTTAEDARQFRDYLPHCSFSRVEGTGHFLDLESKLAAVRVHRALLEHLLKQPEPQRAERAAGFHEMAIGYA

SEQ ID NO: 17665 - protein, 261 aa, Pseudomonas aeruginosa
QRHTPGQFCCDAFYRSGLTAMRNDGGFLLWWDGLRSEMQPIHDSQGVFAVLEKEVRRLGFDYYAYGVRHTIPFTRPKTEVHGTYPKAWLERYQMQNYGAVDPAILNGLRSSEMVVWSDSLFDQSRMLWNEARDWGLCVGATLPIRAPNNLLSVLSVARDQQNISSFEREEIRLRLRCMIELLTQKLTDLEHPMLMSNPVCLSHREREILQWTADGKSSGEIAIILSISESTVNFHHKNIQKKFDAPNKTLAAAYAAALGLI

SEQ ID NO: 17666 - protein, 89 aa, Pseudomonas aeruginosa
SSSASARRRRSRARRWSRSASRPTRSAAWRCCCATTRNGCRAYRCRWRCEVVSRFAHFFPLLLPHARPAPRRHRAFPCIPGFGRGCRLA

SEQ ID NO: 17667 - protein, 279 aa, Pseudomonas aeruginosa
SLCGPPSRGVAMPKSFRHLVQALACLALLASASLQAQESRLDRILESGVLRVATTGDYKPFSYRTEEGGYAGFDVDMAQRLAESLGAKLVVVPTSWPNLMRDFADDRFDIAMSGISINLERQRQAYFSIPYLRDGKTPITLCSEEARFQTLEQIDQPGVTAIVNPGGTNEKFARANLKKARILVHPDNVTIFQQIVDGKADLMMTDAIEARLQSRLHPELCAVHPQQPFDFAEKAYLLPRDEAFKRYVDQWLHIAEQSGLLRQRMEHWLEYRWPTAHGK

SEQ ID NO: 17668 - protein, 317 aa, Pseudomonas aeruginosa
YRGGEGGRGPARPSLAAAKTLWSAPHPGAWSMRYLLFVTVLWAFSFNLIGEYLAGQVDSYFAVLTRVLLAGLVFLPLTRWRGVEPRFVGGVMLVGALQFGITYVCLYLSFNVLTVPEVLLFTVLTPVHVALFDDLLNRRFNFWALAAALVAVLGAAIIRYDGITGEFLQGFLLLQLANATFAAGQVLYKRLVRKYPSELPQRQRFGYFFVGALLVALPAWLLFGDPQRLPAGELQWGVLVWMGLLATALGQFWWNKGATEVDAGTLAVMNNLHVPVGLLLNLLIWNQHADLPRLALGGAVIVASLWVNRLGRREVRA

SEQ ID NO: 17669 - protein, 449 aa, Pseudomonas aeruginosa
RAGFAVQVAILAGPAMTCCSPWPWKASAPGVCSCSPYPSEARRSESRYDRNSQASLVRSPCRPIAAGDAAAEQRQRVQYPGTHRFQPAGPAAAQHRDHRGADRARLQPVQPVQHRSGPPHLPALDPGQQRDPVLPPARGAPGRNDADHLHPHGRPGLPGVLEDLPDPPRPVHLLPGPRADRRHPAQRHQEQREDRGGHRQRADPRPRRPGHRRDGHPDRQAVPVHRLRRVSARPTPCRWCWTSAPTTRTCSTTRCSWGWAPRGGERGALRGVRRPVHPGDQAPLAQRPAAIRGLRPDQCHAVAGALQGRAVLLQRRHPGHRRGGRGHPAGGLQGQGREAQRADRDLRRRRLRRLRHRRTDHRRHATGGPGRGPGASAHLHGRPLGPAHRRHEQPARLPAPPGAEARRSRCLGRPAGRRPGVAGSDPQCPADGADRRLRAARAVFRRGHP

SEQ ID NO: 17670 - protein, 333 aa, Pseudomonas aeruginosa
FGEGAEEPRTAAFPLRLAQRRRQLGQAQRTHHPCFYVAQYPVRLFAPAGLLQPARRLGNQEADGEDEHRRQRQHQENAAPAGQRQQEVGQAAGSDEAQRPEAVHQRNVLAAAAGRDHLRQQRLGDGKLHPHADPQQYPVEGQAVEVAGGGAQVAGQAPEHDAGLEYRLAPEAVGEHARQGRADHHAEEARAGQQPGLRRVKPELGFDRAEQEGHHRQVHRVEEERQRDDHEDQSVIRTQRQPFEAFGGGCGRVGHDLVPLGGGRRTSLRSPPAPCLPGGDPASSRLRRRRWPSRRANKACAPARQPLGYAPVHFHVQCRGLPCSANFPSTNAC

SEQ ID NO: 17671 - protein, 471 aa, Pseudomonas aeruginosa
WRSWGRPGVDRHWSDGAIGEFRCPGRTVPWVSRIGRLAGTESRQERKADEVAVALPAAGGVGRLAEPVGLVQPYGGQLPGIARAGGHPRGAGSRGGAAGGVPRRRARRTGRPAGRAGSLRPSAYRQLPGASGRPALRCRGRGRRLASGVPRGAAGQPGDPPGAGAPAASRAGPAAAPAPQATGGAGVPEPLAVDRLAFHPPGARRASRAPGSAGHRRRRTGLRPRHQPVQRQPRRSRPALRLRHPAIRRPALRVQLPGAVPHGLLSRGGGDLQRRAVPRPGLAGMACLPVLRPVPLRLRQRSSLLGLPVPWLGHALHPGHHPALPLHAAARCQPGGDATDGGQGIARLPGGKAGGHRACREPPYRGGEIPVRLAAPTAPRRPPAADARRLRRHPPRRCLSGLFADLLARRGGRRVERPRRGLRRRHRRMAGRPPGLRRAGLQREQPATPRGPRQCGAERATDRTDRAFRRA

SEQ ID NO: 17672 - protein, 353 aa, Pseudomonas aeruginosa
PRAVIRPTELGRSPAFPGCAGRRTRPRQAGRCRDSVAQQLRRHLAAQHQLALLALRVEQDHRLAPPQGMPGAFYTHVQRGLVAIVGAFAGDEVFQQVVQGVGFEQVVGDQHWRYSGMAANASATHRALSCLSRRLAEQAFEGGIEFRPVHRLAEVGVHASLDSGPAVFVEDVRGQGDDRYAWPALGTLLPADQAGRLEAVHFRHLAIHQDQLDAVRIAQVLVQREPSVAGQAHRVAALGEEAAHHQLVHRVVLGDQDAWGVRAFVRGRLACSALAVGAAPGTVPAGLRAGRSPPPAGPGPAGAGLRAAAGPGSAAAGIAGGCAGLAPVAHRGCPARSTAVPARAPPGPAGAVH

SEQ ID NO: 17673 - protein, 138 aa, Pseudomonas aeruginosa
RPRGCRRCAGWRCAARPGVRRWATRRRSHSRRPAGCARSRGRAGCGFPRRWRPGAGGSAPRSARGCCAGRRRSPRRDDGWRRPPPRSQSPARAGRGRRGSSPAARANRNGGRPRWPPRPLPRCAGPPPRPGPARRPPA

SEQ ID NO: 17674 - protein, 282 aa, Pseudomonas aeruginosa
MAPLNTMARPRSGSIIGWPEASARSMIFSRRCPRAIGPWAWKPQASGPRGARWWVMRSTAARSAAWLSKRNSPDMPHIFLTGSPLGKWVAYPFRVHDLPNRGPLQLEGVLYEFSGPIRTLNEEFIMVESNKTAADTYSLDIFRAIRRIQQAAEIHSKRLSRYGGLTPLQLLILHVLAVEGELTATQLAKLVSLSQASLSGVLDRLEGRGLLYRRRDEQDRRKFWLHLDPAGHEALAEAPPLLPEYVIERFAALPEWERHGLLAALLRAADLFGLPEEDVEEE

SEQ ID NO: 17675 - protein, 237 aa, Pseudomonas aeruginosa
PRHHQEAAAHAHQSRQQADRQADAEQRQAPCLVAGLAFHPGAAPHAPGRPEHQQAEGDDQHAFRDEAAEPLADGVARQAGQRQDQHRPPGHLALARARNGANQRRQGDRAEAHADGVAQRQVQAEQQGQGDQRAAGAGEAEQQAENGADAQGFEEQYIHRRSTISAGEPAGGPVWPARAAGPKGSANRCARGFSRAARAPGRAAGSGSGGRPRPPRAAAAAARRRSTPPAVRRTAAR

SEQ ID NO: 17676 - protein, 355 aa, Pseudomonas aeruginosa
IFGEPAPLRGAGSGPARRPARRDPRRRVHRRDSRRLHRRLCGAGHQPRAEAAGEPVIAESDPGHPVAGQPGHRPADALRGRQAGGRDARGTDRVPRRHGYLQCHPPRPAARRDDVRRPRRTGQQGRLRLFRRPALVAQLRADGGGDGGGHGAADRHGPGDPAGAAQVRRERAAGRQGSLGAGAVLHLRRRHPVRRQGPVAGDPGEHRRRRADRRPVDVFRLQVAGASRRVVRDAGAQRDQPRPGVPAGDRRRQPAYRAALRRAQARRRAGSGVGDLVLAGAGGWRISARRSCALRHLSYVAEGRANNAACVIRRNSGEPADNRKRLFAPAVDPTWGGLRPGATGACHLPVRGWPR

SEQ ID NO: 17677 - protein, 178 aa, Pseudomonas aeruginosa
SRCRPRAAGRDRPPRRRSAGSPAPAGCQGCRRPGAGGTRRVRGSRCCSGSRRAAWPRPPGRRRANRRRRNNAPAGRGCPPGNRCRGGSARRAAARSRRRRGSARHGGPRRAGRPRGRRPGSAASAGRVRGRSACPARRCRPAGCPSHTGWRRASGASSRRTPGAPGARGGGPCCPGRR

SEQ ID NO: 17678 - protein, 869 aa, Pseudomonas aeruginosa
RRRSPSARLRRAARAAAAPRRGCRGRCRRRCAGRPGSRLCLALAERFVEEEVEGLADGLAQFDGGLPVEQAPGVVDARLAVGHVLVAVAVEAAALHLAEAGEGRELRAQRVGLELAQQFLAELADARLVVRVADVDDLPVAAAVAVVDDPREGLDAVVDVGEAALLRAAVDQADRRAFDQVQDELGDRPRAADPRRIQAVQARAHPVERTEQGEAQALLAVGPDHPVEQLLGHRVDPALLVDRPDHQVRAVFVEVRVLAHAVDLGGGREHHAFAVFHAVADDPQVFLEVQFEHPQRVARVLDGRGDGHQRQDHVAFLHMVFEPLRMDADVAFDEVEMRVGLEPFDGVGADVHAVDLVATVAQQAFGQVVADEAVDPEDQHPRAALRAGRRATQARALDQAQLGGQLRAGQVQAALAALAEAQHQRVLAAGDPQRVAGQYAARLATVVAGDHLGAPDDQLLFADLAEGARVGLGHRAHQVVQLPCRPVPVEQAVRRGAPAEVAGLALVLLDFRQHAEGEQRQAVAQQGTGGLAQLAVQAQGGFLGVDGDGLLGEDRPGVGALDHAMQGHPGLRFAVDQHPVRRGSSAVARQQRTVQVVGAACGAGEQLGAEQAAVVEGEQEVRAQLADALQPQRMVHVLGRVQRNAALGTEACDRGVEGVFPWVVGMGEDGGDLVAGIEQGFDTGATDVVVGEDDGFRGHGVEGSLDEEVKPARCRAEGSAEGVARTTRSMKKRGRARTSLYMRPRYSPSRPMPSNCTPLNMNSTNRPLPAQAAPKARRSTRRNRAKRKPARAMPPPTRLSRRSGVVVMQVTRSNIRLSRRIALYFDSPWARSAWATRISQVCRAKPLARIGMKVLRSRQASIASTMLRR

SEQ ID NO: 17679 - protein, 271 aa, Pseudomonas aeruginosa
YSMSAPREYSGNFMETWGGPGKVNPVGCRKKTAPWRIAPPGGRVDASAAAGDHLQGRFCGAPVDVFQALDVVLAEVAAGLHLDDLQRDLAGVGQAVHGGDRDVGRLVLGEQEGLVVAGHLGGPGNHDPVLGAVVVHLQREARAGLHGDVLDLEAAAHVHRVVGAPRAVDLAVVLGLAAALGVEVLDHVLDVLHPVLVGDHHGVLGFHHHDVLQADHRDQLAVAVHQAVVAVVDQHVALGDVAVGVLGVHVPDRRPAADIVPAGGQRHHAGA

SEQ ID NO: 17680 - protein, 260 aa, Pseudomonas aeruginosa
GLLHHRVVDGVVRAAFEGGGVDVHQVAVVLAALQGQQAGVVDVGVVLLQFFQVAAGAEQEHAAVPVVAAGGDELAGAGFVGLLDEALHPADAFRQLRIGARADVAVAGLGAAGGNAEEHHLALFGGVGGQRQGLLEGALVLDHVVGGKDQQQFVAAFGDQFHRGDGHRRRRVAAEGFEEDRLARQVLCLQLFLDDEAVLLVAHQQRRLHAVEGQALDGLLEQGVVAGEGEELLGVLLAGKRPESRAAATGKDYWDHVVSP

SEQ ID NO: 17681 - protein, 564 aa, Pseudomonas aeruginosa
AVAYRPRRRSPARSSATIRRAPAAARRRRRYRRIAGGGKCSVSWRGPRSELEVEEWRVALRGELQHRGGEQQEQRQAGGQDGQLAEPARLVDQRAARRVGDRRRVAGGLARGARLGTGRAVGGHFVAVRRGLGRLGLQWLVVELAQAEERQHQVGQDQGADLQAGEAGAVQFGELPGAEAEHGFVHAPGDLQVLGAEDHPADHHQEEGERPLQRVEHARRGVHSEGPLDRQPHAVPGAPDDVGEVGAVPQAPEEHGQEQVAVGLEGAAAVAAQADVEVVAQPGRQADVPAPPELGDRLADVGLVEVLHEAEAHHQAEADGHVAVAGEVEVELRGVGQGAEPGVAGGRVLQGEAVVGEGGQGVGDEHLLDEALHEAGAAFGELVDGVGAVVELVDQVLEAQHRAGDQVREDRDEGGEVDQVVGRRGIAAVDVDDVADRLEGVEGDADRQQDVGQHERLHAERGDDLVEAVDAEVGVLEVPEHAEVDHHAEDQPALRGPGAYAGGADAQADPVVEDGDPGEQQEEVHPPPGVEHVAGDQQQQVPVTFAAQVVQAEKDRQEQEQEHV

SEQ ID NO: 17682 - protein, 550 aa, Pseudomonas aeruginosa
TPSVAAAGPCAARWRGHPACARSWLPPRRRCSRRGRAVSAGPGATVRPARWSPCSCRFPSGPGSGPARCRPAPGPAAVSPPAAPPTPGRAAAPRRALPRPAGAGAGAGGGGSKGKCRACPVSSRGSEAPDEVDEGAVHGRVGARPVGVARLEQAAAEADQRRGLVDVLAHRGRQQALLEVLGHHQVEFLADVLLARLQGGVDAAGTDVGVVVDAPELVVDQARVVVLAQLPGAEQGGCLEVAQFAAEGFAEAVHARAGAGEVGAIALQPGLLELLLAVLATAAAAGVADAGLPLLVDVPAQAEVDAEGIDVAALLAGGDAPVVDRGGGQVVAVAGQPGGAGPVVQRHARTIVVGIAGSLDAEPGELAGIGLVEVVDFLAGAAQVAAVVGVVDAHADAVVRRPLGGDVAEHMGAVLVLRSQFVEVGAVFAETLGDPGVGVEQGGLEAPVQRLDVGVLPLAAVFPQALAAEAQVLAGVGGEAGVVDPEFACGEVALVRLATVVAAVVAVVGVRLQGVGLDGVGGGHRLAHESRRSSRPTGRRPRAAGRYRCR

SEQ ID NO: 17683 - protein, 485 aa, Pseudomonas aeruginosa
  UNSURE (476): Identity of amino acid at the above locations are unknown.
QADGALPVVAAALLFALEQLLRLAAFGRRQLRFDLPEQVAGLRYLLLHGELAEDVGVDPVRLDAAALRPELGQGHVGAGLAGAGGEDQVVDGLLRIDLAEEAAAVDLPQVVVGLGFAGGGLEQVPLGLARVLRRPLAVVVEAPEEQFGAWLGGVLGVLQVAEHLFQVALVGIVVEQLGQADPGRGVARRDLFQQRLGGLRVGLAEFAVGEHPGHRVDPLAGHPAGLVGGAQLFEQDLLLFRVALHLVDRGQFVPAHIHAPQPALADLLDLAQVLGVGALGAVEDDLRQVGLRQSARAPLVDALLRVDFRPGLRVLQVEHDERHQGTVLALFEGLAEQALGLAVLGVAGAGLGRQPLAKARAGPRRGLRGLAVELFGLGLLGAVAAGDLHVGEADLGVGVTHRGQGLVVALGGGEVAALQGLLGQALVGQSGAAGGQGDGRGQQQVPGRQGQGREDGHLHGRVPVSERWPGSRPCSXGCGRAGRRC

SEQ ID NO: 17684 - protein, 74 aa, Pseudomonas aeruginosa
SWNTMPIRRFSGARVKPGREMTSPPSSICPASTGSKPAMARRVVVLPHPEGPSRQPMSPALRCRSRSCTTFCEA

SEQ ID NO: 17685 - protein, 255 aa, Pseudomonas aeruginosa
YIVGGPIEQRGVHLVGTEQGDARGGFVFLAHRGPHVGAHQVRAGHRLARVADDAQAVAGKGDELGLRLVALGAGHAQLEVQLQRRFYIAVAHVVAVADPGHGLALDAAAVLVEGLHVGEQLAGVQVVGQAVDHRHLRVRGEFRQGGVGEGADHHAVEHPRHDPGAVADRLAAAELGVARGEEDRLAAELDHPGFEGQAGTGRSLLEDHAQDPALQRLVEHASVAQVLQLAAAADQTDQLFGAVIHKREKVPYAHR

SEQ ID NO: 17686 - protein, 233 aa, Pseudomonas aeruginosa
RDPFQRGRAAASRGCAARLGDLRRPGAGLRRAQRPGAETDPGAAADDRPRPARWRLRRPFRAQAEPGHSARTSPRHRPWAAAAEPGAAPEDRRPAHPGRAAAVRRRPATLRRTAAACVRPVVADRTTPRAQQQFLDAQLPSPGEGQAASPVADAPAGPGGSRPGRRATGAGALAGRQRGGGGGGEQRDDARGGQPAARLGPRAARRATGDRPRPGRRQRQRPDRRASSRPAVG

SEQ ID NO: 17687 - protein, 480 aa, Pseudomonas aeruginosa
WPVARSSPTSTSCRTRKSAPTCRSTRTGRPSRNCGSMANWSVAATSSPRCSRRANCRPWSRTRRPKPTPDPRIRRRAPPCAGFLFCPEKPARKPGASMSEVNPRQGRLACIYFFAMAGLVIGNLMGRIPALKEQTQLDERALGQALLGVGVGALTAFPLSGFLVQRIGSRSVVIGGCLIMLLVFPLLGLSQGWWQLALAFYVLGVSFAGMDVAMNIQAVDVERLLGKPCMSMLHGMYSLGCLVGALSAAALAGLTPFWHFLILTALGLLSLPFFVRALLPPDPSKAGARKGGGFTLPPRALLGLGLLILCAFVSEGGVADWSALFLHSVLDASERVAALGFAAFSAAMVVGRLFGDRLRGRIDDAPLLRGLGSLATLGMLVALFSPWPALSIAGFGVVGLGLSVMVPIVISAAGNQPGIDPVIGVAAVSTVGYGGLLMGPPLIGLLAHEIGLRWALLVLVGLCLLLALRADLVRRRPRSA

SEQ ID NO: 17688 - protein, 86 aa, Pseudomonas aeruginosa
SGRCCAAGHRSPGRAGWRSLPACPAHCAVRRPRHTARWRRRRCSTRRNRRRLPWRGGRAAPSRCRGRISDCRSPRRPAGLPGGCCA

SEQ ID NO: 17689 - protein, 231 aa, Pseudomonas aeruginosa
RRGAVQQQPATGRSVAHRPARGAQPAGPPSHLAGRSPGGAPAAGALRQRLQPVPGLHRQAAAGELRPGQAGPGRLPRRRHGAERRGASQAGHHPATAQGRSEHQPDRTRRALRQQRQPPDQPRPVAPPRAGGAGVPEEQRGAGKPDQRALLRRALPAGGQQQRRQPCAQPPGHRAPVARGGGRAGDGSAEGRGQAGAARGRTCRTEASGRLASGKTHGLSRANDRICRFCV

SEQ ID NO: 17690 - protein, 391 aa, Pseudomonas aeruginosa
LRSGDLHRRPRPGRGSRTGSRQGPRDGRQGNLHRRPARRIRPRLRLPDVPRQHRLRRRVPAGHLHRSSADRQAPDRDRQRDRRRRHLPRRHRQGQRPGPLRAGRLRAEARRQGDRALARVGPAVPREADGLCREARHPDRAPRQEEVAVLDGRQPPAYLLRRRRAGRYLDRARRRHVEVDRFPGKRAGHPDLHRADLPQGRHRRHRRQGHDPGRGAHRAEPRRRDQRHRPPRHRREPLCRHEVPWLLRDPRRHHHAQGPPRHRVDHPGPRSGPPERRADAQVRQPDLHRLLVEPGAPDAAADDRRLAGQRERCSAPEAVQGQRRGGGPQVRRLAVRRQHRDLRGRRRRLQPGRCRGLHQAQRAAHAHRREQGPHAVLTDARRLRWNEEPRP

SEQ ID NO: 17691 - protein, 458 aa, Pseudomonas aeruginosa
PVGLPPPPSRAARCVSERARRPAPGDRPKARCAFAMRSEKRGVDLAKVSRSITGHGSGFVQPGHAGSDQEGTTMNLRHFIRITATLGVAALIAGCGESAPPGAASAPPSVPVAEVVVRPVTPYAEFTGSLTAVEQVELRPRVAGYIQDVTVPEGRLVEKGQQLFLIDPRVFKAAQDAARARLREAEAAALLARTEHERAELLYARKVVARERLDSAIASRNASKAQVDAARAALDAAQLDLGFTRVTAPIGGRVGHIQVTEGNYVTNGVTALTSIVSVDPLYVYFDVDERTYLQALAPTRGREGEQAPRVKVALLTDESYGRSSRLDFLANAADRGTGTVRVRAVVDNPDGQLTPGLFAKVRLETGKPRAQVLVADHSIGTDQGRRYVLVVDEGNKTQYRPVELGPMVDGLRVVRQGLQPGERIVVKGLVRPDMQITPRLAEIDGTPVDLSKTVGAAQ

SEQ ID NO: 17692 - protein, 218 aa, Pseudomonas aeruginosa
NRPSPGALRRGARTRPGRQSDRCRGNPGVVRRPGLRATAANPGQAWSRRAVDQLAQRPGPGAGGCRVAGPGVGDAGPGGERDLPPAAQRNRRGTRGQPAGTGGQQHHAAQAEPVVGRPGQRAVAAGAGTDGGAHRCRVSVARARRHRLAHRVGGVAGAVRLRRRLADPHGGGAGRGARGARGTHAHQPRPAGWADPVGAGHARAGGAVRQADRPRTAP

SEQ ID NO: 17693 - protein, 568 aa, Pseudomonas aeruginosa
DNPGLPAAGRSVPRGAARAAKVARLFQRRGARRTPRPRRLRRPRRGDGRPGRRQTTNRRVGRQARRRRLFPRKYRSVPVRDGGSVMDAESLEMLARSSCTAHPQSFGGAPAESSCKHEHSHIVDSKTHGGGYAGPVSRRIFCSHCRLQRWLDVEAALALAQADVGVIPPEAALEIAKAARLSAVDLQQIADGVASTGHSLMPLLGALQRNCSPSAREYVHFGATTQDIQDTAQSLEMRDVLDETERALDILLDRLSVLASGTRNALMVARTHSIPALPTTFGLKVAGWIDELLRHRERLGEARKRILVVQLFGGVGTMAAFGDEAMLLLESFARRLSLDVPLAGWHVSRDRVTEFVSTLAMVTASLARIADEIRTLNRWEIGELEVGWTQQQIGSSTMPHKRNPEGCEQVVVLARLAKAQVLLALDAMILEHERDYRGTRLEWCAVADVSHYALMALSLLTDTIDGLTVHDETMARTANAYSDAICTEAFVFEMAKQLGKSSAYEIIFEITQACQRKRIPMRQALESDPRVGAVMPKETLARLFEPRTHLGMAGTIVDKVLDKVASHH

SEQ ID NO: 17694 - protein, 227 aa, Pseudomonas aeruginosa
TRPAAGSPAGSPGTAGTAGSSSPPPPGRTASACRPAGYPGRAARAGRRGPAGPGRSRGPSAVRRSWRAARRSSPRRGGLGATEDHAVGGDQRDEDAEDLVQLVGPGLHQQFDAGGQHGDDHDERRQPDRLAHRAAHQRYRGIGAGQHEHGGQAQAEGVDRRVAGAQQRAQAEQLDQARVVAPQAVAGDLAEILFTHVRQPLRGRAGVRGWRRSSAAPCARRGPRRAG

SEQ ID NO: 17695 - protein, 510 aa, Pseudomonas aeruginosa
IAAPGPPGPPRPGRRARAGGRCAASNGELRRPSVACLEAALGLAMAVGARPGVVVDGRRRQVHQQHGERHSIGIAAPGADDVGEDADAEAEDQPPAIAGGAGHRVGDDEEGAEHGRPAEQMEQWRAMGIGAGTIPEQQAHGEQAGEHAQRRVPGEQPAPEQEQAAEEERQVDPLAAGATEVAEGRVAGEQLIDGQAAVGLQHVEGGGVGPGVRPGSEAEEFAEAVGQAEGAVRRGPAGHFQGKRDQRHDVAKHRRVERVLSEAAVQVLAEYQGEEGRHQGQPPRGVRRQGDGQQQGGDQRAAVLEEHPRRTFAQGQHGGFAGQRDEAGPGQVEQGARAVQPGQRQQAGDAGAEHQAHDRRGTVGAAGVGQSGAGQGPWSLRAVFGQGALGGAQARAGGGDCGGVGVRQAFELLQGGAGVGQLGLQLAGARVDRALVDPHQLRRRLAAGVLGGHAGRARRLAARRAGVPARCPSPRPARAFFKSARLPTRAIFARFSAAWPSSPGAAGFGA

SEQ ID NO: 17696 - protein, 215 aa, Pseudomonas aeruginosa
RSRRARVASQRSTSARSSSRVARCSAPGASPKAFSERLSWARAMAAWALAFFSSASSSSAAGGALGRSRGRLASASARALSAASAAARSSATRPCCSGVSWLSNCFSAFFRATRAMLASIFSRFSRSLPLPACLRALARSIAACTGSTAVAGAASSRSAWAARASAAFSARWARSAARRSSSRRRRAWRCSKRSRDCSAFSSFCRCSRISALDAR

SEQ ID NO: 17697 - protein, 180 aa, Pseudomonas aeruginosa
AQAPHSMQSNRLWASNCSCSSPRAKKCSCCGSRLTGQTWAQSPQRIQGMAGTGSGSSVASPASRQLQVLISGTERSGRAKPIIGPPISTRSRRPSARPANASNSCTGVPSSASTFIGRSRAPPARVVIREISGRPRTTASCTAARVPTFWHRMPMSAGRPSAGTSLPVSNWISWRSPPEG

SEQ ID NO: 17698 - protein, 258 aa, Pseudomonas aeruginosa
PARRPDRPGRGSAPPHSRAAHRRPGRSAAARRSPGTRRSWPDQPAEAHERQRHQAGGDHADGRAAERRRHVGDGDALAQGGEQHQHQGKAQPGAEALGSGLEEAVFSLVGVEQGDAEDDAIGGDQRQEDAEHPVQQRAGLLHQHLGELHHHRDHQDEADGAQVLQVQRAQHVALQDMAAHRRQGQDEGGGEGQADGRLDLPRHAHERAQAEELHQDKVVDQDGADQDQGEFSHTRSIRCRAGAVGGNPLLSGGIALQG

SEQ ID NO: 17699 - protein, 516 aa, Pseudomonas aeruginosa
PRSTARPPAWLPTGGIRCLRSRRRLPLPCSAPRRRPGACSPGRSGAARPGAGPPVGVGCAACRLRRSGSPRRCAARRSRRGAPPPGRSGGSGSCRSPPRTPRCRPAGRGWRESGRLSSWEPHSRVEEGGVGIVDEHRPARRQVVVPGPRGVFRGQRADIVPRPVARIAGVGAEIDGGKCAAGLRQLAQVLLRREVGDVADVTGGGEDVEFVGSQQGGDRLARQTAAHRLAEQVGEQLVLDRGGDHHLAEADGGVGALDADCRLIVLGVFVAGLVTLLGEDDRADQLRRQVVLARGRGHDLGPRRRVARIGVGEQRADRLADQRLCLVQLVLRRQLAQVGAQVAERVAVLGDGRRVLVEQLELVAEGNGRQVGRIDAGGADPAERTLDRLAGHPGGAGRGEAQAASGVGEVGADVEEGDGGEVDPVVGLGAQGIVDQAADQGIACLVALHGGAPGDAGDQRARQFRRAHPLEQLDQRAALVECGDGRIGHVVVADRGDHPAGFLAGHLPVVPAIGNQ

SEQ ID NO: 17700 - protein, 215 aa, Pseudomonas aeruginosa
GRALVTRILRGSDMGSAYRLRAKRIGHYKRSGGFFSSARHSGRMTGIDSPLNPQEIPHVRYHSPNGGSHPPPVPAPLSEPGPRQRRLPARGGDPGRPRAGAPGTGVRRRAVQERPGANPANGPGGARRRRSRRGPGRLRDPAAQGTAAGRGDGQREEHRRGGFRQGRRRQVHHRRQPGPGLGPRGCAGGHPRRGHLRTQPGHHVRPAGRHPAEGP

SEQ ID NO: 17701 - protein, 240 aa, Pseudomonas aeruginosa
AEVVRAPGGARGAGDVDGLPHRRQHAGGLARADGLRCPDPTDHPDRLGQPRLPGGGHAAGHRRHPADPGAEGAGGRRGDRHYPAGPGAARREEGRGDVPQGEHPGARRGGEHGGAHLLQLRPCRAPVRRGRRREAGGAVRRRAAGVHAAVDRHPHPGRQRPADGDRRPGKPTGDALPGNRPPCRRAHRSQRAGQRRPAEHQYQRRLRRSGSRRRRLPLPWGGGPGKIRDHFSQLSTGHPP

SEQ ID NO: 17702 - protein, 305 aa, Pseudomonas aeruginosa
RHRGGRLALGAGRTHRSREVRDSLPVRAGLAIDLVVGAPAAGTPQVQRARADAAGDAQAALALHRALQAGSHLRAGDQRGAPQGRPGDAGEAHLHPMDAFTAGRGLPVPGLVRAAPAGLAATPAHDRLPAVRRQYPGDPARRRTATLSRSGQPAAGVHPGLDRTPAGRLLRHGPARAGTPRRAWDLPHRRRPGTAARLAEPRAAARLRATGSLAAIVRRAGPSGRYRRHEPGLGGGGAAGAAALRPRPVRQCRTAGPARLRDAPGRAIARAGVARGAVALARGPGHGGGLSAFHGIVTTAQYRLR

SEQ ID NO: 17703 - protein, 143 aa, Pseudomonas aeruginosa
RRSTWPCSTTCSTAASTSGPWPPRWWRCWARRSSATTGSPASSSRASCCCNWPTPPSPPARCCTSAWCASTRPSCRSASASVISSLARCWWRCLPGCCSAIRSACRPASCNGAYWYGWGCWPPPSASSGGTRAPPRWTPVPWR

SEQ ID NO: 17704 - protein, 400 aa, Pseudomonas aeruginosa
TVAGLLPPAAGDGAGGAGVLRRAPDAAAGYRRGLRAGRGAPRVLADPRVLLGLPGHRAGLSPVLHAAAQDGRGRAVRVRLRDALPAAAGVGRAVLAGRREPGLPRGAAPVAAAADAGADQRAGLRRDDGFQPAAADGAVRDSQLRRTGAAVPGGGTVPRRGVPSRAAMDLRADLAGGAVDRLGQRAPAEETGAAGHLSEPQAPESALAGAFDLGEGGRQDALAGQVVAFPVAAVEVGDADLLAAPRRVHEAVVADVDADVVDAAAADPEEHQVARLQLAAGDLVVVHVVDGAGGPRQVDVIDVLEHIVDQAAAIEAFLRRGAAPAVGGADHAEGAVGDFGSGGRDHRAVGGLAGADDPAGRQGGILRRLEGVGDLVGSQAGRREGGQKGREAYRQACQKG

SEQ ID NO: 17705 - protein, 596 aa, Pseudomonas aeruginosa
PVVRRGLGKPLRRGYVRVPRTRVKPVEASPDMTETAKRPLYVPHAGPSLLEMPLLNKGSAFSTQERIDFNLQGLLPHNIETIEEQTERAYSQYNLCNTDLDRHIFLRSIQDNNETLFFRLLEEHLEEMMPIIYTPTVGQACQEFSKIYRTHRGLFISYPDRERIDDILRSATKNNVKIVVVTDSERILGLGDQGIGGMGIPIGKLSLYTACGGYQPGLHPAGGAGRRHQQPGPAQRPDVHGAGRHEGVSGAHYEEFVDLFIQAIKRRWPNVLLQFEDFAQTNAMPLLERYKDELCCFNDDIQGTAAVAVGTLLAACKAKGEKLSEQTVTFVGAGSAGCGIAEQIIAAMQLEGLDEAQARRRIFMVDRWGLLTDDMSNLLDFQHRLAQKRADLGAWGGQQGDDLALLEVIRNARPTVLIGVSGQRGLFSEEVIRELHSHCKQPLVMPLSNPTSRVEATPQEILNWTDGQALVATGSPFQPVQVGDKRIPIAQCNNAYIFPGIGLGVIAARANRVTEGMLMAAANALANCSPIVTQGEGAVLPALGDIREVSKRIAVAVAKQAQAEGKALHTSDEVLNDAIEANFWFPRYRAYRRTSF

SEQ ID NO: 17706 - protein, 162 aa, Pseudomonas aeruginosa
GSAAGCARGRGVNRRYSARSVREREKATPRWPFSLTVALALSAHDRGASGVRPGFPGFPPRAAPGPAGHDRAAAARDCPAALGRGPARPVPPAPPAHRRRGASGRRRYRHRRGCSPRWPPAPGSCRGARRSRRPSAGAVPPAVRAVARRGAFRPARACRPGA

SEQ ID NO: 17707 - protein, 481 aa, Pseudomonas aeruginosa
AMHLSIFTCNAEVSLVQPISPPRTPAEGTGKPVLQRADAGPGRGHSQGAGGARPAGHGADRQRQDRGLPAAAAAPPAGRGQAALPGARADPPADPRAGPADPQGSRALRPVHLHQGLPDHWRRGLQGAGRAPAQEPGDHHRHPRPPARAAQRRQPAVAGHRGAGAGRGRPHARHGLRRRRAGPGQCLPGRAPDPAVLRHPQRRRVEQGDRRGAARAASAAPEPGRRAERECPPAGHHRRRRGAQGTVAAMAAEQRDLHQGHRLHQYPGLRRSPDRAADRQPAQGLRPAWREGPEGPQAGHRTPEAGRGEDPRRHRRRRTRPGRRRPGPGDQLRHAAQRRRVRAPHRPDRSRRRRGPGDLADLPWRLEPDVERRTLPQAELRTTQHQGTEGRLPGAEETQGVGQGRRQQEEKAGQEGRRRQARGQAQARRAAEGRAVGGGQRRRHGAAQAQEADGGVIARRRPLRRADNRLRLSAAPALDGG

SEQ ID NO: 17708 - protein, 553 aa, Pseudomonas aeruginosa
LTQWRICGGPSPACRAVTLSMTILSARVMRSSMRRCWIQLSTRNSSCQTSGLLTSRNSDQRSAPLRRRRRRSGWAARTKSRVRSAGIRYSMETSTMPRRVLKTKLGCPGMLAGAREILAASISGRRELYRRITEASSRQPAASSAPCTVMVSERWPQRNEPQRQGHGTGRVWNKRQGARLDPVGDEDLHRRVVGGEGADPAAAAEDQHREQDPEVVYQAEGQQDQRQGEAGQANQPAAADPLAQARDLGAAENRAEAEGAEHVAVDRRVAVRVAVRQQRQQGPDRAGGEAEGEGAHHHQAGDGGVLGEAQRRGDTFEDAFRRQAALGHLAPPLPDRPDQGHVAEAVEQEHPGRSHRAQQQAAEGRAGGAGDVVVDAVEQHRVADHARRHLLVDRRLPGRDGHRAAEGDPEDGDDQQHRVEVAEEGQQGGEHRPGHLEAESPEHDLAPVVVVGDDPGEDRQQHQRQRRGDLDHRHHQRAGVGVGDHPGGGHRLGPGAEVGEQVADPDDAEGLDRERRPGAGAFWLGRLAFGFEGQVVLGRNGLEHQMGALYQRA

SEQ ID NO: 17709 - protein, 503 aa, Pseudomonas aeruginosa
CRESLAAWRLGAIDGGHGAGPAWIDIGPMALSESSDVQAGQCPGCPALVGLPAPSRDKSEKPMKLLLRCLLLGAWVVSPSLWAWSNHTVGSYLALRELAAIREAPEVEVEPLEAFLAAERGGLAALLDEQEAYARAHIGNYPARPDALRFAAEGEAGDLRQAFLAALRVNPEIRLALALQPLPGQDQPQRPHLKPQEVLVFQNLSPWTAWRFIRLEPGERVAPLAVLATAADEPDYGHDINLFSDNPGEAGQRYGFGTQPFGDPRFEFSSQAPFHMGFYHEAAVIYSGAPFLARAWPEWRAYQYFGLSRFAFANGHPYWGYRFLGWGMHYIQDITQPYHSTPLPGASLAAMLQMEGKALLGYPEEKQAAIERVANRHTAVEKYQFDWLRQLLRDGRPQPMLDAYADTRRDGAYPAYSPTYLRDVVAAESNAHAAAFDAAIGEWLAARPASAAQDFSESNQPRPEAHDNAVLNAQLIELIGHFGAHSRNIARAALETEEGGAKE

SEQ ID NO: 17710 - protein, 524 aa, Pseudomonas aeruginosa
QEDALALLQLRIEGVQPDRRRSRPGRRQDQQGRCTEVLQVGVQPSRLQAAFDPQPPTLQQCLQAVQGQVVLAGQQGRAVLQQLRQFIRFAGVEGGTERQVDAEPGALARLAAHLDAPAHHLHQLAADRQAQAAAAVAAGGDGVGLGEGFEQGLLRLGGYPDAAVADAVQQALASALVEAPLHAHGDMAFGGELEGIAEQVHQYLAQPRRVAVEAARHAPVQAEMQAQAFFHGLGAEQRQGVGEQFLQVEVDALQVQLAGLDASVVEDIVDHRHQRAAGAGDGLHVGRLAAVQRGVAEQLQHAQHAVQRGANLMAHLRQEAALRLVLHPRLLGRLARAEAFLLERIDAVGEADGQGHQFHGHADLDHAAAEQAEQFAAQRGGGGDQERQQQRAPGQDVVEAVAQALAPDVDAGQQQAEGDQHHRQAGEDVPGAQPHQRLAGQQDHAGQQQAAEEAVEAREVAAGVEVAAAELDRHQAAQVHQQVDAGRLQRHVSGQQLEQQAVEAGGKQAEAEVVQQVPGIGGLA

SEQ ID NO: 17711 - protein, 603 aa, Pseudomonas aeruginosa
RHLAAEGEEKIDEAFGGRLRLVVGQAGALVGFDDHVVGLVGGLDQEVQAHHRYFQGPRGLDRGLAEGRMEGVGDVLEDAAGVQVGGAPHGQVFAAGQHVVVAIAGGPQGALGLVVERDAAFPAGGGLAPAALRLDQLADAVPAVADHRGGTTDGGGHHLVANHQHAQVVAGVVALQQHARIEMAGGLDGLLDLFRGAQVHRHALALLAVHRLDHQRTVLGEERGVFLRAAGQALLWLAQAGVLQGAVGEDLVLAEGHAYRRGQVGERFTAADLPAALGQGEQAALGVVDAHLDAAPVGFVDDDPGVGVEVFLRAGAEEQRLVDAVIALDGEGRQFAEAELAVERLGLVVVVQHREVEVSQFAAHEVLDQVPYQRFADARPAALRVHRQAPEAGAALRILERLGVVEAHHRAYRDASVGVLGQPVDRPALVARAEALGLHRKHAARQVQAVDRRPVLLGMHPADAETAWRTARRAVVGEPQAQGIRGIEEELLRGVGQDLLRRRHVERDVAFAGGFLQQVAGQFLGVRVGLPDQQAAPAAVDAQRFLGGLAVIFGETRLEAFVGGRLDTLQALVVRVRQMQVAFHDRSWFGPLRWGPIFKVPVR

SEQ ID NO: 17712 - protein, 161 aa, Pseudomonas aeruginosa
PSARSWRGRPPATARSLRARRCAGDGGGCDSARRSGRNTGTRRRARRRHPRSRWRRSAGCPPRLRAAGPPAGSNRPRRRAARRPRGRRAGGSPPLRGGRRGRAPASRRASARARPGVGRSPASTRCAARSCRRGRRSSRSPAAASSRPPARCAGREPRRGS

SEQ ID NO: 17713 - protein, 488 aa, Pseudomonas aeruginosa
  UNSURE (441),(451): Identity of amino acid at the above locations are unknown.
IRKPPPETSAITAIEVAVAAIIDSGVNQSSPGTTRKPPPTPINPDSKPTARPMPSSGRLRAWSLASRFIPAPRHMRQADQSTSRQKATISTPSGTKRPSHWPTALLGRPASARTSTGRQATWPWRARGMAPISADRATAPRLTPMASRSGRCRLSSRGRATSEPPAPVRPSSRPRTAPMPRDSKSSTSIVDQLFPRVSQPVVRYGLRVRQARRVAQIGAPGASAALPAHQVAQQEAVRVAGLGHRARQRQRLAADPRRQQFAGQRRADQPARAVAAVQVQAWQPGAGTLRHLAGVAGEHRVDLVEGRALGQRAYQGQVVGAGAAECRAAFQALQRQVVGAQALQQVGGYFPQQFEVALVFGEGRRQVFALEVEAGAEGVFVATRRCDVALGADHGAQRPALRGGRQAGDLPANALQRQLGGGREVADVGGGGEDREWRAGXAFVAGVGAPXVALAAQAYCPAAQQGDPGGGGHGLAHRGRMDPAGFGI

SEQ ID NO: 17714 - protein, 286 aa, Pseudomonas aeruginosa
TPSWTGRFMHRGGKLLLRVRLGFGLRCGTGLGLRVRLGRILDAEQFHVEDQYRVGRDRRARALRAVGQLAGDVQLDLLADVHQLQGFDPTRDHAADRQVDRAAALDGAVEDGAIGQAAFVVDGHHVGGLRLRAIGLLHDFVLEAGSGGGHAVALAVFLEEFLAGLGVFVADGGHPLLGTFLQEGEGFGQLFIGELLLLLAEGVFDALGDGFRIQVVHAFLGQALAHVQADTIGSFLRRGLQLNVGLRIAAGENQTDQCDRCCQPMLFHAESFNLFAARAYSMKPRA

SEQ ID NO: 17715 - protein, 315 aa, Pseudomonas aeruginosa
QGKPMRALTALSRFVSASFPFWVLLFAILAFFRPAWFLPLTAAIAPLLGLVMFGMGLTLKGEDFREVARHPIRVLIGVLAQFVIMPGLAWLLCSLLQLPAEIAVGVILVGCCPGGTASNVMTWLSRGDVALSVAITSVTTLLAPLVTPALVWLLASAWLPVSFAAMFLSILQVVLVPIALGLLAQRLLGERTRQVAEVLPLVSVFSIVVIIAAVVAASQARIAESGLLIMAVVMLHNGFGLLLGYLTGKLTGMPLAQRKALAIEVGMQNSGLGAALANVHFAPLAAVPSALFSVWHNLSGSLLAALFRRLDDTPR

SEQ ID NO: 17716 - protein, 173 aa, Pseudomonas aeruginosa
GSGSPRFRRRAAIPWRRSGSASGRPRRGTRTRSCPPASARPPGAGRAPGGGCSRTGRRCSSRASTPAAPPPLAECRGWPGSRRRPPAPPRWPPPPRNAHGTSARRRRWCRPGSPGRCPSPPARCRRPVRPRAGAGAGSNTSPGQIAPSGCPWRTARRTSAAGCRRRSRQRRPA

SEQ ID NO: 17717 - protein, 129 aa, Pseudomonas aeruginosa
PPPPVPPAKADRATAPPAVRGHGPPPTAPARPSALLAGGRGDGTGRAPSHASGSGFPGCRHARPAGGASGRRRVPGAGRGSRCRRSAARRHDGFPARRESRRSVPFPGSSRDRANRHHGPWSRCALRRG

SEQ ID NO: 17718 - protein, 917 aa, Pseudomonas aeruginosa
QAADQIQRIDRRHHQHRPVRRSLAHLAQQADRFRQGELLAGQAGDEAPAANLAARFQAMVDAQQLAPRRQPVGFALQQAPGDHPIAPQQGPGDMFENLRRQTLPRLFRLRPAQRRPAPGVLHAARQAARAALLAAALVRRHQQGAQPGEAVGVDPADRDQLAEGVLQLAAQQVGILAQFVEERCTLLAQHLQYPGRARRQFRLRRVALQDAPEPQLAARQEHDRRAAQRTAGGLAASGQARPDDASGTAQLVQPMAGVVGHPRCQQFAFPGGRRGLEAFQLLDHRSQGLRPPATGARRQALPVEQETHEIGALHRLDFPAQALHRIAMDARQQMAFAPLLFRRARTEAATQHIAFALQGGQRVLLVGQADAQVGRQLPGRAWPEATQAGAGQLHGRRFRRVRRRIAARRLESVGYLRRGMHQAHRRQALRRQPESAACAVQASGAALLRQLRKPFPPARIGLGLARGEEAQAVQRLMHLVGVARFRPGLATHRLDRLKVQGAEVVGGLGIAPAAILYRLGTPLLQRRIVEIGVGTRGEYLRRQRRRRRQVARQQVHRAALHVAQQGQPALAIHRLVQAVVKGLRHQRVIGHLALADDILQARHLVGEHAGQQILALHPQQLRRHLATAGIARQTERGGQVPAPAHAEQRRVEHGLYQQVLGARRMQVAPDLVEGKAVAGGQREDDRVFGGRRLQLEVEATAETLAQRQAPGAVEAAAVGTVDDQLHAAGFVEEAFHHQPPAPGQATQGLAGAGQVLDDLPRGAIVQPEGGAEPGDGWLQPLPFRQCLAFAEQLVEGVAQARHAGRQLVAAPRRLTQPERNVRRLALGVLDPYPSRLDADDPVRGVAQLEHVAGQALHREVLVDRSHQQALRLQQHAVVAGIGNGPARGQRGQPRATAATEQAVERIAMEIGAAHAEA

SEQ ID NO: 17719 - protein, 709 aa, Pseudomonas aeruginosa
MPRANPDMPGRARGSGEQQDAELAQDQGDAAGNQQVGGAIETPAVQLGEGTHVMLQDEHSQCHQDRRDQEDELPEVFDRQRRFAVVREQQGASQQLAQQQQPPDANTGTSPADHQSLPERFRGTSIARCRHAICALGQAGRPARTSTRQFHDAGNILRKRAPPAGRGPSASEHVLQAHHQAIAAIVAVGIADLVGLRLDVVGGNLHRLVGIPVDAQGMGLALGVADLAGGAVDDDVVILDLDRVVAVEQLPGADFLVLRLDGVELGAVQLVEARLAGEGVGQLRVIAGGLEILAVALGLDRAPQVLGLGREGTQRPGAFQAPDRVVLPQPLDCRTAAEQTAVAIAAGIVAAIGGDAAHAHARADPGIHRAVLQVAIGVLQAQVYHVARLVQRREHAAQVVALDAVAVGIVVVLAEHAAREESHAAHHRAGLDTGTDVVVDPVGDVVGEVALQRGDPFGAGGLFQAEVGVEAAELQVDRVEAGIGDRSFVKVAGAVVADVARQVVVDLVLPVPVGGAAELQVGAAEVGGIGGIAVVRVIPVEAAVVGLQAAAELEAEFLVGGGDFEAALGLDHDVGTVGGHGPGQALRGNRQAQQTPGNTAPHPFARVSANHQVSPLFGFRMVLSSAETAGSIAGRRCWRGIIWMGCDSETAKRESFCDRQPDSAWMRPSDKGAGLEASGPGDRCNSLFHILRQPCEDCMTAMKTKSFCR

SEQ ID NO: 17720 - protein, 150 aa, Pseudomonas aeruginosa
GCPGRASPPARRRHFRNTPRRRSGRSFRPTRATTAAAPPAPRPPRSGAARGDRRMATGAGSAPAPPDRARPAGRSARPAAPSADGSAPGDGPASDRPAARPVATTTRPAAASRQAPRPATGPARPTRSEPAPAGRADRPPPRGSRPAASR

SEQ ID NO: 17721 - protein, 147 aa, Pseudomonas aeruginosa
PEGTFRRRAFMRPMYAVAILFLLAGCSSVPAEKTRAIPAERLLGYQQPVSGGGRLEVHRDYGYLGGGCYVAFLIDRQVAARIGVGEEASFQVPAGEHVVGIGIDTQDDTLCGKGLLNRELRTRIAADGNARFRIVSEASSGFDIRTE

SEQ ID NO: 17722 - protein, 110 aa, Pseudomonas aeruginosa
NGPRFNPPAPFTLNLLIAAEVWLYPPIGVDTISGPAWHACKNKKPISKAISQTGVLNPFAFKSFCMKALSSENTFYLDTLDAPGCNRLLRPRPGRTGGNAPATGIFFHYI

SEQ ID NO: 17723 - protein, 673 aa, Pseudomonas aeruginosa
  UNSURE (251): Identity of amino acid at the above locations are unknown.
SPRTYGCNPSPAPPTFSGPLLATPWQQGGPETRGERPNAAPVHARLVPAGGKAGAGGLFAQPLGDEGIALVEVLQALAVGGQVRLDQMLEQAFLAAQAMLAGQHQVFAAVGFGLAPGAQGSDLVRFQAEGRLQRRRLVGLVMTGQRPRPAVAVQPVPAGNRGMQVTALPGIEHVADRHEQARLVETQYAAGTTLVPLGLGAAAQVLAQARQRPGAEQEHQVAAAVDAFEQFVQPGRVAVFQAQQQRALVGXGGLRGLLQQFEQRRRIALPRMLGEQGIVVQPGGIDQYIDVGLQAAIAGALPQLTGPMAGVRRHSTVPQRSASAWPLFFACSKHSSQTRLPPRPVWPRPASGGAPGAVLVGHARHPRHLDRDPRAASRCAACIDPCQRAADGDAACVEPDEAAAGLHRQFAVSLDHHLLPGLQVDLAPGPGQVGTTELHVLAVADRQVVIGLQLDLALSVHGVMLLGLELAVAVRLHGVVAFVADADLLVMLDVLVPVALGMDEDLFLALAILDAQLVVATAARAAEALEDAAGLVRRQLVGHRVGGVVDAAADQRLVGIAFEEVHQHFHADPRNDDAAIAVAGPTAGYAQPATALVVALALAVPVELHPDPAVAVAMDFLARRAGHHRGLAAQHARLRVLQRRAEEHLPGRGEEAVAVALLEIVRAGRRVGR

SEQ ID NO: 17724 - protein, 147 aa, Pseudomonas aeruginosa
RGYSFNHSSGVARTNPGYTRLASWPLTSFSGTVMASSTLPLKRFCRPCQSLRISSTRRARRSACSFQAARLRSASAARAAPSRGRLSPCSTQLSRLARRMSSTSASTRPSSRYSRPISVCPGSLARRYLAGSASCCNSSRCRARRCW

SEQ ID NO: 17725 - protein, 170 aa, Pseudomonas aeruginosa
LRKFFRHQLRRALEPSAWRCSSKPRQRLISAAKSESGSFHCACAWSAACCRSTGRSRGSCTDSALATVNTSSRLPCWAASSSMRPSLGSIGRRASWRPSGVSWPSRLTADSSCRRVKPSLIALPSGGSMKGNASMSPRRRCSICRITAARLVRRISGSVKAGRALKSSSL

SEQ ID NO: 17726 - protein, 516 aa, Pseudomonas aeruginosa
ISSLSLFAARHSRAARAQGWRFSGTKPRTLLECAGTRPPGTRNEHARRCLLAPRQRRNPAVHPPLAERNGRRRGDAVPRHGRARRSLRASRRRAERCRLPLLCDRPARPRPDRRSRRAGPLRRPGRLGQGGRRPGQPEPPYPPAAPGTADLPAGPQHGQLHLHGLPAAPQLQPARGDPFRFQLPAASALPDRPPDRPLRALAPGAAGQERADRLPLVRLVQQGVQAQSHGLRLAQSRSAGSRQVRGRPAVRLPLQQPVVGGPARRPGRYHPAHPPTADRCRPAAADHRRRTRPGQPGQAPGRPGRRPARCRAAPGDPEDLSRGPSRAVQREQPRRGHPRPDRLAGTGPAPPPGSFDKGENMSQVQNIPYAELEVGQKAEYTSSIAERDLQLFAAVSGDRNPVHLDAAYAATTQFKERIAHGMLSGALISAAIATVLPGPGTIYLGQTLRFTRPVKLGDDLKVELEVLEKLPKNRVRMATRVFNQAGKQVVDGEAEIMAPEEKLSVELAELPPISIG

SEQ ID NO: 17727 - protein, 441 aa, Pseudomonas aeruginosa
AAFPTVGPSGPADLPGRRALLYPVRCLTSIIRDNRRHSTARNPLPGIGAAMDLRLLLLSLTTFAAGLAESILIGILPPLAEDLRVSISLAGQLTTLFSLGFALAAPLLGWLTRRIERRRLLLATLLLFALSNALAALAPGYLGLLLARLGMSACCGLLIVLASLLAAELAAPAQRGRAIGLIFMGISGSLVFGVPLGVQISDWFGWRWIFAGIAVYSLPLCLLLWRYLPQRQAGDLPGREGYLRQLRQPALWLAQLVSILLLGGHFTLFAYFTPYLASMAGIRSPSEISLILLLIGLAALSGGYIGGWLADRLGHRRALRLVPAAFALALAAVPLSLGSIGFLPVLMVWSAISWMISPVVQSFLLRSDPASGSAGVALNTSAMHLGVGLGAALGGLVVAALGVAATPWVGLALVLAALACALGASTLDGATQALPFSPPAR

SEQ ID NO: 17728 - protein, 226 aa, Pseudomonas aeruginosa
PAGRPRAPRARGSRRATRSMAAAGGPGRNNGRRRQGRRTRPPGAGADAPRHGCAGSAVPRAFPVPGATARRSPAAHPANAGDSAGRRPAGSGVRRRTGPWAAGYYAARPLLKPGKPGLHFDVDQLSLARQLVRLGALPRLVSRRLVPLVAPRVRLAALAALATAVFLFQPAFLVALLAQGDAIAARASLGRRDRRRGRTGLGRVLLDGDRDQALGDRRKHAGNLSG

SEQ ID NO: 17729 - protein, 328 aa, Pseudomonas aeruginosa
SDALRRLEDDRSRGRGKRGPIGVPRPHRAERAAHPAGNPALQLHPVPPRQRPSVRRTDRSPALVLPALPHSRTPQPTAPVLALGPRRRPRPADRPPVAHRPRSRRPHGAARPAGRRSGPGQDHRGRPDHPSPVALRPRRAGADPGPGKPPAPVVGGDAPALQPAGGPVRQGALRRKRCQQSLRGHPVGPGRPGVAEGRRTRPGRPVRRRLGPAGGRRSPPPGLAPGPGQRRIRAGRATGGDHSRRPVAHRDPGATRPGQPLRAPAPARSESFPRPRSVPPGERAISSGRRSGAGTARPRQSFRRRAQGHPRLPRQRGRRAAGQRRGRR

SEQ ID NO: 17730 - protein, 501 aa, Pseudomonas aeruginosa
ARPRRRLLRRRRVRRPGADLLGNRQRRPQLPVRPPSGAVRPAGPPGPARAAHRPPRPDRPATHHPVARTAPGEQRPAAPVPVVSPGAERLPQYLPHRQRPATRVRPAPAAAARRRRGQGLGRAARRRPRPSRSPRSGAAQRSRPPARAELRRRRRRRGAGGGHRGTGRRLRPADLHGAPVRRLRHPQRRPFGKCPDPQAKREDARRRLPPRRRRRRDHHLRPCPGAGPRGHAVPHLGTSDGSGRHGPGAVRLDGQHLGGADQEQGAEAWHRAARTPVRQRGRGTARPPARPLAAAAGPALPARRQRQRPGRPGIPGNPQRPVGKRATGQRQQVRPGPARCAGQAVRRGRGQDRPAPRGTRGQGQAAVRRRHGRGTGAPDRAQGGQPERPRQRAGQPAHPARGRPGPARQGLPAPRGDPHPGRRLTPGNGCAKREAMGIPHGFFHFISSEGHNGEWPRGDRSPRSPAPAGPRARRRSGIATIALRLIDLRQRSAGREGLQCP

SEQ ID NO: 17731 - protein, 659 aa, Pseudomonas aeruginosa
RPGQGPREGRGEQRRRRHLRSRLPGARQRGNRRAHRARGPGQRCRRGGHGHPWSSRHAPPDARQRGGRPDPRGFASGPAGPRQIRRKPTKKAVGGILHGLFSFSPRRSLGCPGRAATGEDVQRRLVQRSLYVQQAEHRVEQVVVAQVLVVALAVQATALDAPVAQRLRGEPHDHRHVDLRLGRDRIGRRVQVDAILAQRLAVVGHVDHRRIALVGIPLEQFDHLRQEVVGIEDGVVVDVHQLFLAATAELVGPAYRLEALHLLRVALVVLGTVAAIGVQDDDGVVLQAVDVLLQAYQQRLVQAVLAVAERTRLGLRDVPVGHPQAGALAVAVVLQPQHLHAGTLENVQQAFVGLGLLVAVVLARVLGEHAGHRDRGGSAAGTDLGEVDDVLLAQLRVGLASVAVQREMIGTGGLADHEHQQRFLLSLQRSRRLAGVQADRLDHQVFLDHQALLGVLAHRVDVVGRVDEVGQLVFLAEDRGVGGIEAAYHYRDDQQAAEQRQDLVQQAAEERPVAYRPEPDQQRRQDTEQQQIAEQGRVDQVAGLGGVGLEDVLHHHRVDADAVAAHEVGRAGRAQGDQGQGRLEQRAEGNQGQQEREGGPQERRERGEEREALQALQRHQAMQGLPGRRVVEHHQNQREQHHQPGRTDSRQETLDTPTH

SEQ ID NO: 17732 - protein, 203 aa, Pseudomonas aeruginosa
RLSAICGARICNGFESAKPPASAGATRLASTPARSASATTSAITRALQATIIWLQTLVTCPAPTSPMRVRRWPSRERTGRRRSISAARPPAMIARLPLSAPGVPPETGASTQRTPQRASSSAAISRVAAGSALEKSTSNCPGLAFSTMPPAPNTTSRTAAVSARQSIRISASAASSAGTSTAFAPSAASNSRLPGERFHTASG

SEQ ID NO: 17733 - protein, 362 aa, Pseudomonas aeruginosa
  UNSURE (295): Identity of amino acid at the above locations are unknown.
PAASSRRHMGTPIRPRPAKAREGREADMANSNTQRMGTGSAILPARRRRATPRRLPKRAAHHYTPRVFSAIEPENSPMLKRSLALAAGIALSLSAALAHAETLKELKVSAIPDEAPTELLRKFKPLGAYLEKQLGMPVKFVPVADYAGVVEALAADRLDMAWLGGFTFVQARLKTGNAIPLVQREQDQQFTSKFITADPQVKSLQDLKGKTFAFGSVSSTSGSLMPRYFMQKDGIVPEQFFSRVAYSGAHDATVAWVQAGKVDAGVLNASVWQKLVDSGKVDTAKVKVFATTPTXYDYNWTVRGNLDPALAEKIKQAFLALDPAKPADKEILDLQAASRFIETNPDNYKGIEESARAAGLLK

SEQ ID NO: 17734 - protein, 581 aa, Pseudomonas aeruginosa
SGCAPDASPSTCPPAKWTAPRWTPSTPTNNCRPSAPARPANPPWCTSHDAERRFSAARPRRPAARAVDPGRVAAAMAGGAPQRTGYPRPVQRRQRAHHGRFPRRLLAAGTRSRVPRPARPRHPGNPRHRHRRHGPGLAPGVSRRTAGDPRPVALGTAARRPAGLVGTGTALAGARPADPPAQRAGNRLGAAVRPRRGPRAHRRGVGHRHHLCRHARQGLRGNLRVGGSAPHPRPAAGRRIAAGGVRLRGAAERRRGNDFLHCLSLGVRDPCFGGDGLRRRRRPRPADRPVAADVRRRRGCQHPADLPPAGPPRRPAEPLPAREAGMSRTWRLLLWPLLVVPAVGASFAYLDMDTAGLFSGKGLGQMAAYASEFFPPDLSAPHLRAIGRGLLETLAMSAIGTLLAALLGLLFALPAAGRFGVPAQSLARLLLNALRAVPELVWGALMVLAAGLGPNAGTLALALHTGGVLGRLFAEALENTPAQPAEALRLAGSGRLAAFAYGTLPGVWPQLVAYTLYRWENNIRMASVLGFVGAGGLGQMLYFSLSLFQQAQAATVILAMLVLVLGVDSLSAWARQRWVSQ

SEQ ID NO: 17735 - protein, 283 aa, Pseudomonas aeruginosa
ENAPPRPFEEIYEARRRSGIIGARSHQGGTPPPGVQGEEGTMRKPLLSALLLGLLALGGCSLPQHQAGAPTEQRLGTQWGEGVASPVTSVALRRLSEQPVDRRQVFYSASRFDGRAIKELPLAKGRVGFAVLDEDGGKFDLVQHRSTLQLQGREGQRYRLWLNNLGSATYEVVATVDGLDVLNGQPGSLKNRGYVLEPGESLVIEGFRKNEREVAAFRFASPDDAYASNSAAGDSRNLGVIGVALFELDAPASGREAPADGPQAFPADARNGGGYAPPPRYRD

SEQ ID NO: 17736 - protein, 102 aa, Pseudomonas aeruginosa
RRRPARRRKTRPCSSREATTTRPGASTDTSTIRWPAAATASSRWFPWQKLHMGKIDAYSCKQADGQGVCTRWDTYMAKEISYGFVLKDGKWILNTLYPVPLD

SEQ ID NO: 17737 - protein, 769 aa, Pseudomonas aeruginosa
GAGRPRRPPHCREPARPSGSEGQRAQAHARVAEAGATIFHATAETPQEAVRPLRADAEVVPVAAAAQRIADFPALSRRHVDGTPLALAIDVVLDRQLDRMAATVDQLHAQVAEQRLVVDPHFRQRRLALRQVAPQVAAKDPEETVRTVHFQVVVAAGVALEAVVQALARADGVAFRRVLAVEQVEHLEHRAGLAGVGEGQAQRISAAAVARMHAQLVGQGAGRTDAHFLLGHGGHRRRLRLRQLDLAGDDGVGLAGVGQFGERLVVRVGEVERRGQVAADGTTPGTDIRLHDPEALLQEADHRGVVEHLGVDPAALAPRRDHVHRHPRAEAVGLVAITDIALGVPFEGGVGGGLATQRAVLVQARRGRRGDVVEEAVVLVEHHQQRGLAPDLRVGGQRVEYPGSVLGPPDRAGRAGVFGVLGRGDDPGHLRQAVGQHVALQRIELPGAQAVDDQRRVRRRGTVLAEADQRVVGEVVGHVLVDPPGDAGSLQALGIGGPGVALLHRAVAVVVVGGYRTTVLAERVVGAGPEEQPVGVGAALERAVIGVADGEGVGHRELEGDVLLLVVAQGTLGLGRQPLVHAPFVPGLLGVRPGVRGAVDALGAGGAGVEVVGQDLALAALLVPDPLAIGQRDRHAVAEAADALEGAEIVVEGAVLLHQDHHVLDVLEVAMPAVRGNRQGRLDARRQHAGGDGGADRTGGQADEASSAFRNHRGTHQVRVWHRAAERIHDARRLTRQQAVRTPTTLVREKDALVSTRFATTIHANFITI

SEQ ID NO: 17738 - protein, 336 aa, Pseudomonas aeruginosa
LGMLILLLRPLPLEQSFCYPLREWKSIVGTPSMQQIHDLRRIDLNLLVVLDALLSERHVSRAAQRLAMSQPAVSHALGRLRELFGDPLLVRVKSRMQLTSLALELAPKLQASLDQVRGVIGGPTFEPVRSRRHFRLGMSDYGAWVVLPALLRQQQALAPGVSFGIVQEPRLETARQVAEGQLDCALGVFPLLPEGVRARRLFEERFVCVCRRSLFDRPDGLSLDRYLAARHVRVSLQDNPAEEVDSALEKRGLRRQVALTLPHFTVAPALLAGTDLVLTIAERTLERLRLPEELALCEPPLAIPRFDYVQIWRGDAEREAAGAWLREQIQAAARKI

SEQ ID NO: 17739 - protein, 299 aa, Pseudomonas aeruginosa
  UNSURE (131),(145): Identity of amino acid at the above locations are unknown.
RQASLERAMSQGAWVPTPDDLDHFRQVQRLAYTCCETIHGELRAGISEREAAALMKTWLQDHGVDDWFHQPFAWFGSRTSFKGFDGLRHLGGFNLAFYPGKQRLEEGMPFILECAPTLGAYTADVGYSGAXGHNLLQERLMDDLXIHRRTILDLVRERRPLAEVSQAVDRLCVIQGTLPRHKAYPFEVLAHRVEKLGNRRGPSVARFGVRNLYTLTRNALVTGKREGWSPLWSSGKRSEHPPTPGLWAVEPHLGLRGVGAKFEELLVVTEDDAYWLDDDLPHVRRWQARGLLPQAREAA

SEQ ID NO: 17740 - protein, 144 aa, Pseudomonas aeruginosa
SRRTSRGTWSMSPPGVAFAPSRNYPAYATSKAAVLMLSECMRAELAGRSIGVTAVCPGFVDTGIVQATRFVGMDAERQARRQAKIQRFYKRRRLSPDTVGEKLVRAVERNKAVVSVGSDVHLGALQWRFAPWATRFLARFDLTS

SEQ ID NO: 17741 - protein, 298 aa, Pseudomonas aeruginosa
EPAMSEFHHKLVQRKVRFDFSDTPLHWVPGEAEASQVMNVLHMLLPSGELWFCRLYNKALPLVSDARLRDDVQGFIRQEAMHSRAHDGAIQRYLSRFDIDSKPFTDKMDFLFERLLCDYPLGQNRLTRALDGWWLRQRCAIIAAVEHFTCVLGKWVLEARELDRRGSDPVMLDLLRWHGAEEVEHRSVAHDLHVHLGGSFVTRQLTMLLVIAILVYLLADGTCTLLDQDPSLRGAKRQGFLRTWWRLGKQGLLPNLAHTFRDVARYFNPWYHPEHEANTQEALEYLANSPAARRAANA

SEQ ID NO: 17742 - protein, 245 aa, Pseudomonas aeruginosa
EKLPYRSEIKERKTSEKRVGKYALRARLRIYPACGNSLARQRDLPFRNDDLVDQAVLHGLLRVQPEVALGVGTDLFRRLPGGFGEDPVEAFLHPHDLAAVDLDVARRPLDATRRLVQEEAGIGQRIAVFLVRRGIDQRAGAGNAAGTDHDDLRCDEADRVEDHVAGFDVATRGIDEHVDRIVADRGEDVQLLDDVLGHLLVDPAGDEHLPDLERVLHQLGADGAVGVAAFAVLVIGFHATSWNCW

SEQ ID NO: 17743 - protein, 392 aa, Pseudomonas aeruginosa
PGRAGHLGLRVRRAQRRAGGFRIRLRCVRRRLPHGRRGAAYRNLPARPGGGRRAPPRRTRSAVGRRARGTDPHPQRHRPGIPRAGYPAHAVRRAGGAHPATHRAAGSRRRHAQLCRAGRQGPGRGRRPARSGCEDRRAGSATGRPRSPPAAGDPRRAARRRRLCADQSRPSPGARPPAAGRLRRPRGAGGRTRGDTRREPRRDARAAPRTPAAEHRRPAGGQRGARRPGLCHLYLRFDRHAQGRHGRAPLGGQPPELDAASLSDRRTRRASAKDSGDVRRIRLGAVLVELHRRPPVAVAARRREGPAGNAAEHPARRGHGHPLRAVDADAVPRPARRRPDRPRGGKLAAPGVLQRRSPRAVAGHALPPAVRRRRATGQPVRTDRGHRRRVRP

SEQ ID NO: 17744 - protein, 309 aa, Pseudomonas aeruginosa
MRQRQPHAGPDRPADRQPAPVRPRPRAQAAAPRRRRRAIYRRRRRRPRLPEPAGVERRALPRRPLRRRRPSLPYRRPGPLAGRRQPRIPRPRRRPGEDPRQPGRTRRSTRPPRRASRRTRRRGRGTRFGGTRHAPGRLLRGCGGTRPRSIARRTFGDAAGLHAASLLRAHRQPPAQRQRQARPPATAGTAGTGGGGCAAHGDRGRTGGGVGRCPRRGGGRRARRLLRPRRRLDPDAAHPRRRTAARPGLRTRRPDAQPDGGGPRRAPGASARGAKLPALRTGFRSRQAAPGRAGGRLPDQPAESRPALP

SEQ ID NO: 17745 - protein, 291 aa, Pseudomonas aeruginosa
LDRGSRCAVPPGARRTRPSPLSAQRHPADRRRRTEQRLQLRQPACPRTAVATARLPRLGRNQLRPAGQRDRHAQRRHVPAHRQRRPRHQPQPGRADRRDLRRAPVAPRRASRRSRRLRLPRPSPRRRFPARAAGRRRQPVRTPGRGAAGQRRAGLRGATLDLSRPRPCGALRGHPPGPRRRAPRRCDRSGAEPFAGDDRDDLGHPARRPGLRAAGRQLSRAAPGADPGDRTAVPGGRASRARPCRRGGTGAAGRGTGRRHQARNLRRAAARRAGHAAVHLRFHRAAEGRRA

SEQ ID NO: 17746 - protein, 373 aa, Pseudomonas aeruginosa
PSDVGQLHPVAIARRQRRTGAAHPAVRAAELRHGLPGDLLHAVRRRRAATHLQPRADGPLRAAACPRTPPGPARAVALRRPATPRRGLQRAGRAPRRPARGGVLRRAVAHHRRRPRVLRGDARAAAGEPVRPHRDAPGHLPLAERRPGALPGPAADRPAAGRGRGAGARRRAAPGTGRRYRRAVLRRRLPRARLPPRPRTHRRALRRTSLAPRRQALPHRRPRAHPRQRRDRLARPRRYPGQGPRLPHRAGRGRAGDHAPGRAPAGPARRGGGGSRAPGQRCIPRCLPARRARGGGSRRTEAGTAQRTAGTHGAGTLRLGRRLRPHPQRGSATTPPCAHCRWSTGRTSSTWPRATTTSAPWPDSSASCWIVPG

SEQ ID NO: 17747 - protein, 765 aa, Pseudomonas aeruginosa
PYPRPGLRLAAVPHPARATDPRHRLRRPGPSARPAEPGDPPREPAAGAAGTGPRLPYRTGRERHRLPAPRRRRRRHRALQRRPRSARRRADRRRRLQLGDPRHHDRPGASHRLALRDLARHAGVPPSEGDAGLRRPLLGPWAALRSRRHRRRQRLLVGHPQHAGRTGEGLARRQGGHPAPLRRLGRRSAGGHRGDPGGRHQQPAGPGPTVPGALGRRPGDPARRCRASDADQPRPGRRHRHRRRRGAGPLPGHHRRPASRPARLREPPSRPRQGDGRDLAGAEPHRAVGASATHRRPRSLLPLRSGANLRPAERTGTDLPRSRMMAEIRRPLSAVERWYWLSDQFSALNVISRVRVHGRLSIDDLRRGLDALQARHPLLRARIEHDAGLDPRWVPCERPIPLREVRGGGEEQWLREINERELPERIDPDSGPLIRTVAIATDAGAHDLLVVVPHIIADGTTVLTLAEQWLTLAADPAAQPWTASALPPAEDLRPRRFTGDEGAARLAEQTAQDEALVGRHRPGRIEPSNPVPLEARRTRLLHRELDGAQLEQLQRRAREHGTTVHGALTAALAIAAGHDHQRRPSHIAIGSPIDFRDELEPPVRPDEVGTYVATVPVVLDIARPFWEVARALTDDLGERRRQGHHFNLVTLVASAAPRCMADARPFMAFMEAEGPINLCSSNIGRYPFPERIGALRLSDAQFLTGISVNGYFVAAINSSHGRLFWNFTYIDEAVPGERAERLAEDCLGTLLSAIHAPQRSALEEQ

SEQ ID NO: 17748 - protein, 281 aa, Pseudomonas aeruginosa
HVFHQQTSLAPGPPRADHRRLQRPRPGNRAAPGRTGFPGDRRGAPPGGWRAPGERLPVRPDQHAADRCHRRGIHWPGRRAGGGESRRYRALGPGEQRRDLHFRAAGMRLQRPAAAPAGSQPDRPARGDPGDPAAAAPWRRGAPGERHLGPRLGRHSLPGRLLRRAVRQGGSERRPAPRAGAHGHPGLGGQPRGDLDADLGQDRQRGRARPGRRPRRRRRPLSRYLPALPPGQRGRRAQQRDQARRRRRRGACRAHRGQAADPLPGGRRRAPRHPAGAAAAR

SEQ ID NO: 17749 - protein, 549 aa, Pseudomonas aeruginosa
SACRCAPDAAPRRTPLPTPTRSRGSPNECQGNSCPQPAPPGKRRCPWLVRPVPSGRRTRIPLRPAGLEDPLRGPRNHLGAHAPVSRAPDRALHRRAVLRDRRPRPGHRRIPWRRRGHRFRRQAGAGLHLGAAHPRRTDPALPRLLESAAAPRGPGRGRGRRQDRPGSLSHAARRRGLRPGQLPARGRAQQRHARRRAGHFRRLDQQPHRRAPAAYRRRPRQRRPGPAGGLRRARLGGAGASRCGGAGNQHRRLLLPGHRAQGRGAPGVGRRARVRPVRRLHRFRLRPGQRRLADQRRAGGQRAAGRGGHFQPYPRPRRSLDPRTVRRRRRSGGAACRRCRGRRRAAGLRPRQRRPPVRPADDPRRQSRRTQFRTGLQLLPDGRQGSVRPGGDADERLGAAGARPGRLASFGPPSPGPAPGQHTHSRGGRRPARPSRRASGEQHRRGGQYRRRLDSPGPGPRPAPRHPARRRQHGPHRFRCRTDLGFGRPALAEDRSDNGLKREEQCPTTWKTISSPCSASPAACRRRKSAGTAGWKTWLSIRWWSASCR

SEQ ID NO: 17750 - protein, 435 aa, Pseudomonas aeruginosa
RCCPKAPTRASVRRRHESPSCIHRAATARAGRRGSLHRRLNRSGAGNMPLIVYVLGAAIFALTTSEYMVAGLMPALAAEFGVSFAAIGYLVTFYAGAMAVGGPLLTTALLRVPRKNALLGLIALFVVGQVIGALAPGYAVMVAARLVTAVAAAAFFGVALTACAELVEGNQFGRASSLVLGGLMVGTVLGLPVATWLGEWYGWRASFFAVALVAVLVGLLVLQLMPAIPGSAGSGSLREELKVFRNAHLWWVYATSLLLIGATFAGFTYFVPILTEVSGFSASTVPLLLVVYGLATLVGNNIVGRLADRHTIAVLAFGLLAAIAAMVAFALFGQVPAVAVAALVVIGLTGVSMNPALVTRGARVGHNNMLVNSVHTACIMLGVMAGSWIGGLGIAGGFGLQGALWVGAALGVLALLTLLPELRFARAPVGGALGR

SEQ ID NO: 17751 - protein, 274 aa, Pseudomonas aeruginosa
MPPGYAYAPCRPLTCNKPWADGSGSAGRTIVVTEVTLRVDAVANPLLERLGLGEAAVGLALPDLHAVAGDAEYAAGSGLQADFSEIVGEGAEQFLGQPGGTQQPLALGAIGDDDFGLGGGHVGGSGETVAPIIAAFSPGSGSFSCAACCSYCCSCFPCPPSPRRPGRRSVWSSPAVPPAAWPISACSRPSTNRASRSTPSPAPAWARWSAACTPPATPPPNWSASPWRWTGSRRCPTRRRARTCRSGASRTTATSWSSRRSASATTAPSACRWG

SEQ ID NO: 17752 - protein, 602 aa, Pseudomonas aeruginosa
QRRVASAQLVDGLRVAATGQGFLGQRVEAGRIAQLSQHQQQLHPRAQALRLLGEYLTQQVAGLSVATVGDIDVGAVQLVRRSHGGARSGGRSRRRRRRRAGGSGDRRPGLFLDLCRRRCGRRGARRTPQRQVQGDPALRFDRLDRSLFAAATQQQHAEQSEDQQQDDHPAPVLRVRRRFNRLRNRRRGRGGRRRRGPHRLAPGQLLLQFGDLVIALLQLFLQGLQLALQIVHPLAQFLPLPGQRLGLGIRLALRLDESRRSVFHHGGIGWRQDFHGRLLHGAGRASLRLVAGRQAQAHAGLEPVPVGIDEGLRIELVQGLHELRAIGVAGTTQASADGPEVVVGASQVFVARLQQCRVYDGRGTTRRGRRRRGLPLRLDPAARGRKHARRITERIEQYGEFAHDAAVGAGHLHQEIQVGLLHRSDRGHMDAIATAPLEHRTETQLVEELQAFHPGRGEDVGARQADLDLVRAEIADVEQFDIRIQRLVERRMQGDVSHSQGARLPGQQARPGTQHDTQGFTGHSVLFSALRAHSRPAVDCYIYFTLARISPRTGLNAPHGARHGFLPSMNRGMPWKRSRFFVRKPTKTSVEGFRTKAQEVMP

SEQ ID NO: 17753 - protein, 468 aa, Pseudomonas aeruginosa
QVAPLAQFADAVVRGLGKPGSEPQRQLEAPLQHASAGRLVEVDEADAKQAQLGQGAAADQLRADQAEVLELMEASPFAQGPHAPAHRRTEVEIAVIDVLRGTREDAVVRLAVGLDQALHGVRPEVVSRWGRQLCEERPCLAFFPVEPSIRRLVPQSPAAPATGTKSAMDSGHHLVAAERLGFVKRAIGMLVEIVETLQVVARGRPQAGHADRQGHFARRVRRLVLHAQRLDLCAQRFRAQPRLVLVGAVQQQGELFAAQAHRHVQRTPGIRLEHRADALQDRIASLVSVAVVIGLEMVDVAKQQRQGLLFALGLAPEAVEVLVEAAPVVQAGQAVVVGHHPQQAADEEMLARLELQQVAADRADQVTEQQEQQVVAQRLLGTRPPLETQVGEQHHQRTAQCLRQSQAGEEIGGETDQQQAFVGIAGIRPVRQADHRRRTDAKGEDAGDAQRHHQLDVPAQHDQAAADQ

SEQ ID NO: 17754 - protein, 225 aa, Pseudomonas aeruginosa
GRGAAPAAPRPAAADDRPRSGAGRRSRPGRRRPGRARPTDGTGSATRLRHAPCRSRTPPGAGGRDCGSSRSRGRAGYPPDGRRRSAGRCGRSPTAPGARIRWHPRFPRRPRSCRNARRAAASPRRNRPAAPGAGNGFPHRAPAWLPACAARRACAARRPRNSASSAAAAGRPADRRPSRRRPAGHRGRRGRFPGNRPRGSWAGRGGRRNARWACRCPCRRQWSPP

SEQ ID NO: 17755 - protein, 409 aa, Pseudomonas aeruginosa
VSRNHRVSLVVIASTTISRRPPRWVWMRCTSSPRLLMPCCSISLFSRLETRYCLLLPSTMPQVFSRKTLNNSKSALAADTHKPLRPGRPERSRSPVFTLLSRADRSARVHRLDPLHHPRRQIVRTELGEEVVRTDLLHHRLVEDPGQRSMQENVQFLQAGIATDFRRQGITVHFRHFDVGDQHQQLVFRTPSLGEHVLQVLQGLAPVVERGHFHADRLQATDYLLARHRRIVHHQHPLGHRAALGLGVHHSVGHFLGRRCDLREHFFHVDDFHQLLVHPGHRGQVMLAAGALGWRMDLFPVHVDDALHRAHQEALHLGVVLGDDREAVGQVLQPAAAGGQRQVEDRNGASADVRHPAHHRAGLGHHRQARALQHLFHLEHVDAVELVAVQAEQKQLQTVLSDQLRTLVD

SEQ ID NO: 17756 - protein, 303 aa, Pseudomonas aeruginosa
TSSAARTPRACTTAAAAPPRAAGNARSARPEPDQHTYQGTVLSLRHSCPRRALKVPNPFVEEAGPQPPKVLKAPVEIQANLRLLQDSRDSLLITFADRNQRFQSFLVDIDRDRGMVALDELIPNTGERFLQNGEAFRVEAFHEGVRIAWECERPVQFGEHDGVPCYWAALPAEVLYHQRRNAYRASIKQSQPIAAEIAGEKLRAPLSGQLLDISATGAKLRFAGNVAERLHPGEIYEDFSAQLPQGAISSAIELRHVRFDEKLDATFAGVRFSEMSGLAQRQVDRFVYQLQREARRFEKDELF

SEQ ID NO: 17757 - protein, 534 aa, Pseudomonas aeruginosa
PPMMHCSSTPRASCRRRPLRKPSPVITLPRGTPLRSGVTHSISSTPASRSASEPWPSIVMTSYPCWYRGCRTGRRPRTKYASLVQDIKHAAHSRVCKAFRRRGVLPCLPGTRKNAGQAYILCAFAALPATGVLPLILGTPKADWLAEFPRLADLIALRPSEWFNPAIAPSAEALADVGLGAADVADASARLQRFAPLIARLFPETAASGGIIESDLVEVATFHDALRQHYAAELPGRLWLKRDSHLPISGSIKARGGIYEVLAHAERLALEHGLVGLDDDYSRLADADCRAFFARHRIAVGSTGQPGPFHRHHRRRAGLPGQRAHVRRRPPVEEGQAARPRRDGGGVRLRLQCRGGTGPPRSGRRSLHPFRRRRKLPRPVPRLRRRRRATARPVGRRRHPRRQRAPAVRPSALRGRRRSRRGGLRPQAGVRRRGALPVRRADPFALHVPRRLYRPPRAGFGAGLRHRQPHRRRWPGGGASVGLRRPRHAAPARRLLHGGRRRVVPPARLARAQPGHPPGTLGPGRRAGHRPGHP

SEQ ID NO: 17758 - protein, 359 aa, Pseudomonas aeruginosa
AAGLSRTHGADLGAPGQCHPPGLGHRRRHGARDGNARLPGARPLAAGLTPTRAGRHDRPATSRREPCMRTPAWLGSGMPLLFVLLWSTGFLGAKFGLPYAEPFTFLAIRLLLAATLLAAFALLSGAPWPGSARLAGHVAVAGLLVHGLYLGGVFLAIEHGMSAGLTSLLVGLQPLATAALAGIWLGEQVSRRQWLGLALGLAGVALVVLGRIHGGADGLAWAAVLVALAAITCGTLYQKRFCGGMDLRTGGVVQYLASGALLGLAALLFESREVQWSTPFVLTLGWLVLGLSFGAVGLLYTLIRHGAASKVASLFYLVPPVTALASWLLFDERLAPAAIGGMLLVMLGVALVNWPGRRA

SEQ ID NO: 17759 - protein, 330 aa, Pseudomonas aeruginosa
RRTGVGLSRQRRNNGSFVPGENDPMWFRNLLVYRLTQDLQLDADSLEKALGEKPARPCASQELTTYGFTAPFGKGPDAPLVHVSQDFFLISARKEERILPGSVVRDALKEKVDEIEAQQMRKVYKKERDQLKDEIVQTLLPRAFIRRSSTFAAIAPSLGLILVDSASAKKAEDLLSTLREALGSLPVRPLSVKVAPTATLTDWVKTQEAAGDFHVLDECELRDTHEDGGVVRCKRQDLTSEEIQLHLTAGKLVTQLSLAWSDKLSFVLDDKLAVKRLRFEDLLQEQAEKDGGEDALGQLDASFTLMMLTFAEFLPALFEALGGEEIPQGV

SEQ ID NO: 17760 - protein, 86 aa, Pseudomonas aeruginosa
PACRWRSARPWPSKSACRTRGSARRWPTSISRPWQRCPARCSASGTISPVRCWPPCSGAWMIRRVELGPGREALSRPMNHAKYRTQ

SEQ ID NO: 17761 - protein, 129 aa, Pseudomonas aeruginosa
GRPHHPPPAGDRMGTAPPPVALEIAMSWIILFFAGLFEVGWAVGLKYTEGFSKPLPTVLTALAMLVSLGLLGLAMKHLPLGTAYAVWTGVGAVGTVIAGIVLFGESMALLRLASVALIVCGLVGLKLSH

SEQ ID NO: 17762 - protein, 565 aa, Pseudomonas aeruginosa
RPVRSLPFHPGHRLQEPAGRPEGFLRGRQRPERPASRRSTSCLTCSSPKKAPASPGLFRFCGSISELRRASSSPAPAGRGAPPPPAPPIRQPPGLTRDHSRRKKPLVRVAAEEAAPQPLQRHGDHRNRGFLDDPLDPGAELVHLAVGGQLAFREDAHQLPVPQVVGDALEGAFVDPFVLVARRYGHRAGGAEDEVEHRQREDPVVHDEAHRPPDRAGDQQRVHVRDVVAHQHRRSLVRDRLQVHMPDPVHGVAEQPDQEAHGEFRDDLEDVHVHRDVHQRQGEEQLRDRQLGDAEEEDRDQRSGDHEQGVEDVVGGDHPGPLVLVGARLDQGVQRYDIEAAENADEQDVGQHRPGLMVAQHRQPVVGRLAWGNAAGVPPEEDAEDGQADRAERHQADLHLATGKLLAQHRAQRDAHREHGEDQGHHAFVAVQPFLGEGRDLRQVDRAEEPEPGVAHQRARDRRALAEPQAEDAPGLGEDVPVELQPRQRRRRSRNAAAGQVAAGGHQHHRGGHRRRVMRMGHQHAGADGAGQDRQEGAHLHQRVAADQFVLVQVLGQDRILHRAK

SEQ ID NO: 17763 - protein, 796 aa, Pseudomonas aeruginosa
RRVGAHGEQRDEHQRQAAEDEAGSADQHDAYLGQLQRAHQRVLVVLLAELSAQCREQEERQDEQQCAEVDQQAAVAADAEVIEDGEDQRLLEDVVVEGAEQLGDEERQETPLAQQGELRMLGHRPCYLAWPPKGSPSSIGLHGPRIRPQRSDGNSAPIIEQASALPQDACRRTMRQVASEYSETDAGLHEQRSRLTHVDSRIVVAGAGEILLVEQVLHPESELQVRRLRAEVVADAGIPGHVAGNVAVLAVGAGLGDVVVGEVALAVGAQPWRALHGLGEGVEVVGPAVDLVAHPGGGHLARVERQVAPLEGGNVAFVGGAGIGEAAVDRQAVQARIESGEVIVAGSLDALVLGGAEVGPADVVADVLQLVVEVDVEQRDLAAPAAVVVARAQFVGLGLLRLQAGGGIVAAAALAELEVLQAAERFGVVGEQLPLVAQVIHQAQRRQRFVVVLAALLLLHRLAVQAEHRAVAPVAVDLLEADAGGDGPVADIDLVVDVEGAGLGTAGTVLVGMAVRAGTHGRHIVDQGQLAGALVHRFLQVAVADADLLGGRAGEEDPRDPRLHREHMVVARVRGDGPEVARGDAAAAETVAVVGEHLELGEVVDLAGVLQREVLAPTTEIVPVAYRLEGIVVVLRLGQAARHIGVGVVVVEVGRQLVAVGELPMGLEQHVVDIVVVVAVAVVGALHPGIQQRHAQAVVGGPAEERLVELLPAAVAGMLDGGADFAGELLRNRPGHEVDHPADVLRAVAHRAGAAHDVDALQVADGQRHHRQLRLAVGRHRRRHAVDHHRRARRQA

SEQ ID NO: 17764 - protein, 1228 aa, Pseudomonas aeruginosa
  UNSURE (17): Identity of amino acid at the above locations are unknown.
TDSRPPGPSALTQPGTXPTPRVRLKHACDLGRRRPDARADKCETGAKARPPPHASFTRGHHRSSHVAVHRADRRGRPGLHGHPVRHRLLWRPSPHPALTPPARLGLQPLPGSVLHQLDLLRRGRPGHRPALVVPADLPRTGVADAVRALGAAEDDHDQQAGEHHLHRRLHRRPLRQVAGTGGGGGADLHGRRAALHRPATERYRPRGEPADRLRRRLHRYPRPGHGADRVAGAGAVHHRLRYPQPGCHRTPPRHGPGHRLRVAGQAHRLPRRGHLRHLRPLRRLRRSLLPGPRRAAVGRLLGRDRALAGDAAADRRGDDRDHVPAAAIPRHRGGEHRAARPQPGALGVPHLPGAGRVVRGADRPRRPIAPARRGNAGLLRHQPAAGRGAPGAGPAGIHWRRLGRHRNGHRRQRRAVDHGLQRHAPAVAAATPGKGHRTALRGLPSLAADRTPGEHRGDPAARLRGLPPARLQRQPGDHRPDRLRRHRPARPGDDRRAVLETGQPPRGLRRPRRRLAAVGLYAGPAGGGQGPRLAAGAHPRPDLAGKQSLRPADRAADPGRADLAGRQLRPVRPGLGALAHPRVRALAGQPLHRPGDLPAAELALHARGAGGRPADARRAFRRRGTRAAKLHPLRLPPGQGLHPEPDRQQRVDRAHRAPARRGPRRVLGAGGGEGRHRRARDAGGGRGADRRRSLRGAAIQPRPAAGRDREHHPGHQRGRPVAAPGGLEPPLPGAVRVPGRADLRRPADRRHHPLQRRSRPVRARRSGHARGQAPVLDAPGHSAHLRAAVPQRPGHRADRQPDARRRLRHELHRYHRLPRGRTGPQGRQRVAGTAGPGAYPGTFAVEPGTQRGEEQRRGRQPVEDPLPRRRQPRPDAAAERRAAVLRRPRPPGRAARRGPRPGAAPRLVAAFRRGPDHRPAGHLAPGKRPGQRRTQPVPAEQPLRCPRRRVQGAGPGTGPAFPPARQSAAGGQRHQAAAAHPAELPDQRFPLRQGPRAARRPPRGRLPAPGGLGPGAGHPTGQAESHLRRVQAPGQPPDPRGERPRSRPGDRRPALQGPRPSAGSTFLAGQGQRLQRPRTAGAAGAAGPGQRPQGRTGAGAERRPGALRGQRGQHPRRHEQPAQPLGLPGLDRAQPRGMRHAAGQRDAPATGVDRLSPGRRRDRYAIDGLAAHAPGRAGAGRGDQRRRAAGTGGGDPRRRPRLPVQAGQAGRVAGPAQPPSEPALSGPQ

SEQ ID NO: 17765 - protein, 172 aa, Pseudomonas aeruginosa
RRSKVRATCSRTSAGKRCPASSAFARRSGAQRPASCMPPGRPRERRSWRLRLSAGISRVRSPAKLSALTRPTETSSPRAFSSSLRSRWASWLSSSKNDAPCSRSTSSTLAARGDSSGSGASRCRTLQSPSSRRGRSTIGALRSGPPAALLRPARRAQTMRPERHSWSSQWLA

SEQ ID NO: 17766 - protein, 209 aa, Pseudomonas aeruginosa
RQTSSRGKLWLVDSERMIASSVAAACSSKLKLRQKRLRSARPQARLRRLPWGLWMISCMPPDSSKKRSITSRRLPGRPPRAWRARARYSTICRAAPSSSPRVAPSQAMAGSSRCPSGNAWPSPSSSSRVSRRRATLADSSSLRPGASPSQNGMFGGWPWASSTRTRPGSMRMIRYEVLPSWNTSPARLSTAKSSLTVPTSRPCGSSSTL

SEQ ID NO: 17767 - protein, 444 aa, Pseudomonas aeruginosa
RSSSRHSWQATSATICCTSTSSGWRGSTRLSSSPRRTLSSSAAHSTRSSREVGNNRPLGVPPTLCPERPTRCRKAAMERGDDNWQTNSTSPISMPSSSEAVATSTFNCPALRRCSASRRSSLARLPWWAATWRLPRRSARKRVTRSAMRRVLTNTRVVRCSPGQVRQAVVDQLPGVVGHHRFQRHRRYLDAQVAGARIADVDDPAGRIARIAAGADEEARDLLDRFLRGGQPDPQQRSRTQRLQALQRQRQVAAALAAGQGMDLVDDHAAHPGKHLPARLRAEQDVQRFGRGDQDVRRALAHRSAFDLRRIAGAHRATDIDVGQAETRQFLADASQRLLQVDADVVGQRFQRRDIDHLGSIRQLAAGGQPLHHQGIDGGEEGGQGLARTGGRGDQGRKPLADRRPGLDLGRRGRGEVAFEPLADGGMELRQGPRSRLGAAGGRG

SEQ ID NO: 17768 - protein, 152 aa, Pseudomonas aeruginosa
VMAYLLRHKQRGSFAPSLCVRPATRREGSNRSPSGVAAELCRLDRAPPLRTTPQEYAMKPLFALASACALLVATPVFACSEAEAEKMGKEVATKVASITQKNPQRARELNEQLRQRQEARSEQNRPSDCDAYAQMLKELDQEKGDVQRNTSQ

SEQ ID NO: 17769 - protein, 418 aa, Pseudomonas aeruginosa
TMDSDSTGVLQNRTDSQRQPSSTGREAGKAKSLANERGFLWGPTYFGRQAGDSSYSIAPPWASTICAAPQWCKTAPLLACSHFHSGLALTLGLHLAGHRGHLVIDRLGILLLDPPGHPRLLVGQDQETALGHFGVDVVGDVGGADRRTLQQLADLVLHLGARAAERVQQVGLEERRTDHMDADLDQRQLYQQAFRKRHHPGLGHVVVAHRRALHQRRHRGDVDDLALASLQQRQEGLAALDHAHQVDRDLPVPVLQGQLAEEAAGGHPGVVDDDVDAAELLLAALRQRGQLTVVAYVATLGKAIATRLAHQFQAFRQAGFVDVGQRQAPAVTRPAQGDFAPQPGAGTGNHHAVLHRGSCLPVRVMKASVTKGFSALRLNQEAECLGQTRTCRAARGAQASSRTQSLPRTRAMPQETSR

SEQ ID NO: 17770 - protein, 137 aa, Pseudomonas aeruginosa
PSSRTGYGNPGVRPPAVRPGPPGQQPAPRATAATGPAAEPAQPQGRQPADAGQLPWPRRHGTPAAGLQGRPGPAQPGRADTAGRRCVQGRPGDGRTAPRRRRRRRGRLGRRQDRTDDGGHVQPGRGRRQPAGPRRPS

SEQ ID NO: 17771 - protein, 133 aa, Pseudomonas aeruginosa
SGIRCRRAAGRSLRPPSCRRRARPSRPCSHGRTRRRRRVVGAGPAADRTASPPAGRAVCPRRRSAPRCDPTPPVRRRSSAGAACPAGRPRTPGYAACTGPPRPSAGLPACPAGHWRRTPCCAARRHSGRCARR

SEQ ID NO: 17772 - protein, 284 aa, Pseudomonas aeruginosa
TCAPYRLAPRSSRRDASRAPHTSKEIVTSPSSPFPTFVALAGWPCRLAQPPPQHREMRHDPRLSPRPLSCRLHGRARQRLAGPGAPGRSVAVQPPGPWRTQRVRRRTARRAGPDPGPEAVAVEEEGEERDPADRRRHGRLRDHRGAQLRARRGRLLQGYRCAAADRPVHPLLPAQGQRPAGLRDRFRRLRHRLDHRGQVVQRRDRRGYPRTAAPQPAGAGQAQRQGHRQRLHRRAAGRHPRRPARPRHRSQVLRSRGHQQAVPEQCPGERRRRLDHRAVAEDPP

SEQ ID NO: 17773 - protein, 362 aa, Pseudomonas aeruginosa
RGSRRRRRDLRGNRQGWPLCRQDPPRSGRSPRLPDRREPRRAESRAPRQPEAAADRPVRAGQHASALARSDRHLPRQPEPAGGELRGEPEAHRRHPDPGANDQQGHRAAEGQSERLLPAGRGRVHRQAGPCRESVRPDRRDRRPRRSRAEGPGLRQGRWRDPGDRHRRPRPLQPDHPAGNRRAGADPTAHDQGRRAAGDQLRQLRGRLPGAHRHPVAHRRLRPAGGQCHRPDRPDRPVLHHPSRTEPARLIGPERKRRAGFDRRAFFISRGIPGTSPRPGSTAWPGACPRPAAGFPVAGRTARPGTPPASSDTPATRRRACLPGRAWRGAPGIAPRVRPARRSTPGRAGPGRRPCPGAARWP

SEQ ID NO: 17774 - protein, 155 aa, Pseudomonas aeruginosa
SARCRCRSRNGCPAPSARFPRRWWTARSCVPGAAGRSSAARPGSVARTAAAPRCGAGWPCAASPRRRGSPARRGGTPARRRAACRPRVRGRRSRRGRRGCPGPPTGRPRPGCPPRRFPPPAAGTRSPPDRCGRKPRSPGRRRNAGRNAPGRWSPR

SEQ ID NO: 17775 - protein, 628 aa, Pseudomonas aeruginosa
SADGVFLRPGQDRGGPWGVPPAGDALPARPHRPAHPATDCLQRRSPASAGLLQATADLLLARFLQLFVAQFAAQDLADVGGRQAVAELHGLRPLVAGQVVMHVLHDLFLGQGRPRLDHHEDLDRLAGLLVGDADRGALQDARQGRQHVFQFVRIHIEAGDQDHVLLPVDDAHVAVFLDDRDIAGLQPTIGVEDLVGGLLALPVALHHLRTLHAEFAALAQGHFLAVVANHLAQGRGHRDTDGADLDVLERVDRYHRRGLGHAVAFADGAAGDFLPALRGGQLQRHAAGEGQLQRGEVQLAEGFVVAQGDEQGVQADEAGELPLAEVLEHRRQVARVGDQDVVVAGEHHRHAMEGEGIDVVQRQRRDEDLAALVEVGAHQRLALQHVGHQVAVGQHGALGDPGGAAGVLQHGDVVGLRRGFLERLAGAPGQRVGQLGGLRQAVGRHHLLDVLDHEVDDEALQRRQDVADFGDDHLLDAGLRQYALDQVGHVGQADHRLGAGVVELVFQFARGVQRVGVDHDEAGAHGAEDHDRVLQDVGQLDGDAVAGLEIGVLLQVGGEVAGQLVQLAVGQGLAQVGERGLGGKTLAGLLQYRQDVRVLVGIDLGSNTRWVLVLPEVFDHGSPLLSNS

SEQ ID NO: 17776 - protein, 578 aa, Pseudomonas aeruginosa
  UNSURE (565): Identity of amino acid at the above locations are unknown.
CILEHNLSRNFVSGEVFLAVGLEFLDRQAGVAGHHEQLHRLAGLLVGNAHRRATGHLRMGHHHVFDLVGVDIEAGDQDQVLLSIDDAHEAVLVDHRDVAGLQPAFGIENLLGGLGTLPVPLHHLRTFHAEFATFADRQLVALLVDHLERRAHDRYPHRTQACLLAVGVGGHHRRAFGEAIAFHHGAAGDALPALGGGADQCGAAGVGELQVGEIDVLEPGVLHQRDEQGVEAEQRGETPLLQFLDETGDVARVGDQHVMVAADHHAHAVRGEGIDVVERQRRDHHLLRLLHQRQAILAELGKLGVDLQHVRHQVAVGEHRPLRDPGGAAGVLQHGDILQADPDRLQGMALALLQGLPERQRLGQAIIGDHLLHRLHHAVHQPTLQRRQQVAHARLDQVLDPRIREHFLDQLAEHVQVDQRTHAGVLELVAHFAGGVQRIGVDHHQPRAQGAEHRDGILQDIGHLHRDAVAGLEIGLFLQVGGEGGGQTIEFGVAERHAEIAEGRAVGEFLAGALEDLDYGTVGGEVETVGYAGRAFVVPEFRLHLFLSSYLSGSGPHVRGIGQLXSCVGQRKYSSCPY

SEQ ID NO: 17777 - protein, 329 aa, Pseudomonas aeruginosa
NAPERVRPAQGTNMPAAAYWLPASDETPLYTRHWPSATAVGAVMLSHGMAEHAGRYERLAAALNAAGYHFYAIDQRGHGRTAEADELGHFADQGGWGKVVGDLASLNHHIRQQHPELPIFLLGHSMGSYISMAYLLHHSCSLQGAILSGSNYQPQALYRIARLIARFERWRQGPLGKSALIDFLSFGSFNKAFKPNRTAFDWLSRDPQEVDRYVADPLCGFRCSNQLWVDLLGGLADITPPTHLRQIDADLPLLIIGGERDPVSQGKRLGDLADALRGAGLRQVTLKTYPEARHELFNESNRDAVTQDLIDWLEQALRHRRDHSTKERT

SEQ ID NO: 17778 - protein, 108 aa, Pseudomonas aeruginosa
SSWASAVRWCSACHWAYRSATGSAGAGSSPASRSIRCPCACCSGATCRNARPATCPAAKATCGSCASPRCGSRNWYRSCCSAGTSPCSPISPRTWRAWPVFARPARSA

SEQ ID NO: 17779 - protein, 401 aa, Pseudomonas aeruginosa
TPRPCTWAWASARRWAAWWWRHWESPRRPGSASPWCWRRWPARLAPARWMAPRKRCRSVPLHGDAGGHPGAQVDIRRHLVEADAHRNALRQAHPVEGRLDIGQQLAVRRRVAVGDTAADALHRAVDRLIAAHQADLGAHADADAGQLGFLEVGDHIEGLLVDQRHHRLARRGVVALGQAQVGHLAVARGAQLAALEVEFGDLHLGQRLLVLAASDGSIDLGVFLVLGADRADAQAAAPGRLVLAQQVLLVTGLGDGAGLLQVGLVAFLVDAHQHVADLDHLVVLDLQVGHPAGHVRRHHHHVGPHPGIAGPGREHVVAPEPDAGEDSGSDHQQGDDDAKRCTHANLLLGATIQVVAAQVMPLNIKMNRAQSNSASCQTQRRNGVFWISTRSAAVAASASRA

SEQ ID NO: 17780 - protein, 699 aa, Pseudomonas aeruginosa
TPPQADSCRLMAFLLMAPLLPGEQQLRQGRARQAAGFVVVASVTLQGFAQRQADPLQAVTARTRGTGLKQFAQFPEEAVARLAQDATGAFQASPQVDQFVTQVERQEAIVPTPPLLLRQQVGVPRQAQQAVGHAPAEPVLRLRQRAPGEAAEIDAGGVQQASGQPARTQGQQAEDHHREADSDQHALGGIQQGREVVVHLVARRDQDDEVDRERGGGAGGNRYGHAQGGEEQRHAHRQAEQREAIPLRQQPLADQHRRRDRVDDAAQEAQADGHRVVAVGEQAAHHRRQQHRAGRRRPRGIDPVDRQPEQRQGATRTVEQRHLQVAVPGQGTGAAHPPLDLAAGHRAHALLGIHRLEQQHRAAGQQVPLVVAPLRLDRDLRQLLAQRQHRRRIGPFQGAGQRGQPALHPALFLFAQPRPLPGHAARGAQQAEQVAREQRQGAGPAPPALAFEPGMVALRIDLDDLAQRVEQPLRLPLARVDLAARGLHAQQPGGVGLLVEVLLDPLRPEDRTDRRGADDPQADLGTTRHRLLEDQQRLVHRRQANDRYRIAGKYEGIGNVVAQGGRGRRAEPQPERDGQQEQPGRLGEQRDHQHRHRGADQGAEQAEQALRHHHAGQRLGHDQHGHKRPLRLLQVEAKGAPQRQAAGQERLDGELERQRRGCQERLPVNGHRVFRNGVYISIDSRRTPRRYVQPILLGC

SEQ ID NO: 17781 - protein, 994 aa, Pseudomonas aeruginosa
EPAARRSLPYRRTALRRSRGATRNPSPSVAQRHALRYHTRLFWEVDMAQYQPGQRWISDSEAELGLGTILAQDGRLLTVLYPATGDTRQYALRNAPLTRVRFAPGDEVTHFEGWKMTVREVEESEGLLVYHGLTAQNEQRTLPETQLSNFIQFRLASDRLFAGQIDPLPWFSLRYHTLERRSQLLQSSLWGLGGARAQPIAHQLHIAREVADRMAPRVLLADEVGLGKTIEAGLIIHRQLLSGRAGRVLILVPENLQHQWLVEMRRRFNLQVALFDKERFAESDASNPFEDTQLALVALEWLKEDERAQDALFAAGWDLLVVDEAHHLVWHQDQVSAEYALVEQLAEIIPGVLLLTATPEQLGQDSHFARLRLLDPNRFHDLEAFRRESEQYRPVAEAVQELLDHGSLSAGARKAIHGFLGSEGDELLASVEGGDEEARSRLVRELLDRHGTGRVLFRNTRAAVQGFPQRELHAYPLPMPSQYEELPAGEHPDLYPEVNFQQQWEDGDDNNRWWRFDPRVEWLIDTLKMLKQFKVLVICAHAETALDLEDALRLRSGISATVFHEGMSILERDRAAAYFADEEFGAQVLICSEIGSEGRNFQFAHHLVLFDLPAHPDLLEQRIGRLDRIGQRHTIQLHVPHLENSAQQRLFQWYHQALNAFLNTCPTGNALQHEFGPRLLPLLDGGEDKAWDALLAEGRARREALEAELHSGRDRLLELNSGGAGEGEALVEAIEEQDDDFALPIYMERLFDAYGIHSEDHSENALILKPSEKMLDAGFPLGDDEGVTITYDRAQALAREDMQFLTWEHPMVQGGMDLVLSGSMGNTSVALIKNKALKPGTVLLELLFVSEAVAPRALQLGRWLPPQALRCLLDANGNDLAGRVSLETLNDQLESVPRVSANKFVQAQRDVLAKQFDVAEGKIVPRHEERVARAKQQFAAAMDEELARLTALKAVNPSVRDSELDSLRTQREEGLALLDKASLRLEAIRILVAG

SEQ ID NO: 17782 - protein, 245 aa, Pseudomonas aeruginosa
RPATAARNEKPWASPMASFISFPAKATTANGRAATVRPVPRPPPGREPGVAAESRRSPCDLLTSGKGPPAARVYSVLEVSRTPGGRTLTLEGHLMYDRILVAVDGSPVSDRALEEAIKLAGLSGGKLRVITIVDSPLRHLPDYAVYYNPEPLREAALKAADDVLAKAREKVEASNVEGATFDRVCQERASEEIAERIELEAQASDADVVVMGTHGRRGMRRLMLGSVAEGLIRVASRPVLLVRDK

SEQ ID NO: 17783 - protein, 91 aa, Pseudomonas aeruginosa
YSGPWLPSECRTMMASSCRPSMYSCRPTSSDSSRQFLPSQNGLGWVFGMSRLGTRRQVPLQSLLFSSHNTCTPARWRMSSRPSWVLAFLSL

SEQ ID NO: 17784 - protein, 460 aa, Pseudomonas aeruginosa
RTAATPRGGAPELYRAPGQNFVKPREPSRAQRSCPWRWSRNKLSYAFSPRENAETGRMSAASDFLPCRPCRWLPLSILEAQCHPQPAPAPSAGFPCPGRHRYGLARPALPRRVSRRRLRAAELHLFAIAGGARLPRRLPRRVHGTGHGRAGRQQPEPPAPLAMDRGVLPGQRHLGHAFRRHARVPRADRPALRPADHRPVAADRRRRLVPGDVHDRPPALRPAALPARRLLHRPGHRCHALHRDGGDALGGHPVLPAIAVRPFGTDRHRRRLHRPRCGPLPARPAQRALPLHETDRQPAAGRRHRRHAFHRDGRAGAQRTRRHAAGTASQRRLAAPGLAHRSARQRHRRLRHLGRMVGETTGAPAQRKQPGQRPAQPARPRPRVAAPDGSLRQPDRPAEPHGIQRSVRPAPGELSPERQGPGGDVPRPRSLQADQRFPRPRLWRPTAEDRLRTHPQRVAR

SEQ ID NO: 17785 - protein, 421 aa, Pseudomonas aeruginosa
RRGGALRRRRVLRARRPHPGPRGAHPLATPDAEDEGTHRPGRAHPGDDRQRRRQPLPERRRAVRGAAEERRPGPAPVQGLRAQQRAVLQPATAGAGDPGTADGGGTAPGPARRPTGAALPADPRPRRRRGTPVGGIGALAPSDPGPARSGPLHRPGRSQRHDRPARRLGAATRLPRPAQPAPGRPRTAAGGGQLLRQQSRPGQPGRRSPSCAGAGRAGGVLPRTGGDRGRADVQHRPDHPAARTPPRAGRQPVDRRLRHRLFVARLPAAPAAGRAEGGSLVHHGHPRLAAGHGNRPGDHRDGPEAPSESRRRGRGDSAATGVPAGEPLRAGAGLPVQPAAAAGGPGRVPPRLPLRRRAAAAQPEPGLRFTRRRSGIAPPGSPDRVRDSPGCRADASTARPTRSSGWPRLARGTASPRYRDP

SEQ ID NO: 17786 - protein, 190 aa, Pseudomonas aeruginosa
SPGCRFPRPACRRRPARRPSARRSAPLARRPSRGWRPARRWRSPPATARAWRSRRCRRRRTPLRAPPRYRPGKASGFPRRRPARPGPRRLSRPRPRATRVCPANGSTPPADSRRPAAGGTWARPSGRDRRRQGKAGKRTWRTPIRSEWARGAPYYPRGAGEQRRDGCPSGPRTTILPGFFPPLNRRTLPC

SEQ ID NO: 17787 - protein, 543 aa, Pseudomonas aeruginosa
SEPEPRRRGPGPRRRPTRPCRHPPAPGRWRTGSPDRTFRRRQDQPAAGARQPMAAQRRPCRTARRGALGAIRRRPPTPARAHRPGPPGTTAAATAAGGQRGTGRAPRSVAAMEEPGQPGLSAGPRRRPRRTATPGSRRQAVPALRPAFRRPVAAGRHRPGALPARRADPRRRTGLGHGPGARRPYPGPAQPRGRRARQHPAGQPARGGPGAATLPPGDRAARRTHRLRHARRRSGPRRAGRPLRQRTTAGRARQPGRRTRRGAHPTMLNAAFLPRDPAALPRVLLTLAALLLLWPGVRLSELDIPGLFSGDNARTMGGFLAGFWPPAHDPGFLALLGRATLETLAIATAGMALAWLLAFPAALLATRALSLSALPRGGLPAWWARALRWPVRGLLILLRSVPEIVWALLFVRAVGLGPTAGVLAIAITYAGMLGKVYAEIFESVDPRPTRALLLGGGSRLAAFAYGVLPNAAGEMISYTVYRWECAIRASVVMGFVGAGGLGQQIDLSLRMFAGGEVASILLTFLLLVLLADLLSRFLRGRLA

SEQ ID NO: 17788 - protein, 114 aa, Pseudomonas aeruginosa
GKARAGRMPISCLGMAATAGGFGFGSLIWLATMASAWLVSGSSGNGSLFGLAKLNAEVRSPQTARRQGLIFGSMTPKRCSRKRITEVWSNTWELTQPPLLHGEITYIGTRGPRP

SEQ ID NO: 17789 - protein, 370 aa, Pseudomonas aeruginosa
LGLDPDLGKRHRSAVPTADRVLYLDLRALPGPCRFLDARTPQAAQSEGPESGIRPVAPLLVHRLLPYPRRTRAALERRPGPALAAVPEARRRRPPSAGQPDPGQRRPARGQAVPRQLHPQPVPSAQAPHRSAGATDRTDPRPLRRRPAVPAPQPVGATPVAARGERRPLATAGRAGATGRLARRVHRRPGNRRVAAGPATRPGPARRALDERQAGGGHRRRRRHRPFDPAQLRRARRQPARRRSRSGSRRTQRRTGPRPWRHGPCLPGRRRRYPGHGDLRRVGARHPRSPGCGSQQCRHRHGRTDARHLARGMGAPAAGQPVERDRRLPPVRPADDRGEQAGAPGQCRLRGWPSRRREITPHTPPARPRY

SEQ ID NO: 17790 - protein, 2285 aa, Pseudomonas aeruginosa
QRDYPARINSYFFEPAKSNSTPRSCFGCRRFPANHAGYGALKRRRVEPVRRGVRCPCSPNRWIVEEDAGMVRFARLPLSPYQRDIWVAAAQFPELDQYTIFSYDRFTGEVDTQALERALLQAARDTEAFRLRLGETDGTPYQWLDTDAEFEARHVDLRADRDPEAAVRSWLRDAFRHAYPLDGRSLVDLALLHSDQALYVYVRTHHIVSDAWGLQLFLSRVRAGYLGELGEPQAQMPTASLLAQLETDDYSGSEQYRGDRAYFAEALEGLEPALFTRRRPAGLRRTARHRLTLERTLLDAIRDRGESPFLFLSAAVALYLARIHQNDDVVLGVPVLNRADRVAKQVVGHFANTLPLRIRTAPEQTVDEFLAQLREATRTLLRHQKMPLGDLLRGASPLFDTTLSYMRWPAAQAIPNASVETVAQTHAHDPDALAIWVSEFDGHSDAQVDFEYACDVFDADFPMDAAARHIETFLRALVEGGERRLGELDPLSAAEREELIHTRNATDQAFPEQATLPTLFAEQVARTPQRTALLEADGGTLSYAELDAKVQAVADALRAAGVRTDERVALLVARGPHLLPAILGVQRAGGAYVPINPDHPLERVRLLLEDCGARVVLVDERAATLGESLGETRVLHLERLPQSTGDLPAANVAPGDLAYVIYTSGSTGMPKGVMVEHRSVVNRLNWMQRRYPIGERDVLLQKTPVTFDVSVWELFWWSFTGARLSLLPPGAEKDPREMLRSIQRDAVTVIHFVPSMLTPFLDLLDGDPTARAAASSLRLVFCSGEALAPLQVTRFRRLFGDAVRLVNLYGPTEATVDVSDHECASDNPTRVPIGRPIDNLRLYVLDRALRPQPLGAVGELYIGGVGVARGYLNRPELNAERFLADPFVAGGRLYRTGDLARWLADGNLEYLGRADDQVKIRGNRVEPDEVRDRLAALPGVRDAAVVARDSAVRGTHLVGYYVAAAELDPGQLRAGLSATLPDFMLPAFFVRIDSLPLSANGKLDRRQLPAPPEQVAAVAPRTATEAELAAVWADVLGVAEVGVHDDFYALGGDSILMLRIRAAAQRRGLGFELADLMRNPTVAGLAERLVRPLAERSYQPFELVSEVDKPRLEGLEDAFPTSRLSLGLLFHSRQRPDSSVYHDVFHYRFDLAWDEAAFRHALDRVVAAYPALRSSFDLSGASEPLQLVHTQARSEPLILDLRGNPEAGTVLDEHIRQRRFHRYSLQQPGLFLFAAFVREDGLDLVFSFHHAILDGWSVANLIVALVAAYRGEPLPGPAPALACHVREELAALASPAAVGYWTGLLEGARMTRLDGFGAHEPQAAQGPASHREALPDGLLERLKATAAQRGLPLKSLLLAAHCLTLHLFSRSDSVVTGAISNGRPELPDADRMVGLFLNTVPVRSEIAGHSWIEVADALFRQERDGHAHRRYPLSAIQQIVGDELSSAFNYVNLHVLEPLWQLRDFRVWEETNFALLVNVIATPSDGMYLRIDSDGRGISRSQAALIGATFVELLWRLAEHPDEAADFAFLAPRRDAASQPEPLVDVVSLFERQVEALPGSAALAFEEQRWTYRDLDHVARCVATRLVRAGARRGDAIGVALNRSPEMIATIWGILRAGLVCVPLDVSYPAQRLALILETAQPFRVVAHPEHAHVAAAERVLPVEELVADIKPETFAAPQLDELAMLLFTSGSTGRPKGVELSHRMWANYTQWQLRVASGVPGLRTLQFAPLSFDMAFQEIFSTLCGGGELQLISNRERMDPSALLHVLERRQVQRVLLPFVALQRLAEASNALGVRPGALRVVVSSGEQLRITEDVRAFCAAMPGLLLENQYGPTETHQVTYHSLSGDPAHYPDLPPIGRPLDGVEVQVLDAALRPVPVGVTGELYFGGDCLARGYHRAPELTAERFVEHPWRPGARLYRTGDLGRILGNGEIVWLGRADTQVKVRGFRIEPAEVELAIMRQAERQPGLRGAAVVARERQGNDAFLAAFLLGEPEAVDLAELKQALRSELPEHMVPAHFAWVDGFALTPSGEARRRRPARTAAGARDEHRVPGPARRLRAHPGRTPRRVAGSSPGRHPRQLLRPRRHLAQRDALHAADREALWRRPADGRADRDADRGGPRRTPAGTLGGARLRPAGTDPCRRQPPAAVPRPPARRPRTLLPAAGPRTAAGPAGICPAGGRHRPGQYAAGGPRGHRRQLPRGDPPGAAGRPLLPRRLVVRRLRRLRDGPATARARPAGGRPTDRARLHHRRPQPRRQRQRRSPAAVLLLGTGLVRAQRRGSRAAA

SEQ ID NO: 17791 - protein, 523 aa, Pseudomonas aeruginosa
RREPGAEARPHRRTRHRGRRTSRRHPARHRAAALRAVPGELAGTHRLSPGSQRPGHDPAARGRPAAAGAEADARRRRHPLRRPEERLAALDQWPPRCDRRPRRPPGADERTLCRDGRGRDRRVARTLHLQRTDPPMSSPPLKIVIAGAGIGGLAAAACLKAAGFEVELYERARELRAVGSALSLMPNALTALERVGVRPDLTRAQAFDSLRFLTRRGRPIRAIDFGGLARQLGQPSLAIHRASLQQALLEQARDCRIELGVSATGYLRHADGEGVTVLCSDGREVHADVLIGADGFNSAIRATMTGPERPTDWHYVIWRATPAFRHPKVTPGYVAHYWGRGQRFGLADIGEGNVYWWGTRNMPAEQAKDWRGGKAGIQRLYAGWADEVQAVIEATPEADISSLPAQDRPFLERWGDGPVTLLGDAAHPMLTSLGQGAAIAIEDAAVLAHCLATIDDPQAALRAYENRRRDRARAMVETSRALSRIEQLEHPLRTVARDLYFRFAPERTFARQNELALTFPGVE

SEQ ID NO: 17792 - protein, 362 aa, Pseudomonas aeruginosa
TATSWPPSTPAMAGCSGTSPISTKRSPANAPNAWPKIAWAPCCRRSTPPNDPPSRSNDMFFTSKPLSPQGRHVLITGASSGLGRETALHLAEQGFQVIAGVRRQEDGERLANACPSGRISTLLIDVTDEESIGRAAAQVAEKVGDTGLWGLVNNAGICISAPLECVSSDLLRRQLEVNLIGQLAVTRAILPLLRRGGAARLVNVTSGLGSVAIPYLGAYSAAQFAKEGVSDALRRELAPMGIQVSVVSPGAIWTPIWGKIASEGERALADAPDAVADLYRDTYLRFLQANEDGARNSATKPADVAAAVHAALTAAKPRTRYRVGADVRRGTLLARLLPDSVIDGMFRPIVTAAPAAKEEQRA

SEQ ID NO: 17793 - protein, 556 aa, Pseudomonas aeruginosa
SQTETGRGTDLATARALRRPAGGRRAASRASRRRASGVGGDALPRRAQGPQPSGRPPRRPAGRRTLREAYRQPARGDRRGTQPPHAQPRPAGPYPPALAGRPRVHPAPGGAPATAYRTDHRGIAGRHGRPRTGRPDGRLRDPADHRGDLRAAGHSRGRARTRPPVLGAPGGTAVAGGGPGPGRCAGRLPARAARGQAPAASRRRLQRAGAGRRRERPTERGGTRLHGPPADDERLRDHHEHDRQRAGHPAGQPGATGVAAGAAGTPAQRHGRTGPPRQPGARLDVALHRGRRGTGRGHHSRRRIHPGLQPDRQPRRRALRRSRPPRPHPQHRWPSRLRLRRALLRRRLAGPAGGADRHPAPARALPRPPVGGAPRGAAMAADHLPPRPDQRAGAHRMQRPGEHRFPRQPDREDRPMNAKEILVHSLRLLENGDARGWCDLFHPEGVLEFPYAPPGWKTRFEGRETIWAHMRLFPEHLTVRFTDVQFYETADPDLAIGEFHGDGVATVSGGKLAQDYISVLRTRDGQILLYRDFWNPLRHLEALGGVEAAAKIVQGA

SEQ ID NO: 17794 - protein, 331 aa, Pseudomonas aeruginosa
AMPRAAVVCGLGSYLPEAVLSNDMLAAELDTSDAWISSRTGVRQRHIAGDLGSGDLALRAASAALASAGLERVDAVVLATSTGDFCCPATAPRVAARLGLVGALAFDLSAACTGFVYGLASVGSLISAGLADSALLVGVDTFSHTLDPADRSTRALFGDGAGAVVLRAGDAEEEGALLAFDLGSDGHQFDLLMTPAVSRAERSSGQASNYFRMDGKAVFGQAVTQMSDSVRRVLDRVGWQASDLHHLVPHQANTRILAAVADQLDLPVERVVSNIAEVGNTVAASIPLALAHGLRQGILRDGGNMVLTGFGAGLTWGSVALRWPKIVPTMD

SEQ ID NO: 17795 - protein, 361 aa, Pseudomonas aeruginosa
AGHWAAEQDPSGAARQPAAVAGDALFQALEIVAVARLAQQLQVGAGMALVARPQRLGELAVAEQAALHGLLQRQGRLVGVGADAIDHRQGDLVEGPCLAAAEVEDSRTLRMVEEMQVYPRHVLHRDEVAQVAAGREAAVFAEQFDPPVAAQLLVAVVGHRGHPPLVFLARPVDVEVTQADHLAARLRQRPPHTLVEEELGIAVDVQRPLVLARLAEGPAGAVDRRRRGVEERHAEFQAAFQQAATVAVVVLHHVAAIAFQGAGAGALVEQRADRAEVAAGVTLEEVVLVQVVGDIGVRQVAELLAVGEIVHRDDVGLAAPVQRLQQIAADEAGGAGDDDAHGHSLRQDECPQAMPMRRAAR

SEQ ID NO: 17796 - protein, 418 aa, Pseudomonas aeruginosa
PPFHPAPDRSHAPPAARTAAPASPVRPRRGGPAEDRSGPLRRCRPRPGPYRRAQGPRRTGHPDRRHRRHQHGRGGRRPVRLRLHPRRTGAHRPGDGLAAGAVRRAAAQGRAVPAQAGRPRLPGQAEDQLPRRRHPRPAAGGDPGPEPGDGAGKPAGAHQRQPRLRQAGDPLPRRLHRYRNRRESGVPQGPPAPGDPRQHVDPRRVRPGGDRRQAAGGWWHGRQHPGGRGARHGRGRGDRGRHRQPAARPQGPEHRARRDEPVDHPDDPEELRSPAGHAQARRRADPAAAVRLRHHRLRPRAATDRRRLPRHHGARRAPRRVAQAEGPQQRSARRGAHAEPAQAGDRRDPRGEQLEGQRRGDPPLHPPAARHAPRPRPPAGRHEHPLRPRLLRPGAVPGGQGEEAQHPGDPRHRQERRH

SEQ ID NO: 17797 - protein, 485 aa, Pseudomonas aeruginosa
LPSPGPQPVRRHARRKHLQPRRQLPHERPQPARRRVADPGPARRPPGTLQRVLPAARRRLALLRRALPVPRGTERRRHRGQRPAAALSPGALRLRPQRRPADRQQRRNPPGRGAGLRQGRRAHRRPEPAGHRLHRGLLRTEVLVRYRRRRQFPPRGRGDRPDHAPLRQVPRLGRQLPAVGPAAEQGAQLRRRHLGVRRRLRAHPGRRRGGHLQLHPRRRPRAVGLPPRRAVRAELQPGTDRLLPAPHRTFLPAAGLPAVPGRQHRARTHLEQRQRIRQRLHQRRQPDDRLRYAAGAADLQLRDQRRELQGVLPEPRAELLSGVQAISASNSRASAFCHGSPCATTRRRMRLAWSRSPLSMQARARSRLAEASSGGTVAGSGWSSSRCSYSATSGSSWRLLSNARGSSSAGSALPAAARRGRSGLSRGFSRAPQSRSRLRSPKPSAPEVASGCCKTGGSASGRSLQSSSLVVAAGVSVAGICSSAG

SEQ ID NO: 17798 - protein, 141 aa, Pseudomonas aeruginosa
MSAPSSLSAAAMAARGAAAGAGGGDGGGLEGAATGGLACSSTFAGAGAAAGGRGARRSGRFRATRRFGSTAWTGASSRRRRNSNTPSRARTSSRTIIQRQYCESVGVSTGCATEGAAAAGGGAAGRTAWRRASCCCSSATW

SEQ ID NO: 17799 - protein, 566 aa, Pseudomonas aeruginosa
RARLAAEHFQQGRVGEDHIGRHRMLFGQLAPQRAQGLPHFPLFAAHQLAGGAGAAAGGALGALWFEVAAQLQPHLAPQQRTTGLGQAQAAEAVQVDVGQAARDQLTEQGPPLVFATPLADPEHRQVLVAETADLLGLAAEQDIHQMADAVALAAAVDRRQRLARGFGGIPGFHAVHAVVAMPAGLRHLLVEIGQQRLAPATGFLTERQHGFQLVPLDALVPLVALGTLHHLPQQQDVLQTVGHPGVGRQAIAAGAAGFLVIGLEALGQVEVGDETHVGLVDAHAEGNGRHHDQAFLVEEALLVVGTQFVGQSGVIRQRGEALVAEEFRDLLDLLPRQAVDDAGIAAPLGEEAEQLLARLLLGHDAVEDVRPVEAGEELLGVLQVQALDHLLAGTHVRGGGQGDPRHLREQLGKLAELQVFGTEVMAPLRHAVRFVDGEQADRQSLKEGQHARLDQPLRCQVEQLDLATLQALGDVPLLLGVEGGVQRHRRHAEFVQGGDLVLHQRDQRRHHHRQAFAQQRRDLETQGLATAGGHQYQRIATLGHPLDDPCLVATEGVVTENVFEDA

SEQ ID NO: 17800 - protein, 114 aa, Pseudomonas aeruginosa
PSISGISMSEISISSSSSGRRPSESMFCRYSRAWRPSLSAVISTPTASRQRITCLRATDESSTTSTRLVTARLWVSASTTPWDTSSDVGATSASTFSTSMISTNCLSTRVTAVR

SEQ ID NO: 17801 - protein, 284 aa, Pseudomonas aeruginosa
RWAPPGNLGLSIGIIGAALGFQASVHMSADARQWKKDKLRAHGVTVVEYASDYSVAVEQGRREAAGDPYTHFVDDENSRDLFLGYAVAAERLRGQLDAAGIRVDSEHPLFVHLPCGVGGGPGGVAFGLKLAFGDAVHCLFAEPTHSPCMFLGVYTGRHEQVSVQDFGIDNRTAADGLAVGRPSGFVGRAMQRLLDGYYTVDDDELFRLLALLERSQGIRLEPSALAGAPGIARVTREPQGYRERMGLTSARLANATHLVWATGGGMVPETEMRAYLERGRSLLD

SEQ ID NO: 17802 - protein, 358 aa, Pseudomonas aeruginosa
PSPNSFRRSSRPSAAKKSPRASDAPLSRRRPPLGESRPAWQTGGRPITRKAHACPDRPEPLRQRQLPVLGPAVRHPRLLPTCLVPPAHRSHRATARPGDVRHGPDAQGRRLPRGRPAPHTGADRRAGPVRHHARPGLVALQPVAVAGGDRGGRDPGRLLPRRHRFQRDDLAVPWRCRPVGGDHLGDHPARPAGHAGAGLAAGFGLAAGVVRGNVPVDPPGGAGAHRPRPAGTAPARRAHPAGGGGAAAGLGIQHRGDHRRGGGRQPGADRRVRPADHGRGDAAQRLRPVARLSHRQADRHAAGAAQGPGHRSRHAELGARRGAGQRPFRAPGSGAQRAVQRLAQSLRFAAGRPVPAPG

SEQ ID NO: 17803 - protein, 111 aa, Pseudomonas aeruginosa
IVTWCGRSRSAHRLGSSYSLQLSTYRLGYFRRRNQLCFRSYTMSNRQNGTVKWFNDAKGFGFITPESGNDLFVHFRSIQGTGFKSLQEGQKVSFVVVNGQKGLQADEVQVV

SEQ ID NO: 17804 - protein, 154 aa, Pseudomonas aeruginosa
ACLNWRPRWLWSAKPSSRATSSGARPLLSSALACSRRRCLSQAWGGMPVARRKTRAKWNGDRLTAAASSSSEGGSSNRAASSSRARATANGSCPAFGASGRRAWRRNRASTVSRQRVWVSRLPACSASRRCKWTKARARGWSWITLSAKRGTPP

SEQ ID NO: 17805 - protein, 1421 aa, Pseudomonas aeruginosa
  UNSURE (214): Identity of amino acid at the above locations are unknown.
TKVSSSRPPASRRWLRSTPSRCAPSLSMAPWARRLLAAVLSCTRTMRRLSKACLSIRYLIMRFRPLPCWAWSSQVQPISQAGKAGRNSAKRVVPTSCTPRRTASGNALPSRCSARLWRYQSGRVGPSMYCSASRLASARLTSSGMSASTSGSRRKAPRCRVIGSGLNMGALLDIDAKLRSHQSVAAAFSAAAETGYDERTAGRRGRPRSRSPAXYQLRASGSSMRATLVAGGLTRGPTSAKLARKQDPRLTPASRGDIIGVRMSLSIGLIAVVALVYMAILFAIAFYGDRRRTPLSPRLRAWVYSLSLAVYCTSWTFFGAVGQATGQLWSFLPIYLGPVLLMLFAPWVLQKMIMISKQENITSIADFIAARYGKSQALAVVVALICMVGVLPYIALQLKGIVLGVNLLIGSGADSTGTRAQDTALIVSLVLALFTIVFGTRSLDVTEHHRGMVLAIAFESLVKLTAFLAVGIFVTFGLYDGFADLFSQARAAPQLADYWEETVHWPAMLLQTGVAMTAIMCLPRQFHVTVVENIEPRDLNLARWVFPIYLVLAALFVVPIALAGQLHLPAGVMPDSFVISLPLAEAHPALALLAFIGGASAATGMVIVASVALSTMVSNDMLLPWLLRRREKDTERPFEAFRHWLLTVRRVSIAVILLLAYVAYRLLGSSASLATIGQIAFAAIAQLGPAMIGALYWKQANRRGVFAGLAAGSLLWAYTLVLPVVAKGLGWPLERIPGLTWLASNPFGLPIEPLTQGVLISLVGNFALFGLVSVLSRTRVSEHWQASRFIGQEISQRQNSRFMLAVQVEDLLMLAARFVGEERARQSFIRFAYRQGKGFTPNQTANNEWIAHTERLLAGVLGASSARAVVKAAIEGREMQVEDVVRIADEASEVLQFNRALLQGAIENITQGISVVDQSLRLVAWNHRYLELFEYPDGLIYVGRPIADIIRYNADRGLCGPGDPDMHVAKRLYWMRQGTPHTSERLFPNGRVIELIGNPMPGGGFVMSFTDITAYREAEQGLKGANESLEQRVQERTQELSQLNQELSEAKSNAEAANQSKTRFLAAVSHDLMQPLNAARLFSAALAHQDALPGEVRDLVQHLDSSLRSAEDLITDLLDISRLESGRVSAERNPFPLNNLYDALGVEFKALAQEQGLHFRLRGSQLRVDSDIKLLRRILQNFLTNAFRYAKGHVLLGVRREDGYLRLEVWDQGPGIPPDKQKVIFEEFKRLDSHQTRAEKGLGLGLAIADRLCKVLGHPLEVRSWPGKGSVFSVRVPLARQAPPALANGHKAEPAQALNGAQVLCVDNEDSILAGMNSLLSRWGCQVWTARSREECATLLDSEMRPQLALIDYHLDDGETGTQLMAWLRTRLGEPVPGVVISADARPELVAEIHAAGLDYLSKPVKPAALRALLSRHLSLR

SEQ ID NO: 17806 - protein, 146 aa, Pseudomonas aeruginosa
VSPPPTPKAPAGRAPASPPRRSPCRAAGPASPRNPSPRAGSRQGSAPPAGDRAPRARRRYSPGTPPGRGTRWPADPRSSSAAVAAAPCDRRHSAANRARWSGSSASARRTAARRARPVPTGARRSPNAGSARPRRGESCGWWTARG

SEQ ID NO: 17807 - protein, 155 aa, Pseudomonas aeruginosa
AHRDGDRRRARRGVSGSPRQASAGLRRSARAPARRRVRRGSPGDRGRPRATPGRPLRRRSAAPARPAAGVAAPGCPARHGARCRAAPRIPPGRRGRSGTTGPWGCRRHCARNARPVAGRRRWSAATTTGRPTRRRRYRCPAPARRSPPVPSIARP

SEQ ID NO: 17808 - protein, 483 aa, Pseudomonas aeruginosa
KDLAGARPKTGADRCRFLEHVLQTGHEAVAVIVAIVVGDLVGLRLDVGRADLHRIVDVPVHAQVVGLGLGVADFASGGIGDHVVVFHLDVVVAVEHFPGADFLVFRLDGVELGTFQLVLAGLAGQGVGQLRVVTLGLDVLVGVVIGLQLACQVFGLGRERAHRPGAFQAPDAIVLVGTGRRVGDAAEGRAVAVVTGVVAAAGGDAAHAQARTDARVEGGVVEVAVGIVHADMQNIAGFVHRREHAAEVELLDAVAVAVVGVLGGYAGGQVGHVGEGRVDLGAHAVLVGVDPVGQFVGGVTLGSGHPLGAGGLFQAEVGVEATELQVDRVEAGVGDRSFVEIAVVGAAGVVRQVEVDLVFPVLVRGAAEFDEGAAEVGGIGGVAILGIETVETAVVGLQATAQLEAEFLVGGGDFEATLGLDHDIGAVGGHGAGERLGRYGQSQSAGNEAERVLTDHRRFPLNGVCIGNTRVPGYSAPLVPRWP

SEQ ID NO: 17809 - protein, 345 aa, Pseudomonas aeruginosa
RPVPLMTALCTVVPLLSLGRRRTGPIRHSGARLGPAPETGSLAAMPGALRKDVGDALSYRARARSAIAQCATASLRQARAPLSGIEGAKDIPECAPGTADRRTIGLFSPFSPPISVSNCKDDATRPASGHSRLAPSHPNHRLNLPTRPIGNAQQPTSARPPIIRQTRYSQGSSPMTDSPRPELDMETQEFVHQLFDLARQGNSQRLEQLLQQGLPPNLRNHKGDSLLMLASYHGHADTVRLLLAYKADPDLRNLAGQTPLAGAAFKGDLAMVELLLAGGADVEGASADGKTALMMAAMFNQAEVAASLLAHGARRDAQDAAGLTPLAAARMMNAEATVALLSRPH

SEQ ID NO: 17810 - protein, 469 aa, Pseudomonas aeruginosa
GNLSTESLHAPDVRRSDPFPPGRLFLGSRREDPGDPRRTPARLPATGKRWRPAGSPPRLWLPGRRLLRGVPYRPPGRRAHRRRRGSQLPGAGGRACGRYRHRYPGRHSLRQGPAEPRAENPDRRGRQRALPYRQRGQQRVRHPHRMIRGDRSAAFAGRGSKRFHQVLAALQPARRRAGVRRLRLLRTHVLQGLLRLGEPGRRRRRGRLGEFGLGHQPGQAAQVARLERLHGLLSQQHLLQCGRLHRRDRQRRRWRQLADLLDLVARLAGEGPQVVQRRPADHRQGDPGQRVEGADLRQADLAAQQRTRQRWQEQPEQHPRIATLDAEADAGQHHPYAYHPPGGGQYREPLVRLVVEMHQAIAEVVGEGFSRAYRRSVHEPGAGVVHLFVEQRHQLFLARRHPVGSAEQLVVARAAVAVDLAVFLGFVFLVDQEYGAAEQQVDHSAHRHAVVEHAPVALVVMGELGGGAE

SEQ ID NO: 17811 - protein, 100 aa, Pseudomonas aeruginosa
CTISPIIIISAIIAYAHMQSFTTRYSTAFSATLPIPLDFFLIILPLFFYLPTYILRENTWLKRKKPFLRKFRSNTDSHTNIFSQDIYFFGHSATLSITIG

SEQ ID NO: 17812 - protein, 167 aa, Pseudomonas aeruginosa
PITGAANIFWPALGYPVATRGPRNTGGKAECRARSCATRSRRGKSRGRGSVRAAIGRRRHRAGRSPASPGGRRPGAPGPDAGTGFPGCPGHARGATPSIRGGRLRPRSRRARQRPGALPGGGPLAAAASRGPGNDRPAPSAGRRGPASASWKPGHAGNGSAGDRACR

SEQ ID NO: 17813 - protein, 624 aa, Pseudomonas aeruginosa
PGRSGRNGFPRPAGRSPPRSGCPARAASGAPAAGGRTPPRAWRGSGCGSPAGNRPCWPTCRKVTFSSSTCGCLPSWKTSLSSHRSFHSARGCSAISRKCPLTSSGWSLTPSPMRPVGAVPLQGALAEQLAALAIDEATGVIVILQVRLGRGVGNGAIAGLQQQPRILEVVVAASGARGAAGQAQAEALDHRFVGDQPAVVHVGGGTAQAGEHRLVVAEHQQVRLGAVPEMEMDALFGTEALDEMQVAFVVLHAVFALGIPGAELEAVGVGEDAVLLEDQGDDLRHREVLEDPLVVALGEVGQVRDEGEAIAGQALAGIALGSAVDQAVDTLALRGEGEEGGPVEERFEVEAGALSDQFEFETVGATDAFVAVEGEDLQVVAEAVEGEAEVGLVGRVEHPLSPVARKTCTAGVPVRRARSEVRDRADATSKKLCKLLRTSPENRGAPDPRQYVTKYFRKIRRAKDRPRTGPAHAQSALQTLRQTLLKLCEHFRVALLRRMDAEILAAEARDDVEMDVEDRLPGGGAVELGDLHAVRLHLLDQGAGQALDHGHDLGQVLRIDLEQVARLGVLGNHQGMPVGLREQIEEGEHVLVFVDLVAGSFAANDLGEDVLGIVNAVQTHGGFP

SEQ ID NO: 17814 - protein, 496 aa, Pseudomonas aeruginosa
HSPDGPAVSHSHLLNIGKCVMTPGYPLALSLAVSMAVLGSALPAQARQDDPSLFNRQARGELSEYGGARRVEQDLTQALKQSLSKKKAKNVILLIGDGMGDSEITVARNYARGAGGYFKGIDALPLTGQYTHYSLHKDSGLPDYVTDSAASATAWTTGVKSYNGAIGVDIHEQPHRNLLELAKLNGKATGNVSTAELQDATPAALLAHVTARKCYGPEATSKQCPSNALENGGAGSITEQWLKTRPDVVLGGGAATFAETAKAGRYAGKTLRAQAEARGYRIVENLDELKAVRRANQKQPLIGLFAPGNMPVRWLGPTATYHGNLNQPAVSCEANPKRTADIPTLAQMTSKAIELLKDNPNGFFLQVEGASIDKQDHAANPCGQIGETVDLDEAVQKALAFAKADGETLVIVTADHAHSSQIIPPETAAPGLTQLLTTKDGAPLAISYGNSEEGSQEHTGTQLRIAAYGPQAANVTGLTDQTDLFFTIRRALNLRD

SEQ ID NO: 17815 - protein, 1392 aa, Pseudomonas aeruginosa
SDQNEKGAPVSTGAPFSFRAVSLELALDLAPLLGQALVRDRQPGSQLLGEQRDPVLLQHPAIHLQLGVALAFLGVLGEARLVLRPEFAQLAAPHPVALDLAGDLVQALLDGLEVTRILLQPLQRGGADEPRIHQVGQLALDVVQRHGHGQLDLALEALLQAVPELEDIQHQACQALGVLVPGSALALGQRGQGGAVARQAFALQHATVETGQEDVLDQRLDPSQLAVQQAHLGLPRQLGAQVLGRLGQLLQQQSLQGAAVLVVGLGLGREAPFLDLALLLHQRRVYRHRQSGDLLLGLLGDAGEGLGLHRTLLFLVGLGYRQRRLAGFGETRGEFGQVAALAEELALGVDHLNVHPQVIVQLRRRLGPGLVGYPHAGHALKLAAQHLRQRTFAEGDALQGGADEVRYRHEALADRLRQVAHQRHRLVVEQAGHQPVDAFGRQLRQQRRRYPHGDAVARGAGLELVAQRQVQIAQAQAIRVLRRSDFAGFAGQHVFLAHQQQVRLVLPLAGVPFLETGGLVDIRRQARVVIGEQGFLVGQDVAPACLGFQLVELFQQLPVGAQALGAAVDLAAHQAFADEQLARHRRVDRTVVHRTSTDDDEAVEGDLLERHHLAATLLPVRLEVVGLDQVPSQRLQPVRLDLRDHSGEQLGGLHQFRGHDPLRALASDAAGRMDPETSLASAEVVAFLGLLPDLAEQAGQDRFVDRRVIDPRYLAFVVGRRAFLRLRLARLGLGRTPERQLQFAADQGQLAVGVAPLTQAQVVEEVLPAPAAQGIGTQRLALLLEATPEIDQRGEVGIRVLPLRVRLVGGLLPLHRTLARVLHGQRAGHRQHFLEATLLGRLQQHAAQPRVDRQARQLAPQRGQLAFAVDRRQFLQKGEAVLDRLAVRRLDEGERLDVAEAQVQHLQDHRGQVGAEDFRVGEGRTRVEVLLAVETHAYARLDPSATALALVGAGLRHRLDGQPLDLGAVAVAADPRGAAVDHVTDARHRQRGFRDVGGQHDLASRARLEDLLLLGRGQSRVQRQHLGVAQVGLAQHLRGVADLPLAGEEHQHVAGPLADLAFVGGDLVEGGEDALVHRQVVLDPVALLVGFRRQRPVPGLHRIGAAGNLDHRGAVEMPGETLQVDGRRGDDQLQLRTPVQQGLQVAEEEVDVQAALVGFVDDQRVVALQVAVVLGLGQEDAVGHQLDQGAVVALVLEAHLVADQRAQRRTDLFRDPRRHAARRQPTRLGMADQAVDAATQLQTDLRQLGGLARAGLAGDHHHLVGGDSGLDLVALGGDRQAVVVADRRHAGAPRLDLGAGGLEALDPLRQARVVGLLAQFVELPAQAVAVADLGLVEAPDELVKGRSLVGHLGFSNAVSVPQSRRTGEAPATAEAKNIRNCRRFERKRTNPG

SEQ ID NO: 17816 - protein, 209 aa, Pseudomonas aeruginosa
STGWNRPCATAGIIRQRREHEPGPEHSLRRARGRAKGRVHQQHRRARPAVVRRSLRRPQPGASGRRLRGHHPVQGTHRPRHAQRRPDQRGDRHRAARPRHHLSRPDPALHPSGQARRRPEGRTGSPREAAEEPRAHGHAGVQPGRQAGGRRRSGDHGAGREAQRRAGRTAADQHRLSGFPYRRAIRPGGLAGPPRAALPCPLSYLNHQG

SEQ ID NO: 17817 - protein, 472 aa, Pseudomonas aeruginosa
PKALHRPKPLTGNRSRHGPSLAVAIPDHLRRRPGGKHPDRHPAAPGRRPAGLHQPGRPAHHPVLPRLRPRRTAARLADPAHRTPPPAAGDPAAVRPQQRARRPRSGLSRPAPGSPGNVGLLRAADRPRQPARRRAGRPGPARPGDRPDLHGHQRFAGVRRATGRTDQRLVRLALDLRRHRGLFAALVPAALALPAATPGRRPARPRRLPAAVAPARAVARATGIDPVARRALHPVRLFHPVPGEHGRYSLAQRDQPDPPADRPGSAERRLYRRLAGRPPRPPARPASGAGGLRPGAGGGAAEPGQHRVPAGTDGLERDQLDDLAGGAELPAAQRSGQRFRRRRPEHLGHAPGRGPRRGAGRPGGGGTGSRRDALGRPRPGAGGAGLRAWRQHAGWRHASAAVQSPCTVTLAVIPALRWTSAGTWSRRMRTGMRCARRTQLKVGSTLASNWPSGVELRSVIPLLMLSTVPSIG

SEQ ID NO: 17818 - protein, 181 aa, Pseudomonas aeruginosa
WHHCCQVNSSCARAARARRLASSSWRASRSRASRNGRLIRSRRSLRGPAGPASSSSPSSPRKRSRALRRTPRAPSRQARRWISSLPRSSARRPSSQRRRSCSGNRLACRARRNRRSAMRPPNQFSACASGRRVRRPRSTQVASSRRRVSQPGRKVSKRKITTAKPTPISTPWAEFSRVARL

SEQ ID NO: 17819 - protein, 231 aa, Pseudomonas aeruginosa
NSAICRSRCQDRVPALPTRPSTSPLATARMPFSAFTALSSSTEQRVSRYRWSLLHCGSTATCANSSRSASIDAGSAPSRALASAASQRSTRRSSSSLSRARCRATPRAVRNRLSRSRESNARAPARRRPRSPSNQAWSRCASTSTILLSALSSPCGCRWRGSISPRAACMPSSQVAWACLSRFCSTRCGQRIALTAEAQMIPRQISVQRATACSKTSSGWSTAGRPMIATV

SEQ ID NO: 17820 - protein, 195 aa, Pseudomonas aeruginosa
RKTNAPRTPCSPPAGTCWWSTKPTTWSGTRTRSAPNTRWSSNWRRSFPASCCSPRPRSNSARTATSRACACSIRIVSTTSKRSAGRASNIVRSPKRCRNCSTTAVFPPARARPSTASSAARATSCWPASRAAMKKLARAWSASCSTATAPVACCSATPVPPCRASPSANCTPIRCRCRASTRNCRPANTRTCIRK

SEQ ID NO: 17821 - protein, 111 aa, Pseudomonas aeruginosa
SLAPCCSNSCSSARPWHRAPSSSAAGCRRRPCAACSTPTATTWPAGYPWKPSTTSWKACHGSAPTSSSRPSAMCWPSSSTWPRARSSRATRNAWPGPSSSSPPPWTRNWRA

SEQ ID NO: 17822 - protein, 805 aa, Pseudomonas aeruginosa
SLASPRGRSDHARGDGAGTSSAMPFLPGKMPKPAVCRRPATSFHADLAGGSRYLYWKHNATPSPHPRRPRVFRVQGDTAMDWQGLRFLGESPVDGYVLQNCTYSPSLVALAFLVACLAGYTALDMVERVGNSLSHPRLWQWIGAFCLGSGIWATHFVAMLAFHAPIALRYDLPITGLSLLIAVAASYLAMYMTARPRFGLLPCLLAACCIGLGIAAMHYTGMAAMRSVATQYYQPSLFALSVLIAIGAAFTALAAVPYLRGRRSARYRYMKLIASLLLAGAIAAMHFTGMAALVLSVPAGTPLELQASADSLRLGSLTGVLASAIAACGIWAAWSEKQRERRLSENSRVNALLNQLDHAHASLRQMARYDSLTGLQNRTAFNEVFVQHLENCRLRGKGLAVMFLDLDHFKRINDSLGHDSGDQLLKIVSERIRSVLRDSDVVARFAGDEFCVLADLTQDHEAHILSQRLMQKMKEPIALDGRTLVMTASVGVSLYPNDGEQCEELLKNAGLALHQSKACGRNNAQFFSRQLLVRATQELQMEEELRQALRDDQLELHYQPILALADGEVHQLEALVRWRHPTQGLLGPDRFIGLAEANGMIDQLDDWVLRRACRDLRSLHLAGHERLRVAVNCCASNLGRASLVDEVRHALEQAGLAACFLELEVTEDALMYNIDQTIPLLERLRELGVSLSIDDFGTGYSSLAYLRRLPLDALKVDRSFIMDIPASQRDMEIAQAIIAMAQKLHLKVVAEGVETPQQLAFLRENHCELVQGYLFSRPLPLAALEEFLRAYRFDAAPPLRSLNQA

SEQ ID NO: 17823 - protein, 185 aa, Pseudomonas aeruginosa
GSLDGGPVLLHQGRRIAFEIALAAVQTHQLRGQPAHRGGRALLAGQLHRGIEILEQGPYVPLDRLVTALGHLRGEDLQRLRVGEAARQRRSDQAGVDPGPLRQRHHFGDHQGVAGNDHLVADLGHLPGAHLAHARQALAKPGEDRPQAFDIRCASAGHDRQAAAFRARRAAGDRRVDPAHAAARL

SEQ ID NO: 17824 - protein, 557 aa, Pseudomonas aeruginosa
  UNSURE (224): Identity of amino acid at the above locations are unknown.
TGELSHVETLPGARRRHRPVPVRRARPRRNPERTQGLGDPRRGAHRATAQIQAARRLSGEATRHAGEVRPGGRLRRGGRGAGRRPPGHGLAGRLHLRPGAAEDRQRHPPGAARAGPAVHQQIHHGRSPGEIPAGPEGQDLRLRLGLLHLGQPDAALLHAEGRHRPRAVLLPRRLLRRPRRHRSLGPGRQGRRRRAERLGLAEAGGQRQGRYRQGQGLRHHADLXRLQLDRARQPRPGPGREDQAGLPRPRPGETGRQGDPRPAGRQPLHRDQSGQLQGHRGVRTRRRPAEVSLSLDGVDLVHADGQRALADIRLRLAAGERVALIGPSGAGKTSLLRVLASQWRPSAGRVELLGEEPWALSAAARQRLRARIGLVHQAPPLPPRQRVVSAVLAGRLGQWPLWKSLVSLVYPLDRAGAHDALQRLDLGDKLFQRCDQLSGGQLQRVGIARVLYQRAELILADEPVSAMDPVLAGHTLALLNREAAARGSTLLASLHAVDLALQHFPRVIGLRAGRIAFDMPAGEVDRAALDALYANEQLQAERASPAGEPAVVHIPRC

SEQ ID NO: 17825 - protein, 109 aa, Pseudomonas aeruginosa
PWPRCCCYGRGCASANWISPACSAATTRAPWAVSSPASGRRHTIPGSSPCSAAPPWKPSPSPPPAWPWPGSWRFPPHCWRPAPCRSRHCRAAACRPGGHGHCAGRCAAC

SEQ ID NO: 17826 - protein, 418 aa, Pseudomonas aeruginosa
AASCAGGWHEPDLAPAALAAAGGARGGRLVRLSGHGHRRSFQRQGTGPDGRLRQRVLPARPVRSAPAGDWPGAAGNPGHVGHRHPAGGAARPAFRAAGGRSLRRAGAEPGATPAQCAARGAGAGLGRADGAGGRARAERRDPRPGAAHRRRARPAVRRSPGEHPGAARRGLAPGRQRTPRGIRLWHPAGGLAATGGLYPVPLGEQYPHGQRARLRRCRRARADALFQPEPVPAGPGRHGDPGHAGPGARGRQPERLGAAALGQPIGKRAAAPVRGNLRSPPKIGHHRCSEPSGRHPASWCPGRGRNHAQTTAIRITAGPAGPRRLQPAPTSGRRADRAAARHPMGRRRRLAGHLSGPATSIGATGRSPPGVLQREPLRWTCHQGTAPGQGQGGLRRTRRGWRQVRPRAAPQHPAIAGS

SEQ ID NO: 17827 - protein, 170 aa, Pseudomonas aeruginosa
ANAAACRDITSVQQSADATRNTSMGGHVTQHIYGMTPPSGSSQKDKTLFKSRGNYDAAWRQYGYIDNPVACSGNSKFQVVSLAEAAHGQDRCLLLQAGRRPGRLHALGYVHGQGDFVRFRPEGRQVDPQYPLPGSPRLGRRPSAPAAPLQGAGAAVRVRRSACPGPCPGR

SEQ ID NO: 17828 - protein, 193 aa, Pseudomonas aeruginosa
QPSPALSSRSSPPLQEQYPRHHQRQAEIALPGQPAHRETGPAELVAERRDQHLPGHHARDESGGTQARRDQDRHRQVGRAEQPAEPAPPGRAAEAGGSRQRHPHQQQAQADHPEADAQRSQAGAQRMAEQAPEQGVAAGLQHHHAAHRNCHQYHQIIGHADSPPPALASGAEFLLSTSRMEIDSWYTFHAADS

SEQ ID NO: 17829 - protein, 390 aa, Pseudomonas aeruginosa
PTPYRPQPAGGARRAPQRAPRVPRGAAPGHVAAGGQPRPRASPRTVRRSTAGAGEKPHAVDQPGAGAGAEAPGQPRPGTRGDRRADLRTGAQPTPLPPGHVRLRRLGGAAGAAAPATGAGARGELRDSPGTAPGNRPSGRRRTAGLRAGGIPPASGGRARQAPVRGAFRLRLSAQPVRPPRRPVPRPLPGGPPRARLATGQPGRGSRQRPGKTRPAPAGGADPAALHRGPGAAGRHRPGTDHRRTHPRKVAATRGTGALRAAAGDPALRLCADLARRRRARSGRRLAAGTDPGGGAEDLKKSQEGFSSLRSISPTRSPSISLADSLRPRASSTWTTCSASGRRRRNTLASSCRSGAPGSRSVPRPSTRWVTIRRTIPAARCSVSLRNSPS

SEQ ID NO: 17830 - protein, 802 aa, Pseudomonas aeruginosa
PGPRTAPPGRSQPGGRPALRDPGHPATAQGLSLRSARPSRGKARQPPRSLGGALRRAQPVHPDAQRAGHRQARRLVAAVVQRQALRAPADARSLGGGTAPGATRGGRQVRRTAGGHRRRRLLARRRPAARPPLAGARTAAASTGGRMNALLALPDLQPERLFVQSGDVRLAVHCWGAPDNGKPTLLMVHGYPDNHETWLPLIRQLAGRYRIVAYDVRGAGASDKPRWSRDYHLQRLSEDLQAVIRATSPDRPVHLLAHDWGSIQTWESVTDPQCRPLIASYTSISGPCLDHVGFWMREHLRQRSPKALKAVFGQLLHSWYIAFFHTPVVPELLWSAGLARLWPQFLKHAEGVRHPQVNPTQASDGRHGVKLYRGNFIRSLFRPRKRHTEVPVQLIVPTRDRYVGAQLFQHLSLWAPRLWRREASVGHWQLLAEPEQLAGWLGEFIDAQETGESPPALQRAQVRPDARSMNGKLVVVTGAGGGIGRSTLLSFAERGASLLAADLDLEAAERSAELARALGATAHVYQVDVGDTQAMETFAEWVRDTLGVPDVVVSNAGIGMAGPMLDTSPAEWERLLRVNLWSVIDGCRLFGRQMIAANKPGHLVNVASGGGLRAVAKLPRIRHQQGRGTDAQRMHAGGTGRTFDRSHRGVPGLRRYRHCPGHPLRRHGRRTPGTAPGEDPALLQATPAQPGHRRGKAGARRGAQQGGGLGGQRRTPRRPAMALRALGHAVSRALRPDFLRACHERIPPQAGPAQGPLRLQRYPPALGSRRSGSVPGDERPAHAPAFRRTLVLPPLQQGPAVG

SEQ ID NO: 17831 - protein, 283 aa, Pseudomonas aeruginosa
RRPPARRRAGFHPPGSDAFAGPRRRDPALPEQVRHRLQAVHRQDGFPFRTPALRLPAWAEPPDPRPRRLVAAPALRDHRRGGAFHLRARQVGAGGPGAGSPRQRPGDARPAALARRRGSRAPQRRPRPARAPGRQLRHPATDHAVGHRDTGLPARRRHLHPPRPGPEPARRQAPGIPTNLVAARQAGPAAEPRSHLPRRRPLLQSLVPPRARGEYPGSPGIPGQLAGGPARGERLKTIHWKYRQAPRKLELSRRLSIVTSGRVKQGRQTEGNFRKPEKCRSIE

SEQ ID NO: 17832 - protein, 187 aa, Pseudomonas aeruginosa
NVDGWNLSGEACGARVRRIDGLLKRTQGWFVSLACRYRPTNGTSGSPPRSFRNSTSTPSSATTASPARSIPRPWNGHCCRRRETPRRSACASARRTVRRTSGWTRMPSSRRATSTCAPTATPRPPCDPGCATPSATPTRWTAAAWWTWPCCIATRRSTSTCAPTISSATPGACSYSSAGCAPATWAS

SEQ ID NO: 17833 - protein, 156 aa, Pseudomonas aeruginosa
AATRRTTRTCRRSAGRWTGSRCRCSTPRCARYRSALPASCTSAATASRAATTAPPNSPPSASSNIPGAPAPGSTAPATSGASSATARSSGSAAPIPRSRSAASASSRPRSSWRSCARPSASRACAARRWWLASARATMHSSLPSCSASPRRWISPN

SEQ ID NO: 17834 - protein, 419 aa, Pseudomonas aeruginosa
SRHCAANCRNTWCRHTSPGSTASPSPPAGKRDDAALRALPLEHGTNIEYLAPRDDYERTLAGLLGELLDRPRVGIRDSFFDLGGTSLSAMRFMLLIEKRYGVDLPMAALIETPTVEGLAERLRERSAVRAFDPLVPIRAGGSRPPLFLVHPLGGHVLCYLPLVRALPPDQPVYALQAAGTGQGSTPLAVLEDIAASYLAAIRRVQPEGPYYLGGWSFGGFVAYEMARQLRALDPQAVAQLIVLDSITVDRNHAGSASDEALLLFFYWELVWFERSDEEVEPLPEGASLEQKLDHIVERAIEAGVLPAGTPRATVQRLYELFRASWQALIGYRPEVSDQDMTLLRADGPLPLALKPMHDAAGTHYGDPKNGWQHWTSGRLDVIDVPGDHLVLMKEPYVETVAAEIAALLEPSTSSERTRP

SEQ ID NO: 17835 - protein, 266 aa, Pseudomonas aeruginosa
PSQESNDGRDTTPAVRGGTLVLAQRPVLRAERDFPGAGPWPVVHRRPAPRPRRAAGAASAAARADRARCRARSALGALRAAHPAARGARRRRGAMAAGNQRARIAGTHRSGQRATDPYRGDRHRRRRPRPAGRGTAHHRRRHYRADPRRTMADPGRRPCRATLDRQRPAAGGGSASAPLHRRRRRGAPGRADRPGRSAGRSPPPGPDRAEQPGAAGSAAYPPAAPGAGRRAAGTAATTRPRTRHHGTRRADRGAGHRRRPRPPAPP

SEQ ID NO: 17836 - protein, 437 aa, Pseudomonas aeruginosa
STGCSAPSSPPPRRRRRSNVPDRKLRLGEELISPLHALYDGLQVDGAPRPAHRAAEHPVWVVTRYRDARKVLNHPGVRRDARQAAELYAKRTGSPRAGIGEGLSHHMLNLDPPDHTRLRSLVGRAFTPRQVERLQPHIERITEELLDAMAGREQADLMADFAIPLTIAVIFELLGIPEAEREHARQSWERQAELLSPEEAQALADAQVDYLRVLLEAKRRQPADDVYSGLVQAADESGQLSEAELVSMAHLLMMSGFETTMNMIGNALVTLLVNPEQLALLRAQPELLPNAMEELVRHDSPVRASMLRFTVEDVELDGVTIPAGEYILVSNLTANHDAERFDDPDRLDLTRNTDGHLGYGFGVHYCVGASLARLEGRIAIQRLLARFPDLQLAVPHAELQWLPITFLRALISVPVRTGCSAPANTASHANPIERIAQ

SEQ ID NO: 17837 - protein, 204 aa, Pseudomonas aeruginosa
PCASPTCSSTRPPTPTWPSANSMATAWPPFPAASWRRTTSRCCAPATDRSCSTATSGIRCGTSRPWAGSRPPPRSSREPEPCRAPPWSAAWAATCPRPCSATTCSPPSWTLPTPGSAAAPACASGISPATSAAATWPCGRPPPRSPRRGWSESMRWCWQPAPATSAARPPRPGSRRAWGWSARSRSTCPPPAPVSSTAWPASAR

SEQ ID NO: 17838 - protein, 101 aa, Pseudomonas aeruginosa
PGVRSPCAGRRSFRQWTEEGRTMPNDMEDHLLTVLSVASGVPKEEISRDSRMEDLAFDSLVVSELSLKLRKEFGVTGVDDELDLLETVDELFQLVEKHRAA

SEQ ID NO: 17839 - protein, 289 aa, Pseudomonas aeruginosa
GQRTPAFRHFSARRRRCRDMGTRIAFDQPTPERDSLEEEVSQNMDLTIGTHRESAFYELEFGPRTIMTLANFPDDVLPLLQMESLMTFEAMAYLRCDALVELGCYDGRALEIARLLNARYLGVDLDQRAIETLRTRIEREGMSDRADTVVDDILNHTRRGASVGSRALYLLPFNLLGNFREPKRLLDSLAERSVAAVVSVFGDSAEATRVRQSYYRRCGVQGLELHTRDDGTVFTGSDGFYSRSYSRACLHALLAECGLTVVRSASNLFAHCVTVLPEGADQGFGSSAA

SEQ ID NO: 17840 - protein, 349 aa, Pseudomonas aeruginosa
VAVVHSSRGHGTGRSPWLASSSSEPLGSWKHAFDCLRARCRDLRPDHQRIHGRRADAGAGRRIRRVLRRDRLPGHLLRRCDGRRRPAVDHRPAPGAAQERPARPDRAVRGRPGHRRPGAGLCGDGRGATGHRGRRRGLLRRGADRLRRTGRRQPVRPRVVAGARWPDGRNRARPARRHLAGRMVRLARELLRGGAGGGAGRPAGVAADAGDPGVGGQRLAARGTEGVQERPSMVGLRHQSAADRRHLRRLHLFRADPHRGQRLLRLDRTAAAGGLRPGDAGGQQHRRPPGRPPYHRGPGLRPAGGHRRDGGLRPVRTGSGGGGGGAGGDRPDRGVDEPGAGDPRRTCRP

SEQ ID NO: 17841 - protein, 759 aa, Pseudomonas aeruginosa
RFRAWRWACRRLRGNGRAYNSRLFTRLRIVLMRRLLLVLLLLLPLSALAAEARPKIGLVLSGGAARGLAHIGVLKALDEQGIQIDAIAGTSMGAVVGGLYASGYTPAELERIALEMDWQQALSDAPPRKDVPFRRKQDDRDFLVKQKISFRDDGTLGLPLGVIQGQNLAMVLESLLVHTSDNRDFDKLAIPFRAVSTDIATGEKVVFRKGHLPQAIRASMSIPAVFAPVEIDGRLLVDGGMVDNIPVDVARDMGVDVVIVVDIGNPLRDRKDLSTVLDVMNQSITLMTRKNSEAQLATLKPGDVLIQPPLSGYGTTDFGRVPQLIDAGYRATTVLAARLAELRKPKDLNSEALDVARTPNQRKPVIDAIRVENNSKVSDEVIRHYIRQPLGTRLDLGRLQDDMSTLYGLDYFDQVQYRVVKEKKLNTLVIHATGKKGGTDFLRLGLNLSDDMRGESTFNLGGSYRMNGLNRLGAEWLTRVQLGDRQELYSEFYQPLDVGSRYFVAPFLFHEAQNVDVTEDNDPLLRYRLERYGYGLNVGRQIANNGEIRLGAVQAYGKADVRIGDPSLPDIDFTEGYYELKYSFDTVDDVNFPHEGEEIGLTMRRYDKSLGSDDSYRQWDLRLNKALSFGADTWVFGGGYGRTLDDAEVVTSSFTLGGARELSGFRRDALSGQNYSLGRIVYYRRLTERSFLPLDFPLYLGGSIERGRIWNNDNEYDSGYINAASLMIGFDTPLGPLTFSYGINDENFKAFYLNLGQNF

SEQ ID NO: 17842 - protein, 344 aa, Pseudomonas aeruginosa
GRRSRRRPRSHPVAAKRAARPAAGRSSRRPWLLPPASRSPASVAAPGSVRATRRWPPSCRHWPGFPRPARRSRPHRPAQPAPATASSARSGAAAARRVPDAAGRGPVRSDRRRYRCRRRPACPPQPWRRAERRPEQAEETAAGWRERRPAAWPVPRPLPAPVRPPGGAAHAAAAGSGRPGASVRPPGQEPLRGGDATATRRAERGPAAGRSSSASTASPSAFQPVAQPKARPRRAAAPRAAPPGAGPVAVAVRRPGDRAAAVVPARPATGVADRPSAGSVPPVAGPTPRPRHPPGAAPRREPPERFPPRRHRLAARLPRPPPSRRRARLAPAGSRPAGAGARRP

SEQ ID NO: 17843 - protein, 161 aa, Pseudomonas aeruginosa
RNAVETVKIFRQKTDENLCRGLSDESPGGDAIKMAILAEFRDAVLSAFPGSPGFARAPAGTAPARTRRCRSVRRCERWRRWPRYRRSAHRPWESARCAWPAGPPPPPGAVPGPGTRGRRAAAPGSGLRPRPIGPTRAGWANRDGAPDATTPTSAPGTGRGD

SEQ ID NO: 17844 - protein, 612 aa, Pseudomonas aeruginosa
PPAAKPEHDHRDAARTFDRSLKSTSDALPIRSTATKARLCLRRPEKLHGHHLSVGRPLATIGQFADQAQTPAAEAFLALHGIQRALHVETFAAVLDPHQQTPPRAMRRQVQVQPHVAVAQGLQAADPLLVIAGESRRVALHRRIEADDAMFQGVRIEFGEYRIQRAAARAQVVDLEQQLQHMGQRVEMLEGFGAEFEAHRPVQRTAHAAIGKRQRRALQAAIRLQPHFEHAHVVLHRAAELRQAALDLVEQRGRLAIALEQLEQPRLAEHLASLVAGLEDPVGKQEYPIFDIQRIGFATVAERRRFEDSQRQVAGHQGDPLAAGGAQQVAVRQAAVPDLHQFALEAQVEQGGAAEHADRQDALQLGVHLAEDVGHRIALGGHPVEHLGQRHRADRRRQAVAGEVAEQHVHAAGRLVGGQQQVAVEQREGRLQVAHVAGVQAAGMGHLVEHRLGHPLFVEQVLVVPDDQVALLQHRSLQQVQASHGVDLGFEDHPVVRLGEEVVAARLQALHQRLGFAEGGEEDDRHQLLAGLLLDPPGSLEAIHHRHHHVHQDQLRPLGLEQRHRLQAVAGGQHAMPLAADDGRQQQAVGRVVLGDENRQALDPRRRGIHLS

SEQ ID NO: 17845 - protein, 283 aa, Pseudomonas aeruginosa
LNPKHRPLALPSDGRARLRHDHCLTRCMKQATTVFRRIMACSHTSLRFLPVLLGLGYLCAANNSQAQGFTAPEVLIGSTQGFLEFKVEEYLQNSGLDGRYQIQVNRVDPRLRLAECDRDLTLSQESPAQPIGRVTVRISCEGSAPWTIFMPAQVKLFRQVVVAVQPLKRAHVLEDADIALVERDVGLLTQGYLTDPARVVGQKLRRPVVNDQVLAPVFLEQAEAVRKGDQVVILARTATINVKMPGEALSDGAPGQQIRVRNLRSQRIIKARVIEPGTVEVNM

SEQ ID NO: 17846 - protein, 138 aa, Pseudomonas aeruginosa
TGKRRTKISPKVFQAFAEKLGKRPIPSRFTTMVIDFNRLNPGSTPATTGRTGSTAAGRPDATGADKAGQAATSAPKSGESVQISETAQNMQKVTDQLQTLPVVDNDKVARIKQAIADGTYQVDSERVASKLLDFESQR

SEQ ID NO: 17847 - protein, 161 aa, Pseudomonas aeruginosa
TPEPEMPDSPTLLDLFAEDIGHASQLLQLVDEEFQALERRELPVLQQLLGAKQPLMQQLERNGRARAEILREAGVSLDREGLARYARERADGAELLARGDELGELLERCQQANLRNGRIIRANQASTGSLLNILRGQDAPSLYDSRGGTASSSRQRPLSQA

SEQ ID NO: 17848 - protein, 162 aa, Pseudomonas aeruginosa
PRLPADHLCRSQPALPELPGGHRPRPRDGRAGRTHPQHRRTFPAEWRGVSRRSLPRRRAYRLGMRAPGAVRRTRRRSLLLGRPSRRSALPPAPQRLPRQHQAEPADRRGNRRGETPRAAERTTAGYLRHRRQAALRRQCRRTPASRRDLRRLQRPAATGRDQ

SEQ ID NO: 17849 - protein, 208 aa, Pseudomonas aeruginosa
RDRTASRALRRKARRDLRRRPLQRDERPRPASGGSLRLPVTARSAALRERRTVLSFTGPAPAPPGAAGPRDGRRPRAPATGDAPSPVAGDARRSAPAGGLRPRASTRTTAGRPGSGRAARSRPAPPAPAPPGGGPGRCRPLPGSRRPAPGSRGESAVPPRFPPTPAPRYAACARRGRRPAGSSGSSPMPPPAPADRCPDRRRTRGCGR

SEQ ID NO: 17850 - protein, 856 aa, Pseudomonas aeruginosa
HVSAKQPHQRAGRQRPDAGADAEGHQQHGGQRNPSLGLHMVVGKGHCQRIEGELQHARGDSQGQQQRQRHLLQQCQRQGEQAQQDGAGADQPGAVATVGQPAERPLHQQPGEDAGAHVQADLLVGQPQLVGIQRRQAIEGADHQPRDQYGGQRLRHPADEEAWFERRRAQRCGVDLVGQGQRHQAQGEAEGHQHQQFRPQLRMRHQDHLAEHQAQVGSRHVAAEHRAALAGIGLLVEPALDHHVLAHQAQAHHHAQGDPGRQPGQQAMAEDRGGDHPGAGDVGADVADPGDQPVTDLAAQHQAEVVGGHQRADPQAVDLVRRQAQRQVGAEQAGAGEHQQGSEIESAKREENPPHRTSGPVQGSRRRSRTARLAQRWSPGEAPGQDAGCRSRHPTPRPCRREAAGGDTGLGKYHGGSGLGCQDATLPGADLVEEAGQLHALGRHVAFDELAAEQFARQRAAFQAPQGIVHGAGQGQFLRYLELALDRRARLQFVFQAVETGGQAGGDGQVRVGVGARQAILDAPRGGSAGRDAQAGGAVVVGPAGVVRRSVGMAEALEGVHMRREEGREVRQAGLLAADEVAERGGRLAIGFAEDVSPAVQFDDALVDVHRAARRLRQRLGHAHHDQAVLERDLLEQVLEQEGLVGQQDRVAMQEVDLELAGAHLVHEGVAHQAQRIHAAVDVLEERPQAVVGRHAEGRIAQLAPAIRPQRGLERLVGIGVRGEDEELQFGGHHRLPAVGGVARHHLLEQAAGGQPGRRAIQFLRIADGEGARSVAPGQAMDLGRLGDQRQVAIVAAIEARRRVAAHDALQQHATGELQAPAAEEALAGHHLAARHPVEVGGDAFDFFNSSQPFGE

SEQ ID NO: 17851 - protein, 190 aa, Pseudomonas aeruginosa
ALAFDSHDFLSLLVSRMPHRAAAAYKIRIACSRYQACGTFSRVQSLSPQRRSALPAGYEEKRRPGVYPLCLRRPTRHRSTAVDSRNTQGRLARRIPAPGRPHRPASERVVQPGHRAERRSPGRRRPRRRRRGRRQRPPAALRPADRPAVSGNRRQRRHHRVRPGRGRHLPRCPAPALRRRTARPALAETR

SEQ ID NO: 17852 - protein, 202 aa, Pseudomonas aeruginosa
RWWSTPPTTVSRWNRAAAKRPAIPTPISSTTKTPATCSSATPSPPSDCAASWTPPASASTASTRCSSICPAGSAAVPAGWPSASSWRSATRCTACSPSRPIRPACSSASIPAATSRFRCRTSASTTAPPPMAWRWGVRRASSAAPCSACSTATTRWTTTSCSACSPCSSAARASAWNPRPWPARRASPGSPVSRRAIANAWG

SEQ ID NO: 17853 - protein, 161 aa, Pseudomonas aeruginosa
SIQISGGTSMKRFIQGEHRGQSSLLPESLDDYVADTNPVRVVDVFVDELDLGQLGFDGVVPAETGRPAYHPADLLKIYIYGYLNRIQSSRRLEREAQRNVELMWLTGRLMPDFKTIANFRKDNGKAIRGVCRQFVVLCQQLGLFSEAPLAIDVSKDITTGL

SEQ ID NO: 17854 - protein, 340 aa, Pseudomonas aeruginosa
STCSSTASPPPGTTATEASGAPARPVDQRDAEHHQQHAADRRRRQALVEQQPGGQRGHWRHQVEQARHLRRGAMPDQRVEQADGAERESQHQPAEGQHERRAPLHLAAFEKQGGEAEQGAAGQVLDDAAGAQVHAAAEALLVQRAAGDRRQCHQHRGPGQAVGATVDAAEYHQGYASQAERQSQPLPAADLLAEPDAGQGRGSQRLQADQQGGQAGRHAVLDGEEHPAQVQAMDQQAGDRDMPGQPCRARPGRTAEQGEGGQQGGREEQADGQEGEGLGVRQAELGAEESSAPEQHEEQRHAAAEPGGCAHARFSSGGGGTVVAPRACRCQSSSERPRSR

SEQ ID NO: 17855 - protein, 223 aa, Pseudomonas aeruginosa
SEAYSTTVTPWARSLSFFHWRASADMCTLAWKPSAAPMMPMERPRLPGGAHRYPVAGEECPAIRIGQPRVVVVEADQAVLQGQALGMGEHFIDAAAGLDRAGDRQVAIAFQPEPAGQFGGVMLAQGIVEGGDLDQVGLDDAAAGGGFRKQPGDQRGEALQAGAGVGHVGGAEADVGQGFGARRDGRVEPLARTQGDEVGQAREFGEPVGLGCSENQRQYSCGG

SEQ ID NO: 17856 - protein, 845 aa, Pseudomonas aeruginosa
RNRMRHPRPQRGAARQGDDRRGLPQRPAPAARPWRAAAMHHGRLPAGALLWQRRWRPGAGRRADPGPSPALEQHSARLRHLRCAGTGWHAVRAVHPRPAQAGGGALRRPRLATGGGHRTGVLRLRPEHRSQRAVPGPAGAGWPARAGLFGLQRVFQQRPAAVLRGRLPLHGCAGPGARHLHARDGHQPVRDQLPAWRPGPAGRPDLPVQAPAQGGRAQARPDRGVHGQAAGEDAGQLDAHPPEHRRTGRRAKHLQRSRWRAFRRVPPLHRRPAGLPGGLHALLRAACELLPAPLPSLRFAEQRLLVPRQPRRRPAHPGQRSLRAARRESPAGRRRQPLPGHRRQPGRRSLRPGTRTGAEPGDPGRVRGTGGTDPALHHVRCPAAPERQRAGARTVRQRVRRRLRGDQEHGADQLLRRDQPLGASRPGSPGLIHRGTFLALCHPLPPRGGRVVVSGAGFGIPRPVPGPPRDSNAVRAGQSASGAGSLVRDRRSDAADFLLFSRSLFRYPADAHRLRPAQHLPGAAPGGGQGRRPVGRRADGRQLLRPGAGRQGRSPADRPGRPHPRLRRLRRGGHRRGPRPWPAALAAGLDRLAHGDGPGPDVPVHGDRELAQRAGRCQPARRGVRRLHGGFLPGPGARPDDPGGASATGAGIADAGGLLLRPVPGAAGPDPQDPPRSAAPGAARTTLLHPPGAAVADHRIGLGAGGRLLLWPGAAVCQPVGVAQRAGRPVHGRLHLRRAAGAVAARLAVRPSRPRLADPRLRHPAVPVRLAAGIVATDAAGVAAGPGNRREHVAVHPLSAGSGLFQRPCGDRATGFADRHAAGDLRRRRLHRAAGGRRADAAVWR

SEQ ID NO: 17857 - protein, 208 aa, Pseudomonas aeruginosa
AGDVAMSPTLSLHLMVRNLPPGQRRPKIAQAIGEESAGRLQRVLLERALRLPDRGFSARILWFDDDLDSDLQALAVALGWSLMSQPAGDPGERMRRIAALGLAESEAVLLIRHDCPVLDGDYLEAACTALGRHQAVLGPVERGGYALLGLTRVDPLLFESMPWGGDRLLALTCERLRQLGWEHHLLPVLWDVDRPEDLPRLAALGLVL

SEQ ID NO: 17858 - protein, 363 aa, Pseudomonas aeruginosa
PRTGSRARAKRVKTVEKYGYMPLFVEKLSLPVSCNGLSNGRAGVWHDRLRGAPMAGVLDSVNQRTQLVGQNRLELLLFRLDGNQLYGINVFKVKEVLQCPRLTVMPKSSPVVRGVANIRGGTIPILDLALATGRRGLQDLTNSFAIITEYNTKVQGFLVRSVERIVNMNWEEIHPPPKGAGREHYLTAVTRVDKQLVEIIDVEKVLAEVAPTSEEVSHGVVDAETQSRAVTKRVLVVDDSSVARKQVIRCLEAVGVEMTALNDGRQALEYLQNMLSEGRRPEDELLMLISDIEMPEMDGYTLTAEIRSDPRLQKLHILLHTSLSGVFNQAMVKKVGADDFLAKFRPDDLAARVVERIKAVDAG

SEQ ID NO: 17859 - protein, 476 aa, Pseudomonas aeruginosa
CGFRVVQGLPREDLRHCAGQQQAVPGLEPAEQADGAAGHQEPGRAGAAHPDPARRPARDGGGRDDHQRDPVVSRYLPVRGAQAAGSSRTDQGQRRAAPADLVGGLFVRPGAILAVDGHRRVREDQPGAVEGGRADRRHRPVGVDAHRRQGRRIRHPGDGPRSVPGASATLFRRQGTGALGGQAGDPQPRRVPCPEPAGQLRQPRQVRHGVLPQRADLFLRRGEARHPAAHPWHAQAWRLPVPRRLRGVEQPARPLPDGAVQPGHHLPGQVAQGSGPAPGCAGGDMAAWRGSAWDGQVGRDFRPLPRLRAPRAAAPSQPARHRTAGSERGSLGLRDLVVLTDISDSQVIWQVAALPGNCLHDSSLPSIRHAYQETSMAITALPSADGQELTIQIQGRFDFGAHQDFRDAYERVAITPRRYVVDLRNATYLDSSALGMLLVLRDHAGGENAQISLANCSPEVRKILAISNFEQLFKIS

SEQ ID NO: 17860 - protein, 129 aa, Pseudomonas aeruginosa
WVGHRKSTSGSDRMSAPHLDDRVLASLQEVMEDEYPVLLDTFVLDSEERLRSLHAALQAGDAQALRHTAHSFKGGSSNMGAVLLAGYCKELEESARRGDLQRAPALIEQMEREFAIVRILFKQERQRYR

SEQ ID NO: 17861 - protein, 143 aa, Pseudomonas aeruginosa
CRVPRATSGTSASSGTSWKPCWRSVRKPVAGARRCWPISTRRCRSPAGIATTAWTAWKPGMPPNPRARRCRRSTAAASATASAIWWISCSAARPRRSAVSATSTWRCSGSARGVAKTSGGPCSVSWSRAAWPTSTWTASAACA

SEQ ID NO: 17862 - protein, 405 aa, Pseudomonas aeruginosa
RPSQASTVTPSPPREEVCVTQKDRLDDSRSNLYADQLNRGFRGLRFLPELERDYRRYMLEDSFALKRIALSVGMLVWLAFIGIDLLILAGPPLWGVLAVRLGVLVLLLVCGCLIMLRRHIQLMVPLSIACVLALGVGAAAVVGLAHRADPGYPYEGLLLVSFAAYFLAGLRLSQALSCALVVLLAYLGFEWWAGTQEPLGNNLLFLLFGNLIGAVGCYLLEFKSREHFLISRLLRVMADHDSLTGLHNRRSFNQHLDRLWRQAQREQKTLALLLCDVDHFKAYNDRYGHQAGDAVLQRIGAVFEANARRPLDMAVRLGGEEFALLLYGANEHEARLRAEALRAQVQALRMEHEASDTAREVTLSVGVSCLWPTPGNDLKRLYDLYEHADRALYEAKAFGRNQVVA

SEQ ID NO: 17863 - protein, 374 aa, Pseudomonas aeruginosa
LRDEAANARFDRKKCQARPLFAELPAPPRDDFRTDPMQRLIQANGQPHYGIFPSAPQHINYRDFDFRSPMGRRVGALGKWRRFHQFQYFGLISPELIGGCALAQLSLLGVGFVYLYQPSSGRMLERRFKLPLGFGTRFSQTPDDGVCELRQGRNLLRLENRMAHREKRLLVELDDGTRIDACFSEEAPSFQPMCLCTPTAVNGWVYAQKVAGVRCRGDVRSALGDHDLQALDAFAHHDWSAGYMRPETFWNWACLSGEADGLRVGLNLSCGVNETSFTENCYWLDGELLKVDSVRFDFDRDQPLRPWTIRSYDGQVELRFEAHGMHQERLNLGLLASNFKQIFGCFSGVLRPRGRAEVRIERLWGFVEDQYAKW

SEQ ID NO: 17864 - protein, 154 aa, Pseudomonas aeruginosa
SNEISDLLFPMAQTDKHYFGTLLAQTSRAWRAELDRRLSHLGLSQARWLVLLHLARHRDSPTQRELAQSVGVEGPTLARLLDGLESQGLVRRLAVAEDRRAKHIVLTPKADVLIADIEAIAASVRNDVLTGIDESEQALCQQVLLRILANLEKR

SEQ ID NO: 17865 - protein, 703 aa, Pseudomonas aeruginosa
REIDVAVDRWPAVCSKCGEKNGMPGKALRVMLCAWSCLLAGQASALGVGDITLHSALNQPLDADIELLDVGDLGADEIEVRLAGADVFAAAGVERLQFLNELRFSPVLQGRGGNRIHVSSIRPVQEPYLNFLVEVARPNGRIVREFTVLLDPLGYTPRMLPAARSGIEPQRQSSTPAPAPRSAAAVVDPALLEPGDEYLARPNDNLWAISGRLRGAGNADRAQLMEALYQLNPQAFVNADRHRLKAGVRLRLPAGYQPERGAPGAVKEAAVEVLPPADAAVVENAPAALVEAQRQADAEAEALARQREELSQRMDDLQRQLQALQEQLQQRDHQVAELQQQLARRQAVRPAAPPPAAAAPSVAQPVETPTDSQYWRWMIVLLLVLALLGVLLLRRRREEAPVQAVEPKRRVALNLPLRRAPRPPAAAPAPAKVEEQARPPVAAPSSPPPSPPPAPAAAPRAAMAAADKLDGADIYIAYGRYGQARDLLRQVLAEQPQRLSARMKLLLVLAELGDAAGFDALAEETLASGGNSEAIDELRGRYPALLQMPATETPAATTKDDDWSDLPLAEPPVLQQPDATSGADGFGDLNLDLDWGALENPLDNPDLPRRAAAGKAEPAEEEPLAFESNLHELPDVAEYEHLELDQPEPATVPPEEASASLDRARACIDSGDLDQASRILRLVVAHGDPWQKAEARELLALIA

SEQ ID NO: 17866 - protein, 135 aa, Pseudomonas aeruginosa
STGSSRRARCSGPCGRAAGCRCRPRSPRPRPCRAPRPPGCCRPCHHPPAACRRSPPGRTRRGSTCWRGSPGAGGPCGTPLSRRLRYRWRRRGRGSPACRSRGCRWCAPAGFPAPSPGSGPGSPPAAGRGCRRRGS

SEQ ID NO: 17867 - protein, 99 aa, Pseudomonas aeruginosa
AADMPTAKPEIVITYCTQCQWLLRAAWLAQELLSTFADDLGKVCLEPGTGGVFRITCDGVQVWERKADGGFPEAKALKQRVRDRIDPQRDLGHNDRPSR

SEQ ID NO: 17868 - protein, 287 aa, Pseudomonas aeruginosa
MGVPEHLQFLAQRAAARRPRDRRHQLQHQQADQHRHQRHREEARAPAVPFAQPGGDGQAEHGSDHQATEHQRRRAAELVAFDQFGAGGQRHAEEGRGGDRGDQSRRDHHRIARRQGADDLADHEQRDQAEQGVLARHPEQGGGQQRAADGHRTGVEGDQVADRGEGHAEFGGQRRHQPGDHVFAGGQGEDRGTEHVDNQRHVSSSRAVQTTMKRATATCPCRGRAMNARRRLMPPTNRSPGRRLRAAPSRSGRTGSKRCAPRSARTRRAGRGGRRVNTSASRSRRCR

SEQ ID NO: 17869 - protein, 622 aa, Pseudomonas aeruginosa
GMATEPRPEVTFTRRAAPPRRSSGRIARVTASWPIRLTSSWRRSRSLETHSSGAEMQIPALFTRPQSPVSPTFSATCAAARPMDSSSVTSISSVLIRPDGQAFARRSPSSWRRTPAITWKPCSARCSAVSRPRPLEAPVISTWRPWGERGLLVKNMSLLLEGGSLGGVDRRQQGAQAIFGQAFGAFAGDRFVDIGEVPEQPAMAGVDGGHEVAVHRDAGEELRVGEAQGADPLGERIATDVGGAQVDRPFGFHEGHEWPRVGHAARRSAGDQGDQVEMMALATAFAEVVGERAGDLPERPGDVQHHRYRGDVGAYFVGAHRRLQFVAEVDRRADGDVARAALVVVAGGDGQRRGQRAVYRGAVFAGASLQLFQLRAVQLPVQQAGTPRFQRHRVARLDPARAVATDQRFVLGGLLGQARRAFVAGEAARTQILRRRQGAGGPGLRGRVGGQGQPLFGEGQHGSAVGDDVRYHDQQVVGAGVGGDRHGTDQWPAVRIDAFRQFALVDFPQPLLLAAAAHLAQRDGPLAGHPARIEPGIVLDPRAQQRMPRLQRVEAAAQVVDGQPAMDPHPGNHVQRGELVAEPVPAFHRGQRASYLGHHSTPGKVSASSFCRAKVRSGAKRK

SEQ ID NO: 17870 - protein, 153 aa, Pseudomonas aeruginosa
WSRARSVGRPPAGRARAVAGPSRRRRSRRTTSRRGNRGLPAAPGGSPRGNWRRCPRGPPAAYCPGRCRPPAGHIPAGPAAVRGPAAGSRVRGRRAGGRGTAAGGCRRHGSVPAGRRRAPPSVPAGVRRGPPRSASRSARPSAGRRHSASRSAA

SEQ ID NO: 17871 - protein, 170 aa, Pseudomonas aeruginosa
ARCRRGRRSCRGCLPGDDPATRRGVRPGCARSRRAGPGTRCSSRAPAAVRAGRRRRASPLGVRAKPSTQAKCAGTMCSGSSLRSACFSSARSTASGSPSRKAARNASLPWRSRATTAAPRRPGWRSAWRMIASSTSAGSMRKPRTLTWVSARPSQTISPLPRMRPRSPVR

SEQ ID NO: 17872 - protein, 137 aa, Pseudomonas aeruginosa
LSVPPSASSSAVRCGVRATCSANSVGRVACSGNAWSVALRVWISSSRSAADSGSSSPRRRSPPSTRARRKVSICRAAASMGKSASNTSQAYSKSTCASLCPSNSETQMASASGSWAWVCATVSTLAFGIAWAAGQRM

SEQ ID NO: 17873 - protein, 250 aa, Pseudomonas aeruginosa
SKPFESVWLMHNGPLGRGALTDIYPRPGEQRTHALKGLPDGLPTVPGGCMKTDDKDREGGDSHGAIGAKLMEYALKVRKVFVTGGVDEKMAKDVVQQLHILASISDDPIYMFVNSPGGHVESGDMIFDAIRFITPKVIMIGSGSVASAGALIYAAADKENRYSLPNTRFLLHQPSGGIQGPASNIEIYRREIVRMKERLDRIFAEATGQTPEKISADTERDFWLNAEEAVQYGLVNKIIVSEREITLPGQ

SEQ ID NO: 17874 - protein, 725 aa, Pseudomonas aeruginosa
RRRGSNSLLPSEPAGVMDALGSPVPHPDLVSPPMISKSRRSFIRLAAGTVGATVATSMLPSSIQAALAIPAHRRHGNLKDVEHVVILMQENRSFDHYFGTLKGVRGFGDRMAIPLPDGQRVWHQKGSKGEILPYHFDTSTTSAQRVDGTPHTWPDAQQAWNEGRMDKWLPAKTERSLGYYKEQDIAFQFAMANAFTICDAYHCSFQGGTNPNRLFLWTGTNDPLGQHGGPVTTNDHDSNGPVEQGYTWTTYPERLQAAGITWRVYQDMADNFSDNPLIGFRQYRAAAPDSPLIVNGLSTWKLDALKRDVLANSLPQVSWIVAPAKYSEHPGPSSPIWGAEYTSWVLDALTANPEVWSKTALLVMFDENDGFFDHVAPPAAPSLNKDGTLRGKTTADATLEWHTKGDIRYRNQPYGLGPRVPMYVISPWSKGGWVNSQVFDHTSVIRFLEQRFGVMEPNISPWRRAVCGDLTSAFNFANPNNEPFPELPDTSQADAIVASQIKLPKPKPPAVAAMPKQEMGIRPARALPYELGVHARYRSGGDALSLTFANTGKAGAVFQVFDLLDSENPPKRYTVGARKRLHDSFQGDASGDYHLEVHGPNGFLRVFRGNLRRDLAERKAPLPEVRIDYEPLFGNLRVQLINRGRHPVKLTVKDNVYRQGERRTVNVPPGQRREVRYSLRSSGNWYDFSVSAQGADSFLRRFSGRMEDGRSGFSDPGMGLGTLTF

SEQ ID NO: 17875 - protein, 365 aa, Pseudomonas aeruginosa
QWFAHGSFLSLDTRRRGASLMAPSTDDARSSAGFVNFLERARRRVFLLADPALPRPGAQAVDPEHQDQHGQDHRGGLGLLEQAQAEIEHLPEPAGTDEAEHAGHADIVLPAVQGIGHQLRPDPRQGAIGECREASAAGQAQGLGGLRRGVLQGFGEQPAEHAAGVQRQGEGPGVRPEPGRQHHQRAPDQLRHRAQRIEQESRQALRRHAEATCRRQREKQAEQRRQQGADGRHGQGFQQPPANRPQVRSGQVGREELAGVGGHLAQSLAAEKTCGVHVQIGERGAHRGHHQQRPEQQAPGPAHASLPRRKRLSRSARRTSRRKVSRMLATSPPANIRSDRSICWPRPPAPTKPITTEARIAHSQR

SEQ ID NO: 17876 - protein, 343 aa, Pseudomonas aeruginosa
YGAPRAHSLRIGVRHVRFPAFPCLRRSRPDGRAHVPPAAGRRLSAGGVEPFAGQTRVARGRGRESRRGPGRAGRRRGNPDALPGRYRGGARSGVRRRRHRRERQARAVAGGLLQRRAGRHPRDGRRARGALRRALGRRAGLRRHAGRGKRQPGDHGRRTRSGYRTPAAGPLPAWPAPDAHGRGGRRAGDQGLQPDDRCLQRPGDRRSGGAGGAGRGRRQPGRSGAGGRLRRLEAVADPRPANGREPLRAGQVARTDPAQGSRYRGEAVPRARRGHPDERVGRAVDASARQPGLSRTRSGDPGGAIPDRRRVNLRPGSGCAAAARRRSGRRGGTLPGPPAAAAG

SEQ ID NO: 17877 - protein, 571 aa, Pseudomonas aeruginosa
SSGAPPRGVAAVRYVSGVASMGGGIKRFLPAIGSTRLVMLFALVLVVFYNAATWKALHGLVPLQGLKGFAFFASFAAFLWAAFTLLLTLVSFRPLLKPALTLVALCSAGATYFMGSYGISIDTVMVQNVFETNATEAGDLVNPTLLGYLLLLGVLPSLLIWLWPVRYRPFFRGLLNKILTLLGCLLIVAVMVGSFYSTYAPIFREEDKLTHFINPTNYIYAVGKYAKQRLVIKEHLVVEPIGLDARQAPAALQRQKKSLLVFVVGETARADHFSLNGYARETNPELSKQDIVNFTQVRSCGTSTAVSVPCMFSQYPREDYSDKKAKTHEGLLDILQRAGVQVLWLENNSDCKGTCLRVPNRDIPKTQPSPFCDGKNCLDESLLVGLQEYIDGLQDDAIIVLHSDGSHGPEYYERYPKEMERFQPVCRTNQLGSCSKEELVNVYDNTILYTDHFLTKVIELLKRNADKRDTAMIYVSDHGESLGENGVYLHAAPYSIAPQAQIHVPMVMWFAPQALGNWGIQRSCLDGKRDDKDLSHDNLFHSVLGLLDVQTSLYQPALDIFASCRAPRAAQ

SEQ ID NO: 17878 - protein, 299 aa, Pseudomonas aeruginosa
ACSSRWGKPCTAARVLRNSTRPVPWRSSSSRTRRERASSSPPSTLASSSSPSLPRKPWMALRAPAERLPWSSSSCTASATGRYCSLSRRNASRSWKRFGSSRRRRAKWLSWPSCSGVAVSNRTPGMISASCSTSAYSALTWSWCQTRWWASSTTSRSQPAANRASWARSSSFSHSRATRANWVSSKGLLASLSAKRSLSNRATCRLKRRRISTNHWCWRFSGTRISTRPARPESNWRWMIRPASMVLPRPTSSASRTRGAMRSATSRAMCNWWAIGWARAPPRPQSEDWSSWLRRSRVW

SEQ ID NO: 17879 - protein, 124 aa, Pseudomonas aeruginosa
KNAANRHAARTHDAALPREVACMLPPIPQGLIPVTVQQDPPKPRPATPPVAPTQAGAGSDGVALRQERDEESWLEEEYRRRQRRQGGEAHARSDEGDEAPADEAGESAQADELPRKGQLIDIEV

SEQ ID NO: 17880 - protein, 153 aa, Pseudomonas aeruginosa
STCGLAWKAPVASCARRATASSGNWANCLRPVPRVRAVTAWSGSACRCAKPWSVTLATTTKPAAWRARPWRNCCSPGSSGAIRRKAMSLHESAWGGVYLSPLFVYALLALAATAALRVLIQKTPLRRWVWHEALFDCALFILMLSGITWAATT

SEQ ID NO: 17881 - protein, 387 aa, Pseudomonas aeruginosa
PPASPCRGTERQRLRGAIQRAGAKRAGQRRQHQGEADPGRRGDSQCRHHQAAQRRAEAHAQVHGRGVQGDAGGTAGRIAAQQEALHHRRDHPADRAPDHQYRQEPDAAQAQRHRRQRQGEGRRHQTQGAPVAEAVGQPAADIAAAQRCQADQQEDQADLAGRANTGHARQVRGEIGEQGEVPAEQQDRYQLREPQRGLAQLPQVAFAAGQVAGLALRQVAPEQQAQGQRIDRDAGEDPAPAEPVADLYAQWHAEHQRTADAHEDQADRPAALGRGGQLGGEQAGEDDQQPATGRHSQASQEQAEIARSEGGERVAEGEQQQGRQQQAAAFDAPGQPAEQRCGEGEAEGEQGGELAGQADGDPQVFGQGRQDADQDAFRQAGGEGGQG

SEQ ID NO: 17882 - protein, 424 aa, Pseudomonas aeruginosa
PTRPAPRPGPDQRPPPLAPAAPRTAQAARRRAPGAVGRALPDLLRQGRGAARQRAGDPLRRQPADRRQARRDQGRYRRPPGGGDRRRDRLGQDHPVAEDLSGAGSRHPRPDRPYPAASAGGAQRGDAGRGRDRYAAGRAGRLPGALRGPERRQHPGQADDRRHPPGRDPARPLPGALRHADRRRSPRAQPEHRLPPRLPEDPVAPASGAEADHHLGDHRPGAFLPAFRRRPGDRGFRPHLSGGDLVPAAGGGNRRGGQPGRGRPVGGPGHPRRPRRDRRPRTRGRQAARRRAGVPPRRAGDPRRRGDAAQGQPAPHRGAAAVRATDPGRAAEDLPAAPGTQDRAVHQRRGNLADGAGHPLRDRQRHRADQPLQLPRQGPAAAHRGGVAGQRQPAQGPLRTGRAGHMRASLQRGGLQRASGLHRP

SEQ ID NO: 17883 - protein, 404 aa, Pseudomonas aeruginosa
VARRPPPTDPDLPRTEAAVRASGQGRGAQAGGEERRVGRQRTRGTGDRLRGGPQSDPVRPAQPDRAEGRGRRLPRRSPATFLDPSVQRHRSQAPAMDHGRGTGGDHQAVRPNGREDRAGLAGAAGWAPDQDQPLRAALGEASRPGGGVRAGLPLRPHRHRSTSGALRSDRPAGGARAVHPRRPGARRDQQPRQVPERQPAVAGKARRAGSQGTPARHPGRRGNPVRLLRRAPAGGYLPDRQFREMVRPRAAEPAGPAADARGRRAGPRSQRSHCGAVPGSPAPGRSAPVAELPVRARHRARRRHRAGTGAAAAAIAGRTHRLAGARPALRQGGGVGAQPAEGDPQELRAGTGLRPRRPGAHHLRRRFAAAGAGPRASAHDRRAGSRRGLGRGGDAVGRSPADEH

SEQ ID NO: 17884 - protein, 362 aa, Pseudomonas aeruginosa
GGRRPGQVPRRGPRPGRTHRAFRRSQPGGAGDTPGRQGTAASGGGQGLRQRRREGPAEGRRIVDDGIPGAGGGAGRGQGRALPDPGRGRLPTPPRPATTAVAATGRAGQVPARQAAGADRDGPAVPRAGTGRGAGRGHPPGQSRQLRAAGRKPAARRRRPGRAGRAQARCLERARRAPGTPGAGYPQALARPAEALQGQGRAGHDRAAERRQGPTGQPGVSGVRPRHPAGVVEGVSALPQGHRAAPGQGRRPGPARPGVERRAGRTLGAIPGAPRQARPGRQARRRVAGVSLDAGGVPGLAVRPATGNPAAGLGQAPGQAVEPGRGLVPGIPREMKKARRSKPARLFRSGPISRAGSVRDGW

SEQ ID NO: 17885 - protein, 174 aa, Pseudomonas aeruginosa
RSPGSRHRPWRRPGPSARLRRGRRSRRSGRTDSRHGPACRWTRPRPAGRSRSDCPSAARWPCWSFAPGSGCRRCASGSPRSSPPAGSGCRGRWRSDRASALACCPARTGRSAAASGWRGARLSARRGSRRSGSRGLRPERGGSCRHSGQPWRFPRRSRRRRREPRQGGSSATAR

SEQ ID NO: 17886 - protein, 1027 aa, Pseudomonas aeruginosa
  UNSURE (787): Identity of amino acid at the above locations are unknown.
HPRDHALRIEHGEQGRQPCRFFEQQGTADVQPGQPDPLQPHPRRPPPRPAGPRLQRPRRHQSPLPFRTRTGRRARRPRPRNVPPPARLPRLHPAGPGCPRPGLRRCPGRCRQAPDPLSPHPRPAPGLPRPAQQPADLPAPHGAADRRPDPRGARHPRRRLPLPARHPVSRARILRAVRRKRPAFRPAPLCRRGHPFPFPAQRRGAPAGVRRRPDGVPPPGPSHRLRARQRAGRRRTGDQALQPAPGQPHHAHHSPRLRLRESAAAAGGRQSPRCRRPGRAGLGGLRSPRSLRRSPARQAVQPARLGAAPRRPGAWAKGSATSRCWSAGTSWRSPSTRARSGTTCGCSAKSSTKASSRRCWKRTLPSDTSASTDDFQQGYRNRFLATPWEVFFRPPLEHPKPRVLGSQTAVVTGPPGEEIHCDRYGRVRVQFHWDREGQGDDKSSCWLRVASGWAGNGYGGIVIPRVGMEVLVDFLEGDPDQPLVSGCVYHAAHPVPYELPANQTRSVFKSLSSPGGGGYNELRIEDRKGQEQIFVHAQRDWDENIEHDQKIRVGHERHDTVEANSYSEFKAEEHHTMHGERKVELKADDHLTVGDSQHVKLGRAYLARAGREIHLKAGQKMVIEADSELTVKAGGSFIRLDASGIAISGPLARINAGGAPGSGSGIAIKMPRVPGMADQDSSGRATRGGSRPDRPRRQPGLRRVLATGEEKRPGARRALRNRRMTPNPRHWARELWQRSRDRGLQTHIDVLVDATGLDDYPLLAEHARQSDPPALFKLLEQTPEAAXADEGPLLLRLEDGHAAWLDELLERIDCRRHLMLLFSPWPLPRLGEHLRSCTQAEWNQGRSSGVLRFYEPGLFMAVSDMLDPRQSRYLHAPVSSWHWLDRDGRPRALAGHYQAHETPPLQAALRLEAHQVAALRAWSEAEAYRREYLVLPREHGLGSQESLFQHLVQAHLAADRQGLQDFDQRDAFVAQWLREQTPGPGFSPGGNESRMNGRGIRPFPPCFGAPLLPRGSQERARKCWRRR

SEQ ID NO: 17887 - protein, 476 aa, Pseudomonas aeruginosa
LQGRLGRARRRHDGGRSDRPAARRHRIPDQRGRRSRGIQPDPPRRQRALPPVVQRSRPGGAGPGKAGGAVRRTGARLPRLVHEHFGDRPARTLHRLLPLSPGAFRQRVEQAALGTGHRRAGGRRRGDAGQRRPQRQASRSADAARAVPAIAGASAAERQGRPAGDQRLRPADRDRLADGRRGGAGQPAGLHLRAWRQGRADRPVAATAAAGGRGGAIARIAAGAAGSADRGGAQGARPGQPGRAGGQGRTHPGARGGDAGLARRGEAGLAGHGYGAGATAGPRLGAGLAAARQGLDGIALNLDRRTRPTCRPGSFGADVEPAAGLADDTEARVAVRGDPGSQLAVQQALAAESVVLGIDADTDHMLARRHLEAGFLADADARGDLAVDKERHVAAAAQVAIVAVDFQPAATAYRLLVAEQAFGGDRPGLLGGNRGTAGQEEKDRYGVHRAHEGSPSKGSLRLAQFRWSAERRGGVG

SEQ ID NO: 17888 - protein, 111 aa, Pseudomonas aeruginosa
SPGYHAFQCPGAAASRPPEGLRHPGAFRGDRPMLSCKELVARSSDFLDGQLDFRGQLAVRSHLLMCRHCRRFIRQMRLTQATVRHLPEGPGPELDRLAAHLSELRKDAARR

SEQ ID NO: 17889 - protein, 143 aa, Pseudomonas aeruginosa
VQAKGREIFFDSAVTPPGVLRPLERGRHTGARYQLQELPMKKISLASSVVGAALLGVASVGAHAAQNPFAVQELSSGYSVAAAEKAKEGSCGEAKCGADKGKREASKAGHEGSCGADRKAKEGSCGGEKKAGEGNCGADKKKS

SEQ ID NO: 17890 - protein, 290 aa, Pseudomonas aeruginosa
GLRRRTMQREFVSGAGLGLRRALLEPFGAGDEVRVDFLEVAPENWIGIGGRLGRQFRELTERLPFLCHGLSLNLGGYAPLDMSLLRAIKGFIEQHDIRAYSEHLSACADDGQLYDLMPLPFSDESVRRVAERVRVVQDVLERPLIVENVSAYARLPGELEEVDFVRAVLEEADCQLLLDVNNVYVNACNFGFDAHAYIAAMPSRRIAYLHMAGHDEQGASLKIDTHGAPVCDPVWELLAHAYACHGERPTLLERDFNLPPLSELYAETDRIRELQRRSGEAQLRSLGYGT

SEQ ID NO: 17891 - protein, 503 aa, Pseudomonas aeruginosa
ACALIRRPHPGAIRLPVTKAFALCSLAVTTHPDDPPPAAPAGDRTGRFRAAQDHSKSEQGTYLMIRRHSCKGVGSSVAWSLLGLAISAQSLAGTVTTDGADIVIKTKGGLEVATTDKEFSFKLGGRLQADYGRFDGYYTNNGNTADAAYFRRAYLEFGGTAYRDWKYQINYDLSRNVGNDSAGYFDEASVTYTGFNPVNLKFGRFYTDFGLEKATSSKWVTALERNLTYDIADWVNDNVGTGIQASSVVGGMAFLSGSVFSENNNDTDGDSVKRYNLRGVFAPLHEPGNVVHLGLQYAYRDLEDSAVDTRIRPRMGMRGVSTNGGNDAGSNGNRGLFGGSSAVEGLWKDDSVWGLEGAWALGAFSAQAEYLRRTVKAERDREDLKASGYYAQLAYTLTGEPRLYKLDGAKFDTIKPENKEIGAWELFYRYDSIKVEDDNIVVDSATREVGDAKGKTHTLGVNWYANEAVKVSANYVKAKTDKISNANGDDSGDGLVMRLQYVF

SEQ ID NO: 17892 - protein, 155 aa, Pseudomonas aeruginosa
GARAPSGGRGSFPQDVTRVMKLPGGCPGGPPSLTQGTDRMAASGYAGPSETLWEGLMIGWGRACIGVGGLLLLGQLLGGALLLADDGEATLAVEHFWQFVFLIPAILVALGMFVLQHHVGSFAQLYRRRLDGASYLLVSCGIALVLGKLCVLLLA

SEQ ID NO: 17893 - protein, 187 aa, Pseudomonas aeruginosa
LESPACLPKYVGPHKKPRSFARLFAFPASRPVLEGCLCESVLFWSTPVESESIVYGCIRDWPGDSMERRMRRAANRRVLDSLPGGEAWPFLGREMFSRCEQSGAGLYQTQIIHFGASYQAIEYEWSLWVEQFEALLRRLYWASAVVHLETEVNGSHTFRWESERGFHTPQESDLQVRCAWEREGGRR

SEQ ID NO: 17894 - protein, 256 aa, Pseudomonas aeruginosa
ASQSLGRFCSERASWRWRNCSLSSLARCGFFWVIEATLVATSLPIFSASASEQAKTGVATSKAQALARAKSGFMAYSCGVVLSGGARSSRQSSAATPDGDRFEPSRRVAGRTHREGAKDPRCLCRRRYAMTHDWDLVERLLLEVRQSAHENFAPRAHAERLAEERSQAGQRVGDMDALKQKAADYEAILLEGGFIEPRPEEQGGNGENFVLTPRGERLLGLIGGETPKAAEARRLLEENGSEALHAERFDRFVAGL

SEQ ID NO: 17895 - protein, 1179 aa, Pseudomonas aeruginosa
CPTTPGSWSTTAWRTWPGEHRTTLVFVNTRRMAERVTRFLAERLGSRQVAAHHGSLAKELRLDAEQRLKAGQLKVLVATASLELGIDIGDVELVCQLSSPRSIAAFLQRVGRSGHSVGGTPKGRLFPTSRDDLVECAALLDSVRRGELDSLVLPRQPLDVLVQQIVAEVACQEWREDDLYRLVIRAEPYAGLERERFDEVLRMLAEGYHSRLGVRGAYLHRDALNGLLRGRRGARLTALTSGGTIPDTGDYSVLLEPQGLLVGTVNEDFAVESLAGDVFQLGNTSYRIIRIEPGRVRVEDAQGQPPNIPFWLGEAPGRSDELSASVARLRDTLDELLGEGQALPEGQRLEPAIAWLGATLGLDDGAARQIVEYLARARQALGGLPGSRRLVMERFFDESGGMQLIIHSPHGSRLNRAWGLALRKRFCRSFNFELQAAATEDAIILSLSTSHSFPLDEVWRYLHSASAEHLLVQAVLDAPLFGVRWRWNLTTSLGLPRYAGGRKVPPQLLRMKSEDLLASVFPDQVACLENIVGEREVPDHPLVAQTLDDCLHEAMDCEGWLALLRDMESGAVDLLARDLPAPSALAAEILTARPYAYLDDAPLEERRTQAVQNRRWSDPESADDLGALDLEAIEAVRGEAWPEARNADEMHEALNSLGFLTSGEAEANPGWGEWLAQLSEQRRAGRLDCAGSTLWLAAERLPAMRLVHPAAKVPDAFQAPRGYPPPDSAEAATVELTRARLGGFGPRTAGQLAADLGIGLADQQYALAALEREGYVLRGRFSPGATEEEWCERHLLARIHRYTVKRLRREIEPVERADFMRFLFDWQRLAPGTRGRGAEALATVVEQLEGFQAAAAAWESELLAARVADYASHWLDQLCRSGRIVWARLAGRSKAAGGPLRSAPIVLLPRRELGLWSVLQRDAPEPELSPRAARVLEVLREQGASFFDELSQDAHLLRSELENALGELVSVGRVNADSFAGLRTLLMPADKRSRQERRSRGLPGGMQDAGRWAPLRRAKAEEAGQRLPAEVLEHVARTLLRRYGVVAWRLLEREADWLPPWRELLRVYHRLEARGEIRGGRFIAGLAGEQFALAEAVGLLREVRKRPPDGAMLVVSAVDPLNLVGGLLPGERVPAVTGNRLLYRDGAPLAALVAGKVRMLAEVDGETAQQIRALLIRRH

SEQ ID NO: 17896 - protein, 182 aa, Pseudomonas aeruginosa
SGWPASARTRGCARAPRPGRTGRSCRPARSARPGSAARSAGRRDCLPARSGRGCAPAASRGPWPPPAGPAYRPTAASRRRGRRRPRGGWPVSSTARRSSPGRAGRWRRRRSGRWSPGWRWSRAGGRPRRRAAGSPRCSPGVRSAASDGRPRRAVRCPFPGVAAATAGACRWRPWSTARRWRR

SEQ ID NO: 17897 - protein, 167 aa, Pseudomonas aeruginosa
ATSGSCSPTTPNRSAACSTSSSARAAAATIPPPAWSRRRPRPTNWARATTTAAGAARSRCSTSTSTTSCSTSATTSAGPTSAPPSTRASRLPATMTSPLSIRAWTACRSTAASPIPAPPTKATFPPSRGATCRSTRARWPPPGCATRSTAGPTTSTPSPSPCSARQG

SEQ ID NO: 17898 - protein, 572 aa, Pseudomonas aeruginosa
GRPHCVRYFAWFIGRDKASRPGPSSTRRIIQAPEQGGQQRTGEIVPDAEQRAGHRCQGREMDVGQRRAEPRVLHADFDGQGLALRQRHAGQLAGEIAEQQAEAVVQHHHGHDQQAGLGDPRLAGGHHRGDDHHDAEYRDQRQHLRHLPGALAEQALCQQAEGDGHQHHLEDRQEHCRERHRQPGRSQQPDQRRRDQRGEQGGHRGDRHRQGDIATGQPGHHVGSGAAGAAADQDHAHRDLRRQLQQAAEQPGQAGHDDELGQHADQHPYGVPGDLAEVFALERQAHAEHHQAEQWRDGCGEREEPGRSEEGEDGEQQDPEREAGADEAAQGGQGTHGLSLLLDGRQSAMPGATLPAAGAAGRAGRQTPWGISSPPRASKSAGRNSAKVSIIRVKLASSWPRASSPPSFSACSCSRSSKRRRLTASLSSRTKDSLSDQARDNWVTSLPAVRCSWISSLVRSWRLQRTTPPSSWVSRSSHSSSTWKSPAASWVLTQSVRVAVGATFTLSGRTGREPSASRSVESRSSAFFALAESTRIRPRLGAIAAKVLERRMKARGSRVWTISSFNWSRSFL

SEQ ID NO: 17899 - protein, 323 aa, Pseudomonas aeruginosa
FDFFRRFLSTVLLSSFHAFVLLSPSFFGKFGLELIRAHLFLLPIATGRDSLLSSRLHRICPSGEQIKGLSMKQHRLAAAIALVGLVLSGCDSQTNVELKTPAQKASYGIGLNMGKSLSQEGMDDLDSKAVAKGIEDALGKKKQQLTDEELTEAFAFLQKRAEERMAAIGDENAKAGKKFLEENGKRDGVTTTASGLQYEIVKKADGPQPKATDVVTVHYEGRLTDGTVFDSSIERGSPIDLPVSGVIPGWVEALQLMHVGEKIKLYIPSELAYGAQSPSPAIPANSVLVFDMELLGIKDPSKPDAEPEAGAAAQPEAKADAKK

SEQ ID NO: 17900 - protein, 301 aa, Pseudomonas aeruginosa
SRPTAPNESPSTSQPRVSTNGVLHCTSRLSKSRAARPSRAPLARYWTTPPVRRSMPPQKRFWYSVPQVIAASATSTAAQARPSAPPWMRPSTTRATPARPSASPSHCRRLTCSPSQMPARAAVASGCRPTNREVRPADMPCSMARNTPPRYRPWTSRPATATCPASRAEPGQGAPLSRAKAASRVAARSRRMARKVKGSAYGRPNLAPRNPVLQSSTKSSGMPLPSQAGVRMQGSRREVAGRSWRPARVGVSPAASGLAPGRRAFPSRAPCRRRWPRPGGWHWPGAPRSAPCVRDSPAAHG

SEQ ID NO: 17901 - protein, 449 aa, Pseudomonas aeruginosa
EVMTIEGQGSLAERLAGVEEIECVTPDLNGVPRGKVMTGEGFLSGRRLQLARGVLLQCIMGGYPPARFYGSDDGDLALVAEPTQVHRLPWSNTPRAFAICDAQELDGTPSGLSTRGLLKQVVARYAAHGWQPVVATELEFFVFAPNTDPNEPFQAPLGPDGRRELGYSAFSVSSNNGLRPFFEDVYRCMDALGLVRDTFMHEMGTSQFEINFLHGDPVLLADQTFLFKHLLKEVALKHGLIVVCMAKPLAKTPGSSMHIHQSIVELDGGRNIFSEADGEPSAAFRHFIGGQQACLADFTPFFAPHVNSFQRLCHPYASPNNACWSHDNRAAGLRIPASGASARRVENRLPGADANPYLAIAASLAAGLYGLEHELEPSPAIQGEFEVPEELTLPCTMYDALRRLKGSALARELFGSEFVEGYVATKSMELTSFFDEISPWERRVLAAQA

SEQ ID NO: 17902 - protein, 488 aa, Pseudomonas aeruginosa
PCVTPCRLAAAGSWCRVPASASRVLSRGLPGTPTLCEPGSPRAAPAPLYGTGGPMRRIFFSFRALYFATLLMLTGSGLLSTYLALRLAADKVDGLWVGALMAANYFGLVLGGKVGHRLIARVGHIRAYVACAGVVTAAVLGHGLLPWLPAWIALRMVMGLGLMCQYMVIESWLNEQADASQRGAVFGGYMAASYLGLVLGQMILVAHPQLGPELLMLVAFCFALCLVPLALTHKIHPAALRPAPLEPRFFIRRVPQSLTTVLVSGLVVGSFYGLAPLYANQLGLPNEQVGLYMGACIFAGLLVQWPLGWLSDRRDRAWLIRACAILLCLFALPLALLQQMPLALLLALGIAASMLQFTLYPLAVAFSNDHVETERRVSLTAMLLVTFGVGACIGPLAAGALMRLFGANMLYAFVSACALILVWRVHPEKVSGLHRVDDAPLHHVPTPDNMTSSPLVAALDPRVDEQAVQEQMVDGEPDAPQADGATQN

SEQ ID NO: 17903 - protein, 331 aa, Pseudomonas aeruginosa
RRSVRTTSSPSSVRTIWRRGWWSGSRRWTRAERSALDNNVNTGDRLRSGRPGRRGLCVSAANADFELFRVFLEKTCGIVLGSNKQYLVSSRLNKLMEQQGIKSLGELVQRIQTQRGGLREMVVDAMTTNETLWFRDTYPFEVLKQRVLPELIKANGGQRLRIWSAACSSGQEPYSLSMAIDEFEKTNLGQLKAGVQIVATDLSGSMLTAAKAGEYDTLAMGRGLSPERLQRYFDAKGPGRWAVKPAIRSRVEFRALNLLDSYASLGKFDMVFCRNVLIYFSAEVKRDILLRIHGTLKPGGYLFLGASEALNNLPDHYQMVQCSPGIIYRAK

SEQ ID NO: 17904 - protein, 659 aa, Pseudomonas aeruginosa
PSRSRGASTSGPIRISATPTSASRSLRDAMSSTCATPLTWTARPSACSWCCATTPAARTRRSAWRTAARKCARSSPSPTSSSCSRSAEMNPPAARIESLTILIAEDNAADRLLLSTIVSRQGHRVLTAGNGLEAVALFETERPQLVLMDVMMPVMDGFEAARRIKQQAGEELVPIIFLTSLSETEALVQSLEAGGDDFLSKPYNRVILEAKINAMGRLHLLQRTVLEQRDLIVRHNEHLLNEQRVAKAVFDKVAHSGCLNASNVRYLQSPLALFNGDLLLAAYKPSGGMHVLLGDFTGHGLPAAIGAMPLAEVFYGMTAKGYPMADILREMNAKLKRILPVGVFCCATLLNLSFQRELVEVWNGGLPDGYLLRAASGERVALVSRHLPLGILEPAAFSDRCETYPLDIEDRIFLFSDGVLEASNKAGEMFGEARLLQLFERNRQPSALFDEIQRSLAQFRGAVQDDVSMLEVRLQPDSGLQCPPLAFSDSGVSSPLDWSVSFEFRAETLKHFNPLPHVLQLLLEVHDLRARGGALYTVLAELYSNALEHGVIGLDSTMKSDAAGFARYYQERVSRLQALRDGYVRLHLDLAPHGAGGRLLVRVEDSGEGFDVERALNAVERQERLCGRGLRLIRELSDRCQWSADGKVVSVEFFWSPQA

SEQ ID NO: 17905 - protein, 156 aa, Pseudomonas aeruginosa
CAARFGVLHARASPTHPQRRFRLRRLPWQPGTDHRAGGRGWRCAGTDAHRRWQVPVFPGPGAAARRPDGGGVAADRADGGPGRHPGRTRRAGGGAELHPQPRAAAGHRRAPAAWRDQAALPGTGAVGPAAHAGLPSTTAGRPVRHRRSALRVAMGP

SEQ ID NO: 17906 - protein, 352 aa, Pseudomonas aeruginosa
GNPLPAPGAAGLFRRGDAAALRALRQLRGRRGNLGCHRIRAPGAVGDLPQRPALRRRPSGGYPARPRDREDPQSRPPAPGGVRDRQGAWRRRVADPVPSVGRARPGRRRPGRLRRPAPDRGLSSAAAGRGAAGAAPRPQTTARQGLLQRRRQRRQPIGAQRRAGNVGGPARAAAQAGRRAFGAALCDLPRRDPAGNAPQPAALAIRHGPGQRGRRAQAGALRPGLPRCPHRLAGGARRAAAGPAPRIGQPGLCGDDPGADSPPAQLQREERLRDARRGHRRSAGEPGAGAGSARGTPRRNPGRLPRGRRRTAAGGGAGGAFRQAGAEWRAALRARRPAGGTGVVIWPFAGIF

SEQ ID NO: 17907 - protein, 871 aa, Pseudomonas aeruginosa
SPELRSEVLPEVQVERLEVLVVDPVAEGQRPQRRIEADHQAGGVDVAAVVFVVVVPDASALDAAAQVQREVQRQEGTFGEAPVIDDPSQAVVLPGQRVAAEARQLAGAAEGEAGGDHLGVVQGAPVAAAEHPGVGAEAERLVQPQVPLPVAVVRAEGLVVAAHGQADLLALVGEIDVVDGIERVLQFVVALGEVDVRQARVADAHVGLAVGLHRAQADFAVVGDLPADVEAVAVALQAIAQQRVVVLGDVDVLCLVEQEGRDEVARADVERLVELAVEFLAVAELDPGQPLGAEPVEAVHAVAAAEVEGAFAAHVVGQVEAQAKEVSAAFLAGGVDHQGVELLLLDHPVLHLVEVVEAVEGAHVVLQAAEVEARAERLADVVADHLVADLRVVLHADRVDHRLALVRRARHVERFAVEVLRLAQLGEARGEHRGGAVAGVDQLRHAAEVGGAVAGQRRLDQHVAGLERGQLGFGVLPGHQGDRLVHHVEHGAQVLAVAQRVADVDHDHHVHAHVARHVHRDVVDHATIHQQPAVDLHRGEHGGDRHAGADRLGQVALAEHHFLAGCDIGGDGAEGDRQLVEVAVVAGVHQQAFQHHRQVLALDHPQRQAEGAVVAEADLLLDQEVAVVLLAPERHVLARRRVGQRLLPVHLQGDALQFGGGVAGGVQAADHRAHAGAGDGVDLDALFVEGLEHADMGQAAGGTAGEDQTDLRPGLRGEGGQGKQEQQYEQQAAHENDPEPGEKAAIIGATVSPEPPTCPPPSPKSSSPIAPSASGCCVPPGWPRNCSAPSPTISEKSAWSPEPAAYSASPATACRSGSARPTAASPRPRRSSSGFATASTRNVTSVTTIVLPAEPLPSAHGLLQVNGRHGA

SEQ ID NO: 17908 - protein, 221 aa, Pseudomonas aeruginosa
RPRQRRPAAPVAATGRAKRPARLPRVPRVAAGALPEPYLRRPGAAARGGLPRRFPEPGRGRRRLLPLAGAQRLRDPAQRPSAPPTGARAKRSSGSRVSSASTPRAAPTQSAPCRPNPPAMPRPPIQEPAITPSMMQAVCTELTSMLLWPTRAPRVTSAGFIDTPVRPITTSAATATAGTCPNRAKATIAAMAASRPKARTAMVWRSARRPTMLLPTSVARP

SEQ ID NO: 17909 - protein, 493 aa, Pseudomonas aeruginosa
SARSGARETGACAPRWFRGPRSGSSSPAGRRGIRVRLPDGTGRTSHGHRRFPGGAGCGQEFPWHSLGDPLDRVGVGSGVRRGAASGAHRHADQGAEEGDRQPLQLRVGHRQLEVGEAREQALDGDPPLQPGQRGADAVVHAEAVAEMAIGVAGEVEAVGIVEALGVVVGGQVGDQDVFAGGNGDPVQFHVFHGEAQHRGAHRAVVADQFFHGVGQEFRLRPQQRQLLRVDQQGDQRVADHVHGGLEAAHHQQVGHGDEFRLAQLAALVGGLHQPAVDVVGWLPALGLEQHAQVVDLRIGQGLGLLRRQQFRLALPGLAGVFALGLGNAQQLEDHRDGQRDREVGHQVGLFAAGHGVQQFLGDPFYMRLQALHLARGERAADQRAQAGMVRRVEVEHVVAESLADPRARAAGTLRVEFGGLPGVAADARMVEDLARVAVARHHPHRMLGGAMRGTRRAVHLQAVVERVQWRDQFLAQSQFAIRHVAPPSPPGRR

SEQ ID NO: 17910 - protein, 409 aa, Pseudomonas aeruginosa
VPTSSGRTGGSSSSRKSIGEPMAMWLGRRWWSWPAAMASAAVSAPCTVVPCSRARRCSCSSCAPSSSRCSRRVRRASSGTGLLGSIRPGRWRPTSASSWAVCSARRAAPSSPVKRRGRRSSAGGRALAVQGCAAGSAARVSHCSARVSTVVPSAMMCGTTTSRSWAPASVAIATVRISGPLSGSMRSGNSRSLISRSHCSSPPPRTSRSGMGRSQGTQRGSSPASCSIRARSSGCRACSASRPRRRSSMDNRPWTRTREITFSAENWSLSQYQRSTADSGRRISAIIRLLGRSVPVRSAGRRFAPERSGSRDRGRRCVADAPTARCGSAPARSRPSPWRGRDGGSRRRAGRLAGRRWWPGSGPAPRRLRWRWRRPGRGWSASDARHRRAGSPGRRPSAPGTVGPGPAGC

SEQ ID NO: 17911 - protein, 402 aa, Pseudomonas aeruginosa
RSSGGGCSWAGPFAGGGGFEQRGDLCRDRLDIGFFHQHQVVAGDVDHIEAATGPVLPAVLRVAVVGAGGVVHRLQRQRQRAVRAQQGHVLVADFRAIADECLPARPEQLVEPLHGGARGAGGKYAGLDGAFDDVVELLLQARAFRQRLDFLVAALEPDQFPVEEQQQGFVAGAAGVVAVDGDGVEHDQLGDRLRVERAQLPGHLVGDEAAERPAAEVIGAFRLHPADRREVTGGDVLEDRQRRTALAGAGRLQGIYRLVRRQCADQRQVAEYVAAERVDEEQRRAAAAGTDRYQRVEGAHRRAFPQAFGEALHGRRLDQRGHRQVDAIALLDQQHEAHRAERGAAEVEEAVADAYPGTIQQLAEESGQGALVVVARGQVLDVRPVLQRQCAQGGVVALPRWG

SEQ ID NO: 17912 - protein, 67 aa, Pseudomonas aeruginosa
IPGPGRPRGRTRRTGIARAVAANSDGSGVGGCARRAPSRPPGCRAGPGSAVRCAPGYAPVAAVRMHR

SEQ ID NO: 17913 - protein, 180 aa, Pseudomonas aeruginosa
GRTTNAARDRRRPPGPARGGTRLRPRPGRSGSGTRRGRPTSRGAGGYGRAGRDSAGWSGRRPPALPGAACRLRKPVRRAGSFAPRADAPGARRGPPPSGCASGRRVRSPGRAAVRRRGCAASGSSRRRGRRSRRARRPPPRRGHRPTPPPVRPRSPCAAQPPPPVPAVPAVAGGRACRWR

SEQ ID NO: 17914 - protein, 133 aa, Pseudomonas aeruginosa
SPAASPKVRRAIDRGRVPPQPRSSRPGACRVPPNRVPRPRRRVRREARRGGRVLRRVRPGCRGSSPGRRRGRGIRGCRRPASGPGRRYGRDGRRRRRGRRGSARRSTPAGSGSRGRRRRLLYIARRRRRGAAA

SEQ ID NO: 17915 - protein, 238 aa, Pseudomonas aeruginosa
PARGMPGRWRCGCGSVPRARRPTADRVRRGGARRPPPGRAGRFRYAAPRRPWGSRRRTHRRRIRNPPARRCARRTRRPRWPARPGHGRGFAPRSRRWRSGSPGRRASACRKGWCRTVARRRATGRRGASSGGAAASGSPRATAPGIRRRSVPARCGCVAAGYWRSARPLAWPRGRRGSAPVRRGPRRRSGGSAPGTAPRRRRGTGRAIRHDRGSHRAVCVPASACGARCGAARPGACG

SEQ ID NO: 17916 - protein, 496 aa, Pseudomonas aeruginosa
FRDGAKATPGGDIDQVPRLVRRDHLPAEQAAAVDHAPQVDPQQALPFRGRGVEHRSGHADAGIADYHIRDSEGVAHPLGEGLHGLGIADVDLVDMGRGAKGAGQFGAAFGGFQIEIGGEQAGAALGEAEQGRTADAAAGAGDHHQLAVHRARVGPDLGALQGRRRLAGFLGVDELAEPAGQLLRLGQQLPMADARLAPPQAWRPQAEVLEQLGADVTVAGRYDQLHRHFGVALARTEQAADEVAAVQLDPVPAVAGLGRVDLRMADAFGVLQELRPEPGQAGAPEQLGYDGGMEEGDVPGVEQLAEYRFQGLRTALPEVFAHPETDMVQAGPGDRGIGRDQRSALRIGDAFPGLDRAPVMGQQVYRAVRAGGADHRLQVFAEPLQVVVAAPAWLVRSAGATHVVGDDAVAPGQLADQRQPGLVVVRVAMHHQQRRLAVVRRAPAMNRQAHVAGLHEQAFRLQVGEGEERVHAASRACGSSPRACQRRTCGRSSSSQ

SEQ ID NO: 17917 - protein, 388 aa, Pseudomonas aeruginosa
CWPISRRCASPGKSLHAGVTALATGAGRPGAEGSGRFPRVLAVVPEKRLTDESSLWLAPAHPDAGKERCAPGGCGRSAGLVMIRLHEHTPDPPAAPAATWRAAVRRGCPRIQRRRTGSHGRQQRAQRTRLPGPRPAAAAGAARPDRRVFRQSSQAPAADQPVARARLFQRQHQGTAGSLGTGPRPRPCARPGPGDHRRVEPGDARQHRLRRTPGDLRRRTERPGDRQGPGAGPAAVRRRAHEDPQSTAVPGRAGTVPQRHPAGGAARSTRRVAQRHRASGGGNRPPDRHPPGGRPRHRPAARGAGPAGAGQGVPAPAPAGGTRGPGGTGARPQAVGQRNARRACRRDAAQAGKAFLTLLQIFRAAAWICSRSQAPAASRSASPRQICT

SEQ ID NO: 17918 - protein, 166 aa, Pseudomonas aeruginosa
QKLCSRGKGRRRRISMPNYLMVLMAVSVGGMVVLQAGSNALLGRLLGHPLSASLTSLGVSLGVVSLGLLLVRVPLPATASLGGAPWWSWLGGLFGAAYLTVAILVAPRLGAATFIACVVAGQMLVSALCDQFGWAGFPVRRLSWEGYLGLALVVAGVLLLQWRGRA

SEQ ID NO: 17919 - protein, 143 aa, Pseudomonas aeruginosa
CRRTAPSTTISAPSRASAASATAWRSRCPMASGSGTRRAARARSCPTTSTPAPPAPSASTAPRTPGRTPSRPGTKGAWTSGCRPRPSVPWATTRSRTSPSSSRWPTPSPSATPITARSRAAPTPTGCSSGPAPTTRSASTVVR

SEQ ID NO: 17920 - protein, 93 aa, Pseudomonas aeruginosa
PSPTPARPARCSRCSTCSTARTRRNATPSARASACTTASRATPAATTTWKCTVRTVSSGSFAATCGATWRSARRRCRKCGSTTSRCSATCACN

SEQ ID NO: 17921 - protein, 131 aa, Pseudomonas aeruginosa
ANAARRPLPARRKASAGCAGVFSRASANSRPSTPPVCSARARVPAFGPSPAASTISAPQTSSGTARSALSRSRARLCAGTPKRPAAGSAKSRPSSAASRVPMADMARVSSSPRPIARRCGADRSGGKNSLA

SEQ ID NO: 17922 - protein, 138 aa, Pseudomonas aeruginosa
ANEAPTAGTTSSGQSSRRQVRLMPASRAGSGSAGRRGGPAGGRSAGCWQPRRRRTSAATGRSAGRGRRRRRSPSPPKHGSRTPSDRQCRKSFPRRRSAAPRRRTPPAAIRRPAAGRGWGADPPTRRFPRRPCRACRHR

SEQ ID NO: 17923 - protein, 330 aa, Pseudomonas aeruginosa
WCAARLGSRRGVARRRLAGNMALPVPIRCVLEFAMSASLPSLAFAGLGLMGVPMCRRLLAAGYPLAVWNRSPGKRELLAAEGAKAVEVPAELAADAEILMLCLADTAAVREVVFGAGGIVENARPGQLLVDFSSAEPAATREMAAELEARCGVRWVDAPVSGGTPGAESGSLAIMAGGRAADIERLRPVLSRLGQRLTRMGEVGAGQVTKVCNQMIVACNALVIAEVVALAERAGVDASLVAPALAGGFADSKPLQILAPQMAESRYEPVKWHVRTLLKDLDTAVKLSREQGAATPMSGLAAQLMRLHGSQGYLERDPATLVEQYRTAVE

SEQ ID NO: 17924 - protein, 753 aa, Pseudomonas aeruginosa
TSGLVQAAQRRRGVEAVGAEELFQGRQRQRPAEQVALHQLAMVLPQERQLLRSLHALGDDFQMELLGHRDDRLGDFHVPLRGGDVHDERAIHLQRVQRQAPQVGERRIAGAEVVDRQADAQLAEAFEQRDGLVDVVHQRVLGHLQFEEARRQPGLLQRMTDFVDQAGPAEIAGAAVDRHPQPFVAGQVQAAQVAAGASQHPVVELVDHAVGFGQADEAVRTEQALGRMAPAHQCLQLVYLAVGEGEDRLVVQLQLVVAQGLAQFLLHLQFLGRPHQQLPAEELRVVAPAGLGLVQGQAGVLQQLLALLAVVRVEADADAGGHHQGAPVQGDGFLHLLHQALREDVRLVVLGEVGEHAELVAGEARHHVAIAQHAADAFGDDLQQLVARVVAEGIVDPLEVIEVEEHHRQALASQATILQVLDEHFVECRAVLQAGQAVVASHLAQRRVGVVELVEQGVDPAVFAEPALPLFLRPCGPDAAGGDGAGEHSGERAQAQRVGAGLQFQRRAGGYAEHQRGHPGEMHGGDGAGQQQAGDQFHVAVARAAPAAQVGDRSEGGEGGADGDQYRKGEQRWLVVLGGHRAHRRHPGVVHGSDAQADAAGGEQAGQQAEARAGGHVHRQVRGGDGDQQRQAGDRQVVAQGDRRVEREHGDEMRGPDAAAQAERPDPLPEARVAQAVADPLDHVQCRVPGEAGDEEGERHQRWRIGAVLQHVAVDGRLSEEAQALPIHSGVSLDTENPRTARVRAGGGIVLPV

SEQ ID NO: 17925 - protein, 365 aa, Pseudomonas aeruginosa
CRPRFGRPCAHSLEAVPGTLDAGAQVRHQDAPGRRPGVVVRLSLRPGAAAMGAYDRADRVPAVVRHGGGEGLVPPARHPGRHRDVGVDDRAVRPGALVVPAGHLALAGALHGGLDLPAQPRFLCLRTFRLYGSDHWPAGGGPAAAGLRAGGGALYRDLPGDHLRLGGQCDPLAAAGRAEPRQAGPRHLAAGHAGRARRDRPAPAAAAGAAQRAEQDRRGRCAARPCLVRRRARAAPGRRPGVALARPAQPVAHRARRGPATGAAERRGRAPGGALAGRAGQRPGRGRSGVDAGAARGVGAGRGRAAVEQRPAVPADPLLGAAAQGGECREGHARGGQRRGRGAGGQRRYPVLAPRPADGAVLRCA

SEQ ID NO: 17926 - protein, 436 aa, Pseudomonas aeruginosa
VALPGRLRPESSPREGDSHACIASRRRHPAGGRCRCPRRHLALALLHALALDPRCPGAGRRGGGGAGRVRLGDRPGGQGQPGGQGRRRADAHRPGTLPGQPGAGPRRRRDPSPAIPVAPERGGPAQPPGHRRDQRRGQGKRPDQCCHRSQRVPGGAGPGEDRRTQPQAQRAARRAQRPGDQPAPGPGQLRHGGPGGDGVGRPAVLLCGRLLRGNQAARHPRRHARPGPPDERRSADRRHGGEHQQRYHRPQLDAGRPVAGQCRADLQLGAPGAAHSGAHPPRPGAGGCPPERRDDRQRHRAGGLNGSACVAPSSVLAPSAQASAASTRARPTQGVAATPSAATTRPPSAAPRPTPRCMAEVFRATPAEPLAGSLRSRKLCTTGEIIQLIALQTISTGRNPMLPRLSGTAASARAKAAGTRRRARRWPRRSASQPPI

SEQ ID NO: 17927 - protein, 237 aa, Pseudomonas aeruginosa
  UNSURE (237): Identity of amino acid at the above locations are unknown.
TSRTRGSRSARSCPAAPGASARSGRSGGRSGRALAAGSWNRKGSPLAGCSCGAAGRPWRCSCPCCGPAGRSAVPGAAGGYGGSGWPGRRPPCPSRPGRRSGPARRLRRSGRGRAGRSHRSGSRQRSARRRDARSDRRARPCRGTASPRRRPLRSASGGCTAGFRRWRGASRQRRACSFLVPGGRVPAHSSSVRGFVPEKRHPWARAALEWRAAKSDRLEIHTINKGRRSICAVRRNX

SEQ ID NO: 17928 - protein, 282 aa, Pseudomonas aeruginosa
ILERQTPGRRTRQSRLRRLPFRSRGLRALLQEIRRPPGLQQSRRDAQLRRTRSSVRRLRRLPAETDRSPARRPHRGADAQCPAISHRGVRRLARGAGGGQHQSAVHRPRNAPPVQGRRRACAGLPERVRQAGRGSAPGYADRVPDRGAHGRPVAGAEGLAGEQRGEVGEEDGPRLSLAPGAAVQAGLEARPGPCPAAGQGRPGGCRRVAVHRRHHRGLEGGDAHPRQPGGEHAAGPRPAFPARQGWPAADEGGAGGDDRAAAALPHLCLHRELHVHDGQRQP

SEQ ID NO: 17929 - protein, 264 aa, Pseudomonas aeruginosa
RADHQPARHPRFRQGTEEVAFLRAARPQHPVRRADGAPRVQGRRFLQPEAHQLRRHRTGQRHRRALEGRHRLHRGGRLWPHRMLAGGDHQPLRRAGTPGYGGDTGRGHGAQGDRRAGQRAACRRTWRTLRERSASDEGVLAASRGHRGDSRCRRLAEDRRHRGDRRGRLRAHRRSKEGPDPGLRLQCLPQRDRRRGDGPSEGGQLRGGGHSRREVRRGGEAVRGGPRPRPVGRGTQGLLQGKPHRIQNSATDCAQGCITDDACG

SEQ ID NO: 17930 - protein, 532 aa, Pseudomonas aeruginosa
AVKISCCLGVGFHDRKLLEGQVPSGYCCRDQSRPVPEHPVGTEGVLPTFCHQARVHQPGQDPDLRRAVQAVRRLRRLPAAAHRSQARRPHRRPVAQRPAIPDRGLRRHARRPHRGQHQPAVHRARTGTPVQRLRRQGGGLPGQHGPPGRGRTAEDRRQAGDRHRSRRHPAAAEALHRQLRGQAHQEDGAGLQPAASHQADRRAGQGRRQVVPGSRAAGRRRRRAAIHRRHHRGRQGRHADPPQPGGQHVAVQGADGRQPQRGLRDPHRAAAAVPHLCLHLPLHGDDAHRQPQHPDHQPSRPAVDAQGPRPVEVHRLRRPEHPVRRPVQQRNLPQAGLLRAEADPLRRHGAATGHRGALEGSHRLRHLRRLRHDRDRAGGIGQPVPEHPGRHHRYPGALDPVQGDWRRRPGSAPGRARRTLREGSAGDEGLLAAPGGHRRDPRRRWLAEDRRYRDHPGRRLHAHRRPEEGHDPGLRLQCVSERTGRRAGDPAGRPAVRRDRHPRREVRRVDQGLRGGQAGGDPDQGTGHAAHA

SEQ ID NO: 17931 - protein, 152 aa, Pseudomonas aeruginosa
QPDRLQAAEGRGVPRQPADHQRRQDPAPRTARRRAEESGPEVSPLLPEEAPPMRGFFVAGSRLRGERACADVPAAHHLPEEPPMARLDPALAEEIRRLPISRRLELTQALLHRAGPEVERQWLRVAEDRLADCRAGTADALPLAEMLKRLGR

SEQ ID NO: 17932 - protein, 1326 aa, Pseudomonas aeruginosa
MTDQTPSLDQLVRRLDQAQISDRHRLRRQLHELRKQPDDARLAQWVERFQTSCAKVEARRASVPAIRYDDSLPIAAKRDEIKAAIAAHQVVVIAGETGSGKTTQLPKICLELGRGIHGLIGHTQPRRLAARSVATRVAEEIGTPLGALVGYQVRFEDQSDDSTLVKLMTDGILLAETQHDRYLERYDTLIVDEAHERSLNIDFLLGYLKTLLHRRPELKLIITSATIDLERFSRHFDGAPVIEVSGRTYPVETWYRPLAAETDEEGNRVEDDLSVDQGILAALDEIAAHEREVGKRPGDVLVFLPGEREIRDAAEMLRKANLRHTEVLPLYARLTPAEQQKIFQPRPGRKIVLSTNVAETSLTVPGIRYVIDSGTARISRYSYRAKVQRLPIEAVSQASANQRKGRCGRVEPGICVRLYSEEDFNARPAFTDPEILRTNLAAVILQMLHLRLGDIEAFPFIEPPDGKAIKDGFTLLQELSAVNREGQLTPLGRQLARLPIDPRLGRMLLEAAQQGSLEEVLTVASALSVQDPRERPVERQQAADQAHAQWKDPDSDFAALINLWRGFEEQRQALGSNALRSWCRKNFLNYLRLREWRDAHRQLTLICRELKLPFGRPAKAEARKPEAKKGASADNEREVPGIDYAAVHKAILSGLLSQIGQKAEEGDYLGARQRRFWIHPSSGIARKRPQWIMAAELVETTKLFARMVAKIEPDWLEPLAGHLIKTNHFEPHWEKRRGQVVAFEQVSLYGLIVIGRRPVHYGPIDPPVARELFIREGLVRGEINSRAKCLSANRQLLEKLDELEAKARRRDILADEETLFAYYDARLPADIYQTASFEKWYARERQNQPDLLLMREEDVLAREASEVTAAQYPDRLRLGDLHLSLSYQFEPGTARDGVTVRVPAPLLPQLPAERIDWLVPGLLYDKAVALVRNLPKAIRKSFVPVPDFVRAALERITFGEGSLPQVLGRELQRMTGVRVADEAWAEAATQLDDHLRMNIEVVDAQGKFLGEGRDLAELTARFAEASQAALAIPQADKEQQRPVEAKAFASVAEKAQQKVAGLSMTVYPALVEEQGEVKEGRFPTQAEADYQHRRALQRLLLQQLAEPAKYLRAKLPGQTEMGLLYRELGRVEALVEDILLASLDSCVLQGESLPRDGAALAALAERKRAAWNEHAERLARLVLDILKLWHGLQKRFKGKVELAMTVPLNDVKGQLANLVYPGFVRATPLEWLKEYPRYLKAIEQRLDKVAGQVQRDRVWSGELGELWAQYQARLAKHAQEGKRDAELQVYRWMLEEYRVSLFAQQLGTRLPVSDKRLAKQWSQVEG

SEQ ID NO: 17933 - protein, 516 aa, Pseudomonas aeruginosa
KRRAGRNRRAFFVLVRSVAQVQCATDGEEQVGLVGQAGDIGRLRAVGGDAQLGAGVLLGAFLGVAVADRQRRAVLGREQLGQPRRGGFRRDDLAGVGVVGGDDHQGLAIGLGEGQGLLHGFVEVDGLADLAARIRGMVLLVDGRALDLQEEAVRIVLQQLDGLAGHLRQGRDVGGALRVRLAAHRRLVQVAVVGGGRTEPAHWHVARREQADQRLLLVGAAHGFQLVEVLDDPVAAGFGLSAEGLAGIAASLGGFREGRGAAAENHVRAGLQPLLGDRAGAAVLQGIARALLAGGLGTVALASGDVGEQGGGGGVLQLGGGDVAGGLAVELGQLQQVAVRLFVDIHADRAVVRLDPGGPGGGGGGGIGHVVRQAAVLVQGVVGVLAGQRQRIDTLEVAARAARVVARHGDLGVAHAVADQQDHVLRLLLRQRLLQGLGQVLLDAPCAAVLAEFATGLAVEQRRIVLARLGRQGAAEHGHGDGKREGEGITWGHDAFPYVEEVAVRDGRAIRRVLRK

SEQ ID NO: 17934 - protein, 181 aa, Pseudomonas aeruginosa
QFLSKCVARATHHVVTSGERAGMVRRSIPVRSRKASMSLHGVYDSQNIFAKIIRGEAPCYKVYEDEDVLAFLDLFPQSYGHTLVIPKHAEARNLLEIDAQNLAKVMAVVQRLTRALVEEVQPDGVQVAQFNGAPAGQTVFHIHFHVIPRFSGENLGIHAAKQGDPEVLAQLQERLAQRLQG

SEQ ID NO: 17935 - protein, 412 aa, Pseudomonas aeruginosa
RSIRAITHFGSSTANRDASRAGFSSNRGQRMFNPANQTHFSLTLDGLRHDLQVLAFNGHEGISRPYRFELELVGERAGLDLETFLHRPAFLAFTPQGQGVHGLVYGAAQGDAGKRLTRYRLTLVPHLAYLAQRNNQRIFQHLTVPQIVALILEEHGILADAYRFQLGTRYPEREYCVQYDESDLHFVQRLCAEEGIHFHFRHSAEAHLLVFGDDQTVFPRLGRPTAYVHDSGLVADEPVIKRFSLRLASRTTRTTRRDYDFENPRLLLEAGNRPVADAPAEPDLEDYDHPGRFVDRQRGKLFSQRALERHRADRAHGRRGQRPAAAGQRALPGDRRAPARGVERPVAAQRSLPRRQAAAGAGRERYLPTRRPARTISSRATATASSPRPGRCSSARRWSTRSRACWAARPRW

SEQ ID NO: 17936 - protein, 135 aa, Pseudomonas aeruginosa
PAVGPATAMAASSFRGSAWKCWWTSSKAIPTSRWSAAASTTPPTRCPTSCRRTRPAASSRASAALAAVATTSCASRIARARNRSSSMPSATGTRTSSMTRRSASATNATTPWRRTATASSRPRSITPCTESARSS

SEQ ID NO: 17937 - protein, 903 aa, Pseudomonas aeruginosa
LSDGYGESGRMSEEINVLREDIRVTVSVAPEFPKERLLPLEPSVLSKNISRQVKEERKYNEEKIKRDREGGGEGSGIPCCKTLHVSIGYDGTNNNDRADGASLPPSRSNVAKLFHASVGEGSVQEGLGFFRYYCPGVGTVFPDIREYTPSSLGLIAAAGGENRVNWGITRLVDVLQGTLTPESPLLLDESQTMIKNMATNGIAKVLTGGLLENGEKKRRAALEPKLKELEEKLRQRQDSGQKPHILAMRLYIYGFSRGAAEARAFANWLQELTRASGADGRVEYRFAGLPISIEFLGLFDTVAAVGLADSAPFAAGHMDWADGTMRLPDEAQVQCLPTTLPEDCAFLKRCVHLISCHEQRASFPLDSIRRRDLDANGRRTGPSCYRQGTVEYAYPGVHSDVGGGYGVGNQGKAVGGSEFLLSQIALQHMYAEAFGAGAPLQVPKSAVHPDFHEVWREMTPETEAEFSVSEELATRFNAWQAQAKAGPLEEVIRRETALITAWRIDRYAGGLRNKAFFANVPPDMPEAQQKAWEALYKRRSREYAAAQQGKPLPPMSAAEQAEWDRNVALIGGEDKLRDLRVEKQFDPPLDQRQLLGAAAEFAHDYKGDWGVLDDGMTVGGVIDLLLGGTVFLINEEDEAEEYSQIHRDGSARYHQLFSAPDRVAPGQEKLVALFDEQVHDSRAWFMNTSAIGPREPFTDYFRYRLVHFDNESNKRLSVLATAGRVVGVGVMLASVGLSVKRRDPRMLLGLFLPSLARPLLSGKVGLPEISAFDPLTGIALPMVGGAALDNLRAFTCEPGDKVEQIGQLPPPPPLAVAAVQSPALQQVLLAQQTVEALKARDLGSLAGLVAKAELTQAPAAATPAWLAEAKQALQDMGTEQAQPPDPGSAPGWLQRGKDLMESL

SEQ ID NO: 17938 - protein, 182 aa, Pseudomonas aeruginosa
PSFAGARSDGAEWARMPGLFFRSRLPMRQALLIVDVQPCFAPPDWLLEGIGQLLGRMPSVASVERHDESRTPFQRQLGWRPPLDDACLVAADRVFVKHGYLPTAELVDHLRALRAERVLVCGIQADTCVLAAGFALFDAGLQPTLIGDLVLGSSLDRSGELGVRLWKHHFGQVVSLAEVLAD

SEQ ID NO: 17939 - protein, 263 aa, Pseudomonas aeruginosa
AGGELQYLRAPVQRPARRGHRQGRTGGAGRVQLGVHREGVRHQEPLRDEQGRHPRPAAHGSVPSRAQQRRVVDPLRDGRGRRQGGAAACRPQRRRHRRGDRRLLQPAARLPGDRGGGAGRAGYPGLRLRHERGLLLGHLRYPGRHHRDPDRPGAGDPDGQPGDLHRPPELPRPRQPLHLRRRLHRGDRRARRPGRVEAPVRHRQHQAADPVLQQHPQQLRLPQPRRRERYRQARQAVRPGRPQGVQGCLPDGRRADRRAPGGQ

SEQ ID NO: 17940 - protein, 206 aa, Pseudomonas aeruginosa
TLIVAAPTDAELLPRLLAGEQRAFRELVGAYQGAMRAVAWAIIGRSHTEEVVQDAWLAAVRGLDGFQGRSSLKTWLLTITANTAKSRLRQVRREVFLDDLPGPHGTVDDQRFAADGHWSQPPHAWHEDSPEALLAEGELRDCLDKTLNGLSELQRSVLTLRERQGLELEEIRDLLDITLSNVRVLLHRARLKVFATLEHFEETGQC

SEQ ID NO: 17941 - protein, 470 aa, Pseudomonas aeruginosa
ASCMPKPIASASCSGAAVKRNCAAWGTAHEPHDLATAFRRTYPRSAAGLAARHRDGAHGDLRGTVLQQPGRFHQQRFPGPAPVVRRAALASPGACLHARASLPHTVLQPIGRGVHRLAAGRLPRGGGRSALPAGAGSLRVGRAGPVAGRGACRDAAAGLVVVATGLAAGLSLAGPSPGAEPSADGAAGRADLPAGLARSGGAGALPAPVAIRLSPRAAPERGGRGAGGAAAVVARVGRKLRPERRRGVFRKCLRLAGGLARPGHPHGRGRSGVMMKTVFLRLQHALDVTRRADFLAPLALRLYLAPVFWMAGCQKLADMPATIEWFGNPDWGLGLPFPELLAWLAALSEAGGAVLLLCGLAVRWISLPLMVTMLVAIFAVHWPNGWQAIADPSAPFANAQVLEAGEKLARAREILREYGNYDWLTSSGSFAIVNNGIEFAATYLVMLLALFFGGAGKWLSADFWIAQKLR

SEQ ID NO: 17942 - protein, 520 aa, Pseudomonas aeruginosa
DFYPYRITRKARSRGLFALFALEIKSSSVMKHLSPCNLAAICHRQDSPQHKGAALRPARNKGRAVARHSRVANAHTIKGKSSMIRKHSLGFVASALALAVSAQAFAGTVTTDGADIVIKTKGGLEVATTDKEFSFKLGGRLQADYSRFDGFYTKNGNTADAAYFRRAFIELGGTAYKDWKYQINFDLSHNTGSSDNGYFDEASVTYTGFNPVNLKFGRFDPDFGLEKATSSKWVTAPERNAAYELADWINTHQDGMGAQVNSTLADMAYLSAGVSAKDADDSDGDSVKQFNFRGVFAPMHEAGNVLHVGVNYAYRDLDDTAFDSRIRPRLGMRGIATSGGNDAGDNGNRATFGGVSNSPAGSYKDDSVWGLEGAWAMGPFSAQAEYLARKLKADDNAYKDIKAKGYYAQLAYTLTGESRQYKLEGAKFDSVKPENKEIGAWEVFYRYDNIKVEDDNVVADTATREVGDTKAKAHNLGVNWYVNDAVKISAAYVKAKTDKITNNNGDDDGDGFVTRLQYVF

SEQ ID NO: 17943 - protein, 268 aa, Pseudomonas aeruginosa
SSAASTPTSAWKRPPAPNGSPRWSATSPTTSPTGSTTTSVPVSKPARWWAAWLSSRAACSARTTTIPTATASSATTCAACSRRCTSRATWYTWACNTPIATWRTARWIPGSARAWACAASPPMAATMPAAMATAVCSAAVRQSRGCGRTTRSGAWKAPGRWVPSRPRPSTCGARSRPSATARISRPPAITRNWPTPSPASRASTSWTAPSSTPSSRRTRKSAPGSCSTATTRSRSRMTTSSSTAPPARSATPRARPIPWASTGMPTRR

SEQ ID NO: 17944 - protein, 210 aa, Pseudomonas aeruginosa
RGAHRRYAAGRTRSDAQAPAAHPGHHARIAVHPARLGVGPADACRGAQRDRRRDPCPGRQQARQPPGAVAGAPAGAVSATAAADRAVRHAETDREGRALPRRRQRQSARSGLPDRRHRLYAPPRPGHRGTAGGAGSGDVQRHLGAGLRPPGAPGPASTAPPWCSSTPGAWPSGSPASSPNASAAARWRPTTAAWPRSCAWMPSSASRPGN

SEQ ID NO: 17945 - protein, 1133 aa, Pseudomonas aeruginosa
SAVTEARSAQAQMAAEQGPQRGRLDRLGQVVEAGGVDLRHQFRPRVGADHHARHRLAQARAQPGHQLRTGLAVVQVIVDQRQLRAHLAVQQRGAFLAAARGPDLAAPAAEQAVHAGEDAVLVVHAEHLGAVQRLRRFGLVAVGQGRRRLPRQRYADAEDAALARPGTYFQRMAEDLAEPVGDRQAETEAFLRAGLVAVQALELFEDDFLLVRWDARPLVPDLQAQVAVLAADAEQHVALGVAESVGQEVLQDAPQQLDVAVHPQLTAAQAEMQALFLGQRLELDAEGIVEVVQRERVAFGADPAAFQARDVQQVGDQVLGGTQRRVEVLHQVADLAGQRVLVGEGGGEQPRGVQRLHQVVADGGEEAGLRLVGGLGVALRLAEFLVQLRKFLGTLLDPLFQRLVGALEALFGLAVGGDIGEAHDEAAAGHRVADQLDDPAVGEQPLGGVRSALAHPVQALGHVHVRIAGPAQAAIGVVADDVGDRPADVDQPVRVLEQLQVAVVPGHQAQRLVDHADALGDVLDRALQQGAVELQHLGGFVGDPHHVLHLHLAPFDGGLHHRPRRGRAEDPGEQALGVRDPLVVGGLVRGEALALAVGEADEALPRAFLADETRGEHQQVFHLHREHEARVLPLGDLLADEAAGLPVLGHAGAREHRDQAEQGEVADQRDQHALGQRLDRQAEGIACQPGQAGDALQRPAEALGHHRQDQRIGPQQRAGGEAGEDPAAVGLFPVQRADHRRAELGDGGEGDLADGRQAGAGAEQAVGHVGEQQDHRDAHPAYGQQPVTEGLEGPFGVLFPASQQPRQEHVVGDHGRQRDAGDDDHSGGGRGAANECQQGQRRVRLGQRQADDEGVRHYPGGQVQLAGEGDRHHEQRGQHQVDGEHPARQVEVARLDVLHHGDVELPRQAHDRGHRHAGLQQHRRPVHGLFPVVGQLRRGAGLGEEIGEAVVEAEGDEDAHGEEGGELDQRLEGDGQDHAAVVFGDIQAAGTEDDGEQRQHQRHDQRRVLGAGTGGVGAGADQQVHPEDDTFQLQGDVGQHADHADQRHHHRQCLRLAVAGGDEVGDGGDVLLLADHDHLLQHPGREQHQQHRSEVDRQERPELAGGLADRAEEGPAGAVHCQGEAVDPGAQAG

SEQ ID NO: 17946 - protein, 608 aa, Pseudomonas aeruginosa
IPLGLRALILDDLRISQAHICKSFVFTFFTICRNFAPHFFLRPWGSLDVVREFVVAPGRRHRAGCVHAGGAGRRGSQGAGHGHRGRRLAGRSRPGGGAEPSRCAQRGASSGNARERCAERPRRAAQGARRASAGQQRYRRQRHLPERRGAWPDFTPVAALDGDDRRRAGGGGALRPAAAVDDAAVHRQPGEHRRRARRRLGALRPAERRRGDQLRDPGDSGEVLRRNRHHHRACRPRRLEEAQPGVPRRDRRQRPGRGAAVFRGEGRRLPRRQQRQRYRRRAAQDPLAAHRQRPVGGQLPLLRRLRRYAGRPDPGAVRRRSLPVGTRLGQFPWSAQGLLAEVHPPGRRPHPVRGAHLLQRQFPRQQHRRAQPQDHHLVPARLPCVRGGAAGLADLLRRPDHPGGRHRLPLPEGSDERARQPAGPGRQCADRASRLGRPYLPGPYRRYRGQRLLHRRQDRCRQLDHHPRHPLREDRQRLARPPGARPERQAGAGEEAQQGLQRTAAGAEPDVSLERRVEAVRQLLRIVRQPAVLPARPGRQRQRYRRRPGAGEGQDLRTGHALRQRQLGRRDHAVLHRLRRRAAVRQQRRRLDQPRRHQAPGHRDFRPL

SEQ ID NO: 17947 - protein, 296 aa, Pseudomonas aeruginosa
PSNRPKPLCSITTAMISRPDSAIRAWLAATTAAMITTMLNTETSGSTSATCRVRSPSRRCASRPRAMGTSTTWRIDRNIAANDTGSQAEASSQTSAGVTSGASRVVTEVIATDRATSPRDSQVITLEAVPPGQQPTRITPTAISAGNCNRLQSNQARPGMMTNWASTPISTRMGCRATSRKSSPLSVRPMPNITRPSSGAMAAVSGRNQAGRKKARMANSRTQNGKLALTKRLRAVRARMGFPCYWTAASLPCRARLSQRRAPPGERGVRRPGGFLRRRGPRRAPEGIRRRSASSG

SEQ ID NO: 17948 - protein, 81 aa, Pseudomonas aeruginosa
FSRLEYRPVTPGVAGSSPVRCAISFLSCISCASFPLHNSTFFDASFPLFFCPRSTRSFCYLLHFSESSALNLSARTCSYCP

SEQ ID NO: 17949 - protein, 66 aa, Pseudomonas aeruginosa
IDQITARSMPTFLHSLGQYLTPTHDMMYSVLYRFTSVCFAVLITLMTVLVIHLFLNRFAATRHYSH

SEQ ID NO: 17950 - protein, 385 aa, Pseudomonas aeruginosa
RARRTAGRTWRRGIQCSRAARRAAACRCRARRVCACKVLVGRWRDGRGAPRVSVSVQQRAASLQVGAHFRLGHHAAAGGPDQVGGIGQARRGQPHAFAIALRLTGDPGDARRAGQGRGFQADALAALEQGEQAEQLVVVHRVVAVEQALHGAADEARRTPHRQAIGGGAVVDAEVLHRNLLVAAGIDAEEHAGRMGRLGEQAVHRVAERQLEAEGHPAGTAADPAGQMDEQRVLAVDADAGGVQLAAQSLGGDGVAEEQVAGVFVVDEMGVGIAGRFAAALFHRDTVVGGVLHHRHAVGAQLVLLPLAGVGGHVHAGLEAQRGADDADGKAQVARWSPPLSGGGRRMPGNPHRPAASSRRRGRPGRAPGPGARHGRALHRCRRGP

SEQ ID NO: 17951 - protein, 276 aa, Pseudomonas aeruginosa
TNRRCRSRWSMASPTRRRPTVRRRTELRSPREPIGRRCCDESDAFPSPDGAQPAARAAAAEDRPGHRRGERGTLAAGIAGTRPAPARSRFQRPHPLVRRRSGQRSAGAGGGIGLEPDEPAGRRPRRAHAAYRGAGVGGKRGGTADSPRLPGAGRRLPGSGLHRPGPPPGGAGAGGAGRLRAARPDPGRPAVVRVDALGRRPPAGADLRASPATGLGASPVAGALGRRPSRGPAAPGGAGAGPVKLRTVRLSRSAALRAVTGRRSDPPDAGRGRSSR

SEQ ID NO: 17952 - protein, 302 aa, Pseudomonas aeruginosa
PSPSKTGKNRREVWLHAIIRRKTVVACFMQRVKQWSCRSLARPSEGSANGRCFGFSQPAYAVGRTEPSGAASVPPGRQPALRHQRVQGERGVAVPAPDGDAQVQPGGARGGEHPRRHHSDPRPGAGHRPPRVAGPDQQLRDHHRVQHQGAGLPGALGGAHRQHELGRDPSATQGRRPRALPDRGDPGGQAVGGNHRRGKSARGGRTDVRGSVPRSGGRRDPEPRGDQAGAGGGRFVGGAQAGNPLPGGGRRGNDRAQRRAPGPGVPAEHALRGTASGRRAADADLRHRNAGNGRLYPDGGNP

SEQ ID NO: 17953 - protein, 849 aa, Pseudomonas aeruginosa
SCSGFAAGGHGGRISGPAGYLRARLRGAPAQPACRPPGRRCPGFAAYRTQLQGRQQQHGRGTPRRLLQGAGRKRQARRPATGAGADRTDGARIRHRPHPFQTGTSALSLRFSSFPATRYRPDRASLAYNAPLDLESFMREQALRILKDVFGYDAFRGNQARIIERVAEGGDALVLMPTGGGKSLCFQVPALLREGLTVVVSPLIALMEDQVATLDELGVPAVALNSTLNPEQQRDIAERLQRGEIKLLYLAPERLVQPRMLAFLQRLPVGLFAIDEAHCVSQWGHDFRPEYLQLGQLAELFPQVPRIALTATADMRTREEMIQRLHLQNAEQFLSSFDRPNIFYRIVPKEQPRKQLLGFLSERRGDAGIVYCLSRKKVEEVAEFLGNQGFPALPYHAGLSNELRAHHQKRFLNEEGLIMVATIAFGMGIDKPNVRFVAHLDLPKSLEAYYQETGRAGRDGLPADAWMAYGLQDVLLLRQMMQSSEGDERHKRVERHKLEAMLALCEETRCRRQALLAYFDEEMPQPCGHCDNCVDGVETWDATESARQALSAIYRSGQRYGVGHLVDILLGRETEKIRSLGHQHLAVFGIGKGRGEDEWRTLFRQLVARGLADVDLDGFGGLRLTEACRPLLRGEVRLELRRDLKPQRAKGSSSGGASAASQLVRSEEREMWEALRALRRKLAEEHSVPPYVIFPDATLLEMLRSQPRSLSDMAQVSGVGARKLERYGQAFLDVLTDSPAAPAAPPQDLRHELASLACAGMTPAQIARQLNCSEKNVYAMLAEAIAGQQVSLEQALDLPEELLGEIQDAFLEEDGELPPVAALEERFGKRVPSGVLHCVRAALQVELES

SEQ ID NO: 17954 - protein, 155 aa, Pseudomonas aeruginosa
TRPPPQSPRPVPGALVGVVASGAPSRFAHPARVGPIGRGRRPDPGAAARRPRVPGPGTAPGGGGGPAGQAHRADSQGRCADRRYRGHRRQRSQRRTDRHRRVRAGAVPAGALANPGEPGKALSTASRNSARIAIFMASPPGLSSESPLQRFSSVF

SEQ ID NO: 17955 - protein, 184 aa, Pseudomonas aeruginosa
CRGRRRPGTAGAGRRIPGSPQRQPLGHQRTPAWCRQRRSRATHGGPVPAQSAGLRQCRPAPAQGRRAPAPAGRLPAGARRARRREGGGRGSLAASRCRRGGKRSGGSRRGAAPGGCRGRGVGPATGGTEPADGRSATPVAGLAGTTAAARSPGRRTATATGPAPGGAARGAAARRGRAFGCATG

SEQ ID NO: 17956 - protein, 372 aa, Pseudomonas aeruginosa
PRSQRSSFPLNRCRPPMACCRSTGGTAHRHSLGAFILSKGVPMSIIVTGAAGFIGSNLLQALNRRGETDIIAVDDLTDGEQFRNLADADIADYLDQNDFLERYARGDFGTVRALFHQGACASTLESNGRYMMENNYRYSCRLLESSLELGVPFLYASSAAVYGSGRTFREARQYERPLNVYGYSKFLFDQRVRRALPQARSQVVGLRYFNVYGPREEHKGRMASVAYHCYQQLRRDGRVELFGEHGGFPPGGHLRDFVAVEDVARVNLHFFDHPQRSGIFNLGSGQARTFNEVALAVINSVRANADQPPLSLQQAVQSGLLGYREFPESLRARYQSHTCADLELLREAGYRDDFQSLEEGVAGYCRWLARSA

SEQ ID NO: 17957 - protein, 638 aa, Pseudomonas aeruginosa
RNAGVRWPQAARCFSTSWNSSSTVSSRSSSSSTPVTPNSLRSFSDSSLTTSESKARSSILLSRLISSFGTPLATLSTVRRWSSMSLGIVLPSSVHCRNDLRPAQGDRTPGQSGTETGEDHVAAVAQDALAQAVGQGQGNRGGDGIAHLGDVAHHSLDGKVELVGDRRENACVGLVRDQVMEVRSLPADPVEHPPHRVAHLRHRLAEHCLAVHPEVVGGLSGTAFGATDGGGHQQVELVAVAAEVEGQQRAFFLGIAGTQHHRSGAVAEQCAGRAIGGVEGMAESVHPDQQRAVRQPGADQRADAGQAVDETGAGGGQVERERADQPQARRDPGRGGRAAEVAGAGCQHHRIDSLQPRRGERGGGRPQGQVAAAEVAGDMPLAHAGAAADPGVGSVQLGGEHVVAEHGLGQVAAQAADHGGARHGSGSLDDLGGGLDPAQGLEVPQRIPEVAVEQDLSVAGAQHRDVVLRQLAAGNGGHAVAMEFADGQVGVGGLVELHVGEAHGQVLGKQAHVRPDGFAALEAGLPARRGVGEFEYAFRMEQVAPATGIAVFQEAQAVDKNFLGIHWAILSIGLAWEAVFAGALHPVRTGTLIRARRKVIGSHCSSAWGTANWRSGKRASRRWMAIRPSSRASEAPTQ

SEQ ID NO: 17958 - protein, 360 aa, Pseudomonas aeruginosa
SACSGEISSSPSLSLRSGTLLLLRRRGGGDDGAEHPVDHAIGQQPRQQGAAAHVGAHPVAGPRLGRGERGMHRGGDVGGLGRAVARAVLVGLEEAQVGIAIEVGDGVGGVGQGALALAGDLAPDRRPDRPGADHRDLDAHGRQLAAQGVAHSLLGELRGGVGAQVGNGDRAEARGDVHQARRAATAQQRQDRPGHRELADQVDFQLAPQQVAGDAFQRRGNADPGVVHQAPEPGIADFLRHLRGGPANGFLVGDIDQQRADPAGRAGVRQALAILLAAHPGDHLETLFGQVQRGFPAEAAGGAGDQHVAALGRERFAGEKHVIAPRGRIVGGRGSPTAGCPGNLRPGVRRVRRGPLRRYR

SEQ ID NO: 17959 - protein, 827 aa, Pseudomonas aeruginosa
SSRGARYSMFVPCSSGSARRAASSRFPAGGEGEAVDPGEVCRHHVFRQFAAQCLLQFGEIHRLGLAEQEGSEECIVALALASHHRRAAQARLALGLAHDRQLDLGRLDAEAADLDLGIGAAEPDDLAVAEDAPEVAGAVEPGAGAPGMFDEALGGEFGGAVVAAREAVAAEVQLAGNADRYRAQRGVEHLHLDPVQRPADRRQVRVVRRVAAQRVVGDLVRLGGAVLVLQQQPGHRRAERADVFGDAQLLAGGHHHAQGAGAHAQRVGGLGEALQGDEGQQHALDLAAFEDMQQRGGVHPLAVGDELQLAAAAQRGEDLLEGHVEAQRRELQGAQPRYAAGDAQLPLGVVGPHPMAKLDALRPPGGTGGEQQHGQLVELRRGEGFGLDVGDQFLYRQHPFRRGDMGVLGMRDHPERLCGLQDQRQALRGIADVQRHADQAGAQDAPDRRDHLRRTVQRHSDRIAAARAGADQAGGHAARHMVEVAIGPALLLEGQRGAARQRLDLAFEQADDVDQRLGLGSGVAARGEEGEVGGFVGMLGEAPQELDEGRADQRGLAAADAAAVAVDAQVHAVAGRGDHVDQQGEVGFFPDAEVAQLPQRFEDMQVDVVEGAAQFVADDLLDGAERIAAMGVSVALLAEQRIGYLDPAMPGNLRADRHGIQEQADHAVGVGQFGAAVADRAGDHAVAAGEQMQGQAMGGEQQRFQRQSALRRSGLESFEQPVRQRFAMAGRTLRGLRLVGAEAVEAGHPRALQQPGPVPHGGRRSQRGQLLADMAGQRRRGARQRLATVGGDQRDDQVGHAPAVEDRMVEAEYQVQAVLADERGEQE

SEQ ID NO: 17960 - protein, 369 aa, Pseudomonas aeruginosa
PGLLQRIAMEAALADVLVEHRPGLRVAAQVQDQRFAARLGMHQLQRFGCTAEVERRTQRGIGGDHPVQRVAERGFVPGQVEAVVEHVVVDRRVGALAAMEEQAETQPAGREGVLQPFQARLVDFGNQFEGLVASLRERTHQALGEARHRRVAHQVGEFEAQAAPLCGGADAQHQDRVAAEGVEVVVHADLRHAEDIGPHRRQFGLGRRARRNRRHLFRRCRQLPAVELAVGAEREAVDAHEEGWQHEVRQRRRKSGAQLTGVEFRRSHVVADQVRAAYRRIACHDRGVAYAGKRGEAVAYFVGFDPVAADLHLVVGAAEVFEVAVGQPAGQVAGTVETAAGDEGVGEEALGVQLRPVQVAAGDADASYI

SEQ ID NO: 17961 - protein, 289 aa, Pseudomonas aeruginosa
LADGAEGLRPERAVEDVQAQVVDRPADRDPRGVVAGAFMVGHVDGGLGRSVQVDQSHGVAEQPAEARDLQRREGFAAAEHQAQRACRRAGGRVAVEQVEERRQHRRHEVDDRDRVALDAPQHFPRVLLGAGRQQRQAGAGEAPPEQLPDGYVERHRSLLQKHVAFADRITTLHPVQAVDHRAVLDHDALGHAGRTGGIDDIGQVAGRHVGRRQVAGALRQAFEVQHARLAEALAECRRAFVHQHHAGAAVFQQQADALQGMVGIDRHIGAAGALHAEDRRQQVGTAGDQ

SEQ ID NO: 17962 - protein, 273 aa, Pseudomonas aeruginosa
SASMSTPLTLLQRLLQRGEQPSAEDAREYSVDELARTAGSSVRNVRAYQDRGLLPPPERRGRIGVYFDSHLKRLRLISQLLERGYSSANIKELLEAWEQGRDLDHVLGLDQAIIGEWNLETPGSIGFDELQAIFGDELNDRVIDKAQALGLLLFDGERMKIPSPRLFQAGLELYRSGIPLEALLDQLGELRSDTEHLAAGIVRLIVTHLVDGRGTDLLPGAPDLQELAKVFLRLRPLAEHVVQVELARGLKLSANEMLGERVGEMLRKLEKPS

SEQ ID NO: 17963 - protein, 190 aa, Pseudomonas aeruginosa
SAAGSAPPAGAGRVFPGRCRLPRPGCPVARRARGGPPGSGRGTGRRGGRTGCADRRRRNAPRTGAWRARPPEAGGIPPARSPAVLRRPDGRFPGAVPGLSRSSPRAPAPVAGAAAPAAPPRRRSRTCPGGSGVGCAPVRRSARRSPRVPGRGWPGASAPAPAPGWSTACGFSPAPAVDRRTVRGDARGRG

SEQ ID NO: 17964 - protein, 260 aa, Pseudomonas aeruginosa
PGESPDDFEKQKKLHPPGRRYGRRHRRHQHAAVEHPGGPGDSRAPPAWQPQGRRARGDPDAGEPLLRPLFRHPQGRPRLRRPHGDPAARWPAGLAPEGQQGRDPALPLRHQHHQRPARRRHPAHLAGRPAGLERRAHGQVAAGQDRAFPGLLQGAGHRLPVRDGQRLHHLRRLSLLVPGRHQPQPAVPLDRHQRPARPARWSGNHQRPRQQRPGGAGLHLDHLSRAPAGCRHHLAGLPGHGRQLLRQPADRLPPVPCRGA

SEQ ID NO: 17965 - protein, 466 aa, Pseudomonas aeruginosa
LAADRQRPEHLEARCAEARRAGQQPAAGVLDRRPGQVLRTPRPVQPDLGGRVHFLGTRRADRQPGGLEQDRAAGDVRRERRLLRPRRPAGRAEPEQGRHAAWQDHRRRHPRMAHQGRYPLSQPALRPRPAGADVRDLAVEQGRLGQLPGVRPHLGDPLPGAALRGHGAEYQSLASCRLRRPDLGVQLRQPEQRAVPRTARHQPGRRHRRQPDQAAEAEAAGGGRHAQAGNGHPSGPRLALRAGRACALPQRRRCAEPDLRQHRQGRRGVPGVRPARQREPAETLHRRRAQAPARQLPGRRQRRLPPGSARSERFPPGLSRQPAARPGGAQGAAAGSADRLRAAVRQPARATDQPWPPSGQADGQGQRLSPGRAAYRQRAAGTAPGSPLFAAQQRQLVRLQRQRAGGGQLPAAFQRSHGRWSLRLQRPGHGPGHADLLTRTAAPAPCNGAAGADGLRPSRGEPGRGY

SEQ ID NO: 17966 - protein, 595 aa, Pseudomonas aeruginosa
SLRPRGLARLHEILTRRPIEFGRPATGGGGGPLRFRSCFNGWGYQAFLAGYRFDPAGDAVRAGSGGVLQRGDLEGPAWPGAAARLEGLRVLRLVRGVPVGRLHAPADPGFLPPAAQAGLDPGRPVLGRRDLLHGQLRHQHRHGDGAERLRDQRHRGRRPGQPDPARLSAVARCPAFAADLALAGTLPAVLPRPAEQDPDAARLPADRRGNGRQLLFHLRPDLPRGRQADPLHQPDQLHLRGGQVRQAAPGDQGTPGGRADRPGRPPGAGCAAATEEIAAGVRGRRDRPCRSFLAERLRSRDQPGAEQAGHRQLHPGPFLRHFHRGLGALHVLPVPARGLQRQEGQDPRRPAGHSPACRRAGVVAGEQQRLQGHLPAGAQPGHPEDPAESVLRRQELPGRVAAGRPAGVHRRPAGRRHHRPALRWQPRSRVLRALPEGDGALPAGMPDQPARQLQQGRAGERLRQHHPLYRPLPDEGDRIAQAECRQARYGDDLRVRPRRVAGREWRLPARGALFDRAPGADPRADGHVVRPAGAGQLGHPAQLPGRQARRQGPEPRQPVPLGARPAGRTDFAVPAGAGHLRQLPRAQGSPVSDGG

SEQ ID NO: 17967 - protein, 888 aa, Pseudomonas aeruginosa
NERSHGGCPWLLVSRSRCRASAGDQDADRLEAQGGLVEQGQAFLALGAQAVQLAVADARVDRLERGQARQFLVHGGGELLLGPGHAFLVARDDLALGHVELLGQHIALGLDELVGADPWHAFQLVVEGFQGYPAGQVVAVGVEQAAQGLRRQPAAELEGARCHGLADEQEFEQHGARLQRLVLDQRHRGVAHRAGQHQVHAALNHRMFPGEELHVLAGQRLGTVVGDGHAFVVAEGEAGVEHLLAWLEDQGIFRMVFAVDAVGVEQALHVDRQGEVVVLFLDGLHQRLAFAGAAGVQLEQAVATAVQLRFEGFATGAAFGEQRVPGLVLAAVEQRQQARAELVLQGVAGGAGIEEGVQRLVIPLEQALLGAVLQVRYVQLDGVSLADPVEAADALLEQVRVGRQVEQHQMVGELEVAAFAADFRADQHLGAELFVGEVGGGAVALKNAHAFVEHRGGDARTQAQGVFQVEGRLGVGTDDQDLELLEHLQGIDQPLDARVEAPPAVVVVAVFPLLLEIHFRIQVRVFAGRQFLVLARHRQRIGVQFALGEALHGGTGVAEQHATGAVAVEQLADQARASFFIAALDAGQQLVALAAEEAVDGLARAGGKTAVVEQFLHRFGDRTILLALPAERFEVVETIRIEQAQAREVAVLAELLRGRGEQQDAGNDLRQLLDQRVFGADLVLVPDQVVGFVDHQQVPAGGEQGVLGAFVFLQPLQGDQGQLGVLEGIAGIAFGEALLVEQGHLQVEAPAHLHQPLVLEVFRDQDQHPPGAAGEQLAMDDQAGLDGLAQAHFVGQQDARRHAVGDFAGDVQLVGDRLGAGAAEAPERGLEQLAAAFESVVAQGEPGQGIDLSGEQTVAGEAELDEVGELGFRQGALLVLRGEAVVHQ

SEQ ID NO: 17968 - protein, 241 aa, Pseudomonas aeruginosa
RGGGERPGGRAAAQGTIDRHRSVTLVFQASAAALRRSNLRPMDLFADAPLTLPDADLRYLPHWLDAPLASAWLLRLEQETPWEQPILRIHGEEHPPPRLVAWYGDPDAAYRYSGQVHRPLPWTALLGEIRERVEREVGQRVNGVLLNYYRDGQDSMGWHSDDEPELRRDPLVASLSLGGSRRFDLRRKGQTRIAHSLELTHGSLLVMRGATQHHWQHQVAKTRRSCMPRLNLTFRLVYPQL

SEQ ID NO: 17969 - protein, 688 aa, Pseudomonas aeruginosa
YRLHISPRRSPAIYADVDPVSEDPVPIHWKPFLAPSTLALKFAIKTLLAGGLALWCAFRFDLEQPQWALMTVLIVSQPLSGMVVAKGLFRLLGTLVGTAMSVLMIALFAQAPWLFLLAISLWLGLCTAASTSLRNHVSYAFVLSGYTVAIIGLPAVDQPLLVFEQAVARCTEICLGIICASAVSAILWPQRVEQNLDKQAHATWLLGMQAARGEIDPRQRQPQGLLNALSKIVEVDAQRDHAWFEGERGRRRAGALALLSRDLLSLLRTARGVARQRARLSEEEERRVERWLAALASALEGADPASMLALREELAQVAVEPQWSNDQRYLLTRCSVLLLKAVNAEKGMRAVASGEVEGRVGSAGTLSWHRDLQMALFYGARSALALLGLSVYWIYTAWPAASGAMLLAAVVCSLFANRDNAVAIGLSFLRGIVYAIPAAMLVSQWLLPQWNGFPLLCLAMGVPLFFATLGMAVPVTAGTATSFAIHFIVLVAPRNQMDYNLATLLNSAQGVLIGVGFAVVIFRLLTLRPGWLTRRLLDATCVDLGRLTRRPLAQAENWFGGRMADRLLRLARHANLLPEQERRRWDDGLLALDLGNELIHLRACLEGARGVLRKARDRFLGELGELLEAGPAGPRSDRLERISLPLREALERDARHDDEASRLARAALAQLLFTWQQWCHQEESHESA

SEQ ID NO: 17970 - protein, 357 aa, Pseudomonas aeruginosa
IGLGRRLPQPAVRLCPAGAGGHRRAAGADPENAVASLGLARGAVRLRPVHFDVEWHYLGGYDLNRRPEKEIRMRASLRVVVTLLVVAAAVLAGIWLWRYYMLSPWTRDARVRADVVVVAPDVSGWVTDLEVKDNQVVKVGDVLMRIDQERYQANLEQARAVAETRHQQYLLRQNEAARRSRLGIGAISAEDKENAQINAAIARSEYQEALAQVKIAELNLKRSELRAARNGQVTNLRLAQGNYATAGQAVMALVDQQSFYVVAYFEETKLPGIRVGMRAQVRLMSGDQPIDGTVESISSGITDRNSTPDGQLLANVEPTFNWVRLAQRIPVRIRLDQVPADVHLSAGMTASVTVQGD

SEQ ID NO: 17971 - protein, 562 aa, Pseudomonas aeruginosa
MQPEFWNDKRPAGVPDSLDFAAYRSVVEVFERSCKKFADRPAFSNLGVTLSYAELDRLSAAFAAYLQKQTDLQPGDRIAVQMPNVLQYPIAVFGALRAGLVVVNTNPLYTAREMRHQFKDAGVRALVYLNVFGKLVEEVLPDTRIEYLIEARMGDLLPALKGWLVNSVVKSVKKMVPDYRLPQALPFRQALKQGQGHALQPVRVGLEDVAVLQYTGGTTGVSKGAMLTHGNLVANMLQVHAQLSQLGKDGLPLMKEAQEVMIAPLPLYHIYAFTANCMCMMVSGNHNVLITNPRDIPGFVKELKKWRFSALLGLNTLFVALMEHPGFKDVDFSNLKLTNSGGTALVSATAERWKGVTGCTVVEGYGLTECSPVVTTNPYGEQARLGTVGIPVVGTALKVIDEQGNELPVGERGELCVKGPQVMKGYWQRPEATEEILDAEGWLKTGDIAVIDEDGFVRIVDRKKDLILVSGFNVYPNEIEDVVMAHPKVASCAAVGIPDEKSGEAVKLFVVARDPGLSVEELKAYCKENLTGYKIPRQIVLKDALPMTPVGKILRRELREIA

SEQ ID NO: 17972 - protein, 566 aa, Pseudomonas aeruginosa
EWASMIENFWKDKYPAGIAAEINPDQYPNILSVLKESCQRFATKPAFTNLGKTLTYGELYKLSGDFAAYLQQHTDLKPGDRIAVQLPNVLQYPIVVFGAMRAGLIVVNTNPLYTARELEHQFNDSGAKAVVCLANMAHLVEGVLPKTGVKQVIVTEVGDILPPLKRFIVNFVVKHIKKMVPAYSLPQATKLTDALARGAGKSFQEAAPQADDVAVLQYTGGTTGVAKGAMLTHRNLVANMLQCKALMGANLNEGCEILIAPLPLYHIYAFTFHCMAMMLTGNHNILITNPRDLPSMLKDLGQWKFTGFVGLNTLFVALCNNETFRKLDFSALKLTLSGGMALQLATAERWKEVTGCAICEGYGMTETAPVVSVNPFQNIQVGTIGIPVPSTLCKVIGDDGQEVPLGERGELCVKGPQVMKGYWQRQEATDEILDADGWLKTGDIAIIQEDGYMRIVDRKKDMILVSGFNVYPNELEDVLATLPGVLQCAAIGIPDEKSGESIKVFVVVKPGATLTKEQVMQHMHDNLTGYKRPKAVEFRDSLPTTNVGKILRRELRDEELKKAGQK

SEQ ID NO: 17973 - protein, 231 aa, Pseudomonas aeruginosa
PAPWSRRCSRTACRSPSSTAPPPGRRSSTSISTSSRASAARISASMRRSRATRKCSHNFRSVWRSVCKADCAWAGPVRGRSFARRIFLKYFVTYCRGSGAPRFSGDVRNNLHSFFDVASARSRTSDRARRTGTPAVQVFRATGDSGCSTRPTRPTSASPSTASATTCRSSPSTATKASVAPTVSNSNWSESAPASTSKRSSTGPPSSPSPRRARVSTAWSTALPRAMPASA

SEQ ID NO: 17974 - protein, 88 aa, Pseudomonas aeruginosa
SSRSTASSPTPTASSSAPGIPSANTACSTTKATCISSSASVPKRASISISGTAPRRTCWCSATTRRCSPAWAVPPPTCTTAGWSPTNR

SEQ ID NO: 17975 - protein, 309 aa, Pseudomonas aeruginosa
SSASACAWPAAPRAPLAATTTSRIRGCCWRPAIAPLPTPRPSRTWRITITPVASSIASAASCSASAPWSGTAPTGRMGEGVSDQPLLVSGHFLEIAEHPRAEWNDLWLLSEVFHEGKQPQVLEENVTFRHVGQHGRFPAGLPQPLPRHALGGVLPPAAGAPEAARAGQPDRGGDRPAGRGNPLRPLRPGQGAVPLGPRGPGRRQEQLLAARSQRLGRQRLWRHRHSAGRHGSAGGLPRRRSRPAAGQRLRLPRRPPGALRVAGEPDPQRLQEPQQPWRRWLQRAAHRGSQGPGTDLRPCPARLGREHRA

SEQ ID NO: 17976 - protein, 281 aa, Pseudomonas aeruginosa
  UNSURE (53): Identity of amino acid at the above locations are unknown.
AVAALPRSRLADPHRCIGRCHRAGRLSLARRACAAKRSSGAVQIAGANPGGRXGRRGPAAAAPGRRPRGLAGRTARTHRLPPPPDAPVQPLAVAAPGRAPAQLHPGRVEPGSFQRRTAFLRAGPVHGGQRHARSPAEPLPACPGFQLALAGPRRPAEGAGRSLPGPRDAAAASGPPPGSAPGRCLARLERGRSLPPRILGVAPRAWPGQPGKPVPASGPGAPGRRPPGLAGLRPARCLRRPMAARTDPRPRLFPRRERVAHERARHSAFPPVFRGPLVATG

SEQ ID NO: 17977 - protein, 192 aa, Pseudomonas aeruginosa
RLLLYEGYVMHKLMNLICVGNKNSIGLVVFLSTFFGLVACQAGPEVLSTPIMGYNHTPAAINEFTVNGAGGPNLGPHQGGGGQVCCGVIPKYWVPGLEAIVEWEIDPNPKAELKRDRYGSLDMQDYRRHAKNYTHHKAVVEIPRYERPGPIRVHFLPCNQVRVTAAATSPGYPGYPYNYPMVMERVAECPKK

SEQ ID NO: 17978 - protein, 140 aa, Pseudomonas aeruginosa
SATWCSAPRWIARGSWVCACGSIISARSSAWPRCWRIEAQWGRLRSATVASAFIIRAAASGVSPAASWASRRAPWASRLAATSAWLNMAAIISAVLPSAEAPSTSAPPARSSSTIARSPLNAAPASGVCPARLRRSGSAL

SEQ ID NO: 17979 - protein, 491 aa, Pseudomonas aeruginosa
PEAGLVASSLQFDTDIGGENGENKPIVRLSAVPGAHSGISLAPSIPLSGARACRSEAVAHCAMADLARALYESASPTSFRRAPGIAASEPVSGAGPRRAPLCLIGPVRRRPSERRGTTVHKAVISGTGLYTPPYSISNDELVESFNTFVRQYNDQHAEAIAKGELEALAESSSAFIEKASGIKSRFVMNKEGILDPQRMVPYLPERSNDEWSILCEMAVAAAREALQRAGRSAADIDGVIVACSNLQRAYPAIAVEVQAALGIQGYGYDMNVACSSATFGIQAATTAIQTGQARAILMVNPEICTGHLNFRDRDSHFIFGDACTAVIVERADLAVSKHQFDIVSTRLLTQFSNNIRNNFGFLNRADESGIGKRDKLFVQEGRKVFKDVCPMVAELIGEHLAANEIQVAEVKRFWLHQANLNMNLLITRKLLGRDAEAHEAPVILDSYANTSSAGSVIALHKHQDDLPSGAIGVLSSFGAGYSIGSVILRKH

SEQ ID NO: 17980 - protein, 254 aa, Pseudomonas aeruginosa
SATAQPGVRHMNHTTLQRRFAARIRDPQQALPPGIATERMAIYEELFFNNLDGFISSGFPVLRQLFDEPRWHRLVRAFMREHRCRTPYFSQLGEEFIGWLQDGYRAEEGDPPFLLELAHYEWVELALSLAEAPVETLPQAWSWSPLAWPLAYRWPVHRLGPSHRPMEPPAEPTCLLVWRDPAERVRFLHLSPFAYRLAQRLSEEGEAPVALLPLLRELAGSCGLSADVEYFENAFALLEDWHAQGILMGEGALE

SEQ ID NO: 17981 - protein, 292 aa, Pseudomonas aeruginosa
PEGAETLGYTGLHHTNRKAGPPMQNRMMITGAGSGLGREIALRWARDGWRLALADVNEAGLAESLKLVREAGGDGFTQRCDVRDYSQLTALAQSCEEKFGGIDVIVNNAGVASGGFFGELSLEDWDWQIAINLMGVVKGCKAFLPLLERSKGKIVNIASMAALMQGPAMSNYNVAKAGVVALSESLLVELALVEVGVHVVCPSFFQTNLLDSFRGPSPEMKHQVGKLLESSPISAADIADYIHAEVAKGSFLILPHEQARMAWRIKQQNPQAIYDEMTAMAGKMQAKRQRQA

SEQ ID NO: 17982 - protein, 245 aa, Pseudomonas aeruginosa
IHRLWLHPRLAGRFDGAAHASCRQPPRAGQPAGRRGLAVPRTRDVQPLRAVRGRALPDPDHPLRCQLPGHRVRVEPVGRAVRGVAQAPLLGQRGGPPGDRSERQPYLSLGVRAWLPYPPGERPAGPLRLGAGGRAAVINYFWFVLAAFCEIAGCYAFYLWLRLGKSALWVLPGLLSLTLFALLLTRVEATYAGRAYAAYGGIYVAASLFWLAFVERSRPLWSDWLGVALCVVGASVVLFGPRLSQ

SEQ ID NO: 17983 - protein, 593 aa, Pseudomonas aeruginosa
VARGATIVRSMMPISSSSARRAEPAPRPLAEFHPAVRQWFERHFAAPTPAQVEAWPAIREGLSTLVAAPTGSGKTLTAFLAAIDALVVEGLAAGGELADATQVVYVSPLKALSNDIRINLEQPLAGIREELARLGLPDVDIRSAVRTGDTPQVERGAMRKRPPHILVTTPESLYILLGSESGRQMLAGVRSVIVDEIHALAGSKRGSHLALSLERLQALCPRPLLRIGLSATQKPIEKVARFLVGASGNPRDPACRIVDIGYTRPRDLGIEVPPVALEAVMSNDTWELVYDRLAHLARRAPHHPGVRQHPAHGRAGHPLPRRTPRQPPGGGPPRQPGQGAAPGCRAAPQGRAIEGTGGDRLAGAGHRYRRRRVGLPVVVAALHRRLPATGRAFRAQCRRHPQGPVVPDLPRRPGGMRGAARQRAPWRAGQPGAATPAAGRAGAADRRRSGLPGVARGRPLSPGDPRRTLRRAGARALRRSPADACRGLPLTPRRARRLSPSRCAQRPAPWPPWRAADRADLGRDHSRYRRLQRAAGAAGPAGGNGQRGLRGGEPGRRRVPAGQHLVPDHPHRAGTGTGRGRPGPAAEHSVLAG

SEQ ID NO: 17984 - protein, 553 aa, Pseudomonas aeruginosa
GAEQPGLPHLGRGRGQSGLGGMACATVGATPRRTPGLRRQHSLAGGGAPAGDAPGASRGEGTRRFPGASRLSAAGLGGSGDRGADPRPPGWLRATHGRAVGGRPGHRPGRPAVRVGRPGARRLCAAWPLQSWRDGRGVVRTPSAGAHPSLYGEAPAPGNRAGGARRFHAFPVRLAAPGAGHPWPGGGGPGYGGRAAGRLPGRGGRLGKRTAGSAGGRLRQPLAGPAVPFRTHRLGAPGRTQQGRRRSAAQRADRAPAAPRAGALERPAARRAGAGTVAARGQGTGGAARAGCIVLRRTEPGCPPAAQRAGERPRRAGLGRPGQRRQLRRAAHPADAGGQAQPPGAPLARPAGRHAGRRALGAAAPGEGGRGGAAFAGGGSRTCRPDLAAALWGGRLAPAGARSRLAAAVARVAARLPSPGSARRDSRRALHRRPGRRAVRLGGSGRPVARGAQATAGRGDAGGVGGRSVESGRRPATRRTGAGGDRQPPALSRRSAAGGAGSRQGADASGSRRRDRAADPCAADPPSLRPAQRRLRWRLSRARNAAGLTGLDR

SEQ ID NO: 17985 - protein, 202 aa, Pseudomonas aeruginosa
WERSFASMSRRAPMFKPLPITLQRGALRLEPLVEADIPELVSLAEANREALQYMDGPTRPDWYRQSLAEQREGRALPLAVRLGVQLVGTTRFAEFLPALPACEIGWTWLDQAQHGSGLNRMIKYLMLKHAFDNLRMVRVQLSTAASNLRAQGAIDKLGAQREGVLRNHRRLAGGRLDDTFVYSITDHEWPQVKAALEASFTG

SEQ ID NO: 17986 - protein, 306 aa, Pseudomonas aeruginosa
SRFRRSCGMLGGPSGRANEETAVPDETSGEHTHFWRAAELGGVELLHARYVEQRFAPHVHSSFALVIIEQGAQRFRHRGGEHLAPLGSMVLINPDEVHTGSKAHDAGWLYRGYYPEMEQIDGILDELEIHHGGVPRFADSVIHDQPLARAFVHLHRLLAEHAGSLETQTRWRETVLALFRRHARLPEAPKAGQEPLAVARARELLAARLLDPPSLEELAAAVNLSPFHFARVFRRATGMPPHAWLRQRRLEQARALLKSGRAPLEVALELGFADQSHLGRQFKQAYGVAPGEYRSACARSSLTIYE

SEQ ID NO: 17987 - protein, 753 aa, Pseudomonas aeruginosa
VKLTFANHLYLRSLRFAVILRPTFSCVPGGASMSSVSSLSRLAVAIALGVSMQAAQAEEEAKELGTVTVVGDWLGEADQAVVQNHPGARSVVRRREMLESGAQNVRDVLRKVPGVQVQDNNGTGGSDISLNVGVRGLTSRLSPRSTVMIDGVPAAVAPYGQPQLSMMPLSIGNLESIDVVRGAGSVRYGPQNVGGVINFVTRAIPEKFSGEIGTTIEHAGHGGWKKLNQAFLGGTADNGLGVALLYSGVKGADYRDGNNDNDIDDVLLKTHWQLTDSDQLAANFHYYDAYADMPGGLTQAQYDDDPFQSVRDWDNFRGRRKDFSLKYTRQVDDLTQFEVLTYYSDSFRGSSIAARNLRTITSYPRDYHVFAVEPRVSRIFFAGPTTQEVGIGYRYLKEAMNERASQLALVDNVPTVRPGSDGHTYQDRTGGTEASAFYIDDKIDVGNWTITPGIRFEKIDSDWRDRPVLGLNGKPVQEKKRSKDYNEPLPALSLMYHLSDEWKLFANYSESFGSLQYFQLGQGGSGNDTAAGLEPEKAKTYELGTRYDNGSWGGEITLFYIDFDDELQYVSNDVGWTNLGATKHQGIETSGHYDFAALDPRLDGLSVYGSLTYTRATYEGDIPSFKGRDLPLYSRQVATAGVRYEVDRWTYNLDAFAQSMQRAPGLSTDSQGNFTHNYITEPSADGQYGDIPGYVTWNARVGYDFGPQASNLKLGLGVKNLFDKQYFTRSSDNNSGIYVGQPRTLFMQASVGF

SEQ ID NO: 17988 - protein, 629 aa, Pseudomonas aeruginosa
RASFRRPRKVTRTMTQHSQFALLGKRRFLPFFITQLLGAFNDNIFKQSLILAILYHLSVSGDRSLLVNLCALLFILPFFLFSALGGQFGEKYNKDALMRALKLAEVGIMLVGAAGFVFGSLPLMFVALFAMGTHSALFGPVKYSILPQHLHEDELVGGNALVEMGTFLAILAGTIGAGVLMSHAHYAAAVATAVVLVAACGYLASRGIPRAAAALPGLKLDWNIFAQSWSILRLGLGQRPAVSRSLVGNSWFWFLGAVYLTQIPTFAKEWLHGDESVVTLILTVFSVGIALGSMLCEKLSGRKVEIGLVPFGSIGLTVFGILLWWHAGGIPPGEAPYDWLAVLRHHETWAVLADILFIGIFGGFYIVPLYALIQARTDEDKRARVIAANNILNALFMVAAALVSILFLSVAKLSIPQLFLALSLMNVAVNVYIFKIVPEFTMRFLVWLLSHTMYRVRHVNLEAIPDEGAAVLVCNHVSYVDALLIAGSIRRPVRFVMYYRIFSLPVLNFVFRTAGAVPIAARHEDEGIYERAFQRIADYLRDGELVCIFPEGKLTADGEMNEFRAGIERIIEETPVPVIPMALQGLWGSFFSRDPDQGLLPPTVVAGQAWWLANRWRRRRWSASTCRRG

SEQ ID NO: 17989 - protein, 403 aa, Pseudomonas aeruginosa
RSGSGRSGHAWAFLVIGRPPVCHAGRDSPSGGRRRESGASDALGDFFAAEGLEERRKEFGEGQHHQGEAGIELAEGVFAAVLFRLLLQQVFEAQALDRQLVVEDEGQLVRPGQGQLGDQLAGGEMQLDFLAGQVLALATDHAAVLVGVAQLAFVEHVEVAGGFLGLDPVGEGRGRRDLHAQRAYRQGAERFAQRREQVFGLLRAGRVDQDQAEARRDRGEGAGAADEGARQQGLDDLVLQLVAFLLVDLAHLLGFDLVDLFLQCVTHDAARQDALFLACRDQEEVLADVYQRCVRAFAERRGEAVGGQLLAGAGAGGFFAEGFLEGIGIQLQILGEAVDEQIAEPHGVVLSGHKGPIIPPLAAQANPGPSLTPWNGRKFFSSRGLPGAKSLRRMRPTSRVKGD

SEQ ID NO: 17990 - protein, 351 aa, Pseudomonas aeruginosa
GSALSPTRASSCGEACCMDSSAASRSISRRYRSAAIQRASSRTSRVTLAVTLGLPSRSPPIQDAKRSGAAVNGRRSPVLRRSTSSTCRRTFGKACQRECSITAKPHFASSTGVGRTLRISSVCQASATSRCRRCWMRLRSSGSRSAWSLAASCAVIASYFWISVRRATSVGWAVSTSSISSPASWRASCPGACPASLRRPSSSSSTRFSKGSGSFGRRRRIRWYCSAILARLRNWLKARATGSSSSSSSPSRVAVSCWAPSAEPRRAALAPLRISSILSRNRGPYCSRMVSPSNSPRWWTSSRRRASISGMTCLHCGWETSLAQAPPRLQARRVPVRRRRAGSEAAGADRV

SEQ ID NO: 17991 - protein, 523 aa, Pseudomonas aeruginosa
SGCRRSCSSSPRPRRSRFPRGRVRSPRSAWIRRGCGSRVRGWPSPFSLLAGRPPARTGKDRHGGERSEDVRVVRFDAVQAEVVEEVREAHPGRQRVEVAELRRQVLRRRHQALVHQLAQGAHVFQGGLAAEQQGDLFELALAHGELDVVVDEDEALQVGQVLGERQAIRGRAAEDPAGVLVAVLQAVALLAVEVEHVEEIGALLGHVDRPGAIGQLAQAGRVGGEGDHLHQDRQAFLGHGGGRRSLGEEGADRLAQAVQGGADVHQALVDLQRAHVALVEQGVGAYLDVVGAGRRVGDDAVGLEHADGALLLAEHGVQPRLEDRYDLLGGQGLGFVLEIAAVGDVVQVVGEHQAEVGQGRIAGMEGVRGRAVEFLGDQPEVRGAARLEHANDHSVFLAHPPHDLPDRVELAQLAGDVALDVLEFLLLGAGVEGQRAAVVVAAIDLRRMLAAALEEVLADPVVPFDRIQHANRRLRLDDAIGQGADDLLVVVLRLALAHRQSHWVTRWKRAASTNTSELAGSFR

SEQ ID NO: 17992 - protein, 141 aa, Pseudomonas aeruginosa
RTLSATALAACAALSLGATRDTVFPPLADDGALFGLFRVESIGRYRGSSDPTRTFRGQPADRRLSAPGPAAGTPRGHEKTARRRLSMDCCGAQACGRMCGNRITSRIDGELVSSITRRSMPMPSPAVGGMPYSRALMKSAS

SEQ ID NO: 17993 - protein, 421 aa, Pseudomonas aeruginosa
RFRSSTLCFSDQDDDGIQQGLIVETGLRQIIVGAGVETAPTVLLTILVRHHHHRQRLQAAVATHQGDQFDTVHARHVDIGDEQVEMLRAQGVPAVHAIHRHCHVVAAAEQELAFQLTHRERVVDHQDALALRPAGLPPAAIDALQAAAAEQLADRMQEVLDVQDQHRRTVIQQGAGGNVAHLAQARIERHHHQGTLPDETFHGDAVDRIAVAHHHYRDGPFGAAALGPLQQLRSRDQADMATFVPEVLATFELDDLLRFQLAHALDVRQREGVGLLADLHHQAAHHGQGQRHLDVKQRSLPLALLHAHAAAQLADHVLHGVQSDAATGHLGDLLAHAEAGQEEKRQEFLLAQLRHGLGGGELAIEHGLAQALQIDAAAVVAQFQDQHAGVVAGADGDPALGRLAGGEAGFRRLDTVIDGIA

SEQ ID NO: 17994 - protein, 190 aa, Pseudomonas aeruginosa
EGVVAYSVIAALPPLVGALIVVCHFRFQRRPLRRRAPRDTGCSDPQASTASLPPAAMALSTTCGAASRRRSARIICAAFSAITSTGEQVLPEVRLGMIEASAMRRPGIPCTLNCASTTACGPWPMRQVPAGWKMVVPISAAARCRSSSLRYSGPGLYSCGRKAASAGAAAMRRVRRMASAATFRSRGSLR

SEQ ID NO: 17995 - protein, 275 aa, Pseudomonas aeruginosa
LNRQTPSLEFEPVRSCLLADYPPAGVAGSRCGNLHLDRVRFHENTRHPRRRPRPHPDRHALSAECVRRPADRRPGPGRRWLAGAARSAPLRPADHRPDDARQPAGRRLAPGAEGPAALSGPADHRRHHARQPGTRFIPAQAGHSRPGEQTRHARRSAQGDPPRRPSTIHLALHRTPAGSGRSRARQAAGQPRTTHPARSGSAAPVRQRPGGRGNRHPTVPQQADHQRAKEQRHAQAWPGQQCRTLYLHPGKRPGLSSAAAICPPRQPASQGPRSR

SEQ ID NO: 17996 - protein, 451 aa, Pseudomonas aeruginosa
SLGYPPCTKPVSLLIRGASRGTRGNGARQAVQRTQQAEPQDGPRRARDQHQADRARPVETADDQADQQGADHLPQVVALHYPADGQWRQRRRGRGQRRGRQHGGGKHAGDRREDEPQRNRQESRRRGMEERRTGESHQDRGARQQGAGTYAAGKDEARRDIAQGVRRDDGRADESRSLQGDAQALHEEHGEERHQGEELQVVGGEAERQQGDRRNLEQRAKTGRPHACRPAPIVGRDAERQQQRRDQYQQCAQLPVGTPVREQRPEQHREGDSACHEGAPQTEHHAAPRLAGDPVQHGGRRHYHDEETEPLDEASGKQPGEVLHRRTEQARPAENRQPNGQQPAISPTTHQEAGGDAAEYADERKGGHDPAQRGEVAAEAPLQRRQGDGRLADMQGSGDAGEDHIGNCQPSRAGLGVRTSESGRAIHRCLRAWSGARQDRQTLCADSDSSS

SEQ ID NO: 17997 - protein, 169 aa, Pseudomonas aeruginosa
CQADRQGRQRFPSGGPPAPRRADGPDGSLHFQGFARRRAAMSGSQVLRRPGHLLVAQFVGGVQRPVRIAQQFTGKQDQVGLTGAQDMLGLHRLGDHAHRAAGDAGFLLHPFGELGLVARSYRDFRIRRGTAGRHVDQVHAQVLQAPGQFHGLVGVPAILHPVGGGQPHE

SEQ ID NO: 17998 - protein, 239 aa, Pseudomonas aeruginosa
RQLLRPGLAHRGGDLQKQADAVLEAAAVLVATLVRQRREELMQQVAVGRMHLRDLEAGSQGALGGAYEGLHQRLDLRLAQGLGGRVLGIERDRRRRHRYPAAVADRHAAVLAQPRPPGTRLAPGVGQLDPGDRALGLDETGDAMQRLDMRVAPDAEVVSGDAPLGQHRGGFDYHQAGAAHRAAAQVHEMPVVGQALLRRVLAHGRYGDAVGQGDLTQAKRLEQQTHGRTPGRSWNKAHT

SEQ ID NO: 17999 - protein, 419 aa, Pseudomonas aeruginosa
LPAVDQPGVLLGKAVADLVGRHVQRHQRIEHGGAVAEEHRRAVPVGVLHAAPVVHLHVQLVGQRAGAEPVPVQFEHHAAEEMRVVQRRIGAVDLLVGVGRAGEAERRGLAVVGAAVHVDGDDVAVVHLAAVVDDQRTVVATVGVLADLLVAAGAARLGVGQAFPLIEHFAGLGVDDEMRPRQSLAGNQVGDVVDQLGDVVLAQADHQFHFVILGLAALGLQALGLGQHLLGGYRRGGAARQVGSDVGDEMAAALRRHALAGTLDFGDGFADHPYAVVELLVAGDLLAVGQGRAADRFQFVGTASADRGLQGDWAGRALGSLAGEFGHVDQVGGKSGRRNTHDRNEQQVKRRNLLHLVQFSWFFQAEVLGRRLPPPCGLIGTAVSVLRVEGTALPWLGPVFDGAFVYQKEPAAKPARTGR

SEQ ID NO: 18000 - protein, 631 aa, Pseudomonas aeruginosa
FVPFLVAQLQVGQAVAQLAVQSVEVHFPLLVSSGLIVLQRPLLAAQQPAQFVEAAGYLVDAVVRAQVDVDLAVHHLDQRQETVLQAGGKALQHLLHARLRRRRHLDVQRRRALAELAQSSQQLVPGRRLYRLGFASQATDAFHKVVELRNQPSADVGVAAAHGLVAQEVTLDLRPALGLLGALVAAQFGELQQVLLGSGGQQLRLALVVVGDQLQQLGIVHHRGDLLRHLVHVAVAALQLERRLAAVLVGLGGAGDVLLVDLEHHVAHLHEALQGAADLVDLGTAVAVGQLVAGERLALGLGDEAIDVGHVAGGQRRENRVGGQGVLDVAEGERLLHAAEGVAEVVDVGAVGEHVGNAEDLAGLGVGVARHHHAELPPTHVVGLGPALPHPFHPARAVAEGDELLQELRMGVLDVVDIEHHVVAHLQRQVELLQFLPRSRVRRLPGVERAHLVAEGRTVDLHEDQPQAMRHVLHQGGLAVAWRGDQHQQAHQVGALVLAHRPHLLGQVVADDTQVDVIDQLVANERGQRSRLELGQAQCLALAFDDLLAQRLVAPQPRQELLAMATQAAEEVVHRQRQAAFEDARMLAHQAVDLEAQVDLGDPSWHLLVQQRERHRLVQVGRQRLELGVAT

SEQ ID NO: 18001 - protein, 1280 aa, Pseudomonas aeruginosa
QSGALAQRQQANQDRRRIVVVNAFLVALLVARCGEIADRPRQLVRLRQQRLQALQAEAIAARVGGGEHFAGEIFGAVQRLRFGFQVHLPELAQLIEPRVLQRFEEIGAGQVQVQRVAARHQGQVEFLGVDAEAVARAQADDVAALLEQLALVAQCADRLVARGLQARLDVVGLDAVLQFAKTFGQFAQLEDQRVGGEERVQFLRLGEARGASLQAVEDSPGGVEQSLGLALALVEQGLLVRFEGFQQLLALGQDVAEELLMVAELAFQFLQLHQQARQLLVAALGVLGLGQGVGDALAKQFELGAELGHGLARTESLAPLLGARLGLVQAGVDLRDRLDDAGPLGRVVDAQRSHQRGQHVEVAGHRLQGRQRLAELGHGLGFLRLAIEALQALQQGLQGLFAGEEGRGGGGHPLVGREQFGLHGVESRHVDVAVLADGQQQPTLGGDAIEPVDELLHPVPAVGQQAGEQRLVPLLRVDHRLGRLAADTFDLLVLVEHQLGGRRHFAQQRRQAVQLVAAEPVVDVEQALGVLAQQRVALDRNRRGLDLPAQVVEVGDAAHQLGIADPPEKTATRRLAGRVLLGAERRLPDLHRMDAGRFLAFGGEDHHAPVLQARVAVAEQRILQLAVDQVVGEQHVPPLLGMVENVLHVLAVGRAYRALEAHAFHGLLEGAVLAVLQVVAAGEDDPVVLRQLDAGQADGVDALDLAGQAVEHQVAPLLLAIGQDLEQQQAAEAGELNLRVVQRLGLVHHLFAIDAQADLGVVLDLDGQVAANGLDEQGVEDVQVREAALHHHLAGSPLPFEVERCRQGDVALAAVVDVADFAAVAGDRPAEHADVGDPLADLEAGQQLAVADRQLQQAGVLVVGVKLVEVVDEARRGEKAVPQWHRLRLVAFAALHQAVEGEYVGHAGFLAQADEHVVAEQQAIADLDDIAGDAVVLGTDADPADHIHLAVAELLQATGVEPFGGLPQALALLQQALVQHLVGAALGNGLVQYVLRGSCGLSVRHPGLPGSTAVIDGNRPERPAPGAANRPRQGLRRSGRGRNASAVGGGGCGSTQTSAAGSFSWPLLRSGITAAAAPRPLSRRARTSCTTGLLPTTPSMALPTDSDLAKELKKSPSPPTISMFALPSAVASTSACSLAMSLFAAMAAMASSKLFSSCMRNSSCWRALSLRASRAPNFLPSPSASAFRRCSSTSASALPWSLVALALAAPSCSSPRAWAPSFSASTLGFGPGRPSPWPRPAPRAPGRRPGRAPRRPWLRRSVVRHVPAPLPSHPFPSPRR

SEQ ID NO: 18002 - protein, 203 aa, Pseudomonas aeruginosa
QQFSLILTEPGSDTAELFLGNDPIGVLRLQVLQQHDAIAALEAFVLFRTNFQDQPGAAVFQQRLAMLQGDPPAAHHRDLAQHRLAAGAFQLAEQRPQRPAQRGRQRRRQEQRAHRHHGAQRVAQPAERQCAEQPQLDEVAEEPGEEGQQGQHQGDRYAVEFQLRQQRGEAFGLAGAIDDRLGVEIEHIDLDHAQGDDAPVDDR

SEQ ID NO: 18003 - protein, 465 aa, Pseudomonas aeruginosa
RTPHGTFAQTAGRPEGGRARHPDRRPFRLADLRRVRRRSDQDRVARRRRSTAQVAQALRRHLAVVVRSGTQQEIPDPQSQARRRPGDPETPARRCRHPDRELPPRRTGKARPGLGCPPRAEPAPGDGAPVGLRPDRPLQGPAGLRRGRRVDGRTALHYRLRGPPAGSHRDFHRRLDRRPVGRDRRADGAATPRGQRRRGTDGRRRPLRGDLRHDGKHGSGIRRVRFHPRAHRQHHAGHHPLLHPHQRRWPPRTDRRQRRRDLPPLHAGHRPRRPGQRPATGQQRRARCAPRRTLWGYRPLGRLAAPGGSAGGAGASRSPGQPNLLRRRHVPRSAIPCPRDVPLGTLAGRQAIPHAWHRAQAVRHARLGGLGRPGTGRAYRCPARRAGLRQRGHRRPAPERRHLNGTRSPSSVLRGQGGPSPLSSQGEGVIRTLPRAWRHPARAAAPARAFGLTARCATRPRTRRC

SEQ ID NO: 18004 - protein, 409 aa, Pseudomonas aeruginosa
RQHLAKGHVPAQIAIRAEPGQRNDQPAIREAPGKTPTIPPSRNAFTCLKLQYPARPSGSNNETSPCASNSEDLMTAFASPRGAWRAFILALAFAAGTAQGSLLFGAVGLANDQYARPVADTEIASTAVLADCRGFVGTIARIVLLDGSIRCNEAFPYGFASPISTSVYYPADIAASDAKLPVITFVGGILSNAGNYHELMKLWASHDFIVVISSDFINSFPLMHALGILEVAKLDRDPASALHGRADFSRTLVAGHSAGGQATLQSASLSAQALQLIEPRLKLVGALPIEPGPLAIGSTVKTPTLLLTGLADVVVPPLSWPILWQGPLIRDVPAWGATATTATHFSPLRQIEYNEFAGISVAWALYQGKNDAQARDYFVGRYYKLASDIQFNDPLRLLRPSRNKLAAAL

SEQ ID NO: 18005 - protein, 478 aa, Pseudomonas aeruginosa
RMFKTFAVDAGPRAAPGVRSIQLFDTDADHRPGHAFQRFQGGDGIVDALFDDPVGNQDHRHQAVLFLGLLLHDRFDVDAALGQDGGHLGQYARVVLGLDAQVVGAFAGFDRQDRVVGQRVRLERQVRYAVLRIGGHGADHVDEVGHHRGSGRFHAGTGAVVEGRADGVAVDHHRVHHAVDVGDQAIRGNQGRVHAQLEAALGATRHAQVLDAIAEGVGVVDVSAGQLRDAFGVGLVELQRNAEGDRGEDGQLVGGVDAFHVEGRVGLGIAQGLGLGEHVGEGTALLAHFAEDEVAGTVDDPGQPVDAVGRQPLADRLDHRDAAGDSGLEGDDHALLAGLGEDLVAVHGDQRLVRGDHVLAVLDGLEHQLVGQGVAADQLDDHVDLGIARYVEDIGGDGGRTGIALRVRPAGGDLRNLDTAPGTAGNLLGVAFEYIEGTATDGPQPTDAYFDRFHAGTPHLTYDGRTRRPAMVPRSNRG

SEQ ID NO: 18006 - protein, 276 aa, Pseudomonas aeruginosa
  UNSURE (53): Identity of amino acid at the above locations are unknown.
KQKSRTLRSGSLLVNCSADPALFGLQRQLGQLLGRLVAGEQLAIGKDDRRRSXHPDHLAHLELLVDRVLALGRLDLLAVHHGVHRLGRFLRTPDRLQLLVARRLRPLARERHVAHLDPLLGQVRHLGMQLLAVRAGGIGEHRDVRLGLALGRIHHHLAGGHAVDRLGDRLALGLLGQVDRLAVLHLVEVALHDELAVGAGVEHPAALQLHLVEPLQRAAGDGVDRQVRLQGLQGLADVLIGIVCQGQGTHQAEGGSSQKTGHAHVSLLSCGRRSLP

SEQ ID NO: 18007 - protein, 329 aa, Pseudomonas aeruginosa
TAIPTGPTLVAERYESASFRVGTDFSDKASASRVVACVQILEAGPGDMGIDLGGRQVAVAEQHLHHPQVGAMVEQVGGEGVAQGVRRNRRADRRHLRVMLDAMPEGLAGHLFAAQAGEQHVAGPPAEQVAAGLAQVAFEPADGFLAERHQALLAALAEHLDHALAQVDLLQGQADQFADPQAAGIQHFEHGAIAQAQRVVDFRRRQQCLDVRFGEGFRQRLAHLRQVHLQGGILGDQAVAQAIGIEATQAGEEARGRAGLVALFQAPGQVIEDGVAADPSQAQPAAIEPGVELLEVVAISLAGVVGKAFFQPQGIEETVDQGMFEGTHG

SEQ ID NO: 18008 - protein, 433 aa, Pseudomonas aeruginosa
QGILDGPERYPARPRRHRCRRPAQSMAGLAPAPASHSFPAAVRDCRRPATRLARSGRDVRPPAVPTGIPGSGADPLRGQPDPAFQRMEGNRHRGAPNGDHRRALDLGRDRPGRPLPARLQLGNGPAVRHPDPGHRAHGDRSDAAGGPAQGRGGEHPALGRYRHRSHRRPAGGSGVQLHHLQRRRRWLATQPADLRWSDPLRQPVRHPRRLGAGHRPAPPLAAGLPAQPGDAGRGAGRIHRLEPGDARIRAARRHPDGHGPGQHEGRRRTADPALQGKPQRPADFRPVHPPGRAPGHQCPARPGPGGAAGAAADPVRRPAAERGAVDLGFAAELARARPAQLDRPARDRRRGGLGDLRHPPERRRPCPGGAAGAADLSGDHRHGGPAKRHRPPPGAPAEGRRALAQRLPDRRRQSGRARHRQGPEEPRQPRAAD

SEQ ID NO: 18009 - protein, 589 aa, Pseudomonas aeruginosa
RNRCARRSDHRAHCGCWSRSGGRRGAFWSRHEQDGWLPCELRSCSRCLQNECTLGPRPERPHILRIIGEFANLFFGHPSAGAESAGSTRSARRPTARNRRRGQRPRVRSKLGHAPREHTAHASHHLGHAALGGDLLHHLLHLLVLLDQPADVLHLGTGAKGDAALARAADHFRIAPFAGRHRVDDRLHLLELFLRSTLGITHLRQVDPAEHRQLVHEPAEAAHVLHLLQLVAEVFQVEALALLDLLRQLLGLVAVEVLLGLFDQAEHVAHAEDARGHAVGMERIERFALFAHAEELDRLAGDRPHRERGTTTRVAVDLGQDHTGQRQGVIEGLGGVGGILAGHGIDHEQGFRRLDRRVHLLDLVHHVGIDVQAACGIDDHHVDELQPRLADRRLGDGHRLLADVGREEGYADLARQGFQLLDSGGSVDVGGNHHHRLLLAFLKEARQLARGGGLARALQAGHQDHRRRRDAQRQVLVGRPHQLLELGADDLHERLSRGQALRDLGTDGALLDLVDEVLDHRQGHVGLEQGHAHFAQSVLDVVLGQLGLAGDMAKRLREAVCKVFEHARSFHGGCGKRRIITKSASRDTR

SEQ ID NO: 18010 - protein, 325 aa, Pseudomonas aeruginosa
FADAFRLCRSDCRARRSRRPRQAARQPGHRYERTVRNGFLATLDLCQTPFLSGPRLQGLMHPLLPSLIAAVLYLGTAAYQGACVSKRTAPGKPLLLLFGLLALVAHAFSLYQQLLTPAGLVLDFFNAASLIAAAVILLTLLATLRIPVENLLLLLFPLGALTTLLAVLIPHGTVEPINEQPGILAHILLSILAYGLLTIAVFQALLLLLQDYRLKHKHPSGLIRNFPPLQTMESLLFGFLWGGWSLLSLSLLSGWLFVDNLFAQHLAHKTILSCFAWVVFAVLLWGRHQLGWRGHKAIRWTLAGFCLLMLAYFGSKLVREFILHI

SEQ ID NO: 18011 - protein, 434 aa, Pseudomonas aeruginosa
WASFMDELHPGYLVGLLVLLVACSAFFSCVETALLNLDRYRLRLQAKQGLRGARRSSWLLLHDDRLRGTLLFGRTLVNVSAAALASWAALRHWGVIGLAVAIPGMTLLLLLFGALLPRRYGALRSERVALPLSLPLLILQRLCWPLLWLLTLLSNALLRLLGVAAAEQDDSGRSRDEEALHPADNPQASEVNRHDMLLGLLDLEKVTVNDLMIPRNEIEGIDLDDELEVIVEQLRTTSHTRLPVYRDDVNQIEGVVHMRQIARLLTQGRLTKENLRQACMEPYFVPESTPLSTQLVNFQKEKRRIGVVVDEYGEVIGIVTLEDILEEIVGDFNDLDSLDNPDIHAQEDGSFVIDGSANLRELNKSLGWQLPCDGPKTLNGLVTEALEQIPDCAVCLRIGPYCLEIQQSAENRVKSVRAWHPRALTPLVESDASV

SEQ ID NO: 18012 - protein, 211 aa, Pseudomonas aeruginosa
PSGRTEALRRAPIARDLPTMTAATVAADSAPEPANSTTRVAVASFIGTAIEFYDLYVYATAAALVIGPVFIPQTSGTAQMISAFLTFGIAFLARPLGSALFGHFGDRIGRKSTLVASLLLMGVSTTLIGVLPGYDSIGYWAPLLLCVLRFGQGLRPRRRVGRRRAAGHGERAGRQARLVRHVSPARPVDRLPRRQRPVPGPGDAAQRGAVP

SEQ ID NO: 18013 - protein, 367 aa, Pseudomonas aeruginosa
RRIRLAQRGAEVGESDLPGLAFHQDHRRGRRAELADHRDRQAEDRPRVQRELGKILGNQGHQAGIVRTRRHLAEPHLVALDEQFDAEQPASAEGLGHCPGDPLGLGQGLRAHRLRLPGLVVVALDLAVTDWRAESGAVDVAHGEQGDFVVEIDEALDDHPALAGAPAFLGIVPGRLQVVGAFQDALALARRTHDRLHHAGVADALDATAVVLEGIGEVIGRGRQAELLGSQPADTLAVHGQLRGAGGGHHGVAFGLQLDQGRGGDGLDLRHDVVRLLLLDHRAQGGAVEHADHVAAMCHLHGRRVAIAIDGDHFATQALQLDGDFLAQLAGATEKDAGRARRQGGTDTGHGRTSEMKENGIRFRRNR

SEQ ID NO: 18014 - protein, 221 aa, Pseudomonas aeruginosa
SRPPCAGSRCRCPARPARRHARRAKPPVARSRRVLDEVAGVTAGIVHIVGGAGLEHLLLRLAQLAHYLARRAHHQRAVGNLLALGNQRVGADDAVLADLRPIEDHRVDPHQAVVAHAATMQHGVVADGDALAEGQRIAHVGVHHRAVLDVAVLADMDQLVVAAQHRAKPDAGAGIQANLADHRCAGRDPAVGMGFDAGIAQAVFHRDLLMAGVCAPSVNSV

SEQ ID NO: 18015 - protein, 265 aa, Pseudomonas aeruginosa
WAPARPLGGSAGRYPVGGGGAPRCVGAARRACSSYCRGFRGLVVSPRSWHESPGQPTPPARGLVASRPAEQDRPFPEEEPGMKFCSLCGATVVQRIPDGDNRLRYVCDACHTVHYQNPRIVAGSLPVWDGQVLLCRRAIAPRLGYWTLPAGFMENGETLAQAAARETEEEANARIGDLQLYTLFDLPHISQVYLFFRAELLDLDFSAGDESLEVRLFDEAKIPWSELAFPTIGRTLECYFSDRREGCFPVRNEAIAPMLASYKKD

SEQ ID NO: 18016 - protein, 363 aa, Pseudomonas aeruginosa
RGIQVVLVFPALPGDNNTIRIGTSHEDSPRPAPGPASRRGATHPPLSAAGAQSRERDPCRPVESGGSAALRTQPQRNPEHFPRHRAQGPRSTLRAGADPPQPGLRHLHYAASRTTAVASLQLQRDAPPERLHPRLHLAGARHRPAHPRRTDPPRPLADREGHAHEAPAQGRRHSDGDREQHPAGAPAAGPDSGRRFPLRIPGRHRSPSGPRPPARARDQRVRVRCRAGRHRAGHRDAADDPDRLPRGQHPDRADRHLLPQRLLRLRRRTATLTDTEPPCSKATFSPRKAGSSAAYTSRTGVSSGSKASPATRPATPIRTCCQASSTCMCTAAAAATSWKAATPSPPSPAPTGASARPRCWPPP

SEQ ID NO: 18017 - protein, 134 aa, Pseudomonas aeruginosa
SVAAKTARRPSTPCSRPSPAPPRGLRRRPRAPSPRASRRDLRLSPVPWPASALRPAWPAVPWRGSAPSACRRMTAGIVPRNSTSPWTRPCNGCATTYRGACSRPGSAATRTKRRSFPRISRCWKTRVCWTPPTC

SEQ ID NO: 18018 - protein, 233 aa, Pseudomonas aeruginosa
STRASAPPTPGTGRFRPSARFSRRWATCCWPSAPTTCATWKNACCGYCSATPRHCGCLLAPSSPPGRSLPPTSRRWWMPARLACAWPKAAPPPTWPSSPAARACRAWWRSAPGCWSWRKAGRWCWTPARAGWNSAPTLDAWSRSPCKWRSARNNAAASRPMRSARRSPATAGASRSAPTSPRRARPPKPSPTVPTGSACYAPSFSFSSAAPRPTKRSSATPTRRSWTPWASAR

SEQ ID NO: 18019 - protein, 239 aa, Pseudomonas aeruginosa
SSAPSMSAATSTPNTWPLPVEEKPSTGACAASAPGQARPELLDQQLRALLRVEPLERCRILLPMVSEVDELRAIRGRLGELATQLGIERLPELGVMIEVPSAALLADQLAEHADFLSIGTNDLSQYALAMDRCHAGLADRIDALHPALLRLIAQTCAGAARHGRWVGVCGALASDPLATPVLVGLGVEELSVGPNLVGEIKTRVRQLDAAECRRHAQALLDLGSARAVRDACLQHWPLA

SEQ ID NO: 18020 - protein, 671 aa, Pseudomonas aeruginosa
QEQSETTAMPPFLIESLQRLGRALMLPIAIVPIAGLLLRLGDVDLLDIPLVHDAGKAIFANLALIFAIGIAVGFARDNNGTAGLAGAIGYLVMISVLKVIDPGIDMGVLSGIISGLVAGALYNRFKDVKLPEYLAFFGGRRFVPIATGISAVCLGLLFGVIWPPLQQGINGLGQLMLESGSFGAFAFGVLNRLLIVTGLHHILNNLVWFVFGSFTDPETGRVVTGDLARYFAGDPKGGQFMAGMFPVMMFGLPAACLAMYRNARPERRKLIGGLLLSMALTAFLTGVTEPVEFAFMFLAPLLYLLHALLTGLSMALTDLLDIRLGFTFSGGAIDLALGWGRSTHGWMLWPLGLLYAGIYYLVFDFCIRRFNLKTPGREDDASSESGDNAEAERAPAFIRALGGAANLEVVDACTTRLRLRLVDRDKASDAQLKALGAMAVVRPGKAGSLQVVVGPQADSIADEIRRALPFDTQPGEAVPPLGSPNAAEEVVSMQATVDAAEAQAWLGALGGAGNLREVRDVALTRLRVSVADERKLATEQLRRLGGQGVSSLAGGICHILVGPRAAGPEPGPATAAAALTAGGLDLGQSADNRQAVIRPTPQLPRSGSIIAKRLFAPRHSPGSDSPREADNEKGGNWPPFLLVRGKLRRPCRSGARLRRPGSHRDAPPSAP

SEQ ID NO: 18021 - protein, 193 aa, Pseudomonas aeruginosa
ARIWPSALSPWITAKKAFRSSASSTSGTARPSLPWTWARIEPPRRFLPRPRSIRIRSVSPLSRRSCGVRLWRTSATGAKPVTISETGEVTLLSSPLSCQRVFMDIESLPTGMVMPSSGHSSMPTALTVSYRRASSPGWPAAAIQLAESLMSDSLPIRAAARLVTVSPMAMRPEAGASSSASGVRSPIAMASPV

SEQ ID NO: 18022 - protein, 138 aa, Pseudomonas aeruginosa
TSKLVAVTAQSATGTCQGPTIWSRATSPVMVRSPMVIRKLLLATAGWRRTRSTLSCSSSPAASKSSPSSASRVTARCMRGALPSRTSSGMSTGLLSKWLSATVSWRCSMASPTTANGQRSRSQMALKVSKSAASTDST

SEQ ID NO: 18023 - protein, 143 aa, Pseudomonas aeruginosa
RSCDSLHQISSGLMPGSSLGTARSSKRPPRPPSLISSGRALDRPPAPTSWMKLIGLRSPSCQQRSITSWQRRSISGLSRCTEAKSRSAELAPVAIEEAAPPPRPISMAGPPRTMSLAPTLISPFCTCSSRMLPMPPASMIGLW

SEQ ID NO: 18024 - protein, 695 aa, Pseudomonas aeruginosa
AMPRSSRSIFARPQLRAMSEALLDHGEMVPKRGTTRNSRPLGSCTGTLGPYFSSRASTCSSSAVSAPVTSAKCANSAYSPVTAGTCWVSCSSSLPWRKAERAGAPRRISIVGTASGDGKVWGPAGPARRGRAFYRKAPSGGTRADGYRIALHRIRGGPLRSTSRTAPQRSATGQAKRRTNGIPAIAEKVPAVEIWRRLAFAYTAPMFALTAYRLRCAAWLLATGIFLLLAGCSEAKAPTALERVQKEGVLRVITRNSPATYFQDRNGETGFEYELAKRFAERLGVELKIETADNLDDLYAQLSREGGPALAAAGLTPGREDDASVRYSHTYLDVTPQIIYRNGQQRPTRPEDLVGKRIMVLKGSSHAEQLAELKKQYPELKYEESDAVEVVDLLRMVDVGDIDLTLVDSNELAMNQVYFPNVRVAFDFGEARGLAWALPGGDDDSLMNEVNAFLDQAKKEGLLQRLKDRYYGHVDVLGYVGAYTFAQHLQQRLPRYESHFKQSGKQLDTDWRLLAAIGYQESLWQPGATSKTGVRGLMMLTNRTAQAMGVSNRLDPKQSIQGGSKYFVQIRSELPESIKEPDRSWFALAAYNIGGAHLEDARKMAEKEGLNPNKWLDVKKMLPRLAQKQWYAKTRYGYARGGETVHFVQNVRRYYDILTWVTQPQMEGSQIAESGLHLPGVNKTRPEEDSGDEKL

SEQ ID NO: 18025 - protein, 133 aa, Pseudomonas aeruginosa
NGRRAPAPAAHARTGCGAPPRPACASPPRRPRAARRAIPSGAATRSPRAPPRPASAARARAVRPPPPVAARLRPPCAPAGPRWNHGYLYRRSAQWHCLIPAAVRLHRRRALASKPARPPAAPPSAAGACRRSR

SEQ ID NO: 18026 - protein, 538 aa, Pseudomonas aeruginosa
NKSHEKGRPMAASSGSDDLPAGRQQVHGATNGVGGAGQVDRHDHRLDRRMGDPAAFPGRLEVAVPTRRAQHQDRHDRENHPAEGPGEVQRVDEADQPAVGQDERRQRDDRQHQQAGLRPVLRTELVELVEDVGQEATAQAPVGRQHGAQGEGVGGEEGPFAERLAPGQGGDFGLVLQAGQGDHRERHDAEQDEGGQHPGDHRLRQALRGVAETTGHLRDDVLGGEAEHRDVEYRHHVDPVAVEQTGELGIVVEQGGRHQDQDHADHADADELLALADGAQPQVQHAGGRNEEQHAAQGRADTEEGAEDLAAAAHVGDQRADAVDRYGQEDRPGAEGADIALGKAAQLVVGARAQGGFRDVEHGNGGEQAGHRQPEQQWHEAGLAAGVGHGQHACADVGSDDHRHRLEERQALDLQSRGIDGFRPGVILILLDPGITHDNNSLHFELALCGRRPGPPYRWPSSRTMQGRESRTPPDRPRFSAARSGGGIRRRARSHLKPLPAGRLLKRPCKISHNSTKEARGDYDFTPMPIVRNIRINN

SEQ ID NO: 18027 - protein, 497 aa, Pseudomonas aeruginosa
SPAPGLADRDGPHQAGLHMVDDVAVEHPQARIVRHQRDAGSLVLAQQVGVGEVRDDVPAIRIQHLEGHPMQVDRVLVLRHVAQLEDVALAFLELGQRRRVVLVLLAAFPGLAVDLPERRIGILAAGIGHGPDPLETETDLLGIGQVRFAHRIRRQRLRPVAGRCLGAGHAADRRQAYRPVAQGQLGARFRHLQRQLQAHPGTDPVLPLEAAWFHRMAIDGIDPRLAVGQVETVGDGVVDVQQAHPDDLPGRQVDGRHMLAVDRRIAPAGAFTRGLARHAEGGEGALLVHVPGLQAENLLVAEPGGFTLLDDQRADQSAAELLAAHQVRVVPVAAGVLGLELVDEALARLHRRLGNVRHAVHLDRQADAVPVDGGRFVQPVGEAHPQPLALLRPQLHAGALAAIGQRRTAEARDDLQVQRRGDQFVVVLLRHLRTRQPEARAAGAEADHRQPGEAAEHLSTGKCHGAFTFAVLRLGNDRFSHFPAAKASHRSVQPPLC

SEQ ID NO: 18028 - protein, 161 aa, Pseudomonas aeruginosa
MVPWARNFTSCSLVASSSKTSMKVRPMILRFSSGSATPARRPRNLSSALARITFTPMFSANMAITWSPSCRRSRPLSTNTQVSWSPMALCSSAATTEESTPPERPSRTLEEPTWARTVAMASSTMFEGVHSAAQPQMSRTKRERMRRPCLVWVTSGWNCTP

SEQ ID NO: 18029 - protein, 148 aa, Pseudomonas aeruginosa
APATMALARSPEKRMPPSAISGTPVPSRAAATLAMAEICGTPTPATMRVVQIEPGPMPTLTASAPASARALAASAVAMLPPITWTSGKVCLTQRTRSITPLEWPWAVSTTTTSTPAATSAATRSPVSAPVPTAAPTRRRPCSSLDASG

SEQ ID NO: 18030 - protein, 154 aa, Pseudomonas aeruginosa
SLAFISSSGVPSRAVTSLSFGVMIAATVSPAFGFTRRSRPVTIPTSSPCSTTGKPEKPYSRAICSSSMILVEGVTVTGSRTMAVSCFLTLRTSAACCSMPMFLWMMPMPPSWAMAMARRASVTVSIAADTSGMFSSMPRVRRVFKLTSLGRTSE

SEQ ID NO: 18031 - protein, 543 aa, Pseudomonas aeruginosa
AALRDPRRSDHPPQRPCRPLSHAWRPALRGPGETAPRATLGAPGRGRLGQPDPYPGGPARIPRTPGSGHGGMRSLRRAALRRTRLRRPAARRLAGLDRSAVAGGNQPAGLSRCAPGDRLAAGRRPLPAHRAATERDRTVEQSRRRRRPAVQRRQDLQADRPRPRPGAEHRAPSHTHHLFQARRQRQGEHRPPAAPVPAWLTALHPCHHRFARPAMGGMGALSPAKRRNHHRRDERRAHNDRGDRHMTHRTASMAAPTASALALLGIPLLLGAEAGAADLNARDFFGAPAGTTLGVLYLPATRAHEFHGPADRNGKAELKTNAMAYRQVFFSDICGTLCTPQFIIPFVDIDARLPGSAGHTGETGFGDPQVGGTLFFINDPERRRYSGLLTLITLPLGEYHAKNPDVSPGANRWGATFVYNYTQGIGRDWVLEANLEAQFYAKNDDYFGSDLEQKPLYRLQAFASYDFSQSTYGALKLVHADGGELKLQGHSLDDTHQRYTQLGFELGHWLDRRNSLMFGLSRNVATDNAFHGSQALLRLVHVF

SEQ ID NO: 18032 - protein, 128 aa, Pseudomonas aeruginosa
GGAAMSASDKTLASASPASGNLALLAAIVVFAAITPTILMTAPAIAAQLATQWQLSPARVGDLFSVELGAMSLATLPAFHWLKRVDWRHAALPRRPAVHRRQPGLGTGRQLPAAARPAFLQRPSPAAR

SEQ ID NO: 18033 - protein, 630 aa, Pseudomonas aeruginosa
WAQLVVGAVGLALLPALFERFGLARLLPVAGRPDGPRPAVVAGLPQWQPASGSPRQYRRGSLATAGRAGYPRRAHLLYQPQRRVDLHRRHRRRRGDRCRRQRRGTRRRHPDGHRRGGLRLLHRQPPAARPDAARRLPGDGRGDPPADRPATAGALRPGRAAVQVHLDLRPAVHPRLPRRPGPIRPPDERLQPGHRRRAGHRPGAGRTTHRRQRRFPPAAADRRRPGRPLAAAGPGLPATLKPFPEPRIPAMTRRTAFFFDELCLWHAAGPHALTLPVGGWVQPPAAAGHAESPETKRRLKSLLDVSGLTARLQLRSAPPASDEDLLRVHPAHYLERFKALSDAGGGSLGQDAPIGPGSYEIARLSAGLAIAALDAVLAGEADNAYSLSRPPGHHCLPDQAMGFCFFANIAVAIEAAKARHGVERVAVLDWDVHHGNGTQAIYYRRDDVLSISLHQDGCFPPGYSGAEDIGEDRGRGFNLNVPLLPGGGHDAYMQAMQRIVLPALERFRPQLIVVASGFDANAVDPLARMQLHSDSFRAMTAMIRDAAERHAGGRLVVVHEGGYSEAYVPFCGLAVIEELSGVRSAVRDPLRDFIELQQPNAAFRDFQRQRLEELAAQFGLCPAQPLQAAR

SEQ ID NO: 18034 - protein, 206 aa, Pseudomonas aeruginosa
RAQRRASQYNPSPVAISKRHGESSDDLFAATPLLRRNRRVRRLQPCRRTPVRRPVGAQPAGARTGGQHRHPTAPPRSAPGRADAGRSRLPATRAAPARRPGGRPAPGSRGRRRRPWPAAPGALQLGAAGGRPASGAARLPRGAERRPPGTDPAILRAATRRSRRRTPGPWPAAPAGAAPASPAAPARPVPRAVAPGSRRRPSAGPP

SEQ ID NO: 18035 - protein, 783 aa, Pseudomonas aeruginosa
RSLPTARPRSRGADRQPTEPARPPAAGRRVPAGLGRGRAVQPRPAGLRPCLLHPQGQQRADPLRAVPAERPARTPGLARRAGGKGAREDLAVRGTRRLPVDRRYRRAGRRRRPAPGLRGIEGKTRRRRPVRQRTQASAARPSAPHRYRQFAQRGGDPRHHQRVSPPSTAGRADPGAHRSPGPRGRRTDRPRAATGRPAGLRRADPGPWRRFPGRPLVLQRRSGGARRGGLRHADRQRGRPRDRRIDQRLRRRRARADAFGRRRTAGAQRRRPAAASRRPAPAPGAAHARPVAARTPAPGRRRPPPAPSRRTPAPAGAAPGRPGHAPAPCLRAPAGGPPRTPGPPGDASRRTASGPHPGAAPAEARQPRRAPAARRPRGTEGSSSAPRRTGADAQRGQPAGDPGPRLQHPPRRAWPGDPRCRPDPAGTAPEGAPRGRRTGGAGRGQPPDAGDPVAAGLSRDDPPQPTGPGLPQRGDPPRFSAPRRPAPEHRPLGHQPAARQPGGTSRRAPPATHPAGRGAYRGRRTAGGALPPATGQRRGRAVASVGPAGAAPGQGAPGGRRGLHRRPDLPAIAELHPALPRHRAGGPHGRGQRRRGAGQGRRRRPGPGLRPGRGRRTGRARRHPPAPRPDHPRQPCPRRTPRRGADARAAQRVAGVDPQQHRHGPTGGDRRPTGAHRAKAEAAHQLGGGADQFRQVRHRRGLHAGVDGQPRDRGRAYPLPAAGPPGAARRPRADRQPQGPRADRGGDRLPGTPAPRHALLQWRRARALAALRRCLFRITSGLE

SEQ ID NO: 18036 - protein, 638 aa, Pseudomonas aeruginosa
RPRTSSRAGPRWPSATPVSPPPPDLRALPPRRPLPSAGRACPTFRSTSHAVIAQGHARRVAEPRHAAVAARPGPAHLRRVRPLPARQLADLDGRTGPLPHHRRSNAGARRGMDGRRAHARQPVGTTPAAAPGAGPQALPVAAGAGLLRLRRLGQHPLRAERRALPQPRPGRQPHLAVAQPAARLRPADPHAVAPGALAAAAGQHHRRGRVAGMMAIAMIAAFVVNLLLGLPLFLCLLLTALVGFLFVDPALFANTLPQRFFGGMDIFSLMAIPLFVLAGNLMNHSGMTPRLMRLANALVGHFRGGLGHVNVVAGVFFAGVNGSAAADASALSTLLVPAMEKEGYSRRFAAGLTAGSSLIGPIIPPSIFMILYSSLTNTSVGELFLAGVIPGLLLAAAFMLLNAVYAYRNGLQARHAAPAWGEILAALSGALTALIAPVIIVAGIVLGLVTPTESGALIALYVALVGLLQRQLSLVGLWNSLRETVRLTASIYVIIAAASVVNWLLNYAQVASEFAQLLEPFGHSPTLMLFIISAVIFVCGMLMEEVSVLMLLTPIVAPVALAAGVDPVHLGLIFTLNITIALITPPMGACLFIVATISRLDILEMFKGIWPFILVALGVLSLLILFPSLTLWLPRLLN

SEQ ID NO: 18037 - protein, 781 aa, Pseudomonas aeruginosa
LQRLAGLPQARHSSRDPGVPRSRRGLRASPAGRRRPPRRRAPGGAGRLAAVRRAAVSLRQPVQRPGRALPTGRRSRAGTAHPPVRLAAEQQPRGAQPASHRRRGGRHPVRRPGPLAGHGQRLRRSRAGLLHRLLRTPGGARRAPATRPRSSSPALSRDARRRFQQPAQRMVALRFRRPALGLAHRRDAGAVRPGAVAGDGRALAPAVAEAPSGGLGGEGAPVAQRRQAERGGELLAQRHRRTEAGQPGDRLHRMLGGFQQALGQCQAFGLQPLVDGGAGELAEMPGEGPPAHQHPLCQAVQAVRLVEVLPQPHQQLAETAVLGAVRQRLLDELGLAALPMRRHHQAPGQVIGSLRTEPLADQVQAAVDAGDGACRGQQAVVLDVQHVGLHPHRREAPSEILRPHPVGGGAATVEQPGLGQHEGPQAQAHQLRTACTGRDQRIQQRLWRTLVWIAPTRHDHGLRLGQRFQPGLGLDGEPHRGSQPARLGGADTQVEGLRARVVALLAEHQAGHRQVERTDAVEGHHGHGLAGHAHLGGYERVGPILAKVVSQATHSLRRAGTRIRLTHSGGNAMSTRQPKRALLVIDVQNEYVSGNLRIEFPAIQSSLERIGAAMDAAYAAGIPIVVVQHLAPADSPLFARGSRQAELHEVVASRPYQHKVEKQLASSFVGTGLADWLRERDIDTLAVVGYMTQHCDDSTIRQAIHEGWQVEYLHDASGSVPYRNRAGQASAEEIHRIFGIVLQSSFAAVLSTEEWLESLAGRHVPERDNIYDSNQRALANR

SEQ ID NO: 18038 - protein, 176 aa, Pseudomonas aeruginosa
TSHAKAGRRAPLLDTALSGRAARARPVRPAPWTRRRFPPARRRPCGNAASAGSARRPPVAASGPSASGGSRRERSAGPCLVRRRRCRLSACSSCRSCAHARAPRRKPRAACRRQAGCRFPCHGSAPRSRPRRSARSAAGPAPRDARCAVGRRCTRGPGRKRKRPAGPRQRRRMCAW

SEQ ID NO: 18039 - protein, 141 aa, Pseudomonas aeruginosa
GYRRPWPNRSSRSSLPAPRTAANGSPAASAGAPCRGRRCPGRRGSRTAAPRASASRRRFPLAAVAPPARRTAGRPSRSRRTPATPVVRRRSPGRWRAPRRYPPKAGSAPAAGGGGCSVPREGIPGGSSRPTRRSCPAPGTR

SEQ ID NO: 18040 - protein, 182 aa, Pseudomonas aeruginosa
PVSTAGGKPAWLRRPRAYKPAGCQYGAAGPEARLPAPIGSSLKEVPAPRHGPTRAPQHARHDRAEEVSMKIRELVRHWEHTAKGRMARNHYSIPLDVESAARLAALHEMYPRRSVEELLGELVGAALEELEASFPYVKGSQVVATDEQGDPLYEDVGPTPRFLSLSRKYLHELVAQQDTSSH

SEQ ID NO: 18041 - protein, 160 aa, Pseudomonas aeruginosa
SWAPPRASPGGGRHRNPGRQRRVALERPAHRSDGLPDRGTPDPRRPRSPAGSGVAGIQPDAAPAARPASLRQRRAAAEADRRPRHASGAAGCRRKYRRPLASAGETLVAAGPGRRDGAGLGDRRMVRPGAGLGGRRPRPAGHPRRRPADLPQGLDRTEEP

SEQ ID NO: 18042 - protein, 277 aa, Pseudomonas aeruginosa
PEHQRPDEYRRDRRRAHRPVAGSGDGQRAVRHRRVDRGEVPGSRAQRHPRPAATGSGTGHRAGRRRMEGTAGQASGTGSHRAREARRTHRTRRRGDQRPLQRQPGADHRRKPAGGEGGRRAGVRRQHQRRGRAGVPRHPPRRRQHPGPDHPRRGGSPGFPRTDPAFRRQFRPRLHPGGIPHRPRHRGAAAAAIRRRLAGLDLPRPGAAGDRLSLRAGDLHPGDHRQRPFRRGAPGHPDQGRGVPRTRAQAVLGRPRQDRHHHPWQTATDRLPADRGG

SEQ ID NO: 18043 - protein, 160 aa, Pseudomonas aeruginosa
RDGCAPARRQPGRAFRPPGIARRGQRSGRGWPCPGRGRGPRCLAGTRRQRTHRRRPLPPRQPSPGGGTGPLLAGPGRAPGRPGAPGQDGHRAVRSAARAGPLRRRRRGQGQQPRGDPRAARAGREDPDAHRRQPAHRSRHRCPGRHRRSSRQPPAGGQAA

SEQ ID NO: 18044 - protein, 156 aa, Pseudomonas aeruginosa
SGSAPGRRLAGRHGRRRDQRRAGPGPRRHRLRHGRGGHRHGHRDRRRRADGRRPAQVAAIRPAVAHHPRDPGPEHHPGPGHQGGVPRPYPGRRRHPVDGGIRRHGRQPAGGVQRSATVAQAFLKGPTGLLQPHSGGAFFCPSVPSWSAAAVVRFVD

SEQ ID NO: 18045 - protein, 147 aa, Pseudomonas aeruginosa
KPRNQHPCQRKFPMEQKAMSKQHTGSLRGLKLALLAVGSSLVLAGCAGNPPTEQFAVTESAVNNAVSAGGPEYAPVEMKSAQDKLSQARIAMNDKEYDQAKRLAQQAEWDARVAERKTQAAKAQKAVKDAQQGVMELREEGMRDTQH

SEQ ID NO: 18046 - protein, 266 aa, Pseudomonas aeruginosa
LRMTPMRKYIALPAVSLLALALAACSTPPNANLEQARSNFSALQSQPDATKVAALETKDAGDWLAKADKAYQDGEDQRDVDQLAYLTNQRIELAKQTIVLRNAEAQLQNASAQRAQARLDARTAQLDKLRSQLNAKQTSRGTMVTFGDVLFDLDKSDLKPGAMRNIQQLAEFLQQNPERQVIVEGYTDSTGSANYNQRLSERRADSVRMALLSRGISPERVATRGYGKEYPVASNGTSSGRAMNRRVEVTISNDAKPVAPRSSVSG

SEQ ID NO: 18047 - protein, 256 aa, Pseudomonas aeruginosa
AFQVSAGHRPLAEQALVALGHRAIEGNQDDFLQAAVRRALPADLFDGNGRGLLQGIAVDAAADGGERDAGRPGLLGQRQAAPVAAGQQLRFAVVAAAPDRADGVDHVGRRQTEPTGDLRLAGLATVQQAAGRHQFGTGGAVDGAVDTAPTEQRGVRRVDDGIHRKTGDVSLPDADLGHFTSCGTSCPAQRTACFLLSTSTPERPFCSVSNSTRTPSMHCATCLAGSRDSFTSSPGRLFSMVKSASNRASCGLAKCR

SEQ ID NO: 18048 - protein, 69 aa, Pseudomonas aeruginosa
SATGRARRSGSGGPSRCRTWSPPGPGTRRYASAFPARTTWPAASSSRCPCWRAGSVRSGTPPRYWSARG

SEQ ID NO: 18049 - protein, 383 aa, Pseudomonas aeruginosa
MLFHAPPRRAPAPTLAPGRTRARLIEYLRQARGDLFQGKDLHRCIDRRRGLRHPVDRATGLVLGDGEETALAHLLEALGAVAAHAGQQHAHGIATPIIRHALEKHVDGRPVDERTRFGGVHQRTVAQQADVIVGPRQQDLPRYRRLAIARQAHRQLRFAGQPFGHAGGEYLVDMLHQHHCGIETGRQLLEQHRERRRTASRGADRHQTLARPAGLRRHHLDLATVIALADQPADVLNLAQQRRRRRLRVADAQRRRVHRIERPISHRFENPVHILLDIDGNNHDRARTFRHDPTSCLDAVHHRHEQVHQHHVGRIGGALGHRLGTVAGDPDDLVLRLEGQRAAQRLDGQRHVIDDSDPQPCASPIRTTTASSKASSWKLAFAR

SEQ ID NO: 18050 - protein, 276 aa, Pseudomonas aeruginosa
SPVERDTVTASDFEAGYAVAQPVRHQVQLIDGEAGLAQRLHGLPGGLAQLHQRLVDLLGTGSLGLHTLVDHLHPRRQRLHLLNDLRQLLADLADLGDTAADLLGELVHAHHPGRYRRLDLAHHLLDVVGGDRGLVRQPAHLGGHHGEPAAVLAGFLRLDGGVQREQVGLVGDLDDGGDHLVDVAGLLVEDRQLGVDQVGRAHHVVHGFLHARQAQLAGTGQGRRLLGGAGDFAHGPHQVARGGGDLARSGADLRGGRGGFGGGGLLLLGGRGDLGD

SEQ ID NO: 18051 - protein, 235 aa, Pseudomonas aeruginosa
PAFLPRVAAQRSPADRRQASRHHSRHGGPAHREHRARPRHPTVRPAHRRLPVDSGRPGAAQARRGDGEHRAARPGRNEPEHLAAGADPHRRHRRPRQRLPRSAPGAIDAPLPGPGGRAGLGAALRQHHQPRSGHRHLPRPAERRPGDHPPADPLSPGVVRQPRLPGTGAAAARPRRPRQAPVDRLRRRPAVQPGTDVPPQFLPPPAGRVPQHQRGRPAAGGTGRHRPGDPAALHG

SEQ ID NO: 18052 - protein, 503 aa, Pseudomonas aeruginosa
RRRQTPAETPGRRAQALRDSLRHRLLPRPGPVPRGVLRQGQLRRGQAGQRRPDADGCRRGPPRSSQCPLLARLHRRLPAEPRRPGGAHRAVRVTSRLSCRQERGREGNLPGEDQLPRLPAQERRALGNLGEVLPGPQQRLLCPRRRRPAGGRRIRRRLSRLRRPRPAATQRGGPGGNGRAVHLPFPRRQRLAGSAHGARPDPRGGAGPRHGGHRHGPLRLLEAGPRRAPGAPAPEQHRRQRAQPRRRRRCRLQPHRPPAPGTRQALRDGLLQHDGAVPAARPLRGAGPRAEPERQVPAGVHQGIAAQLAGLEDPRHPRDLRADPALLADQAGLPGRPRQLPASTRPAAADRRAHGLRADHPERRHGRPHPGSRRPQQALRDELRATGKGHPRPAPGHARPGGFRPPPRHHRHHREPLVARLLLLHEYPLRRRGGKRSADGTGAKQGRQCRHRQLGCGLGCLRPCRHRPGGAGSPRTGLKDGDGSGTRAAVAPFRCPARLTEMY

SEQ ID NO: 18053 - protein, 218 aa, Pseudomonas aeruginosa
IGFDFMKTRVILVDDHALTLIGMRYLLSAYDDLRIVAQAQDADGLLAQLEAHPCDLLITDLMMPGSQQADGLRLVQKVRRRYPDLPIIVVTMLGNPALVSSLLKLGIHGLVSKRGMLDDLPKAIRHAGRRPFISRSIAHLLEVGEAEHGKPLASLEQLTPREVEVLRLYGSGLAVGEIAIRLCRSKQTISAQKSSAMRKLGLDSNAGLFIYIRENGLA

SEQ ID NO: 18054 - protein, 307 aa, Pseudomonas aeruginosa
AARPRYVRPASPLRKVRAAARMSRSAGRLPCPPPPKDSFHMDRNRRLSARLCLLLLGLASQAEAREPQPCASRLLDAVARQVGHDGWIAPSYESSGPFLAVACKPWPDDPAQTVIAMAYLDPGDTAVEGERHPHLLLAKADSRSGRLLKRYDSDFEEDASVAVGSDSLWLDTARYRLSPTVRAFGVVFHSVARGASCPEAGFDNLLTLVVPAGEGKLRPVLNTYLDQWRTLKGSVCSAEPGFEQEVSHLTLELGRGRSNGFADLVITSRVSDGETENGKPLRTVKRTLRYDGERYPLEEYSDFWHRQ

SEQ ID NO: 18055 - protein, 543 aa, Pseudomonas aeruginosa
GETVASSHGETAEPRARRKGRTRSGNSALAGFLALFDGRRLLLRLAFVVLLVVRLAIRGRVLRPDRLAIAVEQLFGAAIGGGHGEARLAVQVVQCAQGFRRLVASAADFVAQDVTLLRIHLQLLPERWNQRASLAIEQHGVGSVVHTVETFQETTVIRRLDADQFARLQQHLAAAVHQAHHRHLAFRTHEADGLLRPALLRHDEQVVAQRADLRITRLHPLAAFVEVEDAEVGAEQAGAHADGSQAGHVDGVAKRGEAGAVGRIVLRLHLPGAAAIDQAVLARRAIFHALLGQPALLAEGAATGELGGDRHLALVVEVATGAVVLLAERDQAVGRGAQVIVALAVTDHVALGIHQLGALADDAGAHHAVVEVAQALVGHGLLFAGSEVDDPLLLATLGADQAAVFGDAAVDQGGVVERLGELLALGIEDAALAIDLVDDEFVGTVGVDVVETRRLDFLALAVDHAVLAIADEAIEVGGEQRQGFADIVAQHLAVLRLDQVPALLARRHQGALVGAGDDIVVVVVERHEQLGVLVDHRALAVEA

SEQ ID NO: 18056 - protein, 138 aa, Pseudomonas aeruginosa
SVGSATGGALAGRIAAFRKPRRYRPMNDRLQIEDLLLGDGKEVEKGALITTQYKGTLEDGTLFDSSYERGRPFQCVIGTGRVIKGWDQGLMGMKVGGKRRLFVPSHLAYGERQVGAHIKPHSNLLFEIELLEVLTRDD

SEQ ID NO: 18057 - protein, 252 aa, Pseudomonas aeruginosa
VVKPSASRVIAGTLSNAPRPAGLTPAALHPSSAGTLSGSSSAATSTSSALSCQSARQSASSGPNSIERAIPPAMKVLHRPNTTLRRVSLVILCNTAGAATTTMRKPSPSTKRVASNQAKSCIDAPSRLAPPRIASPTVSSRRSPQQRTRRPAAMPPNTPTNGKADMIQLSAARSPPKLRCSDGRAMVALPTCRAAAMPAKITLATASHRGLAWGCGRARVDGLSIVASGHGVAPGKIARRSARILIAQVNLR

SEQ ID NO: 18058 - protein, 254 aa, Pseudomonas aeruginosa
MTSVNPNEKRSQQTAWRLERTVPTAHHAHLPTATPRGPIPLMNDASPRLTERGRQRRRAMLDAATQAFLEHGFEGTTLDMVIERAGGSRGTLYSSFGGKEGLFAAVIAHMIEEIFDDSADQPRPAATLSATLEHFGRRFLTSLLDPRCQSLYRLVVAESPRFPAIGKSFYEQGPQQSYLLLSERLAAVAPHMDEETLYAVACQFLEMLKADLFLKALSVADFQPTMALLETRLKLSVDIIACYLEHLSQRPAQG

SEQ ID NO: 18059 - protein, 169 aa, Pseudomonas aeruginosa
PWAACTSATLKPAARERSAARTKACTSASICASLRASGVVCWGSNGIADGATGIQPPSLIGTLPCLPSHGRQVLALRPAWASWTPATAPWDSMKRVMRCNGSTCASLQMPRSSAVMRPSGNTAVASTITRPAPPTARLPRCTRCQSLARPSCAEYWHMGDTAMRLGKVI

SEQ ID NO: 18060 - protein, 461 aa, Pseudomonas aeruginosa
SGSHRVAAELADQPGMTGGYRVQRVADVEAGNRPCRAFQAAVAGIGEGDGRPVVTLLQARGEDSDHALVPVGVEQAQAERQLLQAQLLELRQRLALHTLLDGLAVLVQLVELHRHVAGQRFVVAEQAFDAEGHVVEPTRRVQARTEDETQVGGGDPYRRPPGHLQQRAQARPGAAGADAREALVDQDAVVGIERHHIGDAAQRHQVEQLGEVRFLQPAPGEPVQLAQARPQRQHHIEDHPDPGHGLAGEFAARLVGVDDRIRRRQFRARQVVVGDQHLEPRGFRRLDAVHAGDAVVHRHQQVGTLLQGHADDLRGQAVAVLEAVRHQVIDPGRAEHAQGQHADAAGGGAVGVEVADDENPLAALQGIHQQRHALLDAFQPLEGNQPRQALVQLLGATHATSCVQACQQWRKVAEIGQGFGQGAGFDTHQVTRSARRKETAAAINARPAAIPAATRAGRSRR

SEQ ID NO: 18061 - protein, 77 aa, Pseudomonas aeruginosa
CARRPAGRLRSSAGPGRPGSFPRAPVRPRPTGHARRRSARRTTARRPASARPGAPRSRRGAGPRSGVTSRRPRGPGR

SEQ ID NO: 18062 - protein, 301 aa, Pseudomonas aeruginosa
RGAAKSRIARASSSGCASSACKRSRLKPSRPASAAASTSPARYSARYSVSDSDSRFTCQNSRNSLSRGSCSGSRKSVPVRCRYSASPRGIRVRSSSWVLTLKRWRGPRRMTSPPSSNSSLLSRNARTAWSRAAFRRASTSSALTLSFNSRRRSASSRNLRISGSAAKNAFSSSAWVKRAVRRCRLSRIRRAASSSPWALRWRSSSRVCLCASKVSSSSSRLARMSPRNCSWSPNWLSSSSSCTSRRDSCSSQRSGSWAWARALVMPWPNSLNWAPNWATVSLEPSPLRRCSARALAWFRRA

SEQ ID NO: 18063 - protein, 579 aa, Pseudomonas aeruginosa
GHPGRRTSCQAPRPRHSGAAAVLPLPRCPGPWWPWPWPRRAAPRRAPGRRASRPAPWASGQAVLLLGRGLRLEHPGVGQAALLVAPGFGDQLFGTYPRRCQAILFLRRGGDFQHPRIGQARRCALGLDALGQTLLRLGLLRRRFQLGLRHGVDFHRLVLGAGLVGFRLLDLAYQLLLGFRLGLQQDHLLDPLGLGNLAHLLDPLLLLGHGLFHRDALANHIGDVLALLFQRLFLLDLLQLHLTLAGDDLQVLGAGDLLHLDDHRALAVLLRHLDLALVVLGAHVDFLLRLDPRLLGLQPLLFLDPRGFRFLAGTDGLDLALLPGLGVSLLALQGQGRLAGLDVLLLDRQLFVALQFVGDDVLGGGQLGDLADALGIEDVARVQRVLRGLLQVVDGDVFQDVAVQVVADHLDDAVTEVLAILEQLDEVELLADGLQRLGELGIEQLVHRRTVGSTVDADGLGHLEHVVLGLVDPQVEGNGDVRAHVVAADQAVLAAPVDLQGDQRDAHELLQVDHRIDQRTGEMHLGRRRHVVDDQRGALRDLDVEGLEQGQQAHDQQNDQAHSQQEGHQRRHIHSSSSP

SEQ ID NO: 18064 - protein, 410 aa, Pseudomonas aeruginosa
AMRTLQPDGHRMEHSPKPLAGLKVVELGTLIAGPFASRICAEFGAEVIKIESPDGGDPLRKWRKLYEGTSLWWFVQARNKKSLTLNLKHAEGQAILKRLLGDADILIENFRPGVLEKLGLGWDVLHALNPRLVMVRLSGFGQTGPYKDQPGFGAVGESMGGLRYITGFEDRPPVRTGISIGDSIAALWGVIGALMALRHREVNGGEGQMVDVALYEAIFAMMESMVPEFDVFGFIRERTGNIMPGITPSSIHTSADGRHVQIGANGDAIFRRFMQAIGRDDLASDPQLASNDGRDARRDELYGVIDRWVASQPLEEVLAVLARAEVPASRIYSAEDMFRDPQFLAREMFLSARLPDGKPFRMPGIVPKLSATPGSADWVGPELGEHTDALLAELGYDSEGIAALRRKGAI

SEQ ID NO: 18065 - protein, 651 aa, Pseudomonas aeruginosa
SGRSTGGRPASRARGKKRSHVARWFAPAQDERSDADKESLMDQNAILLALGGIGAAALLSQWLAWRLRLPAILFLLLSGIVAGPLLGWLDPDEMFGPLLFPLVSLAVALILFEGSLTLHFSEWKEIGTVVHRMVTIGALSTWGVIALAAHYLLDFSWEMALLFGTLTLVTGPTVIVPMLRVVRPKAAVANILRWEGIVIDPIGALLAVVVYSFIISSGEGDGWLHSLQTFGGVILCGSLFGILGGWALGIVLRRHWLPDYLHNLATLAAVLGVFIASNRVMHESGLLAVTLMGMGLANMKGVDVRQILHFKENLSVLLISGLFILLAARLDINALLGLGPAALLVLLLIQFVARPLNVALSTWGSPLSWRERALLSWIAPRGIVAAAVSAIFAIRLSAEGHAQAALLVPLTFLVIIGTVVLQSATARPLARLLKVAEPSPSGYLIVGANPVGRAIGKALKSLGSRVLLTDSSWENIRAARMDNLPTYFGNPTSQHAEAHLDLVGIGHLLGVSPAGELNTLAAMRFRHEFGHRQLFGLPTSQEAKRTDKHRSSDEHRGRPLGQRPLTYAQFASLLSRGAEIRTTLLTDTFGWNDYQALHGESAILLFARDPNGRMHVATPQSTLAPGTGWTLLSLIDAEPSVSKSQATEIAD

SEQ ID NO: 18066 - protein, 235 aa, Pseudomonas aeruginosa
RRPTGRRDPGAVEQPQAPGRNPDRAGPAERTATEEGAEEADQPAPGRDPGRRPAQSVPDGQRRHPAYAAASGHEPPGTAEEPASADRRRDEQRQRPGPQRKPRGPVPEGRGRRRTGRGEATGEAGDADARQPGGGNLDERRSLRNRQDAKHAQPRRLGQPAPAEQYRRGALRQYPHCRRAARADVRQRQPATDRPVPGLPEDQPAALIPTQGRIVRGYGKGTRGCLLSACLKPPG

SEQ ID NO: 18067 - protein, 290 aa, Pseudomonas aeruginosa
SEVRVPVHPHLASGQVDRQHALPGVGQQALAVVQAARAGLDHHDIVGTGFQQMVDHAEQLPALVDHLQAFQLVPVVLTFLERGQLATRDADLVTGEGAGLFAIVEPLELGGQDLAMQAPPDQLGLPNLAVAPERPAAIVQQVVQRVGKGIHLHLTADAVHRNDLADHDQVVGGCRHFTHDGLGVCLGSVLEQLSNALRRLCTLAEPVGSTLLVDGQTHFATSRNRVEETDALDEATIARIAAVGHGQVVEGALFGAATSKTDGYHVNFVPVVGACKMNARWAHGPKGRIF

SEQ ID NO: 18068 - protein, 362 aa, Pseudomonas aeruginosa
GLSGNLQISFSATHRPARRAREAHGPPAGRRRETAGVASGRASDQSLGMPPGNILPMPRIILAMPPLAVTFFIIFCICLCCLISRPTSCTWVPEPRAMRRLREPLIISGSRRSPGVIELMIASICLNCFSAAPWALPICARLTPPSIGSLSMSPPRPPMFFICCNWSRKSSRSKPLPFLIFFASFSALSRSRFCSACSIRLSTSPMPRMREATRSGWNGSSASLFSPMPRNLIGLPVIARTESAAPPRASPSTLVRTTPVSGKASLKALAVLAASWPVMASTTNRVSAGLIAACTCLISSIMSASMCRRPAVSTITTSMNFSLASRIAASAMATGFWLTSEGKKVTPTSPARVSSCLIAAGR

SEQ ID NO: 18069 - protein, 152 aa, Pseudomonas aeruginosa
TSAETTITDFFLRSLRKRASLPAVVVLPAPCRPAIRITAGGATLSARSSLAAPISSSSSARTIFTNACPGVRLFETSVPTARSLTLLTKSLTTGRATSASSRAMRTSRRVSLMLSSVSLALPVTWRSVCERRSVRFSNMRDPSTGVAASGGL

SEQ ID NO: 18070 - protein, 329 aa, Pseudomonas aeruginosa
SASSPVTTASATGRRCCSACCASARACGLGGEWGGAALLATENAPAGKRAWFGMFPQLGPSIGFLAANGLFLALAMLLSEEQFREWGWRIPFLLSAALVVVGLYVRLKLAETPVFAKAMAKHERVRLPIAELFAQHWRPTLLGALAMVVCYALFYISTVFSLSYGVASLGFSREEFLGLLCLAVLFMAAATPLSAWLSDRFGRKPVLLLGSLAAIASGFAMEPLLSQGSTFSVALFLCIELFLMGVTFAPMGALLPEIFPTHVRYTGASAAYNLGGILGASVAPYIAQKLVGIGGLGWVGGYVSAAALLSLLAVLCLKETRDNDLGAVS

SEQ ID NO: 18071 - protein, 188 aa, Pseudomonas aeruginosa
PAAPPAAATAEPPPTRPAMPAGASQSSTRTAWAARVALARAASIDSSRARATPIRRWPSTSGLPNRRSAVSASLSAAPRLAKATCRDLPSTRITAEADGPSWRITGIGRPRIARACSANSERSWEIRVTRPVSCGRGDTSLNHTWSPLTNSSTPNSPRPPRASVTARATRSDSARACALIACGCQDSW

SEQ ID NO: 18072 - protein, 331 aa, Pseudomonas aeruginosa
PMSVCITEPSWTLLCSPIWISSLSPRSTAPNQTLAPASRRTLPITAALGAIQLSGWVSTRASPRRYFIAISSWPGSAPRRSTQFDERSRRRVQVDGVVVQQVDQLHHHDGRQAPDLELAEAIAGHVPAAAEVVDTVGDLARVVAKETQRHVEHRGDLAVVGLVLDEVGNEGDIGSDLDAMPRDQGAQRPDHFHQARRQGDLLLRLAQGGAHQVGIFRVAPPAGEGDLAAMGGQTGGAQGQHQLRIVAAGDGHQHGRLGEALVGIQLAGAVRLDALAQLVERAVHTAGVSEVLSFPRDHGTKAPASPPLPHGALSPPGQPSKIGLSPKKNLA

SEQ ID NO: 18073 - protein, 264 aa, Pseudomonas aeruginosa
FSQHYRATTTQSASEPLMKTAHDLLLALRPDEAQPTPLYLQLARNLESAIHAGQWKAEEALPSERNLSETLNISRVTARKALEVLFEQGLIRRNQGSGTFITPRLEQPLSRLSSFSEMLRLKGFTPGSTWLERGIALPTHDELIRLGLSPTEKVTRMKRLRKADGTVMAIENSTLPARLLPDPTAVGDSLYEYLDGIGRPVVRALQHVRAINASASDAALVGIAPGTAMLLMTRIGYLEDNTPIELTDTYCRNDYYDFVAELRR

SEQ ID NO: 18074 - protein, 708 aa, Pseudomonas aeruginosa
PTRSRHARRQHSHPARLGPRPPTHPGRAYPADRRRALRPGRQRRSVPAARLHRPACARRRRPRHHGRRRRLRHHRPHPPALRHDLAAGHHHDRTARGDRRHPQPARRLLPPLAGGRFTDTRRAPGRPLHQLRQARRAAQLRPCRGARGSRGLPAPRADPGDHHRPRDRRTPAADPRPRRARRTPADRPYPGQLRGRRGRTGSRRQQLHPPLQRDDRPAPPRTGYRRRGPGPRTLRRADPRPAACPSRRHQGGPAFDPVPVLRDRLHRRRRHARRPVQARQPHGDQVPGRRAPARRHPGRQHPDHGPGTAQPGEDRPAPGRSLATPFAIPRRLPRPRRARPPGARSLGRCGAPGSLPGTRRRDGGRRTRMTSLMLEEALSAAAVASRQLAVLDACLPALGQRLREVDPNLALTVARGSSDHAASYFAYLAMQHAGLPVASLPMSVVTLNRSPLRVAGQAVFAFSQSGQSPDLVDSLRILRERGALGIALVNAEDSPLEAASEFVVPLCAGTERSVAATKSFIATLSASARLLAHWQRDNALLAAGQGLAAGLEQAARLDWSPAIEALRDCQRLMVIGRGAGYAIAQEAALKFKETSAIQAEAFSSAEVRHGPMALVEERYPLLVFAPRGPEQEGLLALAEDMRQRGAQVLLAAPDDIAERDLPLQRAAHPALDPILAIQSFYVMAAGLAEARGMDPDQPRHLSKVTRTH

SEQ ID NO: 18075 - protein, 311 aa, Pseudomonas aeruginosa
ARAHEQQESRPQSAPERPRDAAQPSTRPGVFQRHPGRRHRHRPTQRLPARALRRAGQPPGANPPRAQPARRQRCRAAAARRPRYRTAARRRLRGAGRGRCAGDRGPAAAALRPGPRRPRQPQSDHGDDPDQRRRLPGTPADHQPGGGRRAAPATESGEGRATSGQSRAWRRLRAAPGPRAGAGRPSWRSARTPGSAATEDRAGLFQPGRTALRRAGGQRRQPGRHHGPGGRRTGRGRGDLSRRRQRGGPRRPARGPRQRHRGGSEGGPARHRPGRAGATCGCRRYPGRRLRFARPGQRSPGAARRHQPAGG

SEQ ID NO: 18076 - protein, 345 aa, Pseudomonas aeruginosa
RPASSRGTAPRPGPGPATGARRRTGEPAAGQARRRRERSGDLFRASRAAGRPGSAGRRRHADRPGRRRRPRLAPGDSGPVRDSPGAGQPAAGRARQRPARPGKTRAAGTARRHRAIAGACWRHRRRPGDHSLRPRAAGGCRRGWPVHGRRRRHLPRGHPRPQQGPAVPGGARRRAAGAGGRPAGGAGRRPGPAGTQPRRSTPGAGRLASGAARGTTPPPAGRCAARGAHPRRPAHRDRRQRRLAARGRRSLRQRCRRGRPATHRVSLSRAPRRARRRGAAQRLPGGPGRHGPAQGDHPHHRCRRRQAPPIPGRCRWKKNPALGPARHPPRARRARSCSTSSCARC

SEQ ID NO: 18077 - protein, 147 aa, Pseudomonas aeruginosa
GHIQGAAWQPVVARLRRCHADRQHFGVGTGIVATDRPVEAPPDDLALAHQDRAHRHFAEGRGLFRLCQGLAHEMRVPAAIDDRTHAFYRRVALAVADQLSHPHQASPTAMVPIRPVSIWSMTWQWNIHRPGLSATSATRAVSFLPSR

SEQ ID NO: 18078 - protein, 191 aa, Pseudomonas aeruginosa
LGASLVIWTSWTWGLGHARAGDPDELRLACASAGCRRCRCSPWRRAGRPSAGGRWRTGHPCTARDPRCLPAPASRRRRRRPGSSGRTSPGSRTWRPANPCRGRTCRNGPGTARSRPALPRYRRTSSPSSHSRRRRPWPWPGRRRSGCRRRRSAVRRCLRERRRRWRWRRSAARRHRRRCGWCRSSPGRCRP

SEQ ID NO: 18079 - protein, 416 aa, Pseudomonas aeruginosa
FAAWRALPDGKNGSATLYPATGFRSTQLIAENGEWANILQGARQAPFRLSYPAFAGWQRGGGWPDTAYVTQRPPRRRDADSKNYKSGTGERMKGSTDPHSSSAALLAAFGAAVLDINRLARDKTLERFHRTALERLQQLVPFQRAWWGRAALIDGVPVEHSAHLFNLEEHYVEDWKSISHDDITVGLVHARPGTAVAVDMQATAGLRWLGARHDIGELLCVIHVDPITRLSDHVALYRTPGGPPFADQEKLLLGQLSAHLAAAVSANQIRTLVALRESLERQALAMAVCDRYGVLHCAERGFVDLLLGAWPGWTGPQLPEETSPQGYRDARLVIDSRQVGDLYLLTARQPSAIEQLSNREGDVALLFSEGKTYKQIARDLGLAPNTVRHHIRTIYSKLGVNDKASIAHLLHQFPPG

SEQ ID NO: 18080 - protein, 142 aa, Pseudomonas aeruginosa
PTAPPRWPHRPPAPSRCSASRSCWAPRPAPPTSTPAISSAPRRAPRSACSTCRRPAPMSSTDRPIATARPNSRPTRWPTARCSSATSAALSARRSSSFPSSTSMRACPAAPGIPARPVSAIPRSAAPCSSSTTRNGAATAAC

SEQ ID NO: 18081 - protein, 308 aa, Pseudomonas aeruginosa
NVSIGATRRCLAGLLFIAANLASALAGSYPLLLALRFCSAPRRRLADDPLRVQGRQHRHPEPGLRALGDGPNWWSAPSAWHCCRRCSNASVWPACYLLLAGLMGLALPLSRAFPSGSPPAEARASTGAVHSRLRVGLGILAVLTFYISLSGVWTFIGAIAEGAGIGAGASGEVLAVATLMGIAGAACASFIGNRLPRDLMLLGGYLAMAAAILLLIGQPPLARFALAALLFKFTWTFALPFILACLADLDRSGRLMNASNLVIGGGLAIGPALAGRLIEGSGGFLPLLPIAAGLAALSLLLALACRPR

SEQ ID NO: 18082 - protein, 312 aa, Pseudomonas aeruginosa
PSRKGMGNLPMISLRQLHYFVEIVESGGFSRAAERLFVAQSALSRQVRELEDSIGTPLLRRGPRQVELTPAGRAFLPRAQRLLGDLEAARRLAREVGEGGHGLLRLGHSSSVPLVGGLQAALRGYLAVQSGVRLELTQQSSEQQLADLAEGRLDLGLLRLPVLRQHPRLHLRALYREPLLLALAADHPLARREAPVALAALAGETFVSIPHLQRGGLSYRAAELCLGAGFYPRPARALSRKTSQLQLIEAGFGVALVPASMRAIAPPAVSFMSLAEAEAYSEVALAWRRDDSPLVEGFVEYFLENLPNEAKD

SEQ ID NO: 18083 - protein, 471 aa, Pseudomonas aeruginosa
SHIPVRRLIMPPMRNDPFQRLGLDREVLTVSQLNQRARLLLEDVFPQVWVEGELSNLARPASGHVYFTLKDSNAQIRCALFRQNALRVRQALRDGLAVKVRGKISLFEGRGDYQLIADTVEPAGDGALRLAFEALKEKLAGEGLFASERKRPLPAHPRRIGIVSSPSGAVIRDIISVFRRRAPQVELTLVPTAVQGREAVAQIVRALQLADRQGFDALILARGGGSLEDLWCFNEEAVARAVAACATPIVSAVGHETDVSISDFVADVRAPTPSAAAELLAPNAGDLQQRLDGLRRRLVLRMRDQLLRERLRLEGVARRLRHPGERLRQQAQRLDDLDMRLRRAFERQLAVRHERLVRLETRLAAQHPGRTLALLRQKLDSLAARLPRAAREVLKDRRQRLEGLAQTLNVVSPLATLGRGYSILLDERGRAIRDAGQTQPGQRLKARLAEGELEVRVEDNHRTPVTLSLLD

SEQ ID NO: 18084 - protein, 313 aa, Pseudomonas aeruginosa
AAMIRLSQRALAYLNEVIHHGSLRRAAQHLNIDPSAISRQLASLEEHLGVRLLQRTPQGVAPTEAGELLVAHYRQQRANEEGVLSRLSALQGLRQGKVRLAVGEGFIADLISQPLQSFILRYPGIELEVRMAGANEGVALVKEDAVDLALVYAPVEDGELDVHVDTRQPLDLIIPANHALAGHRGAVPMRALRNESLALIHNSTGMGQLAVIAAQLERIELRPKLRTNSVAVLTNFVKSGIGVAFMPELTVSHEIEAGHIRCLPLAHPALRDARARIVSHKGRELTVAAIACLEHLRRGMRFFSGDAPGLSQR

SEQ ID NO: 18085 - protein, 266 aa, Pseudomonas aeruginosa
RRRRQREEPGAPVRQQPQAPGRGKERRRTAVQALPQQHARRRGAAHGTGDDRPRPEHRLLRRDRPAVPGDLRQRHALHVQGRRRGPRLLRQRQLLAGRPRGLPRAHRHRAAGGGRGRRLPQLHQRQEADPRPGGLPGPALPRHGSQPGGALRSLRRLRHADPLDRVVHGPAHRRRRRPDEPDLLHHPRQPLPGAEVPDPGQHPVLRPVPGGQRRSARQPPGKGAPGPARRRRRSHPAEPRGGRRPAGARPGVPQGKGHADHPAVRR

SEQ ID NO: 18086 - protein, 229 aa, Pseudomonas aeruginosa
PRRLPRERPAVLPGLAEDPGHRAALDRDGLPRRRSRHRPLTFARCPPDGRCRRPGAPVRLSGVPPMPSLLKGMRAALLNLATLLLLLDLVLLIYGVFARYLLGSSPIWMDELARYLIIGAVMLALGAVWMEGGHMRVNLLEQRLPPRLAQALRLYQWLLALAFFAFAAWVSTRYALNAGRFRSLGLGVSRTWPLLSLPLGFGLLTLMLLLQGPWPRQPASTTVEGGSQA

SEQ ID NO: 18087 - protein, 264 aa, Pseudomonas aeruginosa
PCGCHACSIDAMTDFTQAIPVLPEPDWHAVAGIPIVDAGTPLEALGLSRDFSVWPAYHKLGIPHAIPECHARGEVFERLLRVAAALPGGVRLVVLDAWRPFAVQQYLYDSLSSALAAHYPRAGEAELERLTRQFVSPPSSSREAPSPHLTGGAVDVTLCDAQGRWLDMGSAFDEAVPASYTAYFERLAEPDARQRRVRDHRRLLYHAMLDAGFSNLPSEWWHYDFGDQLWAWHTGATQALFGPVQLQAMDALWRQQLQKRPLAD

SEQ ID NO: 18088 - protein, 159 aa, Pseudomonas aeruginosa
PSTATTRPSARRSTKAGRWNTCTTPAARCPTATAPARPARKRSTGSSASSCSPPSPPCSAPRSGWKASPAGTFRNATTSTTPTSEPWPTAETAPPPHAGRRALSRPASRAPATASSPGTRAAAGRAPRNRRMSSSAPAGPGAPAAHACRRRPAAPSSPG

SEQ ID NO: 18089 - protein, 294 aa, Pseudomonas aeruginosa
TFVVEPRDIRVGLGQDHFQHVDAGGEERPSLAHLPEQRALATLDGVQQGGLPAKPCRQHQARLGPGEDPGNRPQALHPAFAALGRAAAQRQATQFLLGRGQAEILDELRIVAHHPAVGQQRVLRQAVHLRAPGRLGSRRRHQGRFQHRGEVEIEVLFGDVRQTELEADHLALFGDPEAPGHRTRRLRQDRRVGRPAAATDSTAAAVEEQQLDLVLAADLHQFLLRPVLRPGRREGTGVLGRIGVADHHFLHPGQPRTVARQRQQALHAGAGVVQVVEGLEQRHHAHRPVDAAFL

SEQ ID NO: 18090 - protein, 530 aa, Pseudomonas aeruginosa
QQLHRQHVGRLAGHRDHVGPQRRRWCGGDRPAGGEHLGGIRRRLVVRRQQGAAAVQFLEKEFQAGLLVPLVVAAQLQVLGDLAQRGGMAGRVLAHVQAYQEQAEGGGAAQAVEQRAIGDHAHAAGVQRLVAQLQRLDQVAVVLQDALRGRHLAGQGLVGPVAGHAQALAQLLEQGAIGLGAIADPRQQLRRGLLHGQLGGQSVDIAQVQVGGHPARQQQDLAGHAGGDVGIAVAVAPHPGREAQRRGGQRQAFAGAAQEYLVDVPKDVRQGLPERMFDHREAPFRLVHRGRPDLADLVGMPGLGHQPLQALLDATALLRQQVGMVLGRQLRGDRIVFLDQRAPRHLGGMGGQHQFDLQPGELASQLPGGMPGVLETPQQLLQHQVLEGFRLVRPAPADTVVLLGDIGQVEELVEGPRHRQQFVFLEPVEGGGELLGALRGTAAGSLGALADQLDLVEEPRAVLLADGVAEQFAQMVDVLAQARIDFRHDLSPLRVGNQLGSGAPALTSPQGASTAPPGRKRGCRRRSGLV

SEQ ID NO: 18091 - protein, 755 aa, Pseudomonas aeruginosa
LLQGVQSHPTRQTGIVSMSHEHADTCCHGHGHDHGHRHAPRPAVAAIGTLAGNAELRWSDLRIEAMDCPTEERLIRDALGRQPAVESLEFNLMQRLLRVQHRFDSVEPLQKLIAGLGMQAVPLDAGENTDGPSQAPAKPWWPLALAGAMALASEIVEWFGLAPDWVVAGLALLAILGAGLPTYRKGWIALKNRNLNINALMSIAVTGAVLIGQWPEAAMVSVLFAIAELIEAKSLDRARNAIRGLLQLAPEQATVLVGGEWKELPAKQVELEATVRVKPGERIALDGEVTSGRSSVNQAPITGESLPVEKEVGEPVFAGSINGEGALEYRVTRRADDSTLARIIHAVEEAQGSRAPTQRFVDSFARVYTPVVFLIALATAVLPPLLFGGAWLDWIYRALVLLVIACPCALVISTPVTIVSGLSAAARLGILIKGGVFLELGRKLSWVALDKTGTITHGKPQQTDYLPIAEADGTDARLLAASLAARSDHPVSRAVANAAEEDGLALGVVEDLAALPGRGVSGRIDGVLYHLGNHRLVEELGLCSPALEERLDALERQGKTVIALCDPQRVRALFAVADGVKDSSREAIRELHALDVKTLMLTGDNPHTAAAIAAQVGIDAARGNLLPEDKLREVEARQADGSRVGMVGDGINDAPALARADIGFAMGAAGTDTAIETAGVALMDDDLRKLPQFVRLSRTTHAILVQNITLALGIKAVFLALTLAGEGTLWMAVFADMGASLLVVFNGLRLLRKRF

SEQ ID NO: 18092 - protein, 524 aa, Pseudomonas aeruginosa
SSGSRSAPCAGSSAISLGDPLEAGGLDEHVGIGGIVQVGEDLRQRAAHQRALALIAVDGLAVELAGAEVLDDALDVEVVDHQLVTVGDLEAGDDEVAAQALRQAGRQVPALALVGDGEAVVFQALGIVLAVHVAERTVDIAAGTGDLQELFFLPLVLAAPGPEQMARRRLARRYRLLEGDQATAQQQETQDHQATPGFHHTLLRNPPQPATGWPREGSGMKNPAMAGLTLRSQAHDQIQVPSEYGAHFVHGQLLDPVHEALIFHLQNNRRQHLGVLLGLPGTEHLEEMHGAEGENPLVGIGQFAQARVEQRLLAEGLLGQQVLAALGELDLDILHGKLDDPFHQRATGAGVVGQHRGHLLEVALHAAPERRQRLCVALDEEGEGVGDEIVDVLEVVGGGRQRHLGLGGHRAVAHGPYAVADDQAHGGIENRLAPLLAALAAGLAALVTNAFGYRAGGLRGAVSGSYSGHGVSSARGRWGIVRTFSRGINRPLSGKLRSHPHLPWSAGGSAAIGPWPGGRDTARP

SEQ ID NO: 18093 - protein, 589 aa, Pseudomonas aeruginosa
KNRPKAAFHGLLRRSGLRAHVREQDHVADRRRVGQQHHQAVDADAFAGGRRHAVFQGIDEVGVVVHRLVVAGVLLLDLQHEALGLVLGVVQLGIGIGDLAAADEQLEAVGDARVFVVAAGQRRNLEGVAGDEVRLLQLVLHQFLENHHLQLAQAFVAEDLGAGLLGDGPRLLDVVEVGGGDLRVVLEDRIEHRQAHERLAEVEDLVAVGHVGGTEYRLGQFAEQFLGQVHVVFVVGVGLVELEHGELGVVPGRDAFVTEVAVDLEDLLETADHQALEVQLRGDAQEHGHVQRVVMGLERLGRGAAGDGLQHRGLHFEETALAEETADVGDDLGTHAEGVAGFLVDHQVDVALAVALLGVGQAMVLVRQRTQRLGQQAHAGHVDVQVALARAGQHAFGADDVAQVPGLDLGQGFFRQGLAVDVDLQALAAVLEDDEGTAVEHDPTGHLDRDRCGFQLFLGLVGVLFLQVREVGVAAEVVGEGDGPGFAHGGKFFLALGDQLVFFLLQFVLVELLVAHGLGGSWLGSLACGNGLRNRGEKRSERRPGKAGNGEDTEFTIVKNEQSEPFSNAAWPGAAALQPLFEAGFEVFV

SEQ ID NO: 18094 - protein, 341 aa, Pseudomonas aeruginosa
IAVEHLVAVAALDTGTQVLDPRLVEHVGADLVAPADVGLGVLQGLGRGGTLLHFQLVQLGPQHLHRGVLVGVLGAFVLARHHGIGRHVGDPHRRIGGVHVLTARAGGAVGIDAQVGRVDLDLDVVVDFRRYEHRGERGVATVAGVERTLAHQAVHADLGAQPAEGVLALDVHGGALDAGDLALGQLDDSGVEAVLVGPAQVHAQQHVGPVLGLGAAGAGLDVQVGVVRVHLAAEHAAELQLLEDLAQTLDFVGNVVDGALVVFLDRHVQQVAGVGQAAGQVVQGFHHLRQLGALAAEVLGVFGVVPDVGVFELAVYFDQAIMLLIVVKDTPEWSGCARRGP

SEQ ID NO: 18095 - protein, 427 aa, Pseudomonas aeruginosa
FPWLALTRGKTSKSCEVYCTCAPQAVRRPLFNAGRRRMAAARRSARRGRRHRLFHQAHLVAAIVLGLVERLVGHLDENPEGLPAAARHQGADADADGQVRARAWLVVADLQALHRAPDLLRQQPCAARRGAREDHGELLAAVPSRQVRGATAALADGPGDLAQGLVAGDVAEGVVVALEIVHVDHQQRQLRLLAQRAAPLHLQVFVEVTTVGEPGQAVGVHQPLQHQVGLQQLLLALAQRPIGLVALLQGDVRTRVVADPRHQLDGVRQLDQVVVGAGGERRALHRRLFLGRQDDDRDVAGRRVAAVGSEQREAVDAGHHQVLEDHRRLDLVGHRHRLLRIGTEVEVDARLARQRATHSLSDHGLIIDKQYHDRAVQRGAQVGLALMRVVHVSLRDRGPSYQIECCSTHRRGGRRRLPWRLAGLAPG

SEQ ID NO: 18096 - protein, 181 aa, Pseudomonas aeruginosa
AACRPNAGGPRRPGSAPANRHPARRRRKRRAPCPGADREASPPGYAPRRNVPRRRCRPHRGRAPPLPGWPLRCGCSRAVAAVAQPRPGRHGDLRTRSAGDLRAGRSPPLPARTCARCAPAGRRRPPRRSPPPGCAPRTGSAAPRRETALPAPGVAPCARRRATGGPCAARRPVRRRDRTPR

SEQ ID NO: 18097 - protein, 308 aa, Pseudomonas aeruginosa
STWARWPPCQANSSRSAMCCTSICWHSPISCRASPSMAWACGSRAVSWTVSRTTSSARLALDCRRRRRCRESASGLMRWNSTSDLLEISSSRSRRSAVTRRTRLRRSSACSPPACPAGSSSLSSLAAADAAGGASGTASGRPGVVAGSSARASGRPLRTRPSRRSTRPSISSRPAPSAQPASPAGGVPIRSNRSQPWSNASICSDCRSRRPSCASTRQSSMTCATRTPASSPTIRAAPFSECAARMQASSWSAWVGLRSSAIRPALSTWVWASASSRNSSSSDASLIWSGVMPGSALRLAGEGLRRAG

SEQ ID NO: 18098 - protein, 288 aa, Pseudomonas aeruginosa
VATAVWSASRRTSVATTANPRPYSPAFSASMAAFSESRLVWSATLTMVVTTWLMLPAFSLRIASLALTRSAAPITWCMVSSMRARPNWPEPARVDVCSAAPETSLMVRTRSREVAAISREVAPISVVVAAVSVAVACCCLEVAAISVTEVVTCTEERWACDTRPLSSSAMPLKPVSMAPNSSRRPRFRRAVRSPPAIRSRLRTIFWIGWVIARNSRKPQMPATTTASSRVTSMLSSASSTAFTMLSEARSAMSLFSSIISLRYLRPSRQCSVNGPATSLPASSKRFSR

SEQ ID NO: 18099 - protein, 594 aa, Pseudomonas aeruginosa
EDRLITEGMCAPSPCRERGAISPVDVGMAGFAEEQQGADQATAGDQHRIPEAVEDVAGVHHQGERDRGQEAAEPAVADMVRQGQRGIADAGREQFDHQRRQRAIAEGGDQYQGEDDGDHHRLVHLAAVGLLRIACRLHRGRHRFGVEAGDLGLADPHPDVAAGGRRHRRVGQAGLDQEGLDLVAGAVEGRLAYRVELESAGRRVGHHADRRLPAGLVDGRVGVVGQALEQREVEQRGEQQAGQQHRLAADAVGQPAGDDEERRAKHQGDDQQTVGGAAIDLEHLGKEEQHVELRRVEGHRLAGIDAEQRGQHHLQVAPLGEGLAQRRLADLALGLHLEERWRLAHGQADPGGDAQQDDGQQEWQAPAPGLELVAGQLATGQDHQQREQQAEGRGGLDPTGVATALVRRGVLGDIDRRAAVLAAQGQALEHAQGDQDDRRGDPDRGIGGQQADSEGRQPHQQDGHQEGVLAPDHVAHAAEHQRAEGPHQEAGGEGHQGEDEGRGVVDAGEELLADHRRQGAVEEEVVPLEDRAQRGGEDHLALPLGRGRRHCVGRGRCVLGHCGSPAPCGGSYCCLPFPFSASTAAAPGATRYGV

SEQ ID NO: 18100 - protein, 241 aa, Pseudomonas aeruginosa
RSSGLHRLLAAGRHGAFDDLRRGLAAALGENHLRRLLGDHQHRRTGVAGGQAGHDRGIGDAQAGDSVHPQLRIHHRLRPLAHAAGAGRVEDGGADLRRSALQILFAAVFRAGLVFLRTEGGQRRCGGDAAGQAYGVGGDLQVARIAQVVGLDRRRLARVERADAHRSPAVRTQVADRRGERREGMQRLAEAIQRERLDVVFEVGRGLLRIGAGEGAQLARRHRQRPAAARQVAQTHAQLAP

SEQ ID NO: 18101 - protein, 342 aa, Pseudomonas aeruginosa
PASLERLEASRSFAIKKQTFRGSYCSFSNSPPPSARQKALPMFDWNDLRFFLELQRSGRLLTAAKRLGTTHATVARHIENIERDLGTQLFAQHTGGYQLTPAGQALLKHAEAMENTALLAQEEMSQSISPLGQIRIGVTEGLGSVFLAPRLAQLMRHYPGLEVELVSVPRFVSITNREADIAISLDRPSADLVITRLLTRYRLALFASPAYLEQAPPLRDRDDLGRHQWIGYVDDLLFSQELMFHHSFCRHPQVVFRSTSVVAQQQAAQAGIGLAILPHFMGSRDPLLVPVLPEESIQREYWMSTRRELHRSVRLRVVWDFLLELCQREREVLLGPSATPPP

SEQ ID NO: 18102 - protein, 677 aa, Pseudomonas aeruginosa
RPSASRKPFDAPAWPSKLRARPRLRVGVRRQPLRAHSQQQSVNMAPPSHPLPRKGLPMTISRRDFLNGVALTIAAGLTPAEILRAAPGGRYYPPALTGLRGSHPGAFEVAHQMGWEKKTFDVDHLPIEEEYDLVVVGGGISGLAAAWFYRERHPAARILVIENHDDFGGHAKRNEFQAGGRTILGYGGSESLQSPNALYSEDAKHLLKRLGVELKRFETAFDTDFYPGLGLSRAVFFDKASFGVDKLVSGDPTPMVADEVPRDRLNARSWRAFIGDFPLSREDREALIALYESPRDYLAGKSVEEKETYLAKTSYRDYLLKNVGLSETSVKYFQGRSNDFSALGADALPAADAYAAGFPGFDALGLPQPSEEAQAEMDEPYIYHFPDGNASLARLMVRDLIPAVAPGRGMEDIVMARFDYSKLDLAGHPVRLRLNSTAVSVRNRAGGVDVGYSRTGRLHRVRGKHCVMACYNMMVPYLLRDLSEEQAHALSQNVKFPLVYTKVLLRNWQAWKTLGIHEIYAPTLPYSRIKLDFPVDLGSYRHPRDPRQPIGVHMVYVPTTPNAGMDARTQARVGRSKLYAMSFEQLEKDIRDQLQAMLGPAGFDHRRDITGITVNRWSHGYSYFMNTLYDDEAESEALMELARSKVGNVAIANSDAAWDAYAHAAIDQAVRAVRELG

SEQ ID NO: 18103 - protein, 181 aa, Pseudomonas aeruginosa
RSFRREARIPITPWCQSASNRHKPNGSCSRLSSLSCASASRCIPCSMALRSWFNWSSCTAMSRASASSSQSRHSMPRDMSSSRPAAFRRGPRMKPRSVEVIRTGGRPATSSSARKPGRARPARMRARPWWTRMRLLASSGTTSATLPSATKSSSSARFGSFSPRRANQSSSRRRARNASIT

SEQ ID NO: 18104 - protein, 177 aa, Pseudomonas aeruginosa
ARRRTAAPGPSRRAASRRAAPCAAPPRRSSPGPTGGGYFRPSRTRRAPARRSPPLRATAAPSRPVGRCRASGRRRTGAGCSGTAASSAGSKPPGSRSPGTGRRGRRRRAPARHCRSARENRYAPVGGPRTPRCRTASARPASDGCGSVPRLRRRRSPCARPPGARSRGRTADSATGG

SEQ ID NO: 18105 - protein, 601 aa, Pseudomonas aeruginosa
AFRRSAAGAGPAPAGACAAPRRRRPRQRPCPIRPARELRLECPTSWSSWVYGGHRWKPARAACPGRSQQATPGAAPLRARAERLRSWRRRLRVDSDFRRRLVLVAALAFRHHRSGCATAVEQAGEDVLHHRALADHTFDGLAHRQRLGEGVEEVALAADDLDVRLAQRGGEHLGLLLGDVLVRGDGRHGLLEALLQLHAELFVLASAVAEGIQGAELLAKPLGLGIQALQQYFRFRAALVLGGLGLGRAELLLAARLGAELLGQHLGLRARPSFSLAAACASSTRASARPRSSSPLASAISCSARTRAAAKPSFSFAAAVTSSTRASARPGAARSASMPSARRFFASACFDAASSSACAMVLISTALCLERASSASACLTWRTSSCSASAWACSRITCLTRSASETSRTSLIRSSSWATVFSTATRSRITLAMFLRCSSSAFSFSIFCSSTSRSRATISRSLARVTFSTSMTTARWRFCCATSTSRWWFSVRTSISCCAWIRACSAFSRSSSLTRAVSASSRARMVSISRFCRASASACWRSRARAASRVSTFFFLIASSSLRSSSLVMTFWVAVSSVILRMPSASRMLLGSSEFFAVCSR

SEQ ID NO: 18106 - protein, 157 aa, Pseudomonas aeruginosa
WKAWFRNSTCSVSSASAPATSCRASPPPPSTPAPMAATYRSAPTATRSSAASCRPSAATTWPATRNWPATTGAMRAATNSMGLSTAGSPRSPWRKCWRCWREPKSRPAESTPPKTCSAIRNSLPARCSSRHACRTASHSACLASCPSCPPRQARRIG

SEQ ID NO: 18107 - protein, 674 aa, Pseudomonas aeruginosa
GRETGQGPGLGPAWPGGLFPDAGRRALRRRPGHTAERQPLCTSPATHRATVEAGRRPADRARPPGHRFHGKDPDPAADRTGRCGRAAAQLADPLAGPVDPRRARLGRHGHHGDPLQPAATDRVQRVRRHQRRLGAVPGKERCPGPRLFRRALLQAGQRHPVQRSTEAAPPLAQQTRRCPLRRHEKARHQGGLLPFTTGSERLAAIAVLADEGLYLGQLVRQYGAALLALEQVGEVRRQRRRLADAGLLHRFGELDRMRSAQGHHRHAQAAPAFAGGTHANGGVRVEQLATGAVYLGDGLAGLLVADRQGVEQLARLGPALVFHRQLAAGLEGIQQFGDGLAVAAVQVEQQAFEVGRDHDIHRRRQRGMQGVLVVAITAHEAVQDVVAVGRDDQLADRQAHVARQVAGEDVAEVAGRHRERHRAMRRAELQRGMEVVDDLGHDPRPVDRVHRYQAGTLEEALVGEAGLDHLLAVVEVAFDGDVVDVVAEDGGHLPALHLGHAVVRVHDEDVDVVATAAAFDGRGAGIAGGGPHDHHALAALGQHMVEQAAEQLQGEVLEGQGRAVEQLQHPFVAVQLAQRRHCVMGEDAIGFLEDLLEVGIGDAAGDERAHHPEGQLVVGQADPGGDLLEGEAWQVFRDVEAAVAGQAGEEDIFEVQGGRLAAGADVTHVQNLRC

SEQ ID NO: 18108 - protein, 240 aa, Pseudomonas aeruginosa
LHLAIILFFHQAMTMSNQQHSRLGQILINKGLISAAQLDAAIQAQLSNHKRLGETLIEQGLLSERQLKKALKKQTNLRLAATLVAALLSPFQMASADIQRMQPPAAMSRQELPKNLRPLTDVEMSNVNAQGLNESLEGLFLKAEGGDGLAAVKQLAKLVMPMLDSLEAETSMSDVRYETGKTQSTLNPDGSVNLRLPSSIGEVRFDNIRIAGAPREQTFGSVSLQQIDLSQASLKISLRP

SEQ ID NO: 18109 - protein, 187 aa, Pseudomonas aeruginosa
AAPRVPGRPAGSPGRLLGVLLLRRDRPAQPRPLPPAPAGQARPARGPAQQLAAAARRPPARHPVVRPHPGQRQRRRPGQLGRAAPLGRHRPGRRHPRHDPAPAAVRRPAAAPLRRPSLGTRRPAAQPAAPDPAAPLLAPAVATDPAEQRAAAPARRRCGGTGRQRTQPRRRGPASGRQPPGQRGQPA

SEQ ID NO: 18110 - protein, 556 aa, Pseudomonas aeruginosa
HAARPAGPGEGHGQRPDDPAQRNRRHRPRRRTRGHRRAVAHHQPHPPAGLPRRRQPDRRGRAHAPDRAPADPGPPDQGESPPGLHGAVFRAGKHAAVDPVGELPEGEAPYRRGGRRIWRGDRHRHAGGHPRRDRRRLQRPRQPRQPGYPCPGGRQLRHRRQRQPARAEQVAWLAITLRRPEDPQRPGHRSPGADPRLRGVPAHRPLLPGNPAVGGKPCEKRARLASPRADPAGRKRRQRLIRDCRTGPAALYNRPQLIQPCRRFRRYPQPEPRPVTRQSRLPARPRCRRYQPAHGAHPHPPCATDLVRPTRAPRRRIGALAITIRPHGSTPSCPDCQGPSHHDRRHRRRGLRSGTGQLDHPGRSRQLHRHRHRVLRFVRLCHCRRPGDRSGIHPADIRHRADDQRLPHLWHRIPRPSAGLGAVRPFRRPHRAQVNPGRLAAADGGVHHPDRRPPRLRQHRLLGAVAALRAALRPGPAASAASGAAPRCWPRRTRRPASAPGSACFPSSARRSASSPPTACSWPWRCCSARSSSVSGAGGSRSCSARRWLWSASTYA

SEQ ID NO: 18111 - protein, 228 aa, Pseudomonas aeruginosa
QAFARLAAGDTVLAQRLPCHRAPHTLAERRGQAAGQGVIQATGADPGHCRLTEQQQAQRLFGTGPTDQPFARSRRGRQAQGSAAGADSQRHRQRQQRQSRRPPGQRCQPAHLRVRREPPGRPGSPWRGRRRSTRRAPGPRPSAAGHPLPACRTGVAPYPPRSARRRGWRKRPAGTCLPPGSPPRPTGRAGGSPGSAGRGSPARAARTRKDPGKSGSPGRYRADAATPR

SEQ ID NO: 18112 - protein, 136 aa, Pseudomonas aeruginosa
AFPRRRTWHEILQPVRRHGGPAHPGRRQPPALRLRRLPHRALPEPAYRRRQPAGVGRPGPALPSRHCAAPGLLDAAGRLHGERRDPRPGGGPRDRGRSQRADRRPAALYPFRPAAHQPGLPVLPRRAARPGFLRRR

SEQ ID NO: 18113 - protein, 190 aa, Pseudomonas aeruginosa
ERLNAKHSNTAAVAAQGNIRDFTSMRWLLALLCLTFASLTQANAAPSLEGKVDKVLVLKSERKLLLLNKGNVLKSYRVSLGKRPTGPKLAEGDNRTPEGFYWIDWRKTSNNYNLSMHISYPNARDVAKAREKGLPAGGMIMIHGTPLDDEYPEWYFSTLDWTNGCIAMNNTDMREVWSVVKDGTLIEIRP

SEQ ID NO: 18114 - protein, 387 aa, Pseudomonas aeruginosa
PTPTAATTTTTSSPNCDADRHGAAMLEGNILTPQGWVLGRLHIQDGRIQRIEGEPCDPAGNADPYLLPGFIDLHVHGGGGRDIMEGGDAFATIARTHRRFGTTSLLATTMTAPREEIADILSQLGAYCRRSLEGGSRILGVHLEGPYINSGKLGAQPNFAHAAVLEEVEDYLRRAPIRVITIAPEIAGHRPLIRALAERGVRLQIGHTLGSYEDGVAALEAGASSFTHLYNAMTGLHHREPGIVGAALAHARYAELIPDLLHVHPGAIRVALRSIPCLYCVTDSTAAAGMPDGQYKLGSHTVTKCLGGVRLPDGTLAGSTLTMDQALRNLVKIGLPLAEASQRLSQFPADYLGLAERGRLAPAAWADVVRLDRSLELDAVMVEGELE

SEQ ID NO: 18115 - protein, 686 aa, Pseudomonas aeruginosa
AKSPEPTEPERAPMNNKNLALKAPLSGPVMPLNRVPDPVFSSGTLGEGIAIDPLNDCLHAPCAGLVSHLARTRHALSLRADNGAELLLHVGLDTVQLQGEGFEALVEEGARVIEGQPLLRFDLDRVARGSRSLITVMILTNGDGFQVRPLTTNPVEVGAPLLQLSPEKAEQRPANPAPGEGSAQRQVRGRARVAHHGGLHARPAALLRKTAQGFSSQAELHFAGQVASVDSLVGIMGLGVAEQDEVEVICRGEDSEAALDALLAALASATAGAPKEAPRAIAPGEPARPAAVAGTLAGVCASPGLASGPLARLGAISLPADDGRHRPEEQHLALDQALQRVRDDVQGSLQQARLGGDENEAAIFSAHLALLEDPGLLDAADMLIDQGVGAAHAWHRAIQAQCEILQALGNLLLAERANDLRDLEKRVLRVLLGDTAPLRVPAGAIVAAREITPSDLAPLVDAGAAGLCMAEGGATSHVAILARSKGLPCLVALGAGLLELEEGRQVVLDAGQGRLELSPDARRLEQVALQVAQREEQRRRQQADAQREALTRDGRRIEIGANVASPREAAEAFANGADGVGLLRTEFLFLERRAAPDEEEQRNAYQEVLDAMGQRKVIIRTIDVGGDKHPQYLAAAGGRKTQHWGLRGIRPGPGAPGAARPAVARAAEGRTTGTLPDTAADGQRGR

SEQ ID NO: 18116 - protein, 151 aa, Pseudomonas aeruginosa
MPPPRPGATGPGQRPGGARRLPATLAAGLTRTIGDHRHAPVPDRKPATPGPRPDAADRDRADRRPAAAPGRRRPARHSAGPRRRQGDLRQPGADLRHRHRRRFRSRQQWHRRPRRRHRLPGDDLGAQGDRSGHRHGRALRHHQRPGGWRPV

SEQ ID NO: 18117 - protein, 355 aa, Pseudomonas aeruginosa
LHRPGNRARRHRRPGALFRRRPEGRPVHGRDVPGDDVRPARRLPGDVPQRPSGAAQADRRAAPVDGLDRLPHRRHRAGGVRLHVPRAAALPAACAAHRPVHGPHRPARYPPRLHLLRWRHRPRPGLGPFHPRLDALAAGPALCRHLLPGVRLLHPPLQPEDPGPRRRREQRIGRQRRSRARPGIHPRPGWRSQPRSGGRLHHAPASAPGRPRQGLGRPAQGPRCDGRGTSGQGRQPAGGGRPTGRQHRRRDPPRPALRYATGRSRTAAGQSERSRRGGVDAGHRRRRRSPGLARRPRRRRQPARGTGRRTDPPAGQRGGRTQAGHRATASSRRTGRQLPRRRHLPYPGGPPRRGP

SEQ ID NO: 18118 - protein, 1452 aa, Pseudomonas aeruginosa
HDEYLTLPLRQISATFVRSSQHLRAGVHRFTLRPRKRRHLAFSPEAEGAWLPSQYGRSAERPQRHNSNRRSRVAWSVRPLRQSAGQSGSEAEAPQVQSRKVSPGETRRTSGKKVGATSWSPHRPPCRISPPRPGRWGNMRSQPPSSCQSSGRQEFLHGAEHPLGVRHHDGDPAVAAAQPGDAARRPVGVGRVGFGDLAVVVDETQRHAAGKVGLEQRFLRLELRMAFAMGDGDRQARTGHALQEDRRRLLHLDHRHPRLELLGTVAHEVRPELGAGNQLVQVGHHLAAVADAEGEAVLAREERLEAVAGAGVEEDRLGPALAGAEHVAVGEATAGHQALEGVQVDPPGEDVAHVHVDRGEAGAVERRGHLHLAVDALLAEDRHFRPHALLDVGRGDVVVDVVTELDRQPGVVFVQQRIELLLGAVGVVAQTLDLVAGLAPDALQDAALGAVDGLAVVVQVDLVAVDRLADHRHAVVETGGAELREDFRSGALANLDHRAQFLAEQHGRQLFAAIGQGIEVQLDAAVTGKGHLQHAGDQAAVGTVVVGEDMAVGIEPLDHREEGFQVLGVVDVRHGAAELAVDLGQDRAAETVLAAAEIDQDQVGLALVQAQLRGQALAHVGDRGEAGDDQRDRRSHALVLAIVLPAGLHGHRVLAHRDGDAQFRAQFHAHGLDRVIQARVLAGVAGGGHPVGGKLDVGQLADTRGSQVGDRLADGHASGSRGVQQRQRGTFAHRHGLAGVDVEAGGGDGAVGHRHLPGPDHLVAGHQPGDGAVADGDQEALAGHGRMAQDALDAFLQLQPGGVEIVAQLGLAGNRAVHARRLAEQDFQRHVHRLVVEMAVGDGQLALLDGLADHRERAALALADGLEGLEVGGVHRQHVALLRLVAPDFQRAHARLVVGHRAQLEATAAAAVVDQFRQGVGQAAGTDVMDEADRVALAELPAAVDHFLATSLHFRVVALHRGEVEVGGAGAGGHRRGGAAAQADQHGRAAKDDELGADADLALLHVFVANVAHAAGEHDRLVVAAHFLAVRGSDLLLEGTEVAGQRRTAELVVERGAAQRALDHDVQRGDDALGLAVGHFPGLFETGDLQVGHGEAGQAGLRLGAAAGGALVADLAAGTGGGTGERRDGGRVVVGLHLHQDLHRLAAGGVFAGLRIGEETPGDMADDDRGVVLVCGQHAFAVHLVGVLDHAEQALVLGLPVDVPTGIEDLVPAMLGVGLGEHHQLDVVRVAPQFAEALQQVVDLVLGQGQAQLDVGLLQRGATAAKHVDGGERAGLRMAEQLGGAFQAVQHQLGHAVMQAGGDLLGVALGQFALHIVGNAALQPVDLRQAAVAGDVGGLARPRRDGAEARHHQEQPSAGLLHRHARAVFQQPRQHLLLVGGERAGDVGEMRELSVQPGNGRYVLGQLLEQFAVAESGKGGSAAQDQHCRNSLWRREGVGAGRAGPQRPCILP

SEQ ID NO: 18119 - protein, 521 aa, Pseudomonas aeruginosa
RGESPYRPGARAEGGRTARDHPQQPGHLLPGPQRRNRLRIRTGQALRRAPRRRAEDRDRRQPRRPLCPAFPRGRPGARRGRPDPGTRRRRQRALLAHLPRRHPADHLPQRPAAPDPPGRPGRQAHHGAQGQQPRGAARRAEEAVSRTEVRRIRCCRSGRPVAHGRRRRHRPDPGRLQRTGDEPGVLPQRPRRLRLRRSPRAGLGLAGGRRRQPDERGQRVPRPGQEGRPAATPEGPLLRACRRTRLRRRLHLRPAPAATPAALRKPLQAERQAAGYRLAPARRHRLPGIAVAARRHLQDRRARPDDADQPDRPGDGRVQPARPEAEHPGRQQVFRADPQRTAREHQGTGPQLVRPGRLQHRRRAPGRRAQDGREGRPQPEQVAGREEDAAAPGAEAVVRQDPLRLCARRRDRALRTERAALLRHPHLGDPAADGRQPDRRERVAPARREQDAPGRRQRRRETLAAPSPQDSPSLASQAACSRTSVGQPAIRSAKPSRSPANSARVASSKPGRSPAIAFMKW

SEQ ID NO: 18120 - protein, 334 aa, Pseudomonas aeruginosa
IFSFPSREGEPSLRATASLLIRSKRKGQPKLPFPLIGASRSFPLDSRRRLARHVVGDPGDTGDLVDDAVRDLLQQFVGQVRPARGHEVDGLHRAQGDDPGVATAVADHADRFHWLEHHERLAGLVVPVEGAQFLDEDVVGLAQQVGVLLLHLAEDAHAQARAGERVAVDHVVGQAQLQADLAHFVLEQFAQRLDQFELHVLRQAADVVVRLDHVGLAGLGAGRLDHVGVDGALGEELHVLQLGGFFVENFDEGAADDLALLFRVGDAGQAAEELVLGVGADHLHAHVLGEHGHHLVAFVQAQQAVVDEHAGQLVADGLVQQRGDHRGVHAAGEA

SEQ ID NO: 18121 - protein, 244 aa, Pseudomonas aeruginosa
QDLGGTDLGAHGGDGVVDDVRGGPQRGATADVEDEARENAQALLGVGDFRVELHAVVGAGIVGHGGDRAARGAGQDVEAGRHLGDLVAVAHPHVEAEHAVVVHVVLDAVQQARLADHVDAGVAELAQVGALHLAAHLLGHGLHAVADAEQRHLQVEHRLRRARAVGFVYRLGATGEDDAARREGDDRLVAHVEGMDFAIHADLAHAASDQLGVLGAEIEDQDTVGVNVLGHGHLSLRNSKTTRG

SEQ ID NO: 18122 - protein, 503 aa, Pseudomonas aeruginosa
SGRRGHGDSAMPAPVIRTNCGWRAHLLDVGAAGVAHGGAQAAHQLVDDGGQGTLVRHATLDAFRHQLLGAGGGVLEVAVGRALGAGHGAQRTHAAVGLVGTALEQLDLARRFLGTGEHRAHHHTVGAGDHGLGQVAGEADAAVGDQRYAGAFESGGDVGDGGDLRHADTGDDAGGADRARADADLDRVGASLGEGLGGLGGGDVAADHLDVREGLLDPAHTLDHALGVAVGGVHHHHVDPGGDQRGNALAGIGAGADGGADAQAALLVLGRQRVGLGLLDVTEGHQATQVEVLVDHQHLLDAVLVKLGLHLFQRGAFAGGDQLVLRGHDRGDGIAGVRLHPQVATGDDTDQLALLHHRETGEAVLAGHLQQFDDLGRGGHGDRVADDGRFVLLDLADFRGLLLDAHVLVDDADAAFLGHGDGQAGFGHGIHRGGYQRDVQFDAAGQASFQTHVLGQDFGITGDQKDVVESQGFLTDSQHGGRSQTGKMEARHYTQPRASAQRS

SEQ ID NO: 18123 - protein, 423 aa, Pseudomonas aeruginosa
VPRTGRSQRQGRTQDQRDGLPPGVLQRHLRHSLHAAVHHSLRRHRCAPARQRRAYRRDRFRRSPGRRHPVLHQRPGTAPLQRPADPDHPAAGRVPREEPRCLARRQPLGRHLRLQLHPGHRPRLGAGSQPGSAVLREERRLLRQRPGTETALSPAGLRLLRLQPEHLRRPQAGARRWRRTEAAGPFPRRHPPALHPTRLRARPLAGPAQQPDVRSLAQRRHRQCFPWQPGPVAPGPCVLRRRSHERFRQDSRQRLSGVRQPRAARGHRGVRRDHPDHPDDRPRHRRATGDPVATEPGAGRRPVFGGAGRHEPGDAAGLPLAETCRLAPRGAASPACCSSPPTWPRHWPAATRCCSPCVSAAPLAGGSLMILCVSRAASTATPSLVYGLWVMGPTGGRRRRPGTAAGAVRTLRSGPPATCCWPA

SEQ ID NO: 18124 - protein, 592 aa, Pseudomonas aeruginosa
TPPTWSSAAGWPSARRWQDDSSKAAAVSSRCCRSPPAWPPSRCCWPWPAGHAETLSRTTDTRHDPTYRFLLRRTLPLARRRPARADPAGRRLGATACRRRTRRITGNQAPAEKPARRVRPDRPPATAQRTAGERRGPAARASGALSGTLQGVERRRRRQPRPGRADRPGQLRDRPALRRPGHRRAGRGARRRGGQRLLAVAAARSSLPAGPGDGLLFLRQHRRGHRGGQGAPRRRAGRGAGLGRPPRQRHPGDLLPARRRAEHFPAPGRLLPAWLQRRRRHRRGSRSWLQPQRAAASRRRSRRLHAGHATHRVASAGTLPPAIDRGRQWLRRQRGGPAGTHATAQRQLPGDDRDDPRRGRAACRRTPGGGPRRRLLGSLRAVLRLGCDRRTQRRAQRGARPAARLHRVAAAQRGVPRLPAPAPRRAGRTVRPVPGAAASSGQVAPDQRQAAAQHQPGDQADEGFTRQTQGHPTADPQAQRHARQQAGGEQPGLARGIQPGEQEQPQADEGATTDQRALGGAHLLLARQASVQVQRIKEAAAAEQRAEQPAEDTEGQRPGRPPARLAAWLEEQRVERIETDEHAEGQHQQLRA

SEQ ID NO: 18125 - protein, 175 aa, Pseudomonas aeruginosa
SWPVAAVPWKTSGASTKKRWRAPWRPAPRRSSARSATRPTYRSATSSPTCARRRLRPPPNCWRPTPATCSSVSTACAGAWCCACATSCCANACAWKASPAACAIPANACASRRSAWTTWTCACAVPSSASWRSATNAWSAWRRVSPHSIRAAPWRCSGRSSTASPRACRAPPARY

SEQ ID NO: 18126 - protein, 385 aa, Pseudomonas aeruginosa
IVNETTASVASLSCEHPAPRPDKKCRRSPDRSDCHKENNMHTNPRHGLARRFAAGLLAAALGLGGSLAQAATTLNLSYNGAADSEKNLVHLFASNLKRLAEEKSGGELQFKLYPNSMLGEEEQRMEQVMTGPGLNIASFAGIAPLFPEIYVSATPFMFKDAAAAHAFFDSGSYWQAAREAFRERTGTELLAVVEEGGFLNFTNGKKPIHGPADFQGLRFRAMDPSQVALYEAFGASGTPIPWTELYMGLRTGVADGQMNPTSYIILGSLYQVQKYLTLANIQYSDQFLVANGDLLASLPAKERQALLDAAAEATRLNREAVAAQQERDLAFLKEKGMQIIQPSADDLAAFREKGQPSYLAWLKTQDIEPRWTEMAFRDAGLATAP

SEQ ID NO: 18127 - protein, 453 aa, Pseudomonas aeruginosa
PSCCCSRGPGRGSRPAPPSREGRRHDGHRHDRSLRGQPPARPAAVPLPAAHRAGGVPLRRPGAVRQHPAAALLRRHGHLLADGDPAVRAGRQPDEPFRHDPAPDASGQRPGRPLPRRPRPRQRGRRGVLRRGQRVRRGRRFGTQHPAGAGHGKGRLLAALRRRADRGQLADRSDHPAEHLHDPLLLADQHLGGRAVPRRGDSRPAAGRRLHAAERGVRLPQRAAGAPCGAGLGRDPGGAVRRPDRADRAGDHRRRNRPGTGHAHRVGRLDRSLRGAGRSAPAPTEPGRAVELAARDGTPDRQHLRDHRRRFGGQLVAQLRPGRQRVRPVAGAVRPLADPDAVHHQRSDLRLRHAHGRSLGTDAADADSRSGGAGRRRGSGAPGADLHPEHHHRPDHPANGRLPVHRGDHQPPRYPGNVQGYLAVHPRGPGGAVAADPVPVPDPVAATPAQLTP

SEQ ID NO: 18128 - protein, 276 aa, Pseudomonas aeruginosa
AVTSASGRPTTSSAFLTRSRSATLAARSSSVSCGSPPPSPAACAWWCWTPGGRSPCSSISTTACPAPWPRTTHGPAKPSWNGSPASSSRRRAAAARRPARISPAARWTSPCATPRAAGWTWAAPSTKPCRPPTPPTSNAWRSPTRASDASAIIVACSITRCSTPVSATCPANGGTTISATSSGPGTPARRRRCSARCSCRRWTRSGASSCRSALWRTRRRRRAGSPAAAGRTRRRTAGATTPPNRSRPARRSPAPNARWFPAGAGPVPGVRPAATG

SEQ ID NO: 18129 - protein, 517 aa, Pseudomonas aeruginosa
AGWPDSSESCLSGHSLATPRRDQNPPHPLRRKRHVHTSTQTRLAGHRRTERIRQRQPAYRISRHPIVAGTYRRRHGCRLRGGHPDRRGAAPGAGGLAVVRARQPAGRAARGGRLAALPAQGGKATGQFLRRHRAGRLAARARHRHPRRGRLHDPALRRLDHPPGDPRRLAGGIPARRQRLGALPQPRRPGQRGRDPPDLRHRPAVLLRRRAQHRGVAGKPRRPARSGTRQHLRLQPASPGQPLKRRRPPTRGGERSADQRAARRQRLPARELAQPRVGHRAIGECPVRRRQVQALQRHTRAGAGLRRLPVLGDVRTALAGQEDAAVGAGVVHRPARGGGVHQHLQMLIGHLGAERRLQQPAVQAQVHRPVPGGLLLGRPLQETTEDGQAIRRIDLQQFRAKVVEMVPGAAQALVELVRTQGGVLRRQAGSHHQAGLRRQGISVAVHALNLARKGGAPGAPARHGAQWPCCSCPPCSAGALDSTTISTGTSPALRKCSVSGKRSPATSGCFRPISIRW

SEQ ID NO: 18130 - protein, 162 aa, Pseudomonas aeruginosa
NRANPLIPTEVRMSRQSVAVVAFDRISPFHLSVPCLVFGQECYDPCAQAFDLRVCAAEPGRLRTTVGFTIEAEAGLEALAEAQTVIVPSWRDPHERPPQALLDALIAARARGAQLVGLCLGAFVLAEAGLLDGRRATTHWMWAEDFAGRFPAVRVEPDVLYI

SEQ ID NO: 18131 - protein, 166 aa, Pseudomonas aeruginosa
DDGLLTSAGTVAGIDCCLHLVRQRLGAQTTNHLARRLVVAPHRQGGQAQFIEQPLPDSAQDGRLGELLVWLRQNLDQAHSLDSLAQRVLMSRRTFTRHFRQLTGTTVNQWLQAERLALAQRLLETTEHSVQAIAGLAGFGSAVSLRQQFSAAFGLPPLGYRRAFAS

SEQ ID NO: 18132 - protein, 528 aa, Pseudomonas aeruginosa
AGQTLKSRLSPSASSGVPASTMGMPATACQSGSGRTGMAWVKSVMASIEQAWQPQGQGREQDQQRQHPQGHEDERPDTLEHFQDIEAADGRHDEQAGAHWRGDQGDGDVQGEDQPQVHRIHAGGQRHRSDYRRQQHQYRDFFHEHAADEDHCADDEQHQGRRVAERLQQLGELAGDLGVVEQPVDHRSGGDDHVDAGGQAYRLAQRVPQPDQAQLALEQTDQRHVESDQGARLGGRDQSQDDSGDDDHRRDQRGQGAGQRRQDLAPGRRRMARLQPVAVGVHRVQQHEGGGQQQAGNHPGEEQLAHRGVGQRGVEDHEDARRDDRTDQRAARGQPGGEAPRVAFLFHGRHQQGAECRSVGRGGPVDPGEEHPGDHVDVAEAAAEVADQGVGQTHQARGHAGMVHQVAGQHEQRDRHQREDVHAAEEALRQGVGEQRRVDEEEPHQRGEQQAEEQRQAEQEVDHEGCDHGDGHHACDPPSTVVLAGCRGQGPWSNSMRVSRPKPSGRLSNGQVRLTPRPRLRKRPAFSA

SEQ ID NO: 18133 - protein, 285 aa, Pseudomonas aeruginosa
RRSFSTSRAARGRRAARLSSFCRSSARVRPGCCAARRVSRRTRRSWRTASWRSKARRRRMSRSSRRCACWRRRSPGWRRRRATPSRRRRSRSNWSRMRSTRRRRRPSRRCCRSPALGASSSAAAEGVGARTSATKSLIDTSVSWPTALTIGVAQAATARATASSLKHQRSSREPPPRARISASKPCRSASCSARTICATASRPWTAVGTRVSSTCGARRRNTLMMSRITAPLGELTIPMRRGWAGSGRLRSLANRPSPASFSFNASKARRRAPSPAGSTVSAINW

SEQ ID NO: 18134 - protein, 359 aa, Pseudomonas aeruginosa
SLRPPGHLAGAVQRPGAGRALPGRLKRLRRAQAELCGQLFEALALEVAERRVGLLQLDEVAQRVAHRAAHAAEFFDHSQAAERHVGFRVAAFVDHHQASAGMPLGRVADHRGHRPEAVAVQLHACQRVHRVGVEATGDHDQLRAEAFQRWQHDALHGLHVGVVTAAGKQRHVEVEATTAILADVFGAAVARREAAVLVQGNAQHVVAPVVDRLGAVAVVDVPVQHRDPLDAVARLGRLDGHGDVGEETEAHRLVRQAVMTWRPRQRVGVVRLAGEHRVQRGDGQAGGEPGDLVAARADRRVLAEAAAAGVAQRLEAFQIVRRMHAQQVLVARRRCAAQLQAGGQAGHVEQAFQPALGFR

SEQ ID NO: 18135 - protein, 155 aa, Pseudomonas aeruginosa
FGVSGGGRRLHPAADRQGQRVRAGGVPEAEFVEEESGTSGHGGYPWFGKGFQRGRQARASSSERAARPAAIGSSGRKPPLPSMSRPASAGPMASPPPMTRLEAFIRRPDRSRSARQARMNGRAKVQVNLNSSAARAKRASGGWPISRRIAAAIAR

SEQ ID NO: 18136 - protein, 291 aa, Pseudomonas aeruginosa
HREGQDLPAGVQGRAGPPARRRRRRHRRRYRRARCRAGRRRGRRGGGGHRPRPLQGRDRACALGQADLPGRPGDRRQHRHRRGRQGPRRGWRRRGQGRHRPGLDLHHPHRRRCRRAADLRHRQRRRRSRRHRRTADRRRRHPLLRRPGQGHGRRRLLCDDGLDVRRYRGSAGRDRAVPGPFLQVLPRHGFAGRHVRLPGLVRPLLPGRLRRRREAGAGRHRGSRAVQGCPVRHRPPADGRPARRHGLHRQRRHPADAHASRSSSGSPARAWPSPHVHDVQITKEAPNYRVG

SEQ ID NO: 18137 - protein, 552 aa, Pseudomonas aeruginosa
VLHGAVRFSPVSFSNSVARDGHVPRHSRPPYPDPRFRLPVHPTDRSPRARDRRVLRNPSLRHEQRGDHRLRAARHHPRRWPRVGTRSRQPARAAGGVRPEGAAVRHLLRHADHGRADGRQGAGLRPARVRLRPRRRGRQGAPAGRHRGPRGRRRRARPRRVDEPRRQGHRDAGRLPHPGQHPELPDRRHGRRCPRLLRRAIPPGSHPHQAGPAHSLALRPRHLRLRRAVDPLEHRRRRHRHRARPGRFLQGPARPLRRRGLLGGRRAAAQGHRRPTDLRVRRQRPAAPARRRPGDGHVRREHGREGDPRQRRGQVPRPPGRRRRPGREAQDHRPHLHRSFRRRSHQAAGREVPRPGHHLPRRDRVGRRQDRQGPRDQVAPQRRRPAGGHAVRTGRAAARTVQGRSAQDRPGAGPALRHGLPPPVPRPGPGRAHPRRGEEGVRRPAAPGRPHLHRGTARLRLVPQDQPGVRGVPASEIGRRGRRRPSLRLGRRPARGGDHRLHDRALGAPALRTAGEGLEPHHQRDRRYLPGHLRRVEQAAGDYRVGMIGSRR

SEQ ID NO: 18138 - protein, 511 aa, Pseudomonas aeruginosa
EERAASAALFVCSGSAKRRLHGAMARLRGWEMRKSIISQPQYREGEGSMTFTRRQVLGGLAGLAVVGLGAGGARLWLARPQVAQEYDYELIAAPLDLEIVPGFSSPALAYGGQCPGVELRAKQGEWLRVRFTNRLDEPTTIHWHGIRLPIEMDGVPYISQPPVQPGESFIYQFKTQDAGSYWYHPHLMSSEQLGRGLVGPLIIEEREPTGFRHEKVLCLKTWHVDEQGAFTPFSVPRQAAREGTRGRYSTINGKHVPTIDLPAGQIVRVRLLNVDNTVTYRLNLPNGEARIYAIDGHPVEPRGFEGQYWIGPGMRLELALKVPEAGTELSLRDGPVRLATIRSVASAEAPAGDWPKPLPANPVSEPDLANAEKIGFRFEWVGAMSDTSGKNPYPSFWQINGKAWEGGEEHKHNAPPLAKLKEGQSYIFELRNMAQYQHPIHLHGMAFKVLDSDRRDIIPYFTDTYLLGKNETARVALVADNPGLWMFHCHVIDHMETGLMGTIAVGEAWCG

SEQ ID NO: 18139 - protein, 492 aa, Pseudomonas aeruginosa
YFARPLEQAARRQWLQVRASPPADTPAGPRSRKARPVRRRPRFPALHCPRRRPSVRRSWPPPAQCQFEMQGVVVMSDTRVQQYQDHAGAEAVDSSGLEVKRLTFLEAVAMIVGTNIGAGVLSMAYASRKAGFMPLLLWLAVAGLFTTISMLYVSETALRTRTHNQLSGLAQRYVGSFGAWAIFLSVAVNSIGALIAYMSGSGKILSAFFGISPALGSVLFFIPAAGVLYLGLSAIGKGEKFISIGMVSMILILVAATLLNDNTEFARLLDGDWIYMVPVFNIAVFCFSAQYIVPEMARGFSHAPERLPKAVITGMLTTFVLLSIVPLSVIALTGLENQSEVATLAWGKALGEWAFFTANTFALCAMLTSYWGLGGSFLTNIFDKFHKLGPENRPKTRLLVLAIVALPPFVLAYSGLVGFVNALYFAGAFSGVILSIMPILMLRSARRNGDFEPAWKCGWIAHPAIQAVIVTIYLASAAYAICSAMNLLPAGW

SEQ ID NO: 18140 - protein, 536 aa, Pseudomonas aeruginosa
MRWPATCRASRRRRVRCSPGIARASPSGSPAGRPMCASTPPGWQATENPEGRGRLEFLVAAVFFRARLVHAGQVQPALGDLAAFHLRLGHPGEDVVVAPHVLYEVHGLAAARIAVAGLGVPLLLRQARQHLLHVQPLVRVEAFLLGHLARVFQVRAADVVGGQGEPAAVRFLDALGQFAADLHEILAAALDALLRVEPVGHAHRLGGPVGQHHQAAHAGLGGGAGLPQRFLVADGGEQAPVGIQLLAALLEVAFVARQALLQVLGEGVGADVAEYVDMPVVTVLQALQQAFLLGLVEERVDLVHQAVVVAPRQGPGQPAGFAEVEGDADVGEVHLVHRQFVGVDQGQVDVADVDHAQQVDHFDSIGFFVLQFGILLLQLGELLRVAAALEHHDALADQVFRAGRALLAVAVDDLRGDVEVGVRVAHAGVVFASRGQAGRGERRAALAGKLGIEVVEVVGGLDLQLDAEALGEALGQFVFEAGFAVAVLEVGGRAVAGDHAQYALLLHALQGGRGFRLATARKQQKDAGRQQPGGAT

SEQ ID NO: 18141 - protein, 252 aa, Pseudomonas aeruginosa
RRCRRPVQRPAGTDQRRRPRRSLRAARGAQRRAGHEPAGNLVQRVAGALRAVGGRRRLRDLQGHLRARALPVRGGRRGHRAAPADRRRQPFRQQAGGHAAGSPARQGAAHAPRGYPRGRAGRRFRRRRAGAAGKRRARPAPSCRGQQELPDHHRRPHHHRAGGPRPDGRALAGAGGRLRRHRHQLRRLHRRGHGDGRTYPAGAAGRPGFRTHGHRRDGHQPGCRAYRQAVRHQAFRQLDGRRRPPRRGRAPV

SEQ ID NO: 18142 - protein, 161 aa, Pseudomonas aeruginosa
HGQGRGHGTVPGTGHHHPGGQGLDVHEDPLAGQWRGQERDFSGLADRHRLRPGRRRAPEPDPATAPGQGRDRPDPDRSRPRQEPSRRLDPGPGPRQARPRRAGRRRRRGPESLLRGDPGAQCRRPYPRLPRPFRRRPDHQRAGDGLCRSLRRRVEPRCPGR

SEQ ID NO: 18143 - protein, 384 aa, Pseudomonas aeruginosa
PRRVGGRVVQRGTGRGDPGSRGRHSGSPRAVQRRRSRRLRGGDRPAGQRLRDQPELQRRGRLQRPAPHPATHLERDQLPDPASARQRRLRRAGVRCAAGRRQPRAVDQAQLRRQRRHRRALHQEGRAAESGDPPRAGRQRPGGDGRGVRPRRLRRDRRAHERHPRRAGRPGRLQGPGGLRWLLLRRRARRRRGLGQVDPLQRPRPRRLPGVLRAQGQLRPRRLQRLPDDVQPARADSRHRVLAALRAQPFRAVRGAGGDGPGAGVVVDLPAGHGRFAPADRHRPWRRPCGVRVGGSVARGRPFRLRVAAFRRQPRQGHRSLPGQPQRVAARHHRAEQPRRPGHHHDAAPRAGVPRRAEIPGVRTTGRKTAAGCACSPNARVWVD

SEQ ID NO: 18144 - protein, 673 aa, Pseudomonas aeruginosa
PTWSSEFSSDKQEGRPVAALFVIRLTGRVRPGAVAWREQPLRDYRTRTGELWRRANNRLAVIRRLAEVQPSCRQRRSSGCRAWLRARGAGAHQDMADAAGEGADALSAETTQLLGGQLAFVRHADPQAGQCDVPYLAQVAGAAEGAEPGLGFGGVDGGLHRHHLFGCVRTAQRRYGFARLRIEGQGAADLVGDAVGLWADHHLQAAGLARTYHGHRTEGLELGVRGLVAVDQAQTQARGAGVHHFEVGCATQGADECRGALGFGVVARFAARVVFAARGLQVEAADAEVEHQVIDAGIEQAQRPEHPAVGGTAPAQGEVDGATGEGEAEADIEQVGEGHGQAGEQRMQQVEQRREEHEGELHRLGDAGEEGGQGHRQEQPADQLAPLRTGVAVHRQAGGGQAEHHHREHPGHELAALRVAGEIARQVAGDDAPGFRVGEATEDEPHQVVEDVVQPGDDQQAVQHAEGEGAEAAAFQHELAEAVDALLQRWPDHPEQQAQADRADPGGDRHEAAAAEERQVFRQLHVLEAVIQGASHQAADDAGEHAHVDARIDHLEHRDHHQVADGAGEAGGAIVVASETDGDADGEDQRQVGEDRLAGVVDQRNVEQVDVAQAQQQAGDRHDRDRQHQGAAQALQAFDQERGHGGGLRLFLSGQRPVLQAGVAHRPGAAQVQ

SEQ ID NO: 18145 - protein, 217 aa, Pseudomonas aeruginosa
RLGVAAAFSGVELAHPGLDLADQVRPDGQFLDPEADQYRCRQRVRGQRTADADPSAVAGCSGAGLGDQSQQRRVQGVDAVGQAGVATVHGQGVLRQVVGADGEEVGVFGQLIGEQGGGGHLDHHPEFGQALDPQLRGQLAEAATDGAQFIDLADHRQQYPAAFQWFDPQQRAQLLVEQLRARLARGGCRAGPSAGFFFHRQRPGIGGACRRRHRWCG

SEQ ID NO: 18146 - protein, 188 aa, Pseudomonas aeruginosa
VDRRGADPGHEEIAMKYRLGDARVETHPDSWIAPSAAVIGKVRLDAGASVWFGAVLRGDNELIHIGEHSNVQDGSVMHTDMGYPLTLGKGVTVGHNAMLHGCSVGDYSLVGINAVILNGAKIGKYCIIGANALIPEGKEIPDGSLVMGSPGKVVRELSEPQKKMLEASAAHYVHNARRYARDLVEDPA

SEQ ID NO: 18147 - protein, 432 aa, Pseudomonas aeruginosa
ATTSAARCSVAVSSAPRRKGWSAVPPEADSVFFHFRGSSMTRIGTPLSPSATRVLLCGSGELGKEVAIELQRLGCEVIAVDRYGNAPAMQVAHRSHVISMLDGAALRAVIEQEKPHYIVPEIEAIATATLVELEAEGYTVVPTARAAQLTMNREGIRRLAAEELGLPTSPYHFADTFEDYRRGVECVGYPCVVKPIMSSSGKGQSVLKGPDDLQAAWDYAQEGGRAGKGRVIVEGFIDFDYEITLLTVRHVDGTTFCAPIGHRQVKGDYHESWQPQAMSAQALAESERVARAVTEALGGRGLFGVELFVKGDQVWFSEVSPRPHDTGLVTLISQDLSEFALHARAILGLPIPVIRQLGPSASAVILVEGKSRQVAFANLGAALSEADTALRLFGKPEVDGQRRMGVALARDESIDAARAKATRAAQAVRVEL

SEQ ID NO: 18148 - protein, 158 aa, Pseudomonas aeruginosa
LAPDAVAEMAEQRRAQRTGEECDAKGEEGADHLRGAGCLRDEYRTDHQGGGSGIDVQIVELDGGADEAGDCDPGGRVGRFRSGVRGDGGGGHGGKVPGNRGTTECFRAAGWLWPVRRCGGAAPGWGGRDRSRREDGDARRAPAGTVGIGAGRAGGTGG

SEQ ID NO: 18149 - protein, 220 aa, Pseudomonas aeruginosa
LPAKRLVQLAQVGAAVDDEAAVLLGMDIRVVEAVEVVEVADDLFEDVLQRDDADHLAIFVDHHADTALLLLEVHQLGRQRRAFRHEIRLHAGLAEILLGQAALGQQARDLAHVHDPFDLVDVVAVDRQAGVAGGAQLLDDDLEFVVEVDAFDFVARDHQVVDRDLLQVQQAEQHVMPVDLAGLGVVGRMQGLFVAAASAVVLFRRSDAEQAQQRVAQQGQ

SEQ ID NO: 18150 - protein, 319 aa, Pseudomonas aeruginosa
PQQGPAEALQDQERQAERQGDAFRAKGAVAARQQGAEQQQEQGHAGDGDGQADDAPVAQRGPTGQGGGADVDQGAAEQQGAAQAVVVQQQPTAAPGPAQALLGLQAQAVTVEVEQGGLDAGEERRAGDQENQQADQVPGVQLIHEGGPSDVQDEFPHQLAAEVRQHQQAETGQGPADRLVAPPAELVATPEEHGEDHPGEAGQDGLVRQVLGEQVVDEQPSGQQRQRKQRPAAPEEAEQQAFHGLQGREVADQPGRMLVLEAVVLEQQQERLEHRDGEQAVGQDREQDVGQDARLFVDRLDGAVGDEYRQQGGEGAQRE

SEQ ID NO: 18151 - protein, 494 aa, Pseudomonas aeruginosa
GWPPVVAGHTLRLSSRVPRRALGYNPPLAATPVEGSRMFENLTDRLSQTLRHVTGKAKLTEDNIKDTLREVRMALLEADVALPVVKDFVNKVKERAVGTEVSKSLTPGQAFVKIVRAELEELMGAANEDLALSVAPPAVILMAGLQGAGKTTTAGKLARFLKERKKKSVMVVSADVYRPAAIKQLETLAGEVGVTFFPSDVSQKPVAIAEAAIREARLKFIDVVIVDTAGRLHIDADMMDEIKQVHAAIKPAETLFVVDAMTGQDAANTAKAFNDALPLTGVVLTKVDGDARGGAALSVRAITGKPIKFLGMGEKSEALDPFHPDRVASRILGMGDVLSLIEQAEQNLDRDKAEKLAKKIKKGKGFDLEDFRDQLQQMKNMGGLGGLMDKLPMLGGVNLAQMGNAQGAAEKQFKQMEAIINSMTPGERRDPEMISGSRKRRIALGSGTQVQDVGRLIKQHKQMQKMMKKVTAKGGMAKMMRGMGSMFPGGMPKL

SEQ ID NO: 18152 - protein, 84 aa, Pseudomonas aeruginosa
RCIPLPTRWTTCWTIAAGRSGATARFGRPSWSGGACMARSWPPSSRGSTIAKRPAPSPVTRSASRVASCPLSRKVSTTGTSWKA

SEQ ID NO: 18153 - protein, 316 aa, Pseudomonas aeruginosa
RPGYERLAALSFGSQPSSMSTLEHPLIDRFLDALWLEKGLADNSREAYRNDLQQFNAWLDGRRLRLGGICRYAILDYLAWRLEQGYKARSTARFLSGLRGFYPYCLRDGLIAEDPTLQVDLPQMGKPLPKSLSEADVEALLAAPEVDDPLGLRDRTMLEVLYACGLRVSELVGLTLEQVNLRQGVVKVFGKGSKERLVPLGEEAIGWLERYLREARGDLLGGRPSDVLFPSLRGEQMTRQTFWHRIKHHAQVAAIGTSISPHTLRHAFATHLLNHGADLRVVQMLLGHSDLSTTQIYTHIARARLQDLHARHHPRG

SEQ ID NO: 18154 - protein, 243 aa, Pseudomonas aeruginosa
  UNSURE (213): Identity of amino acid at the above locations are unknown.
HMRVTRFLAAAALGLMSTLALADNADQNIRKTLQALQPDLPIDSIASSPLQGLYQVQLKGGRVLYASADGQFVMQGYLYQVKDGKPVNLTEKAESQAIAKAINGVPASEMVVYPAKGQAKAHITVFTDTTCPYCQKLHAEVPDLTEQGIEVRYMAFPRQGPQSAGDKQLQAVWCAKEPTKAMDAMMNGKEIKSSECKNPVDKQFQMGQMVGVXGTPAIVLANGQLLPGYQPAKQLAKLALEAK

SEQ ID NO: 18155 - protein, 490 aa, Pseudomonas aeruginosa
CAALLFSSLAISAARWRNPSPGCVVARTVVASTSIRSGNHSRPARPAVVGEMGSSSVKPVKVGICGLGTVGGGTFNVLKRNAEEIARRAGRGIEVAQIAARRPNPKCDTGATPITADIFDVACNPEIDVVVELIGGYTLAHELVLKAIENGKHVVTANKALIAVHGNEIFAKAREKGVIVAFEAAVAGGIPVIKAIREGLSANRINWLAGIINGTGNFILSEMREKGRTFPDVLAEAQALGYAEADPTFDVEGIDAAHKLTILASIAFGIPLQFDKAYTEGISKLTSADVNYADALGYRIKHLGVARRTESGFELRVHPTLIPSDRLIANVNGVMNAVMVNGDAVGSTLYYGAGAGMEPTASSVVADLVDVVRAMTSDPENRVPHLAFQPDALSDHPILPIEACESAYYLRIQAKDHPGVLAQVATILSERGINIESIMQKEAEEQDGLVPMILVTHRVIEQRINDAIAALEALEGVSGPVVRIRVEQLN

SEQ ID NO: 18156 - protein, 209 aa, Pseudomonas aeruginosa
CESMQRKSSAHYQRVFRQRLREQGLVKKEVWILPENAAALAGIERMLRRPAAGAAHLEKEEDMTEARVWNARSLAEALSGTELFSSGEAQIELIEGAEASLYVIMREYGDLPVFVAPQGEQIIVEALLWPESDVTDATAFNEEVLLSRQLFPLSSIGLLNLPGEERCYSMFGALSTTSSLASVLHEIETLAGNVIRATEVYAGYLKARA

SEQ ID NO: 18157 - protein, 238 aa, Pseudomonas aeruginosa
RKRARPDRPAARRRRPGPFFRDRATMEGFLQTALSFPTVLFSFLLILAIIYWGIVALGMVEIDVLDLDAESVVDGAGQAEGLAALLAKLKLNGVPVTLVLTLLSFFAWFLCYFVQLWLLSALPLGWLRYPLGAVVAVGALFLAAPLAATLCRPLRPLFRKLESTSSKSVLGQVAVVRSGRVTLQHGEALLEDGGAGLILKVRAEENKGFKRGDRVVLLEYLEAEHAYRVVTEEEFRGI

SEQ ID NO: 18158 - protein, 222 aa, Pseudomonas aeruginosa
SPKPGATRSAAWPTPGCSRRRPRPRRRTAWPEAQGAGREARRPGARRGAARRGQGQGHQGPGQRGSGSTAAAPECRGRGAWQEVRRPGCPQRQRSPARRVPHAAGEELRGGHGGHRREQGHRQGAGRGARHRAGQGEHRDRRRRGRLLQLLRQVAVGGQGHRRCGRQEPGGAGRPRPPAQRPWRSRCGDAGTQERPRERAGGGSLSRPAASSANCGGVPPAP

SEQ ID NO: 18159 - protein, 1778 aa, Pseudomonas aeruginosa
AAQPLAWPVGCARGRPLGPVSIDDRRRPRKTRMSDTQAATPAQDVLDKAVAEGGAYEVLHKRLLEQGQRLRQTAERLNASRLEEFGDSQMDVIGRVRIRTENNCIARDIVQVGDCLLFGYNVFIGLRKETGVADVFSLYRLVEGSEGYEAEPVPLGDSFLAAPGFVNDFNELYTYYKNTRLLQLAIRDGKLLASFQIGERITDIRVFRWSISSDGSEVRYIDNRGERDIALPAPFDFEWQRATREMVVEGRFPHLNILDTLFVETIGGDLTIKVENNTEVGLGIYREEVMDKTQSLDDAQVEFARLGSLLLLKVLPYREEQWRYLVFNSLTGKVERIDAIGLACIQLPEDHGIIFPGGYYLQNGEYRTFEQSMEGMRFKRSVRSPNGEDVQYVFYHPEQGRNVLLTYNLINRQLQNPLFGHGYARLEDGRMVIFAAEGEEPTRIHPMQVWQTPFCTEEYAARQPARSGFLGRIGNAELVRGVSDLYDLCREIETPAVSIQRYSLLCQNTQRLFDVYHWLGSDQLDGLAPLLREVAATAELVLDEYEKVESIRRQSAQAMIDAEERHKALLSGLLPDGWDRVQQFVDGLNGITAQRGLLLTIREYRYIDVARLDAMEAELLAAHERVAAATATFLASEQALQPLLERLQSLDGEAQKAETVAQLGEPLAALEAMAGDLDMLSSLMASLRIDDATQRTRIIESISEIYARLNQAKARAEQRRKGLGSSETVAQFGAQFKLFGQGITNALAQAQDPERCDEQLSRLLVQLEELESQFGDHEQFLGDILAKREELLETFEAHKQTLLDERQRKAQGLLDAARRILDSLQRRTARFTQAEELNAFFAADPLILKLRELAERLRELKDSVKADDVEARLKAARDQAVRALRDKSELFEEGGDVIRLGPRHRFSVNTQELDLTLMPRGDALYLHLTGTDFLEPLQDPRLNELREFWQVNLESESETLYRAEYLAGEVLAAADAGRDGFSLERLQALLAQPDELARAIRDFAAPRYKEGYEKGIHDHDAAAILVRLLPLRESAGLLRYAPSARAFASLFWSRRREEREVAGWPERARSSRSIQQMFGRDDGLLALRGEVAAAMRALLAEQPIALDPQHIDEAAEYLVWELSAERPEFTFSKYARQLQEGLKLRLQGARLWDDYRQTLERLGERPAAQWELAGNWLRGLCGDAEFQPLAAYLDEAVALSLLDEEMPRRITEVDLRFQVDGLMGEHPRIFERGLALAVDDFFGRLRRHRQQFLPGLRRYQALRQEIVEREREALRLAEFKPRPLSSFVRNKLINDVYLGVIGDNLAKQMGTVGENKRTDLMGLLMLISPPGYGKTTLMEYVAHRLGLIFMKINGPALGHEVRSLDPGQAPDATSRQELEKLNLALEMGNNVMLYVDDIQHTHPEFLQKFISLCDGTRRVEGVWKGRTKTYDMRGRKFCVVMAGNPYTESGEVFRIPDMLANRADIYNLGDTLSGMQEAFSLSYIENALTSNPVLAPLATRDMADVYRFVAKAEGKPFSSNELAHGYSGAEINEISSTLQRLMQVRDVVLKVNQQYIASAAQADQYRSEPPFKLQGSYRNMNKMAEKISAVMNDAELLQLIADHYQGESQLLTTGAEENLLKLAELRGNQSPEQAERWAQIKRDFLRNKSMGGSDADVGGRLVAQLNDLVESVRGLAREPQPVQPAPWDELLAGLRQLGQGAPALNVEVTAPAQPGVQQVLESLAACLQDSFLPLIKVMDRKIDVDLRTHNRINEISSRLDELGRLLGGEQRPLENDQP

SEQ ID NO: 18160 - protein, 236 aa, Pseudomonas aeruginosa
GHEEREMDFDGLDRQLRDSLADLKLSNEERDELRQLGSELAPDQVRFLRNRAFDLVRELVLVEEQGERIAALKWLELVVRTLEVTAAAPRSRASAYFSPGEECRRKIRELCRQARQSLDICVFTISDDQLSAEILACHRRGVPVRIISDDDKQFDEGSDIHALREAGVPLRIDDSPFHMHHKFALVDGAWLLNGSFNWTRSASVNNEENLLVTDDAVLIGAYRREFEELWGRYAPR

SEQ ID NO: 18161 - protein, 514 aa, Pseudomonas aeruginosa
ASAEYFGLKKPGELNKMKKVSTLDLLFVAIMGVSPAAFAADLIDVSKLPSKAAQGAPGPVTLQAAVGAGGADELKAIRSTTLPNGKQVTRYEQFHNGVRVVGEAITEVKGPGKSVAAQRSGHFVANIAADLPGSTTAAVSAEQVLAQAKSLKAQGRKTENDKVELVIRLGENNIAQLVYNVSYLIPGEGLSRPHFVIDAKTGEVLDQWEGLAHAEAGGPGGNQKIGKYTYGSDYGPLIVNDRCEMDDGNVITVDMNGSTDDSKTTPFRFACPTNTYKQVNGAYSPLNDAHFFGGVVFKLYRDWFGTSPLTHKLYMKVHYGRSVENAYWDGTAMLFGDGATMFYPLVSLDVAAHEVSHGFTEQNSGLIYRGQSGGMNEAFSDMAGEAAEFYMRGKNDFLIGYDIKKGSGALRYMDQPSRDGRSIDNASQYYNGIDVHHSSGVYNRAFYLLANSPGWDTRKAFEVFVDANRYYWTATSNYNSGACGVIRSAQNRNYSAADVTRAFSTVGVTCPSAL

SEQ ID NO: 18162 - protein, 383 aa, Pseudomonas aeruginosa
SSGVSFIPRPTGSPAMSLLFEPLSLRQITLPNRIAVSPMCQYSAQEGLANDWHLVHLGSRAVGGAGLVIVEATAVLPEGRITADDLGIWSDAHVEPLHRITRFIESQGAVAGVQLAHAGRKASTWRPWLGKHGSVPISDGGWIPVAPSAIPFDPQHTTPEALSEAQIEALVQAFVRAAERSLAAGFKVAEVHAAHGYLLHQFLSPLSNQRRDQYGGCFENRIRLLLQVTAAVRKAWPQELPLFVRLSATDWVEDGWNPDETVELARRLKDLGVDLIDVSSGGTAANAEIPVGPGYQTEFAERVKKEAGIASGTVGMITEPVQAEHILRTGQADLILLARELLRDPYWPLHAADELRNEQMPWPPQYLRAAHRSTPPRKSLEMQ

SEQ ID NO: 18163 - protein, 435 aa, Pseudomonas aeruginosa
AIRIRAERLAILPGATPCPEATMDSPSTLARPHPQASPRWLAVANVIFAGIAAALHVGKATIALPSLQRSFGGDLAALSWIMSAFPFVGVFGGIAAGLLVRCWGDRRLLTVGLAILGGASLLGASMQDFAWLLATRFVEGLGFLIVVVAAPAVLHRITSETRRSVVFGLWSTFMAGGIALSMLFGPLLADWRADWQLSALLVLVAALLLPLSVPADDGCRAAGVRPAGLGALLKVPAITLLALGFTTYNLQFFALMTFLPVFLMQRLGVALETAGLIGAAIVAANALGNVAAGFILSRGIRPGALLASTAILMGLTGAAFFHAATPGLLAIALGFVFSAVAGMLPTTVLATAPLASPAPSLTPLAIGWVMQGNYLGQVIGPLLIGLIVSRFDWSGAIGLMLVAGAAGAVLGFCLLRALDGLPRAIATGSAARPAD

SEQ ID NO: 18164 - protein, 192 aa, Pseudomonas aeruginosa
PRDPPGHRRCGQGRRPHRRARTADDRRRGGQADQRPRGAGLAGARAEQAAGPGRDRPCREHPGDRRGDVPGQPADGRRGKLHGALLPRGAGAAAAPGALVQAGAGEPGQTGAATPGLRRRSVVPRITAAIRAAALPKGRAEPLARAGTAPAGSPRPPAGAPSGATPAECSSSTRAGCFPRAAPVPATDRGYP

SEQ ID NO: 18165 - protein, 506 aa, Pseudomonas aeruginosa
GAPRDRPERRRDRFAVPAATLRDRPAGPAGAARRRGRPRVARGRWQSPGSPAAAHDLQGRRRSHPQPDRRQPMGQAGHGSALPGEPQRAVVDGAEPTGRLRPLRSAAALGQPRIPRPAALAGSLRRAAACLPCVHRVGLRPASAQPGNGAHPLARPGRGAVDPAQLPERSARPEGRRRRHTPDPPHRRRTGAGRLPSAGIQARPGIPQRRGSAARCGGDRHHHLPPCRHLPHGPGAASGGGCAIEGARNPRPAHRRCLDHAQPDLRQHLFAGAGDRREGGADDSRRAPPRGRAAGRRKRHGGRRQGGGGGLRIATPRIAWRPAPQRSTLKTEMADNNKSPHKGRESRNDRVRNDPFLHSACDHAPGGAQGDLRLLAGHGLRVVRLLPLRRPGGGDQQAVLRRRQRHHGLHLRPDGLRRRLPGAALRRAGVRPHGRHDRAQVHLPGDHPVDGVVDLRCRPAAHLCLDRGRRADHPGHLAHAPGPGPGRRVRRRGDLCRRARPGEQAR

SEQ ID NO: 18166 - protein, 189 aa, Pseudomonas aeruginosa
TWWRTGCATAYPASKSEAVTVSRSTGDHRRTSKLFLLFRMEGDRYALDAREVVEVLPLLRLKRIPEAPEWVAGVFSHRGVLVPVLDLCAMAFGRAALARTSTRIVLVEYRARQDREPVWLGLILEQATDTLRCEPSAFRDYGLDNGGARYLGPVYEGPRGLVQWVRVEALLPDEVRALLFPPECGEGTA

SEQ ID NO: 18167 - protein, 231 aa, Pseudomonas aeruginosa
TKMVEASLTLLDTQQVDDCWNRIGVHGDKSCERLAEHVHCRNCEVYAAAATYLLDRIALRQDQLDSAETMDSQREQSDLGETRSILVFRLGEEWFGLATGSLVEVAPMNPIHSLPHQRSRALQGVTNVRGALVACLSLGELLDLEPGAAPVSERRVVPRMLIISAAGGPVVAPVEEVDGIHAIPLARILPPNHADGQASRRHVAGVLQWRERSITLLDEGPLLQAVARSLA

SEQ ID NO: 18168 - protein, 506 aa, Pseudomonas aeruginosa
LANASRCWCSTSPISTSSPGRAASVPMCSTTRRLASRMRPFADVLSGQARMVRDLGRSLGKQVRLLVEGESTQVDRDVLEKLEAPLTHLLRNAVDHGIEAPETRLAAGKPAEGRITIRARHHAGMLVLELSDDGGGIDLQRLRETVLNRQFATAETVAQLSEEELLAFLFLPGFSMREQVTEVSGRGVGLDAVQHMVRQLRGGVRMEQRQGQGALFHVEVPLTLSVVRSLVVEIGEEAYAFPLAHIERMCELEAEEIVQLEGRQHFWYEGRHVGLVSAAQLLQRPESSRTEGAIPVVVVRDRDAVYSVSVERFVGERTLVVMPLDPRLGKVRDVSAGALLDDGSPVLILDVEDLLHSVGKLLSSGRLERIDRSRRQAGGAQRKRILVVDDSLTVRELERKLLLGRGYDVAVAVDGMDGWNALRSEHFDLLITDIDMPRMDGIELVTLVRRDSRLQSLPVMVVSYKDREEDRRRGLDAGADYYLAKASFHDEALLDAVVVLIGEAQG

SEQ ID NO: 18169 - protein, 334 aa, Pseudomonas aeruginosa
SGHDRRGCASLAGERGGHRLPLLFRSAAGGGGGQPDQADGDPPGPGDARRRRPHAARCLPRQPGDPRHPDHRPVDQGRADGEERGVRRRRQRLPGQAAGRHRAGGADPLPLAFVHRPAATRRGLSGAAREPAAVAGDQPGAAAADELRRPDRALQPSSLRRIPGDGVAPLAARAVATVAADDRRGLFQELQRHLRPRRRRRGPAPGRRGHPRGLQSLLGPGGSVRRRGVRHGPPGHLAGRRTVAGGEGPAHGGEPADQPRPATPGLAPDRQHRRQHPGAGRRRANLPGSHRDGRPGALPGQEQWPQPGGPDGTAGAAGPGGLSGARRPCVAGRH

SEQ ID NO: 18170 - protein, 297 aa, Pseudomonas aeruginosa
TPCPRHFPPCLAGVRYAFRPCCAIRFHRQESLTRNHQDHERPTTRPARTATGRKQADRPAQGKTCRRARSPGHRLPQRLPPRRLLRGPAETVRRQDQGRAGSRSDPGQGGRSDHAQPRFLHRPPGQQRAPAGLRQPQDPAGRNPGRDQDLGPGRHHRRRRRAGPLGQGRPVRRHDQRAPADQVAASAAGQAPWPDRHRAALPPALRRPDGQRGNPPHLPRAFPGHRPHPPFPQRARFPRSGDPDAADHPRRRRGQAVRDPSQRAGHGHVPAHRPGAVPQAPGGRRFREGLRDQPQLP

SEQ ID NO: 18171 - protein, 270 aa, Pseudomonas aeruginosa
RRRLDPAQPRVHHARVLPGLRRLRRQHGPDRGTVPRTGPGGTRYHRRALRRQGLPLRRAVRAPVGVRFDPQVQPGDHRRRPQRRREGAGHRQEGRRQGPRPRRPGQAAGDDFRGTGGAQAGAAALHHPLPLRGFAAGPPQRRRPERHRPLRAVHRRPRDRQCLFRAERRRGPGRALHVAGQGEGRRRRRGDALRRRLHQCPGIRHAADRRRRHRHRPPGDAADQLAVDPRRDPVPAHAPAGLSAATVHGKPPSGGFFMAARCPGRRARGR

SEQ ID NO: 18172 - protein, 257 aa, Pseudomonas aeruginosa
FHAKKSEQCPIVRERRKHRVPSSSQRQRRAGRQRGSRKRSLPGPQGQPPGQRAAAPGDSRCRHAPDRPRRRTGRAPPRGGRRGPGAVVGHHLLLQGHRRSHHRHLRPLRRAQRRGAVGVLEQRGGRPPGDGRGAGRRPRRPWLAGGTDRRACRAVCPGPAHRAPRAPAGRAGLPPGGVAQPAPARTGRCPPADSLPRRRAFLPSARFRAARAGRQGVDVDYSADGISGPRGRGRATGRGRNARHTQTVPESGHGPVT

SEQ ID NO: 18173 - protein, 502 aa, Pseudomonas aeruginosa
RAGDLQPRRRAHRRGPRRRPARRRDRRQRSGQGRAGAQPVGEGLRLPERSRQFRRVRRGRPLPAGHPMRLPMSQRKAQNDYQKIIRSLSDRIVEAQTPIRVLDAIKWDDGIRQDFLKGRGKHAPKVDRGYYDSRPLAFDASAKKQEFQNIERDITRQLGQFNPVGQIMRRMCKEYRMVIRMLEARGTPDLGLISQELYGSASDAFHAGDPTLADLGLMLSDYLNNIADRGDLKDEPKTLTAKEVVPILQARLNTVFGEEEGTIRVFESDGIVADAAAGADYIKVRADALFNERDVRALEVHEGLVHVGTTLNGLSQPICTFLAKGPPSSTVTQEGLAILMEVIAFASYPTRLRKLTNRTRAIHMAEEGADFLDVFHFYREQGYSLEDSYQNASRVFRGSTPDGLPFTKDLSYLKGFILIYNYIQLAVRKGKLEQIPLLFCGKTTLEDMRTLRQLVDEGLVAPPKYLPPQFRDLNALSAWMCFSNFLNHLSLDRIEADYANIL

SEQ ID NO: 18174 - protein, 412 aa, Pseudomonas aeruginosa
GPTTDEAPADPAAGTRRAVPRWLQFAAVLSRAGGADHSGARRAGVPRRHPDHRRRRAPARLVAAGEERRAGERHRALPARQRRQPVLAPRRHVVAARRGLPGADARLSRLRPVGGPAGTAGGLPRHRRGVRLARPGAGGEGHRARAAGAESRRRAGDPLPGRASAAPGPVQGAGVRRGTGELPRHRPAHAGRFLADLATAGAAVLAGARRRQRHPFGGAAFWRTHAVLSQHRRYHCAPRERHRPVPPGAAAEGPATDPRRPRADLRRSDLAGSDAALPRRSPWLHRPAPAGRNPEPRIRETRRQSMSDRNVLPCILTGIGTIFVTVGVLWYYGYLHFAKPQDALLLADFTMLKSLPGEDVKLSLEPAKQVAQCIDGVLVLFDTEQKGLSGVLVDNRKHAVRCAGQEVPQEVK

SEQ ID NO: 18175 - protein, 266 aa, Pseudomonas aeruginosa
IPATPLPAGDRGRRGSGVPRSGSPSLRCAGRSSATRRCRPGFRWRPPPGEARGGAHDHVRDRDSKCRRVRGSWKQFPFDVLGAIAHPVATTESSGTANSGSRVGDWRRVGMKIGELAKRTGCPVETIRYYEREGLLPEPARSEGNYRQYTLAHVERLSFIRHCRSLDMTQEEIRTLLALRDRPEADCGTANRLIDEHLHHVEVRIAELQALREQLQDLGSRCTVAGNSQACGILRELEQPAPLSPIPEECAEAGHMHVPGVHRRHG

SEQ ID NO: 18176 - protein, 324 aa, Pseudomonas aeruginosa
ARGRLSQAGFPPAVETGHAGNRCAPARGRPPSGRIARRHHPRAVRPAVPRQDRADPQGRQGCPPRFRGGRPAAHRHPRRARGRRTAAGGAGLQPVPQPGQYRRAIPPYPPAPAERAGTLREPGAGGAAGASQGRRACPRATGSPARRAGDRTGADRPSHRGGAAHADPEIRCDHRATGGQGPCRPAAGGAQSHPAAPAAAGGRGLAYRRDPQGPADPGGRGEMGLRGDRTFSLAGLAERPSARRRGTPAQHRRTPAVDRRAAALRVLDGGRPRRQSQRHRQRDPRGPAAGALDGRRPVPARYRPTGRRAVHAAGLAAAAGAGRR

SEQ ID NO: 18177 - protein, 513 aa, Pseudomonas aeruginosa
RRALSRPAQAIARAPARDPQLDPPGPGRRGAGRGGRPGAQPRPGRAAATVPRVAARLRHGRDRRWRVARLPAPRRHLRPVPGTPGRAPGLGPPCRRAERDHRVPGAGQLRRVGREDPPGIPSRGTEQPPPPAAGALPAFGGYRRGARHLPGDRRRTTGVAGVLRDLDGRPAVRRAGGATAAKGKRRRLADARGAAVRDPRRPGQRRPLHGAPADAAGLPFAAVRGAGSDDRLLRFGQGRRYPHGGLGAVPGAGETGGDLPPARGRVAALPRPRRYCRSRRRAGPRGDPVAAAGFGGRALPGHRTGRDDPLQVRSAGHRRTEPQSLPRRGAGSDPDAAAGSRAGLARADGPPGEGRAAGLPQGGARRSAVRRVFPPGHARAGTGSPAAGQPPGQAPRRRGGEPAGDSLDLRLDPDAPDAAGMAWLGDRLAERHRAWRGRAARADARAMAVLHHPHRHAGNGPGQGRRGYRAALRRTSSCEAPIGCIRCSSGLGLRDWKSPNTQSTQDAQPDEHP

SEQ ID NO: 18178 - protein, 436 aa, Pseudomonas aeruginosa
RFLRHRPASPALLAPRQSARLSCRLTPPPRLRQPGPSGRGRSRRNTLASPMESPVRRKKTGHTLLESHHAHILLRCRGPAGRFRFRPGPRVQRRPTAHRASLGAGPAADLAERRGLLRGAEPWQGKRHPAWRRHAARGFRRGARACAQERHDEHAESRQRRRRTRQGPALRSRRLPPDADGPEAATGGRRALPADAAFPQGRRRAGGNRRRVQGAGRTGRARAARPLSAVSSRGARRPAFACEVQSMNSNRYPLPAQTGLVVAPGLPPKNSTLRPDQLNKRLSSAWHHLYDLCPELLKIDPPDGLTILRGFLQWAAEQKAAWNWAMHLRLYCWLLQSPFGAKVTDEHLEVLMDASAARWTVDDTSANRGILLASQGGAHITQDWKAPQAGAGTRVPLERLDLPAPNWTFAYCAVPDPRLREFPGWKPLPARGSLVG

SEQ ID NO: 18179 - protein, 62 aa, Pseudomonas aeruginosa
SRPVHAVRNWWACAWGPSCWPRPGCSTVAAPPPTGCGRRISLGASLRCGWSPTCCTSRTTAC

SEQ ID NO: 18180 - protein, 137 aa, Pseudomonas aeruginosa
SRSWRQLSRRGSHRVRDGNRISSDSTPRATRMNGQIPLNISRISRRLMVATMNRQAPIGGVIRAMVMFRVKISPRCTGSTPAASATGATIGVSSISTETSSMSMPQTKITALMMNSIRVGEWPNGSSNWANSLATWA

SEQ ID NO: 18181 - protein, 153 aa, Pseudomonas aeruginosa
PSFSMAGTSRVLSAEASAAADPLTPAKNTPATTLTWPRPPRKWPTRALARRIRRGVMPEWFIRLPASTNSGIAISEKMSMPPKKRCGRVLANSAGSTKRNPTSAVSSRQRNSGRPSRRLTTKAAIMAMAIMPATLPRRWCWPAAAARAPGATA

SEQ ID NO: 18182 - protein, 437 aa, Pseudomonas aeruginosa
AMTAWEVLRKVGQARPADGSGRRGGNARRSGGGGETGVAEGHLGPARLDVLGLQPGQVGRLAFLAEGGEVIGGRLDDLHALFLEERQVALLLGGDRLAVQPGGFGGGVEQGLALLCREAGEQIAVGHQELVGVLDVGQGQVLLHLVEAAEDDVGGRVHLAVGDAGAQAHVQLGPGDRRAGGAEGFVERHLAGIHGAEAQALEVRRAVDRLLAVGEVEEAAFLDHRQQLGAGALAEGLAGGLPVAAAVEEGVGRGGVLEHEGRGADVDLREQRGDPGEGGDVQAGAGHHLFHALLLFAEHAVGVELELQFAAALFLGQALEVAGEQVHQVLLAVGGAVIAQVEGGGGLGEAAAQAQGGGQQSGGEAAGEAVARIRVHVVFLMAVRTVGGSAALLVGARGRVLARKRSNASRCLVDYSSPDVMRKRQRLSAARARARRH

SEQ ID NO: 18183 - protein, 146 aa, Pseudomonas aeruginosa
ASAPVLRGADDDPSVPRGRRAAGARRGCRASAGAAPGCGPDAVRRDASPGGPGVRGGPPAGARRHGAGACPGRPGAAPAGAGVRRDGAGGGRRLPGAGVRAATGRACAAPGAGAGRRDAAAGRRRWAPAVRRRPKASARARRRRSR

SEQ ID NO: 18184 - protein, 173 aa, Pseudomonas aeruginosa
GRRVAGGEWRRRFLRPGRPRPRGLHGGPADGRRREPGATARGTGRAGAAGDAGAAPAGAAGQGPGVLRRDRRVAARRIAGSVPGGRRSAPRGSRAAPLAGRPPAAPSWSAPGAAGHGRLRRPREPGAGRPPGRRAGAARVAGRRDRPASARPGADRGGAVGCRCCPPVRAPAG

SEQ ID NO: 18185 - protein, 270 aa, Pseudomonas aeruginosa
SAQVVVPGVAMSSLDPSVLFAALPFSLWQWLLVELAIVLAYVVFGIAGFGTALVAGPLLAGVLPLSQIIPLLVLLDFSASFGNWLPARRQIAVTELKRLLPCMLLGCALGAYGLLALRAELLMLALGVFVSFYALYALFLQPRGQPRWRATWALPFGVFGGLFGALFGSGGFLYSLYLNGRLASKEQMRATQSALIGCSTFVRLGLFLLAGLYAAREPWLLAACLLPGMALGLWIGRRVTLRLSREAFVRLVTWLVLCSGLALVGRYLAA

SEQ ID NO: 18186 - protein, 143 aa, Pseudomonas aeruginosa
TAGRRGSAAWRQSTRFSQWKAGSVARLMAPSSTENRSPTRAGLSCHWVASCAAMAGAVIRMVGVIAANTTMAASSARLPDAGEALARVLSEALMAAPPQNTWTRRNRAWLPWKALSVATLRERPNIRLLRRSSQWPSSKPSWV

SEQ ID NO: 18187 - protein, 558 aa, Pseudomonas aeruginosa
RTQYPAIRRRAAILQMRDRTGGTGPGGRLARYLPIRRFRRSTALSGSPWLGIMSRFHFSRLGAPAMLRISQEALTFDDVLLIPGYSEVLPKDVSLKTRLTRGIELNIPLVSAAMDTVTEARLAIAMAQEGGIGIIHKNMGIEQQAAEVRKVKKHETAIVRDPVTVTPSTKIIELLQMAREYGFSGFPVVEQGELVGIVTGRDLRVKPNAGDTVAAIMTPKDKLVTAREGTPLEEMKAKLYENRIEKMLVVDENFYLRGLVTFRDIEKAKTYPLASKDEQGRLRVGAAVGTGADTGERVAALVAAGVDVVVVDTAHGHSKGVIERVRWVKQTFPDVQVIGGNIATAEAAKALAEAGADAVKVGIGPGSICTTRIVAGVGVPQISAIANVAAALEGTGVPLIADGGIRFSGDLAKAMVAGAYCVMMGSMFAGTEEAPGEIELFQGRSYKSYRGMGSLGAMSGSQGSSDRYFQDASAGAEKLVPEGIEGRVPYKGALSAIVHQLMGGLRAAMGYTGSADIQQMRTPAAVRPDHRRGHGRVPMSTTSRSPRKPPTTGLVEAD

SEQ ID NO: 18188 - protein, 529 aa, Pseudomonas aeruginosa
REMAMSQDIHAHRILILDFGSQYTQLIARRVREIGVYCEIHPFDMSNEAIIAFAPRGIILAGGPESVHEADSPRAPQAVFDLKVPLFGICYGMQTMAEQMGGKVQGSDLREFGYARVDVVGKARLLDGIEDHVDDDGVLGLDVWMSHGDKVTEMPAGFHILASTPSCPIAAMADDARAYYGVQFHPEVTHTKQGLRILSRFVLDICGCAALWTPSNIVDDAIATVRAQVGSSKVLLGLSGGVDSSVVAALLHKAIGDQLTCVFVDNGLLRLHEGDQVMAMFAENMGVKVIRANAEDKFLGRLAGVADPEEKRKIIGRTFIEVFDEEATKLQDVKFLAQGTIYPDVIESAGAKTGKAHVIKSHHNVGGLPEDMQFELVEPLRELFKDEVRKIGLELGLPYDMVYRHPFPGPGLGVRILGEVKKEYADLLRQADHIFIEELRAFDWYHKTSQAFVVFQPVKSVGVVGDGRRYAWVVALRAVETIDFMTARWAHLPYELLEKVSNRIINEIAGISRVTYDVSSKPPATIEWE

SEQ ID NO: 18189 - protein, 196 aa, Pseudomonas aeruginosa
SIHPILHLLRRHAPAADGGAAGGRAGFEASARRRCSRTAAGIRQCHWALRRYRYPWFQRGPAGAHGGRRRAATGGGGRTARARAAEAGRGGARGDLVAAPLGMARRAARGRLGGDAQAGRGGAPQPVRACAAGAGARLPFHECDGRRPAGLRGGDACAVRRGSRGLRRADRRLADRCARARRLAGKRRRILRGGGG

SEQ ID NO: 18190 - protein, 1430 aa, Pseudomonas aeruginosa
NARPLRAGPAGPHTFPSPEAVPTMLILRGAPALSAFRHGKLLEQLTQHVPAVTGLYAEFAHFADVTGALTADEEQVLARLLKYGPSVPVQEPSGRLFLVVPRFGTISPWSSKASDIARNCGLAKIDRLERGIAYYVQGELSESDAQQVAARLHDRMTQLVLDRLEGAAELFSHAQPRPLTAVDVLGGGRAALEKANVELGLALAEDEIDYLLKSFGELGRNPHDVELMMFAQANSEHCRHKIFNASWDIDGQAQDKSLFGMIKNTYEMNREGVLSAYKDNAAVIVGHVAGRFFPDPQTREYAASREPVQILMKVETHNHPTAIAPFPGASTGSGGEIRDEGATGRGAKPKAGLTGFTVSNLQIPGFEQPWEVPYGKPERIVTALDIMIEGPLGGAAFNNEFGRPALTGYFRTFEQKIATPHGEEVRGYHKPIMLAGGMGNIRDEHVQKGEISVGAKLIVLGGPAMLIGLGGGAASSMATGASSADLDFASVQRDNPEMERRCQEVIDRCWQLGERNPISFIHDVGAGGLSNALPELINDGGRGGRFELRAVPNDEPGMSPLEIWCNESQERYVLSVDAADFETFKAICERERCPFAVVGEAIEQRQLTVADSHFDNKPVDMPLEVLLGKAPRMHRAVTREAELGDDFDAAGLELQESVERVLRHPAVASKSFLITIGDRTITGLVARDQMVGPWQVPVADCAVTATSFDVYTGEAMAMGERTPLALLDAPASGRMAIGETVTNLAAARIGKLSDIKLSANWMAAAGHPGEDARLYDTVKAVGMELCPELGITIPVGKDSMSMKTRWQDNGEDKSVTSPVSLIVTGFAPVADVRQSLTPQLRLDKGETDLILIDLGRGKNRLGGSILAQVHGKLGRAVPDVDDAEDLKAFFAVIQGLNADGHILAYHDRSDGGLITSVLEMAFAGHCGVELNLDALADSREELAAVLFSEELGAVIQVREGATPEVLAQFSAAGLDDCVAVIGQPVNGYEINLNYNGEAVYSAQRRILQRIWSETSYQIQRLRDNADCAEQEFDALLDEDNPGLSIKLSYDVNDDIAAPYIKKGVRPKVAILREQGVNGQVEMAAAFDRAGFAAIDVHMSDILAGRVDLDAFKGLVACGGFSYGDVLGAGEGWAKSILFNARARDGFQAFFARKDSFALGVCNGCQMMSNLHELIPGTEFWPHFVRNRSEQFEARVAMVQVQESSSIFLQGMAGSRLPIAIAHGEGHAEFESEEALLEADLSGCVSLRFVDNHGKVTEAYPANPNGSPRGITGLSSRDGRVTIMMPHPERVFRAVQKFLASGRLAGRRRLAAHVPPTPGSGWTDPAWRAMRTPTRRPDLLPRGSPGLSRRHLAALYLRGFGFASRLSRRLPQRPDAPRDPRAPVAVVPLRALRRPAVLRRQPCAFRLRAEGQVAAFPRPERKSVNARTKVL

SEQ ID NO: 18191 - protein, 302 aa, Pseudomonas aeruginosa
DPGLRSLAPDRHGLLSFPRTSKKGGQLPPFSLSASRGESDPGLWRGANNRFAIIEPERGSCGVGRITAWRLSADWPRSSPPAVSAAAAVAGPGSGPAARGPTRIWQMPPARELTPCPPRRRSCSVASLRSSATLTRRRVSATSRTSRRLPAPPRAPSQAWASAASTVACIDTTSSAAFGLPSGGTASPGCVSKGRARRISSAMLSACGPTTTCRLPALPGRTTAIAPRALSWASEALSRSTRRRRRRVVQASTTSRLAAPPRARMNAGARSASALSPDSLLASSSRPGVFRLKRRMQKSNTR

SEQ ID NO: 18192 - protein, 139 aa, Pseudomonas aeruginosa
RARSPVTTRPVSGSVKLPKTNHTRLLRMWCNPVTISRRFSTPKAKAPKLPLSSMSWPRPLMPCCSGGQITPNSRPRQTALIPVAIGTKRRPPKNARYSGSFTSLKRLYRAPATRPLMMPESTPMSMPGSITLSTEIITR

SEQ ID NO: 18193 - protein, 221 aa, Pseudomonas aeruginosa
PMAPARPAVPLLSRAKPTAMPMAKISARLAKIALPASWTSGMSSRSTSPRRSSRPAIGTIAIGSIRARPRRCRLSIRNGGMAVVSDCSCQASGQCCRQASRTARALPRSSSAWAWRRHSAASSWRTRVLISPTRFGPTDNSSTPRPTSTGVASGSEASAPQTPTHRPWRAAPAQVWAISRSSAGCRASMRSARPAWQRSMARAYCDRSLVPMERKSACSAS

SEQ ID NO: 18194 - protein, 203 aa, Pseudomonas aeruginosa
QRCRACVQTAMMGDPRPPADLALRGAFARRGIGRTLLGLLRTQLQERRADLHRVGGQRAYLEAVAVGQDHHRDQTAAAAGDAVQVEAQQRLALDHPRTFLDQRLEAFALQLYGIEADVQQQLGTVVGAQAERVAGSRQVADQPGAGRVQAVVEWVDGDAFAQGAAGKHRVGYSVERHHGAAQGRFEGEILVVHGRALRLSGFG

SEQ ID NO: 18195 - protein, 402 aa, Pseudomonas aeruginosa
SSWSLRRCARCRRRAARRIRWRLPAANLRHSPGRCPGRRVRAGCAGCPRDRGSVLTARKRRRPARRHAAASGSGSLPTWAARPPASRRAAWPGRRSSWRHGRSCRARRSAPGSDRPPAGAGQAPAGKRRARPVDGSPPRRRRALPRASAKSFEFSFHHHGVEFQGAIQAHHIGPGCGRQAAALGEAEVIGGELRKALRGFGQGQADLHQVAQCLVHGQGAAGQGAVGQAHAAQALGHRVAAELVLAVGHAGGGGGVGHAVQARDRTQGHPDGAGMDMQQVGDQLGVACVGQGRADDTRFAVVQAGHRVVEVGEAAGAGFQCGHAVLVAAQGMADLQAYAALGEGADQRPVSGDLGGDGDHPDRRAAQVVLDFLEHRGMGEVGLRAELAGVDVGAFQVHAEYP

SEQ ID NO: 18196 - protein, 286 aa, Pseudomonas aeruginosa
RRRLSPSGMRWTTVAPHRLQNFMPGSSSGKGLSCSAGREATRPRAGGVGWPGLSCHDLGETTRPRKPRQYELHARRAAPTHRGAPPPPTGYRPALPPSGRAGAHHPQRRSGAGADPARRRFVHPWRRGRLPRRAARPGRCRPGAHRPARGGGGDRLAAGPGGSGRAAEHPGLAAWHRGHSLCRLHSRLRRVPAQRRRDRRGVQRAAEFLSRRPARGHPPYRLLRPQLVRAQLSLRRVQDLGPDGHHGGGAGQPAVRRPHRPAHAAGFVHQTELTDGAQTPAMRRSR

SEQ ID NO: 18197 - protein, 299 aa, Pseudomonas aeruginosa
ARRIRRYACSASRKWMASGGWAWPWRATSRSTPPAPRRPGPPRRFASNSEMRRLASLAWWAAALPLLPLAVPLAIRTRRRALRLAPAAGPREGLVGGAGAEEPLRLLLFGESTVAGVGASCLDYALAGRLAAALGERMRRPVAWQALGENGITSGEARERLLPQVAGRFFDQVILVFGVNDTTSLRSLERWRADCAALIDGFQAAGAQVTCTAVPPLQHFSALPGLLRALLGWRGRLLDEALCDLAGATGAGYCPISLDLLPGYLAIDGFHPSQLGYQVWAGALADWLAAREKGGVAVA

SEQ ID NO: 18198 - protein, 75 aa, Pseudomonas aeruginosa
PGRTPIRVVDTPISSSEATRVDLRPMRSPKWPNSAEPSGRARNAMPKVRKALIICAVPDVCGMNTGPITRAAAVA

SEQ ID NO: 18199 - protein, 168 aa, Pseudomonas aeruginosa
NSMAVPMKLATATRVVELAGSGAESAATVAAVMVGRSLAIGARRSASVRPDGYGQCADAAARRPGGADEIGRAGRMGMRAVRRLVPSASGPGGQAGLAGDWPGLGLRVAAEPAAGLDKLGSIIERRGAGSAIPDQTLASLSTSGVSARGCQARTLFTRFSADCWISRQ

SEQ ID NO: 18200 - protein, 119 aa, Pseudomonas aeruginosa
EHSMTNKIIQQIEAEQMNKEIPAFAPGDTVIVQVKVKEGDRQRLQAFEGVVIAKRNRGLNSAFTVRKISNGVGVERTFQTYSPIVDSLSVKRRGDVRKAKLYYLRALSGKAARIKEKLV

SEQ ID NO: 18201 - protein, 159 aa, Pseudomonas aeruginosa
PVQHPRHPGSHSIRYSWHDPQRARNPASHRAFRNPCDQGGIPAHHQSPQHPVRRDCAGLDGRGLVHHRDPFLPPAAGDRFHRSHRLQPPDPGRGSIVELVGRVVNVGNTILKVEVEVYLESMYADGREKAIHGLFSFVAIDDEKRPVPVLPGFPVSQAA

SEQ ID NO: 18202 - protein, 64 aa, Pseudomonas aeruginosa
RSGPSRIPCQRRSARPEPGRTIEPHGSAFSRGHGKPADLLSTGLTNHYVAMTANARDSAQAMKD

SEQ ID NO: 18203 - protein, 488 aa, Pseudomonas aeruginosa
IDRTPGAARGPASTAKVLNMRYISTRGQAPALNFEDVLLAGLASDGGLYVPENLPRFTLEEIASWVGLPYHELAFRVMRPFVAGSIADTDFKKILEETYGVFAHDAVAPLRQLNGNEWVLELFHGPTLAFKDFALQLLGRLLDHVLAKRGERVVIMGATSGDTGSAAIEGCRRCDNVDIFIMHPHNRVSEVQRRQMTTILGDNIHNIAIEGNFDDCQEMVKASFADQGFLKGTRLVAVNSINWARIMAQIVYYFHAALQLGAPHRSVAFSVPTGNFGDIFAGYLARNMGLPVSQLIVATNRNDILHRFMSGNRYDKDTLHPSLSPSMDIMVSSNFERLLFDLHGRNGKAVAELLDAFKASGKLSVEDQRWTEARKLFDSLAVSDEQTCETIAEVYRSSGELLDPHTAIGVRAARECRRSLSVPMVTLGTAHPVKFPEAVEKAGIGQAPALPAHLADLFEREERCTVLPNELAKVQAFVSQHGNRGKPL

SEQ ID NO: 18204 - protein, 122 aa, Pseudomonas aeruginosa
SGKCLHRRTLFAFFRSLTSLIRRNRRPDLDSLKQRLADAFAPHPFTLSQPRPDGGRVVTLVDPQGETLLQRVIAKVQLNDESYLEDAVQTIRRELQVLVGRMEEDVLATFRERDHVLLYSSR

SEQ ID NO: 18205 - protein, 279 aa, Pseudomonas aeruginosa
KPGPEGGHHHDGMEQAAERPARRSQRGWRGDRRQPGAAHPRPGDPRRRRRTAQVAGSAGLDHGPPPPGPGARREGRGPGRRVRAIRDQGTGGRQRGAGPGGRGEDRDPGEPARGRACPGRGIRRQRSPVAQVGEPGRGQHPPAQATGGYGQGHRERAEGADGRCPALRQLEEQAADRGGLPGADQAAPGRTRGDHGCRGRTGQRGGAGRCAGRQAARGWDQGLGQQRGWRAGAPEGKGQGLIGPRPGEGVRARFSGIERQWKVSCRRRCRSRPCCSAFF

SEQ ID NO: 18206 - protein, 356 aa, Pseudomonas aeruginosa
GGAAEDREGKGAGRAAQEHRQCDSRARRGGKDRGPGGGADQGGARGFRGRAGQAGDPAAGPGGSRAGAGTPGQAGGSRRGPLQAQGGGNQHHGAGRAGSGVEAGRGEEASGRGHRGRARSAGPGRCAGAGSHRRGEGKGWLGSGAGTCRTTDRRSQGRRGARPGRRPGARGAGRGQGEGRPGPKPKVLAEKLGAQARGEEQLGAAKAKATKDQGSAEAEVLLQRLNAEAEGLGKKFGALDALSDSARQHEEFRMQLEKSFEEAMAAIAANKDIAKEQAEVLATALGKANIEIVGGEGDFFNSFAKSLSVGKAIEGVVGKSPVVQDVLARLLNGRGAAAAVMPERKSGHENEPAAEV

SEQ ID NO: 18207 - protein, 162 aa, Pseudomonas aeruginosa
SAGSASVPRTTASPAISSRSAIACCSATTCSSACARKPAWPTYSPSTAWWRAAKATRRSLCHWGTAFSPRRASSTTSTSFTPTTRTPACCNWRSATASCWPASRSASGSPTSACSAGRSPATAAKSATSTTAASATSPCRHRSTSNGSGLPARWWWRAASRT

SEQ ID NO: 18208 - protein, 139 aa, Pseudomonas aeruginosa
SGWSWWCAPWRLPRRRRAAAPAPISVPARSVGGRSASCAGRPGRAWTSACSPSPTTSSVRKSWPAIGAVFRCGSSATMTSSSTKAATSMRCARPACRCESTTVPSTCTTSSPWWMAPGCSTAVSTGPAAPASTTKRTCW

SEQ ID NO: 18209 - protein, 233 aa, Pseudomonas aeruginosa
SAPIGVNSRNSGAATPRAERQRREKGRAGGRPADRTRAGFRLDLRPFASHAGIPMALQSTPYKADISLTDLDRGVYETLRLTVARHPSETEERLAVRLLAYVLWYGEQIAFGRGLSDVDEPALWEKSLDGRVLHWIEVGQPDAERITWCSRRCERFSLLAYGNLRVWQTKVLDSVRSLKNINVAAVPQEPLESLSRDLPRSINWTVMISEGTLFVTDENGQHELQLEWLQGER

SEQ ID NO: 18210 - protein, 589 aa, Pseudomonas aeruginosa
PDAYRTPPPARNPARSRRPSAIAGTPVRSSWRALRRGAGQGPGAADSLPAAERHRGGRGAAGGCPGGRPADSHRRRLRRRRRHRQQRRRAGPAHARRGLGRLPGAEPLRVRLRPDPGDRRRGPGEASRPAGDGGQRHLQRGRRPGGESRGAQGAGHRPPPAWPGTAGGGCDHQPQPAGLRIPQQGHGRGRGDLLCDAGVAGAPARAGLVRPARAEGTEPRRAARLGGAGQRRRCGAARCQQPHPGPPGPRAHPRRPRPAGLARAAGGGRAASGTDHLHRPGFHPRSAPERGGSARRHVPRHRMPALRRRSAGPRHGGAARPVEPGPQGHRAGYAARGAGAAQGAEPGATAVRLVPVRRRLAPGRDRNPRLAPEGALPPADHRLRRCRRRQPERLGTVDSRLPHPRRAGRGSRPSSRADQQVRRPRDGCRTIVAAGKLRRFLRRLRCRSTPPTGRGGPGRAPALRWPVEHPGVPPGVGARVAPGRSLGPALSRADVPRGVPAGAAADRRRASPEAGAEKRMRLAATGWHCLQHRPRAVAQPYRALGRAGLQARRQRIPRPGKRATDDRPHGSSLNAPRGHGQPSCPLLFC

SEQ ID NO: 18211 - protein, 123 aa, Pseudomonas aeruginosa
QRCRPAGQYPGPGDTQHEQHDHHAGAPFGGAQPERRATPATGRSSGPERTLGAGGRPGDPVGPDRRAGAFLTPARTYPAAPGTPGHRDPPHRTAGPGAAALRLIGASLSPARGAATGVPGSRR

SEQ ID NO: 18212 - protein, 188 aa, Pseudomonas aeruginosa
RQELRLPGHPGQRPGRVPREVRQPLWLPRLPGQGGDRRPVRRLRRLRQAGRAGPAAHGRWLVGQVRPDRSQRRLEGAAAVRFGRQRRPHRAWLHRRRARPGCRRREHRPVQRRLRHLQPRRRQRVGEAGLCADRRAGQRPVRRGEEGRAAEDRQLHGFGKPGAGGGPDGPQRQDAAGAGRTDQHPVCV

SEQ ID NO: 18213 - protein, 443 aa, Pseudomonas aeruginosa
EISYVFSLGYFEGRPRNIGSLNGFRGVGVEIAVSTFLSVLLDIGRARRQRGFRCRRRPSTQFADCPHRLVDGGMGVGIPGRIRVGDGDIADLASRQFHQRFAFRLVVVEGIHEVGVAVRPAVHGDAGDVAAVVETRRAEHGLELVADVLFQLLEAHRVELAAAYASLGAGVHAGVRGGRHVDHVHADRLPRVAWMPVAAEVDREVQLDPRVGQGRRVNLVDAEGLPGLPVAQQYLGVHQRELDVLAQRVGLLLGEVAQQVRHHHVVAGHHAVLAAYPVQAAGAAVADIDAAGAVAHADGGAVQAQAHRVPGEVQLRVVEAGHDDVLHASARRHRGDQVAHHEPSQRGVAVGEMVDVRLVHFRLGLLAGLRQAEGVEAGKAGGVCVGRRQGVGAEGREVVAAALEVLHRGFREPDVLEQVVAVAGLRQVGFLLFHALAGKIVAR

SEQ ID NO: 18214 - protein, 275 aa, Pseudomonas aeruginosa
HVSRFATVSGEAGNISKQTPGGQRGREGLESVESGCYRTSWRFLMNTRGLLDQLLKSGQEMLQNKSGGKPGASGGGQLGSLLSGAGGGALAAGAIGLLLGNKKARKFGGKAITYGGLAALGVIAYKAYNNWQQQQNGAAPQAQPQTVDRLPEAQAEVHSHAILQAIVGAAKADGHIDERERQMIEGEVAKLTSDREVQGWLERELNKPLDPAEIARAASTPEIAAEMYLASLLMVDEESFMERSYLEELARQLRLEPSFKLELENQARQALQRLA

SEQ ID NO: 18215 - protein, 585 aa, Pseudomonas aeruginosa
TTSLKPFETCRSSAGPTAHHKNDKTRLAMPEVLDTYDYLIVGAGPAGCLLANRLSADPANRVLLLEAGGPDNYPWIHIPVGYLYCIGNPRTDWCFDTDEVPGLNGRSLKYPRGKVLGGCSSINGMIYMRGQARDYDQWVAEGNPGWSWRELLPLFRRMEDHFAGTSEMHGAGGEWRVERQRLSWKLLDAFQQAAAQTGIASVEDFNGGDNEGCGYFQVNQRGGVRWNASKGFLRGIAQRANLTVLTHAEVQRVLLEDGRARALSVRWQGREQRFEARREIVLSAGAIGSPCLLQRSGIGPRDLLEQLGAGVVHELPGVGGNLQDHLQLRMIYKVDGVPTLNQIAGSLWGKLGMGLRYLASRSGPLSMAPSQLGAFARSDPQQPSANLEYHVQPLSLDRFGEPLHAFPAFTASVCDLRPHSRGTVRIRSLDPGEAPSIQPNYLSDPRDLKVAADAIRLTRRIAAAPALAAFRPQEYKPGPEYRSEEDLQRAAAEIGTTIFHPAGTCRMGQGPQAVVDAQLRVHGIPGLRIADASIMPSLTSGNTCSPVLVIAEKAAQMILAERRREAAPQVVESAMAAGGKEAVEA

SEQ ID NO: 18216 - protein, 557 aa, Pseudomonas aeruginosa
KRKWQTTIRAPTRGGRAAMTEYATTPSYTVPATTPQGERKVIFASSLGTVFEWYDFFLYGALAAVISKQFFAGVNDTTAFIFALMAFAAGFLVRPFGALVFGRMGDMIGRKYTFLVTILLMGLSTFAVGLLPTYASIGVAAPIILVTLRMLQGLALGGEYGGAAIYVAEHAPANKRGSYTSWIQSTATLGLLLSLLVILACRQLTGDEFETWGWRLPFLLSIVLLGISTWIRLSMRESPAFLKMKAEGKVSKAPLRESFTQWGNLKVVLTALFSINAGQAVTFYTAQFYVLFFLTQVLKVDGGTANGLLIVALVLGAPFFIVAGWLSDRIGRKPVLLAGLLLATLFYFPLFKGLTHYANPAIDQASRQSPISVVADPATCTFQFDPVGKATFDSPCDKVKTFLVKAGLPYSTVAAPAGSDVRVRIGETEIAGFDAEAMAAAVKTAGYPQQADGSQVNKPMVIAIIFALVLISTLCYGPLAALMVELFPTRIRYSSLSLPYHIGNGWFGGFLPTVSFALVVYTGDIFYGLWYPVLITGGSLVCALLFLRETRHTDIHR

SEQ ID NO: 18217 - protein, 280 aa, Pseudomonas aeruginosa
RIRRHRDRFQRHGRRAQGPGVAGPAFFGAGHHLSHRDRRDLQAAAGHRHRNRRDHHGDRRHFSRDRRHLARPGADHERSLRRRRADVDPGRFRPVGPGAHGGNHAPRDGRGRPGQRQAGDPQREGRQHQPGGHHHRQGRRPDQPALAERRHRGGESRRVRPRVRRGGHRGAPAGGPDRGRHLRHRADGARDPVGGIGRGDGHGQVLRGGPPRYRRGRPGRRATVADHSAGAGAGAAGADGQRGYAGPGYRCRADQPGAGATGRGHRADRGVAAPGQLRHR

SEQ ID NO: 18218 - protein, 492 aa, Pseudomonas aeruginosa
SSNRPPIPCAANRRRSATMAWTTAGPAISVRSMKDHGDWCNGCGSRHCCPTKCAPCCSRRSAARGRHERSLRTPAQEQDRPGCQLGGQRGDRARGTPAHERPRAARRGRILDAPERLAGRGAGADRSGGGAGDLVLPLPGVVHHPRQAGLRAPAEPGRRTRAKDPQPALFHRRGAVFHRHGLARCRALRVPVRGRRPRRQRSGDRARQPRGVRQEFLPRRRTGVSRPPFQRGCRGLPVGRAGSPQGALPLRQFARSRATGGRGTLRFRVLSQPADLFRPPDPERGGRGAQAPVAAGRRDVHRTSRGEPAQPAWHAADRRAAVFRVPPDQRGAPRRAAQGGERRSAPGGCRRRGACEYSAFAAATGETAPAAVQPGSTSQRPAPRQSRRRVRRNRPPGGCRPAPRGARRLRAPTGRAWAVGHGLLLARAAQRCRRAGAGSPGFLPQGPVPGAAARRGAGAPGGAARRSRRPCRRPAPAATCGPWSEQRWLRRA

SEQ ID NO: 18219 - protein, 397 aa, Pseudomonas aeruginosa
RGAWHDPGPDERRVAARAVPARGGGPDPGAQRRPDGAGAQPDPGRPTGSLHARRALAERRGAYRRAGRRRARGARHGGLPGGGAGRTPAPAIGTYRCVAPGLRPVAAYRHPASRRRRLGRRRRAGRDRRPGAAPRRPGAQRPAAGPRGAAGDDSRSAGSGPRGAASGVSGRQRRQRRGARRAGGRRTGRGAPQPGPAGHRRTPGPAAGYLQQVAGGVPAHQAAGRFPATPASPAVQRQPRARRGTRDGPGNRPRPAGPGHARRGAATDWRMPADAGAAHRRSRRVRLAGRPACPCALRRGAWPRGCGHSPTSLAARRGWFATWAARWASRCACWSRAKAPRSTGMSWKNSKRRSPTCYAMPSITVSRRRKPASPPASRPRAGSPSAPATTPACWSWN

SEQ ID NO: 18220 - protein, 372 aa, Pseudomonas aeruginosa
APAPAAAVRGTAFNLIRGAPVPERNMHNPHESKTDLGAPLDGAVMVLLVDDQAMIGEAVRRSLASEAGIDFHFCSDPQQAVAVANQIKPTVILQDLVMPGVDGLTLLAAYRGNPATRDIPIIVLSTKEEPTVKSAAFAAGANDYLVKLPDAIELVARIRYHSRSYIALQQRDEAYRALRESQQQLLETNLVLQRLMNSDGLTGLSNRRHFDEYLEMEWRRSLREQSQLSLLMIDVDYFKSYNDTFGHVAGDEALRQVAGAIREGCSRSSDLAARYGGEEFAMVLPGTSPGGARLLAEKVRRTVESLQISHDQPRPGSHLTVSIGVSTLVPGGGGQTFRVLIEMADQALYQAKNNGRNQVGLMEQPVPPAPAG

SEQ ID NO: 18221 - protein, 391 aa, Pseudomonas aeruginosa
RPAYCLWGASAVYFAAFRRFPASERQPWKSTRSSTASRTSPSAPRPFGGIFDYDQKHDRLVEVNRELEDPNVWNNPEYAQNLGRERAQLAQVVETLDDLTSGLADSRDLLDMAVEEDDEGAVDDVANEVERLREILEKLEFRRMFSGEMDPNNAYLDIQAGSGGTEAQDWANMLLRMYLRWADKHGFDATIIELSEGEVAGIKGATVHIKGEYAFGWLRTEIGVHRLVRKSPFDSGNRRHTSFTAVFVSPEIDDNIEIEINPADLRIDTYRSSGAGGQHVNTTDSAVRITHVPTNTVVACQNERSQHANKDTAMKMLRAKLYELEMQKRTAASQALEDSKSDIGWGHQIRSYVLDQSRIKDLRTGIERSDCDKVLDGDLDEYLEASLKQGL

SEQ ID NO: 18222 - protein, 507 aa, Pseudomonas aeruginosa
PGTTKTMSDQQLDQHELQQEENKLIAQRKEKLAAVREARAIAFPNDFRRDAYFADLQKQYADKTKEELEAAAIPVKVAGRIMLNRGSFIVLQDSSERLQVYVNRKTLPEETLAEIKTWDLGDIIGAEGVLARSGKGDLYVDMTSVRLLTKSLRPLPDKHHGLTDTEQRYRQRYVDLMVNEETRHTFRVRSQVIAHIRRFLSERGFLEVETPMLQTIPGGAAAKPFETHHNALDMAMFLRIAPELYLKRLVVGGFEKVFEINRNFRNEGVSTRHNPEFTMLEFYQAYADYEDNMDLTEELFRELAQAVLGTTDVPYGDKVFHFGEPFVRLSVFDSILKYNPEITAADLNDVEKARAIAKKAGAKVLGHEGLGKLQVMIFEELVEHKLEQPHFITRYPFEVSPLARRNDEDPSVTDRFELFIGGREIANAYSELNDAEDQAERFMLQVKEKDAGDDEAMHYDADFINALEYGMPPTAGEGIGIDRLVMLLTNSPSIRDVILFPHMRPQA

SEQ ID NO: 18223 - protein, 259 aa, Pseudomonas aeruginosa
RPIDSTRKSPNNAPSSASGGNTVSRVAPRDSAAQAASAVAESVRYQGRKASRQGSEQRRQAILDAAMRLIVRDGVRAVRHRAVAAEAQVPLSATTYYFKDIDDLITDTFALFVERNAEALSAFWSSVEGDLQEMAAVLADDPGARGSLVERIVELAVQYVQVQLTERREHLLAEQAFRQEALLNPRLRELADAHQRILSLGAVHFFQVLGSGQPEQDAKVLTSIILQMEYQGLVDGVEQLAVDEMRAILRRYLNLVMGL

SEQ ID NO: 18224 - protein, 215 aa, Pseudomonas aeruginosa
PERQPRHGGVFHTRTFPRPAGRRLRRVPKERVMKAWRCLVVLSFLLLGGCLVTFKEPIPPREAAPSHLLGTWSRENEWKEEQFLEITRSGSNVYRALSYVDSKDNTESLEDYGFTVSHQGKRWYLSAGLPKSLGGNFIIAGFEITDGDELVIYNLDVERIVEDLGAGQLDGETVDSDQGKGALVRSPLAKVFAYLNDPANSDVFVEAARFQRVTQ

SEQ ID NO: 18225 - protein, 661 aa, Pseudomonas aeruginosa
RASSSSTTTSSSPCARASSNRSPCCSAARPPWKTCAPCANWWTRAWWRRRSTCRRSSATSTRCRPGCASRTSSTTSAWTASKRTTRTSSDRSPPCRSFPVRAGGRPASKENGDGQPRTRLPHPRRIHADRGDRTRPRGNRDRRGRGDELHDRRHPLHRADGRRLRRQPAGQAVERRQAQARWRVGVHDPLHQRRPGQAARGLCRALSGQRGGGGPGRCRRAPVLPEGLVPLRSLWHPGRHRLHQAPGRRFLRRRGLHPAEARGRWPGLRPRRRHADPPPVEWRDAAGRHRLPGGLHRRHRLRRATGRRPEEHAVRRRRIAADHPQGQRHRLAAEPAVLAPGRAHLRRHLSRPRRGKDQQRMKRLLIPLLVLGALFLGGCSSLLFYPEPVVQITPARAGLEYRDVTLTTADGVRLRAWWLPAKKGVPVKGTVLYLHGNGGNLSWHLGGTWWLPAEGYQVLMLDYRGYGQSEGQPGLPEVYRDIDAAFAWLDQAPEVKGTERVLLGQSLGGALAIHYLAEHPQRQGQFKALVFDGVPASYRGIARHMLDGSWLTWPLQVPLSWLVPDDDSAIHSVARLSGAPMLFFHSIDDTIVPLENGIALYRQARPPKVLQLTRGGHVQTFAEATWQEVMLRFLDDPHGFTGLRRLAEIPNRESAKPEGNP

SEQ ID NO: 18226 - protein, 430 aa, Pseudomonas aeruginosa
NFLTEQSASGVVAERHLCSLKPVLQGSSPRNAQLPQRSRTEHSGRKKPHLSGAGGGQWGLLETLAQQSQTVEHHQQAGAHVGEYRHPQGAFACQGKGEEHRLDAQGQGDVLDQDRVGGARQPDELRQLAQVVVHQRDAGGLDGRVGARRAHGEADVGAGQGRRVVDPVADHADPRAVGLARFHFTQLVLRQEVAASCVDAYLGSDGGCGVRVVAGEHQGLHVQRVQLADRLAAAVLDPVGDGEEGPHALRIAQRDDRLALALQGVQALFQGRRAEAQFLHQAMVAEVVEDAVDASADASSRQGSEVLDHAQGKAILFRCVGHGARYRVVGTRGQAGGEQARIRPVSLRDRQVVGLLRFAMGDGAGLVEGDPGQLAPEFEEHPALDQDAQARRGGKAADDGHRGGDHQRAGTGDHQQHQGAVDPVQPGAAE

SEQ ID NO: 18227 - protein, 383 aa, Pseudomonas aeruginosa
QRRQHRGGEGDEEYHRGVDAGETVDETLGRCAGTLGFLHGVDDPGQGAVVGAAGDAVLQRALAVDAAGEHRLADLLLHRQAFAGDRRLVDAGAAAGHLAVECDAFAGLHAHGGFQFHLLGRQFLPFAADQHGGLFRSQLQQAADGVARAIQGLRLDQLGDGEQHADHRRFRPLADEHGAGHGDTHQGVDVQVTVLQCDPALAVGRQAGAEDGQQGEAGDHPVRRQAEPFDDLRGQRHRAGQGQRPPGFRRRLRGAVGIFAGIQRHRLHAEAGDQLLQRLDAVEAMLDAQQALHQVEFQRLHCRLATEGVADQAFLGRAVHRFDAQVAPAQLGVAGQGSDGGHRRARRVAVPMIMSVTVTASVGVFVAHGNNSRLTCWVRLHTL

SEQ ID NO: 18228 - protein, 801 aa, Pseudomonas aeruginosa
AKLVSHPQWRQVMPEIDARLREDVHHLGELLGDTIREQYGPRFLDKIELIRKGAKAARRGSAEGAQQLTATLDGLEEDELLPVARAFNQFLNLANIAEQYHRIRRRRPNEPEPFENLVLEELLGRLKDAGHAPGQLARQLAGLEIELVLTAHPTEVARRTLIQKYDAITAQLAAKDHADLLPEERSRIQQRLQRLVAEAWHTDEIRKVRPTPVDEAKWGFAVIEHSLWQALPNVLRHVDEVLLRSTGERLPLTAAPLRFASWMGGDRDGNPNVTASVTREVLLLARWMAADLYLRDIDRLAAELSMQQASPQLLARVGDSAEPYRALLKQLRERLRVTRNWTHQALAGEVPAAEGVLEHNRDLVEPLQLCHESLHACGMGVIADGALLDCLRRAATFGLFLVRLDVRQDSARHAAALSEITEYLELGSYDEWDEKTRLEFLLEELNSRRPLLPAHYQPSADTAEVLATCRAIAAAPPASLGSYVISMAGQPSDVLAVQLLLKESGVDWPMRVVPLFETLDDLDNAGPCMERLLTLPGYRSRLSGVQEVMIGYSDSAKDAGTLTAAWAQYRAQEKLVEICRQHEVELLLFHGRGGTVGRGGGPAHAAILSQPPGSVAGRFRVTEQGEMIRFKFGLPDIAEQNLNLYLAAVLEATLMPPPAPEPAWRAQMDRLAKDALLAYRRVVRDDPQFVEYFRLATPEQELGRLPLGSRPAKRREGGVESLRAIPWIFAWTQTRLMLPAWLGWETALLNAIERGEGALLGQMRERWPFFTTRIDMLEMVLAKADADIARLYDERLVVKLQ

SEQ ID NO: 18229 - protein, 118 aa, Pseudomonas aeruginosa
ETGSRQTPNPLRTPNRMNTHKHARLTFARRLEMVKQMTLEGLDAVRAAAAHGVTAPTARKWLGRYLAGGQAALADASSRPLRSPRAIDAGKALLIVELRKRPMLQARIARSVGVSEFN

SEQ ID NO: 18230 - protein, 149 aa, Pseudomonas aeruginosa
RLSVPIDDHARLAFTAMHPDEKTAQAVLFLRNAVAYYARLGITVQRLLTDNGAAFRSREFRSTCVELGIKHNFTRPYRPQTNGKAERFIQSALREWAYGWTYQNSAHRTDALASWQHHYNWHRPHSGIGGIAPMSRLNSSRNNLLTLHS

SEQ ID NO: 18231 - protein, 190 aa, Pseudomonas aeruginosa
GAGHRLLDSSGVKAVYAGGRARRGKARKGCKRFHLRHSVAPGVFTFAPRSGIKGPFSGEPTMPLSRRPVAWLASLAVLMNLFVVPLSQALTTQERASLLLGGFCSTSSDSLLRLKLSAAFKDIDLPDDHESLAPHLCCCAGAAGTPGLVASWPALPLAPLASPARNAFSATDLPPLRYWRLANPRASPVA

SEQ ID NO: 18232 - protein, 179 aa, Pseudomonas aeruginosa
LPPWNRRSDGKRPVIRYWRVTMRTSFFAAAALLAVSAFAQAHEYSAGQLHIEHPWALALPPTSPNGAAYFVVQNHGKENDTLLGADTPRAASAEVHEHVHKNGMMSMQKVDSVDVAPGKDLRFAPGGYHLMLMGLKQPLVAGERFPLTLHFRKAGDVPVEIVVESKAPAEQGGHEQHGH

SEQ ID NO: 18233 - protein, 606 aa, Pseudomonas aeruginosa
GGFWSRRGVASEWPERQLSLESGQPAHTHRGAHVPPVRGRGGLRPHQSVPPVGALPGVRPGVLRPLRAGLRPACLRRRAGPAANHGGVHHRGRGRAGSAGRGADRDRAELARSTRASATSAAGCVDRGPCTRCATGGLVPGGLRAGRGRVARRSPRHHPLDVGGGFRWALPCGAGGARRAVHLGRRPADLGRHRRRHRLLPAPGPPAARCADYQSPGPAPGGGAASAGRPGPVHRAAAAGQRPGRPSRRAAGVAAAEPRPGAQPGQPGTAGADEPADLHPAFPPAHRHHRQPVAAGRTPGTGPAPAGNHRAFGAGDRRAGRLRFGGVVAPAVLRRVRPAAAGLPARLRLLVRQRALLQLLAPERVHRLQLHRAEQRLRRAGVPGPELVAEIVVPPFAGQVAETGVEHRVIEQATMIADASLARVGLRQAFEVGGVGGRHGFVEGAAHVQPAALGVAQGDVHRAAGEMRAGRLAAAARRRDELAGEPFQLGFAGPWVVRGQGAGQAVVEILLHGERPPGVQHHQAHAAGEGGGDPQETLEDLAASVALRDRVRNAELVVGRPDAEVTAQPERLQRRAGIDDGDAGHGVPVGLRENGDGLGEVGHGVN

SEQ ID NO: 18234 - protein, 1142 aa, Pseudomonas aeruginosa
LDALQLGGDHRQLAHAGAVVDQRQRLVAQRAHRHRAAVSGEGMVGGDDQVEGLAGVDVHVQFAVLDRGVDQGQVDGVFLDQRHAFVGPGHADLQLDAGVAQDEALQWLGDQVGDEALADRQAHLALAQPLQGRQTRQHALFVGPLLAVVRHQQFAGLGRRHALRGALQEAHAEMFLQAGELPADGRGVDVQVLGGAAQRTVVDHLVEVGQGPLAEADHRGSVQQRQGHRRPVVVLDPHLQFAFREARLQALSRLGLAGIADRPATLVEEDAVAAAQGRQRADHVERLRQSFEALTTILQYLAGGARQARGEAVELLPEQRQGAARMLCGETRLQADQAFVADRQLALEGTAQAHVQVVQALRLLAQAFAGMAQAAGDAFQAQAFAQQLVAHAQHQAPAQAVETLLQVAGVGRQQFGGGRRRRRAHVGDEVADRYVGLVADRADDRRGAGRHGARHRFFVEAPEVFQGTAATGQDQRVEALPVGQLQRADDLCDGLAALDCGGHQGQLDLRCSAAKHADDVADHRPAGRTDDTDAARMGGQRTLAFAGEQAFAGEFFLQCLEGQAQGAVAGRLDGIGDQLVVAASLEQRDLPAHLYRQPVAQGLAYAQGVLPEQRAADLRVAVLEGEVDMAGGRPGEVGQLALDPDLREHVFQQQAGALVQLADGQHLAIEAEPLEGIVTHGRHDKAAHRDVRSILGFVRQILQEIFDEAFHQGAIVASPGQRHLAVCLGLGQRHEAHGGRCDGAHRGGHQGDAEAGLDQLQLAGLARQRARRAWVETGAEAEFGGAIAEAAALQVGNGDEGFSGQGGQGHGGFTAGQRMVGGESQEQRLAVQGAQVQPGMLAQHRQAQQAKVQASFGEIGELLLGGLLGQFQADAALHREVAAQRRLQAAHQRHRAGVPQAQQAMAAFADLASQAPGGLQVAEQALRAWQEGATGRRQLDLARTAAEQWGADAVLQFAHLPAERRLGDEQAFGGTAEAAGLDDFDEVMELPQRDHRKIPHAFSRWLQGSDCIGWRAVALARVRRSSFRESPCPRSIRQSCSPPCRSAYGNGCWSNWPSSSPMWCSASPASAPRWSPARCWPGCCRCRRSFRCWSCWISARRSATGCRRGGRSPSLSSSVCCPACCWAVRSGRTDFWRYARSC

SEQ ID NO: 18235 - protein, 449 aa, Pseudomonas aeruginosa
RHPRALFDDQRQACADHRPAGRADRPGAPAERRQHRHLPSQPAQRRGEDLCHRWPSGGTTRLRGAVLDRSRDAPGAGAEGAGSGHRAVPARRAGTPGDDPQRGQRRGTCRRLAEAVAGESGERTGPGQCREDRFPFRVGRGHVRYQRQESLSVVLADQRQGLGRRRGAQAQRAAAGQAQGRPELHLRAAQHGAVPAPDPPAWDGLQGAGFGSPGHHPVLHRHLPAGQERDCPRRAGGGQSGPVDVPLPRHRPYGDRPDGDHRGRRGLVRVTKLISNGKGYPTVKGVRPIIDRSRDPHFMREALAEAEKAAALGEVPVGAVLVREGEIIGRGFNRPISSHDPSAHAEMLAIRMAAAEAGNYRLPGSTLYVTLEPCSMCSGLLVHARIQRLVYGTVEPKSGAVESRGRFFEQEHLNHRVMVEGGVLAEECSQTLSAFFRARREAAKKPRED

SEQ ID NO: 18236 - protein, 226 aa, Pseudomonas aeruginosa
GGLFHGIYFIRIILLLYLYPGIIRAFHPWEPVMANDPYIQSFTCFDGTRRLLTAALPEVALALKQALAGGAAGPLLVLDNATGRSVDIDIRGSSEDRLARMVVAGERQPAEEAAPRGRGRQKLGVVAREVTLLPRHWEWLAAQPGGASVAMRKLVEEARRSQSGRARQAQERAYHFMNAMAGDLPGFEEATRALFAGDREGFAERIAGWPTDVREHAAWLASDGES

SEQ ID NO: 18237 - protein, 139 aa, Pseudomonas aeruginosa
CRTPSGCSAPCRNSWRPDDWQEDGGWLRMFPQRPGLGGLIRHGGRCGLQLVAPTFFPEVRRVSPGDTLRLCTCGASASLPDCPADCRNGLTLHATRERLLLLCRCGRSADLPYCDGSHAPSASGLKARWRRFRGLSVNL

SEQ ID NO: 18238 - protein, 160 aa, Pseudomonas aeruginosa
TPARRCCDERTNVALICRKGSVKYSSCQGKVPLFGVGSRTTTDRLVQHSIRAEKTMYKLCFYVPESHLDVVKQAVFAAGGGRIGAYDSCCWQSLGQGQFRPLDGSQPYLGQVGQVEHVAEWKVELVVADELIHASVKALKAAHPYETPAYEVWRLTDMVF

SEQ ID NO: 18239 - protein, 205 aa, Pseudomonas aeruginosa
ALRCSSSSGAARRSRKRNSVRSRPTPSAPLAKASAASRGEATLAPISMRRPSRVSASRCASACWRRRCSSRCATCKATCSRRRASGLSSSRPWPASSTTCRPSSSSSSPAPSATRHGRPLLRARMATWEVAPPSAMHRPAAPASTSGARSEGVISRAATMAPAGTRNGAVSPSSTRSTRFSRSRRSLARSASSRLPSAWRISHWA

SEQ ID NO: 18240 - protein, 202 aa, Pseudomonas aeruginosa
IARCQAWAAPTPWSISMSAASSRPGSSSSARCAEKIAASFSSPPSLACCRLPCTSSRTRCRAWSRARCCSSGRCRPSSAGRLMAPSRARGPLARPGEAQTPARVPATAAGRAGSPGAMARGASFGAPAVALARAASRASRAASLSSPRQITSTSSCSATPRPMMPTRLSTLATCPAKCSSAWLEKPCAVFRSSAAGRACRPP

SEQ ID NO: 18241 - protein, 431 aa, Pseudomonas aeruginosa
WATRARPRTWRCAEPSPGAGLAGRCSAFSGLSCRSGAPTSTGLVVSGRTWKPSPLVRIITVIRLRLPRATRSRSKRSSGWPSITRAPSSTSASKPSPCSCTVSRPTCSSSSAPLSARRLSAWRVRARWLTSPAQGACRQSLSGSMAMPSPRVPLENTGSGTRLSGITGPLRGALRARFLLFMGARSGSVGSGDFAQVPWLVRVHAAGFGQAGGHDVEALDRQDRIERRMRGALQRQVAFGDVVRGSEQYLRTALAHILGERQQAFLLRAAGSEHQQRIALLDQRHRSMADLGAAEGLGLDRRGFLEFQRGLLGDGVAGAATDHHQPLAVAQGLDGRRPVEPGGLLQPGRQALAGGQQGIVALPVGEQAGAGAERGDEALGRCDAALGAGAERHDEFAGGFQRRIFGIHQGDAQGAAFAQDAQAVHEIGALS

SEQ ID NO: 18242 - protein, 399 aa, Pseudomonas aeruginosa
APSWLRMSAISSRGAVMVVASSEVVPKRRWVRAMVAKASPPSMMSRPPPPCTCRSMKPGSRYGSALPAGSQGSPSIRWIRPSWMCRRPRTQPCGVRMLPSSMAAPCRSASQFGDEVVVVVAAVGVGQLDRGVVLEVADPGHQQHRGARRDADQRGIGRGRVDRAHVLEGADHWATDAVQVFVEGIADRCRVRQQARRQGAVLDRHHCAVGLAQALHARDLLGRREAEADQFVVGGQGDAALQPGGAGGEAFQAEHLAEAGETRQRLFETRRNEGAGALVAADQPLLEEYFEGLARGDAGNVQGFAEVAFGGQRFLRFPLAGMDRALEIARQLQIEGGGLRLVGTQGQEQVVGCLHERFRCGLCCCRPVMLGKLIPLEYHVNASCASRTRQPAVPSIDLA

SEQ ID NO: 18243 - protein, 320 aa, Pseudomonas aeruginosa
SRPAASSSPGAAQWRDGRAGPGRPTPAGCRRRYAGSGSARCGRRRRRSAGGCRRPGCAGPPWRRTGCRISCQVLLRGKAYLARLAGRRQGPVREGWAGRGFRAMISGKRQDLGNPGSMNCTLDELRQRIEAHRPRQLDTDQRFPQAAVLVPITRSDDPELVLTLRAAGLSTHGGEVAFPGGRRDPEDADLVRTALREAEEEIALPPGLVEVVGPLSTLVSRHGIEVTPYVAFIPDFVEYQPNDGEIAAVFNVPLSFFRDDPREVTHRIDYFGRSWYVPSYRFGEFKIWGLTAIMVVELVNLLYDDPIDLHTPPASFIKLS

SEQ ID NO: 18244 - protein, 241 aa, Pseudomonas aeruginosa
GDRDEIPPGRCPRRNPSRQLDRAQRSGDRQGSPGCRRQRLVWRGAARRQRADPYRRAQQRPGRLGDAHRHGLSADPRQGRHRRPQRHAAWLQRGRLQPGGDQRGDPQWGEDRQVLHHRRQRADSRGQGDSRRLAGDGLAGQGSARAERAAEEDARGQRRPLCAQCPPLRPRPRRGPGVNERPVASPCVHVCALDEQDICIGCQRTAAEITRWGLMSNDERREVLGRCFERAKAQGLVSGSA

SEQ ID NO: 18245 - protein, 529 aa, Pseudomonas aeruginosa
SGFRFLSFPRFFHDPYRYPPVAERDPRPSLWLRRAGQGSRHRAATPGLRSDRRRSLWQRAGHAGGTSQPRDQHARRRRPARGDRAGEAALHRAGDRGHRHRDPGRAGGRRLHRGAHRPRRATDHEPRGYPPAGCRGARLADLALSLRRYLRGLPPWRRVRRLPLRGEADHEFVGQGPERPERPRRPAGGLGLCPGRRARRQGPGDRRGLHRFRLRNHPAHRAPRRRHHFLRANRSPPGQGRLPRVLAAAGDERAGPGRVRAGRPGSDRGPRRTRAVRRRTVRQGRPGVVQRGVAASARYRPGDPDFPGSFRVRAARAGDPRPADPGDPPARPVGLGGDPGGRQVPAGRFRQPRRRAERGGYGATPVRQAGSGWPAADGRGPGARRVDRRRPRQGDPGRPGGSRRTLRCAGWHRWPGGRRLCRCCRWRCRWLSAPAAEPCAWRPRRDLAKGWSVGPVPKSRCACCCSVSRQWPGSAPVAWITPWPAAWPRRSASVCGARWHGRRWARTVSPAARRANACYRRWRDVSSTR

SEQ ID NO: 18246 - protein, 376 aa, Pseudomonas aeruginosa
PERDSGHCAEVVVAGFLQAQHRQQAEQRRCGDVAADPAQAADADQLLGDIGRHRGAENAAQVVGRRRAGVAHVGGEYFRQQRAHRGEGDPHQEQLDAEEQGDAERRALAEQRLHGEAGGDRRQAAEQQYRLASEAVAEPGRQRRGGGHEEHREAQQTKELLAAEAEAGHPVAQREHRGDIEQRITHHHRQGAEQGRPPVLGEQLGDRQADPLVLGHGLGEHRGFRQLQAYVEADHNQRRAEQERDPPAPLTELLLAEQHRQGQEQAVGGEEADRRAELGKHAEPGALAGRRVLRGQQRGAAPLAAEAAGPGRSAARRAATAPSSRCCRNRGGRRSGWWTPPSAAARRPGLTCARCGRRNGRTAPSPADGRGMRCQR

SEQ ID NO: 18247 - protein, 136 aa, Pseudomonas aeruginosa
SAACRNPRGRIAHVRKPYRPPLADASPCHRQGQADRGQHQGHSARSAHGPARGRRGPAGGQGLRQQGQGARRRYRGLEEPDPGTGVREDRPRRARGADGGGQRGPGAERRAAGGDPDGRPAGRGQDHHRGQAGALP

SEQ ID NO: 18248 - protein, 110 aa, Pseudomonas aeruginosa
SLEYAAFRAVGPACIHFASTDYRNEVHMVTIRLARGGSKKRPFYHLTVTNSRNARDGRFVERIGFFNPVATGGEVRLSVDQERATYWLGQGAQPSERVAQLLKDAAKANA

SEQ ID NO: 18249 - protein, 180 aa, Pseudomonas aeruginosa
AVMSEMPTPADDLVVIGKIVSVYGIRGEVKVYSFTDPLDNLLDYRRWTLRRDGEIRQAELVRGRLHGKVLAAKLKGLDDREEARTFTGYEICIPRSELPSLEEGEYYWHQLEGLKVIDQGGQLLGVIDHLLETGANDVMVVKPCAGSLDDRERLLPYTGQCVLSIDLAAGEMRVDWDADF

SEQ ID NO: 18250 - protein, 254 aa, Pseudomonas aeruginosa
SSMDKRLWVGVVSIFPEMFRAISDYGITSRAVKQGLLTLTCWNPRDYTEDRHQTVDDRPFGGGPGMVMKIKPLEGALADARQAAGGRKAKVIYLSPQGRQLTQAGVRELAEEEALILIAGRYEGIDERFIEEHVDEEWSIGDYVLSGGELPAMVLVDAVTRLLPGALGHADSAEEDSFTDGLLDCPHYTRPEVYADKRVPEVLLSGNHEHIRRWRLQQALGRTWERRADLLDSRSLSGEEQKLLAEYIRQRDDS

SEQ ID NO: 18251 - protein, 312 aa, Pseudomonas aeruginosa
ASSVAATCARPSCTTSAPCPARPRASRKNWSNPVLLREKQPEGCFFHVWRSPFRRRFLLPTAAHNQYNIRGTQAATPSGIRGMTPREQEILRRTELSETRVTKAVFPPTTNHHNTLFGGTALAWMDEVSFITATRFCRLPLVTVSTDRIDFNHPIPGGARSSNWSDGWSTSATPSSRWRSRCTWKACTPTVARRPYTACSASLPSTTKSGRFRSCRGSRSARRLETGRKKAPTGAFSISPDDPALGWDQGRRLIFREAWDRSICCRLTLPNVCSRGAPAMRILSKRTSPILLGRRRLTEPSGLSVLCVLPVS

SEQ ID NO: 18252 - protein, 415 aa, Pseudomonas aeruginosa
RFRVDQRQQRPAGARRQRGLWRGDVHPAVRIAGEQQDRGLAVQRLVVVPAEGVGEQGGADFGAARQQAGELRVGQRSLAKRTATVFVAGAVLVGTLGFLAGRQAEQLAMAELVAEAHGRQGIQLAGWRNPQQMPDADQVEVGFGVLRGGIAEIGGQVVHAGGADVFPARISQQHAAAEALQGLADGAPDRIGADDQVAAGRGLGDLQQARQGAGGGALQDHRADDHQKGQRHQQRRLGMAFGAQADGEDRRDRRGDDPARGDPAEQGALAPAQRRTPGRQRHVQRPGDELDQQQHQQRRRAQAEQGIDVQARGQEDEQAGNQQDAEVFLEVQDLPYVDALHVGQAHAHQGDGEQPGFVHHPVRGDEYAQHRGQRRQVVQVVRQPVAAQDDAQRPAAEDAEQAAAEDHSTEGLQAV

SEQ ID NO: 18253 - protein, 339 aa, Pseudomonas aeruginosa
KTSRAFIWFAAFIHEYPRTSPDRPFPRCPVAGKRPCRQLPRGLSQRPPAVQRLARWPPAAPGRDLPLRHPRLPGLAPGTGLQGPLDRALPLRPAWLLSLLPARRPDRRGSHLAGGPAANGQAVAEIPLRSGRRGIAGGAGSRRPAGPARSHHARSAVCLRPAGQRTGRPDPGAGQPAPGRGQGVRQGQQGAPGAARRGSHRLARTLPARGPRRPARRAAQRRAVPQPARRTDDPPDLLASHQASRAGGGDRHVDFAAHPAPRLRHPPAQPWRRPAGGADAARPQRPVDHPDLYPYRPGPPPGSARTPPPARLTLCPKNPYLPEKRRFRSVLRQASGPSG

SEQ ID NO: 18254 - protein, 237 aa, Pseudomonas aeruginosa
DGEFQRETGQSRHLWVGDRRWRYLQCTQTQRRGDCPPCRARYRGCADRRPPAEPEVRYRCDPHHRRYLRRSVQSRDRRGRRVDRRLHPGPRAGAQGHRERQARGHREQGADRRARQRDLRQGPREGRDRRLRGRCRRRHPGDQGDPRGAVGQPHQLAGRDHQRYRQLHPQRNAREGPYLPRRARRGPGPGLCRGRPDLRRGRHRRRPQADHPRLDRLRHSAAVRQGLHRRHLEADQR

SEQ ID NO: 18255 - protein, 450 aa, Pseudomonas aeruginosa
PPLPGWIGERGRPVRGAPMKGSAYRSDGAFPAQGGDALAVVAQLGEQGIGMLAQFRAYPIRRAWRGGQLGHDARHAEWLAVRQACREEHLAGKELRIAEHVFGGVDSAGRDFGSRQHRQHFLQGLRGDPAVDNPIEFVAARIAPVVAGQLRVAGQVVAADGLHEAAEDRVAVGADLYVAAIGAGVDGGGGDARHDVAGALADETEHVEFRNHAFHHGEDRLVEGDVDHLSLAAVDLAVSQRHQRADHAPQGGDRVADGNPGANRRAVLEAGNVAQSAHRLADRAEARLVLVGAGLAEARQAHHHQARVQRVEDIPAQAELFQYAGAEVLDQDVGIAEQAFQDRLAFGVLEIEGQGFLVACLNEPPQRGAFVELAPLAQWIAAVGRLDLDHFGAELGADPRGERAGDQGAELDHLQAGQRFGRMFHAVSVRLQCAHSLEHLPAVRAGAAVG

SEQ ID NO: 18256 - protein, 444 aa, Pseudomonas aeruginosa
VHATEIISPLSACLSPAPARAGPGEEGSLDLAGERRGARRHRADAASPGCRSGSFGEGGRHDGSPGMERSLAGRGPERHRAVQQRRGPDRADRGGGSESLCDHARIRRPAGVRRAPGRADHRRGAALAGKRRYRRDRLQRRGPAQPATVPAVEHRPAQPAGRGALLQHVRRVEHDFVAGQRAARNRNPGRQRDPRHGSLRRLPESPGLREDTIMTVWSKLLSALRGGANEVGEAIVDSQALRILDQEIRDADVELRKSREALASIMARHRLAQERVEKGAAQVAEYEQYAIKALEAGNEELAREVAEKIATLENQLEGERAQVAEFAASVAQLRKSVSQAEGNIRQLKQQVDTVKATESVQKAQMAVAQRYGNSKSKLQTAVDSLERIKQRQAERAATMDAAAELASAAAPDDALDAKLRAAGIKASGNSVDGVLARLKEKGKA

SEQ ID NO: 18257 - protein, 564 aa, Pseudomonas aeruginosa
ESRRTAAMDMTSLMPLLLGVGLVVLLVVGLLALFKAFYIKVPQGTALIVNDMSSTPKVHFTGALVYPVIHLKEFMRISLITLEVDRRGKDGLICRDNMRADITVAFYLRVNETQDDVLKVAKAIGVDRASDRSAVNELFNAKFSEALKTVGKQFDFVQLFENRQDFRDRIIEVIGNDLNGYVLEDVAIDYLEQTAKNSLDPSNILDAEGIRKITELTATQNVITNELERNEELAIKKKNVETREAALALERQQADAEARQKREIETIRAREEAETARVKEEERLKAEQARIQAQQEIDVRTENHQREVEVAQQNRQRAVVIEVEKVTRAKDLEIVAREREVELQKIEKEKALEEQRKNIANVIRERVAVEKTVAQEEERIKEVREVSEAERVKQVILLQAQAEAEQELVRQVKQAEADEARSKHKAVEINTMAQAELEAASKQAEAKKRLAEGIEAERAAPGLADARVLEVTAAAKEKDGLAAARVRAEQLIAEARGDEERGLADARVLEAQAAAKEKDGLARSPRCWPRSSAPRRAARSSSARPRPRPPRTRAARKRKYCCSA

SEQ ID NO: 18258 - protein, 612 aa, Pseudomonas aeruginosa
SARAPCSSPTRTASTSCSWNGCRASVDRRRRFLPSSRTSDLMRIEPRPLPETLPDLGDLPPLLARLYAARGVRCAEELDKGLARLIPFQRLKGIEEGVALLVDALEGGQRILIVGDFDADGATASSVGVLALRMLGAAWVDYLVPNRFEYGYGLTPEIVGVALEKRPDLLVTVDNGISSVDGVQAAKAAGLKVLVTDHHLPGPELPAADAIINPNQPGCEFPSKAMAGVGVIFYVMLALRARLRELDWFARRGLKEPNLAELLDLVALGSVADVVPLDANNRILVHQGLARIRAGRARPGLRALLEVAGRPPVRITSTDLGFILGPRLNAAGRLDDMSLGIECLLCDDEALARDMAVQLDQLNQDRKAIEQGMQREALAQLKELSLEQLPFGLCLFDADWHQGVIGILASRLKERYHRPTIAFADAGDGSLKGSARSIPGFHIRDALDAVAARHPGLISKFGGHAMAAGLSLPQENFGAFSAAFDAEVRRQLAEEDLAGRLLSDGQLSIQEFHLELARALRQAGPWGQHFPEPMFHGVFQLVQQRIVGERHLKLVLKSECGSLQLDGIAFNIDREQWPNPTVRWAELAYKLDVNEFRGQESVQLMIVHMAPR

SEQ ID NO: 18259 - protein, 134 aa, Pseudomonas aeruginosa
CYSPATFAPDRTSRKDARMHANAGSPHASLPDSDVALLANILVLATRNMNNMTTMLAHLSVELSQSEEPRLQRVGHRVLNELSELGAALETQWDLIGALARFSPLLERTLPRQEPLVTEIHLTELPGQALPPSA

SEQ ID NO: 18260 - protein, 255 aa, Pseudomonas aeruginosa
TTGPFYHHVQGGAFETVFEKGLGSGVEHGAAALPAAFGQTGRSIVHERYRASRGGGRKVRMVGRRDGPFKPPGGLLRAFLVRVDAGHLRTVSYSTVLASTSAHSSALPPRRSPPMNAPAKSLLDIDAFPLVQVREMPRELADVERWLEEVEALLAVERDFALVYPPLPQETAEDDQQARKRLVLWLKENRQRFVEHCRGILLSANGQPDNLADLQQLAPVLQAVYGPPVSVAPDLASARGMAKALLSGPATGMNW

SEQ ID NO: 18261 - protein, 1196 aa, Pseudomonas aeruginosa
PVHSRSSAPPGQPAMAGSCQCDLRRHRRCPACRQGDHRPAVAATELRRRPRRAELDHVRLSVRRRIRRHRRRPPGALLGRSPAADRWAGDSRRGEPARCVDAGLRLVACHSLRRGARFPHRGSGGARRVAQDHQRDAAQRGVRSVEHLHGRRNRPLDAVRAAARGLACRLATERTAGTGRGAAAAAQRPCRRWVQGGRREAGRSWRVAQGSGDHPAGARLHHLQPAVLRPDDVPPRVPHAAPGRRPGDCGTHRRGHRRGERPGQCRGGLHPFPRHTSRRLAGEHRDPDGTHRCGVLPCRDAGTPGDCAGVRLLGGRRHASHHRAGDRAAGLARAFADATGHRLGNAGQLPGAGDRPLADRPDRQPFRLVGRDRPDAGRGRGGGRPGVLPAACAGRPASRHCHGFRGSPRGLEEKPASCRAGSRATIRPAHWFGTGGQRPPPSLGSVVAGEHFQQFDLEQQVGVGLDVRADLPFAVGQVGRDEQPSLATDLHAHQALVPTLDHSSGADHALEWPAALVGGVEQRAVFQGALVLGGDQRTLLYLLAVAQEEVFDLQSVVHGAVPARFAESRDSASKRAACRRADGSGHCQAVRGTGIMPAPFRREGYRVPRCRAHRGWTHISGIIREHIRMQRLSRIGRNTLAVSVSTLLLSACNQGDDAPKPAAVAPQPAAPSMAALSIPLCLNGQCAVIDQDAKLLVPFDNDYDNIVASAYQGTLMAAREERWNLIQAKDGKVLRDDIGEALSLLTPNLYGFVRDGKYGVVDGQGKEVQAPRFDDIYPNSANEFIIYEIDGKRGILDAKGKQLTEALYDTTLVNGSVAEHGGLISAERGEEKWIINLATGEQKAVAYESLGDLHDGVMSASVIGKGSQLVDAKGDVVGDGKSYDYLGTPANGLVAFREKYDSPCGYLDYQGKVAIAAQFAGCGAFGKQGGLAQQRMEDGSSGKYGLIDRSGAWKVQPQYDSADSAGLTALGYTVDVPGLAAVGVSTGLFSADFGIFNLDEGSEWVKPGYAQIGALGNDLFVVAKKGGPQKTVSFMGSESQVPVVGLMDRSGKMLLEPGELISIQSAYDGRFLEGLDGMDHAAHTVLLDRQGRTLVPALWQKLEVNPQQGYILGYEVSGTGDEATETLRALYDLNGKPRFTVATTDCGAEQLLDGNGKAIWPQDPTPYCQSDDEQDDEGEPEQEPAPVEESEETSES

SEQ ID NO: 18262 - protein, 151 aa, Pseudomonas aeruginosa
NECRVAEHGDDDDRQVRIAPPDLLHQAQAVGLLAAGHHQVGDQQVAGVRFELRQQAIGVLGLGDDPQVVVRTQQIAHADQGEGVVVDEDDACFHEIEPDLGGGFRSGYRQRRQADNPPGGSSGRARILAMVSVGLIRTFLNASRKFPMCFP

SEQ ID NO: 18263 - protein, 119 aa, Pseudomonas aeruginosa
LPRNVCFFIANERLASSRSRLAGHPQVRRPITRTTRRGSPCPRYWIPTTTSSLAPDLPAACWPTGFPPTLPTVSCCWKPAARTTIPGSTFPSATSTASATRVPTGASTPTRSPGSTVVP

SEQ ID NO: 18264 - protein, 653 aa, Pseudomonas aeruginosa
SPAVAWSAPCCSSAKPAIPTSTGEIAPRSRHGDGAHIPSVMSLSSQKSLACQFSFSFCHTSGVKKRLSSAYNSGKTLWRCLPVPGTAYTVRAIDGPLWRQERIRTRVLGKNVKNWTVRQRILASFAVIIAIMLLMAATAYVKMLTVEKGAYRVQDDAMPGMYFITLVRSSWTDNYLQTQELFGITDDHELSKAEADSILASEERLDQQIASYQKTMNPDEARDHELLAGFQAVRKNYLEQHDKVLELYREKRFEEAGKLVAGPLTEHWREGRKYLNEMIELNKDIADRASDNIVNAVDDAELSMLVTLLLAVVVAGICGFLLLRAITQPIQKIVRSLDLMAGGDLTARLNLGRRDEFGAIETGFNGMAEELKGLVSQAQRSSVQVTTSVTEIAATSKQQQATATETAATTTEIGATSREIAATSRDLVRTMSEVSGAAEQTSTLAGSGQLGLARMEETMHHVMGAADLVNAKLAILNEKAGNINQVVTTIVKVADQTNLLSLNAAIEAEKAGEYGRGFAVVATEVRRLADQTAVATYDIEQMVREIQSAVSAGVMGMDKFSEEVRRGIAEVGQVGEQLSQIIQQVQALAPRVQMVNEGMQAQATGAEQINQALVQLGEATGQTVESLRQASFAIDELNLVANGLRNGVSRFKV

SEQ ID NO: 18265 - protein, 455 aa, Pseudomonas aeruginosa
RTTGTGAMGAGRGIAARRSARPAVPAGVRRGDGMNDRFERLLKSRIGLDASSVGSAVIERAVRQRMSGLALHDEDEYWMRLNGSPGEVQALIEAVVVPETWFFRYPESFTTLARLAFERLPSLGGGRALRILSLPCSTGEEPYSIVMALLDAGLSEYLFEVDALDVSARVIERASLGVYGRNSFRGDELGFRDRHFSEVAEGYQLAEQVRRKVRFRCGNLLDPGLLAGEAPYDFVFCRNLLIYFDRPTQSEVVEVLKRLLRPDGAMFIGPAEASLLSQHGMQPIGVPLSFVFRRTSEAPRGARPKAVSDGARPVVAAAVERASIRPSPPPPAKPRQRLSSLVPPASGQPLASPVGEFDEIARLADAGQHREARAACERQLAARGPSATVFYWLGLLSDVAGQEQEAQDFYRKALYLEPQHAEALAHLAALLAARGDHAGARRLQQRAARGVNKDG

SEQ ID NO: 18266 - protein, 521 aa, Pseudomonas aeruginosa
LLEPHRRAWRQVLRTPGRACPLPQLRGLRCRGDLLAGPHRPAPGPARQRRNDGQPARTERPRRDAFDPGVPPGRRVVRPGHRQPGGSGADESYPFPAAPALARPARGDQRARRAGRLPFPRRTAGSRTRRRAGQRAPGGSAHADHFRRRRSGGGAGGGSRRHPCDSAGADTAAQPRRRPGLAPARGRRAAMARAEHHPARRRPSPASRSAEPGMTPDQMRDASLLELFRLEAEAQTQVLNAGLMALERSPTQADQLEACMRAAHSLKGAARIVGLDAGVRVAHVMEDCLVEAQDGRLLLQSEHIDALLQGCDLLLRIGTPPAGDAGWAEGAGREEIDGLVLRLEGLVRSGLPLARAELPATTPGLPEAVPEAPPAASAAASDDNDEEPAGQAGGEQAEERRSRVLRVTAERLDRLLDISSKSLVEFQRIKPLADSLQRLRRLQSSASRALDVVRETVQETALDPQAQAMLGEARQLIGECQQMLVQHIADLDEFAWQGGQRAHVLYDAAPGLADAAIRRRP

SEQ ID NO: 18267 - protein, 295 aa, Pseudomonas aeruginosa
RPGADGSRPGPLAGQAGAPAGRGRKHPGRPGCPGKTRSAAHPPATQCRRSRYRGAGNPPRRRQAGRGQDHHPRPPPRRHAGPGTERRRRRHRSAAPARDRAQSPVRHRRDRGATERGGTPGVSLPARLQHARAGHRGVRSRRRTGRRAAHGPPVARRRAHGATPGAGSAVSRRGAADPVRGAQPGGGDRRGGLRLPAGAHRAHVRAGSGGDRPARRSPALLVRRSPCRPGLGCATAATAREQPHRRGHPGSGGARPRCGLQRLRGTFRRGAYPGGDASRSAPGQGARRFRRRLAG

SEQ ID NO: 18268 - protein, 350 aa, Pseudomonas aeruginosa
GLAGCRRRPDRRSTGLRIGIVNDMPLAVEALRRALAFEPQHQIVWVASNGAEAVTQCAADTPDVVLMDLLMPVMDGVEATRRIMAESPCAIVIVTVDIEQNVHRVFEAMGYGALDAVNTPALGIGNPQTAAAPLLRKIQNVGWLIGQRDNRGKVQVVPPKAGGARQRLVAIGASAGGPASLAVLLKQLPASFNAAVVLVQHVDEVFAAGMAEWLASESKLPVRLARDGEPPIPGQILLAGTNNHIRLLRNGSLVYTAEPRSFVYRPSIDVFFESVANYWRGDAVGVLLTGMGRDGAQGLKQMRERGFLTIAQDQASCAVYGMPKAAAAIDAAVQILSLEKIAPRLAEVFN

SEQ ID NO: 18269 - protein, 180 aa, Pseudomonas aeruginosa
PAAWPTPATCWTWRSRKTTRAPSTTLPTKSSVCARSSRSWSSAACSAARWTRTTPTWTSRPAPAAPRPRTGPTCCCACTCAGPTSTASTPLSSSCPRARSPASRAPPCTSRASTPSAGCAPRSACTAWCARVRSTPATVATPRSPRCSYRRKSTTTSRSRSTRPTCASIPTAPPARAVST

SEQ ID NO: 18270 - protein, 151 aa, Pseudomonas aeruginosa
SSATAYGPCATARWPPRPRCRCRPPPTTSRTSTISSPTPSPSSSSATQRRCRRSGAAWRATSRRWPRCWPTTPAPVARWWNGSSSLPCSMSRSSSPSAASTCWPSRPSARRRCSTRACANWPMPTSGFSPSAPCISSKCSVPGSPSRTPRC

SEQ ID NO: 18271 - protein, 726 aa, Pseudomonas aeruginosa
TIPPIPTCSSRPPASSGSPNEIADEPAQGAERLPEDHPLPVRSHRRGADADSRAGCDQMGRRDPPGLPQGPRQACAEGRSRLLRQPPAGLRRQRQEAGIPEHRARHHPPVGPVQPGRADHAADVQGIPNGHSHARGARHPGPRADLPGTLRLGLGRLPCRRSDPGRPRPDALRLPEQHRRPRRSQGRTQDPDRQGGRTDPPGAAEHRVRRGGGHHPRVRVRRHRRRRGGRRRLHQGTRRRPVQRARRARAGGPRGPGARRHHPERPEPADLHLPRQGTAVLHRDPGRPGDPDGGDRLRLLPDPPAQADQSHPGDPHGRGGRRFPRRVPLLPRAGLQPGGQLPERQPGLPRLDPGWPAVHQGPVLPEGLHPHLQLHPARRAQGQARTDPPAVLRQDHPGRHAHPAPTGGRGPGGAAEVPAAAVPRPQRAVGLDVLLELPQPPQPGPHRSGLREHPLTVPRRAGLSRCARAVGRQARRTAMASHELDYRILGESMQTVEIELDPGETVIAEAGAMNYMTGDIRFTARMGDGSDGSLLGKLWSAGKRKLGGESVFMTHFTNEGQGKQHVAFAAPYPGSVVAVDLDDVGGRLFCQKDSFLCAAYGTRVGIAFTKRLGAGFFGGEGFILQKLEGDGLVFVHAGGTLIRRQLNGETLRVDTGCLVAFTDGIDYDVQLAGGLKSMLFGGEGLLLTTLKGSGTVWLQSLPFSRLAGRIYDATFRAREEVRTNNG

SEQ ID NO: 18272 - protein, 275 aa, Pseudomonas aeruginosa
RTPLHPDRHRYHLRHRRRALVLRLPAFRQAAGRPVAGRLHHAEEPARRRCEAVPGAGQAGRAVHRWRPGAVRHRAEGPFRRAGGQQEARRALRRTGSPAGSEMTEVRVWQGDITRLAVDAIVNAANSSLLGGGGVDGAIHRAAGAELVAACRLLHGCKTGEAKITRGFRLPAAHVIHTVGPVWRGGDNGEAELLASCYRRSLALAEQAGAASVAFPAISCGIYGYPLEQAAAIAVEEVCRQRPAHSSLEEIVLVAFDSSMAERYQRLLGERPVAR

SEQ ID NO: 18273 - protein, 268 aa, Pseudomonas aeruginosa
GLSAADGGAWRDRLGVVGNGDFHPTVHGTAGAGAVAGHRIFLAVATGGYAFRADAAAEQGHAHRVGTTLGQALVVVGGTGAIGVALYDHLALRVLLEELGQLLDVAHGAGLQVGLVEIEQNVAEGHHGAARGLLGIQLATQLVQLRGARVEAGLGALGGGVLQLRLGIAQDDGLLGQFDALVGQVGQLVHVALVFAILVGLVGLGQPVAGVLGFQGRDLGRVGLRLQRGEVAAGLFQVGVRRRGAGGQRQGQQGYGGEGNVLTHRGHP

SEQ ID NO: 18274 - protein, 226 aa, Pseudomonas aeruginosa
KRLRNSRRPLNTTSRLAPMSANTAIHRVPSPARVRARNTALMPRARVMFWTRIAWVVRDSRTNCGNLRRSSSISATPAVSMAVSVPAAPMAKPMSARARAGASLIPSPTMPTREPSAWRASTSRSLSSGRRLPRAASMPTWAAMAAAVCGLSPVSIRVFTSSACSSRIASRLLSLTPSATAKRARTRCGSHSAMTVLPWRSRASRRSSRAGEQRPSSSTRRWLPRW

SEQ ID NO: 18275 - protein, 184 aa, Pseudomonas aeruginosa
TRAKLSTKRWVGAREPWASSTAWMIRARVLSSARRVTRYSSAPSPLMLPANTGSPTSFSTGRLSPVIGAWLTLERPLVTSPSSAMRSPGFTRTVASSSTCLAGSSFHSPPTSTVACSGASCSRPRMALRARSRDFASINSAMANSTLTIAASGHWPMSTAPVTAILIRALMFRLRFFSAIQPLR

SEQ ID NO: 18276 - protein, 148 aa, Pseudomonas aeruginosa
VGRPAPRMASRARPATTQSGARPNHSTISEASAIAPARASGHQGFAGACEGPSVFSPASSGTACMPRPAISFCSGSTLSKRCWTRSRRCIRLNSSDSTAGWRPRASRIRRSSVGQSIASMRRSLQRNSALPARVPMAATAGRGAWRCP

SEQ ID NO: 18277 - protein, 605 aa, Pseudomonas aeruginosa
GNPRAARAVAQRIHHRQLRHRHQPGGGAPAAGRHDQRRGADRPAQGPAGADAPGILPRLGKRRGSRHPQGCRRRSRRHPWRPGVRPGAPERRAWRALPCRPRGRYGDPPGADPGGRRAGDQSGAATDDRTPPRPARRRTGLRRRLRGRHRRGGRRRAGAEDHEPAPGHPRRAVDPRHQRHRPAVLLLGLYRLDPSGHRCRSRQRRPSHRRLYRQRQRGRHAPALCAAGDRPDRDGRLRRRGAQAPAQGAGGKAQPVRRLRQDQQARRRPPRPAQPPFQHRPAAIGRLGRRARCQHRATGQHARRQHQPAGAGPGTRRRRGPGRCGLRPRPALRPRHRAHRGGAGSLRHRPPGQPGRPGLRGAPMKRLLLLGGIGEALALARRLGPAHLYSLAGLGKVPGDLACRVRVGGYGGAEGLAAFIDEQGFDLLVDATHPYAARISRNAVRAARLAGVPCWALRRPGWQAGPGDDWREVADWRELIAALAPFRRPLFTLGREPLEHLGQVPPHQHWTVRCLQGQPAAPRAEVIGARGPFSLDGERALFERLACDVLVSKNSGSQATEPKLQVAREMGLPVLVLARPALPPADREFADGEALLTAIRDWESA

SEQ ID NO: 18278 - protein, 219 aa, Pseudomonas aeruginosa
SERPPTRRDLSRLHLRRRSRRAEMLVENGRADQDQHHPADHLRALAGHRAERPAEHGAEGDHGHGGQADGTGGEEDVDVDEGQADAHRQRVDAGGQRRHRENPERMLAGLFLFRRMIRAQAVVDHVQAEQHQQDEGDPVIPVGDELAGGLAKQPADQRGDGLDHAEDYPGAQRLRQARPIQAGALADGRGEGIGGHGEGEEDQGNGIHADTPAGHESTT

SEQ ID NO: 18279 - protein, 723 aa, Pseudomonas aeruginosa
DGTPMPRFSRLRTEPFALGLSTSLLLVPPALAETEEAALALPSQLVSVRQDPAELDHIDLATPVSAGSRLGLSALDTPASTSSISGEEVRRRNNPSVQAAVTRSPGISFIGTPGDGGTGLSARGFSGHASVMQLFDGTRLYTGMGTVNFPSDPWMVERIDVIRGPASVLYGEGATGAVINVVPKKPFAGEIRNHLRLGYGSYDNRQLALDSGGSLTDSLSYRLNLNQQQSHGWIDRGDSRNLGISAALRWQASDDLAFTLAHDYGDQEPMNDFGTPLVGGKYHKRLREKNYNVRNDVQRYNDQWTRLTSDWSLSDSVTASNQLYYIKARRHWRNAETYEWDVPREELLRRDYLRISHEQEQIGDRQTFAFQHALFGLDSRTLVGAEYNRIRFRLTNNISPYTDVGGDYIDPWHPAPGYFESRSPYRPHSRSQTRTFALFAENRLQLNERLSLVTGVRRDQNHIDRDDLLTGTRSDRSLQGGNWRAGMVFALTPELSLYGQYSTSEDGVSNLITLNAAQQQMDLTHSKQTEVGLKQLFPDGRGEWTLAAYHIVKKKLLSANPLPPHDAQQVGQQSSDGLEASLELNLAQDWRLSANAALVRAEYDDFDETIDGQTYSRNGNRPRNVPRRTANLWLDKSFAETLRVGAGLRYVDRRYADAANQASLPGYTVVDSNLGWRVRPDLTLGLELYNLFDRQYALADNNNGQQWIMGQPRSFNVTADFSF

SEQ ID NO: 18280 - protein, 587 aa, Pseudomonas aeruginosa
TTGPASSHVVPSPRCPALVARRLHRVAARRASGSPGQQFRRPDRPQRQRQDQPAALRLPLCATAARPGGARRRRPLAPAAALGRPAYRGGVAGVPRGLRPCRRGRGRHGPHAAQGPVRRPRRGRPPAGPPGATPGRSRRACREPLRQPLRWREAARPAGSRAGPGTAPADPRRTDQPPRPALPAGASAPAARPRPEHPGELPRPQPGGGLLRPPLRARRRAHRRPGHADRGARCRPAVAGVRRPRPGRPPPPRRPPAPDLDYPSMKHPILHHLLLGALLACADAALAERYPLSVRSCEREVTFERAPSRAVSHDINLTEMMVALGLQTRMVGYTGISGWWKNADPGLIAALKPLPELVARYPTAETLLDVDADFFFAGWGYGMRVGGDLTPASLEPLGVKVYELSESCAQIGEPRRASLDELYRDLRNLGRIFDVEPRAERLVASLQARIERARAGIPANTEAPRVFLYDSGEDRPFTSGRLGMPQALIEAAGGRSVTDDVAASWTQVNWESVVARDPQVIVIVDYGETSAAQKQRFLEENPALRSLTAIRERRFIVLPYNQATPGIGNAAAIETLVAGLHPRAPRP

SEQ ID NO: 18281 - protein, 333 aa, Pseudomonas aeruginosa
SRRRRRTAGRARGIAWTGSCGGGAFILATRRASVWKLGALPAVGRRGHPVGAPEPAAEMALVGETESAGEVRRLPADSEHLPRLGQAQLDQVGVGWQAVGGLECTVQAEAVGAAGAGQLVQADVLVEVRMQVVAGFLRHQRQARIEWLRLAPAEVHAQPLQHQLQGGLPQQSQLAAMQDAEGLGDGQGQARVFGEVGVEAGVAVAGRIVEGRPQFAPQPVRLQVQHRVGEAAGDRRATVVDLPRFDQEYLAGGAVVSASAAVELLHADLGVADQVAVVPVRIVGVALEMGAQGLDPGLGVAGQVDPVSAPHRASGLPTRWFRRRDYNAPVPGF

SEQ ID NO: 18282 - protein, 304 aa, Pseudomonas aeruginosa
KIRAGGCAPPEAGIDRRFWTIYPGRRDYSARPPSLDWVLHSPQEKHPMVDHSIKGKTVLITGGAKNLGGLIARDLAAHGAKAIAIHYNSAASKADADATVAALQAAGAKAVALQGDLTSAAAMEKLFADAIAAVGKPDIAINTVGKVLKKPITEISETEYDEMSAVNSKSAFFFLREAGKHVNDNGKICTLVTSLLGAYTPYYAAYAGTKAPVEHFTRAASKEFGARGISVTAVGPGPMDTPFFYPAEGADAVDYLKNAAALSPFSKTGLTDIDDVVPFIRHLVSEGWWITGQTILINGGFSTK

SEQ ID NO: 18283 - protein, 172 aa, Pseudomonas aeruginosa
SPAPRCTCRPAPPGSAGSPRSARGRCAARRSRRRGARTTRASGRRGRRRCSSTPSPVPAARGSSRNPPADAPGGPAPRCRSRAASRRRTPGPPGRRAAGRWRNPCCRREAMAGPPPSGFRKAPGAPPACARGTPAPPPRGRSAPPKASPRCTAGRWPGHAGGRVRPARAPVA

SEQ ID NO: 18284 - protein, 356 aa, Pseudomonas aeruginosa
SAMARARAAASCTTPATTSTTTAWPSAPATGCDWPSASWPEPGFSTGARPGARGSTEDNHNDKNPRQHRPLPPPRRTGRRRRLDRQGPAPGRRPDLPAARIQAAGRPPGRLRHRDRRSPLRGAASPLRMGRKQLGRHHPGAAVAQDRRHRLVDDHHAETRTAHRLHRPRLQRAEPPGGTPWLGAPARRREPARQARGGRPGLQPGGLRQGRMGRQGGAGRLLPEPGPGLRRPRHGPPRRLAARRGAGQLRLPRQAGRQGFRTGRSGAGRPSLLRGRRRHRPAQGGRGAARGPEQGAGDDPRQRNLRANQRPLLRLRPLRHALNGVRPLFTSTDNNKQWRVKCSSTASARRYSPAPW

SEQ ID NO: 18285 - protein, 143 aa, Pseudomonas aeruginosa
SAASPTWSSCCCCSSACRSSSTASPTPSASARSTSTRSPPAASPWRSSMAPTSRKPSAAPSRRSRPARSKPRKPTAWGAGECSAGYSCRRCCATPCRASATTGRCWSSPPRWSRSSVSATWSRPPRTPAKAPCSSSTSPWSAG

SEQ ID NO: 18286 - protein, 528 aa, Pseudomonas aeruginosa
STWPSPQSPTPRCCGWSGAARWASGGRCHERGTRRILAGLPVDRRPATDRTGDDPVAADPRRGAWLPAGHPAGGGADLRQPAAALPGLALHLRVPRHPAVHPVAVLLHRRLQPECHTRPGLSQRVLPRRLQLHGAGLRPQHLRLHDGNLRRRDQEHAPRRSGSGARLRHGRLHPLPAHRPALGAAPGTAVLQQRSDPDAAFHLGGVHRHSAGPAQGGPRRQFRHLCAVPVLRHRRRALRRHRLPADLAVPPRRAALAGLPQTANPLTSPGDTRMYSLQVEDIHKRYGSHEVLRGVSLRAGKGDVISIIGSSGSGKSTFLRCVNFLEKPCAGRIRVGDEELRTRPGTLGELRAADPRQLQRIRSRLAMVFQHFNLWSHLTVLENVVECPVNVLRMNRDDAVAHARHYLAKVGLAEKVERQYPCELSGGQQQRVAIARALAMEPQVMLFDEPTSALDPELVGEVLKVMQQLAEEGRTMVLVTHEMAFARQVSSHVIFLHQGVIEEQGTPDQVFGAPRSERLRQFLAGNLK

SEQ ID NO: 18287 - protein, 550 aa, Pseudomonas aeruginosa
AWGSARRREETHEDQLRITFVEVVDHPARLESLALQQAPHRQVGAVAGSEQAVAATVVPRLPQQRAGDAAPAAVGGDRRILDVFTGQGTSPRRMIYSRPDQPQRMPDMPRSIVIVHGWSDDSKSFRRLAEQMEAWFGSAPTQIRLADWISLQDDVTYADLAAALDRAWTAQGLSRAPRTVDVVVHSTGALVLRDWLTRHFDPASAPVKRFLMLAPANFGSPLAHKGRSFIGRVLKGWNRFVGQTGTQVLKGLELGSPYSWQLAERDLFGAEAWYGAGRLLATVLVGNAGYSGVEAIANEAGGDGTVRIATANLNACRLSLELDVRQRARPGWRLEESRGEIAFAIVDGENHASVALKDRGPKNPHTLELIRAALEVEDADYRSSGASFPWQRRIDQLDPGIERRSPRYLNLVSHVCDDLDQEVRDYFIQFFRKLNSDRRFEQRFYEQVIADVHPYEDNPAYRSLYLSIESLDDLLAGFAVDTLSLSVSAQPPFDPPRQPVGYTAVGPGDSEGLAIPLAQVPRFLAAHRTLLLRIRLTRLVDSGVFVFRNP

SEQ ID NO: 18288 - protein, 578 aa, Pseudomonas aeruginosa
PGEPRAVPAGDRRRAGRRGRCRARRPAPVALGHDQRHARRRAGSDDPLPCRSPAATRHRLPAPGRVGMERRPGLPARLPRAPARTLPRAADRLRQLRRRARRSDTPGRTGRRGGDRPAVHRQPRPGRADPSRRAAGRGQPGAVLRWRRCRLHRLPDSRPVRYGLIPFPPMHRSRARPRLRSRRSLAVLLPILLLAAAGFTILTTEFVIVGLLPALAADLQVSVAQAGLLVSLFAFSVAAFGPFLTAALAGVERKRLFVACLLLFAAANALAAVAGDIWTMAVARFVPALALPVFWAMASETAAHLAGPSREGRAVALVFFGIVAATVLGIPIGTLIADAWGWRLAFAALAALALAKALLLAAWLPRIPGRPGISLRSQASVLRQPLVLGHLLLSLLVFTGMFTPYTYLADILQRLAGFSGSLVGWTLMGFGAVGLLGNWLGGRLVDRSPLGATLLFVLLMALGMLALVPTLGNAWLLAATLAIWGVAQAALFIVGQVRVMKSAPRAPAFAASLNISACNAGIGIGALAGSWVIDGSGLAPLGEVGALVCLAAMAVALLLMLAPRQAATEPSLGGQIPH

SEQ ID NO: 18289 - protein, 326 aa, Pseudomonas aeruginosa
AHQGSTTMILDRLCRGLLAGIALTFSLGGFAAEEFPVPNGFESAYREVDGVKLHYVKGGQGPLVMLVHGFGQTWYEWHQLMPELAKRFTVIAPDLPGLGQSEPPKTGYSGEQVAVYLHKLARQFSPDRPFDLVAHDIGIWNTYPMVVKNQADIARLVYMEAPIPDARIYRFPAFTAQGESLVWHFSFFAADDRLAETLIAGKERFFLEHFIKSHASNTEVFSERLLDLYARSYAKPHSLNASFEYYRALNESVRQNAELAKTRLQMPTMTLAGGGHGGMGTFQLEQMKAYAEDVEGHVLPGCGHWLPEECAAPMNRLVIDFLSRGR

SEQ ID NO: 18290 - protein, 67 aa, Pseudomonas aeruginosa
GSAAPRPRLCRRGASAGAKEKPTYNDPDPELFRQVASASEKSDSQHCFGAITSHLKVSIKFSVIDYP

SEQ ID NO: 18291 - protein, 241 aa, Pseudomonas aeruginosa
RLLIPVTATRPTFWAKALWVKEPKIGASMLENMSARRPLPRRRESTLVSMISPTARMSAEVSTRVTMITMHIEMIAATWKVGMPKWNGVGNATSGPSVTLEKSAMPRNTAMTVPMTIARRIDRREIEALPSLLSSSTMTRVIAARPMLAMLPKSGAWLLPPIAQRAATGIRVRPMVVMTMPVTSGGKNLVMREKIGVISNPISEAAITAPSTAGMPPLPPLPMIATMVATPAKDTPWTNGN

SEQ ID NO: 18292 - protein, 584 aa, Pseudomonas aeruginosa
NSHFRNYARTARKALLVWQSGRARGGISGNSAMPSTAYRSSPHKERSLMSNKNNLRYALGALALSVSAASLAAPSEAQQFTEFWTPGKPNPSICKSPLLVSTPLGLPRCLQASNVVKRLQKLEDIASLNDGNRAAATPGYQASVDYVKQTLQKAGYKVSVQPFPFTAYYPKGPGSLSATVPQPVTYEWEKDFTYLSQTEAGDVTAKVVPVDLSLGAGNTSTSGCEAEDFANFPAGSIALIQRGTCNFEQKAENAAAAGAAGVIIFNQGNTDDRKGLENVTVGESYEGGIPVIFATYDNGVAWSQTPDLQLHLVVDVVRKKTETYNVVAETRRGNPNNVVMVGAHLDSVFEGPGINDNGSGSAAQLEMAVLLAKALPVNKVRFAWWGAEEAGLVGSTHYVQNLAPEEKKKIKAYLNFDMIGSPNFGNFIYDGDGSDFGLQGPPGSAAIERLFEAYFRLRGQQSEGTEIDFRSDYAEFFNSGIAFGGLFTGAEGLKTEEQAQKYGGTAGKAYDECYHSKCDGIANINQDALEIHSDAMAFVTSWLSLSTKVVDDEIAAAGQKVQSRSLQMQKSASQIERWGHDFIK

SEQ ID NO: 18293 - protein, 173 aa, Pseudomonas aeruginosa
PMARAPPSRLILSMSSPSSRMQAMDWLAKASLISTRSMSAMPSPARCRTLRVACTGPMPMISGAQPATATALIRARIASPWRRAKSSLQTSSAALPSVSGDEVAAVTLPPNAGFNWARLSRLVPGRMQPSSATRPAGVSMATISWRSKPASRAATALAWERTAISSCSTRLTA

SEQ ID NO: 18294 - protein, 493 aa, Pseudomonas aeruginosa
DGLAGSQEDITRIIFIELQSKYNLTEKAAGLAETPSDFVQFTDMPILGPQFPGQALGLAQAQRAAFEVDQQARAGSLRQRRPVAQTAVGKHQQTLMLGGFLPLSARQPASGLVQGVEQRRTAAGAQLAQPVLQLPRGLLPLPEPLRLLPGGVQHGQADTLPIGLLEQRRQHPLGLGQGAVPAGAGGGIDDHQPEFARAPAARLAKQVAALSGTSTQQGRQPLDGALRTLAQGAAKTAAQGSGSAPGIRTHDRARADAQGFFGQRGSSRAVPMATGRAGNSPHCPSPLPVRSGSATGAAAGGGGGLAADGGGFDWRRRCSRAKCSTASMSSASIRSPPRQAAWARAARSQTRSARRPSTAASKQRRAMLSSAASSRGIRASRRRASAQRRRRVSCWPSQRSAKACGSASKASRRRMISARSAGGGWVSRRTLRPKRSSSCGRSSPSSGFIVPISTKRAGCRWEMPSRSTRLTPLAATSSNKSTRWSGSRFTSST

SEQ ID NO: 18295 - protein, 71 aa, Pseudomonas aeruginosa
TSPASSPACWTQRLAGASDLVGVMLESHLLDGCQALGGELRYGVSITDGCLGWEGTERILRDAARRLAERR

SEQ ID NO: 18296 - protein, 467 aa, Pseudomonas aeruginosa
ACGCAGCPAGCGRRGNWPPARRAGFPPPPACRPGTGSSRWNRAGRARGCPGCAAPPAGVPGAGRSVPAPACRRRRHRRRSRPSSGRPRQGRRGSPTAALRLRPARRRRRHPAWRRRSASRPAGAPPPAPCPAPRGAGAPSVRERPAGSAPPPRPARRPPAPPHRTGGSGWRRRRGRTRRPAASRRPAGGPAGRPGGSRNRRRAGCRPARPVARRAGPGPGRCRRRRCAWSPCPTPRDRAGAGDRHVPAGDARAAGWPTGSRCARRSGSAGCARPPRRSCVRWAARRVARDSARRSDRPVRSALRGLPAARRSRPRHRRPGSVPPVRTSRATPRRWHARWQAAIRRPGSVLSSATPAIPGVRGYPREYARAPRPALPGRPAARPARPRPCRRPADRSPGQGRPPGSSATRRWRPCHRRAEPAAAPAGYPGAIARSATRRTHAGRRGSATPSGRRDRRPAAAASCPDRR

SEQ ID NO: 18297 - protein, 146 aa, Pseudomonas aeruginosa
TDRCSAADRATRPASIRRTGRLPCPAAIPGYRACRRAAGHRRGRRGAARSRTPGSRAAAPGRDRGRPPPDRADSRAPAGCRRRSGHSAGRRPSSVRRGTSGPVAARPSAPAPPGDCAPAGVRSRPGSRPAPGSGRRAVGRDAPGRC

SEQ ID NO: 18298 - protein, 426 aa, Pseudomonas aeruginosa
RSTSSPRASSSAASSTSGRSTWKESNSSWSWSSWPSWSWWVGRPSMCSSASALSPSKTGSGSSPRLASTIFTAAGSSPAISARTRARASASSWSALFRITRSALANWSSNSSCSGDSWSRLGSWRRCWSTCSGWAAKVPAATAGLSTTVITASTVQALRISGHWKACTSGLGRARPLVSMRIWSRSPRRATSSRITGKNSSCTVQHRQPLASSKTRPCASSSLQPMEHCLRISPSMPSSPNSLTITAMRRPSALSSMCRSKVVLPAPRKPVTMVTGSFARVFMGSPCSARRACGRVARTQGPRNGFATGSPRPVVWKSCPRASRHGIDEAGLLAHGLASPPVPRLPASRSGIGERSPFTVAGAAAASTAFPFSPAVAGEEPRTGKATQCAGQGQSGRLTPGGPSCCPRRVVPGVSCRRARGETGSR

SEQ ID NO: 18299 - protein, 84 aa, Pseudomonas aeruginosa
SGPSGPVPRAYSSATPMPIQRERTMSSSTLAHASSTTSLSKRLSLAIGAGLLGALLVYFAGFSHIDAVHNAAHDTRHSSGFPCH

SEQ ID NO: 18300 - protein, 235 aa, Pseudomonas aeruginosa
SPASAAAEAVAPSICARCWSERWANTGAAWPSWTPSPASTANATNPACGNWPRCSNAPCISSHPPSCTTTSRACSAPPPSRCAKPAAPASPRPPPWPWPNAWVAVAPICSGRNAATIGRASPWHVFSPNENSHDRLFHRRRSRRPRPDHRQGAAPDPPVPGDPLRRLAGSASAARGAPGRPGGEHRRAGPRTDRRATRASPSPRLRRSPRAFRRSLPVRRHRRADPPPARTRHPL

SEQ ID NO: 18301 - protein, 320 aa, Pseudomonas aeruginosa
SLRTPMKRFLLGLVLLLAVAAGVLYFVPATLLASVRTVERGLAGLSEHSVQVDNLEIAYLEGGSEKNPTLLLIHGFGADKDNWLRFARPLTERYHVVALDLPGFGDSSKPQQASYDVGTQAERVANFAAAIGVRRLHLAGNSMGGHIAALYAARHPEQVLSLALIDNAGVMPARKSELFEDLERGENPLVVRQPEDFQKLLDFVFVQQPPLPAPLKRYLGERAVAASAFNAQIFEQLRQRYIPLEPELPKIEAPTLLLWGDRDRVLDVSSIEVMRPLLKRPSVVIMENCGHVPMVERPEETAQHYQAFLDGVRNAQVAGR

SEQ ID NO: 18302 - protein, 428 aa, Pseudomonas aeruginosa
KREPAPGRRFGGAGAVARTARIQASGLDQVGDLHVRVDVLLVVDPSDLETEQVEELALVASEVGQFVKVLVGYLVPQLLDTGLHFRLQFLVVGTQAAFLVEARLGAVQALPVQAVDLLDATFVGALLLHHLEQQRQVQRHHRDRRAGLGHHRLEHRHARVAAQRGELVADTEDLLVEILLGRADGTVPVDVVGDLLAQVGERGGLRAVGQHVGLQQRVDPHLPVLAAHHRNGIGDLLVAGRLQDHVLDHFLVGVQATEADRLADRLEGRGEHFAALRMGTARRGQAVDHQVDLAEIALDGLDGQPLHLVGESVAIDAAGIQAFLVGELLEGRRVVPAGGARLALAARTLEEHPEGIGAGTERGGDAGSQAIAGGGTDDQDLLRSVDDGALGLDVVDLLLDVGLAACRMGSDADEATHARFDDHENLGC

SEQ ID NO: 18303 - protein, 258 aa, Pseudomonas aeruginosa
PLDYLRLVLQFLYQFSHGLDLDASGACSRRLDLQGLHGGSGGNAQGVRGHHVQRLLLGFHDVRQRRVARLVQAQVGGDDGRQVQRDGLQTAIDLAGHVDLVASDLDLGGEGALGVAGQRGEHLAGLVVVAVDGLLAEDHQLRLLLVDHGLEQLGHGQGVQLVVALHQDRTVSAQRQRGAQLLLGGGRADGDSDDLGSHALLFQAHGFFHGDFAEGVHGHLDVGEVDAGVVRLDADLDVVVDHSFDCYKNLHGFLVILR

SEQ ID NO: 18304 - protein, 462 aa, Pseudomonas aeruginosa
RAPRALPRCPTSSCPRPCTTRATISSPWATSAAGWPHQAEGLGVEIYPGFAAQEALIDENGVVRGIVTGDLGVDREGNPKEGYYTPGMELRAKYTLFAEGCRGHIGKQLIKKYNLDSEADAQHYGIGIKEIWDIDPSKHKPGLVVHTAGWPLNDENTGGSFLYHLENNQVFVGLIIDLSYSNPHLSPFDEFQRYKHHPVVKQYLEGGKRVAYGARAICKGGLNSLPKMVFPGGALIGCDLGTLNFAKIKGSHTAMKSGMLAADAIAEALAAGREGGDELSSYVDAFKASWLYDELFRSRNFGAAIHKFGAIGGGAFNFIDQNIFGGKIPVTLHDDKPDYACLKKASEAPKIDYPKPDGKLSFDKLSSVFLSNTNHEEDQPIHLKLADASIPIEKNLPLYDEPAQRYCPAGVYEVVANDDGSKRFQINAQNCVHCKTCDIKDPAQNITWVAPEGTGGPNYPNM

SEQ ID NO: 18305 - protein, 540 aa, Pseudomonas aeruginosa
SCLALHRVGRPVRLQRPGQVGFDLVAGGVVTVVELHADASRTVALGALRGDPDDLAGHRDLLRLFHQVEQHEDFVAELVVLVGGNEQPAVPDERHVGGVQHGLVLDGQGQDAVTRPQIGWQTHAGSCQSNISGILARPGQACPLHQQGFEKQDTVEVGLVQHFLPLLQQPVLHGQHLGLPGFVAQVLDHLAHVGQPQPLLVVGQLVAQDAQRPVAEPVEEQWQRHAVPAFGQWAGGDLLLEQLLHPLDHLRALLAHALAVQALGGERRAAGKRQQFLQGLGRLVGQGPRQPFQTRRRARQRAGLLHAAALDGRQQAAGLVADQQQHSIARRLFKAFQQGVGGVHVHRLGGFEQHDLAPAQLRGLHHEANQVADLIDPDRFLRLLRLQHEVVRMGTGGQQLAGLALAACASGGRPLAEQLGGPMLGQGTLADPGGTVEQIGVGVLGAAAQLAPERLLPGIDISHSDAPADSAAADPGQPAPRPAATRHRAPGNAPGPARRAAGRSDARPRRSVGPPARNGRAGHAPPPAPGRFPPAGRRPA

SEQ ID NO: 18306 - protein, 514 aa, Pseudomonas aeruginosa
RSAWRHRRPAPRRTPATPGATPRRREGSPGADTPLPGAPGGAPGDAACRRAPPGSRTARRHRPVRDRARTARRRAGRRPSPASVGEPAEHQGAVGPAETERVRQGHVDLARLGFMGHQVEIATFVRVVQVDGRRGDLVAQGQHAEDRLHRAGGTQQVAGHRLGRTHRQRMGMLAEHALHRGDLGDVAGRGGGAMGVDVIDLARIQAGIAQRVLHAAGGTGAVFRRRGHVEGVAAHAEANQLGIDPRAAGTGVLQFFEHQGAGTVGQDEAVAIPVPRTAGTGRLVVASGERASRAETTQAETAGSHFGTAGDHHVGLAIGDVASSHADAVGTGGAGGGEGVVGPLQTQVDRQEAGNHVDDRTGHEERRDAPRPLLEQGSAVVLDIGQAADTGTHGYADTLTIGVGDLQAGIANGLEAGGETVLDEQVELAGFLGGQVFLDIETLDRTTEAGGIGGQVHMLDRGDPAATGENTFPTARDIQAQRRQHAHASNDDASTRHYDFLFLISRGCADRLPE

SEQ ID NO: 18307 - protein, 437 aa, Pseudomonas aeruginosa
RLFRLVLTTSNHSSSFMRTSRLSRVMPALLTTISGWPRCCWMCSRVAATDSSLETSRTRPAPSTPLALRVSAIFSAPDALVAVPMTTAPRRPSSSAIAWPMPRLAPVTNATLPCRLMGFSPFSLSGQGGARGGERLDAIQAMGIDALRAAPVEACQDLARPALDQLGDALFRQQLDALHPANRAVQLCQQVAAQRIEISRHGGADVLHQRNLRRLPLQAFDRGGELLGGRTHQFAMRRHADWQRHRALGAACLACLDGTLNGSRGTGDHYLPRRVEVDRADHLALGRLGTGRQYIGVFQAKDRGHAALPRRNRLLHQLAPTLDQLDRIGERQAFGRDQRGIFAQAVPGDERRARAALGQPEAPERDRNREDGRLGLVGLVQVLFRTILDQRPKVVTERLGGLGEGIAHQRLLGAQLGQHAEGLRTLAGEDECEGCRH

SEQ ID NO: 18308 - protein, 341 aa, Pseudomonas aeruginosa
PRKPLVLHEKNADQRDSTRGVACCTGRRPTPVRPRHRVGRPRAEEGQHLQRPHHSRRTQPRSRLRRLRRRTPRLPPPQRNLPRILQEIPRRPDQHQGSPERRPGSHRPGREGRARQQGRRPDHLHQPGRPLPGADAEQPARRRHLPPYRRRRAQRAARGPERPQRTGRHGPDRAHRRPRPQHRGTAVGPRLPAATVERDQGSVRRTWRALPDLPGKQRHHPRHPRLPAPGHRRSADRQHRRPGRSPELHPPGDAAVRQQGEAVPGQRSAVQSLPDREPDRDRFPARSEAAVRRLHRHRPDRGPGFHRHQLGARHQGRRHRGNRPADQPGSGRGNRPPAAPA

SEQ ID NO: 18309 - protein, 152 aa, Pseudomonas aeruginosa
HRRPDRHRLHRHDPGEEPARRGRACPRSPRGRPRARPGRSHLALRPAGNVPPAPASVPRRDQRHRLPALQRPGHHPRRRVAVAGHPAPDRGRSPEGPHRGSPRPRALPGRRLPAQREAQRHHQDRTAYPRAHLHPAGRSSGNPAFRSAASAR

SEQ ID NO: 18310 - protein, 447 aa, Pseudomonas aeruginosa
GFSEQCSCSSRLTVAPWLRSTDGRRHVRSGRGPARSLLRRHSRDRVLRPARTRSDAGTDPVRRHRARHAGSRGRPGWTGPWPGSGHGRRNPRCRPGVHAVPTDRSRAFARPGGCAGQVPCRHASRRCRRNRHGYGRPARPPRPCAGTRLRRWATGRCCPGRRTGRASAPQHAANAFEVFRRIHARKHGFAGIGHMDSHPVPERAQLLEAFGVLQPARSPGDEIGKETHAIGVDADVATIGHALRQAVAIAGEGVASPGQGRTTESQGQAVDVGGDLDHVRIEQRGDLMDRLGQGSDGSFRVRRQVGRHLVDERRGDQRFVALDVDHDGIAGQAEPGSDFLQAIGAGVVLGTRQQRLGAEPLARRQDAFVVGGDDHAAGGALAGLVPDALDHWLAGDILQWLAGQASGGVAGGNDDSERLGHYLSSRSSTFRERASLSSITGMPSRIG

SEQ ID NO: 18311 - protein, 330 aa, Pseudomonas aeruginosa
RLERPEETLRIADPGQGMDLLARGKMLQRSALAALQVDQRSRLQAECVTAVRILVGAVVKQRVDAFQTLRRFAQRTGRQATTIAETARGIDQHQFQIARQAIVLQAIVAEDQVQLLFGEQRLQGARTIRVDHQRHAAAPDDHQRFVASLRGVLLGPHPPRRGGRPGTIAAADHANPQAASPAVLDHPEDHRRLAGSADGDIAYHQHRQRCPVSGLAPGQEVRPAAVRHPTIESLQRTQQRQRRMPLVPGGEQSLGERHQGLAAVFSTVVMRRWTKPSLPAASIAVTTDWWVDLASALITTGRLLSPADSRCIAAIRVARSLLASACPFKA

SEQ ID NO: 18312 - protein, 177 aa, Pseudomonas aeruginosa
HSDPFPPTATVLIFPARSAPNHAPGVRRHGFRGETSGHRRVPCRGPARRPSRNAPSLRHGDGRRRCANLARPAHGEAAYATRRRLRRNCGCHDAAPATSRPGDRPVAPARHARPHARCPRSAAGLRHRPRPSAHRSGRCCRRPVPMPTVRKPRHPRTSSARRSCPRTTAKAGARVRR

SEQ ID NO: 18313 - protein, 272 aa, Pseudomonas aeruginosa
EHRLHGRCRHGSATGRPGAAGPGCAAPAPPPVRPCRTPPAAHRCHRARHAFGYAPARPAPGRRPAPALPPAPIRQAAMTATMPAVATRHRGHATASQPAPASRARRACPALRSRPLRRVAARPRPGPPAGQAHETAGPAKRQRREAAPRPARAPTAAGSPPGPGALPAVRSKAPPAGWPALRSGSTAGPAPAAASPAPAPSPTAPAPRPPTSASAQGARRTARAAGQPPGTTARTPPAGWPAARPARPAPALPAAGSASPGGGNAGARPAPG

SEQ ID NO: 18314 - protein, 134 aa, Pseudomonas aeruginosa
PSDARCRCPGTCATRPRSTPSHPPAPAPPGRRRAPVRRPPAGAGARHRARHPGRWPAAGAGPPSPCPQHRPAAPTTRPRSRNPPRSPGRGGVSGSPPGASVRRPSAAARRASSGANAREEARPAQRGPPPAGSA

SEQ ID NO: 18315 - protein, 91 aa, Pseudomonas aeruginosa
RPRRSPADRPHAPPAKGCDHPARRPGVRPGRLAPSRRPRRTRAGTTPASTAGRTAATVRRRPCPAASRPTAIPPGSAGPAAPRRGLAIPGA

SEQ ID NO: 18316 - protein, 137 aa, Pseudomonas aeruginosa
LMKYTSELKTLCPTNRSMRSIIPVMFNAANTPSTPPMTVPITPMTVPWTMKIAMICRGVAPRVRRIAMSVRLSATTMIRVAMMLKAATAMISSRSRPIMVFSIFIALNRLPWVLVQSLDLKPCPNSLTTLAATCGDW

SEQ ID NO: 18317 - protein, 209 aa, Pseudomonas aeruginosa
RSFSSRRTLGTWPGCRRSNWPASAMSISASELSSSAPTLNRATMVKRCMRGVMPPGALVASGTIRVSLSPTLTWKRRAVISPRTMPNSPGLRSSRLPWTMCSPTMETLRSSCGSMPLTSTGSILPLYDSMPCSSANGAAPTTSRCRSAALATVCQSSSGCAALMVACGTMPRIRVRISFWKPFITESTMIIASTPSARPIIEVSEMNEM

SEQ ID NO: 18318 - protein, 285 aa, Pseudomonas aeruginosa
RRPMKNGNGLNMSRMHRVDGGFAGRERTAGTPSPRYAAISRPSSRRRMRSMCPASWRSWVTTRNEVCNERLSSSISSWIPWAVCWSRLPVGSSSSTSCGRLTIARAIATRWRSPPDSSAGLCEQAMPQPDPLQQLGRPLAGFRDRRAADQQRHADVLQSGELRQQVVELVDEAQRAVARQPAGRLVQRREFLAGEPDAAGGGRVQAAEHVQQGALARTGAADDSHPLPRQQVQLDAGQHLHRLRPLVVALAQVAATQHRLVIHNAKPPQAGCAPHARLDTKWRRS

SEQ ID NO: 18319 - protein, 197 aa, Pseudomonas aeruginosa
PPRILPYRRYPRTGISPCRGRRRRPGERAGGHPVQPAQRPPPDGLRVAAPSAPHQRTRPHAGQLPEGDEQAHRPAWPGHGAEPAQGDRRTAQGQPVRGGSQLPPRPRIAGRPVARPAHGPVAAGVRPRTAGPGNPRPATRRRIRDRHRVRSVERRTAPVAGPAYPPEAGPAAPPGTGRTGPARRAGPTFFDLKPSST

SEQ ID NO: 18320 - protein, 105 aa, Pseudomonas aeruginosa
DVPMLRSLLLCSLLLAPPLFADTLSIPLGAQGDTRVALPAHGESREAVLQRFGLADEEHPAVGQPPIVRWDYRDFSVYFESGRVLDSVRHHRPRNPAQPSNKEPQ

SEQ ID NO: 18321 - protein, 455 aa, Pseudomonas aeruginosa
VLPMVGPPKLSRVSPQPARTSASAASPAMASGRKRSATEIVQQDILALHAQVGEHLDHRGIHHRRAAHVELAVLGRRVVLQVVLEQHVVDETGQAGPVVLRLRVGQRQVPLEVGILRLQLVVLLGIEGLAQRARAVPEADLAVRLEPAQLVEDVRTHRRHAGAAADEDHLGLGVLGEELAERPVHGDLVARLEVEHPGRHLPRRQVAARRRRGDADVELDHALLFRVVGHRVGADHRLVDLRHVAPHVELVPVAAIFRLDIEVLVLDHVRRAFQLHVAAGTKVHALAVRQAQGEFLDEGGDVGVGLHRALPFLHPEDLFRHADLHILLDRRLARQAPAFLRLAPGEVRLLGGQHLAAALDHHAFALRAGAAAAAGGRQEHVVRRQGLQQLAAGRHGQAVLAVDLDGHVATRHQLGAGDQDDRHQAQDDGGEHADGQENLESDHGPLLTTARRRTT

SEQ ID NO: 18322 - protein, 293 aa, Pseudomonas aeruginosa
CSAPSVSLLAGYLRGHLVGRGLDLVFLPGPQGPDDQADQEERRRRQQEQAVRLVPAAIVDRRQHADAVELAGAEQLADEAQHQQHGAVAETVADAVEERHERRVGHGEGFGAAHHDAVGDDQPDEHRELLAQAIGIGLEHLVDDDHQRGDDHHLHDHPDRAGNLPADHRDEQVGEAGHQGQGDGHDGSGLQVRGYRQRRADPEDLQADRIVLEDRIEQDFADRGLSSHHASPLRRLARKASKPSLPSQKCSRLSTPLLVRVAPARPSTWWVAFADCGSTEPLMICTARSPWAS

SEQ ID NO: 18323 - protein, 342 aa, Pseudomonas aeruginosa
LAIARQPPLDVGLNDEMVDQRCEQVGEQDRQHHAFRERRVDHPDQHDHHSDQGAEQPLAGIGHGRRDRVGGHEDHAEGEAAGDQVPIPGHGEHRVAGRADGVEQVAHGDHPQHHPGDDAPGGDAGQQQHGAADEDRQGAGLAHRTLHVAEEGIHPGQAVAEDVVHAAGGGQAQRGGAGEAVHRGPYRVAGHLRRVGEEQEGPADQCRIEEVLPGAAEHFLAQHHAEADPQGYLPQRDGRRQGQGEQHRGDEEAFVDLVAADAGEQHLPETADDEGGQVHRQEVRGALDQAIPQAVRVEPGQRADQGEAPAILGAQQVGALGEDQVGLVADVVHAEEHRREGA

SEQ ID NO: 18324 - protein, 311 aa, Pseudomonas aeruginosa
PDDDHHALQVDAVAHVCSGAGDAAGTIEEGVHGFVQRVPLLVAPALLEMMLDLVEQVTQTHGSALLLDACQIVPQNRAVFVLAGADVAAQRQVLFVEFQGAELLGHFRVADDQVAQQLSRQDIQRHHRLVVTYRHHRPWAAVGAGGEGKALAAEQPGDEHVEQRMLFHPGAQVVEELALVALLETGQLQVVAPQVGVGAMGGATAQHGAGDQSVVARLQLAGGQFVEVGAQAGAHQTRLFHHRTGQGDHPLGPQLPGREQLADGNHVLVVQVPHALAGTHRVEEVDMGAGQARRMRTGECLRGHAGERLAG

SEQ ID NO: 18325 - protein, 197 aa, Pseudomonas aeruginosa
RNAFRLAQEHPGQAPEHRQPGLEGLALLRDNHLRIGGQRLGIDGSDENRTGAGLGIGHLAERPGPQRGPQARLQQVVADLLGAQRGEFVSGITGELQLLVAVEIDDHRLQDALLATMDGTDHTGAGCGIADGGILLVGEQHLPQLHPVAYLHRHGRLHAVVVETDQRHAAYRACCLNALFGGAADGQVQATFYLDHV

SEQ ID NO: 18326 - protein, 514 aa, Pseudomonas aeruginosa
RATSPGATQAAHRVLKRVTENDRKTCPCEMKNGSRSSRPAPPAGSGLLAEPAPFRQRQLDPVAQPHQQQPEWNGVHRDVDPGDHQHDAKDEHHEGQAQVVAERRPERLEEGVHALALHRRAELQVRQADHRPVDHQRRHHQRHQQLQRLVRQYVVDDHAEEGDQRRDQDRQHRHAPAVHRHQHLRRVTLGGQAVEHPAVAVDAAVVDRQCRGEYYEVEDVGRGAAADQREDLHERAAAVVVAGSVDGLHQLVPWIQREQHRQGADIEDQDPVDHLVDRLRDHLPRLGRLGGGDTHQLQPPEGEHDDRQGHHQAAETVGEEAAAVPQVAHRGLRSATAADQQVDTEQDHADDRRYLDDREPELGLAEGFHVGQVDRVDQHEERRRRRPGRHVRPPILDVLAHRGQLRHAHQDVQHPVVPAGKETGESAPVLVCEVTEGAGHRLLDDHLAELAHDQEGDEAANGVTEDHRRAGRLDDARRAEEQPGADRPAQRDQLDVAILQATLQLALVQMLTIH

SEQ ID NO: 18327 - protein, 140 aa, Pseudomonas aeruginosa
PNSLSYHTYRTTRLSLQMVASASTTPAWREPTKSVETTSWELTKSICFCRSECMAIWRRYSLISSRVVAFSRFRLRIAMDTFGVGTRIALPVSLPFSTGRALAAAVAAPVSVITMFSGALRPRRLPLWKLSIRFWSLVYE

SEQ ID NO: 18328 - protein, 1185 aa, Pseudomonas aeruginosa
PRRPGSAICSSRKTDIQQSGKLQSGGSNSRPEPSLPVSVLRLPSLPASAGKQHWGNLPGAALSLAVAEAASSAKRFTLLLTADSQNAERLEQELRFFAPDLPVLHFPDWETLPYDVFSPHQDIISQRIAALYQLPQLKHGVLVVPISTALHRLAPTRFLLGSSLVLDVGQKLDVERMRLRLEGAGYRCVDTVYEHGEFAVRGALIDLFPMGSELPFRIDLFDDEIETLRTFDPETQRSIDKVESIRLLPAREFPLNKEAVTGFRGRFRERFDVDYRRCPIYQDLASGLTPSGIEYYLPLFFEETATLFDYLPQDTQVFSLPGIEQAAEQFWNDVRSRYEDRRVDPERPLLPPAEVFLPVEDCFARLKNWPRVVASQEDVEPGVGRERFPALPLPNLAIEAKTAEPLAALRRFIEEFPGRVLFCAESAGRREVLLELLARLKLRPEEVDGWPAFLASQARLAISIAPLDEGLLLDHPALALVAESPLFGQRVMQRRRREKTRDGGDAVIKNLTELREGAPVVHIDHGVGRYLGLITLEVDNQQAEFLMLQYAEDAKLYVPVANLHLIARYTGADDALAPLHRLGSETWQKAKRKAAEQVRDVAAELLDIYARRAAREGFAFKDPQADYATFSAGFPFEETPDQQSAIEAVVADMLAPRPMDRLVCGDVGFGKTEVAMRAAFVAVHSGKQVAVLVPTTLLAQQHYNSFRDRFADWPVSVEVMSRFKSAKEVENAARLLAEGKIDILIGTHKLLQEDVKFANLGLVVIDEEHRFGVRQKEQLKALRSEVDILTLTATPIPRTLNMAVSGMRDLSIIATPPARRLSVRTFVMEQQNAVIKEALLRELLRGGQVYYLHNEVKTIEKCARDLAELVPEARIGIGHGQMHERELEQVMSDFYHKRFNVLVASTIIETGIDVPSANTILIERADKFGLAQLHQLRGRVGRSHHQAYAYLLTPPRRQMTPDAEKRLEAIAKRPGPGRRVPSSPPTTWRSAAPGELLGDGQSGQIQAVGFTLYMEMLERAVKPIRKGEQPNLEQPLGGGPEVNLRVPALIPEDYLPDVHARLILYKRIANAPDEEGLRELQVEMIDRFGLLPDPAKNLMRLTLLKLQAEKLGILKVDAGPQGGRIEFAADTQVDPLVLIKLIQGQPNRYKFEGATLFRFQVPMERPEERFNTLEALFERLTPQTT

SEQ ID NO: 18329 - protein, 255 aa, Pseudomonas aeruginosa
GLAYALVPLPCPAALTGRPRGIRRRSLPGGTGGVPPGRRCRAVQPAGPGRMGHRRTAAGQRRPARHRARQPARQAQPGQRIHRAGAQGLAPGHRRDPGEDRPQRRPGTGSSFPGGRYADPQPGALRRHGGRFLGQSLRRRRFPRRQPAHQAGHAAEEWRTDLSRPSEPGHPDQGGAGRRPSRRPQSHGNGRTAGTGGRAPRRRRLRRRTSCAIAKKAAIAAFFSLRWPPSRPGPAPAPRAPCRCHRATPVRFRPW

SEQ ID NO: 18330 - protein, 647 aa, Pseudomonas aeruginosa
SRRHSSTAPSINQLRGAQRGQCFQPARLLAIVGIRVALATHALQTRRRGHLQALQGSQGQLGGSPVVAHQAHVAARGQGGLDAAGGVADHMGAGHRQVVAEYHPVELQLAAQDLLQPAPGKAGGLRVDLRIDDMGRHQRVELSGQAGERNQVAAPDFLETARVFGNRHMGIGLGPAVTGKMLAGGGHPGGMHAANESTGKQRGTLRVALEGAATDHGAALVVEIQHRRETQVEADRLHLGRHQPATMLGQLFGIGVVGDRAHRRQAHEALAQALHAPSFLVDGQQQVGTDGANGRTQFANLGRMLDVASEDDQPAHLGVAQDLAVLGGQPGAADVEHQRALHEKSYGLEISEARRHGPQTAHTVLHPAERLKSRGGTARLPMEPAWRMEFRPEHRERRKENGALGRRLRSGLGGRLVPRAQLRPGQQRIVDAALGAHAGSEERHHQVHHLLGGSVHAEIGFRHRPQGLDPRHAEGGRAEHEVHAPEQLDGRQLRRSLVDQQHVAPEDLAVDLLQVLAQVPLALAEGQAEQAHEDRQVVAAARLHRHRLGHQQVQEVLQGGVLGLGLGLATIQLLFQAGAEWPEEAREHRLDQRLLRTEVIIHRRQVDPGLAGDQTQRGFGEAFFREQLFRRIENAFDGFRLGHGFSA

SEQ ID NO: 18331 - protein, 234 aa, Pseudomonas aeruginosa
RRTKCHAENHCHAPLTVYNPSHWIKTQSDDMQKLTPRQAEILSFIKRCLEDHGFPPTRAEIAQELGFKSPNAAEEHLKALARKGAIEMTPGASRGIRIPGFEPHAANDDEGLPVIGRVAAGAPILAEQNIEESCRINPAFFNPRADYLLRVRGMSMKDIGILDGDLLAVHVTREARNGQVVVARIGEEVTVKRFKREGSKVWLLAENPEFAPIEVDLKEQELIIEGLSVGVIRR

SEQ ID NO: 18332 - protein, 290 aa, Pseudomonas aeruginosa
PMIAGSTPATAMERITAIGWMPRSWARWADITIMQEAPSVICEEVPAVTVPPFGLNAGFNSARVSTVVSGRMVSSKSKTFRKPFSSYPSIGMISSLNLPSWVAFQASWCERAPNLSCASRLIPCILPSISAVRPIMPEALAAYRDRCGFGSTPCIMPTWPMCSTPPMTNTSPLPVWIAWAAVCSALIDEPHRRLTVCAALVCGIWVISDAMRAMFQPCSRVWLTQPQITSSTSAGSTFGLRSSSLLIRCADMVSARVLRCMPPLERPIGVRPKSTMTTSLGFRLINSLSL

SEQ ID NO: 18333 - protein, 142 aa, Pseudomonas aeruginosa
MPSLTSGRPTLAVALITRKSAARHISRPPPRAMPLIAATVGTSRSSKSLKILLASRLPAISSSSGSWKLSTNSVMSAPTMNTSLPLVTITPLTDASALIASTAARNSLRVRRLNLLTDSPLRSKFNSTMPPSRGLTVMALPW

SEQ ID NO: 18334 - protein, 311 aa, Pseudomonas aeruginosa
SAPWALVPVRKGRLESPQIAMHDRPRAVTKEQQEGLQGHMEMEPMICRPFTLCLALLGLLSLPVFAAGTADDLLALHQMRLATQKSLNAFFMYVGQEGDQRYASLIESSAQTAEARLQRLDGVNGSESRRLLGQLREQWRDYAQDLDKLTGAVRNKGYSDLQPVADLARRNQQLMDLGGQLYRSLQRENAATVPTLTEQSREQSLLMQDIALDYASRNASVGASFFGGGEERPLDDLASRFSVNLLKLQQAPQNDEEIARALRSVAIKWHYIEKSLRNYNQNSVPFLVNKNADRIIDGLEKVAALYAARNQ

SEQ ID NO: 18335 - protein, 401 aa, Pseudomonas aeruginosa
TPGCLRRTLSGPRQRAAPPGLRATAPGNPPPRRGTGLRPDRGRQPRSPRPGAAARFHCQRRAARRALRRARGAPEESLISPRSAGACASAERFLGAHHQRADLLQLGFQRIADARRQREEGQERLQVGIADTGVVDSLPERLVDQLQLLEQPHQPFQFPIGMPPLAEVEVLAHQVQRHHPQHELLVAGERQVLHGHRPQRRQQRTGAAGHDQADQRAQSFLQARLLDVLALRRAHADAGLAERRQVAEILDHPMQVDRRRTMAVAFAIERAVAAAIVFQARPARRCGSRLRVVVPLQLDAIVELMLVVQRDAVLDCHGLILSRETAGPSMTPARGTDGGLHPPPARPARIIEMSRYHIDAAHFFEMDQSSSSAQRSSKASSSCCNASSRARVSRCSSCGRR

SEQ ID NO: 18336 - protein, 148 aa, Pseudomonas aeruginosa
ATSSLVPTSILPEVGCRSPSSSLSKVVLPVPLAPSRPIRSPRCRTMEKSRTSGWPPGWAKLTCSTTITCLPDLSALSSWKLALPWRSRRSARSRRISFSARTRPSLRVRRALMPWRIHTSSWARRLSNNALAASSAASCCSLCTRKLA

SEQ ID NO: 18337 - protein, 290 aa, Pseudomonas aeruginosa
SPFQSIRWPRSSSRMRVARDCRKARSWVMNSTAPLKPSSASSSQAMAPMSRWLVGSSSSSRSGSATSAWASSTRRRQPPESSARVLSAGNCRRLRVLSTSCCRRQPSRASSSCWTRERRARSSSVWMFRLRWWYSASSLPTSARPSATTSNTVRSSARGSSWGNSPIFSAGARQTSPSSACCSPLTTLNRLDLPVPLRPITQTRSPRPICHDTLSSKGVVPKARDTSVNLSRVMGASGNRARILRRIGIGWHGAFTAMPQRLSLGKPSARLRARPATAVARQSRERSKRP

SEQ ID NO: 18338 - protein, 89 aa, Pseudomonas aeruginosa
TSPNSTACMASTSWATARRPKATPPANACGWSASRSRLPATPCSASGRAKASSPRKRSGNASSWPPKRATTASPRTSRSACRPSATRAR

SEQ ID NO: 18339 - protein, 180 aa, Pseudomonas aeruginosa
KGPQDEQAPRHRPARHLQPAARRRRPGRRRLRYAAQRLRQRVLPQRRVFPGRPRAEPAVRHPAQAPERRPESPAEEEPDRLDQGARRGLQRKQGQRLFRQPRLRHREDPPAPRLPPRTRARVPEHRLRRRQALIAGNGRPPQRRATVPQSRISTGIPTSRLPCPSAIRFCPNSTAPSFSR

SEQ ID NO: 18340 - protein, 99 aa, Pseudomonas aeruginosa
VFRVVSGSRSSLRSPVAGSRVVRMQREQGLATTNSTEPMRMRFQPSSANAALPSTTRLGRKRSISNGRPTRWLRSSSEAWPISSSGKPSAKCTFCPGSA

SEQ ID NO: 18341 - protein, 224 aa, Pseudomonas aeruginosa
ARDRCPPGPRAADRPRRASPSSTRGPVRPSPDASSSRPPAPPCPCPAGCPAGRTAGRARSGCHCRSPADSSCRSSRSRLGWSDGQAVLPAPEVQIGLLLTFPARVVPAQARLAECADTRQVCRAASGQQQAEAGAAQQQVIEMQHHFRLGGERQFGPERFAGTHAVRSEGVHQPLEADQVASVATGQAASLAAAEPVDERAFAGAEHRRAIVRDRAPEQRRAGL

SEQ ID NO: 18342 - protein, 336 aa, Pseudomonas aeruginosa
TPGSPASARCPATSRCPACSSAGGSMSQEQSPFHTGELAIQERAGVREQVAGFGSRAIRTFMPDQHREFFSLLSLLLVGSLDADGYPSASVLWGPPGFARSPEPTRLRIDNLPQADDPLAANLEAGTRLGILGLEWPTRRRNRMNGRVLARDGKGFTVGVEQSFGNCPKYIQARSHQPVSRIASPALQGEGLDPRWLSLVSRSDTLFIASQHADPLRGGVDVSHRGGPPGFLRLGADGRLWLPDYAGNRLFNTLGNLLQDPRCGLLFIDFDAGELLHLHAEAELFWPGSQPSIPWPAGAERLLALRPRRAGAGGAAACRWHSGEPHPSLFFPAGES

SEQ ID NO: 18343 - protein, 206 aa, Pseudomonas aeruginosa
SSTTPPPCSSTLAWGATSTPSSVPTCLGGQRRCSLTRKSSRRATNWTQPVSASIASCCPTHTGITPRAWSTSPKYRSGHPTRRSPSAASPPRRPPSPANSAMACAGDLTASIRGRSWASTKASTCLATAAWCWSPCPAIRPARSVCSSPSTAGAGCSSAATPVGDSKASKAHGRNSSPAAPWSIAIPRAPSRNWRRSACCSAATRA

SEQ ID NO: 18344 - protein, 191 aa, Pseudomonas aeruginosa
SSAMRICRRRDGSMDAASGSWPDSGIFGPHWRKSRSSDTRVPLPGSLCISTSPPMRSTNFRQIASPRPVPPCTVRPLATWMKGWNRRAWSAGAIPIPESSTSTRTIALPSSRLLSWRRIVTCPRSVNLIALLTRLESTCLKRRGSISTSRPGASSSSTTSLRPFCRARPSNMRRTDSTTWRRRTRSGVRVR

SEQ ID NO: 18345 - protein, 503 aa, Pseudomonas aeruginosa
CPSLFSGSLRFSSSFHFLPSVFKGSSLMFKSLRTLAFATLLPFALPTLAQVNATLPANVQKALQTNKLTGNDLSLVLIPLDGPGNPTYYNADVSVNPASTMKLFTTYAALEMLGPTYQWKTEFYTDGQLKNGVLNGNLYLKGGGDPKLNMEKLWLLMRDLRANGVTKVTGDLVLDRSYFNIPQLPVFNDDGGDDTKPFLVGPDSLLVNLKSVRMVVRTDGNKVNVQMDPPLANVRIDNQVKMTAPATCPAWPKLRFSPVTQFDGTTLLATGQIPQGCSAQTYMSLLDHPGYTAGAVRGIWQELGGSILGKDRQGSVPRNATLIAKAFSPDLVEIIRDINKYSNNTMARQLFLSIGAQFRNSADGDDAQAAQRVVRQWLARKGITAPRLVMENGSGLSRQERVSAREMAAMLQAAWHSPYAAEYISSLPLAGLDGTMRKRLRRTALVGEAHVKTGTLNTVRALAGFSRDASGHNWVVVAILNSPRPWGASAILDQVLLSLHTRK

SEQ ID NO: 18346 - protein, 74 aa, Pseudomonas aeruginosa
GQHPMRRLKRDPLERAFLRGYQNGITGKSRDLCPFTHPTTRQSWLNGWREGRGDNWDGLTGTAGLQRLNQLQHV

SEQ ID NO: 18347 - protein, 423 aa, Pseudomonas aeruginosa
ATTRIAPISPRHAPSGRRAQAQGLRKEPFSIPPRQSGDGIHRFADQRRSLVDETRIDLHQARPGGDLLRRVRALGDTAGGDDRQPSAQLAGQHLHRVRALLPHRRAGQATRLVAMRQAFHAFAAESGIGRDHRVHPRLDQRRGDQRGLFVGHVRGDLDRQRYPPAMPQRQRFLALAQCLQQLLERIAELQAAQAGRVRRADVDGDVAGVGVDLVQADQVVVDRALHRGIEVLADVDPQYAAILRRAHPCQQVVDAVVVEAHAIDDRVGLRQAEQARLGIARLRSRSDGADLDEAETELAEPVDGVAVLVQARGQPHRIGKLQAQHRDRQAGRLGRQQAVQAQATAGPDQVDGQFVGGFRGQFEQQLAGQGVHGRVSVGRMKGADYSRRAPAQARRCSASRRPSSLKSRRNVPCTPSWPMNGRR

SEQ ID NO: 18348 - protein, 142 aa, Pseudomonas aeruginosa
  UNSURE (119): Identity of amino acid at the above locations are unknown.
QQHLHRSPFRTRQPPAPGCRAKRWPGAARTGGRPRAAVPAIATAGAERLVAGRTAPAHPGRSAARRAVRPGPGRQGGSPRGPQAPGAGQSLHPGVGRPEDHRRRVQPGDPRPGTLPTPXKTWPRPRSAGAYGSSATRISSRP

SEQ ID NO: 18349 - protein, 1036 aa, Pseudomonas aeruginosa
  UNSURE (427): Identity of amino acid at the above locations are unknown.
RASSSRPTQERSHVPTPPQYMFRPRLRAGAGQPGAGLRRTPGRLRLRLSGALSGLHLPGPAAEHGLPRRRAEESQRPHHPAHARQEFLRRDLGAHHRRARRRRLPGDRRRPGRFLQVEQAGPLPVQLPATGSQHPRPAGTARRRPGQRDRPLHGRHARYPLRPALSAAGRTTGAGQPHRSGGLEGPGRALAQRRRLVQARLADQRRRHSPIPASHLLRRRMAPRVRSLGTDAGRHVSRQGARVGGLELGADLRHDLHPAGGLRTGPVADADPAADRRERQHRHRQGRRAGGTESQAGQLRATGQGRRQTDSPGDPGGIPRPWPYPADTGSGTLPPGTAGGSANPALNHPPAALSPSASPRLARRHPRCLPPAFHCTGCATTRGSRRAGPPTPRPFPSTWRFIVFPCLPRSLFAGVMLASAMPAHAEXPHAPAYIDDSAYPAAARQRILPPMFEQRLGSLRYLAKPGDPLITQAESSDFQRTSDYRETRAYLEKLVAASSGRIALRELPERSAEGHPMLLVTASTEADKSAAGLKRSAKPTLLVEAEIHPGEANGKDAMFMLLRDMSAADRPLAGLLEKINLLFIPVVNVDGDLRRSAYGRINQNGPQETGWRVNGRNLNLNRDFTKLDSAEIRNVAWVFNHYELSFFADTHSTDGAMYPYDSSYCHNGNGWSPASSAWMDQVMRKPVYQALESLGHMVHECISLNDNQDPTQGYYPYRTDLARFSNQYGDIRNVPSILIEQHALHPYKTQVLGNYVMLKAMFEVIGEQAASLRQAIASDRERLLRQKEVILTWKPGEAAETPFVVGDYRYEQSPVTGARTIVWSNRPKTLKLPVTDNGVPDLVVPRPQRFIVPAQWHEVIARIKAHGIRYSTLERPTEIAVTLYRMDDIKLADGFEPDRVQGNRIPGYEGRLLVSGTPKPFQRLQTFPAGSLSIDTAQPLGVLAIDLLQPQSPDSFWSWGFFNSTLVAAEEPEEYVMEPMARKMLAEDPALKAAFDKRLREDKAFAADPQARLQWFYQRTPFYDVNAFVYPVGVVF

SEQ ID NO: 18350 - protein, 139 aa, Pseudomonas aeruginosa
VAGGDAAAWPRRVVPASVQRLLLRRLLLRRLGRLTRQRRPSSDSSQHGTERPSAARQRKHGMLRRVRRTARRSWRRGPGPPSRPLRRRQRRRNRPETPTSHCWPPTWRRAHRYRPALRRPEPYARQQPRRHPRPSRRRR

SEQ ID NO: 18351 - protein, 607 aa, Pseudomonas aeruginosa
RSRSMRKPAPVSRGSVEMQVSPAIAAVPAGAGEDAAVVIEDVDKHFGDVKALRGLSARIHYGRLTGLVGPDGAGKTTLMRILTGLLVPNAGRVTLAGYDVVKDNDAIHVASGYMPQRFGLYEDLSVMENMRLYAQLRGMDADRNAELFAELLDFTRLGPFTKRLAGKLSGGMKQKLGLACALMARPKVLLLDEPGVGVDPVSRQDLWRMVQALTDEGMAVVWSTAYLDEAERCESVLLLNQGQLLFDGPPQELTAQLEGRSFRLENVGAERRAVLTEALDLPSVSDGVIQGAGVRVVLREGAPTEQIQALADRAQVQLAPVPARFEDAFIDLLGGGPGGTSTLAERLSPVELGSDVAVSCRNLTKRFGEFTATDQVSFEVQKGEIFGLLGPNGAGKSTTFKMLCGLLKPTAGEAHVVGHDLRHATGAAKSQLGYMAQKFSLYGLLSVRQNLEFSAGVYGLEGNVRRERIEEMIATFDLGDWLSATPDSLPLGHKQRLALACSLMHRPPVLFLDEPTSGVDPITRREFWTHINGLARKGVTIMVTTHFMDEAEYCDRVAMLSRARLIALDTPDALKRIAANSERPDPTMEDAFIHLVESADREMEATA

SEQ ID NO: 18352 - protein, 385 aa, Pseudomonas aeruginosa
SPSAPRARTWSEAMLTSAFSFTRLRAQFIKEVLSVLRDPRSRMVVFVPPILQLLVFAFAATLEVRNVDIAVYDQDAGRWSHELVQRLDSARFITHVRHVDSQQQLHELIDRGEVIAALAIPVDFSRSIAAGESGRAQVLVDGRRSNSGQITVAYLSTIAADIGAEVVPDAQAPTPVVVRHWFNPNLVYRWFIVPGLTGILALFSALLITSLSIARERELGTFDQLLVSPTSTPEIIISKSLPALAIGTALGLFMISAGVFLFGIPFTGSFALLLASLVLFILSVVGIGLMISAVSMTQQQAILGAFAIGVPAVLMSGFATPVENMPVVLQWLAQAIPLTHFLIIVEGSFLKAMPPSDILASLWPLAVIALATLTMATVFVRGRLQ

SEQ ID NO: 18353 - protein, 373 aa, Pseudomonas aeruginosa
ARSPALTPRRPSTTRASTRPGRPTCSGPSGARWKAPAPACRRPKPRRRAYACASWPRSRAPGSPPSAPATSCTHNRPHWIRCSRPWNWCACGMRWATRRPPTWRRRTPNGQQSTRSSRISRRVSAPRYSAWAFCWALRRERELALLDGPLTPSTLRALPVGERAEMLRRRPDVLAAERLLAASSADIGVATAELFPKLSIGVGGGFQALSTGDWFDASSSRFSILPLISWRLFDGGRVRAEIRAREAAERQAALAYEQAVLTALGDAERALGDYHGGLDTLERRGMALDAARTSYGHAKARYAAGDIALVELLAAQRSLHEAETAAARAHTNAAVQLVALYKALGGGWDASTAASTATHPLRGAAAPVAFSSR

SEQ ID NO: 18354 - protein, 483 aa, Pseudomonas aeruginosa
TLARYKSKNRSEHPMKLHFLGAAREVTGSCFLVEALNVRFLVDCGMVQGGRIAAARNHEPFPFDPASIDFVLLTHAHIDHSGLLPKLTRAGFKGPIYATPATVDLLGVMLPDSAHIQESDAKRDVKRFKEKTALSPLYTLQDASDCLQQVRGIEYDREFAPRVGVRARFRDAGHILGSAIIEVWVTEYGYPTKLVFSGDLGQPGRPILRDPTTIEDADILVIESTYGNRQHKDFSATEEEMIGIVEKTLFERGGNVIVPAFAVGRTQEILYHLHRLTCEGRLRQPKVFVDSPMATQATRITREHLELFDEQAKRLAGWHARGENLPYLSFTASAEESMALNRIRSGAIIISASGMCDAGRIRHHLRHNLPRRECSILFPGFQAQGTLGRRLIEGAERVRIFGEDIPVRAAIHSVDGLSAHADQKALLDWARAFIQAPAQTFVVHGESSAAQTFADLLQQQLGWQVTVPEYGHALRWPDFLAHE

SEQ ID NO: 18355 - protein, 191 aa, Pseudomonas aeruginosa
RWRPPRPPGRCRRRSRSRCRRCATRRRRRRITTRRGASGDRPACQEDRTRLSRGVADSPGRRLSIGWRTIRRQARYRRRHPPAPTARLDLALRPPISPVRHAAQGRAAAVRVESGSGPVKDRYRKECRERSKSSRWGEPEATTASGCALPRAGQEDAKSVAHKPRSELRLFLLWRIGRLATTEEPPVRRLG

SEQ ID NO: 18356 - protein, 397 aa, Pseudomonas aeruginosa
RDRWAVSTPGARPCRSPCWNCASPPPGSLPAMREETPEQPAPLRSGYTTGSCATATSLAAARLLLGGTISDAVQIVLPKGQQVLMRLEFCRAWENGAEAGTLKDAGDDPDVTHGALVFARVRLSAEPGVRFHAGPGVGTVTRPGLTLAVGEPAINPVPRQMIERHLAQLAAERGYAGGFEVAIGVEGGAELALKTMNPRLGILGGLSILGTSGIVRPFSCSAYIASIHQGIDVARANGVRHIAACTGNASEDAMRRRYALPEIALIEMGDFAGAVLKHLRRAPVEKLSLCGGFGKISKLAGGHLDLHSRHSSIDLPQLAGWAAALGASTALQDSMRAANTSQQALAQAHAEGVALGDAVCAHALRFARGIVPTEVALEVFAIDRQGNLVGQACEERR

SEQ ID NO: 18357 - protein, 133 aa, Pseudomonas aeruginosa
SQSATNWLAAWPSSQPTRGVMASITPKIIPVRSASDRRGRSRLEPLPMAAAKASVDMAKARKIRETGFTRILQPGMSQRHDPAARLRRRNVVGLTNPVGCAGHGRLPRMLTSAPSTGDGRLLPKEGRQHSRPA

SEQ ID NO: 18358 - protein, 212 aa, Pseudomonas aeruginosa
NGKPVRHFGDQSGAAPATVSERNPLQATVLRHGKARISRPSQARRPACNALLAHPRWAGASRLFEALSRLRFPARSVLPGHEMERPCPASAVCAPSLSPSASPPACCWYRPPSPKPRKPPSPCPASWSAFARIPPNSTTSTSPLRSVPVRAWASAPWTPRRAPAASAARKFADATTPASRPPSPAAPASASSAPQEMAVPASRRAASAATHR

SEQ ID NO: 18359 - protein, 86 aa, Pseudomonas aeruginosa
PATGAFPTASPRATSCTTSRPAATGATPKPTNGTSRAKSCCAGTTCASATSRSRSATARPSPSSTPCSASTAAPWSAPSTTASASA

SEQ ID NO: 18360 - protein, 97 aa, Pseudomonas aeruginosa
TWPRTGGCRRTPRWCVPNTTTSTKRSTGRPTRATAIAPGTCHGAPPTSGWTSPSPRPCASAPGCATSTGATPTPPTRPACPATRWSTPTWAGGYGRT

SEQ ID NO: 18361 - protein, 316 aa, Pseudomonas aeruginosa
PSALSCTTCSTASTPWLTTTTASNGSWASHARSTSPPTSVSEAGAAAIVSAEPPDLRVAMSSLHLDALHWSPDASTELLRGVHLEVPASSFVGLIGPNGSGKTSLLRCAFRYARPQRGRVVLDGDDLWRQPPRWAARRIAVVLQEFPEDFGLAVEDVVAMGRTPHKGLFDGHGADDRQRVRQALLQVGLEGRAASPFASLSGGEKQRALLARALVQEPRLLILDEPTNHLDPRYQLELLRLLRGLGLSTLASFHDLNLAAAFCDRLYVLDGGRIVAQGTPTEVLDADLLWRVFGVRALVDRHPLADHPRLTWITQA

SEQ ID NO: 18362 - protein, 383 aa, Pseudomonas aeruginosa
KPWSPASTLGRHVHDPVPQPSRLLPVAGQPGHVARPVLRGRPRLRSGATGQRPGRPHRPPAPVRRGGGARCLERRPGAHRLADPRPTGTARRLRRRRPGAGGSGPAGGHAQSAGRSAPARRHLRRDPRRGVGGALHRRGDRPADPAAGGLPRRPRQHAAGARRGQSRRPPGQRPAVAGGGRGVVRAPGAGQPAAVPRRPPRRLLCAVLDARRPRPGALVVDLAAGAVRGRRPAGTARAGPCAERADGRRTDRRDPRPGRPSRTPVGLRLLLAADRRAGLGERRHRLRRSHAAARRAPAGGCRAPPTAAGVRPARRAVPGLDGCRRAHPDRPPGPAHRHRHRGHRRAVLHSPAASPQLIRTDPAGSSGNAPRCLPPAAGCRRAC

SEQ ID NO: 18363 - protein, 270 aa, Pseudomonas aeruginosa
CRVSTWRFLARRADGDRAMATDRPTIANPGPAYQPTGLSGSYRTASEQQGGPGRCQQQQRHALVEAFHQRRRAQQPRAADAEQGPTGQARQRNQEEQQCQQADPPGLSGAFPGEQCQRGEGHHPGLGIDQLQRRAAEHAEAPRRLRAVDAARAAEQAPGQVAEPADAEPGEPLLEQRMASQQLAQAEPEQQDQRRHRRAGAEHDRPGGGQAVALAVAQDQDVGRSGGDRGDDGEQQEGHEGLHGRAPVAGEPSSWRRAGPQSGSWVHCRR

SEQ ID NO: 18364 - protein, 407 aa, Pseudomonas aeruginosa
PTSTTWCRSSATWSAKVGGSPARPSSSTAASPPSEPRSGRHGGRCLPAETLHARDPGNRRRHRPARSVPALRQTLGCRAGARCRPVPADLAGRRAGQPVGRRPARRLRLARRTADPAAGLPGPGGTGRRGDLAGAALGGGASDAETADQPRQFRGQLGQPAAGPGTLLRMFRRLGGKLAHLADVAGDFVDYPALLLAGRGDLRGEVVDPPHRVAGGGQHAVDPGGALDAVARLEAARLHGPHGVLHPGLEALDARLDVLGRILGARRQRPHLVGHHGETATLLAGPRGFDGGVEGEQVGLFGDALDHRQHRVDAGGFLGQLLDALGTALHFLRQLADHLDGRFHHVGALARLPAGVIGHLRGALGIARHLVDGAAHLRRGGADLVHRCVLAVDQTIVGGGHAGQRTG

SEQ ID NO: 18365 - protein, 1031 aa, Pseudomonas aeruginosa
QAQGFEQAPVILLRRAGVAADHLQQALDEALRRIAEGSAAPGDDAQPSWLEGFPQRQRHHPAEQRRGGAYDRRHPGAHVGLLHQGLQDRHGVRADDAPLVDQGAVAPEQLAHQGVVAVAGVVQRPVLFQQLVDRAATRQRMPLADQHRGVVVEQLLAGELLGRLGAVQRADGEIHAAVAKQWLGHRHQAFEKLQAHLRHALAERLHRLREEGQRHPRRHPDAQPAAGLATQVVEFDLRVLQLLEHQPGVDQQRLAVFGEGQAAGRADEQRQMLFGFQFAQRAGHGRLGNPQDAGGGADAAGVGTGDQGLQLVEFHGLTEVTTKGCHHSQSEPPRQSPACLPSASTTPRRPPVGALEENKKNDRACRPARHRGAAGRDGYLAPPYPCPPGVGFRGTANRHAGRRMPGGLGLPGQPWSGSHRRGRHPVPRRGPSAGPARRHGRATDPGSHRPALRQPGGRRDARLRPRRPHRDAPRRGQAPGRVAALARHPATDLPACRRGPRRCPRDARRRAAGALPLRRHLRHAQRPGIPRRPPRLPSRPLHGLGRYRGHPRDRQWRPRRGAAAHRRPGGGLLRHRAGLAEHRLAQRRPAGHRDRQRRRDPCRDGLQRDPGQRRNDPQRPGPDRGNPCPAGAPHRRTGPRPGRQLRRAGGGRLPALPSGAGQPSRADRVRPRGGPRLAGRGMPDRRTAAVHRQRGFRLHPRTLSRQLPGDRQWPGRERLPVAQPRLRLQRRLPGRRRQLLGATGRALPGLSQGFQRARGLARADRQRTTTMTRTLGSIALSLLLAAPAGAADWTGKVLRLGVDPTYPPLEYKQPDGRLAGFGIEIGEALCAELRARCEWVESNWDGIIPALLSRKIDAIVSSMTITPKRAQHIAFTDRVSNAPSRLVVRRGSALLPDAESLRGKRVGVGQGSNQEAYAKAEWAAKGVRVVSYQNQDQVYADLVMGRLDASLQGAVQASYGFLDKPVGKDFELAGAVLDDPRYFGVGDGIGLRKEDVALREDLNKALATIRANGTYARINARYFDFDLYGTP

SEQ ID NO: 18366 - protein, 466 aa, Pseudomonas aeruginosa
NVPRRLRPADTRRHPGDPETGAGLPARRRAHRPPRRQRQARRQPPAARPGQRLYDADPQRPRPGHHAVAVLQPADPPQPRHRRPRHRPGRHRPVRRRLRHPGVHLWRLLHGNLPRRLPGGPGRPGRSRASLRHGALASVPPGTPAADAALRPAGHRQQLAGAGQVHRAGLDHRSRRPGQGHPGRRQRHPAVLPLHPGLRADLPGHHRNLQRRAAVAGAAQLAGRQEAAAMNAVLDEYWQAYLWTDGLQLTGLAMTLWLLILAVALGFLLAIPLAVARTCGNPLLRYPVWLYTYVFRGTPLYIQLLFFYTGVYSLNAIRAQDFLNAFFRDGFNCTVLAFVLNTCAYMTEIFAGAIRNTPHGEVEAARAYGMGGFTLYRRIVLPSALRRALPYFSNEVILMLHSTSVAFTATVPDLLKVARDVNSATYAPFLSFGIAGALYAGTAFLLIWLFRRGELRWLAYLRPQTH

SEQ ID NO: 18367 - protein, 68 aa, Pseudomonas aeruginosa
RDWSWARRTPGNSPSATCSAPRPGTAPAACSPRCWWAMPATAASKPSPTKPAATARCGSPRRTSTPAA

SEQ ID NO: 18368 - protein, 146 aa, Pseudomonas aeruginosa
RAWWTAAYSSSGTPESAPGPPAGQPPRPGAGDHGWPSGHSTRCNGAPPRPRRWTMPLPRRRSTRTNRPPSSPRPLRSRLWASRRNSRSGRSMGSSRVQSKLPSPDTELSSSSLRSARLRRCSTSQLPSTRQGRRANLESPPGSAEA

SEQ ID NO: 18369 - protein, 339 aa, Pseudomonas aeruginosa
WSGKLATLSCLEGSKVEWTTQSTGLQRRARTMNTDNHGEENSPFRRRRLPSLNALRCFEAAARLENFSRAAEALCLTHGAISRAVRTLEEELGCALFERRSQRVFLSEAGRRLLAGTGPALDLIERTGETLRAEAGPTALVLSCEPTLLMRWLIPRIAGFMQEQPRLSIQLVAGGGPFAFGRGIDLAIRRNDFPWPPGSHAHWLFHHQVRGVCRASDVERHFHLDAGPPGLRAVAPRLHTATRPQAWNTWTRLAGQAPATTEGQRFEHFYLSLQAAGAGLGVAIGPWQLVRDDLAAGLLAAPLGFLADGSSYHLLTPRPLQAGEPATLLLEWLRRSAAA

SEQ ID NO: 18370 - protein, 387 aa, Pseudomonas aeruginosa
RPIQIFKPSPCRLRKEKTMSNLLLSPLAVGNLALRNRIVMAPMTRSRAQQPGDVPTALNALYYAQRAGAGLIVSEGTQISRLGQGYAYTPGIYSEAQLAGWRQVTEAVHAAGGLIAAQLWHVGRMSHRSLQAGGEAPIAPSPIQAKAQVFIADGQGGGSMAPADAPREMTLEDIRRVRDEFVRAARNALDAGFDLVELHGANGYLIDQFLASASNRRSDAYGGSLENRARFLLEIVDALVAAVGAERVGLRLSPWGTINDMHDDEPEAMTLYLAEALLRRGIAYLHLAEWEWSGGPAYPQGFRERLRERFRAPLIVCGNYDAERAEAILQAGLADAVAIGRPFIANPDLVERIRLGAPLAEANQARFYGGDAAGYTDYPTLGQSATA

SEQ ID NO: 18371 - protein, 228 aa, Pseudomonas aeruginosa
SLSGRFIDCTPSLSARHSRDASSDRLQPVHPPAALEHGVLFHRRDRAGLFRHLGARPRPPTAPAGTQPALGAGPAGRPAADPSDRLAAARAAPASGPRDAAGAPPGALRAPVAVYLDAGDAAHRLRRHPPAHRLRPVRGTQLQGHRAVRLDFANLEPELGGIREALRRRSPHGRPVAEHLGGAAPCARRRLSPVGPPRRHPGAHARPSPAPLSGALRRLSRRIGDDLL

SEQ ID NO: 18372 - protein, 115 aa, Pseudomonas aeruginosa
GHAGKTSPPRGSSVATTGVAQVAGSASDREEHAMASLHCQHRSYTITADVVEHPGIPTPWAGGCHITDPEGHTSKRIALPVRFAFLADLENAQRASIAHGKWLVDQRLDRGKALF

SEQ ID NO: 18373 - protein, 252 aa, Pseudomonas aeruginosa
ASSNSVANTPLAWARAPYRRVLAEASTITSQSSPGRRLRGWRSRSRRCRGRPRSRVGNHWMAPSAPWLRAPPRPPRRAPGLLLASAPMTERGRMLRAFLASAAARGRSPWPPAEPAIHPTALRRCRCAPGARQGPPRAVAVDWPPMVAGSTGDGDAAGRNVPPHRCPPPRSARRRARPHGRAPRAARPGRRAGHRQPPRSSVERCCPAPHRPGESAPAAGAPRRNGGAGCPAGLPSVRRRPAGRHRRPAGDG

SEQ ID NO: 18374 - protein, 328 aa, Pseudomonas aeruginosa
PHTATALATRSTPGDLATAASRSPTHDIAEHLDRARRARDARRQPRKPDHELIRIRTDHPFAERPGRRPAQRHRPYRPGTPAQPARTQGPPAVAAGAGQPGRRQPRRHPRHPRRRRPAPAGGSRSLFDPRSPLRPRIRRTPRRAERRTRRPVAPGDARLRGKATHHGGLEGPRLRPAPGWQRRHGRRPGAIPATDAGHAAPRPAAGHRTPATAGRRLLRRPAELGGDRRAHQRIADPPRAGQRPRPAGGLQERHRRRRRHRLRRDPFGGPRPPPFRPRPARSPGADRDPRQSGHPCGAARRPPRFELRARAGAGRAPGPGKARHRHAG

SEQ ID NO: 18375 - protein, 861 aa, Pseudomonas aeruginosa
CWKATCSTVARRSAANCATASRSPTAASAGKAPSGFSATPPGGSPSGAESGGSGHAAPLFLFDVQQQVLQGLAIGPRLLPEPAPLRLHQALGHVAQGLRIVLADELAGLRVEQVGVGQQRVLVVVDQLAGGIEGAQVVHRRRQFEGALVAVALHPGDPLRIHRPRPHHPVELFLERADARVVRLAVVAVVTGHRRAAQGFHRRQHAALELVVVVGIEQVVLAVVLVVQHRLQAFQALGEAFPRRRAVVGGTVGVAAPVQVDLGKVGAGLPQPLFDCALHAGAVGTRLGAEDPPAGLPARLRRRRALRLEALALQAYASGQRVQLLRLVQLGDRLHRRIEQADQVGEGVAEEPGDPQRHVDPRAVQQGDREDLEIGDALAAGLPDRSHAEQGQGLGDVVAAGAHGRRAPHRETELAQVIAMFLQVTLEQQVGRLEADAPGGRGRQVAHVHREEVASGGQHVESPATRRAARTGRYEAPFEGCQQPVDLGPATGVQGRCHLFAQAAQHLAAGTPGGRRRFAAQAAFYPVQRQQFQAFAGIPESTPGLPAPLFQAGRPRALPGLAHVAGQRIEAQAKVVRQALQQPGVGALAIAARNPQQRQQGIQAQSPARRLAEHMQAVADLRLLQVAEIGVQLRQPAVRIVAELQADLAVETVVAQEDENLAAQLFGAARVEQRGIVELVGQALQVAQRAVALGAGQRRHQVVDDHRLGAALGLGALPRIVDDERIDVRQRTEQRVRPAFGGQADSLARQPFQVTVLADVQQGIGAVGVAQPEVERQVAVRRHQVGIVVDRRRIELIAARRLDADEGQAIAQAGDHHPSVAEHRVLLRLAPARQHRLAIALRQACEAGQVVVQRQALGAGP

SEQ ID NO: 18376 - protein, 450 aa, Pseudomonas aeruginosa
VEMLQVVADAAEQLADQLGSAGGQSVDRIALLAQGTKDVQRRRRGVQADAIADPAIAGRVVGQHQRHPFFRVWLARQLGPAPRQFGDEIHALVVGEIADHVALAAFAAPGQALETDRPGDDAPVQLRQRHVHGQVARPQALRVVQPERAVVQRADRLQYRHVATERTQLGRLRIGLGETGGIDDQRGVAALQPVFHLRQAGAFLEAGQRDRQRVEPLRREAFAEARDEGGVGCLQVGAIEQQRDHRTPGLPVGTPVFPGSPRHAVDGTAPPAAAPAVRARRSRGRGTGWPGSGRTARRSPARPGASIARSARPAPPAGCQGRSAPGRGGRRRAPGSAARRARPAPPVAPRRSASSRCRRAAKAGSPARAAAIGRRRGPPRRGSATAWGWPGAGSGSRPAAHGRPRPAMRGANRRCRGSPARRESGPGGRCRRRERSRRVGCATGAWTFYR

SEQ ID NO: 18377 - protein, 372 aa, Pseudomonas aeruginosa
RRASARAAGANAGRTRAQPGRAGRPRQHRRQTRRTRPAATGHAARTPRAFPRTRRPARLRAAPAQPLRRRAARNRLLQRRRGRRPGPGRTPGWRSRRSARGETQQRSGEHRPGTSSHRTRTPMTVYFIGAGPGDPDLITVKGQRLIRQCPVILYAGSLVPQALLEGHQAGQVVNTAELDLEQIVELLAQAHRRGFDVARVHSGDPSLYGAIGEQIRHLRELGIPYEIVPGVTATAACAALFGCELTLPEVSQTLILTRYAARTKMPEGESLGDLARHRATLAIHLGVAHLAKIVEELLPHYGADCPVAVIHRASWPDQEQVRGTLGDILPKVAARNFRRTALILVGEVLAAEGFADSSLYRAEHRHLYRPGE

SEQ ID NO: 18378 - protein, 325 aa, Pseudomonas aeruginosa
KNPLRGAGLVGLESGSDGLFQLRYGVEQVGDQAVVGDLEDRSLFVLIDRDDHLRVLHARQVLDGTGDAHRDVQLRGDDLAGLADLHVVRHETGVDRGAGSADCGTQLVGQGVEDLEVVAVLHAAAAGDHDLGSGQFRTVGLGQLFADEGGLAGIGRAGNLLDGSRTAFGGDGVEAGGTHGDHLDRSRGLHGSDGVTGVDRTLEGVGADHFDDLGDLVDVQQRGDARQEVLAVGGSRGQHVAVVLAQLGDQRCDVFRQLVGVGGVVGDQHLGDALDLGGGFGHGGNVLSGDQHVDVAANGLGSGNGVQGGSRQGRVVVLSDNQDSH

SEQ ID NO: 18379 - protein, 148 aa, Pseudomonas aeruginosa
EIDSGTRIHGIRRRHRRRRPRRSVRRMPTEAEGRRSRSRDQRLRGREGFRSGRPHPLRRGVRAARAERAVPRLEGTRRAAQYPGDRRRHLRPEERRERYQGAQLLRAQDHAQRGQLYHLPGQPLPLAGPTRPKDWAWRSIRASPPRKR

SEQ ID NO: 18380 - protein, 171 aa, Pseudomonas aeruginosa
KRPAKRRRSTTRSRTASSASTSCPRCSSPIPTTRKTSRSTSSWPMRAFRSRRTCRSTTSRPSATARQACTKWWPTTTAASASRSTRRTACTARPATSRTRRRTSPGWRRKVPAGRTTPTCKANEKGSLGSLFSCCACQSGCGPRGKNSPWLQTPSHSMPSIRRGTASSTSW

SEQ ID NO: 18381 - protein, 455 aa, Pseudomonas aeruginosa
IVPLPMPTASAIISTVTLSSPCSRNSLRAVSRISCSRRRNSRTLRGSFCIKRLSGQNESKIEAAYYAYSARKCTEHPTMNCYQDEFDQTNGLRYLNHAAVAPWPRRAADAVSAFARENVAHGASDYPEWLKIEHRLRERLARLLNARAGSDLALVKNTSEALSFVAFGLDWREGDQVVIGNEEFPSNRVVWEALRPRGVEVVEVGLAGDDPESALLAACGPRTRLLSISAVQYASGLRLDLERIGAGCRRRGVLFCIDAIQQLGALPFDVQAYDCAFAMADGHKWMLGPEGLGVFYCHPEQRERLALHEYGWHMLEHALDYERRDWRPARSARRFECGSPNMLGAMALEASLGLLEEVGMERVGRDIAERVQWLQDGLSGIPGVRLHSPRNPSRRAGILTFSLDGQDNRTLFETLRQERVICAQRGGGIRFSPHFYTSSTVIDDTLAILRQVAGT

SEQ ID NO: 18382 - protein, 278 aa, Pseudomonas aeruginosa
PGFIPQNPGFFYPCAGLAGQRKQPMEIGGSLLRQGFQADATQRREEFGDIAHVFRQVRLAAMGNRRQVGRVGLHQQPVGRYLASHLAQGIGIAEGDDAGQGNVEAQVQRRSRHFPVLGEAMQHAGLRQRRLAQQRQRVGARLAGVHDHWLGGDPRGFQVQAKRLLLQLGGFRFVVVVEAGLADRHHPRMRQFAQQPVQRWRASGLQVQRVHAHRTVHVGIALGQGLHRLGIVGADADAEELTDATRSRGIQRRIERAAMGGQVEAIEVAVGIDQHDPV

SEQ ID NO: 18383 - protein, 227 aa, Pseudomonas aeruginosa
ISAIQTLQQIRQQPIQASLHLGQRQPGIEHLVTLRGLRGALQVGLTHGLEEASVLLLETVEPATRRRPRQADFHRQVEDQREVGPQVALDEAFQRGDARLRQTAPAALVGIGGIGEAIAEHHGPARQRRADDPGEMLGPRGEHQQQLGIGGHRLVAGRQQQFTDALGERRAARLAGQLHLDAALAQALGQVVAVGALAGPFRALQGDEQAGHTALLILAAPLIVAAG

SEQ ID NO: 18384 - protein, 250 aa, Pseudomonas aeruginosa
QGLLGQARAASEQAHALLPVALGIGRTRRSGEDSPRRGLGRRRVATQTLAAGDDQLGDTVAQRRAERQQLLAQRRGVERDRQAPTPLFQARQVALQETRRAGAHRQGLEQPVAIGQSAIAHGQLGGGPAVDPVQHQSANLRNTRVPLVPPKPNEFDRATSILRGLASWATRSRSQPSSGLSRLMVGGATWSRRASTLKIASTAPAAPNRWPVIDLVELIDSAWACSPNTLFTAAISAMSPAGVEVPWALM

SEQ ID NO: 18385 - protein, 309 aa, Pseudomonas aeruginosa
PRHPGAPVPAQSPGRCHGWRRLPMRPYLADSWDSLLSLSQARAARVAANASTPSRPWVLMPFAQRLLRPARTLPGPHSTSSVTPFSASSWMLSTQRTGLYSCASRSRRSVSRSAGTAALTFCTSAIFGACHCRLSTEAANCSAAGRISSQCDGTLTGSATARLAPRALHASMARSTAAAAPAITTCPGALKLTALTTSPWAASAQAANTSASSRPRIAAMPPCPAGTACCISWPLRSTSLTASANARLSAATSAEYSPKLCPATNAGRAPPSASQRRQSAIETVRMAGWVLSVWFRCSSGPFWTSAQRS

SEQ ID NO: 18386 - protein, 213 aa, Pseudomonas aeruginosa
GRVFSLKSAVRHGEPHARPDPRLQLPLPTRTPDPPAPSLRKRQPRYRRKPSRRGKCRGTGAPPFRQQGRSAGRTLSATPGDRLRPGRRTRRRHPRQAAHPRTRHPAATGRQRQERDLPHRTGPPQQRQPTHPGGMRAVHRALPPPRREPHPPLRRSGTPAGLRRQLQGGRPGRQPVPLHRRRGRHQPGGTAPDPPGRHAPRGRRRNPLSRHSI

SEQ ID NO: 18387 - protein, 1075 aa, Pseudomonas aeruginosa
ESCVPIAVSGSPGNHWYYMKRMLINATQPEELRVALVDGQRLFDLDIESGAREQKKANIYKGRITRVEPSLEAAFVDFGAERHGFLPLKEISREYFKKSPEGRINIKEVLSEGQEVIVQVEKEERGNKGAALTTFISLAGRYLVLMPNNPRAGGISRRIEGEERNELREALNGLNAPADMGLIVRTAGLGRSTEELQWDLDYLLQLWSAIKEASGERGAPFLIYQESNVIIRAIRDYLRQDIGEVLIDSIDAQEEALNFIRQVMPQYASKVKLYQDSVPLFNRFQIESQIETAFQREVKLPSGGSIVIDPTEALVSIDINSARATKGGDIEETALQTNLEAAEEIARQLRLRDIGGLIVIDFIDMTPAKNQRAVEERVREALEADRARVQVGRISRFGLLEMSRQRLRPSLGETSGIVCPRCNGQGIIRDVESLSLAILRLIEEEALKDRTAEVRARVPFQVAAFLLNEKRNAITKIELRTRARIFILPDDHLETPHFEVQRLRDDSPELVAGQTSYEMATVEHEEAQPVSSTRTLVRQEAAVKTVAPQQPAPQHTEAPVEPAKPMPEPSLFQGLVKSLVGLFAGKDQPAAKPAETSKPAAERQTRQDERRNGRQQNRRRDGRDGNRRDEERKPREERAERQPREERAERPNREERSERRREERAERPAREERQPREGREERAERTPREERQPREGREGREERSERRREERAERPAREERQPREGREERVERPAREERQPREDRQARDAAALEAEALPNDESLEQDEQDDTDGERPRRRSRGQRRRSNRRERQREVSGEVEGSEATDNAAAPLNTVAAAAAAGIAVASEAVEANVEQAPATTSEAASETTASDETDASTSEAVETQDADSEANTGETADIEAPVTVSVVRDEADQSTLLVAQATEEAPFASESVESREDAESAVQPATEAAEEVAAPVPVEVAAPSEPAATEEPTPAIAAVPANATGRALNDPREKRRLQREAERLAREAAAAAEAAAQAAPAVEEIPAVASEEASAQEEPAAPQAEEITQADVPSQADEAQEAVQAEPEASGEDAADTEHAKKTEESETSRPHA

SEQ ID NO: 18388 - protein, 330 aa, Pseudomonas aeruginosa
DFPDRPGPVPGSIARMGPRPRPPPPRPAPNPRHRKQFAAPGWPCAIPAPRRHGSAAGCCHHRSPAAAIHAPEPGPGPRAHQPRPGRGPAGGRARRCRRCYRASASNALAVPGSQSPLGFDQQTVAGMFDQVEDLLEAFFAAIVGIGYFVPLGPVATQEQIQFGGTAPGTQGLEVGQVGQVHGQDQVMAGEILDADLASTQCRQIVAAPLRGQAGALVRCLADMPAGGAGGIDMDTGGQPGLLDLAPEHAFGGGRPADVAQADEQDAHQPPSTRRTRSRSSGVSTPGSMVSRASATWIRTPCQSARNCSRLSAFSSQHGPQATKSARKPTR

SEQ ID NO: 18389 - protein, 169 aa, Pseudomonas aeruginosa
GTPSGRLSRSRAKASRAQGKGARLKVRARPSMSVATLTTFGLNSAETSWIGSARVAMAASGCAARLAATWSMSAGGISGSSPWTLTTMASLARPSREATSSRRSVPELCSARVSSASAPNPWHAARMRSSSVATTTRLAALLRAWFQTRWIIGWPAISCNGLPGRRVEA

SEQ ID NO: 18390 - protein, 506 aa, Pseudomonas aeruginosa
RRLHGRHPPVCGGISRFAFLDVVDFTIALHHFHQLDGLLLHGDHQFVDPPQQVAMEEHRRNRHQQAGGGGDQCLGDARGEHRRVGHAVVHEGAEDLDHAEHRTQQAQQRRHRGDGAEGVEVALQLVDDTGSSLLDALLHDLATVLGVGQTGGEDLSQRRVGAQVLELLGAQLLALDLLPHLAEQLGRRDAALAQRPQALRDDGGGGDRTQNDRQHHPAAGLNQFPHSGISPKKKWRHSSTATLFRRPPRFSFFPPEVRRITLPACAATASEEKRQGTVACRVVDLRGDPRVTLHHFAMGMAEGVAPTSRDQHMARPRTQHEGDSGGTAAAMMRRQQPVDPGIGLSRQPGMLGRTRDVPGQQQDFAIGLDPQHTGAVVAVAGLCPCPLFENHAIPGPAPLVAAVREQRRRQARGFAADQPNRRESGSDRRSTACMVVVGMAQQQAVQAPQVQAAQHRHHHPFAHVERPLPRTAVIEQDMLSGTHQHGQPLADVQHPHFRPPPFDRRR

SEQ ID NO: 18391 - protein, 703 aa, Pseudomonas aeruginosa
QRGTEGTQRQASRRQPAERAEHAQRYAPGRCGGWLPGLGQARQQAKRTKQQVQRNASGAKQPLAQPGHPQQQAPRQGRGHYQQFDPRHRQQVGRRSAQAQRQAQRQQRHRQPQRHPPLRPPPGRPPAPAPKAPGEQPEQQGNRQERQPEPRLQAGQRLDQQDQHQRCQQRGQQAQVAETQAPDQRQADHQAGAPHRDLETRHQPVAPGTKQTQGAGTGQPGQAPRPAAQAMQGRHQAIEHPRQQRDMRTGDDHQMHGAGVLEHAPLGRAQPRAIPQHQRRQGGAAPLCVDRQQALAPGIAPGIQAAGRLQALARLHRAHSTDPLRQQPGLVVETRRVHQAAGAFQGHRQAPAFAAHQRRRAAPAQAQTLGKKHAPRSADLLQPEARDALAARRQIDHTPLQPKGATIQLGGQASVQGDLRRAAGPGEPEQEQPQPVQPAEQQQQSGGGHAQQPADRRQFRQEAQGQQPRGEGWQSQAHERFLPSPWRALRSPTCHMGSYNGQRNPVILLGIIRKPISTESPHAASPVQALHARSGKHPLAEVAALSRQVDARSQPLASQSPLGIARHGRRAVRRLHPDADADAAGGRSGGVDSEQSANLRRIGLADQSDHDAPGLLLHLQAGRLVDAGAAAHPAGPSHLGMDQPGAVQPLAALPARFGGVRHHRRHPRLRADDALLALVGAAQLEPTLPATSRTGRREVIRRT

SEQ ID NO: 18392 - protein, 662 aa, Pseudomonas aeruginosa
LLLRLRQLSTDLSFITQSLRRLGARRTPGWIQSGEEAEDQGRAADQHDIVEHQLRRQVIDEVHVGREELVAQQLFQGGNPGADVECRDHPEDPADQRADHPDHRTLDHEGSHDLPRRGAEGTKDGDVRLLVGDHHHQGGNDVERGDRDDQQQQQADHGLFHADGLVQVAVAARPVAGVEVIVGQGPGDLPGHPRRLEQVVELQAQPLYLVGLPALQARGVFQVDQRQAAIQFAGADAEGADHGETLHPREYPGRGDRHLGEDQGDLIADADAELLRRQLADDDAEAAGLEFRQRALLEEIGNDRDLGLFQRIDRIDHHRLYRAIGAEHALHLGERRYRGDMLVGLDLLGQGAPVIDGLVRLDGGLRHHAEDAGTHFAIEAVHHREHHDHHQHAQCQADHRGQRNEGDEMAATFGPRIARADENGQGSEHVALSWQKMDASGWRSGEASPAALHSDHHCRRGFAMSTRDADDRREYYRIEDTLALEFRPAGAVEDGLESEPGATLFSLLSDLHLMDYESQHLLRHISERDRTLANYLKVMNKRIDLLGQVMVQSLLKEIGEPRKVSLSEGGVSFRHDRALPVGQLLVLRMVLLPQGFGLELRARVIHAQPHDDEFEIGTEFEALSDAQRQLLARHILQKQAQQRRLARAGQGPLGEPGQPSST

SEQ ID NO: 18393 - protein, 373 aa, Pseudomonas aeruginosa
PPARKSTLSPSGRRRVSSLMKVATLGLDSTVHSHFFTPKTSSGTRICISCLTGVWHDRRQPSFAWRRVKCDSSVGSISPPPSTTTHLHCAQVPPPPQAEDRNTLFAARVCSSLPPAGTVRLCSPLIWMVTSPLDTSLARATRMIATRPRTMAVNMPMARKISNPITGLSLQLHAGERHEAQRHQADGDEGDPQALQALGDVAVLELLADTRQRGDRQRPGKARADAVHRALGKVVVALDHEQRAGHDRAVHRDQRQEHAQRVVEAGYVLVEEHLEDLHDGGDHPDVAEQAEETQVHLGQPGPGQRAVLEQVGVDQVVGRHGDGLHHDHRDTQADGGLHLLRDGDEGTHAEEERQRHVLDEHGLHEQADVVLHQ

SEQ ID NO: 18394 - protein, 89 aa, Pseudomonas aeruginosa
LMATIPSITPATMRQEAMRVSSSTAPPMKIARVLVSPIEPCMWPRKASIQVKPWPRMLSTPPAAARLSEVAPAKPSTEVHTASPDICAG

SEQ ID NO: 18395 - protein, 174 aa, Pseudomonas aeruginosa
AKNRKARPTSAGLRKFFPVPPNTSLPSTTPKLIPRATCHNGTDGGRVRANSTEVTKKPSLTSWRRMLANSTSQKPPTMKVVRYTGRKYAAPWTRQSHKLFGSNPASAPIRAKRQPSWALNRSGLWAKIRLAWWPTLYMPKNIAGKVHSQTMIIMRFRSMPSRTCAVVRVTLPGR

SEQ ID NO: 18396 - protein, 134 aa, Pseudomonas aeruginosa
FRFHTLLPAPTGSRKWIWVPGRPAGCGPENACAVTPESASPGSETPSALHRNTRARRPSTVSPAWKASPCSAITTCGSAASGWVSMAVTKIELGLDSGSGTLLNGRVRSAVHRPDCNRLSRTCSALSVASLSAG

SEQ ID NO: 18397 - protein, 149 aa, Pseudomonas aeruginosa
SPATPAPTTPWRRCTGSARKPGRRPSARPPSRSATSPPSCSTSTPAAPPAKASRSRIRRPTTRPSRPASRSRRRRTSKAPSRRWSPICSRPGPWTAWSAATSASARPKWRCARRSSPCIAASRWRCWCPPPCSPSSTTTASATASPTGR

SEQ ID NO: 18398 - protein, 210 aa, Pseudomonas aeruginosa
PMRLFRCLALLLSLAAPAAFAGGPYQVELVVFRQAGDAVPSSQPAPDEWATGAQPLASDALRATALDNQLAKLSQDNGYTVLVHKAWRQDIGETPVKIALSEGQEQDHHFPVEGTLTLSQVRFVDMEADFWVNRFGDDGFLAGSQHIRQGTRLKNGELTYLDHPSLGILIKVVPVGARPAAPNPMEMEEQQAPADAPPVEGGFDAAPPAQ

SEQ ID NO: 18399 - protein, 846 aa, Pseudomonas aeruginosa
SSWAMPVLPIKTGRNAERRPGQRPAFAQYKRAPCKRARHPSALVFDLPLAAIVEGAPAGGLAIDLGLHVLLLGLAAETDHRGTAVRVFLRGVAEVMVLGIQLGLVRDDLAHQRRAGLAVLRELAGGQEHARSAVAQHVDIVHLLALQFRHADGVHLRRRRLAILQQLAGVLAGRIGATEELAETAGFQLHLAATLVAFQARPFVALDPVLAFLDLVARTVGVIAADMQLVFLVQQVGVHRGTADRAAMLATQHPRLGLALVVRGDLVAGNQVDGRLATFLRRQAVARAAEEHAGGGGTNHHRPAALAAGNVGQGRLVGAHPLLADFGHLELLLEIAVELVEQVLPVALALGHVVEMLLHPGGETVVHQVGEALVEPIGDDVAHLLRIEAAVVGGYVTALLDGGDDRRVGRGAADTALLQFLDQARFGVARRRLGEVLARIELDQLEVLAFLHFRQDVVLARLALLRQYPGITVELEDAALGAQLEIAGGDAHAGREVFGRGHLARHELAPDQVVQALGVTLHAGQLGRLEVDVGRTDRLVRFLGALLARVDVGLARQVLLAELVLDETADHANGIGRQVGRVGTHVGDVAGLVETLGHHHGLLHPEAQAVARRLLQGGSDERRRGSAGGRPVLALGDAIGRGLELFQGRHGLGFVERLEGLALLTGNLEAHVGALGGTEVGMHFPVLFRDEGANLAFALHHQLHRHRLHAAGGQPTGNLLPEQRRDHVADHAVEETPRLLGVHPVDIELAGLGEGLLDGLLGDFVEYHALVAAFVAADGFPQVPGDGLPFAVQVGREIDGVGVLGQAAQLVDDLFLAGQDLVLGLPAMLGVDPHARDQLAPGLLLR

SEQ ID NO: 18400 - protein, 430 aa, Pseudomonas aeruginosa
SCSRRRRTTRRSPGRCAAWRSSGTTSRSPCATTTRTACRSWSTRMQTGSSMAWRRSPRCMPRATNEPRRAASGALAEKLGDAPEVGAIAALAPIQGKELGGRLHLVDIPGEAAQGVQQLIVRARLAPLVQPLARGILPIAPGLPAASARAVELRAGRRRSALQPMRPILARELHGQAETARLEAQGHPAALPVGRHQPGQGTEHDSQQQDHQPSGHKERTLEKRLRHLPRSARAGRIGRSRQGRRSLQANATTAEQLFAQRNGTGSTRGAKVHNENTIPFWEETFMPYQHILVAVDLTDECDPVMKRAAALATSNQARLSVVHVVEPMAMAFGGDVPMDLSMLQQQQFDQARERLDAFAVRYPDLGSEQRHLVYGQPRQEIHRLAAEQACDLIVVGSHGRHGLALLLGSTANDVLHGAPCDVLAVHLKKA

SEQ ID NO: 18401 - protein, 834 aa, Pseudomonas aeruginosa
ASHPPGFGRAPRQRSRASPASGRNARRQPLRTCRRYPTSPARISHARSPVHSRFLPFAQYFLRRRGPRRFPDRTTPSLRPGQGRPGQGQQRALHGLAQRPARLPAGTLPGLRRTDPPAEVRQQRGGRALPHRTRRPAADRLAETALAAPAGRPRRLEDLRQLLRSEAELHRTRLPVWPVPAGPRPEGRRLRHQRTPVAGRQVAAGCLRHPVRPLAGRRPAHRGKGLETPQAGRRSAQLQPRLAPRAAPADPRQPGRADGQRGAEPRPAEPDRPLQPARPCHRRRGRSRPAPPGAAGPGKGPEPARLLQLGATLLQRREGRHRPRDRSQPGQALRSACTAADDPVRSRPARQYRHRMAHPPAAAPGPLGRSLRADPQAAPGSRRHQPLALLAGTQPATGTAEQQGADRAVPEARRRARLLWLPRRRPPERAVQARQPSCAHRPARPATRTQRRQYAPGHGVLQPWRSDQRPPRVVPRRAPVRSRRADRPGQAGLRHAVVFPGDPLDQPGAVLGRPGHPLPDGAPRHPGARSEEPRPALQLDLRHHPAGKRVHVRCPFRSRRHRADAADARHRQGDLAQVRHPAGLDPATDRARRQHPPRRRLPEPGAWPVQRQPGTRLGRLQRRSGPRPPVAERYPPPGLRRVDRDHSVRRDSPVRAERAVLCGDLRAEAQCAAAHRRLARTLLRRFLTPNPARTPGPFQYLEKDLKMNKPLATALLATSSLLLADGALAADACGTPRNAFDSVYCRSGEFSQADRELNQQFGTLRKHLNDGQKALLKKSQIAWIKERDAACSESKDNGYFVNLDCATEKTRQRLDFLRERERECLSTGCVDAKL

SEQ ID NO: 18402 - protein, 143 aa, Pseudomonas aeruginosa
GTACRSPRPGRSAAPSGRAAPAPRPVPGESRRRGRNRWRCPAAGSPGSPRLARAPALRPPRAACRRHRRRPASHSRPPAPPRRCAGRRRPPRLLAPPAPVRPRAAPRPRHEPLRCPPACHAGPAEPCPCPSNRTPRRGLVFAY

SEQ ID NO: 18403 - protein, 551 aa, Pseudomonas aeruginosa
PRIRDGSAAPGSGRVAGNLANAAVERAQLAIHAQVDLAIEPLVDLPGLRLGQENPADAGHPGHRAGDVRIEAEPHRAVDRRTQAGRLVDMRALGRQAEDVGGELHRRVALRAAAGHAQAHDRRARTLLDALLALAQGIGQALEDGPVDVRPGMHVAETDHRPLGLQSRFADSRRPVGLQGQAHRAGRHAVDQFVEQLLRLDPLLARLLHLAQAELALEPADHPVAAIDHHLGIEMIGNRRRIGWNQRHGFQVAGASGVDGRRGAIGEAGDGGLQRTCAEHLAGLVGPRSDQRQALRNAGVPAGLGADLAEPLARLEQLRQLLAAYRQCLPFPVARRGPAQALVVERQVGHAAPHRVDETAGQAVAEKAGKQQHLVGLRGDLRLLLGHPVDLGLGAEMLHRALGADQLEQPAPRPPDALADLRPALVEPEDRRPQRPALGIDMDHRATLGGQRHPADEPAIDVHLVPEPPTGLAEHRPVVLGVLFGPARMLRVVGLQLHLALAQQVALQVEQQGAHALGAIVDRQQIVLVVHLVLVSAGQTGRLYCRRQRSR

SEQ ID NO: 18404 - protein, 365 aa, Pseudomonas aeruginosa
PIKTAGTHAGRPVPPATTRTTTMQTLGSTSVPALLKYLRHAERLGLDIAPALAAAGLQADQLNDNRQRLPGEAHERLLGYFCEHSGDPLFGLHSARFVQPGSWSVLGYIAMNCATLGEAMSRITPYEKLVGDMGTSRIEAAGGQVRLIWNCRHQTPLVRRHMVEHVLASWVLYARWIADLEGSPDEVWLEHDLPDGTRVEDYETFFGCPVRFAQPCSALLVPLDYLALPLRQADATLLRTLEEHALALMAELDDDEPLPLRVKNALRQLLKDGLPRKERVAEKFGMTVRTLQRHLQQAGSSYQQTLDELRRELAEHYLLHSELPIQDIAQYLGFTESRSFHRSFKGWTGQTPGEYRQRRKEPAAQ

SEQ ID NO: 18405 - protein, 151 aa, Pseudomonas aeruginosa
AFARPVRGAVPAPSRPASAPAVRSSRSPAALAGRRLFQVRDEVARAMTGVQLLDEDAFPGSAAGVGGARQAADQGAVGKPGQGPRLDGGGTDVGQRNLPEQLAEAVHLLVQQAGHRFRGAVAAGETGAAGDQHDLHAILGDPGRDLCADPV

SEQ ID NO: 18406 - protein, 211 aa, Pseudomonas aeruginosa
SRCYITGPTRRPQMPDSALPPCSILLLAGGRGQRMGGRDKGLIEWQGLPLIAHLHRLVRPLTDDLIVSCNRNQERYAAYADRLVSDDSRDFPGPLAGIRAGLAVARHPWLLVLPCDAPRIDRALLETLLQAAGRTPARPWMLRCGGQWEPLFSLIPTHLAEEIEHAWRQGDRSPRHVLLPLGAEAIELAAGDPRLANLNTPELLANHRELK

SEQ ID NO: 18407 - protein, 286 aa, Pseudomonas aeruginosa
RVSFGTRRSLVRIQSLRPYPEKPASTAGFLLPAIRPFSQGTQVGHQVALLFRGQLALQHQVEELHGVLQGQQAVVVQVRRRILDPAQREGLDRPVGGRHHAIDQFRIVEALHLQVVHQVVGEVRRRMAPGAGRLAVEQLFATQFLLAGLARIEPPLHIQLRCRGEVQQRLELTHEMHLTATLEHVHPLLGGDYRITVEVGGALLELGEVLDGLQRPLRAEQPLDVHPAQRRRVDAVAERLRAHIAGQVGSGIGVAVRMAVEAGYAAARMLATAIVGEVELLLRKGR

SEQ ID NO: 18408 - protein, 176 aa, Pseudomonas aeruginosa
GRLRPARPRTASSARRHCRSGAAPGSAGHSARPRLRRRRCPPVRPAGHVRRRASAPPPRLRRGGNRGFRRVGIPGASKGPVQCFAAMVAPALRCQRPATDFRPPARPREPDPPAHGCAPSPGRPPSGIATAAQAVPPNARPGAPAGAGNRLQRRPFARPPGDGSDASAHGTRRRHG

SEQ ID NO: 18409 - protein, 501 aa, Pseudomonas aeruginosa
MDGSWRGTERVSRSASSNPSETVPSTSRRAAISPSPGSQVPRCRAKDSIHAGCRWSRAAIRCSSPASMPTRSEAASTSPIGAGRRAFSGSARMAACGCPTMPATACSIPSATCSRILAAASCSSISTLANCCTCTPRPSCSGRVRSHPSPGPPAPSACWRCAPAGLALAARPPAAGILASPTHPFFFLPVNLDAFPVSPCLVVDRPPRPAGAGGGNASRPVAHLGSGNPRCAHRRRRLLGAPGAAQPYRGADRAPRRHPALRHWPGARHRRPVPCRHALVGSAAVRLPESRPGARPTGRSRYPRRSHPAVPRTLGSRLGPGRLPRSTGLGTLRGDRLQPHRHPAGRLPQPIPPWRALATLQLRSAAVHGLRRKPRPVWRRPPGAGPPARPYARLGRSVRHPRQRAPAVLQRRHQLATRRRRRPTAEILRRPRPGRSRSRAHPRATGEDPPAAPQRPAPERDSGARCAGPGRPGLLPALAGIAGKPVLDRVRANSRPPSTNV

SEQ ID NO: 18410 - protein, 453 aa, Pseudomonas aeruginosa
FPPGRRQPVQGRGMGSGLPPALRIRLHRGHHRFRRRRHRPARGEARLQPRPQRHRPAQARPRDRPRPGRLWRGRDHRQAAGVEEHPEDRHPDPQAAGDHAQRQPPAATDLPGRRAELHGDRRPDPRRRAPEEGQPARLLGQRGHDHHRWRQAQHRGPFRADFGQVRLRRRQLQVDRQPQHQLPLRQARQLLQAALPRPGAHPADRRQAVAEIRHPLGALHRRRFQQRRQQGAQRHVHLQPRLPRLRRRLPEDERRHRLRLHQRRRPLPGELHPDRRLRQQGREILAGALRLQLRRRRHSRPDLHDPLRQGRQHRPADHLGRRQGMGTRHGHRLRVPERPVEEPRGEVAQRDHAHQLHQRLRRKSPDRQLHAAALVTAGPADSRATAIRPSPEPRGGTKRPPLGGLFHGGMPRSQRAGRIAPGALSADTPPDQGSPPPHSWLIAPILWIDRSAP

SEQ ID NO: 18411 - protein, 114 aa, Pseudomonas aeruginosa
PEELVMPRKTTANAAKDELLAEFQALVADTEKLLQSTADVAGDQAEEIRGKIHDSLKRARDTLRDTKDSLKDNVRERSQAAVDATEVYVGEHPWQSIGIAAGVGFLLGLLVSRR

SEQ ID NO: 18412 - protein, 127 aa, Pseudomonas aeruginosa
AMSEGKDPADGRPSLRRFGAAFLGLLHGHVELFGIELQEQKANTLRLLLFAGLALVFALLLLVGLSLLVLIVFWDTNRLAAALGLCLFYVIGSLFCGWRLYQSINDESSPFSATLEELANDRERLLP

SEQ ID NO: 18413 - protein, 463 aa, Pseudomonas aeruginosa
ACQGKPLACPHRLSASLEFPMDWQTLLTRERLGKPVHSNDELGRSAFHKDHDRIIFSGAFRRLGRKTQVHPVSSNDHIHTRLTHSLEVACVGRSLGMRVGEILREELPEWCDPSDLGVIVQSACLAHDIGNPPFGHSGEDAIRNWFQQAAGRGWLDEMSDAERSDFLHFEGNAQGFRVLTQLEYHQFDGGTRLTYATLGTYLKYPWTSRHAEALGYKKHKFGCYQSELPLLEQITHKLGMPQLDDERWARHPLVYLMEAADDICYGLIDLEDGLEMELLEYSEVEALLLGLVGDDLPDTYRQLGPRDSRRRKLAILRGKAIEHLTNAAARAFVDQQQALLAGQLAGDLVEHMHGPAKLCVQRAKAIAREKIFQDKRKTLHEIGAYTTLEILLNAFCGAALEQYGGHTPSFKNRRILDLLGRNAPDPQWPLYRAFLQVIDFIAGMTDSYATEMAREMTGRSSPS

SEQ ID NO: 18414 - protein, 149 aa, Pseudomonas aeruginosa
ICTRLAPAAIFSAACAPSVIPPAAMIGSRPPSSPASTFTVCVLFSRTGAPDRPPASSPCGRPSTPSRPRVVLVAITASIPASTSAAATSAVSSSVMSGAILIASGTRRPCRSASASWRWRSASSSCLSESPNCRLRRPGVFGELTLTVT

SEQ ID NO: 18415 - protein, 160 aa, Pseudomonas aeruginosa
SSTARSTGVSKFLPMLIPSTPRYFAARTRASRWSTPWLLKPMRLMIALACGRRNRRGLGLPGCGRGVTVPISMKPKPSWPNPSMASPFLSRPAASPTGLGNSRPSTETGRLAGLGVSRRFRPRRPPAPIRSMDSSWEVSGDSLNSSWRARVYMVGYRSAE

SEQ ID NO: 18416 - protein, 684 aa, Pseudomonas aeruginosa
  UNSURE (159): Identity of amino acid at the above locations are unknown.
MSRPNLCFNGRTVAVPSRPFPRRSPSPRSPPSIMSSNSRSNSTFTGRLSALANRLRLGAARSDGRELRERAAALELPFQPLRLPEPSVWWQAGPPLHTLVDLPRGALSGPVQEDKAEAHAVLKRLVRVSHSTLESVDLKTIEGVCSREILVQAPCPRLXRPGHGRGLPGRTDHQLQGFRQGPEPGPAAFHQRRQHPPAPGRLARRAPVLGGRTPSLRLRRGDRLRPPPRTGTEAAGTPGTLRTGARRAGRTGTALPHAADSDPGLVRADLHEPAAGYRPALCATRPVHPGNPGVPVAAPQRRTRRCPRRRSAGGWRGRRGEVSEATVGNRPGLASSRPDVHPPADPHRSDRMSLPRLSICFALACGPALASQAPVYGERLEGFDYAYPVHYLDFTSQGQPLSMAYLDVAPKKANGRTILLMHGKNFCAGTWERTIDVLADAGYRVIAVDQVGFCKSSKPAHYQYSFQQLAANTHALLEQLGVARASVIGHSMGGMLATRYALLYPRQVERLVLVNPIGLEDWKALGVPWRSVDDWYRRDLQTSAEGIRQYQQATYYAGEWRPEFDRWVQMQAGMYRGKGRESVAWNSALTYDMIFTQPVVYELDRLQMPTLLLIGEKDNTAIGKDAAPAELKARLGNYAQLGKDAARRIPQATLVEFPDLGHTPQIQAPERFHQALLEGLQTQP

SEQ ID NO: 18417 - protein, 340 aa, Pseudomonas aeruginosa
RSPRAWARRGPRHWRARRAPSRRPAPAWAWRPRLRAMASTAPASAAPRARPPPPPARAVRAAAGPAPAHRARWSAVACPAWRSPPGQARSPARRIYGKDHSWLGSFGRIQFAAPRQAVDVDAQGVLAQAFFGARRLEHDGHHGRPPLQARRGAVDVAAFRPAHVERRVAGAHDAGDLHSHRLFTDACERVVDPRVVVEHGRALVGRVVVGVQPVLADDDGVDGQRAHQRHEARDVVRRLCIVGPVGRGGFAHGAHLARAVHFHHVGRHDGLRRAPHQAASHQQRERQAPEGHQPPVLRLHARRADTVVPHLAGSLVRRGRLRRVGIAHLRFSESHGQFSL

SEQ ID NO: 18418 - protein, 511 aa, Pseudomonas aeruginosa
RASVGRRAIPASTERSGHPLPGSGSTGCCGASGGLRAGLGDVAQARHRALCAAASGGGTGLKRRLRIAGRRRGGARTATGQLCGGRSHTRASSHGATHARRGGADSDGRAGSADSSTGHRARAELRRTGHKARRNAGAEDPERQQGERGQHDDQRVVDGRLGGMDLELSEQARADPDDHGQHQNLDAGGHHVAQDLFGEERGLVPECERHQHESGERGQLELDQRDEQLDRQHQEAQDRDQPREEHHHDGVEVHEHFRKARHLADLLQNRRPGIDAGFRQPARLQEVLHRDGRAGGGDAQSRKRAEHDAGQPVEVIDDVGEGTDVEHLAQQLGDHVLALAGGMAHGPVQAGDRHVDDDQRGREERHLATQQPETRVDISGKGVEELVDDGHIIHGVSSGSAGKAGAMPSAGSSKLGGIGGRSASVWYSSGPASPEKKRRRKASAAARQASSPLVCRSAAHCARNALSRAGSAARASARLSAGCLLQAASSTTSTTTDGARTHRMAASRQLP

SEQ ID NO: 18419 - protein, 172 aa, Pseudomonas aeruginosa
GRPESPAKSRSGSPAPTPCAGAGRPAWAPGHRPVRNRSAARRYGTPLRARRRDSAASRWWRAGRSVSGRHRAKRFPASRHRAGQRRDPSPRRRLAAARASPRHRWAGSRTASPPRGRAIPRAAGTPASGDSRSRSRCPIPRRWPGAPRPPATTAARETPIADSRQRVGARPR

SEQ ID NO: 18420 - protein, 329 aa, Pseudomonas aeruginosa
PTPSKPTTRAMLSMRRLRPRPAMWITTLTASAISARGGFTATSRISCSRRSSAPSAEPAWIVAMPPGCPVPHTLMRSSASAPRTSPTNTRSGRRRMDERTSSVMDTTPARVRSGTWSRAAHCSSTVSSSTSTRSPVAAISASKALASVVLPLLVAPAISTFCRSRTARTRKPACTLVIIPSMTYRSNGITPIARLRSAKAGPGAAGGKMPSKRSPVSGSSADSSGWPRWISAPTWAATRRMIRSPSASGSSTPIGARPLESRSTQRVRSGFSITSTTSGSSSAAAISDPIAVRSIWIRRSSDVALMDCGTALMTHAPALAQPPPRPPFA

SEQ ID NO: 18421 - protein, 411 aa, Pseudomonas aeruginosa
QRARCFLARHHQMPEPRREPVARIVALRTQLGGGAERFGNSFGRAFVVGGERHAHMAVVQNRMVLAVGFVDLVQALSDEEAANAVARHEGQGRLEEVQAAQRREFVEHQQQLVAPLDAVGAIKRFGEAPADLVEDQANERLRPRNVRGRHHQIQRHRMFRSDQVGYAPVAARSDFGHRGIAVQAEERHGRAQHAGTLVVRLVEHFSRRRSDDRVRPIAQVGRGHHPMQGQLERAGRVGEEVGDAAQRLVLARVEHMQNGADQQRVRGLFPMVALLQRAFGIDQNVRDVLHVAHFMRAAPNLQQRVVGRRFRIGRVEQQAMREARAPACGDLPVLALDVVNDGRRGPAQQGGHYQAHALTRARGREGQDVFRAFMPQILAIVLAQEHAGRLCEASLANFLRVGPARRAVSRD

SEQ ID NO: 18422 - protein, 308 aa, Pseudomonas aeruginosa
WPATAATARCAAARRRERSGVLQRRRRSTEDGAVPLTSRRACDVPVPLRQQGAEGDICACPKSTVAGRLRSRFCCPLRPPFRASPLAASLHGAKIVIDYSLLKAQAMSGHSKHLPADERRAATVEAVVDLAAEQNPSDITTTAIAQRMGLTQGALFRHFPTKDAILQAVMAWVTERLLARVDKAAEGTTSPVAALEAVFMTHIDFVSEHPGVPRTLFGELQRPGETLPKRMVQTLIHHYGERLHRLLEAGKAQGELDAGLDVDAAAVLFIGTIQGLVMQSLLAGTVSRIGREAPAVFSIYRRGIESNT

SEQ ID NO: 18423 - protein, 222 aa, Pseudomonas aeruginosa
PARSGRPTGLRRPARLRGDSAGFRAAAGPAWQRAAGADRHRWLLPQYRQLRRELRPRRGPVLARRAGCRGARASRHAGAALLVQPRAGKPPRTDSRRHRHRHDHHRHHADCTGGGARMGARHHGGSAVHASLGGRNSDRQAAAVLRTRHAVHAGCGGAGGVRVRRPDARLLAVPVALVGRVHGAGAGSGSADFLIGAQPVPGRADRAVHGFSAGFHAVGVSI

SEQ ID NO: 18424 - protein, 444 aa, Pseudomonas aeruginosa
FRSSARRRLCLFIRSRLVHLRRRCGGNRQCPRTLLRQQGGRRWGNMIGIGGYRWSLRGTKVRQPMQCVILLIAGALFSPISAFGSEVSLSANPPSCSPEQSLRWRGGTLRLENDLFTGSDRNYTNGVALTAVSRDLQGGLRPECLPQPIGLYARFIGWADPGFWHDAGAHSSSQNLVVRFGQAMYTPENKTRTDVIPDDRPYAGLLYLGLAWNRRIHPQAASYEMLDVRELTLGVIGPWSLAEQSQDLVHRARGIERFRGWDNQLRNEPAFQMAMERKFKPYTEGAVRPGWGSDVIGGYALRVGNIETAASTGVEFRAGWNIPNDFGSYPIRPGAENRPPSGVADLRTTTPQSVLAPKPGAHVFLNLEGKAVAWDFSLDGNMFRNSHHVSRRPWVAQAALGISSQWIVAGRGVRLAVMRVWRTREFDQQASYHAFGSIALSLEF

SEQ ID NO: 18425 - protein, 142 aa, Pseudomonas aeruginosa
SRWATSPARCSSTCAGRRWKSSACAAASARSASSPAATSTCTAAIPASTCRNWPAGPPRSVPAPRYRTACAPPTPASRRWPRHTPKAWPWAMRSAPTPCASPAASCPPRWRWKSSPSTARATWSARPARSADEAPVAARRDR

SEQ ID NO: 18426 - protein, 181 aa, Pseudomonas aeruginosa
GPGPRPPARSGASLQPRRAGQGARRPGLPGPGRRLRRRRRAGGVHRRAGLRPAGGRHPPLRRTDQPERRARRATGRSALLGAAPARLAGRARRRLARGSRLARADRRPRTLPPSAVHPRPRTAGASRPGPAAPALDRALPARPAGRAARRGDRRARAVQPGWRTGVVRAPRLRRAGEQEQR

SEQ ID NO: 18427 - protein, 748 aa, Pseudomonas aeruginosa
ASEILFRPLCSGMGRRGFHDPRKPGDRPATPCWHTRGGRERAGCSRRCRACDFLRVPSCPVMRWNAHAPLQPFAHRAFRPRPLHQPAAGTARPRRNRGSRPRPAQPVGQRSPGSRRTRPHRPRHSGQCRFAPGPQRPGHPGEHQQHQRRGSSPTQQPQRPGRRHPQPRHQLHRHPRRWRYRPLGARLQRPRIGDATVRRHAPVHRHGHGELPQRSVDGRAHRRDPRPGLGAVRRRRHRRGDQRGAEEAFRRRDPQPPAPRLRLLRQPPVGPGQRRLADRQPQLPAQPEPAAEPRLDRPWRLAQPGHQRGAALAGQRRSGLHPRPRLWRPGADERLRHPAGRRQVPQAPAREELQRAQRRAALQRPVDPPDQRLEPFRQRHREQPVVLHQGPPPLAQRRNLRMGRPARRAVAQGLPAHQPRAGADRRPPDLRLPARPVRPRQPHPGRRRVQPHPLPPDQQHIALYRCRRRLHRPLASRARLLRKPLALPAALAQPDPHLRPVRREPPAAQRAPVAGDRGAPRPEPYRPRRPAHRHPQRPQPAGRQLARRDGLRADPGTVAVRPVLHQRGRCEQPDHPQRGPAADGPDPLEADRGRPQAAVPGRSRRMDPGRLPYRQEEAAQRQPAAAARRAAGRPAEFGRPGGQPGTEPGPGLAAVGERRAGACRIRRLRRNDRRADLLAQRQSPQERATAHRQPLAGQVLRRDPARRRRAALRRPALRRRRQPGQPARLHGGRLQPGLAGTAGPDPRP

SEQ ID NO: 18428 - protein, 301 aa, Pseudomonas aeruginosa
PGLPKHEAPDPAPPAARRPARLRRCRAGRALPAQRAQLRARSDVRARAVARGQPRHQPHRDDGRPRSADAHGRLYRHQRLVEECRSRIDRRAQAAARAGGALPHGGNPARCRRRLLLRRLGLRHARRRRPHSGQPGAAGGEGLRAERILRADRRAAPRQPRRAIPRPAQPGTDLRRRTARRAPGRQPPGTHRARPRRHPGEHRGAAGVPLRQRRGPPLHLWPPGHAAGADRGRRRPQRDRRRGGQLDPGQLGKRGRPRSAGHRHRRLRRDQRRAEAALPRREPGAAQPDRDPRATLHRPAL

SEQ ID NO: 18429 - protein, 369 aa, Pseudomonas aeruginosa
PGHAGHRQRRGDRNPGRRPPPSGATSMTLFRSPRAYCLLLGSLVMLLGLSCVVALGFGPARLDSGLVGRIVLQRLFGVAAEPGAWSAGQEHIVWLIRAPRVLLGACVGAGLALVGAALQAVTRNPLADPHLLGATSGATLGAVLVVLYIGEVIGLLTLPLAAFLGALGSMLLVLGVASRGGRLGSDRLLLAGVAVSFVLLALANLLLFLGDHRAASSVLFWMLGGLGLARWSLIWLPALCVAGGLLVLLGLGRALNALMAGEQTAVTLGLDARRVRLWVFVCCSLLTGVLVSVSGAIGFVGLMLPHAARLLVGAEHRRLLPVCALLGALFLVWMDVAARTLIAPQDLPIGIATAAIGGLFFILLLRRRS

SEQ ID NO: 18430 - protein, 168 aa, Pseudomonas aeruginosa
LSQPTPSQASPCWSSGWRRSNSPRPSPSSRISAATAAQAPSTIGQAAARPWRWLLLRTRMLVGPGVIEATTANSRKGTRDCMDGLLWRGSLHPGDAPGLSLEAGCTAGGRPPGSSRRRAGTSGRDGSGRRNRERWRGPPVARRQRASAAPWPGATGPGRRRVASRRRP

SEQ ID NO: 18431 - protein, 333 aa, Pseudomonas aeruginosa
SRRPRREGDRHPLQQRREQGRCRRHRRRAAGSRSQGGSAAGRSHQRRGHGKAVRRRHRRGGQAGHRHQHRRQGAEETHHRDQRDRIRRDERGQFQVCVLLPARSRQARQRQRQDLHPGDLPAWRLYPVLRRLCRHQGAGGALHPCRFQGVRRARHLGHRGRPGPHGHALLLPRRRCRCGGLPEERRGLVAVLQNRPDRHRRRGAVHPPPGQRRLVDHRPDHPHQRRLLHQVSHAAAATAVAACLRKPFMHVTLVIAGGIVLLGLFLLFGKLWDAGPALAAGLFLPTWLAVALVNLWVGVQHAGYGLREELPILLLVFLVPAALAGVAIWLAPR

SEQ ID NO: 18432 - protein, 399 aa, Pseudomonas aeruginosa
AAALQTRKRPTSRASSEDSSDSRRLAPVPCSECSAAWAESSRTSLMLRAISSITRLCSSQAEAICAARSLIRPTASPVAASTPSTPAARSTLSRALRLPDCMARTAFCTPAWRRSMRAWMSLVESWVRAASARTSSATTAKPRPCSPARAASMAALRASRLVCSAMPLITVSTASMLAVSWASCWMLSELLSTSCANWRITSMVASTTLAPSRACRRASSATCAALWALRATSWTALLICVAAVLTWSTDACSLLIRRSLAAVMPASEPAESATSPVTRPTSRISGCNLSRKALKALPRRPGSSREVTSRRTRRSPSPLAISSRRCSRRCNGRVTRPGNTSTSDRHTSRPNATSATCCQRWRSPSAEDASPSAAAAASSISSSWLITSRIAPNWRSLSP

SEQ ID NO: 18433 - protein, 429 aa, Pseudomonas aeruginosa
QRKVVIIAKASLPASPPLAYHRLRQRPAAHRSEPLRRTRRMTEPAVLPAIAALREEMVTLRRHIHAHPELGFEERRTATLVAECLEAWGYQVSRGVGRTGVVGTLCRGEGPALGLRADMDALPIQEATGLPYASQVDGVMHACGHDGHTAMLLAAARHLVESPHWRGTLQLIFQPAEEGLGGARAMLDDGLLERFPCDAIFAMHNVPGYPVGHLGFHPGPFMASADTVVIRVIGSGGHGAVPQRTVDPVVVCSAIVLALQSIVSRNVDPQDTAIVSVGAIHAGTVSNVIPASAEMILSVRALTAETRALLERRIGELARGQAASFGARAEVDYRHCHPVLVNHPGQTAFAREVARDWLGEECLIDGLRPFTASEDFAFILERCPGSYLVIGNGQGESGCQLHNPGYDFNDDCLAVGASYWVRLAERFLA

SEQ ID NO: 18434 - protein, 138 aa, Pseudomonas aeruginosa
PSRRNAHSTSPSPTASPTRRAAWWYAVARRSCPTPRACAASAWGSARAPTRRPTPRPNGPPRGCGSSPTRTRTRSTPTSSWAASTPRCKARCRPATASSTSRSARISNWPERCWTTLATSGSATASACARRTWRCART

SEQ ID NO: 18435 - protein, 277 aa, Pseudomonas aeruginosa
TRRWRRSAPTEPTRESTPATSTSTSTARPERRPAAFHLDRQQQAMESEMFLDGFGPQILAGTLVTLKLALGSLLGAVLIGLLGASAKLAANRPLRALASGYTTLIRSVPDLVIMLLLFFSLQILLNRVTDALGIGQVDIDPFAAGCVTLAFIYGAYFTETFRGAFQAVPAGQVEAAQAYGMGRWRVFRRVLLPQMLRYALPGIGNNWQVLVKSTALVSIIGLGDLVKATQDAGKGTLQFFHFTLVCGLIYLAITAISNAALLWLERRSSLGVRRPLP

SEQ ID NO: 18436 - protein, 288 aa, Pseudomonas aeruginosa
GAQGRFAQGREGRRDQHHRLLRLGQEHLPALRQLPGKALCRAHPRRRRGTAHPSRHPGRAARRRSPAVAEDPQPAGDGLPAFQPVEPPDGAGERGRVPGQRPENEPRRRRGPRAPLPGQGRPGGEGRTAVSLRTLRRPATARGDRPRPGHGAAGDAVRRTDLGARSGTGRRSAESHAAVGRGRSHHGPGHPRDGLRPPGFQPCDLPPPGRDRRARDAGPGVRRAAQRTPAPVPRRQPEMSLGLSATARGNARRPAPDHLRRGCRSPRSAGIPCAPAGAASAGWSGCRK

SEQ ID NO: 18437 - protein, 430 aa, Pseudomonas aeruginosa
RGGAQHRRPGAARLADPPLRPRQRAGQALPDARPGQLRLAAGAQGTLLHRSRTERLEPLRRADRHPGAEGTGAGLAVLLATRRARPVRRRGLVRRRPPARHGAGGQCRLQRRRSHRQRSRRRRHGADRHGEPQRLPPEPRTGCPPARQARLAPGRIARRDRLRHRRRREPRQRGAEGPRTEEPAYPGADPRRAGGRGRRLPEQRRKLPLAAPHRSARPRHRAPLAALPEPGQPRLRRPRPGGARLLHPVLPQAEQRPAFRTALLRAGHRRRPSLRGQPRLPLAVPVDRVPRRPARRFRRGHPVAQRVGPAAVRSAAPAGRLYRGGPRRQRRPGNSAGAGAALPRSPPHPAAAHPPDAPGGQRRIRLQEPLNRRPAPPLGSHPGRAQAITVGLRATRPAAMARRRARGDGRCRCPGADRPAPTARLPLHGR

SEQ ID NO: 18438 - protein, 370 aa, Pseudomonas aeruginosa
AAARYARPGCAGAAPASCRRLARDGAPTWNRRPAAPRHSDGTTPPPASARRAGDGTRHPPPPPGRRPVPARHRARQSSVAVPGGRRHAPQGTHGYWENAPRARRTLPAAAARAAATDAGAAARTVDRAAAAALRQRLDRAAGHPAGRPRRAADAVDSPPATANPGCPVTGAGVAPVGSLPAAPRHAPALGPRDRWRGSAGVRRAGASGPAPASRSRHSPAAAGRRGNTARHRLPELRAGPGCRRRGTRRGRPARASAIRPGLRRSDRRPSPRAPTSTAARQCAAPARQTPAQGRRRAGRVRRVRCAGRTGSATTGPAVRRNPSRRRARCRHPGACSSAGCRPPGRPPGHSCGCCRVPRRCPLRWRDSRRG

SEQ ID NO: 18439 - protein, 499 aa, Pseudomonas aeruginosa
SSAATTTPSAPKRYSRPDWPTRWRSAGRSSPTPTWSSGSVSARRWPRPTRRGSTVATLPATPITRLSASPLRPDSLPSHASFPGAATAALAEESCRAIADPPAGRRRLHHPDHRVRHRRPAPGTCRRPPGQRRPGRPAGQPVRLQRRRLRSVPHRRAGGRRTQAAVRRLPAAVRRGQCAGRRGRRYLDDGRGALRPGPGAPGVLGHGQRNRRAPGRPLARRARRGAGVLRHRRRHRAWHSHRHADRRRLGLAPGIRRTRRAGPGQGAAAGRLAAAHSRTAGYLAAQPGERVAPTAGARPPVAVAAGLHRHVHPLHLPGRHPPAPGRLQRFAGRLDADGLRRGRPARQLARRAPGGSQPAGRNPAVRPADGAGHARPGADPRQRLAARRHPGDLGRGPGSTVHRRPGAGDEVRAAGPGVRRLAEHLRLQRRDRHRRPRRQLGDRRQRPGAARRGRRAGLPGGDGRGPAADAGATPSCHRAVPRRPNPSLSPPRKHNHDPR

SEQ ID NO: 18440 - protein, 204 aa, Pseudomonas aeruginosa
IARLHSLRGIPVTHPATVYSLSTRLLHWSMAFCFIGAIVLAYFVIWVLGHDHPQRLPVLNLHWVLGLLVGLLLIPRIVSRLRGPRLPAVPGTPLEHRLAHYAHLSLYTLMLVMPLTGYVGTRLPTDFGLFVVPSFKDTALFAWISQTWNLSWEAFEKPFDAVHRMVGLWLSTSVVLLHALAAGYHQWVRRDGTLERMLGRRQRR

SEQ ID NO: 18441 - protein, 654 aa, Pseudomonas aeruginosa
PGRPPTERSMPWPACTASTAATPSPPTSSSIRAFPRPGPAAATSPIPKATPASASPCPCASPSSPTWKTPSAPPSPTANGWWTSAWTAARRCSEAHNENGPRKEGRRSSRRGSGAAGFSGFAAPSRRRAMAVVAGQRHFVALGVVQLAVEEIVAFVQGGDVLVAQGPLAGGDEHRLLVGVAGGEVVERQVEQDRHDRRGTDAGMEDGGEPTGEVIVEGRRGDRDHTEADRSGDDDQVHVVAVVHLRQGADAAGGDRAEQHDAGAAEHGGGHRGDHPAHHRQQAEDHQEQPTGGDHVAALDPGHRHQTDVLGEGALGEGAEDRRQHAGEHVRAQAVAQAPRVDLGVDDLAYREDVRRGFHQGHHDHDAHRDDRGDLEGRHAEVERRGKRHQRAFGDLGEVGHAEEHRDDGADDHRQEDRQARDRGAAELAQQQHDDQGDRRQADVGHAAEVRRVAVAAHRPARGDRHQGQADGGDDDAGHQRREEFGDAREDRRDQQPDQRGRHHRAEHCGNAAAATAADDRHHGRHASEGHPLDQRQLTAEERSAEGLQQGRQAAGEQRSGNQQADVAGREAGGLAEDQGDRDDTAIHGQHMLQAVGHVGADTEVLVFRPWNGWGSGGRRFHGALFSLLLLCAHCRQFDPKISRKMYTKFPTNL

SEQ ID NO: 18442 - protein, 91 aa, Pseudomonas aeruginosa
QRWCQPLRSRAYPRARRFPSCCTILPAPTNGHGPAPKGINDRKPPSIPPASYQQFFHKKLMKFTFQELRQDSPESAPSLAVRPCPRRHFGQ

SEQ ID NO: 18443 - protein, 254 aa, Pseudomonas aeruginosa
PERHRAAAGHLRMGEGLHLPVADRGRRRHRQGGPGGPVPRRRQHLHQRLRGGRLRQLPGRLDRADPARHLQLRAEGRERRGRRRRRGDHLQPGQHRRPQGPGERHRGRVLRGRHPGDLRHLRQRRGLVADPGPAVAPGGRRGTQEDRDLQRGRRDPSRQPEQRGDGRRAPRLGVRRPRYQRQRFGQRRPTGDGRAAGQGAAGQQGALRLVGRRGSRPGGLDPLRAEPRPGREEEDQGLPELRHDRLAELRQLHL

SEQ ID NO: 18444 - protein, 559 aa, Pseudomonas aeruginosa
RRRFRLRPPGSARLGRHRAPVRSLLPPARPAIGRHRDRLPLRLRRVLQQRHRLRRPVHRRRGPEDRRAGAEVRRHRRQGLRRVLPQQVRRHRQHQPGRPGDPQRRHGLRDQLAVAVDQGGRRRDRRRRPESTIAVAADAEERQPDRTLGSRLHQVTATTLRRAAGAGSPSRPGSSTGPFFIGARSLHRFQQGRHALAAGDALGGDGIAPAGAPQQRSGLAGDPRAGGAQRMTDGQGAAIQVDPVHVQPQFADAGDGLAGEGLVDLHQVDVGDAQPGPLQNLARRLHRPHAHDLRRTTGHRHRLDPRQDRQPVAAREVLATDQQRGAAIGERRRGGGGDAAAERRLQLGQALQVGTRADAAILGDPAGGGVDGDDLLAQQAGLARGDCLGVGAYGHLFLLDAADGVALGDILGGLPHAHVYRRIVLQQRGIGRQVEAAHRHPRHRLYPGGDEGFSGAQQDLPGGVVDGAHGRTAETVEGRTAEALREAGTETGDARDVHALFRLRIGAAHDHVLQQRRVEIEFLHQPLEHRGGQVIRADIDQRAFPGEVERRTGVTGDND

SEQ ID NO: 18445 - protein, 160 aa, Pseudomonas aeruginosa
APADADARRVSAAVGAPASQRPGAGRRAAAYRRRRPAGAASPATPARPSAPARAIAPAARWRAARPGGYAADRPPRTASPTPPWPGPGRRTGGCWRRHRRSPARVRPGAGCAAGEAGRGAVGDVHAAGSATIGWRPPHPGSGRRQDRRAGLRVCSWHPHP

SEQ ID NO: 18446 - protein, 501 aa, Pseudomonas aeruginosa
PSAGGCSGLFWPARQLAGGPHGHRPSRQFTPLPFAVAGALRERDRGRRGRWRWIGRRWWRVRLATAMQQGEMFHRIDVLRLDPLAAAPGRMGARRAQPDQVGAQAIDSRLEAASSDAVQRRIVQGNPRQPPARLGATAAQGVLLAFPAFGEGLRVGIEGQPATDDLCPLGRRRLGVETHVEAETVEQLRAQFALFRVHRADQHETRRMPVGNAIALDQVDAAGGDVEQQVHQVVRQQVHFVDVEHAAVGLGQHAWGKPRATFAEGGVQVEAADDALLAGAQRQGNELARRQQFGDAPRQGRLGHSARPLDQYPADRRIDRGQAQRQLQFVGGDHGGQGVMHGSAHGDSCGGRTEIRTAKSIRPAAPVSNRETVVEPAASLAVSSGLVHGRNPCRTPAIRTCIPVPRALACRCARVRRRHPVPRISSGIGLATPAPDTPTAPTVYGTPTLHTQTPGRLPDRGFCFSGPFFRPTRPQPQTNAQDIDHDRIPLPHWLPAQHLAI

SEQ ID NO: 18447 - protein, 423 aa, Pseudomonas aeruginosa
RRPPAARQPTTLPNTSIGHDARGTPAASPGSQTMNSSVSALTTLSPNVQAVALPSATARTALERLPSPLELKARQPLPLELASQVAASRDAIRAILDGDDPRLLVVVGPCSIHDPRSALEYAERLAALSDELDGQLLLVMRAYVEKPRTTVGWKGLAYDPHLDGSDDMAAGLALSRQLMLDMLRLGLPLATELLQPLAAGYFDDLLSWAAIGARTSESQIHRELVSGLGLPVGFKNGTDGGVGIACDAIRSAAHGHRHFGLDPHGHPALIETRGNPDTHVVLRGGRHGSNYGPEQVQAVRQALGKPGIATPDDGRLQSRQQRQEPLNQPGVLASVLDPAPGRCQRPGRGNAGKPPARRLPGARRRTALRRLDHRRLPRLGRHRADSPRRRPAARRAALKAVGAAMPLRYSSSTSSSRFSRASR

SEQ ID NO: 18448 - protein, 133 aa, Pseudomonas aeruginosa
APGLAPKIRQPACRRASAGAVPCASRRWRSKRTRAASGFSSSASSSSATACTAASNRRIRLAKASRKNPETRSVTSTRGRSSRETGRISKSATRWLPACQTGRTPSRARAWAMSSPPVRMVAVPHTERPSWRR

SEQ ID NO: 18449 - protein, 204 aa, Pseudomonas aeruginosa
RSSSRLADWKPMRQAVGVGRLRTSTEKKLRPVGSTSSRPRLGAPLGPAGTKRPSRAASSPSISAPPQASRVGATCSHKPRNTSPLARQVAGGDSPPRQRSIQCNASNSRRSRVSPRVRQGSPPRSSRQAGRAPCQASPMSQASGSKPRPRSSARLFSNPALAPLPSPRGTRSSASRVSRRNRPLGDSPNTCRPSRICDSFRSQR

SEQ ID NO: 18450 - protein, 671 aa, Pseudomonas aeruginosa
NSNATTGRPACQSARQCSQGRLGMPWMEQRHPRQRLRFAPGVVAAEALAGQAAVELPGVLQPALAQVLPEALGLLRRQVAKGAQLRVGAVVAGHRDQQRAALGQRHQLLHAVAPVADAAVQRKQDHPRVPQQLVDVEVHRGVVLQLHGVGQAQARVVVRQRTGGLGQQCEVRIAAAEDHQLGGSLGQVGDAVVGNEAAGLGAQQVHGRSTGRTQEAGAGESPSPAPAGDHGSGKRCAQLVGNGGLVQLLADHHQPGAADFVGQPLAVEMPVEALADALYQQAHGLARNGGETLDAKYVVTLHQLAEGLEQRSFLHLGEIDVEGVELVVVVVLVAFVVVVGRPAVDVQLGLGVESQQDRQRQLAPARLDDLHCRRQLPGDLRADPRQGLGVELVGLVQDHQVGTGQLVLEQFVQRRFMVEVGVLAALLVHLLGMGGEGTGRHRRTVDHGDHRVDRAGVADFRPLESLHQRLGQGQAAGLDEDLVKVAAARHQLAHHREELFLHGAAQATVGQLENAALRLFFAAADGTLLEDLAVDAEFAELVDDHRDAPAFGVVQHVPEQGGLAGAEEAGDDGDGEFRQGFHGQPLFSSAGMRTSGADAGAAQRIRHRITPPGCMEVLSPGIAPRDRRGRSPGSRSGVSAGSPPSRVTQWHWGTIAVHSCGGSRGIDRVPF

SEQ ID NO: 18451 - protein, 368 aa, Pseudomonas aeruginosa
NGKPVTLSEPVRRCPRNGKRIAREPGDRPGTFRLIHPRWAGASVKRAVRACSSCVLLCHAHANPEGTHHVQQHPGARQLHHLPVEATEPGHRRRPARRAAGLFRRFLAHRRGTQRRPRYPAQLRLPLPLSREGTRMIKRIAQTAGFAGLLAALLLTLLQILWVTPLILEAETYEKSEPVAAQPHEHTPGVAAHVHDEEAWEPEDGWQRTLSTTGGNLVVAVGFPLMLAGLFTLRAPGQNWLGLLWGLAGYSVFCLAPSLGLPPELPGTAAADLVQRQYWWIATAAATAVGLALLVFGGNWPLKLVGAVLLALPHLFGAPQPEVHASLAPEALAQRFVVASLVSNALFWAALGLAAAWLFRRNRGGVDA

SEQ ID NO: 18452 - protein, 166 aa, Pseudomonas aeruginosa
PPATRDPCRSRVHSASPSISSGARMPLPIPSLLIAGIGCRRGCSAEHLRALLERTLGEHGRSLAELDALASIDGKRDEPGLRQLATLLERPVHFLAPAVLHDYEPRLLSPSAVALRETGCSSVAEAAALALAERLGGGRADLLGAKRSNDRASIALARLLTERELP

SEQ ID NO: 18453 - protein, 367 aa, Pseudomonas aeruginosa
RSALAPFFLKPSDTHETIPPRSGSAAGGRRRRPLLRPGYPPRQRTHRRARSRRSQRAQRAGRQPGDRLPGRWLGEEPDPVADPRLRRRQGQLAALRPAADRALPCGRPRPARLRRQQQAATGQLRRRHPGRASRQFRRRHRRAPPAPGRQLHGRAHRRALRGAPSGTGAIAGADRQRRGDAGAQERTVRGPGARRESPGGAPAGRLPEAARLRVRPATAAAGAAQALPRRARGSRVGVQRADIRTTAPALHPAGAGTAEDRGTDPAAMGRPRPRAGRLQHRGDASAAEAAQRGDHGKLRTRADGRTPGGNRAALPGLPRRRTERPGGRSLKTRTGAWAPVRGSGSRREDGSDPGLRPGSGWRSARPG

SEQ ID NO: 18454 - protein, 334 aa, Pseudomonas aeruginosa
ALSRRSIVEREYMEFDVVIVGAGPAGLSAACRLKQKAAEAGQEISVCVVEKGSEVGAHILSGAVFEPRALNELFPDWKELGAPLNTPVTGDDIYVLKSAESATKVPNFFVPKTMHNEGNYIISLGNLCRWLAPPGRRTGRGDLSGLRRPGSADRRERRGPRHRHRRPRRRPRRQPERRLLHPRHGAAGQVHPVRRRLPRAHRQATDQEIQPGQRGRCPALRYRHQGNLGHRPVQAQARPGGPYRRLAAERRKYRRLVPLPPGEQPGVRRPDHRPVLQQPAPVAVRRVPALQAPPGGQAVPGRRQARGLRRPGHLQGRPEFAAEDGLPRRRADRL

SEQ ID NO: 18455 - protein, 233 aa, Pseudomonas aeruginosa
PSAWIGERATRSSSATRSSPPIEWSGKPCARAASKWSRSVSPATIPRAPCSPPAARAPACCRSARCSTPAACALTWSASARDVAAAGCCSASTRSSSSAPCPSTYRPTIVPSPWPMGTSGCSAPKGWASSIAIPSSASAWRCTNMAGTCWNMPSITSVATGGRRAAPGASNAAARTCSARWPWRPAWGCWRRSAWSGSAETSPSASSGYRTVCREFPGYACTARGTRADARAS

SEQ ID NO: 18456 - protein, 169 aa, Pseudomonas aeruginosa
SAAAQYRPTALQGFSTGRWRRSRSSPRRVRATRPCARPVARSAPRSQPGRGPDRPGSVSPPPPAPARSSPDGYRRPATGRPCTRRMRQRRQAAGRAVGRPNARPGHACRSRRDRRADRRGRAGRGRPVGSRAPAARDRYQPFRRSSRFGSSRSRPACTSASGNPASSTW

SEQ ID NO: 18457 - protein, 542 aa, Pseudomonas aeruginosa
SRLVLLPAPSGPSRVTNRPVTRHSLSWLRRSLWRRGDGRGAGAIVRATLQLVLADRLVVFVQAAGEHMAAIAARHEIQGLTLGRMQRGANRLAPGQGDRGRRHARHHIGIVRGRFAQVGAGDLAVVALAHAIDHRRISLQQHAALQAADEDAGDLRTLFRHAGFLFHQRGHDQRLVGVAIRQVLAAAIPFLGEDGLHALVGLAQYVDVAHATGVAVGIGEEAPFGHFVGLAEALHDLAVAQAGQGLLQLALPGERFAHLAETPALDQGQAVLHHLAFTPEFQQVGALHPRQEAVFAAVHGLARQVETPVEAQPERAMEHLFLLQTREHAARRGARGNVQQALLGQLQGLLQRPLLLPCSQADAEANEQQATLQQHQQFAHQSQKSRSSRSWSCSLRVSSPTGQTCSSNARTGQMPNWLLHRKTSSAVASSAMETSRIASGTPIPSARSSNSARITPATPQRRRSGATRVPSRTSSRLLNTPSTTRSCTSSMSPSACPASLHSARARTCSRRLRCLRPASRGCSARRVRQANRRTPCCQWRSG

SEQ ID NO: 18458 - protein, 288 aa, Pseudomonas aeruginosa
TALMTDPRKVTSHSAHVHPTIDRHGGPGHIGCAVRSEEADHLGDLFRLPQATQRNLAQQRFALGFRQLAGHVGVDEARRHRIHGNGTRTDFPGQRTGEALQAGLRRGIVGLPGIAHGADHGTDVDDAPPAGLGHTAQNGFRQTVETVQVGVDHIEPLVVFHAHQQIIAGDAGVIDHDQRLAEMLLDVLQGRGYGFVAGNVQDQARTLDAIGLEGFGDLLGAGRAGRGADDHGTQAPQFQRNRLADATAGAGYQCDLTLQTHGILSFLSLRPGRRAWRRTPRRHPGHGY

SEQ ID NO: 18459 - protein, 66 aa, Pseudomonas aeruginosa
LVRTRITRRSPCLLPYGRDRSRPGIRGGAGGLHRCSFPRTEHWTRAHRGNDACHERNETFCSAEQP

SEQ ID NO: 18460 - protein, 201 aa, Pseudomonas aeruginosa
NRPFAMENLMPDLILASSSPYRRELLTRLRLPFESASPDIDESHRAGESAEELVRRLSASKAEALAGRYPQHLVIGSDQVAVLDGDILGKPHTPERAIQQLRDASGKSVTFLTGLALLNSASRRIQVACVPFTVHFRHLDESRIRRYVEAERPLDCAGSFKAEGLGVSLFRSTEGEDATSLVGLPLIRLVDMLLEEGVEIP

SEQ ID NO: 18461 - protein, 236 aa, Pseudomonas aeruginosa
SPWSACSQARINLPPSLLKPASRLPSAKPARTSVATAASRTAAAMAAMAIAATKSANRARSVQSVNRAKSAPNARTAKSAANAAAKSAPSVRLARSASRAKAVKSAPSGHPAKSANRAKAAKVARNAANAAAKSAPNARPAKSANPAKAVKNASNARPAKSASRARIARLATPRPWKPRHCRTTRAWSRTSRTIPMASARAAAPAASVVAATAANASARSAARWKAARRPIMPPRR

SEQ ID NO: 18462 - protein, 211 aa, Pseudomonas aeruginosa
PEPPNTHNEKGMPPASLFHSPAAPSVEIGFRLQFDAETPTDVLLDTLGQCPDLGTSGAAMVDQDQRLLRVYPHRAIAETLPAALVDEPACSQLQPTVRLRIADQIREGLTQAFGLRRIHQRVLEEAAGIAQYGGVGQLLPANGADYPAYVPGRRTGDALLLQALAYRPVVQVQPLPPRQAQAHAEDQPAIRLLLEQAIAVAETAGLAIELT

SEQ ID NO: 18463 - protein, 158 aa, Pseudomonas aeruginosa
PRLCAARRVRWSGALPTCQPAVPAESTWIREASPASSTLRRNTPSAVGDRQMLPRQTNRTRISPPARGERVRGLPAYPRPEAWFRGHRPHGFAPRARARAIARGFRRSPASTVPRRRNRQGNPRDRRRCRCGDDRARPPAGCRDRGRRRREPRARAHD

SEQ ID NO: 18464 - protein, 211 aa, Pseudomonas aeruginosa
YCLPPAPAAVPGKRACARTGSPPGGRSPPDDREPPADAAAPAPDAPGTRRRAVARRTTSGLGRRVLDRGDAQVDEAQLARCVHRRDHRLVGGLGIGADHHRQVVVARRFTLHRRHQGGQVALGQRLPVQGVVPLGIHREFQLLLLGAGGFAALRRWQLDVELLGAGEGGTDHEEQQQDEDHVDQRRQVDEDVFTGGTRPSAAEFHALPSST

SEQ ID NO: 18465 - protein, 244 aa, Pseudomonas aeruginosa
SKTCFRVRTSTASPWPTSSTRTSARPHSTGGDDGNNAGSSNAAPRARNGKPAGASQQSAPSMPSATLQAAAAGGCQASARPASRPSARNSRSSETPAARSSPSPSPGTHSSRLPARAGGTTSSSIQGTASRLAGAPLRLNGRPSASSGIASPSAIPHCARPQAAHQRQRPRRPANSQSSRATARNDSQNPACRLASGSTSKTSTSVASSGVSKPRWRKRRRQTSARLTIRQARRTGTSKPAINP

SEQ ID NO: 18466 - protein, 179 aa, Pseudomonas aeruginosa
SKPAAFTRPRGRFRVTARRQRSPPISGGAPRQLRRKRSGRSTPRAARTSSSRKRVTPSPLAGRSTTRPSSQRVRPSSSAARRPSRATCAEPQAQANPSRNNPSQYSRPNSSNSPAAAMPSSQPTDGNSARKRRASSPAARAGNPRRMNGSSHPRGVPSAPRHVTWGHTMGNEILSSCLA

SEQ ID NO: 18467 - protein, 187 aa, Pseudomonas aeruginosa
YASLYPPRAHMPRRLFKRYMPDPESIRSQKSLRFLGKLTHDPNLWHLNRHSVSRAMAAGLFAAFIPMPMQMLLAAGLAVWIRSNLPISVGLVWLTNPITMPPVFYCTYKLGAWLMQVPPRTLPDHLTWEWISQELSSLWQPFLLGSVVCGIIAAILGYALTMLYWRWWVQRSWSRRCRQRRERVAAK

SEQ ID NO: 18468 - protein, 439 aa, Pseudomonas aeruginosa
SAGHEKAASKAAFSWALSAPCWDWRRPSRSLVAQRLGRLCPRRAPGWVQGGEEAHQQCSAADQHHVQHLQIGRQVVDEVHIRAEDLVSDQPFDAVDHPGDVQRREHPEYPADDRPDHADDGALDHEDRHDLPRRGAEGTKNRDVGALVGDHHDQGGDDVEGGDRDDQQQEQADHGLFHLHRVEQAALGPGPVAGPEALPQLLDHLGGDLRRLVEILQLQAHARHLARLQAQQLAGIGDVDQRQRVVQFGTDLEQGDDGEALHARSDAARRAGGFRDDQGQLVADIDMEAPRGDLAEDDAELARLEVVQAALDDVLTDDGNLALLLRVDAVDQHRQHIALVRQHALQFGERRRADHLAVPKRRVGDGLPVVQRLRRADGGMRHHAEDPRAHFLLEAVHHREHDDHRQHAQRQADHRGQRDERDVVVAAFGAGVAQAYEER

SEQ ID NO: 18469 - protein, 152 aa, Pseudomonas aeruginosa
RSEHVADAPSRWGIRRTGADGGHAVAPLRGDQSAFFQAQDAIHVPGQLEIVGYHQERGLQRTAQFQHQLLDTLGGMLVEVAGGLVEQYQLRTVDHRAGDRHPLALAAGQLGRLVRTGDAPARPAPAARPPAGGLPRSACGRSTAACRRSPER

SEQ ID NO: 18470 - protein, 238 aa, Pseudomonas aeruginosa
KSLSVRVRAISQATRGAWNRSSSFRRSPCTWLVFQRCRRAASSRWISDRPPSSSPAPTRKVPTTVKRFIRGNTPAGVTATSGRIRVTLSPMPTPSFCAASWPMTMPKPPALSSASEPCLKKSGMIETLASSSGSTASTITVCTAPLALSMPCIWVNGATAVTCSWALTFSARARQSSMGWYDSTVACGTMPRMRVRISRSKPFITESTTIITSTPSARPIIEVSEMKETKWLRRLARV

SEQ ID NO: 18471 - protein, 390 aa, Pseudomonas aeruginosa
ATHSASCWPGISSRSRPSSAAWHGPDRARSASRANLLRPETFFDLRCADAPFATAVLPPPRPAAVRRHPEHSAGRPGRYPGRPARARRKPRSRAATLRPGRRGTSRGRPAAHRALGLPRLLGIFRKRPGARQRSPSSAAESRATLEQGATVTLIYGHRGAKGEAPENTLASFQRCLEHGVNRCELDLHLSRDGELMVIHDPTLKRTTGRRGKVAEHDAATLVTYDARKGGPGWVRPTPIPRLEELFEKCPFEHWQLEVKSASRERAARTVTRIRELTERFGNRDKVTVTSGSRTVLKALNELTPELSRGLVAEYAWLDPLKVAQHYGCALLALNWTLCTPERLLKAQRQGLHVSVWTVNEPALMRRLADFGVDSLITDFPGLASATLGNR

SEQ ID NO: 18472 - protein, 592 aa, Pseudomonas aeruginosa
AHPLRPAQAAGRSPSKKPVEAVERRYPIGFRHGRVVEGGVDEVLQGIQLARLVHDRLTDVDDFRSLVAEAVHAENLQGLAMEQDLQHAHRLVGNLRPGHALEERLAHFVGNLRRGQFAFVLADRADLRNGVDAGRHIVDEAPAVALDDVAGGRAALVVGSAGQARPADHVAGGEDVAHRSAVVLVHLDLATAVDLDADVLQAELVGVAGPAVAPEQRVRLDLLARLQVQDDTVVQPLDALVLLVVADQHVVVAQVVAQRIGNLVIEEAEQLVARIDQVHQHAQAAEDRRVFAADHPGSVDDQPARGVAQGQDGVAVVDPRVVEIDVRRTIRARAGGDHELVGDQALHRAARRHHFDGAFVDEAGGAGEHVDAIARVVAGTRSDLLGDHPVGALQHVGEGEPARLADLAEHRVGVELDDLLHRVAQGLGRNGAEVRAVASDHATAVDYRQLASVLGGVHRRPFARRTRAQNHHVVVVDSHAYSSEQAEAPTGASGKAAAQHVRGGSIRSSGRCERRHSPGKARSDLEAGICYALCEMSHISVWSRRRRVFRALQIRRGWLPRISAGRRRRSSIPSRSPGWRCRRRNRRSACGP

SEQ ID NO: 18473 - protein, 364 aa, Pseudomonas aeruginosa
RRPVARSWTFSLVAEQLLVAWRGAAVETVALATDEQRRQSVLLGETVALLRTEHHQQGRQAVGVARRRIDHRDRSQVMVDRRAGARVEGVRIALAVLFEIVAVIARGRDAVAVQRQYLLGDPLALARRFDSDAPGRAVRLAPFGFQLAGDFRQVAAHAELLQAFAYRVHRIASGDAVEVQLYGGVLAQALAVDAQVSMADVTAHRGDLLGAGNLLHPRLRTEAPEVHQRLDGHVEGALALFRQLAAVAQQLQHRWRQLHAGLRRQRIETRDQGIVAVGGHLPVDLGEDRLHRGFRRLDVGRRGAAHVLDRIGAAHGRAAEAFQGVAATGQDQRQRCQSGHGKRTETLSHRNRPAGYSRAPRPGR

SEQ ID NO: 18474 - protein, 528 aa, Pseudomonas aeruginosa
KTGARELPFSSTPCASTREGRRVDPSHVFHHAHYLAAVAELVVVPHVQDDTVVVADGRLGVHHAGMARTDEVGGNHFLGADEVDLLLQVRVHGHLAQVLVDLFAGGGLFQVQVEDRHGHVRRRHADRIAGQLAFQHRQGLGRGGGGTGLGDHHVQRRAAATTTALVEVVDQVLVVGVRVNGLDVTVDDAVLVVDGLQHRHDGVGGAGGGRDDLVVGADVGVVDTVHDVLQRTLARSGKDHAIDPRALQVLAEAFGVAPLAGVVDQQGVLDAVLGVVDRRWIVGVDHLDQVAVGGQRVVFFVDGDGAVERTVHRVPTQQAGPLDQVVLGTLAHDDRAQAQAVAAAGLLDQDARQQAADAAEAVEHDVGAFAGIAVLLADHLGQLGLDEVLDAAAVTFCLELGDHLAQIDGSGAQLELAHRLEDRERLVNRQLGVISHAMTGETMRLHDRDHRAVDQTTAMDRGHHIVIAVELANQRDHGFRDGFTIDPFTETLVGLLSHGQYLPHVGDEKRGYIMTAPARLGNLQQSED

SEQ ID NO: 18475 - protein, 317 aa, Pseudomonas aeruginosa
HPAVGKVTIRRVKFPTGAQLARVRTASSQPAGQRRQATLGQPPRCRAEPGCRRGRQFRQALHPAADRRQPECRTPGTGTAVLRPRPAGIAFPRLGNPALRRLFAAPGHHFPAHRRPLPVAAAQARRAGGADLHRLAPPGADPLPARQQPGPRRRPETRRRADAPAPGRRRLPLRRHGLRARRVRRPRRADRPVPDGQRVALPYRPVRRRDRDPAHLRPGDPALHRQGRVDPPAAGTRIPPEQGSGHRLPRPLPRALRRRLPALPDLPGPRQRFDTLGNRVLPAAVLRGNRDPLRLPAARHPGVLPARHRTGRGAVLE

SEQ ID NO: 18476 - protein, 351 aa, Pseudomonas aeruginosa
RTQPLRGPPGRSGTAIAAAGGSVPSGGRLLRPAEELATGGRQPGGRRAGRRARALPGPAAAEPGDRSQDRRAAGRAAPVHRGVPRPRTVLRRIGRTPGSPAGAAGPTEAAPRGSRRLAGLPRQPGTPGDQHRAAGRGPAAGPSGPRPGRRKPAVRPARHAAPAPGKDPRRRRRGDQEPHRAARRRAGGAHRPWRRPLPGPDHPRGGQPAGGIPHAAIRRGRQALRAGRQPAPDRPLHRRRRRPGAVAPARLGNLAEGQAQGRRAGPRRRRRAARHLRPPRRPRRLRVQGSAGRLRDLLGRLPVRGDAGPAKRHRGGGRRYARAQAHGPPGLRRRRLRQDRSGDARGVRRRA

SEQ ID NO: 18477 - protein, 387 aa, Pseudomonas aeruginosa
RQAGGGAGAHHPARPAALQQLPRPLRRLAGERRGDEPLQERQGSRERCAATGRRQDRHPHRDPQAAPGRREVRQPGVGRDRRGTPLRGAPEGAAQGPAQRSGHPHPHRHADPADPEHGRLRHARPVHHRHAAGAPPVGAHLRHGAAERGDQGSAAPRTAARRPGVLSAQRSEDHREVRPRPSRTGPGGAHRHRPRTDARARAGTGDERLLPQALQRAGGLDHHRDRHRRAQRQHHPHRARRQVRPGPVAPVARPRRSQPPPGLRLPADTAAPSDDAGRRETPGSHRQTPRTWAPGSFLATHDLEIRGARRVARRRPERADPGGRLHPLHGNARTGGEAHPQGRATEPRAATGRRAGGQPAGACADPRGLPARRACPADPLQAHRQRP

SEQ ID NO: 18478 - protein, 96 aa, Pseudomonas aeruginosa
VPGRYRAPANGAGLAHGVPPGAQRKEKGKRRPGAPSAIRPWRASCSAGAVAPRPAADRRCRSRRACRQRRTAPSGASPARWKCSRRNRFPPSPAGP

SEQ ID NO: 18479 - protein, 191 aa, Pseudomonas aeruginosa
VRSDRSRSEGAGTDHRRLERRRDPALTGDTMQTSHSLPSAQLPLFQEAFWASNGAPLLDDVIDSPSSASIEEPAAFSELSLSGLPGHCLTLLAPILRELSEEQDARWLTLIAPPASLTHEWLRRAGLNRERILLLQAKDNAAALALSCEALRLGRSHTVVSWLEPLSRAARKQLSRAAQLGQAQSLNIRLG

SEQ ID NO: 18480 - protein, 1181 aa, Pseudomonas aeruginosa
ANPRSRGVIRSIQPETTDTEKRKPGHEAPAFPFDERLDALEDGGDTLSQAHAHGGHAKGTAVLLHHVQQGAGNARTGATERVTQGDGAAVEVDLLVHLVEQLEVLQHRQGLGGEGFVEFDEIDVGDGQAGTLERLVGRRHRAVAHDRRVDTRHGHGADHRHRLDAQVLGALGRHHDHAGGTVGDLRGGPRGHGAAFRIERRLQLGQGLDGGFRTNGLVEVEDFQETVLVIPFHRDDLVLELAFLGGLPGQLVRTRAELVLRLTADTVHLAEHFRSQAHHARGLGGVQGQVRVRVDAMHHADVAHVLHAADDEYIAIAGLDRLGGGVQRAHRRTAQAADGLRGAGVRDLGHQRRHARDVPALLQGLVDAAPDHVFHFGRVDLRVTLQQLADQVRRHGLGAGVAVHATLGTTHRGAAEVDNDDVSRIQAHKFTLALVVPRLTEEFLTVLGHFTQLRGRVVQRAQLGVLVGQGHELGDTDRIDVAQSTTTEGREADAVDQAHIGLGSGLDDAVFQATHGFQAQRDHHEVDDVLVGHFALLDHDRLEHFVGLRIGDLLRLAALVGLVSVEALAVLLAQAVGLVHHVDGGLALDRHAVREALGHDVAAMVAGVDADHVGQVGRAHGPAELLHHLVDAHEVDAEAQQLGEAAEVREQHTVDQEAGAIVDHDRALAHLLGVGDGGGDGGFTGLLATDHFHQRHHVHRVEEMHAAEVFRTLQRLGQQADGDGRGVGGDDRVFLHRAFHFGEHGLLDLGVLDDGFDDDVDVAEVAIGHGRTDAIERLGHLRRGQATLLDALAEQLGGLVQAHLDTLFADILHQDRGALERRLIGDAAAHDAGAEHGGQFHVLGDFVVFLGFLLQFLVIQEQADQTLRDRGLGQLDEAGGFDFQRLVAAEVGGLLDALDGFHRRRVVRTGLAGDEALGGFEGHHLLDCIQLQLFQLRLAPCLVVQLAGDGALGQVEGSGLQLLGSDHGVDGADLQGVLGLVFLARGDPLDGVIAADQARQADGAAEARVDAQLDFRQADLGGRAHHAEVCGQAHLQAAAEGDAVDRGNGGYVQVFEVAEDLVGFEVARHQFLVGQLEVVNELGDVGTNDEHVLAAGHDHALDRCIGLDRIDCRTQLTEGETVELVDGLALEIEIQLDDAALKRLNRDGFTLVNHQLISTLLWKLELTHRTPCRDPFGNRRA

SEQ ID NO: 18481 - protein, 722 aa, Pseudomonas aeruginosa
CSSLFRDGSVFQFGPALEQGIEFLLQRVQPRQGFALLVLRAQIEILLRDGFLDTRQLRLDRVDLPGQSLQLALQLVAELFLRRRLARRRSSRRGFGGGRQRGIQLGLAALRLAHAEQARRAPLAQPVLVATDEFANLALALEDQGAGHHVVEEGPIVADHQHGALEAEQDFLQQFQGFHVEVVGRFVEHQQVGRLAEQLGQQQARALAAGQRLHRGAGALRTEQEVAEIAEHMPVLAVDGDELAAFGDIVDHRLLGFELMAQLVEVGHFQLGAHLDLARGRLQVAKQQLEQGGLAGTVGAEQADTVAALQDHGEVAYQRLAAGMGEADVLHHDHLLAGLVRAFQLEAGLALALAALGAFATHFLQCPNPPFVARAAGLDALADPHFFLGQALVEQCVGSFFGGQLLFLVHQETGVVAVPVDQVATIQLEDAGRQGLQEGAVVGNEQHRAVEAQQRFLEPGDGADVQVVGRFVEQQQVRLGDQRLGQQHAPTPAAGEFGEGLVGRQLQAAEGAVHQLLQAPAIARLEFLLDPREARQVIVGMDVQAQVVVLGEQLADFRQTLGHHVEHCPFVGTRQFLGQFADLQRRCAPDFAVVGLLFALDHLEQAGLAGTVAPDHADPLATADLPRHLVQQGSGAKGKGYIGELEQGHGRLRKQGAHFTPDRHRMARRFHRHAATAKLRQAIRPASGAPRDSGRAPVPRAVETPVGSRCGPADVTRHHLPG

SEQ ID NO: 18482 - protein, 643 aa, Pseudomonas aeruginosa
VMRGRLFTLVSCLLLSISSVDAVHAASLTEQRRLYDQAKAALAKGNSAPYMASRSALRDYPLEPYLAYDELTHRLKSASNEEVERFLTEHGDLPQIGWLKLRWLRLLADRGDWKTFVNYYDPKLNFTELDCLYGQYQLGHGQKAEGYATSERLWLVGKSQPAACDTLFGLWQGEGQLTEEKVWKRLKLAAEARNYSLASHLAQRLPTLGNQGALMVSVAQNPAQLSQTGRFSQRDHATADVVGLGLRRLARQDPEKALSLLDYYSSALPFSSDEKVAIAREIGLSLAKRFDPRALPLMTQYDPGLRDNTVTEWRTRLLLRLGRWDEAYALTRKLPQDLAATSRWRYWQARSLQLAQPNSKEPIALYQKLAGERDFYGFLAADRLSVPYKLGNRPAHIDPRVLQRVRNAASTRRAMEFFNRGEVINARREWYHAARLFDRDELIAQARLAYDMQWYFPAIRSISQAQYWDDLDIRFPMAHRATLVREAKNRGLHSSWIFAITRQESAFMSDARSGVGATGLMQLMPGTAKETSRKFGIPLASTQQLIVPDVNIRLGAAYLSQVHGQFNGNRVLASAAYNAGPGRVRQWLKDTRHLAFDVWIETIPFDETRQYVQNVLSYAVIYGQKLNAPQPIVDWHERYFDDF

SEQ ID NO: 18483 - protein, 658 aa, Pseudomonas aeruginosa
APVASTPSSDRRQWPPAATAGDRSSVEDFHRHPHLQAALSQRNQVLPEQHRAILFPVGLQGRQRLAVLVALAGRRIQGGEDAAGTGLGHDELDRADADAFPAVLGERGAAFHHQVGTEAQHLQRPADPLAEVVERSLADQQQRETVGEMHLLPRFGVAGIDLPRARLGNVHQARRAAEEARQPVRCGVAGIRRLQGIAPDRDATQVGVGCRYFEAQLGHPRRIQPQDLRRRPARLDTPQLRQQALGEETSGFGVHRHPASVADHAQRIERDALQGLGGGRLDRIAVQRGETEHGTSILGGKMLLYGVAGKADKTQTPLQAADQSAPPSVLARRLAQQRRTGRQVHAQRARGNRETQLASFQRLAVEIDVETFRRLHFQPWHPRADEQAFHSVATAEQGAQGTDHVLRRRQDAHVQQAVVHSRLRTQYVPAAGLAPVTDAQGEELAFPLEVRGAETALGGMHFGKTGQPGQQVGGTAENLLQVLRGIRRDLRTEAASGHVEEQLAVHLAQVDRPRRLVEQRQRRGRFQGNPGGAGEIVGGAQRQDRQARLASPARQRFGHLAQRAVATAGDQRRIAGRQRLLDDAPGVAVLPGYSHRQRPSGLALRRDRGTNLFVARLLAMQDQQNLVLVHRTEPLVVALSLPIDRVSGTEVRRPVQAG

SEQ ID NO: 18484 - protein, 156 aa, Pseudomonas aeruginosa
MPRRRRDAPRPAPAAPGAHRRSPHRRIACRRAAVVPSGPAPGSATRRRRRNGGCAARQGRRTRSAGRRIAAGRESRRGSGPSRSSTAPPAQAPRRAGAGARAPSRGSAATGPSRCSAGRHGPSSTSGSRCPRRSPAAPAAGSASRAARLRGGCRHR

SEQ ID NO: 18485 - protein, 635 aa, Pseudomonas aeruginosa
CRRRPRSGPTPAPPAPAGGGDATPRSRLKSFRSVLQQGAAVEPPGRVEVTGHGTQRGDAQFALLAGQVGCVVLADAMLVADGAAIVDDRLAGRMLETLPALQRRRIARGRTEHVGGIDARPLAIDMREVGEHMDPLALGRQAVAQAGLDLLQQAVDVAPVGGGLQGVHGVARLPQGLAQVGEAEAVLRPLAPQQGSGEDPAEAFQQGLRLAQRQSVLPAVAGHAEGQHALALARAAQRQVFLQPGDLSGMAGQGQLGHGFHGVGQSQHRQRHARLCQLAGGLQGLLPVRQEDAVEALVLGQRRDPHLHRGNDPEASLRAQHQFAQVRSRRGCREGSDFKRPGEGLQGPAGEKLFDPPVAQRLLATGAAGDPATEGRQLPGLREMPERVAQRTQLALHLRAGGAGAEGRDQALAVQIDQAVHALQRDRQYRPPRGLRIDMAGHGSTAAIGNQLQVAGVGQGQQLADLFGGFRIGHGVRVDAEVALAHRQPVRQALPAGMQQTLTGVDAVARIGLQARRRDLRQRRLQAGVRQACALPDQFRQEPTGAVRQFDHGAFFAPAIPTAHEPLPSLVAATCLSEPFWLPILASRPRLSLSDRDTPCDRSRQPARTPDGLFHPPRQEQRPCRPLAPPRFRPC

SEQ ID NO: 18486 - protein, 514 aa, Pseudomonas aeruginosa
PYAPCNATCSKPAAATSRPSTNCAANWPSTTCCIASCRSRTSPSTWALPSRARSIAVSRVGPGRRPASTGNGARSRRRNENGGHPATVGSVEQFAQRNERHTLAFHEGTSLADLHQPLGPGSAAQYPGTLVRIEHRAALLQATTQVLATLPRLGPGKAGRYLHPQRRDLRHAKPAQQVGTRQQGEGDQGRSRIARQADHRDALELADGQRLAGFYRQLPEGQLAGFAQRHAEEVGLAHRYAAGGQDQVHPGQPGQALASTCQVVGKDAGVEHVAAQALQPILEQRTVAVVDLPGLQRLARLDQLVAGGQQRHPRLASHLQGRVAERSRQPQFDGAQARAGRQDQVALADFLATRAHMLAHAQRLGEAHAAIVERFGVFLHLYQIGAFGQRRTGEDPRTGIRLQRLRRLSGKDLLADRQWLAVPVGEAQGVAVHGAVRPRRQVQAGQQVDRQHAAASLLQGHLLTRIDRRLRGQFEEPFQRRLDRHQPRLFAAAAHPRLSQGAACFRCGTKLHGR

SEQ ID NO: 18487 - protein, 84 aa, Pseudomonas aeruginosa
LQSLTAQENCAMIKRMLPALLLAVGLGALAGCSSPTVITLNDGREIQAVDTPSYDEDSGFYEFEQLDGKRARVNKDQVRTVKEL

SEQ ID NO: 18488 - protein, 217 aa, Pseudomonas aeruginosa
NIQTCLSNIQAPIPAWNPQMKLHDLDLSGNAYKVRLFLSLIGREATLRPVDFLNREHKTQAFLRMNPRGQIPVLEDGELQLGDSHAILVYLARRHAGPEWYPLDPVSQGRIAYWLSYSANEVQNGPASARLITRFNLPLDREQTHQRGLEVLRLVDRHLAEHRWLAQGEQPSIADVALYPYLALAPEGGLALDHYLALNAWIARIRALPGYIPMPGL

SEQ ID NO: 18489 - protein, 314 aa, Pseudomonas aeruginosa
LGRRQHEPGTESLPHRRTGDPGTRRRSRTGRRLRQPRDPHLHAGPAPGVLLPAIAVAGGQPRRRRLPQRLGALGPPRLRPFAGTDPPAHRQPAASGRSAGGQSRGWHPPRHPRPGMADPPPQPHEWTGPGAGRKGFHGRRRAILRKLSQVHPGAQPSARLQDRKSRVAGRRTRSTLAVAGLAQRYAVHRQPACRPAQRRRRRLPSGRAAGLSPARRGWPPVVARLCRQPPVQYPRQPAPGSSLRPPVHRFRRWRTAAPARRGRAVLAGFAAIHPLARRRRAPAGVAPPQGWRWRRGRLPLAFWRAPPIPFFSCR

SEQ ID NO: 18490 - protein, 290 aa, Pseudomonas aeruginosa
ILMPFLYRLASLLIALLVLPVQAAEMRVALLRTSGVETLDALTVDGGSWVRRVPLSHTAVLIEHHAATLLFDTGLGRDIDAQFRADMPWWAAPLFAYQKVVPARDQLDAAGIRVDRILLSHAHWDHASGLVDFPEVPVWAPYEEIAFSRIATPPAAFPSQFRHGVRWRPYSFDPRPFMGFDESLDLFGDGRLVLVPLPGHTPGSVGLFVTLDSGRRLFFSGDTSWRLEGVEGPRQKFFAGRALVDRDPARTLAQLAKIRLLLRSDPRLSVIPAHDARVQAALGYFPHWLE

SEQ ID NO: 18491 - protein, 446 aa, Pseudomonas aeruginosa
PGCHRPTWRHAAAIGLPQALEETITMSMTPIARAVAFAALGSSITVPTLAHAEFIKDSKASIELRNFYFNRDFRQEGASQSKAEEWAQGFLLRYESGYTEGTIGFGVDAIGLLGVKLDSSPDRSGTGLLKRDRETGRAQDDYGEAGITAKLRASKSTLKIGTLTPKLPVIMPNDSRLLPQTFQGGALNSMEIDGLTLDAGRLKKVNQRDSSDNEDMTITGGGKRNIVVRSGLTSDKFDFAGGSYKWTDSLSTSYHYGKLDNFYKQHYLGLVHTLPIADKQSLKSDIRWARSTDDGSSNVDNKALNAMFTYSLGYHAFGVGYQKMSGDTGFAYINGADPYLVNFIQIGDFANKDEKSWQARYDYNFAGVGIPGLTFMTRYVKGDNIDLLTTSGEGKEWERDMDIAYVFQSGPLKNLGVKWRNATMRTNYTNDYDENRLIVSYTLPLW

SEQ ID NO: 18492 - protein, 149 aa, Pseudomonas aeruginosa
SARCSAAGACTSRSTTKARRSAPPWKNWPTTASDCCHDKETRMSQLPVNATGLSRRELRKAVIRLRLEMQRQQLRRESQLLVQPFRQAQGLGHNLSQQLFGGGNAALWGAGGAALLGVLLGKGGRWQRLLRLGVALAPLLLGLRKQKGR

SEQ ID NO: 18493 - protein, 232 aa, Pseudomonas aeruginosa
QGLQQFAQPFRAVAAEAAESGCIIEPPGLRGVASERGREVVAQGLQAERLEQAIIHARVAAALYLVRLGVGGIAEDQDRRASLASFLDAYPACQLIAVQARHVAVADQHLEALVGPELQRHLAILRFRHPVAEKLQLLAQQYPVGRIVVGDEDMQAARRLHGCCQRVLAGFRHFRPALAQEQVERHPGAFARLAVHLDIAAHEVHQLPTDRQPKAGPALHRASLGHLDERLE

SEQ ID NO: 18494 - protein, 362 aa, Pseudomonas aeruginosa
ARLVRRSDTDTGILHVHPDDRPPLVQAPFLETDRHLSPLGELDRIAHQVGEHLLEAQGIDQHVPSRGIVQLHNEPQAFLPGQAFEHAAHRLHDMAQANPLGREGQVTGLDLGDVEDVSDEQLQRPRCLVGDLQRGAFALLRRQALQDQFEDADDRIHRRTDLVAHGRQEDALRPIRLVRLAHRLAQLAGQALPFGDVDPAVHQAEHPALAIPVGRDPMVDLQQLPADAHRHVGEARRSSPSHRQALLVHEPCLAALDPVGIGQQGAARLLTGHPQAFQVIAVAGQQATVERADAHRVGNPVDQRLLQCQAAAQVGFGTLPTPEPELQDGIPAQASDADQAGHQQAEHQAGRGWRAQPVGSLA

SEQ ID NO: 18495 - protein, 824 aa, Pseudomonas aeruginosa
MPLASANGDSPGPMDLRITREIRIEGFASDLFDRIAGLHALVQFELAEVVGEIQHPARRQPRHGQVEQFDVVALHVEHAFHALGVGEGRRVDEDQFVLAIVFPQPLHHVAVHQALLVGKAVERQVAARPVQVGLRQVDAGGAARAAPGRMHGGRGGIAEQVEEALAGRLLLDAQAHRPVIEEQPGIQVIGQVHQQAHIALTHLEELALAALPFVLLLAGLALAALDHHSLLGNAQGLRNRRQGVEQARLGFCRIDRLGRGVLLDVNPIAVDIHRQGILRHVGVIQAIALDLVAARPFAQLPEVLLQAIGEHLPPLAQPCRLARRPCQAFVVAFATLAGDELARLDLDHQQLAGQRAVPERVLLMAADAHALAQFRRPGKHPGAPADAALAQALAEVLVEIQQAGFVAETLAIGRVADHQAGLALVRARLESRQFALVDLHPVGHSGTLDIVARRLDQARVGLVAANPQRRPGQAGRRALLGFLVELAPQRRHVTQPIAEAPALTPEVRRDIGSHQRRLDQEGADAAHRVGQGTALGGDLRPAGTDQHRRRQVLLQRRGALLQTIAALVQAMPGEVQGKGRLAAVKVQVDAHVRIDLVHRRASAGALAQVVDDRILDLQRPEMGVVDARALAAELHRQRAAGVQVVFPVHRVDRHVHGLGVLHRESRQHQQDPVGQARPQAEAIGHLQAALSAHRRHLGARLVQAEPLRLFEEQAFQAFRAGQKQFVNISHIAFPGRSPCQWKHPHGHFFGTRCRGSIAGTLPALLAATPSRSLGDPSSECEEISIGGGANRYKAQPRDPAALAPETRRHEPATYGPIDESVKSL

SEQ ID NO: 18496 - protein, 188 aa, Pseudomonas aeruginosa
  UNSURE (20): Identity of amino acid at the above locations are unknown.
RPSKACAAGRSSSRHLAHAXEDLATAEVCRGVRIISYKDFVKALSLALPRFTNGDSIRLRQAAWHGERLFWAGERQACAFAAAIVYARRRELELKLPAHLERYELEPGALDELERRYHMLRIPTQAWSEPTFMSLLLDTGLPYARLALFTPETPECLLLPRNDERADALGEGLRAAGAADVVKYLKQL

SEQ ID NO: 18497 - protein, 213 aa, Pseudomonas aeruginosa
DPRLPGETGSRLLRPHRPARVARAQRRGSPDAAGDRLHRGRQVRRRPEALRQADLAGGSRDPSRRGQRQGRHVHAAARHERCRPPARRATGEDQPAVHPGGQRRRRPAPQRLRADQPERPAGDRLAGERPQSQSQPRLHQARQRGDPQRRLGIQPLRAELLRRHPLHRRRHVSLRQLLLPQRQRLVTGEQRLDGPGHAQAGVPGAGKPRAHGP

SEQ ID NO: 18498 - protein, 299 aa, Pseudomonas aeruginosa
RRITLRVIRPTAGLREPRCLSRLRERAGEREPVSGTVGGCGQVASRLALAPGFRWFFGWRRQLPLAHLLEDFPMLLAPGRHVETVEFEQLGVALHQIDRRFLGGLGDLPGDRLRFDAAFIGDPVAELREGPADLLEILVVHALPATLDVLKAFGIHADHLGKLRSVQPRQPAQPEQALAGAKQAALPHYIDHVQILPFVSGAMRLSRPCRSRAFSSSAGAWVPAALPGAPAPPPAPVPPPAAPRVSRGGVRARPACRCRAAPAAPGCAPPGRPRPPAPSRRPSRRSTAARCCLHRRSSR

SEQ ID NO: 18499 - protein, 106 aa, Pseudomonas aeruginosa
TEGSPPTSDHGAGRLMKVEELPQEGFAECPRYITLMRFAFLTGLSDRPDLLYAWIESGDLPMRTFGTQRLVDMQKLQKRIEEAKKCRCQVFRANHAGLETVYGTVG

SEQ ID NO: 18500 - protein, 180 aa, Pseudomonas aeruginosa
SRLSGTPLSGLAGSVRRSGRQAASPPMPARPRVGRRPRARLHHQAHPVSPAPRSRRLGLGRPSGRTPTKPQRLPPLCARHRWGRGRGPRKRPRPAAASSRWQGRGRPAAAAPARAPSAAASSSRPADRPALRTSRRDRRCIARSVRLRCAAAVAATRSWPRARRPTGRRQGRPACAGSGA

SEQ ID NO: 18501 - protein, 354 aa, Pseudomonas aeruginosa
APLSSGNPSMKTPNLLSRKTRWVVIAVVVLALGGALAFWLSRDHGQQDALRLYGNVDIREVQLAFRQPGRVMQMAFDEGDAVSAGARLAALDPQPYREALAAAQAQVQVAQAELAKLRRGLRPQEITQAREALRQAQALATETERNFQRQSGLLASGATSQRTVDAARTARDQAAAGVEAAKAALSQASEGFRKEDIAAAEARLAAAQAAAAQATTALADTELAAPSSGTVIARVREPGSMVVSQSAVYSLSLDKPVYVRAYVGESDLGRIAPGTVVRVKSDSSEKVYRGQIGFISPRAEFTPKTVETTDLRTDLVYRLRIVIDETDSDRALRQGMPVTIEVDAKAGTSIPGER

SEQ ID NO: 18502 - protein, 394 aa, Pseudomonas aeruginosa
DGGYRMNAVEKHKDGAGPMQGDLRRFNLGRLVALVTKESYQALRDPSTLLIAFVLPVVLLLLFAYAVSLDAKEVRVGVVLESPGASAQSLAAAFSGTRFLNTHFAHDRREVADQLVSGDLRGYVVIPQDFEQRLAQRGSEPLVQIVTDGSYPNTANYVENYARGVVQFWRAGLDVAAPAQAVMLEPRYWFNPELESRRALIPGAIAIVMTIIGTMLTALVVAREWERGTMEAVLSTPASVAEILIGKLLPYFVLGMLSTLGAAALAVFVFGVPMRGSLLSLLLLSAVFMVPALGQGLLISSLARNQFLAAQIALFTGFLPAFMLSGFLYEIDAMPAPIRAITRAVPARYFVDSLKTVFLAGDIWAVFLPNLAAMAAIGVLFFVIAKRATRKNLE

SEQ ID NO: 18503 - protein, 445 aa, Pseudomonas aeruginosa
TRDLRPVAGVAHLDARDHHFQITAGTRNWHRAGPVHDQRGRLPVRHPVYGLVCAPARQSGAVHPVGGRHRSDDFRGQHDAAAGHPGGVRHRRAGGADVRLCDACRKHACRPAMAGSSHSTDPLPHHRRRQLSQGHATQRHSRQPVAAGGHRPRHADHGHRIRPRTPAMKSKPCTPFLRATITGLPPGRARPLALALSCMLLTACASVGPDYREPPPVDVGSGWSLPLASESQSADLSQWWSALDDPILDRLMATALAQNLDLRQAAARIDEARALRDRVAGEALPTAAAGASVNRRRQSENGPLPVGSIPGLDATQTIYDAGFDAAWEADLFGAKRRALEGASARLQATEAEAQGVRMRIVAEVARTWFTAVGARYELHAQQATLDTLQQTLELVRLRHALGDASAADVEAAYAQWTAVHALIPDIQARQRAAILSLGVLLGAPP

SEQ ID NO: 18504 - protein, 317 aa, Pseudomonas aeruginosa
PLAAATRLAGHGARVWPCAALAGLSGARVMKPAEDLDERLRAIRESPTYRLAYEDIELLGQDELRPLRLQLELLKPERILHEQGIRSTVVVFGSARVSDAETAEARLGVLERQALVTPEDVGLRQELARANRRVEQARHYEQARRFSGLISARFQQQNRRDFVVVTGGGPGIMEAANRGAFEVGARSIGLNITLPHEQAPNPYMCPDLAFRFHYFALRKMHFLLHAKGLVAFPGGYGTLDELFEVLTLIQTRKMQRVPVVLVGRAFWRRVVDFDLLLDEGYVSSSDLDLFTCVDDAEEIVSALERFYVNRAAGDGAT

SEQ ID NO: 18505 - protein, 223 aa, Pseudomonas aeruginosa
KARATVSAQEPLDMNLIAALTAENGSTRLKAALVIGSNADPGLVDTVIARCAIEPDFYVRDMLTWALTRFPNEITVPRLVAELHSEGAQARSQALHTLSKIKDAGAWPAITRSLLRDSDDEVARSAWRAAVVMVPDGQKKDLAEELAVQFGRGNREVQLSLSRALIALGEEVVEPVLRKAMASDNPGVHAHASATERILRDPNASFEFAVQEARRIFVLGKER

SEQ ID NO: 18506 - protein, 317 aa, Pseudomonas aeruginosa
PLMNDMVYRSAEAAAAVETQYKRVLERWPVPKTELHVPTHYGSTFVVACGPESAPPVVLLHGSLANSAAWVPDVALWSTKFRLFAIDMIGEAGFSARVRPDLAGDAHALWLDDVLEGLGLGLGSGRARVAIVGTSLGGWLALDYANRRPAAVRALALICPAGIGRQKNFLLKVLPLLLLGAWGKRRVWELVFGPAPKVLPPEMQPLAELMEIVGRAVKPRVASIPQLTDAQLSELGMPILTIIGGRDVLLDSRHTRERLQRSAPQAEICFIEDGYHFLPDQAPRVMDFLERSAIFAPASRATGKEIKAEQSSVASWR

SEQ ID NO: 18507 - protein, 199 aa, Pseudomonas aeruginosa
PKSMTRMLSTVRKQLLALRARDEQVRAELTADGSLYEGYHPRMEKVHQGNAEELRSIIQEHGWPDEELAGPEGAEAAWLIAQHSIGEPEFLRQCRTLLDEASSLGRVPRWQFAYIDDRIRVFEGKPQRFGTQIDLRPEGPKIHELEDPSQVDAWRKEIGLPALASTLARAQSDPLPTPDEYEAKEAAGLSWRRKVGWVK

SEQ ID NO: 18508 - protein, 109 aa, Pseudomonas aeruginosa
QALGEGRCTAWPAAEQINKGVFETRGHWSQLHLGPIGQRLDLLRWCTLAQYHAHPCALDHAIAHAGQIERLGQNRPALGADVFQAEAAAFKLRGQLLRRTIKQELPLVQ

SEQ ID NO: 18509 - protein, 253 aa, Pseudomonas aeruginosa
QHALAALGLVEVGGGPDHRHALIGQRLHHAPQVLAADGINAHSRFVQQQDLGPRHERAGQAQFLLHAARELAGEALGEGSEPREVEQLGKQLGVAVCVHATQLRIQAHVLHHRQVFVQAKALRHVAAGDMNGVVVLDHVIACQGDAAGVRHQEAGQNPHQRRLASAVGADQTRQPPIVDARAQAPQRLYVAEMLVHVFDDDGSVFARARRHGGDGRAYLHLNAPPGYWCRLSHRPRSSPACPGARPCRCRFRR

SEQ ID NO: 18510 - protein, 99 aa, Pseudomonas aeruginosa
SPGGIDAMKKAIPFLLAAILTACGQAETPQKAISSEPDIPTVEELAANPERLKELRQQCKTDRPKLGDVLCNRVAEATRKRFYGDGETPYTPPKESPKF

SEQ ID NO: 18511 - protein, 395 aa, Pseudomonas aeruginosa
TVGPPPAARAQPGARRGGGTASRSYANGGRGGGCASAGACVMSAVPQSMSATSLDRRIQMLRTAMGSLIAAALEDPDVVEVMLNPDRTLWVDRLSSGRAPMGVELPEADGERIIRLVAAHVGAEIHRGQPLLSAELPETGERFEGILPPAAPGPAFALRKRAIGVIPLERYVIDGMMTSVQAGFLVRAVRERQNVLIAGATSSGKTTLANALLAEIAATGDRVLVLEDTVELQCAARDHVPLRTRAGVVSMTELVRSSMRLRPDRVFVGEVRGAEALDLIKVWGTGHPGGIATIHAGSALGALLRLEQLILEVAVNPPRALIAEAVNVVIHIAGRGRKRRIESIARVVGFDGVGYRLANWEADALDTPFPELSPNPDAASAAATSPSPDLLGELP

SEQ ID NO: 18512 - protein, 412 aa, Pseudomonas aeruginosa
RPDTDLPARHHLDAALSRRRARSGVPYRRAADRFRTGRWPGAHAGRPAPAHGVGAGLPDLDLAGDSGRPQPPWLCLPLEHALPVPRQSRGGTGVGTPAPPVVRQTQERHRAAARNDLPAGKSAGRYRRQQQGRRCRCRLAGAGQRSSRLRLPHRHGDGARCRRGCGRREAAHGGACHPGPGLHHHPGNAQRRGCLAVVHSGQRLRQRAPAHRLDVEPGAHDAGFGGMGRAGEERPPRRPSADRHAHGWRDAVPASDAHRRRGPHVGRGADRHGQVGLARHAGDAIPPLSRLAHLCLRHGAFNARHDPRAGRRTLRPGHGWRNRLPATRPHRPRELPHLGGRMDRGPLAARRRRSRPRRKGRYLVGAGKFGRCARRTAHDDRPVRAAAIECAAPSARALCAGRRARQAAGRRP

SEQ ID NO: 18513 - protein, 412 aa, Pseudomonas aeruginosa
PGVCRAHPPVAQDAAQEERQRHIRHAVARGHQGFEHRARDHRELRESDFLAQPAGHRAADSHDLRGLRPQQAADRNRRHRATQARLLLPIPPRQPPVRPRPGGGGAGLRRRFHAARPARHRPRAAGRRHTRLRGRLAAPSRPRLGGRPAALVPRSRAGFPPYHRPPTGEPVMKKRLVAAAIAAVLCTATAHAQWVVIDPTNLVQNTLTAIRTLEQINNQIQQLQNEAQMLMNQARNLANLPSSVVNQLRANLATTERLIAQARGLAYDVTNLDREFARLYPEQYAATVSGDQMYRDAQERWRNTLNGLQTTMQMQAQVSQNLGEDESVLADLVGKSQSAEGALQAMQAMNQLLALQAKQSIQSQRLQVTQDRAASLELARQAAATERAREVRRRFLGEGTPYTPQSVNFYGN

SEQ ID NO: 18514 - protein, 114 aa, Pseudomonas aeruginosa
REAAMRCVLAPSVVVLVVLLAACNKQPADNLADALAADPARLKALRAQCAADRQTKGEDACRAAAEAFRRRFFSGEAGPDEYQTLADLPPIPPSFEEPADGMAPAFPAEPEDTP

SEQ ID NO: 18515 - protein, 250 aa, Pseudomonas aeruginosa
SSGSARACSLSSKSIPPSRPSTTRWSSCWPRSPCWRSGSSAPALRRALCPVRRSSARARWPVLLSALPARPSLSAPPRRAWVAPWLLARVWLRPPQSWPVAVRAPPRRRPAMRSRRFRPVPPPLAAAQRARWRAWATSPRPARSPPDAPQHPVLPLPGSGWPLRSVLAGIARRPTLARQPAKPPQEKPPQEKPLHRSRNNPPGPSGCIAASNSPTPRPPPRTRCAVATVAARGKARACAAPTTNAIHKEN

SEQ ID NO: 18516 - protein, 186 aa, Pseudomonas aeruginosa
AGAGPAAARTARAGGGGGRARGAADAGAVEAIARSRGRQAHAGAGRRDGARLARQCRGPRRAHARGLRQRDSGVALHRWRAVSGLCGRGPRDRRFAPAGRGTGDGGRRRYRALDRGRHVQRQRCRSARERAGQADSLGPQDQSRHHHQPQDVPAGAGFDGKDVDGIGVLGVPARPDAGLAAPGTGR

SEQ ID NO: 18517 - protein, 443 aa, Pseudomonas aeruginosa
QGRRGANRAHGRRGAEGLTMSQDDTPDLDTPQAGKVAPESVTLRAQPRPVTRLNRRTLAVLVGGLSVAVLGATIWSLQPQRRSAGEQTELYNVDRVSKSEGLDGLPADYSKLPPKVPELGPPLPGDLGPAIVNSQQPAVAAYAAPGHDPNDALRKEAEAAAASSVFFRSGGQGQAAATVAQATPGAPGGASALAAFDPLAAGPASVATQPADPTAVQNRQDQKEAFLKAGSTETRNSGNLALPASPYQVMAGTVIAGALVTGMKSDLPGDVIATVTEPVYDTATGKFLLIPQGSRILGKYNSQVSYGQSRVQIVWNRVILPDTSSLTLDNLVGTDSAGYAGLEDDVDWHWKRIVSGAVLTTLLGVGAELAAPENRQDGNRIVIAGRDSAQDSINQVGQEITRRNMNIQPTLTARPGLPVRIIVNRDLVLRPYQPLFFNRGASQ

SEQ ID NO: 18518 - protein, 166 aa, Pseudomonas aeruginosa
GTIRRGLHMVKNRRLFTAGKRLRALRELMGLSRPQFAELVGMTAKRLENIENELQRMHDEDFEKVCGTFPEFSDWIAYEGSIEPQSIAWKVADSAQAAAVYLVERNPVLLERHGIDMQAWRERHREIREALLAAEQAPEAEPAPLEEPPEPRRQRKRKTPASGKGD

SEQ ID NO: 18519 - protein, 163 aa, Pseudomonas aeruginosa
  UNSURE (148): Identity of amino acid at the above locations are unknown.
PGERAVGSAHVAQQHEHGVLAVGLAGMDLGFHQQGRLGGALQAGGGLVGLGGGGHQQHRVTLGAALGQLAQGDAAGGGGYQFLQVGAGLTVVAGALKVAALGLGDQGVAGLGEVAQAAQPLLEHRWQDALAGRGRVGAVIDVGGRVGXLRVSGHGARQHDAGE

SEQ ID NO: 18520 - protein, 581 aa, Pseudomonas aeruginosa
LTRTRRLRTAWASALSSWTGPDSAPRGRSTRVCRGGPACHQTLGSGSRNGWNGSSRAAARSRSSRPSLRAAPRRRRLASAERRPVKVLLLRELELMIDGGLLGLGDRRGKGREGTATVRPLKHRFGRDIQPRGLWQAVVVHSSGGLHAQSHHGYRPVRRTPAGHLRRQGQSGPAAQPRRSPGEPAGPSPASVHRPRWRAWHVPPRFQRGRPPAGAATPRLSGCSTAIIGTLHSADRYPTMYTLARQLLFKLSPETSHELSIDLIGAGGRLGLNRLLTPKPASLPVSVLGLEFPNPVGLAAGLDKNGDAIDGFGQLGFGFIEIGTVTPRPQPGNPKPRLFRLPQANAIINRMGFNNHGVDHLLARVRAAKYRGVLGINIGKNFDTPVERAVDDYLICLDKVYADASYVTVNVSSPNTPGLRSLQFGDSLKQLLEALRQRQEALALRHGRRVPLAIKIAPDMTDEETALVAAALVEAGMDAVIATNTTLGREGVEGLPHGDEAGGLSGAPVREKSTHTVKVLAGELGGRLPIIAAGGITEGAHAAEKIAAGASLVQIYSGFIYKGPALIREAVDAIAALPRRN

SEQ ID NO: 18521 - protein, 143 aa, Pseudomonas aeruginosa
CLRIVSDLPERPGKPAPRRGAGARPGRGARPGVGGARTGQPGGGLSPLPVVAPGQPGLAGAGAIPGGERRVHVHGGPRGELGRPPGRRRHAGGGVQRQGLGHRQHPFRGAEGQGCDRRQPARALRPTPVGGQGQSGRARPPAP

SEQ ID NO: 18522 - protein, 513 aa, Pseudomonas aeruginosa
SEDPSGLENHRSLRRAAFMQKAAGGQPLAAFFSYCALFPRVQAQQYLVEDRRSAPRPRAVEDRHHHPVVAAGVAAEAGEGAHGVEGAGLHVRLADQCGAPQAFAHGAVEAGQRQRGDVLRCIGAVPGGLQHRRHLTGADPFLARQSRAVLHHQARRGDALARQPLPHHPLRGLGVVAVGAVAELRADGEEQLPGHGVVTVFVDVADDLDQVWREGLGDQRGVARYAALAVLAEDAAAQFLPDAAHRAGGVAGVVEQRHVGLRATALGNLSGGQQGGAVELGHRAEAQLRPGRAGGRRGHLHLVVDAYVGQRRVHLHVDLVAVGAHHHAHALQVDQQRVRTDQERLGVVAAVVVEYRQLRDVEVAAVEYQVTCDLGHAIGAQVAHQQPELLHVQFRIAAALEVEVAVEHSVLELAVGVELGLPLVGRAEHFQGGIGGEQLHGRGRVHRYVGVVVGGVARAVERNQHQRQIVAGQLVGLQGFLHVGRQGGVDLGEGGKGERQERGEGKSTQRLEH

SEQ ID NO: 18523 - protein, 248 aa, Pseudomonas aeruginosa
VSVRIFLKVYELPSSISTIWLPSISCSGEFFLNFYWQGNQTMSRILIVDDHPVIRMAMKMLLEAEGHQIVGDTDNGVDAISLGRELKPDLVILDIGIPRLDGLEVISRLMVLALPLKILVLTGQSASLFALRSMQAGAAGFVCKQGGLAELVTAVNAVASGYSYFPSSAMRPVQQGAYSDDVELLGRLSDREVSVLQYLSQGYSNKQISEQMFISNKTVSTYKARLLLKLNAGSLVDLIEFAKRNTLI

SEQ ID NO: 18524 - protein, 331 aa, Pseudomonas aeruginosa
AGARHPVDRFRLGRGQQGTAHAPAVPGGGSGRNGELHRHGGAHRRAIAGDPPLGHALQGSPGPGARPDERLDRHHRTGAPGPPVARGDAPGGRGESGEERLPGDHEPRDPYADECGHRHPRTGPAAPGAGAARTRLAGGRLRGSGVAATAHRRHPRRRQDRVRSPDPHARAGSPAPCRGVGAPHVRRPGPAERPEARCGAGRCPGTGRADRSPALQAGALQPGEQCDQVHRAGTGDDPSPGKEPGRGEGDRPGGRGGFRYRYRSGGPGAPIPAFHPGGQGTHGAGRDRPWAGDLSEVGGPHGRRCRDAQRAGQRHPGVARPALAPVRAENA

SEQ ID NO: 18525 - protein, 464 aa, Pseudomonas aeruginosa
TSNPMKIKESPGAFHAASGTLRNVCRRKAAVRTTTTASSWCVEGRAWAFLVLSLYARRLPQSMDNLNSAVQVLIHGSNTLFILLGAVMVLAMHAGFAFLEVGTVRLKNQVNALSKILSDFAISALAYFFVGYWIAYGVTFFHPAAALTVDSGYALVKFFFLLTFAAAIPAIISGGIAERARFGPQLCATALIVAFVYPFFEGLVWNGNFGLQEWLKLEFGAPFHDFAGSVVVHALGGWLALAAVLLLGSRNGRYRDGKLVAMAPSSIPFLALGSWILIIGWFGFNVMSAQTLAGVSGLVAVNSLLAMVGGTMASLLIGRNDPGFLHNGPLAGLVAVCAGSDLMHPIGALATGLVAGALFVWAFTATQVRWKIDDVLGVWPLHGLCGVWGGIACGIFGQQALGGLGGVSLASQALGSLLGVTVAFAGGLLVYGLMKALLGIRLSQEEEYYGADLSIHKIGAISHE

SEQ ID NO: 18526 - protein, 135 aa, Pseudomonas aeruginosa
QGEELPVLVRHEGADRAAAEAGDLFANAGAFLDRQFAGVEGTLFLAHAASCRATGRASGCSRAARGCGRSRRSAPGSGPAPGRLRGRGPGRGRGPRRRCSAVRPGPASDARPGAGRPGAALPGLAGGFARDPAAG

SEQ ID NO: 18527 - protein, 432 aa, Pseudomonas aeruginosa
AGAPGAGWRPRAGGRPAGRPGPAAVAEQRHGRLRLAPRRLERRATAGQPEDLCRTGAEAAASGYLCADLHRCAAARRRRSGRDAGKRRSARRWPRALHPAVARGPACAPAWPGNPPGRPGPAGRHAPALHRTGVGGFARLRGPGGATQAAGGAAVHRRRAGRGGPAAAGRADLQQQPSVAQGLAATPGLRRARRRHPSRRPGTYSRAPGRVGRGGPDPVHRRRIGGRGRLPRHGAARSRRADPLEAGDKTRQAADRRPVPGHPGDRPAGQSGFDPGHLRPAGASLPAAPAWRGAGRAAAGGGTGRLCLDQGGAASRVPAWSPGAGPRGALSEPEFRGTAQRFLGRGAGGGPRGTYPRGRRGCGVHSAERTARLSRRWPDGRRSHCAAGSLRRCRYSPGVCPVQPLKLRWNERDSVKPRYWAMSWIGSSLCSR

SEQ ID NO: 18528 - protein, 812 aa, Pseudomonas aeruginosa
GTLRDHFLGEGAGLAAGRGRALLQRLPAELAAGPASHPRAGTGARAAVDAATVQRRGNHDPTGPGRPSRTDRLAGEIPGAARRGRGQVHADLRRDRQPPAERIVAEPGEGLAETLRRGLHRNPAGAQVGAEPLPLPLPARGPVAGGLRRGHPGDRHRLEQRRRPAAEDRGQPARRPGGRGREGPCVHPPLACLWRGVEHLYHLRVPSGRELCGDAGALEASQACGQPGDRRQSRHHQPPAWRRQGPRTLPAPREGRTGRRRAACHGRSLRPGRAAQPRHPAAGLSGMTSAWNEEWRRRRLPALAGQEWDLIVVGGGISGAGILREAARRGWRCLLLEQRDFAWGTSSRSSKMVHGGLRYIAKGQWRLTRDSVRERQRLLGEAPGLVEPLSFVMAHYRGGFPGPRLFGGLLSVYDALAGRRNHRFYDAAALRYLAPGLKEQRLLGGTRFFDAVTDDARLVLRVLAEARHDGGEAFNGMRVRELLREGGQVVGLRAEDRESGELFDFRCRALALATGAWADELRQPGGSEHIRPLRGSHLLLPAWRLPVAHAFSFMHATDRRPVFVFPWEGATVVGTTDLDHRDGLGEDARISRAELDYLLAACAQQFPAAAIEARDVLSTWAGVRPVVSSGDDSGKPSDEKREHVLWREPGCVTLAGGKLTTFRPLAVEVLQACAPLLGRTVTDDGAAVFGACEGPLIDGLGSGQRRRLAGRYGRDLVRLKRLVDTLGTDCVGASETLWAELAFAAEAEMVLHLDDLLLRRTRLGLLLPGGGAAYLPRIRALCQARLGWDDPRWEREQQAYLDLWRRQYSLPV

SEQ ID NO: 18529 - protein, 205 aa, Pseudomonas aeruginosa
AKTRPRRGVRFDGQGQGSAGPAWQAGGQRRGSCRGRGAARGRTGAGGASNLGGRRRPAHRRGGAGGRLCDAGRRRWRRHAARGGRSAGARARRGEPGDPAAGHRQRFRPRRRDSPGTGRGAGAARPDGAADRPGRGERQAVPQHGHWRLRFEGHGEYLGGPEEGSRRCRLPVDRVDPFFRSACRPGPFQRPGLPVGRRVPRPGHR

SEQ ID NO: 18530 - protein, 462 aa, Pseudomonas aeruginosa
RAPGRRRARTVSASASGRRPAGREHPADAAGHGRYPGHPARRWQRSGKPVRPRAGAMAGSGGGGRSRRQSRRRAAGRTQAAFLGFPGRAARALAGRFAVVARAAARGLRAGPTDPLPGVASVSCRPFPRHRITASFHQGCWFHVPSLRAVPLSDQVFRRRVPGARRARCAGRGRRPTLDGGGHRNRTFLHPAPAAAAGAYPGALGGAGGPAAECAGDVRAEPRSTGSRRQPAWRHGLARYLAGAGCRRRRSGLADALPRPPDAPGAHSRGARAAGRYRLRRTGAEGAFRRRFPAAADRPGFARRPQPAGRPAVGDAALPSQPGGGRQRRVRRGRLETHPHRLGRVRRGQALFPLHPHHPGSGDRRAQRGPRAADDPEDLPGKGWRGAVRAEPDCAGTGQPGGGDAGGNPRLRNGRPPLRRAAIAGDQSLASTQPVLRHSRSRSRRKSRRWRVFSVAQSRLTK

SEQ ID NO: 18531 - protein, 566 aa, Pseudomonas aeruginosa
PGAPLAGPAGTRGARWLAPAATGGQHPQPPAVAGRQDPRRTLRRLASARAAGPGAGRRAGPAAARRTDQPPGHRRHRLARGSAAGLQRRGAVHYPRPRLPAIPGDPHPRAGSWPPDRLERRLRQFPGAQGTATGRRRSCQRIVRQAPGPGRSVDPPGHQGPPHAQRRAGSGTEGNASRTRRAPRAPGQGQLPAGKRGQVRQAGDRGGARQLRPSRRPAAGTRLLHGPAARRPYRPARRQRYRQDHLAQAAAWRPAADLGQDRGGHQAGSGLLRPVAPSARTRADGDRQYLRRPRVHHHRRPEPACAQLSRRLPVQSAARPHPGEGVVRRRARAPVAGQAVQQAGQPAGARRTDQRPRRGNPGTAGGSPARLPGHRADGQPRSGLPRQRGDQHPGLRGRGQGSRIRRWLPGLAAPRGHAAPARRERVEERQGRAEYRAGARRRTRAGCCGAERGAGEEKAQLQVAARAGGFARADRRGRGGAGGCPGNHRAAGFLSAPAGRAARNPGAAGRVAAGTRCLARALGRTGRLIHLEKVSCINVIAAHLDDPCGPCRRWVQSPVGPSGWRH

SEQ ID NO: 18532 - protein, 239 aa, Pseudomonas aeruginosa
RAGRLPRKDQSMAIEYRITLDDQHQLNYRIELERHYDPQAAAAAPRWTRLEHNRCSNCPLDRERYSHCPAAVDLHGVIEDFRNLPAFRKAGICVRTPEREYIKQAGLEEGLRALIGLIMASSACPLLAPLRPMAMQHLPFASNQEFVLRVVPLYLMRQYFNFREGRHADWELKGLVRLFQQLQLVNQAFWQRIHDTCVSDSNLKAFLTFFSLSSSISYSLETQLQKIRPLVMSAEETLG

SEQ ID NO: 18533 - protein, 133 aa, Pseudomonas aeruginosa
RRRVDRLGQGKQGRGRPEGRRRRRRGRSRATAGRCPRPGQARRRRRAGPQGTAPAEAGKAEAECNRADDGLRNRQGLRRRPGRSELPGAGGSHQEHPEGRQLRPRQGAGSRSRRLRQAGQDLGRAESDRPVPE

SEQ ID NO: 18534 - protein, 232 aa, Pseudomonas aeruginosa
NRHRHHRRLRQEDGQEPDRGQRLPRLPGQPCAVPVLRRLRQAAELRRRLRAHRQGDGEVRLAHGPGLPVRRGRHRHRPPWPRRHGRGLPGPHGGRGQDRRRRDVRGQPPGPEERQGLLRLRDRQARQAEEGHRSAGLRSAQADRGRAARSDRRGHRQLHDDPAVPGNRALPGRRHRRDRCRGRYGPDLRHRLPALPWWCSALHRFDRCRRVRGPGRQVRRAGRAVPPDREAA

SEQ ID NO: 18535 - protein, 139 aa, Pseudomonas aeruginosa
SRASATSVTCPPVVRRVPRSRRPRAARAPPRRRRCHRRRRPGANWSRAWGSTPSMAGRPSTRSCPARKRSSTSCAAWPRTPTPSISRPTWTAKGRPSPGTCGKPSAATKAATSAWYSTKSPRRPSRRPSPSPASSISTG

SEQ ID NO: 18536 - protein, 82 aa, Pseudomonas aeruginosa
FPATRSPRTTRASPSRGCCVASIAARSAVPRWTPTCWTRNTSCISAAITPTVRATRSRKASTGSRATKGRAWNATSVAARCS

SEQ ID NO: 18537 - protein, 188 aa, Pseudomonas aeruginosa
PGLRSAFLPVLIGSTGMAQELYTRTNQKLYFAGLALEAWKRADAERAMNAQAIIQGERESALFHLYGAVLGVCHEIAGYYRLPQAAAPRVDALLNAEVLAAAPSPELAELVELASQPETWLGQLLGAYSELFLPPRPTKAAKIDPSTPLIVAVSIDEEAPLLSRETLEEWRQSLKQLVLRFRESLTEL

SEQ ID NO: 18538 - protein, 271 aa, Pseudomonas aeruginosa
HRRARVRRCWPRTLPGTVATGRWAASGRSAWYLLSAPDHADAQAFDDQFLLLQIDFDRSELRVFRQQPDLAAFALEAFHRDLLADPRDHHLAVARFAGDVDGQQVAVEDADVLHAHAAHAQQVVGARIEEGGIDTAGFLDVLFGEDRCAGGDPSDHRQALIVVGGMRFEAGNADAARGARSHFDGALACQRLEVLLGGVRRLEAEFLGDFRPGRRKAVVFQAALDEGEDLGLAGRQLLHVVALCFYPVTGIIYSERGVAMIFRMTFRPASR

SEQ ID NO: 18539 - protein, 277 aa, Pseudomonas aeruginosa
SWPVSCFRFSGLLCNFPDWCVICRLTRDVAETYVSNKCLSGGETMAQSETVERILDAAEQLFAEKGFAETSLRLITSKAGVNLAAVNYHFGSKKALIQAVFSRFLGPFCASLEKELDRRQAKPEAQHATLEDLLHLLVSQAMAVKPRSGNDLSIFMRLLGLAFSQSQGHLRKYLEEVYGKVFRRYMLLVNEAAPKLPPIELFWRVHFMLGAAAFSMSGIKALRAMAETDFGVNTSTEQVMHLMVPFFAAGMRAESGIDDPLLAGAQLRPRNKTPAKA

SEQ ID NO: 18540 - protein, 399 aa, Pseudomonas aeruginosa
SQTAPQGAVFLSPFSVLRAELHAPGRLHWQARGTAPGLKSFCRVQYSVRCLRPVTAGFADFQAIGLFMQGSLMLDIGGTWLTAEDRQILRHPEVGGLIIFARNIEHPAQVRELCAAIRAIRPDLLLAVDQEGGRVQRLRQGFVRLPAMRAIADNPNAEELAEHCGWLMATEVQAVGLDLSFAPVLDLDHQRSAVVGSRAFEGDPERAALLAGAFIRGMHAAGMAATGKHFPGHGWAEADSHVAIPEDARSLEEIRRSDLVPFARLAGQLDALMPAHVIYPQVDPQPAGFSRRWLQEILRGELKFDGVIFSDDLSMAGAHVVGDAASRIEAALAAGCDMGLVCNDRASAELALAALQCLKVTPPSRLQRMRGKGYANTDYRQQPRWLEALSALRAAQLID

SEQ ID NO: 18541 - protein, 321 aa, Pseudomonas aeruginosa
SLGGLRCQALEQRLQGIEAFFRSFHGHLEAEQGCAFELVAVRLALDQLDQYQRVDLGIGGEFYTTALRSGIDLEYSKFFRLQFQKGQAHQVLRRIGQEPEAVDHLHLQLAQTFLVRGVGDALVKDQPGMHVGQVILGDQRRHPQVDLRPAAQWLLEVRLLALADGLHRPFEHFHVEGEADRLDLPALAVAEQLAGRRGSPSRGWRGRNPAPRSWAFGDGFQAFLGVRRHLTARRCQQVGVGLVVAATDAAAQLVQLGQAELVGALDEDGVGAGHVDAGLDDGRGHQHVEALVVEVAHHLFQLALVHLSVADADARLRDQFG

SEQ ID NO: 18542 - protein, 707 aa, Pseudomonas aeruginosa
PRSVLDFLGALEAAHHLDAHRPVGEAVAEAVVVLLGEQGGGHQHRHLLAAMHGDERRAHRHFGLAEADVAADQAVHGPGREHIGDHRLDGALLVRRLLEREAGREGRVVGLRILEREAFAGGAAGVDVEQLGGDVADLLGGLALGLLPGFRAEPVQRRQGVVGAGVAGDQVQVGDRHVELGVLGVLQHEEFRLLVVHLEGDQAQVAADAMVDVHHRRAFAQLGEVLDHRVAAVAGLFPAPALHDALAEQRAFGDQGEGRMVQQQALVQRRDADRQACLAGEEGRPAVDFLGAQLQSGQQLQQDFPASGRFGAEQYAAGELLDEPAQRGQRLGGLGFDRQVRQRQGREALAPDARLDVLLAGDHPWPVLQPGEAVFHRKEHFRRRQQWPFRIDPAVLVAAAYVIPELLRGLFDAGQGEHLGVLRQVVEEGRGFLEEQRQVVLDSRGCQTAGEVLVDRAAPVVDVEALAEAAAEAGDRFLVQGEFACRQQADRLDLVDGALGLRVEGAQGLDLVVEQVDTEGQLAAHREQVDQRAADGELAVLVDRVDAAVAGAFQAQAHPLDVEFLADVEDQAAAEQEAGRRQAVQGGGDRHHQHAVLELRQLVEGGDALGNDVLVRRKDVVGQGFPIGEMQYRQVGGEEPQFLFQAFGILAVGGQQQGEALGGTGGLGDSQAQRGTGEVAPVLLAGAGRQAGKTQYGHGQAGLRSGI

SEQ ID NO: 18543 - protein, 382 aa, Pseudomonas aeruginosa
RPQHRGLRQGRAGRGGRQAERRCPRRHRRRALRLRPHRPPAGAHPDREDRRRRRPAPARDRRAQGCRERPGQAGQPAASGLGARSVRRHHHHRRRKQHADRQRQPDPGDLLQRSSVDRLHPVRHQERPAGRQHRQVARRRRPRPAPEVPGDRSRGPYRSGQGCAEEHRARYQPHRHRRRRQDHLGRLLHHQRHRAGAEGRQRPVRHRQRSRRDRSLVHQRPEPDRQLPQGQSSWPQRAAEHGDHRDRCRHRRGQGPAGAERQADRQCDPRADAERVHGDPQPEPGKGHHPRRDQRVPAPDGHALGPAEADRLRQLPGSGFHRLRRFAPCRRGGRRGDHLQRQPCRPVRVVRQRVRLQLPGSARDGRHGWGQPAGLPALMRKA

SEQ ID NO: 18544 - protein, 472 aa, Pseudomonas aeruginosa
GFSMDGQHLHQGELKRGLKNRHIQLIALGGAIGTGLFLGSAGVIKTAGPSMILGYAIGGFIAFLIMRQLGEMIVEEPVAGSFSHFAHKYWGGFAGFLSGWNYWVLYILVGMSELTAVGKYIQYWWPDVPTWATAAAFFVLINAINLANVKAFGETEFWFAIIKVAAIIGMILLGIYLLVGGGGGPQASVSNLWDRGGFFPNGLSGLVMTLAIIMFSFGGLELVGITAAEASEPRKVIPKAINQVIYRILIFYIGALAVLLSLYPWDQLVETINASGDDYSGSPFVQIFSLIGSGTAANILNFVVLTAALSVYNSGVYCNSRMLYGLAAQGDAPKVLMSVDRRGVPVLSILVSALITFLCVIVNYVLPHKALELLMSLVVAALVINWAMISLSHLKFRAAMKRQGVDTFFKALWSPFSNYLCLAFVVFILGIMLMIPGINISVYAIPFWLLLMWLCYRVKLSLAERRGLGQQA

SEQ ID NO: 18545 - protein, 448 aa, Pseudomonas aeruginosa
ALDMIKIKRGLDLPISGAPEQRIEAARPVRSVALIGFDYHGMKPTMAVQVGDRVKLGQVLFTDKKNPSVSYTAPGAGVVSAIHRGEKRVLQSVVIDLDGDEQLEFARYPADKLATLSAEQVRDNLLQSGLWTALRTRPFSKVPDPESSPSSIFVTAIDTQPLAADPQVVIAEQGEAFQAGLTVLGRLARVFLCKAEGVSLPGEALSGVTAQAFSGPHPAGLPGTHIHFLDPVGAGKSVWNLNYQDVIAIGKLFTTGQLWTERVIALAGPVVEKPRLVRTRLGANLDELAAGQLQPGNNRLISGSVLGGRTAHGAYAYLGRYHLQLSCLKEGDQREFLHYLRAGVEKHSLLNVFVSRLLGGKRFAFTTSTNGSPRAMVPVGNYEAVMPLDILPTQLLRYLIVGDTEMAQKLGALELDEEDLALCSYVCAGKYEYGPILRDNLARIEQEG

SEQ ID NO: 18546 - protein, 404 aa, Pseudomonas aeruginosa
AMGLRNLLDKVEHHFEKGGRYEKWYPLYEAVDTFLYRPGSVTRTTAHVRDGIDLKRMMIIVWLCTFPAMFFGMYNVGHQANLIFAQSPDLLSAQDGWRFALIGALAGFDPNSLWDCLVQGAAYFLPVYLTTFIVGGFWEVLFASIRRHEVNEGFFVTSVLFALTLPPSVPLWQVALGISFGVVLGKEVFGGTGKNFLNPALVGRAFLFFAYPAQMSGDAVWTSVDGFAGATSLSLAAAGGVDNILGHGLTWMDAFLGHMQGSMGETSTLAIFIGGAVLLLTRIASWRIVAGVMLGMVAMSYLFNAIGSASNPMFAMPWYWHLVTGGFAFGMIFMATDPVSASMTDTGKWLFGALIGVMVMLIRVVNPAFPEGMMLAILFANLFAPLIDHFVVQANIKRRLARNG

SEQ ID NO: 18547 - protein, 482 aa, Pseudomonas aeruginosa
SRIHHPHTAGSPGGVPGQLGVRHWRGGGAEADPGGKPPARQAAQHPRHRWSRRAGHVRQRGQGAVRQSHHRQGGRPPERHLQRCPGPARLGPAESGQGPGAVGCAARRRGHRLDQAPRALYHGLPGGDRRQARHPDPAGARLRSVVDPLRLPGAQGRPQYGRRLRLLPAWRDPRSRRRGRQSEMEGAVGRQDPLRRPGRSCRTDHQGLGGPAIGEGDPPGRRPGRRHPDQQGCRQPAAFLARQGRFRRLPRQSAQRGGVMAAQPTIREVLFNPVFQNNPIGLQILGICSALAVTSNLKTATVMAIALTLVTGFSNLFISMIRRQIPSSIRMIVQMVIIASLVIVVDQVLKAYAYSLSKQLSVFVGLIITNCIVMGRAEAFAMANPPLVSFFDGIGNGLGYSAMLLVLGFVRELFGAGKLYGISVLPTVNDGGWYQPNGLLLLPPSAFFLIGLIIWALRTWKKDQVEAPTYKMAPQVSSKEAY

SEQ ID NO: 18548 - protein, 424 aa, Pseudomonas aeruginosa
CRWASCRSPACSCKERPVIGFEIFLAIGMFTAIVLGLVAIILVARAKLVSSGDVTIQINGEHSLTVPAGGKLLQTLAANNVFLSSACGGGGTCAQCKCVVVEGGGEMLPTEESHFTRRQAKEGWRLSCQTPVKQDMQIRVPEEVFGVKKWECTVESNPNVATFIKELTLRLPDGESVDFRAGGYVQLECPPHVVEYKDFDIQPEYRGDWDKFNMWRYVSKVDETVIRAYSMANYPEEKGVVKFNIRIASPPPGSDLPPGQMSSWVFNLKPGDKVTVYGPFGEFFAKDTEAEMVFIGGGAGMAPMRSHIFDQLRRLKSNRKISFWYGARSLREAFYTEEYDQLQAENPNFQWHLALSDPQPEDNWTGLTGFIHNVLFENYLKDHPAPEDCEFYMCGPPMMNAAVIKMLTDLGVERENILLDDFGG

SEQ ID NO: 18549 - protein, 268 aa, Pseudomonas aeruginosa
RRPSTPAHRRPAPVQGRRRTAGLRQHRRWLYGGRGRRTPEGARRAQLPGGNHRRVESRRAQAGRHALAHRYRSAARGPAGRPAGTGAGRLRRLDLGRLPQLFRRERPALFAHLRPAHRRADRPSPGFGHGDRSVDAQRRRPVDPADGARSGGGLPFRREAPTGGAVRQSPGQRFRQPHHATLRATVRQPRRTSMTWLLVFVIMLLVVFGMSIGVIMGRKPIAGSCGGIANLGIEKECSICGGDRQKCEEANRDESVVPGKLAYDATKR

SEQ ID NO: 18550 - protein, 417 aa, Pseudomonas aeruginosa
CSTMSCWSAARPWSSASSPLCIQPGVRRAPSLRRLCVMNDKSVLSCRNLSKSYDEGPQSVQVLSGVELNLLPGERVAIVGSSGSGKSTLLNMLGGLDTPSAGSVWLAGEELSALNETARGLPRNRALGFVYQFHHLLPEFTALENVCMPLLIGRTPIAEARQRAAELLERVGLGHRLFAQAGRAVRRRAPAGGDRPRDGQPSAAGTARRAHRQPRPAYRPGYPGADAGTEPFVADLVPGGNPRSPAGRAHGSHPAPGRRPTDRRVAGRRRARRPLPSGESPIDSVHPRHVQTVTVLHRPALHPRQTPQPLHLVHLADLDDRPGAGRAGDDHRALGDERLPEGNAHADPRHGAACHHQRGAAAGRLADRRQRGASAPRGGRRGAVRRTAGHAVVQGQYAAGAGQRHRPAGGAQGFHRR

SEQ ID NO: 18551 - protein, 351 aa, Pseudomonas aeruginosa
AHRPGQPGRPQAWRVRHRPRRDHRAALPCQCRRQADPDRPGSHQRAGRHHSAHAALHHRRPVQGRCRTGQLAGADRHRRCRPVAAPATGPGAERAPGAEGSLPVAAGRRQGGQGVGAGLQVQRLDQDPGQPVQRDEDGKDHDRPAPAADHRGRRLQHHRHPDHGGRRQAHRHRDSSYPRRHAAADHGDLHGPGHRHRRDRDGHRRGTRGVRGVEHHRDDRPHRTVGRTQGLQLGCVLHQLPAFRSAGAGRGADLQRCIADELPRHPVPILARGADTTGRVAALRVSEKACASPSTGRTRPTKKPPSRRLFHVRRITSRRPVRDVAGSVGSNCAAPTSASRASSARSRGWRR

SEQ ID NO: 18552 - protein, 382 aa, Pseudomonas aeruginosa
IGGRQQPAGGDQRRCQVHPPVGGHGDGRSGQAGLRPPAHHHGREHGGQALMSFSERLLAAWYQGHPALALLRPLEALYRRVANGRRADFLSGRKPAYRAPLPVLVVGNITVGGTGKTPMILWMIEHCRARGLRVGVISRGYGARPPTTPWRVRAEQDAAEAGDEPLMIVRRSGVPLMIDPDRPRALQALLAEEQLDLVLCDDGLQHYRLARDLELVLIDAARGLGNGRCLPAGPLREPAERLESVDALLYNGADEDPDGGYAFRLQPTALINLQSGERRPLEHFPAGQEVHALAGIGNPQRFFRTLEALHWRAIPHAFPDHATYTAAELAFSPPLPLLMTEKDAVKCRAFAAADWWYLAVDAVPSPAFVAWFDARLEHLLAR

SEQ ID NO: 18553 - protein, 328 aa, Pseudomonas aeruginosa
PAAVPPLYEGLRHGPETPRYPCLPVDQGPAGAQRRQDRTDQQAGRPGLSDPRRHPGDAGERGSLPERGRAAGQVMTQAFTVVIPARYASTRLPGKPLQDIAGQPMIQRVWNQARKSAASRVVVATDDERILAACQGFGAEALLTRAEHNSGTDRLEEVASRLGLASDAIVVNVQGDEPLIPPALIDQVAANLAAHPEAAIATLAEPIHEVSALFNPNVVKVATDIDGLALTFSRAPLPWARDAFARDRDSLPEGVPYRRHIGIYAYRVGFLADFVAWGPCWLENAESLEQLRALWHGVRIHVADARETMLPGVDTPEDLERVRRVLGG

SEQ ID NO: 18554 - protein, 166 aa, Pseudomonas aeruginosa
PVQAGAGSLADPPRAPAPDAAGEAAPGLRAGTPAPGGGGHRQSDGQGRKPGNLRHSPGEAARPRRIGQCRQLLQEPAGGCGAGRTLASGLPGSGRLSAGGRSAEAGCRLAHRQGRLEGFPRWPGGGTRAAGAGPGQPWRRHWCPGPGIGRAYPGGRPSAFRRRIGA

SEQ ID NO: 18555 - protein, 356 aa, Pseudomonas aeruginosa
AAASAAAAASRARRSASRCRRRFSRGSLRARPVALAGTAAMAGVGSSVAAGSLGAATSTGTGAATSSAASVAGCTALSASSRLSTLSLAKGASSVACATSRVLWSASSRTTLTVTGASMSAVSPVLASLSASWVSTASLVDASVSSLAVVSLAASLVVAGACSTFASTASLATAIPAAAAAATVFSGAAALSVASLPSTSPLTSRWRSRRLLRRRWPRERRRGRSPSVSSCSSCSRLSSFGNASASRAAASRAWRSSRGWRSSRAGRSTRSSRPSRGWRSSRAGRSARSSRRRSLRSSRPSRPSRGWRSSRGVRSARSSRPSRGWRSSRAGRSARSSRRRSLRSSRFGRSARSSRG

SEQ ID NO: 18556 - protein, 230 aa, Pseudomonas aeruginosa
MTDYALLVFDWDGTLVDSIARIVDSMKAAARETALPERDDTRIKGIIGLGLPEAIASLYPEVGDPALVERFRCAYSEHYLAQEAQPSRLFPGVAEAMVHFREAGFRLAVATGKSRRGLDRVLAGHGWSDFFDITRCADETASKPDPLMLHEILAHCRVEPGRALMIGDSPFDLEMARRAGMDSVAVAYGAQSLEQLRPYAPRLEVEHFTELRAWLGGARREAVSGVVEHV

SEQ ID NO: 18557 - protein, 62 aa, Pseudomonas aeruginosa
SIMAVQQNKKSRSARDMRRSHDALESNALSVEKSTGEVHLRHHVSPDGFYRGRKVVDKGSDE

SEQ ID NO: 18558 - protein, 337 aa, Pseudomonas aeruginosa
SLSAPIIAIDAMGGDFGPHCVVPASIAFLAENSSSQLILVGQPALLEELLSRYPSLDRQRLRVHAASEVIGSDERPSQALRGKPDASMRVALELVRDGRAHACVSAGNTGALMALSRHLLKTLPGIDRPAMVTAVPTEKGHCHLLDLGANVDCSAEHLYQFAVMGAVAAEALGCVSPRVALLNVGTEEIKGNQQVKLAASLLQKAQGLNFSGYIEGDGLYRGEADVVVCDGFVGNILLKASEGLAAMVSARIEQRFRDGLAAKLVGALALPLLRRLRGDIAPARYNGASFLGLQGIVVKSHGSAAEEGFQSALRRAALEVRENLPQRLHGRLEHLLL

SEQ ID NO: 18559 - protein, 347 aa, Pseudomonas aeruginosa
CVTGRSRQPSNTQFPAPVAAGALSPTSKRPQGTYSMSASLAFVFPGQGSQSLGMLAELGAQQALVRDTFAEASEALGYDLWALVQNGPEEHLNQTDKTQPAILTVSIALWRLWLAEGGARPAFVAGHSLGEYSALVAAESLAFADAVKLVERRGQLMQQAVPAGQGGMAAILGLEDADVLAACAEAAQGEVVSAVNFNAPGQVVIAGAAAAVERAIEACKARGAKRAVALPVSVPSHCELMRPAAEQFAASVESLQWQAPKIALVQNVSAAVPADLDTLRRDLLAQLYSPVRWVESIQLLAEKGVTELVECGPGKVLAGLNRRCAKGINTHGLDGVEAFAATRAALA

SEQ ID NO: 18560 - protein, 421 aa, Pseudomonas aeruginosa
NEKEEVVVSRRRVVITGMGMLSPLGLDVPSSWEGILAGRSGIAPIEHMDLSAYSTRFGGSVKGFNVEEYLSAKEARKLDLFIQYGLAASFQAVRDSGLEVTDANRERIGVSMGSGIGGLTNIENNCRSLFEQGPRRISPFFVPGSIINMVSGFLSIHLGLQGPNYALTTACTTGTHSIGMAARNIAYGEADVMVAGGSEMAACGLGLGGFGAARALSTRNDEPTRASRPWDRDRDGFVLSDGSGALVLEELEHARARGARIYAELVGFGMSGDAFHMTAPPEDGAGAARCMKNALRDAGLDPRQVDYINAHGTSTPAGDIAEIAAVKSVFGEHAHALSMSSTKSMTGHLLGAAGAVEAIFSVLALRDQVAPPTINLDNPDEGCDLDLVAHEAKPRKIDVALSNSFGFGGTNGTLVFRRFAD

SEQ ID NO: 18561 - protein, 328 aa, Pseudomonas aeruginosa
MADIYPWQQALWSQLGGRAQHAHAYLLYGPAGIGKRALAEHWAAQLLCQRPAAAGACGECKACQLLAAGTHPDYFVLEPEEAEKPIRVDQVRDLVGFVVQTAQLGGRKVVLLEPAEAMNVNAANALLKSLEEPSGDTVLLLISHQPSRLLPTIKSRCVQQACPLPGAAASLEWLARALPDEPAEALEELLALSGGSPLTAQRLHGQGVREQRAQVVEGVKKLLKQQIAASPLAESWNSVPLPLLFDWFCDWTLGILRYQLTHDEEGLGLADMRKVIQYLGDKSGQAKVLAMQDWLLQQRQKVLNKANLNRVLLLEALLVQWASLPGPG

SEQ ID NO: 18562 - protein, 129 aa, Pseudomonas aeruginosa
NPADIRLAGTCMSLPPNLGPRNGILSLTIKDKSVLYAAYMPFIRNGGLFIPTNKNYKLGDEVFMLLNLMEEPEKIPVAGKVVWITPKGAQGNRAAGIGVQFNDGDNTARNKIETYLAGALKSDRPTHTM

SEQ ID NO: 18563 - protein, 146 aa, Pseudomonas aeruginosa
ACTSKGRAPSCWIASMQNSTPRRRHPAPMRSRSRRRPLAYCTALIDSRRVRGPQAASRALSGSSPARPTSTTSTPRGRKASQTTLLEGNSSLPMTTWSPSRQSRPKATKESASEVFLTRARSLPARALSSRARRSRRRCSIFSHSG

SEQ ID NO: 18564 - protein, 217 aa, Pseudomonas aeruginosa
PDSLFMQKEPRKVREFRRREQEILDTALKLFLEQGEDSVTVEMIADAVGIGKGTIYKHFKSKAEIYLRLMLDYERDLAALFHSEDVARDKEALSRAYFEFRMRDPQRYRLFDRLEEKVVKTSQVPEMVEELHKIRASNFERLTQLIKERIADGKLENVPPYFHYCAAWALVHGAVALYHSPFWREVLEDQEGFFHFLMDIGVRMGNKRKREGDAPSA

SEQ ID NO: 18565 - protein, 134 aa, Pseudomonas aeruginosa
SPATWPTAPTTTCATPGCSITAPASAATTGGSRPTPSSTSARARSCRRATGTRGRTWWPSRPSKVSSSISRWCAAPRRRSAWTTRCARRVPPALTTCCTAVSPGATTGSATGRSGKTKRNSAGSGAIAVSSRSC

SEQ ID NO: 18566 - protein, 195 aa, Pseudomonas aeruginosa
TVEEQAMSDTGKANDLLAQIPRGEKKGLPPVHLWNPPFCGDIDMRIARDGTWFYLGTPIGRKPMVKLFSSIIRRDGDDYFLVTPVEKVGIRVDDAPFVAVTLQVQGEGGAQVLRFATNVEDEVEADAGHPLRVEIDPRSQEPTPYLRVRDNLEALVHRNVFYQLVELAVPRRIDGIEWLGVWSHGEFFPLGPQPD

SEQ ID NO: 18567 - protein, 454 aa, Pseudomonas aeruginosa
QAQHEKRLPREPFSFALHVGVVRPAGTFRRHPGDVLRRVLDVAGLAVHAVLRVDLEALAAVVVGHHFVHACRAVALGRLVVERQVLLDRNARIGQLEVDRLVFLVVGIGEEHRGQLVEAELAVRLRVVDLRRFAGLFQAGVVRLVVMQGDGDLAAEDVLVDEVERAAADSAELVDGRAEVAAAEQFVVQPAGLERIDVAGQLVAAFAAGGQGLGDRVGGEHAGLHRGVAALDLGEVQGAEVTTDQRAAGEDHLRQRIQAALADGPGAVGHALAAFQVLLDHRVVLVALELVERRQVRVAVGQVDDQADEHLVVLQVVEERAAGIFVVQRPAGGMDHQAGLVLGRVDVPDFLDADTVVLGIGLAVQVVFLDQLLADVPAAAFGEQGVLGPQLHAGGVVAFFRVAFAVDAEVAGDDAADHAVLVDQRFLGGEARIDLHAQSFGLVGPASGRGCPGR

SEQ ID NO: 18568 - protein, 309 aa, Pseudomonas aeruginosa
NRHSRGGNHPFAVLTEKGDPVKIRAVLRSLSIRVSVSGRRASPARPVWRHPYSPENNEESMKVLVAVKRVVDYNVKVRVKADNSGVDLANVKMSMNPFCEIAVEEAVRLKEKGVATEIVAVSVGPTAAQEQLRTALALGADRAILVESNDELNSLAVAKLLKAVVDKEQPQLVILGKQAIDSDNNQTGQMLAALTGYAQGTFASKVEVAGDKVNVTREIDGGLQTVALNLPAIVTTDLRLNEPRYASLPNIMKAKKKPLDVVTPDALGVSTASTVKTLKVEAPAARSAGIKVKSVAELVEKLKNEAKVI

SEQ ID NO: 18569 - protein, 412 aa, Pseudomonas aeruginosa
LLNVLFRHLATEVFMIIKPRVRGFICVTTHPAGCEANVKQQIDYVEAKGPVVNGPKKVLVIGSSTGYGLAARITAAFGSGADTLGVFFERPGSESKPGTAGWYNSAAFEKFAHEKGLYARSINGDAFSDEVKRLTIETIKRDLGKVDLVVYSLAAPRRTHPKSGEVFSSTLKPIGKSVSFRGLDTDKEVIKDVVLEAASDQEVADTVAVMGGEDWQMWIDALLEADVLADGAKTTAFTYLGEKITHDIYWNGSIGAAKKDLDQKVLGIRDKLAPLGGDARVSVLKAVVTQASSAIPMMPLYLSLLFKVMKEQGTHEGCIEQVDGLYRESLYGAEPRLDEEGRLRADYKELQPEVQSRVEELWDKVTNENLYELTDFAGYKSEFLNLFGFEVAGVDYEQDVNPDVQIANLIQA

SEQ ID NO: 18570 - protein, 206 aa, Pseudomonas aeruginosa
IAAARTVRGPVGQCRPGDPEQGRPARRRGPGAGPRGDRRGAAGGSEDRRGEPGRAAAAGLAGTQRRGRAAHRRPADPPRPRRPRGPRPRRVRLLPRRSPRGGGSCAARGPRRAGGASRHTSHQGFRRHSGQAHAPVGTGRRQALRQAFRPQVAGRRSPQHPAGGDRPGAGPGRHCQPAAHSACLIRDPRPGPAMAIRRPQLLASYR

SEQ ID NO: 18571 - protein, 153 aa, Pseudomonas aeruginosa
PARGGSAIRWCARRSPPSSAGRRSSRRPAVAGVRWPAAGRGAACPASVAGIAPGRRPCRRCHPGAGRRRGPSSPPWCVAFPRRRASPGATGRRVRRSARRGVRRIRGRSGDRGSNRDRLPPAGAGRRRRGWRGWRRGWRRPGWPAPAATAGGP

SEQ ID NO: 18572 - protein, 85 aa, Pseudomonas aeruginosa
ASRIPWAPLGYQAPEWLNQYPKKYAARGACGARARNDKPGREALECRCGWRVCGMGFSRERVPSLLQARRPVQRLFHGSIPAPPA

SEQ ID NO: 18573 - protein, 330 aa, Pseudomonas aeruginosa
TWRSVFPSVRRRNPHERYRALPPVRRGRRRRTEAGAVPGRGRSGDRRGTDRGAARNGQVDPGAGRRRTAAGGRVRYPAAGRQRGAHRRQPRPGRRPRRRSRAVFPRRAGQGRRRRALRRRSEPAAGPPGGLVARRRRQRRQPGRARWHFPPASGAFRADRHDEPGRGRTAPATARPFRPQRASRHPAAAGRAGRDHPSPAGLRCRPAGLRRTLGRPAGHPAPPLRRGAPAAGADSPGRCGAGQHRSTLLRGGCRWPARRPGLAARGARPCGLARRRADRGGGHRCGGTFRPAASPSPVEPATIGGQSTATARGGPCRAPGAHRQRRRAVG

SEQ ID NO: 18574 - protein, 243 aa, Pseudomonas aeruginosa
IAGSAGGHGDRPRAAALAKKALSIRPRSVMGADARSRPGALRGGLGGALSQGAEGAIQWLPTLLRGRPRQRRDLLRQPRSRRPGELWLVIVDASASTRRYGALAQAKGVLATLFEEAYRQRIRLAVLHATGQQAQWLWQGQKASRELQDWLRQLGAGGGTPLLDALHQAAGWLARRQRQKPAEHQRLLVLTDGRLRDWPALPEAACPSLLVDLESGPLRLGKAERLARELGAEYRHISELNEV

SEQ ID NO: 18575 - protein, 138 aa, Pseudomonas aeruginosa
RGLRAPPRAGDPGADQGGGGGRLCAGDHGHGAGAGDAQGSATGRAGHRRHRPGGDQRGLRQPIHRLHPRTGAGHGQDQPGWRRPGHRSSAGRHRRADHRQGRCVAAAHRRALCHRHPVHRRRPGRGDPAGSGGVIARR

SEQ ID NO: 18576 - protein, 547 aa, Pseudomonas aeruginosa
SRLLDEVVTPAFDLAGALLHLQRPRLYFLAGGGDLVVDHLGRQRQPTGHEGHGVAVDLQGVLVDVGDAVALAVVALVVGLAGGAAVLLRLLFGLQALGAGEQAAEGDAAVEELGVVGAEVDLGAFRLLAAQAEVGFEQALDGGRAGRTLEAEVGTVAVIDEVAEVRRADHVEVQVGLDLLLLFRGEVLHVVGRAHQAGFLGAPPGEAHLVDRQRLGQQHGHLQLGGAARTVVVDTGAFEHRVEVRADHHHVVRVAATGLGDHVVGLGLLAYHVDHQVQLQVRGLRPGHAVVVGGEDHRDAALVGLAHGDVLQALAVVGVALVEDDHPGGAGGRGVLGLLLEVAGAALDQRDRAGREVGEVFRLATAGGGVAGAEGQVHRDHLGGDVACLGLRQVGEVLLPFVGDRLRHGGAQATRAFRVVGGEREGLHADLVAGFLQGLLHVVDGGLVARRGGGAVAVVETGDVLQLLQALDHVAGLQAARQAKRGADQQRRFADRRVGFAGRPELGELLRFRRCRQGCGGNREGEGAECVSEIVLVAHETPFLVRR

SEQ ID NO: 18577 - protein, 489 aa, Pseudomonas aeruginosa
RREPRCRRQHGLRPATCADHVWRYRRGPPDPRPGRRPRARRHRPADCRFAVRRRPGDPVANPRRSVLRLSVAVGPGGVLRWRGDHGGDHRQRWQRRHSRSARRGDGGLADRVADHADLLAHHQILPAAGDRHRHHHHRPDPDAGRRALGDGRQQPRAGLRQHGQHRPGGDHPGHRAAAEQARQRLDLAPVDPPGDGHRHRHRGVPRHGRLLQGHRRPAGGVSHAVPLRHADLPGRRDHLDVHRDHGDPGGNLGGHPRGRRDHRHQGRLAAPGQRPARGHVLQHAGADLRLLHPERLRPERRSGGGDRDQEPLRGRHRWVVPGDPRPAAGDGPGDRRGAHRRARRRRHRVVRHGRRQRHPHPVEGGLPQQHEPDHRRHFDRLRYDPDRRADLLRSLPQLVRHHLPFRHQFLGDHGDPAQPGVQPLHRRQLRPAVGVRRRQRADPALPGHRRPARRRLFPRRQAVRRPGQRSAAGRRRQPWRAAATAQRNR

SEQ ID NO: 18578 - protein, 588 aa, Pseudomonas aeruginosa
GFRQAVVGGEETEVPDQRLALGGEGREAVDPRVRDRRFHVHQAGDVGLVLHHHRVGVPDTDVVGHQVERAIRAELPGQLVQVDGDLFAAIAGLRRLGLAEAGQVRRDHGEALGQFRHQLVPFVPGLAETVHQHHQRPLAAFHVVQLHAVDFPVGAFEAIRDGEFLGGEAAQGEGQGDAGQEAAAESIEDHGCASLVGSVRDLAAEGRLGGSLAWRQHQQQGHGHRRQADQRADLAERRQAAAVDHPAAGEGADADPGVAGGDVQRGGERRGPRRGLHHPHLADDEQCCLGHAPDRQGGGEQPGVAEGRHQGEHAQRHQQDEQQGCAQRAAIHQAPAEPVAEQAYRAEAHQRPADQRTAEAGQALEDVGQVGVGGEHAGEDQQRQQQVAEHQRLAQHARLAAQRDTRPSGNARQPGGQQQRLGQGQRGECGECQAPTPGVGDQRADGNAKHGGGDDAEEHQRHGAPFARGAGQVRGGFAGHGPKHRERQGRDEARHGHRPDIAGHGGQRIGRGEQQQAGDEQPLAFDARQRGGEERTEGGDAEGEQADQQAGLGDADLEVCGKCREQADDDELGGQDGEAGGGQQEDRQ

SEQ ID NO: 18579 - protein, 170 aa, Pseudomonas aeruginosa
WWNSQWAWLPGGQGKSLRRIARSMPRPKANGPPPATSWIDSRGCSCMNPAIRGISQRISKVGSQDSTSAVGPASARRVSPVRSIRSRAGPVPASRRLPASLRKTRWLRRSKSAQPSSSSRVRTARLMAPWVRHRASAAREKFSRRAAASKQRRAFSEGRRRRLNGEFSSP

SEQ ID NO: 18580 - protein, 524 aa, Pseudomonas aeruginosa
NAPFMPSPVEGWSQDRGTHGSCMKKGATLFAVLWAVLGLGLLVGLPVAIHFILGQYDEAGFSGPQLVFEEQGHSYLAFTLDDYRANEVDNGVVHGSSRSYAQVVDLEDGSLRWSMRLDADNERGDDWGSGELLGQSSRYLFFLRNELYVLDRRDAAPALAFDELERRTGGLPLKWAPWGKDAYRYDEGRGGLLMLALDGRVWFLDGDSLALREAPEVDAARYFHGDPPPPANAGIDWQAPGLTRLPDGRLLILASDHEARALERGEALPAANQRARRQRLSLGTLDWRSPAENRLRPLLDAAFLQDGLLPDPAAAEEPQRLLDRPSERQRQHPSLPPEPQPPEEFDERVERFPSTRAFLAARDAYRQERRRWIAAHDAWRERVADLEAAADAEYRRRRDEQTREEALYRRYASALPGGDSRLARRPWRVDGNWLVLHRRSLAERSELLLSSVSGDGSLLWTLELPIERPERLFRLDAHNLLLSGRGEEGGRLVRVDLRRGSGIVHRLGRGGAPLQRVEWPEGQP

SEQ ID NO: 18581 - protein, 487 aa, Pseudomonas aeruginosa
SPAPGLGGCPAGGPGADSGVPEDEYAAVHQARQADAQQQGAVGCEEARHLRQRNCQAFAVAGAHRGIADRLARRIERRLGRHAERQGVHGETGEQVVEGLDRQVQRAVGGVVLVGMDVGDDLLVEALFETPVAVQLAEELDEVVAHLLVEVVADVADQVQVARRAALDAGVELIDAALPGEACAAAPVIGVLDLQRGADQLQGMRVLRSAVLQRHAGVVLAVDDGEGDLAARFFQAPAGPGALADIQFEAQAAGVEVRRGDPHRAVAAGFVGDGFDAAVAGIAHQHRGEQAAGAVPGLGAEQVALGELPGVRRAQLQSLQHLGAGLPDEAVPAFQYATDEGASLVRQRRAEVGRGEHQEALDRRAGGVEVAGQPVAQHQGAGAVHHHVNRARCPRQSLGGPGAIQGGGEVGVGDVVLQGDPVGEANLRRRAAEPGFHLLGEAAERLRIVAPAVDDDDRTGHVRHPLGLIRATIDHAPRRRALTCENV

SEQ ID NO: 18582 - protein, 76 aa, Pseudomonas aeruginosa
DAAVAPDCRRRGIASALLRQARDDCRGDRLFTSCNRSNLPMRRLLERKGFQPSGVIDNLDEGDPELVFVRFLAPSR

SEQ ID NO: 18583 - protein, 273 aa, Pseudomonas aeruginosa
APGSFQVAGEELAQAFAARRAEHLVRRPLLFDHALVEEDHMAGNLAGEGHLVGDQDHGATFLGQLLHDFQHFADQFRIERRGRFVEQHHLRLHGQGAGDRHALLLAAGEFAGILPFDLLRQADLGQVVARVGHGVVAVHSQDVDRALDHVLQHRQVAPQVEMLEDHRQPAADPLQLPGIGGAQLAQGAGTGAQFLVADADAPGTGLFQEVDAAQEGALARAGGADDADHVSLPGPERNAPEHLMAAVALVDVFDLQAVHARVSGRGQWVCGLR

SEQ ID NO: 18584 - protein, 280 aa, Pseudomonas aeruginosa
RTMGSRDWIDLARDAETGIETLRAHFEGHAYDPHWHDSYLIGYTEIGVQQFNCRRRRHDSTAGQVFLVEPGEIHDGRAPIAGGFTYSMLYLQPDWLRRELRATFDDAPSDRDPGFHANLTEDPRLTLAIAQAFRVLHGRELRLLRQTALELVLERLRVHLGWREAKPFDPRLPLVAQKARDYLHAHFYQDIGLDELASACGTDRFRLNRAFKAAYGLPPYAYLVQLRLAKARQMLAVGGQPADLASALGFADQSHLGRWFRRAYGMTPAAYRRQCTQLPD

SEQ ID NO: 18585 - protein, 333 aa, Pseudomonas aeruginosa
LPDKPVGWYAGPGLAMVGRSVAMARSPSARRARNLHVDTRHHCLLRPGHLHLQLRGARPVQPRLRHRRPGARLRPGRRAHQPCQRRTPDRPCSPARPAGGMAAGDPRARRPPVGGHLPAARTGRVPGHRRANHPGAGEILRPVQPRRGVPGGRPPVRAPVRGRRVVPHRRPGMPRAAYPGAYPGVHDLPGRRQRLRRRYPVHARLRHRPLRFPRRRRAPTVSLDPAPVRATRRDPPVHVPRLHGSRPRRAPLRNQRRRAAPAQRARPRRRRRGGVRRHAPAARCHPRHANPDAAGDPGQHARRQPAAGGRQRGALPEDPAGSVLISCGDAAGE

SEQ ID NO: 18586 - protein, 180 aa, Pseudomonas aeruginosa
DRRSRWRRSPRPARRSAASSRRRPTGVRDGRPGRGSRRSVRRPSARSAHGPARAVPAGRRPRTAPAARSTTSAPGRGRRASRTAQRRRRGGRRGTAAGWPAPGARTTPRPPPATAGRCPGGRRDWPRRAPAACCRGRRGRPPAAGSAGRSPRRCRAPPTPRRGSRRRWRRAGADRPADCA

SEQ ID NO: 18587 - protein, 746 aa, Pseudomonas aeruginosa
RDDMATRRSGGSAETIAAAPASETEVGGDVERAWLAHDPLLAVVVVSQGVLAVEQVVQLKAEGQVRPYPPAQVGVDHRVAGQAGLVGGVGVAPVDVAQPGADAQGLGEGLVQPEVGGAPWHVPGAIAVARVGLPVDRFVEVVVFGTHQRGVRRQPPVLGQVQFQAGLQAVRTLLADLLRVVRRQRVGAEQLLLDDMVGGQGPFAATVREQLLEADLGLLRVGQVHLLLGRVEGDQVAHTVLAGGVLAVQRQFRGQREDHPGAPVAALQAAVAAGAGEQVVAVDMVLVAAHPGHQRQALVELQAVLGEQGEGAGLAARVRPVGRAAFEVAGRGMPGVDVVAADIGIGRYVVGQAEADAVVLGADQGAAVEAEQGVLEGEGLAVADLLLLVADAQVVPAQQLFARDVPFVGFGVAPVAAGLDVVQLVARGDAVGKAPVAGQAGPLVVVALHVVAHVVVLLAQALVVLAADQRGAEVVHRLLVAIVVGEGEGQIVAGLPAQRRADAQVARVATVDPAVALLLVQVEPVAEAVGQRAAAVQGQLAVVVGAVAEAQVVADLAGERLLRHHVDHRAGGAFAVQHRGRAADHVDALDHPRIAGEVHRAHAGVQARAVEQLHHRCVAAEAARREAGTAISWGADEADAGAAGDGGLDAGVVASANFLAADAAGARRGVQGAEAQARTGTDRSGEVDVVEFGGILANADQLAGQGEGGFLGFGEGGRYQQQAGGEAEGERLGAQTAEAGHGRSIS

SEQ ID NO: 18588 - protein, 197 aa, Pseudomonas aeruginosa
LMPGWSIRVNPVSLIFLAFAMSTDAFAAAIGKGSSLDRPRLSEALRTGIIFGVIEAITPLVGWLLGQAASQFVADWDHWIAFVLLVLLGLHMIHNGLRADHATEQEKPGQHSFWILAVTALATSIDALAVGVGLAFVDVNIFLAAGAIGLATMTMVTLGTMLGRALGAVTGKRAEMVGGVVLILVGATILYEHLSAA

SEQ ID NO: 18589 - protein, 400 aa, Pseudomonas aeruginosa
AAPEMEAGQVAASGWAFASGAFPIADRRQQRLAVGELAVRRRQRRTRQDQHRQAHFPRHLELRLGGLATAVLAHQHVAGEALEQRPFAIQAERPARADHLGARRGRLALQAAHGPVLVRRDLAEMLQRFAAEGEQRTAEGCEGGDQLAPVGYLAPVVAGPGLPAGPAQRPAGHSGQSRGAHGVPADPCGVGVGGVHQQVEALLVDERRQPFGAAVAADPDPAGQVAGHLAQPGEAVEMRRTEPAGEGQGLTDPAEQQQALHRRSSQAWPTRLPWRSMAKTSSATSVGTMPRAKRRAWAQTASPRATPSACAWASACWLVLAARMLSCSAVLAPSAAAQPANCGRSMLEWRLCRSRWPPASLLILPKPPHRLSFSTGALRRCLSTAPAKSPISIRAISGSA

SEQ ID NO: 18590 - protein, 352 aa, Pseudomonas aeruginosa
SPRELVQLLPEAGRPRGVLPAVQIRRHPGNQQRLSAHPCPRTAGVGRHDGRFGRPGRDAPAPDTERIACRHLMSASSRFPPEVTAWMERWRLLRDGELLTTHSSWILPVRQGDMPAMLKVARIPDEEAGYRLLTWWDGQGAARVFASAAGALLMERASGAGDLAQIAWSGQDDEACRILCDTAARLHAPRSGPPPDLHPLQEWFQPLFRLAAEHAALAPAARVARPLLAAPREVCPLHGDLHHENVLDFGDRGWLAIDPHGLLGERTFDYANIFTNPDLSDPGRPLAILPGRLEARLSIVVATTGFEPERLLRWIIAWTGLSAAWFIGDGDGDGEGAAIDLAINAMACRLLD

SEQ ID NO: 18591 - protein, 149 aa, Pseudomonas aeruginosa
FKDNRGYMGMSVSLVTVEQAAEHLHLHPKTVLRYIRDGRLSATRVGKSYRIARTGLDAFSGVASAQSESAAGIRATCIVDIPDVSVGTAERLATFLQSAAMASPANTPPLHLQTAFDPLAKSMKVVVIASPSNAAELLEMLQVKMSSLL

SEQ ID NO: 18592 - protein, 179 aa, Pseudomonas aeruginosa
HSGRHRQAPRRLPRPASPPVSAARRPGTRPDLCTKALRQGRRPGGADAVELAGVRRHQQRADFLAEQGLAERRGQRAIPARNLLGTLRNRELTQAAKDIASETGLQHRPVADGQRVAGIYRRSVMLASGRYAMLDDGMGFSLVPWKPVIEQRLGQQLAATIHKGSASWELGIRRGISIG

SEQ ID NO: 18593 - protein, 445 aa, Pseudomonas aeruginosa
ASAACRSAASRARISARTRPPSNRRQEISGRMEKRELDASNQSPVLSAWNPPPTPMESLGNSSAVATPMSAELAARRRSAASTSGRRRSISARSPTGSARSVLGVKGPSSSASSRSRRSAQQNAQAEYRGALTRLDIRDERVDCCPLGVRRLHVGGRRVAQRMPQAHQFQGLLQRIQCGLLCVQLVAGADGGEPGARDLGHDAHAYALRLGFGRLQAGAGAFQRAPLGPEQVGLPGRVEARVVDGLRGVKAGDRAYGQGSVLALTAPVDARASGGGGQCLAGHTIAQGACLIDACRSLAQIQVLCQRRGHQAIEDGIVQCRPPLAQVCGLGFACQRQAPAAADVDRWRLAVVRAHACAGSQQHAGQGQRERTRAPRGQAGDGCAKKGSAGLGFHCRRPRTNTVAMVSVARAMTASGHRLARMSLGGMALRKLPSTMMRKWVSGMA

SEQ ID NO: 18594 - protein, 145 aa, Pseudomonas aeruginosa
ASHCRTTGMFSTGVAKPDISTAGTPMANAPRMACCCVMLTAEIIRPMPTTDRMNSTRLASRSANEPVNGMPNRKTPALIMNRPSAVPIASAGSDLEMMISGVEVGDTSNWSKVPSSRSRAIDSEVMSSALNSARMPVRPGTMNQR

SEQ ID NO: 18595 - protein, 183 aa, Pseudomonas aeruginosa
GNQQTLTQRRHHEHGRQEQQGQQGAAHRDAEHEHRQRRRTQRGQHAEYEVRQQLADQNFGHRGWRGQHCLHGAALPFARHHQCSQHGADDGHDDGDGAGNQCAAAFQLGVEPVARLQHDGLRGRRDIQPGAPELDHAAGVVLDVVGGIGVGAIGDDLHQRLAATLGQPLLEILRNHHVAAQVA

SEQ ID NO: 18596 - protein, 135 aa, Pseudomonas aeruginosa
MKASSMVGSGRSELAAIRLSASGVSSAIRRARESMATRSQYSASSMKCVVTMMVTPLRAKPLMWVQNSRRVIGSTPEVGSSRNSTGGRCMSEQASARRCLCPSGRESGVADNQSPRSKVAIISSIRSRRTLPSSP

SEQ ID NO: 18597 - protein, 192 aa, Pseudomonas aeruginosa
PTTCASPAVGFSRPHSILKVVDLPAPLGPSRPKISPFCTSKLTWSVAVNSPKRFVRLRQDTATSEPSSTGDRRSARVDVPPGPPPSKSIKASSKRAGTGASCTWARSASAWICSVGAPSRSTTRTPAPWITPSLTLGRSSASVRTARRSAPTFSRRKLRPSSCAVNSCGGPSNKSCPWFSNSTLSQRSASSR

SEQ ID NO: 18598 - protein, 279 aa, Pseudomonas aeruginosa
IAFDAHHSTGRDAPQVRLAHVGAHVNRLVQAQAVDRALAYNHAAGLAHPCDDGATTGRRQFGVRQGCRGLRCGGLCGRKASFCRGDVFLAKTFGCLRQGRLGRFDASGCLVARCAGCIDRALAGGARCQQPTLALEITLGLGGERLGLPEGFARLGDFLRSQAAAQLGQFRLRHLHLGLCCCKGFPIGLRIERRQARAGADGIALIESHLHHAPGLTEGQLNLADVDVAVEAQCILLSMVARQPERQCAAKSEHDDGDHDPTGFSGKEVWSFHRWVSAG

SEQ ID NO: 18599 - protein, 314 aa, Pseudomonas aeruginosa
VELRHLRCFVAVAEELHFARAAERLHIEQSPLSRAIKELEEELGVMLFARTTRSTRLTHAGTLFLEHVRRVFAALEQARESVKAAANGFHGQLRVALSDGITPSRLPALLALCRQEEPEVEIRFFEVSLSQQIKGLHDDLYDVGFAQSDEVGDGIVTLPAWSDALMVAVPARHPLLAYKRIPLDELLRYPLVLCDPQVCEGHAKHVERVLRRADMEPLIAERVATCDLMMALVSAGFALGLAGAAHIAASREPGVVARPLASRVPPLTTYLLRLDGNPSDELARFVERVQTIELPETPRAIRGRNPDPPEELMP

SEQ ID NO: 18600 - protein, 174 aa, Pseudomonas aeruginosa
SSHAAHGPAGFPRPQRRNRAMSHYRLNLFIQPEHAKRLDELAAKKGVSKSSIVAAALASWLSPDAADQREAAIAKRLDRLSRQSERLERDQNIQIETLALFIRYYLTVSTPVPEAHQEAARAQGKARFEQFVEQLGRHLLRGRSLVRDVVEELHPDPMRMEDAAAAAQARERAS

SEQ ID NO: 18601 - protein, 824 aa, Pseudomonas aeruginosa
GEDAAMLNLAEYRQRPALLADWLPWAGLVAPGVILNKDGSFQRTARFRGPDLDSATQGELIATSARLNNALRRMGSGWALFIEAERRPAADYPQSEFPEPLSWLVDEERRATFEESGNDFESGYHLTLVYLPPEESRARAAGMLYENRPTDGVDWRERLQAFVAETDRVFDLLDGVMPEIAWLDDGQTLTYLHATISTRRYRVGVPEVAFHIDALLTDSALVGGLAPMLGDQHLRMVSVRGFPTSTWPGILDDLNRLGFAYRWSTRFLCLDKAEAERELGRLRRQWFAKRKNVIALLRETIFQQESPLVDTDASNKAADADAALQELGSDQVAFGYLTATVMVLDADAAVADEKLRMVERVIQGRGFITIPETLNAVDAWLSSIPGNAYANVRQPIVSTLNLAHMMPVSAVWAGPEKNDHLDGPPLIVTRTDGATPFRLVTHIGDVGHTLVAGPTGMGKSVLLATLAMQFRRYRGSRIFAFDMGRSMRATILGLGGEHYDLGTDGEIAFQPLARIDRESYRTWAAEWIEGRLLHEGVAVGPDEKAAIWSALGSLAGAPVEQRTMTGLSVLLQSNALRQALAPYVLGGAHGKLLDADHDRLGMADVQCFEMEELMHSKAAVMAVLHYLFARFDERFDGAPTLLILDEAWLFLDDPVFAARIRQWLKTLRKKNVSVIFATQSLADIKDSSIAPAIIESCASRIFLPNPQATEPQIRTIYEGFGLNRRQIEIVATAQPKRDYYYQSRLGNRLFDLDLGAAALAFAGASTPQDQRDIDRVLLDVGIPGFAGAWLRHRGLDWAADLLPSFPGLAPGSLRTTDHPQESLS

SEQ ID NO: 18602 - protein, 411 aa, Pseudomonas aeruginosa
RVGDCADHQRRARQRHVFQRALDGTPLRQRRRGGLGAVDGRGVHRAPAAAHRRTPAQEPPGHLRQRPVVEPRTGFFRRSQAMNDLFRKSALPVILLALAGCATQGKPPPTISLDEPVQAQPLPERPAPVEVVAVPEVLPMPAQLKPLPEAEDAKPTPEPADETVRVSRANAEARVAPTREGYVNAIQVWPFTDGALYQVYAAVGRVTVVSLQPGEELVTVAAGDTVRWIVGDTSSGSGADLRVNVLVKPIRSGLKTNLVITTSRRTYLLELASTEKTWMASVSWEYPRDRMLALQRQAQAASAAAPVDSGLSLENLRFRYAISGSNPPWKPLRAFDDGQKVYIQFPAGIAQGELPPLFVIGAQGDGQLVNYRFRSPYYIVDRLFGAAELRLGGDKGDVVRIERTDGVARRD

SEQ ID NO: 18603 - protein, 295 aa, Pseudomonas aeruginosa
RPSAWRTSRTSCSACTTRTSRRSAEPSRSSATGSPMKAASSRSRSPGRSPTRRRRPRSTWWSATRCCWSGTASTCRPGANATARYARRCWRRNRRRRRSRRPWKSRRNPGASGRGKRPRAARATEAHRARNEGKYLYMVYVVRKRCLFRAGERLFGLRGLTGLNRPQFSEVVGMDPKRLENIESGRQRMHDEDFEKVCGTFPEFSDWIAYEGSIEPQSIAWKIAEAAQEAAVYLVERNPELLELHGLDVPAWREKHREILKKVRKRELSPPPEKPPKPRRKRKPRSNLPTPTDGT

SEQ ID NO: 18604 - protein, 98 aa, Pseudomonas aeruginosa
STGSGVTFNRVVCGKLSWFIQAGGSMPSLIMDIALSGERLQAIYGGRANRVLLRSRDGRRVNLPAHHLRPFIGHDGVHGTFRLDFSEDGRLLALQRLA

SEQ ID NO: 18605 - protein, 778 aa, Pseudomonas aeruginosa
DFLAFRRRVAQTATRGRSEQRRERSGNRTTAPGAKEVPMRVLPLTRATAREGDMADVYELFLTCPKGLESLLLEEAQGLGLDEARAQVSAVRGQGSLEVAYRLCLWSRLANRVLLVLARFPVENAESMYMAVHAVNWEDHLDAGGTLAVEFSGKGSGIDNTHFGALKVKDAIVDNLRERSGRRPSVDKVNPDVRVHLHLDRGQATLSLDLSGHSLHQRGYRLQQGAAPLKENLAAAVLIRAGWPKIAAEGGALADPMCGVGTFLVEAALMAADIAPNLRRERWGFSNWLGHVPALWRKLHEEAQQRAATGLARPPLWIRGYEADPRLIQPARNNIERAGVADWVKIYQGELATFEPRPDKGQTGLVICNPPYGERLGDEASLLYLYQNLGERLRQSCIGWSAGVFTGAPELGKRMGIRSHKQYAFWNGALACKLLMIQVEPRQFVTGERGERNDEGLARAPSEPARLSEGGQMFANRLQKNLRQLGKWARRDKIECYRLYDADMPEYALAVDIYGDWVHVQEYAAPKSIDPAKAQARLFDALAAIPQTLGVAQERVVVKRRERQAGKKQYERQSSEGKFLEVGEGDVRLLVNLTDYLDTGLFLDHRPMRLRIQKEAAGKRFLNLFCYTATATVHAARGGARSTTSVDLSKTYLDWARRNLSLNGFSDKQRLVHGDVMEWLREDDGQYELIFIDPPTFSNSKRMEGVFDVQRDHVELLDLAMARLAPGGVLYFSNNFRKFELDESVQARYAVEEITGETLDPDFARNPKIHRAWRITVR

SEQ ID NO: 18606 - protein, 205 aa, Pseudomonas aeruginosa
NEDEKRSEPEKRDGHHAKRPSCSLCRKADNDALEFRGVRRHIAEWSELVECAGNPAAPRGACRGSSAAPAASATVCNARLRQWSVNPGDAAMATNRSRRLRKKLCVDEFQELGFELNFHYKEGVDADAVNAFMLRFIDQAIEANELTYGGCDEFGFVCLARRGSVNEEQRALIEAWLKQQPELASVEVGALVDAWYPEQPVLPKL

SEQ ID NO: 18607 - protein, 764 aa, Pseudomonas aeruginosa
TPARWWISSSSPNAIRLSKGRNRMKFQKRSACMLGLLLIFACMAGYAVPARATAGEYSSMLRIPAPDRPGDADVVDEAPLRQAADGLRSPSPSSLVLGLLVACLVCVGCLGWNTVLQLRLRRWQRTEADLSGRLALKQALVDGIPYPVSIRTLDGRLLACNRNYLESLRMTREQARGTLLTDSDWVEGSKARLMHQQCLAVARGGTASFTDMAVRIGGQLLEIHHWVTPYRDRQGRVLGLMNGWIDITERERLARQLREAMRQADEANRAKSVFLATMSHEIRTPMNAVIGILELVLQRLAPEQRERASLEVAYEAAGSLQLLIGDILDVAKIESGHLTLTPERVRLRHVVESVRRMFEGLARQKGLRLVVELDDAPGRDVLIDPLRFKQVLSNLVSNAIKFTERGQVTIRLQERSLDEGRAIVRVDVEDSGIGIAPADQARLFQPFIQVAKGRTVQGGTGLGLAICRKLVDLMGGDVEMHSEPGKGTRVSLDLLLRQCGPKMPESGQDPLAASMEPSRRLHILIADDYPPNRVLLRQQLEFLGHRVAEAEDGQVALELWADERFEVLISDCNMPRLNGYQLARRIRIQERCERRAPILILGYTADAEPDEVQRCRDAGMDDCLFKPLGLETLRNYLATSFGRDAAQPRGLYDAAALSSLGGDRPERLRELLETLLGSNRQDLQRLAILLREGDRTRLAEHAHRIKGAARMIGARTLLEACEALEDACRRSGDGECLQTPGERLRLALEALQEELQEQLAGAAV

SEQ ID NO: 18608 - protein, 468 aa, Pseudomonas aeruginosa
RGYPRGLPLPERQRVADDQAIFVVVVGVVGAHGRVAPLHPEVLQRAALEHVGDVHVAFPFLAFARGGQQVDVVALDVAGHEGQAGNADAGEVVVVARLPGFLVLVGEVADLDEVHQVGVGAVDVGEAGVAAHLLVADAEGVVAEAVGEHGVERLVVDVAGTVVGGARPADVGFQRLLVGDRQGVHQAEVMLLVEVVELAVVVAGAEAVGPLVAAAGEVELVRSQPGTDHDVALAATGDGHVLVVRGVALVDLLQAPGVEGQAVDLHGVQRAALEGLWQQAAVVGHDHRQLGGQGADLQGALRRPQLGGDPCLAIVVLGAAGLAVALEQAGAAAVGAGVELHPEQADGVDAETDGALGVAGFVAQEEALSPFLGLGLAGAFLAEITVEVEVAEFDAGLAVLDELGMGQGWDGNAGTQRGKSHGTGDRGHAHCYCLLERLGQADGGGVTPRRPVTARLLKHYRKTATVRH

SEQ ID NO: 18609 - protein, 504 aa, Pseudomonas aeruginosa
PSASRLPTSNSDSREKNSRCWSGMKVRIARLPKPATCSRTPARSWIASSPVWKGLCSWLMLPPAELQAGHRDVAGQRADAGDPGVQRQVVVQRQAAFGGEGQVGVEGHVGDARLFALGQPAMLGQVPVDQAQHFQASLVGLLAIQRQVKASDQPGAGRAVLHLVGRIAEPVGDAALADGVERIPLGTGMASCQIDENGVGVAQLQLAVFQHRDLSAGIHAEEGLGLVLAVEEIDRPQRRLAADEGEEQADLVGVAGEIQVMQFHLRVPGGYWCLDIRQTGLYISRRAFAFFRRYSSGERRRAVQGGARVAHNGPLRRLSMTSRKREQLLSTAVDLFYREGYHATGIDRILAESGVAKMTLYKHFRSKDELIMAALEVRRQRTAERMLEAEARLQPRAAILAVFDGLQEFLQDEAFRGCAFIHAAAEFHERSHPIHRQAAEQKAFVEAYFQRQLERLGARSAALLARQLQYLMEGALVMAHIHGPADQAREAWQAAESLLQVAGI

SEQ ID NO: 18610 - protein, 94 aa, Pseudomonas aeruginosa
ARVLPSPRNTAQVLSMPPECQLFGTLGCHLCEVAEAVLMPFVEHGLLVELVDIADDEAWVEHYGLRIPVLRRCDNGAELNWPFEAEQVAAFLSC

SEQ ID NO: 18611 - protein, 514 aa, Pseudomonas aeruginosa
RAGRADHRRHRFHRPRQHPGSGGLPAGQAGGRLRRAVPADFAGRHRYLHHPVAGPGRAFQRHPGLLPAGLHQRLPHCLGRHPRRATGRPSSPVQLRPAPETGGALREPRVSGCCEQPGLMPVETALERLLELAAQTPIDTCEQVPLEQAGGRVLAVDLLAGLDLPPWPNSAMDGYALRLADWNGEPLPVSQKIFAGQAPKPLQADTCARIFTGAPLPEGADLVEMQENAEALDDGRVRFTQPLRVGQHVRPRGQEIRQGDLVLPAGTRLRSIELGLAASLGYAALEVRRKPRVALLSTGDELVEAGQPLQAGQIYNSNRPLLKDWLQRLGCDVLDAGILPDDLARTRERLAGLAGVDLILSTGGVSVGEADFLGMALREAGELTLWKLAIKPGKPLTVGQFQGIPVIGLPGNPASTLVTFALLARPYLLRRLGVAQVAPLRVEVPAGFAWTKAGQRREYLRGRLEQGRAVLYPNQSSGVLRSASWAEGLVEVREGRTLVEGEGVAFIPLSELLD

SEQ ID NO: 18612 - protein, 146 aa, Pseudomonas aeruginosa
VAGAGRSSPAAAAVRHRLARPSAPGHVPPGCAAASRRPGAAAAPGSPAVPAAPNRVGRSAPDSRRRSRSLPRGFRPAGRVPARPRPANLPGRRSSARRGPRKPGRARPCGAVPGVSGGGSSRSAGPARRPPRCGWCPCRRPASRRA

SEQ ID NO: 18613 - protein, 542 aa, Pseudomonas aeruginosa
TGCRDKRGERFMRRWNGWGEESTVVELPDSARGFLAELVGQGARLPDASLEAALAKVPASRLEADPRYSIDPRERLLHARGQSLPDWLAMREGDFGVYPDAVAYPETAEQIRELLALADSRDLQLIPYGGGTSVAGHINPQASRRPVLTVSLERMNRLIDLDRESLVATFGPGAAGPQVESQLRALGYTLGHFPQSWELSTLGGWVASRSSGQQSLRYGRIEQLFAGGTLETFAGPLEIATFPASAAGPDLRELVLGSEGRFGIISSVKVRVSPLAEDERFYSVFLPNWQQALQATRELAQARVPLSMLRLSNAVETMTQLALAGHPGQIAWLEKYLALRGAGEGKCMLTFGVTGNRRQNGLSLSQAKALLKRFGGVFTGTLLGRKWAQNRFRFPYLREALWQAGYAVDTLETATDWSNVDGLLQKIEASLRDGLAAEGERVHVFTHLSHVYGEGSSIYTTYVFRPAASYAATLERWKRLKHAASQAIVDNRGTISHQHGVGKDHAPYLPREKGELGVAALRAMAGHFDPAGRLNRGTLLQD

SEQ ID NO: 18614 - protein, 1007 aa, Pseudomonas aeruginosa
PPSGRWRWRCYKPARRCSGARSRTMARRCSAPAKARSSTGSAAASDAAWPVATDATWSASSGWWTPSERTAWVPAKRSGPNWRSPPRRKWCCISMTCCCAAPASACCCPEAARHTCRVSAHSAKRAWAGTTRAGNVSNRPIWTSGAGNTACPSDQPRRERDERQELSAGDRQWHPERARPAVRPAGQPAGQGQGGAGGLLLEASGLGRTGPRVLLGDARRGLSAALGPGGHRSRAHPRGVADHPAWHGDPCRCRGQAVAAGDPLARPAPGGGPRAHQGALGLAVQAGRRRGRGGAFPRPGRGQLGGPGAAGDRREDRQGVAAFRLSQPPPDRPFRRLGGVLRGLPAVRLQAPALGRAARLEMAGTGGTPRAVAGAVQAGRAARRDQRRGQPAHRHSARPAVDRCGGRQGLRGARRRCAGAHHRLPLLWHHGDHQHHSRPLPGNRAADSTLSGGDSRSFQYRGDDLSRLLDGQLVQARVRLARDAAGARAGGRAGATVRRTGQRRAARLDGPDPATLLVAGNPRTGTGGQGGDDRFRRRAYPGAHLPGHPRGPGLCPAPGQGAHREAFGHADRAPARGRRRLAERRGDAAHRRHLRPAGRAPACLRGVRPGCGDRLRGGARPLSGRRQRGGRDDPRRPGFPAPGGGPADLPAALWRGLPAHVSPVAPALPQHSRDYRLPCLNRAPHFRPGYAVNRQRQGHDEGFGSMDKDKVLLVLHGKQAGNEEVRAAVAAQREAGRALAVRVTWEDGDARRIVEEALAAGYATLVAGGGDGTLREVAEALARGRGEASLAILPLGTANDFARAAGIPLEPAAALALLDQTARPIDLGEVNGKLFLNMATGGFGSKVTANTSEDLKKVLGGAAYLLTGLTRFSEVHAAQGRFSAPDFQWEGEFLALGIGNGRQAGGGHVLCPQARVDDGLLDVSILPTPQDMVGTLGTLLGGGNGVESLFVRARVPWLEVEAAEGLDVNLDGEPLEGRKLRFSVSPGALRVHLPAGSPLLREPPRED

SEQ ID NO: 18615 - protein, 278 aa, Pseudomonas aeruginosa
QHLSTKDAGSMFRLSALYRYPIKSSAAESLERVALDALGVVGDRRWMAVDTETGRFFTQRLLPQLGRIQARWAAPEVLRLNAPGMSELSLEVPAADANLRGVTVWRDTLQAPDAGDAAADWLTRFLGRPTRLVHIPEARARQVDTGYAEPGQKVHFADGFPLLLIGQASLDDLSQRVGRPLEMLRFRPNLVVEGSAAFAEDGWKRIRIGSVEFVVAKPCSRCILTTLDPATGERNEDREPLTTLKTYREKDGAVLFGQNLIALGQGSLEVGMPVEILD

SEQ ID NO: 18616 - protein, 981 aa, Pseudomonas aeruginosa
RRAVVVEQAQGLFRVLPRQAAQAETDHVGGGMVALAEAAGLAQLGGVLRHADHQRALVAEGRQALREVRGEAVVARFGGQLEAFPDLFLGELAFALPEAEQGVAGSRLRLADQPQAFAGGVAFGLLAVAQLVLAIQAVEFGEVQLRIVVVDEGLPVAAVGQQAQPAQFQPADLRQVAVFGEEALDLLVAGGLQPVGQFVVGQVGFQRVIAQGAARGHVGRAVALGQGGLGLVVETALFGQGSGVDRVDGGNTEQKAGNESEQATAHDLSGQVMSGNVGRSATAAYGRFDRSRDWRATAVAGRARSRADGLPKLSRCGMAVKAPCHPMPIRRKMRALFPEAPMTLLKFTDVSLAFGTTPLLDKVSWQIGRGERVCVIGRNGTGKSSLFKVVKGEQQADDGEVWRAPALKIGELPQELPRADERTVFDVVAEGLAEVGKLLAEYHHLSLNIHTDDDLARLSRVQQELEARDGWRLQQLVDSTLSRLQLPADKTLAELSGGWRRRVLLAQALVAEPDLLLLDEPTNHLDIGAIAWLEEALLGFNGAVLFITHDRAFLQSLATRILELDRGHLIDWNGDYASFLVHKEQQLAAEEAANALFDKRLAQEEVWIRQGIKARRTRNEGRVRALKEMRRERAERRERQGKASFQLESADKSGKQVIVVEHVSFAHPGGQPLVRDFSMVLQRGDRIGLLGANGTGKTTLLKLLLGDLQPTSGKIEVGTKLEVAYFDQLRHQLEPEQTVIDNISEGREFITIDGQNRHVLSYLGDFLFSPQRARTPVKALSGGERARLLLAKLFSKPANLLVLDEPTNDLDVETLELLEEVLLGFQGTVLMVSHDRAFLDNVVTSTLVFEGEGKVREFVGGYQDWLRQGGTPRLLGVSESKSGKAELNTALAPAAEPAPAAAAPSEAPAKKKLSYKLQRELEALPGQIDAVEAELAGVQETIAQQDFYLRPQDEQRETLARLDALQQELDALLERWAELED

SEQ ID NO: 18617 - protein, 163 aa, Pseudomonas aeruginosa
APRKRSAEAQAPAERGEIRLSSGAPRARRRARRAARRWQWNRAAAPGRGDRGCRPRSGRKPVPRRGGGFPGAVARRPGGAARCRGPDSVRRRHPGVHGPGRTAAAATSTGPSARPHRRPWPWARPHAPPRAGPGCWWPGPPHASSPGRIRRSGRRRPECVDRA

SEQ ID NO: 18618 - protein, 720 aa, Pseudomonas aeruginosa
RGDQLMIYQGKAITVKPLEGGIVELNFDLKGESVNKFNRLTLSELRAAVDAIKADASVKGVIVTSGKDVFIVGADITEFVDNFQLPDEELMAGNLEANKIFSDFEDLDVPTVAAINGIALGGGLEMCLAADFRVMSATAKVGLPEVKLGIYPGFGGTVRLPRLIGCDNAVEWIASGKENKAEDALKVGAVDAVVAPEQLQAAALDLAKRAVAGELDHKARRQPKLEKLKLNAIEQMMAFETAKGFVAGQAGPNYPAPVEAIKSIQKAANFGRDKALEVEAAGFVKLAKTSVAQSLIGLFLNDQELKKKAKKYDEVAKDVKLAAVLGAGIMGGGIAYQSALKGTPILMKDIREEGIQMGLNEAAKLLGKRVEKGRLTPAKMAEALNGIRPTMSYGDFGNVDIVVEAVVENPKVKQAVLAEVEGAVKEDAIIASNTSTISISLLAQALKRPENFCGMHFFNPVHMMPLVEVIRGEKTGETAIATTVAYAKKMGKSPIVVNDCPGFLVNRVLFPYFGGFAKLLSFGVDFVRIDKVMEKFGWPMGPAYLSDVVGIDTGHHGRDVMAEGFPDRMAVEGKTAVDVMYEANRLGQKNGKGFYAYETDKRGKPKKVTDPQAYEVLKPIVVEQREVTDEDIVNFMMIPLCLETVRCLEDGIVETAAEADMGLIYGIGFPPFRGGALRYIDSIGVAEFVALADKYAELGALYHPTAKLREMAKNGQKFFG

SEQ ID NO: 18619 - protein, 396 aa, Pseudomonas aeruginosa
SESEFMSLNPRDVVIVDFGRTPMGRSKGGMHRNTRAETMSAHLISKLLERNPKVDPAEVEDVIWGCVNQTLEQGWNIARMASLMTQIPHTSAAQTVSRLCGSSMSALHTAAQAIQTGNGDVFVIGGVEHMGHVGMMHGVDPNPHLSLYAAKASGMMGLTAEMLGKMHGISREAQDKFGARSHQLAWKATQEGKFKDEIIPMEGYDENGFLKVFDFDETIRPETTVETLAELKPAFNPKGGTVTAGTSSQITDGASCMIVMSAQRAQDLGIQPMAVIRSMAVAGVDPAIMGYGPVPSTNKALKRAGLTIADIDFVELNEAFAAQALPVLKDLKLLDKMDEKVNLHGGAIALGHPFGCSGARISGTLLNVMKQNGGTLGVSTMCVGLGQGITTVFERI

SEQ ID NO: 18620 - protein, 296 aa, Pseudomonas aeruginosa
RRAPVRPDLAPVRGVPDDPGRIPLDQRERHRRRFRAARQGPHPQVRRLYPGTAAAEQAGRGRRPAGNEGRREPQADQARSEPALHQAAGALLRSEPGQGTGEARYRPPLDLRGDHLHHPGARLRNHPQPPLLCGEDGRHRHRSAQRELRQPDGLRFHRRDGGASRRRGPGRARLEAPARRVLRRFQEEARGGRSQREGDARQPADPDQHSLPRVRPADDDSYRLHRRVPRLLGLQPAAEGTLQGDRQPDSRRRDRRGRRGRVRVAGVAWQASLPDLQYRDGRLPAGRETQAAYLRQ

SEQ ID NO: 18621 - protein, 81 aa, Pseudomonas aeruginosa
RASVMPTSFLEIVEMPDGRIVLRRADDEEALVTLEFSGDAKNFLQGQHVEVAKAMFNVGVQMAGRLAEGEMEHDEGPRVLH

SEQ ID NO: 18622 - protein, 195 aa, Pseudomonas aeruginosa
QDALAVQAGAAQPFMGQARRRSDQGQPAGILFLAELAENRCEQGQAVPRQAAERKFAKGSGFLDGGAGRAVDDIVEQGCAVAGPERFLEQWQLGAGQRVGGLHGISCQRRITPTLKPSMISSCSFRSTSIGANSGFSASSQTLLPSRLKRFTVTSSPIRATTTWPLRASRVTWTASRSPSRMPMSFMLMPRTRNR

SEQ ID NO: 18623 - protein, 168 aa, Pseudomonas aeruginosa
RAVAPAPDRGVACVGAGAQQPWGLRLHPRAAPGNGGGNRPVGAGRQRYRRHDRHARGGTGPRAGPALRLPGAGGQSRGGQVGGDHHHGRNRTGVARWHRQGARGAGAGPGRLGGHRNEKKAAIAAFFAIAQEVRRRSRLRRGARPPVPAVLPFPWDWGRRDGRRPAPP

SEQ ID NO: 18624 - protein, 147 aa, Pseudomonas aeruginosa
YTWPPRSSSRSSASLITAFCCSMTKVRTDRRRAGGVAMMDRSRMPETAMFRVRGIGVAVRVRMSTSLRRALSCSFWRTPKRCSSSITTNPRLANFTSSWSSLWVPMRMSILPSASSRAAFSTSLALLKRLITSTLTGQSAKRSRKLL

SEQ ID NO: 18625 - protein, 75 aa, Pseudomonas aeruginosa
CCWASRVVGTSTATCLPLCTATNAARIATSVLPKPTSPQTRRSMGLGASISATTASMALCWSGVSSNGKPAEKVA

SEQ ID NO: 18626 - protein, 191 aa, Pseudomonas aeruginosa
RPTPWSMCTTGAPSRSSVRFLITASPPSRVFSRRRRCMTRWPNSGLSATRARAGWSSSRPSSSGAMLIARRAWLARKAGQPSTSSGRSFSRASSSSRTSRRPADSAQNSTRPGNSSMNRRSAASGSAVLASIARFGSGRAGKRSRPTPGSTSSWLATTRGQFFSRAKQSSTGRNTSAGGSNGRSGSTRRSS

SEQ ID NO: 18627 - protein, 611 aa, Pseudomonas aeruginosa
GRVSQSGKCNTGRSGAKNRSSCSRRSAFWLSAVSSRVKRLAELAASATARLSAAPGRLPQCCLPALAGRLGRRSTDTGKLGSGREFDPPDCNFPDCWMSVFRLLQIAEPGRRGHNVAPFFIPYMWKVLPVTQKPDQCLGEWIDREAIAEAMIPLIGQLYRNNNVVTSIHGRGLINRSVIAIMKAHRFARHRMADDAELSVHETFPILKAMSELKLGAASVDLGKMVAKFKAEGNGRSIEDFVKAELAEVVGKQNGDAREGTDVVLYGFGRIGRLLARILIEKTGGGDGLRLRAIVVRKGAENDLVKRASLLRRDSVHGPFDGTITIDEENNTLTANGNLIQVIYSNDPASIDYTQYGIKNALLVDNTGKWRDAEGLGQHLKCPGIDRVVLTAPGKGALKNIVHGINHTDIGADDKIISAASCTTNAIVPVLKAVNDQYGIVNGHVETVHSYTNDQNLIDNFHKGSRRGRSAPLNMVITETGAATAAAKALPVLKGKLTGNAIRVPTPNVSMAILNLNLEKATTREEINEYLRQMAMHSDLQKQIDFVSSQEVVSTDFVGSRHAGVVDAEATICNDNRVVLYVWYDNEFGYSCQVVRVMEDMAGVNPPAFPR

SEQ ID NO: 18628 - protein, 108 aa, Pseudomonas aeruginosa
STISSFRPTSSGGWRAMANQESTTRTLLVALVVCLVSSVFVTGAAVALKPTQAENRLLDKQRSILAIAGLGEPGMSGKEVKALFDSRITAKVVDLQSGTFSDAQDPLG

SEQ ID NO: 18629 - protein, 168 aa, Pseudomonas aeruginosa
DPLKAAKDPALSDALPAAEDIASIKRRERYTTVYLVETDGKLDTLILPVRGYGLWSTLYGFLALKGDLNTVAGFGFYQHGETPGLGGEVDNPKWKALWVGKTLYDAQGDLAVQIIKGSVDPQSAKATHQVDGLAGATLTSKGVDNLLHFWLGKDGFDAFLANLRKGEA

SEQ ID NO: 18630 - protein, 237 aa, Pseudomonas aeruginosa
SSGPCGPGRKTRSRPRPTRWPRRYPARRLTDGALHQPVREGRVRREHGAGVLPRHVYLHRHLEEGGDRHRPGYRGDRGADHHRAGQQPDLHLPAQGRRAGLGRAARGGPEFPRPAQLHRGDRRHRADPRDAPRQVRTQPLQRAGRVPAADHGELRDHGRLAVHGRARLQPCREHGVRRRLGLFLGAGDRRAGGYPREAQVQRRPRGPAGPGDHLHHHRPDVVGLHVVLRRAVVRRGP

SEQ ID NO: 18631 - protein, 141 aa, Pseudomonas aeruginosa
SAPTRWPTTRKRRAWSSSTSASPRRRRAATCRRGRCRPGCSTSSRATRSPCTGRSASSSPRTPRPRWSSSAAAPAWRRCVRTSSTSCAGSSRTARSASGTARARCARPSIPRSTTSCRRRIPTSSGTWRCPTRSRRTTGPA

SEQ ID NO: 18632 - protein, 361 aa, Pseudomonas aeruginosa
SRCSPTWAWSARISCWTISVAERFRPLAMAGLAALALVLAGCGDTLESFGGPTMGSTYSIKYVRGASAPDVQTAKAAVEAILAEVDRQMSTYRDDSLVSRFNALPAQSCMELPPPMLELLRYGGELSEQSQGAFDMTVEPLMNLWGFGPQARVEKVPSAEQIAAVRRDVGHRHLRIDGQRLCKDAAVQLDFDSIAAGYTVDAVGERLKELGVRSYLAEITGELKAEGRKPDGTPWRIAIEAPREGQRVAQQVLALDGYGVSTSGDYRNYFEENGQRYSHTFDPRTGAPIDHHLASVTVIDPSTRNADGLSTLLMVLGPEEGYRFAEKHRLAALFVSRQGNGFDSRTTPRYEQLFGNQGERP

SEQ ID NO: 18633 - protein, 467 aa, Pseudomonas aeruginosa
GVRMAVYNYDVVILGTGPAGEGAAMNASKYGRKLAVVDSRRVVGGNCTHLGTIPSKALRHSVKQIIEFNTNPMFRQIGEPRWFSFPDVLKSADRVISKQVASRTGYYARNRIDMFTGTASFVDERTVEVVTPSGAVERLVADQFVIATGSRPYRPSDINFNHPRVYDSDTILSLSHTPRRLIIYGAGVIGCEYASIFSGLGVLVDLIDTRDQLLSFLDDEISDALSYHLRNNNVLIRHNEEYERVEGLDNGVILHLKSGKKIKADALLWCNGRTGNTDKLGLENVGIKVNSRGQIEVDENYRTSVSNIFAAGDVIGWPSLASAAYDQGRSAAGNIVESDSWRFVNDVPTGIYTIPEISSIGKNESELTAAKIPYEVGKAFFKGMARAQISNEPVGMLKILFHRETLEILGVHCFGDQASEIVHIGQAIMNQPGELNTLKYFVNTTFNYPTMAEAYRVAAFDGLNRLF

SEQ ID NO: 18634 - protein, 165 aa, Pseudomonas aeruginosa
LLRPRLDAQPRQPVPGHPHGKDHDRPVAAADRRGRRVQHHFHPGDGGHRQEVGHRHPSYPRRHAGADHGYLHGPGYGDRGDRHAGRRGPRGGRGTQRQRLDFRPGKAAGPPVPRVRRVLHRLPAVATDARRCRAGLRRGPGPQLLRHFVSSLACGAHPACGGFAL

SEQ ID NO: 18635 - protein, 113 aa, Pseudomonas aeruginosa
SAARRSRKPASGRPSCWSGSGWGIACSHKPAELSGGERQRVAIARAMVNRPQLVLLDEPTGNLDQHTAQGIQELMLELSRSLQTSFLVVTHDLQLAGHMDRILRLEEGRLIAA

SEQ ID NO: 18636 - protein, 437 aa, Pseudomonas aeruginosa
RGDGVPAVRSRPANPPSTRCIRDMFRPLPFFIGLRYTRAKRRNHYISFISLTSMIGLALGVLAMIIVLSVMNGFQKEMRTRILGMVPHATISAAQPLDDWQTVANAALRHREVVGAAPFAELQGMLSYKGNMLPVLVNGIDPQEERKVSIVGEHIVQGSLDDLKPGEFGIVLGEITARRFHVNVGDKLTLIVPEATSAPGGITPRMQRFTIVALFKVGAELDNSLALIDIADAGQLLRLQPGQVPSVRLELKDLYQSPQVAAKVVKELGQGFRSSDWTRTQGSLFNAMKMEKTMIGLLLLLIIAVAAFNIIATLIMVVADKRTDIAILRTLGATPRQIMAIFMVQGTVIGVIGTVIGGVLGVFAALNITGMIDRIERLVGHKVFSSDVYFINYLPSDLQVLDVVLICSAALLMSFLATLYPSWRAARTQPAESLRYE

SEQ ID NO: 18637 - protein, 546 aa, Pseudomonas aeruginosa
QDFVAHCMTPCDMSGSGGHATGMGGTVHAPGIASPRRGAAGPALPGGIAVGRLAAGHGRRRTVAAVRPAVLAGVVPARVRLGLRLGASRPGRTPGRRAGWSHPLAGGACGRSAGERRGRHALPAGGGPRCAGRASSRAFAPELARRAAADGRRTLAPGGDPETPPRPGERGGFRLRGLVVGAAGRCCGHGEGGPAPAAGQRPGCLARCLAPAPAGGRRTGARRRPGGAGAGGWLGVERGRVAHVPGHRHRASDGHLRFAYLVAGGDALWPGGGLASPGLLAAAPALAALCLRPGFAWCLELRVDGGFRGPGAARLPDGQPGAGLAPAFPPPGLADPAAGNAGAGLAGRAAGQPAGGVLAVVPGGCPAALAVRRAPWALALVGGLGAGAVGDGAGAGDAAAGAGPAVEPERSAGQPAGGALDRTAGSAPGPGGEPAAVGARAGRGAASRRWRFAGPAVSCAWPAGGPGRGLAATRRSGLERSAGHARRALLAGAGWLAVACPRCRVATAGIVAVIAACRMGAGGSAGAGRRPGAGRAGAYPKACLAL

SEQ ID NO: 18638 - protein, 155 aa, Pseudomonas aeruginosa
SRLRRGRQSVKFRRRRAGAAREDVFINLASLIDVIFVLLLFFVVSTTFTRPEQLNIELPSAESGETAGTEQKQLELSVDAEGHYALNGQALAKSDLATLMAAMQRESAGDNNLPVVISADAKSTHQSVVTAMDAAGKLGFVHLRITTVENTAAKP

SEQ ID NO: 18639 - protein, 117 aa, Pseudomonas aeruginosa
PRRMPLNAGLSQRPTGGTWRSMRCLPQHSSPGSTPDSSISWRADRRPCRHCMKDSAMDPKLLDILACPLTKGPLVLSEDKTELISKQAGLAYPIRDGIPVMLESEARSLNVDERLDK

SEQ ID NO: 18640 - protein, 148 aa, Pseudomonas aeruginosa
LSVVRPCPGLATPSPAIATACRRACPIVATSASTPIAWVSLPISSPGDRAGWRTPKASSNCARSGTGCESMWPMPAKPCFRAWIRRKTSNAFAACWGADARPVRLPGQHLPVAHRRRRVPAQGRGGRAGLPYPCRFRRHRRLACRQGT

SEQ ID NO: 18641 - protein, 411 aa, Pseudomonas aeruginosa
PDPGHGPVQPGRPRDPACRARCRRTGSVPASLRVRAGRSTRSLLWRRRRLRAGPRPDRTCLRPSVDRSQGATVSLELQEHCSLKPYNTFGIDVRARLLAHARDEADVREALALARERGLPLLVIGGGSNLLLTRDVEALVLRMASQGRRIVSDAADSVLVEAEAGEAWDPFVQWSLERGLAGLENLSLIPGTVGAAPMQNIGAYGVELKDVFDSLTALDRQDGTLREFDRQACRFGYRDSLFKQEPDRWLILRVRLRLTRRERLHLDYGPVRQRLEEEGIASPTARDVSRVICAIRREKLPDPAVLGNAGSFFKNPLVDAAQAERLRQAFPDLVGYPQADGRLKLAAGWLIDKGGWKGFRDGPVGVHAQQALVLVNHGGATGAQVRALAERIQEDVRRRFGVELEPEPNLY

SEQ ID NO: 18642 - protein, 252 aa, Pseudomonas aeruginosa
PRAGVRGGCCDDAGRGSGGAGARHRYRPARPAPGSRRSAMPRLPGPRRREPGDPRAAGALRGPGVRRVLHGLRGVGALRGPGVRRALRGGVRCVPRDLRGLRAVGALRGVSARRALHGLRAAGAPREPDARRALRGGVRCALRGSGVRRALRAVDALHAPRAVCALRRGDCHRGHRGGGSAGGRCDARPGGFGARQPACWFQQAWRQVDPCLRTGRPGTSPGPGTGSARASAWPARPVLRCVAVRAAGERRS

SEQ ID NO: 18643 - protein, 78 aa, Pseudomonas aeruginosa
VRRRNRLSEADEKCVWIKLEATQSNSRTSPPYTCSLRIGRRSQYPERVGISRSPKWSRLMFQGFGFESLAGWKFSYFR

SEQ ID NO: 18644 - protein, 389 aa, Pseudomonas aeruginosa
SVIRRSTWKWRDGRGWIRLRWPMAPNRWSSCGLMRRGWKLSISPSCAPGWAVLDVRRFQEWLSMSDEWKSETPKANDDKSWKLLEKAVLAGVQEQRRARRWGIFFKSLTFIYLFVVLLAFSPFGSLEKSASRSGSHTALIEVKGMIADDEPASADNIVTALRAAFKDEGTKGIVLRINSPGGSPVQSGYIYDEIRRLRGEHPNVKVYAVISDLGASGAYYIASAADQIYADKASLVGSIGVTAASFGFVGTMEKLGVERRVYTSGEHKSFLDPFQPQKPEETQFWQQVLDTTHKQFIDSVKKGRGDRLKVEGHPELFSGLVWSGEQALQLGLIDGLGNASYVAREVVKEKKIEDYTVQESPFDRFAKKFGASVAERLALWMGWQGPVLR

SEQ ID NO: 18645 - protein, 362 aa, Pseudomonas aeruginosa
CVRPPSSSPPRSKACSGRRRRLRWCRTSAPPCRLISIRCAATCWHSCTARFAGWRASSCWRKRASPSWSSAGRARSWQASTGAARRASIPMAWMASRRSPPRAPPWPEREKGENPMSLQGKVALVTGASRGIGQAIALELGRLGAVVIGTATSASGAEKIAETLKANGVEGAGLVLDVSSDESVAATLEHIQQHLGQPLIVVNNAGITRDNLLVRMKDDEWFDVVNTNLNSLYRLSKAVLRGMTKARWGRIINIGSVVGAMGNAGQTNYAAAKAGLEGFTRALAREVGSRAITVNAVAPGFIDTDMTRELPEAQREALLGQIPLGRLGQAEEIAKVVGFLASDGAAYVTGATVPVNGGMYMS

SEQ ID NO: 18646 - protein, 81 aa, Pseudomonas aeruginosa
KQGMSTIEERVKKIVAEQLGVKEEEVTNSASFVEDLGADSLDTVELVMALEEEFETEIPDEKAEKITTVQEAIDYIVAHQQ

SEQ ID NO: 18647 - protein, 266 aa, Pseudomonas aeruginosa
PATCWVPPARWRRSSACWPCATRSPRRPSTWTTRTKVAISTWWPMKPSRARSTWPCRTRSVSAGPTAPWCSAGSPTDAGLGRRPARRRAVRARSRTGLWRRAVRDPGGARRHAASPGAPPGAPGRGVSAPGDPSRRRGVAPGVAGVLRGAGRRCRQADRHPRRGFAWLRAACRGLAAANPLRIAASGLSRAPLAARRAPVRLPHAPGRAAPASRPQAPQSPGAGPRPCRVERRRACRRAHAGRARAGSGGRVQQPAAGSRRHPRGA

SEQ ID NO: 18648 - protein, 363 aa, Pseudomonas aeruginosa
TARPTSRRPGFLTLMRKLLVLLESGLLFVGLCVGLAAWQQQRALEQPLQLTEERLLDVSSGSTPGGMLARLEQEKVLHGAFWLRLYWRFNLPGQAMHSGEYRLLPGMKGADLLELWREGEVVQYSLTLVEGWSFRQVREALARQGKLEQTLAGLSDGEIMQRLGKPDEVAEGRFFPDTYRYTRGMRDIDILRKAYQRMQTILAKEWDGRSQDLPYRDAYQALIMASLVEKETGVPEERSQIAGVFVRRLQRGMLLQTDPTVIYGMGERYNGKITRADLREPTPYNTYVVPGMPPTPIALAGREAIRAALHPAEGETLYFVARGDGSHVFSSSLDEHNKAVREYQLKRRSDYRSSPAPITPPPQ

SEQ ID NO: 18649 - protein, 275 aa, Pseudomonas aeruginosa
TAAGAQRRADGRRYRAVADVRRAGPASRRGHPPGAGARGRGALRSLHRCHLCLPGRRARFAGGAHRRAGKLRPGRPAARPHAGLRPAGGNRPGAGGGAWPARPFRAGGPTLLRGRASDLPAARRAGPGALPGARCRVAAGRGAGWPGSAAAESAGASEWLISIPGSRRSGANWAAAPSTPTPICSTVPPGSASVPWPSIGPPNCSASGLPPLAHAASARPASCWPPVPIRTTSCWSRRRRRNRSGSIRSATWLASWCRPRNWAGARSCCSNPPRR

SEQ ID NO: 18650 - protein, 286 aa, Pseudomonas aeruginosa
SRTGRPTRCNARQDHAGRFPLPPRSPRPGRPWRLARCGAGCRASAWRRSIPLHRRQRRQCPGGEGPGRALCRRALFGGRAPAGPGARKRASAGLAAGRTGASAGGGDRRDRPRLPLRTGSRRVATGGVSPAPGSRADHRQASDRAHPRGARRHAGAAARGGVAAGRRAALLHRGLGNGAIGAGPGLLHFPVRHRHLPQCRCPARGGSPGTGRPAVGGDRLALPGADSPSRQAEPAGIRARCRRIPRDVAWRQPGNPGGADYRQFPSAVSVGPLGRRTDKKNPGSGG

SEQ ID NO: 18651 - protein, 374 aa, Pseudomonas aeruginosa
WISACAWATSASAKATLPAPDTCGAETQSLRPAHSLPAGIYSSPIDPPAGRRLPISGESAGGTVPVAAPRSFRSSPMSVREFPIHYIEPVFRPPSEAHSLILPVTNGCSWNKCGFCEMYTQPQKKFRARDENEVLEEIRRCGERLIVKRVFLADGDALVLPTRRLLAVLQAIRQHLPEVERVSSYCLPRNLRRKSVDELRELADAGLRMAYVGAESGDDEVLARVNKGETYSSTLDALEKLGEAGISRSVMILNGLGGMTLSAQHADNSARLMNAAQPEYLSTLVVSFPTGEQRFRAGFADFEALDRRALFVEVERLLQGLELEDTVFRSDHASNYLVLKGELGADKARLLAEVRQAIEQPQHAALRQEWQRGL

SEQ ID NO: 18652 - protein, 148 aa, Pseudomonas aeruginosa
RHRYRAVLGCGQGDHRAYHRLRRRRRRRRFGCRRAGFRPGRCRQVRLRRRRAGQVRPSGTDRCQDRGLRRPRHAERRQLQDPLRPGRQAGCRSRRFPRRGRRRFRAERHAGRPDRQDRRPAAVHRGGHLRCHPAPGGHEGLEGDRRDQ

SEQ ID NO: 18653 - protein, 145 aa, Pseudomonas aeruginosa
GRRFIRRVDRDVDARRGTAKSRRSLRRPAPRRPGSARCGGNSWRRPWAGCRRGCREPVPGRANWPGGSPRPGSRRRSAAAVPRRSSPGGRRPGGSPGSPGAAPGHPGSRLPASSCVRRSGSGSASGTLRAGSARTRTGRRRRRWR

SEQ ID NO: 18654 - protein, 298 aa, Pseudomonas aeruginosa
NRRSWEFSFGEKTCQGDARPIVAAFRPEQIGATATQAFGQGQGGGLGDAGAAGFAQRDGGGAEQARLVVVQDGGCEEMHGAFEQRGQLPQAGFVAFAVDAGEGVQLGQAAPVFAQRSLQQRAQMLGATASAAADAGDQQAGDGQGHARTGGNGRRGTMDPRPARVAGGRRSGVDAAPVAPEQPGSGQAEGGPEQRIADQRGDHETLGQGFRRQAGMDLGLRRAEQVRQRQQDGADQLQRPVAAEHQQGQAHRGGGGGGDPPVLALHQVGRGGTRQLRRQAQRRRQAEHRVAGQAPEQA

SEQ ID NO: 18655 - protein, 401 aa, Pseudomonas aeruginosa
ARRPASSIPWRDARGQDFHTTGRGDPVANPLRGPCVRATRPHARRAEQGLPMKTLAKLPVTIVTGFLGAGKTTLLRHMLDNAEGRRIAVIVNEFGELGIDGEILKQCSIGCSEEEAQGRVFELANGCLCCTVQEEFFPVMRELVARRGDLDQILIETSGLALPKPLVQAFQWPEIRNACTVDAVITVVDSPAVAAGTFAAHPEQVDQQRRQDPNLDHESPLHELFEDQLASADLVILNKADQLDAEALARVRAEIAGELPAAVKIVEASRGELPLPVLLGLNAEAELHIDGRPTHHDHEGHEDHDHDEFDSFHVDLPEVEEAALLEALGELVERHDILRIKGFAAIPGKPMRLLVQGVGKRFDRHFDRKWLADEVRSTRLVVIGQELDQAAIANQLRTALA

SEQ ID NO: 18656 - protein, 578 aa, Pseudomonas aeruginosa
SVIPGRGRRWRFAGPSFLRPTGRTSMHLLRTQPGGFVPDDGIAHLAQTPAELVILCSGDSHLALLAEAARALPDDYPSLRLANPMQLQNHASVDLYVDQLLRHARVILLSLHGGIGYWRYGVEQLVALAERGALLIPVPGDDRPDPELSALGNLPAEQAERFWQYLRQGGLENAGQFYRCLASQCLGRDYAWREPQALPRVALFHPRHAEATLGTLACRLAGRASGGRVAVLSHPPAGSQHRLHRALLRTPRGAGAQPVADRAGQPQGKRLPGAGGRLAGAQRRRADRQYHRFRPVQSGGARVASVPSRRAGIAGDLLAGQPPALAGQPARPGAARPGHARGAAGAGRAHRHPADQFQGPGLAQRTQRERRGLLSRRRRAHGFRRRTGAALGRAGAQAKRGKTGGAGAGQLPDPRWPDRQWRRPGHPGGGAEHPSCPAPAGLSGRRTARQRNRADPPVARRRQQRPGASRPTALRPEPGAGRLPGLLRTPAGAQSPGGAGALGRAATGPDVPRRTDDGRRPALWPDLRRHPAGARLSARSGGGLPRSRPGAAARLPGVLLLAAPRLPRRCPAARRQAR

SEQ ID NO: 18657 - protein, 735 aa, Pseudomonas aeruginosa
PGMAAGQGSRPVRRMLAGRVARSAAEHLSVHRQRSGGGRPGQAPHPGGDHRPPDAAADPRRELRPAARPGAPGRRVLRCLAARPAPRRTVARRDSRPPARQPSRPRDRLAAQRRSGQLAAAAGRLSLRPEGVADPRRPACVRRVAERAIAPGYPAGAAAGSARRWQGRQRRVAEEPGGRPWPGLRSAGLRHGRGLAGRAAGLPGRAGRGALAYSRGYPRTPGIAGVALDRTLPGRRIAACHLACQRRGVARLVRTGGTDPGRLWRGRDRRAAGSPRRALRTGRSERRAESRATRRAAHRTQLLLGGRAQPADPDRLAHRLPVGQPAARASPAGTWRSPAPARSLGVGHGDHAHRRRRHRPGPGPARRATGLAGRQPARRRFRDPPGLPAGPPAGRRDAAGLRVLPRRLRQPDPPVRCGGAGGRRAGRGGGAEPAGRSRTLGAPAPRGAGHGAGGGAPAGRLADLRRQAGCLRRRRAGRNRRAAVGDPRRPCRGLPELGRLRLRCRRRRHAGAGTLRPAPGTPAGGAAQPGQPRARPARFQRLLPVPGRHAGGGGNPARRAGGQLPRRPQPAGQPAHPHAQGRAQPGGAGAGGESEVDRRDEAPRLQGRLRTGGDGGLPVRLRCHQRADRRPPVRAAGRRLPARRGDPRVRPPAQSASLARHGRAPGGGAAARALAGAGGLSRGPGEPAAGRRRGIAERHGRSHRFQRRSASRRAASRRIRSVPSQPRQPSVIETP

SEQ ID NO: 18658 - protein, 143 aa, Pseudomonas aeruginosa
LQSTIIRRGDAWLSQGLAHGLHLLGPVVRTVAAAAQHHMGVRIAAGLDQRRVTVRVEAEMAVAVGRRTDRVAGDADAAVGAVLEAHRQAEAADQLAVDLRFAGARADRRPAQQVVEVAGGQRLQEFGGQRQAEAQHVQHQLPG

SEQ ID NO: 18659 - protein, 137 aa, Pseudomonas aeruginosa
RQAGGHVVAAIQVRVVGEALPAHRGAWLFHVGAHHQEQLAVEFVAQRGEAFGVFEGGAGIVDRTGTDYHQQARVVAVEDGADGVAAGGDLAGQLQRQRLAGLEFERAGQAFQGGTGGGAGQGDGLDVRRKGGQCGYG

SEQ ID NO: 18660 - protein, 422 aa, Pseudomonas aeruginosa
TNTRRNTRHGVPAAHARATTSQGARHWNAGADGGCAAWVSPVNESRAYCKRGGRFNDCFTVRYRRRRPDRLGGPYFRPSAAGIPMSATVHYPLSAVVAADELKLALCLAAVDPAIGGVLIEGPRGMAKSTLARGVAELLPAGEFVTLPLGASEERIVGSLDLDAALGEGRARFSPGVLAKADGGVLYVDEVNLLPDHLVDLLLDVAASGVNLVERDGISHRHPARFVLIGTMNPEEGELRPQLLDRFGLNVRLDTQPPPAERAEIIRRRLAFDADPQAFAERWEGQQDTLRRRCAEARRRLARIPLDDAALDSIARRCFEAAVDGLRADLVWLRAARAHAAWRGGERIEAEDIDAVEHFALLHRRRQSNPPPSAANPPPPPAAAPVALPERTGNGEGQWGELPARPVAMGTARELPRWPKKP

SEQ ID NO: 18661 - protein, 423 aa, Pseudomonas aeruginosa
TKSEGVSASPAAFSVKLYFDCNSINIMRVISSCDPANPSHGDILMSPISVVIAGYARSPFHFARKGALVDIRPDDLAAAVLKGLVEKLDLDPALLEDVVMGCAYPEAEQGMNIARIASFRAGFPQSLGGATLNRFCGSSMSAVHYAAGQVLLGAGEAFIAAGVESMTRVPMGGFNLSPNPALLQDYPAVYMSMGQTAENVAERYAVSRVEQEEMAVRSHAKAVAAREAGLLRQEIVAIDTPAGRVAEDGCIRPGTNLESLAQLKPAFGGSVTAATSSPLTDGSAALLVCSEDFARRHGLAILARIKAVAVAGCAPEIMGMGPVQATRKVLQRAGLGIADIDLVEINEAFASQSIACIRELGLDMDRINLDGGALAIGHPLGATGARITGKAAALLRRTGGRYAIATQCIAGGQGVATLLEAVE

SEQ ID NO: 18662 - protein, 515 aa, Pseudomonas aeruginosa
KREQRTMKTTSSGTPPVPRPEDENLGVGANMAYGLQHVLTMYGGIVAVPLILGQAAGLAPGDIGLLIAASLFAGGLATLLQTLGAPFFGCQLPLVQGVSFAGVATMVAIIGSGGSGGIPAVLGAVMAASLIGLLITPIFSRITKFFPPLVTGIVITTIGLTLMPVAARWAMGGNSHAPDFGSMANIGLAAITLVIVLLLSKLGSASISRLSILLAMVIGTVIAVFLGMADFSKVTEGPLVAFPTPFHFGMPTFQVAAIISMCIVIMVTLVETSADILAVGEIIDTKVDSRRLGNGLRADMFSSMLAPIFGSFTQSAFAQNVGLVAVTGIKSRYVVATGGLFLVILGLLPVMGRVIAAVPTAVLGGAGIVLFGTVAASGIRTLSKVDYRNNMNLIIVATSIGFGMIPIAAPTFYDHFPSWFATIFHSGISSSAIMAILLNLAFNHFTAGNSDQQSVFVAASERTLRYQDIAALHEGDYFLDGKLYDAQGNEVPLAGDDSHGAPPRRRSETAEAGSA

SEQ ID NO: 18663 - protein, 170 aa, Pseudomonas aeruginosa
GIWPPRDGSVAAWRGASISSRATAIAARQTSAPTSPSGARPLPSITQLPARAPMPIPALQAEMFSEAANAGARGADFITRTWPTMNSAAWATPQIARVAASSQALPRVGTRASMPSAISRTNSRVAPSGLRSTRRPPSQLPSRPTAPKPISVQPTSEPLKPARRWRMSAR

SEQ ID NO: 18664 - protein, 242 aa, Pseudomonas aeruginosa
GVNMPVKTSSDSNRWPSTSGWRNTLAWLRSEIPGRPGMRGSQAASSSALARASAASAANARRQPQASAISVPMGMPSTVAATMPKNTSATARPSREGPARCAAVSLAMAQNTGSARAGTKRATAIVQISPATAASALAAANSSRQATNSRLRSTPASAAVRNGPKAATLKANRLTSRPAWATLTWRSAASAGSRPTMTNSVVRMVKPAAASRRIGNSTARLLRERSRGRARERCMGGKGIRP

SEQ ID NO: 18665 - protein, 204 aa, Pseudomonas aeruginosa
SIQIMEVRMATRGRPRAFDRDTALQRAMDVFWVRGYEGASLAALTEAMEIRPPSLYAAFGSKEGLFREALAHYLGQHGRYRRDVLDGAPSAREGVAELLRETVARFCSDEFPRGCLVVLAALTGTPESEAVRDALSAERGESIRLFRERMRRGIADGDLAADTDVEELATFYATVLFGLSVQAKDRVPCERLLAVVERALRAWP

SEQ ID NO: 18666 - protein, 216 aa, Pseudomonas aeruginosa
IVSSILPWSLPGMTELLAFLTITVLAVISPGADFAMVSRNSLLYSRRAGLLTALGIGAGVTVHVGYSILGVGVLVRESLALFTALKLAGAAYLVFLGLRMLLAREDSVAEEAAGGAGVSSWAMLRSGFLTNALNPKTCLFVVSLFMQVIDPHTALPAQLGYGAFIALAHVAWFGLVACFLSSPAVRGRLLRFRRRIDQFFGALLVGFGVLLGAKSP
